United States Patent 9,878,056 (MODIFIED POLYNUCLEOTIDES FOR THE PRODUCTION OF COSMETIC PROTEINS AND PEPTIDES) - sequence listing, part 2

SEQ ID NO: 451 - DNA, 2276 bp, Homo sapiens
ggaaagactgggcggagagaaggagagccggtcagattcccctaactttcctggacttggaacgttcttcgaaataacttttttctcacctaggtgtaccccaattaccgctggttgtgctttttcggcacttcctctcctactgctaatttttccgtcctctttgccgggagcagcggaaagggacgttttccagcgatacaagccctttccccctgccccgcagtttggatagagccttttggcagcggctgtcgcctttatttattctatttatttatttattggttctcaagacgcgagaggatggtagcggagcgcacccacaaagcggcagccaccggtgcccgcggccctggggagttgggcgcgcccgggacggtggctctggtggcggcgcgggcggagcgcggcgcacggctgccgagtccagggtcgtgcgggctgctgacgctggccctctgctcgctggcactcagcctgctcgcccactttcggacggccgagctgcaggcccgggtgctgcgcctggaagcggagcgcggggagcagcaaatggagacggctattttgggacgagtcaatcaactgctggacgagaaatggaagctccactcaaggaggcgccgggaggccccaaagacatctccaggatgtaactgcccaccaggacctcctggtcaaccaggaactagaggtttccctggatttccgggtcccattgggctggacggcaaaccgggccacccaggaccaaagggcgacatgggtctgacgggtcccccaggacagccgggaccccagggacaaaaaggagaaaagggtcagtgtggagagtacccacaccggctgctgcctctcctcaattcagtgcgactggctccacccccggtcataaaaaggcggacgttccagggcgaacagagccaggccagcatccaaggtccaccagggcccccaggcccccctggaccaagtggacctctggggcacccaggactgccagggcctatggggccacctggcttacctgggcctcctggaccaaagggagacccagggatccagggctaccacggccggaagggagaacggggcatgccagggatgccaggcaagcatggagccaagggggcgcccggaattgccgtggctgggatgaagggtgagccagggatcccaggaaccaagggtgagaagggggctgaaggctcccctgggcttcctggcctcctggggcagaagggagagaaaggcgatgctggcaactccattggaggaggcagaggggaacctggccctccagggctccctgggcccccagggccaaagggagaagcaggtgtcgatggccaggttggccccccagggcagccaggagacaagggggagcgtggagcagctggagaacagggaccagatggccccaagggctccaagggagaaccagggaaaggagagatggtggattacaatggaaacatcaatgaggctctccaggagatccggacgctggccttgatggggcctcctggtcttcctgggcaaattggcccacctggagctccagggattccaggccagaagggggagattggactgccaggccctccaggacacgatggggaaaagggacctcgcggtaaaccaggagacatgggccctcctggtccccaaggccccccaggaaaggatggacctccaggagtgaagggagaaaacgggcacccagggagcccaggagagaagggggaaaaaggggagacaggacaagcaggctcaccggttcctgggctgccagggccagaggggcctcccggacctccggggctccaaggtgttcctggaccaaagggggaagcaggactagatggagcaaaaggagagaaaggcttccagggagaaaaaggagaccgtggtcccctgggactacccggagcttcaggtttggacggcaggcctgggccaccgggtactccaggaccaattggagttccaggcccagcgggaccaaagggcgagaggggcagcaaaggagaccctgggatgacaggaccaacgggagcagctgggcttcctggtttacatggaccacccggggacaagggaaaccggggggagagggggaagaaaggctctagagggcctaaaggggataagggagaccaaggagcgcctggattagatgccccctgcccattgggcgaagatggcttaccagtccaaggctgctggaacaagtgatgcctctaaccttggattggcctgtgtgtgtg

SEQ ID NO: 452 - DNA, 6167 bp, Homo sapiens
atcctgggctcccagctggagaggcggaggcagctccagggggctggaagtggaagcgcagcggcagaaggagagggagagagaaagagagagaggctaattaaaaaaggatactccgagggaagagagcaagggcggtgcgccgccaaggaccaactagcggcggagcttcgatcttgcctaggcgcggagagctcccaacctgggctggaaccttgcccagcacaggtggctgctacaccccatgtaaaaagcggaaaataaaatgaagattttccagcgcaagatgcggtactggttgcttccaccttttttggcaattgtttatttctgcaccattgtccaaggtcaagtggctccacccacaaggttaagatataatgtaatatctcatgacagtatacagatttcatggaaggctccaagagggaaatttggtggttacaaacttcttgtgactccaacttcaggtggaaaaactaaccagctgaatctgcagaacactgcaactaaagcaattattcaaggccttatgccagaccagaattacacagttcaaattattgcatacaataaagataaagaaagcaagccagctcaaggccaattcagaattaaagatttagaaaaaagaaaggatccaaagcccagagtcaaagttgtggacagaggaaatgggagtagaccatcttcaccagaagaagtgaaatttgtctgtcaaactccagcaattgctgacattgtaatcctggtcgatggttcatggagtattggaagattcaacttcagactggttcggcatttcttggaaaacctggttacagcattcgatgtgggctcagagaagacacgaattggggtgaaaaacgcggatgtgaatgagctgcaggagatcgcctctgaaccagacagcactcatgtgtacaatgttgccgaattcgatctgatgcacacagttgtggagagtctgaccaggactctctgctctagagtggaagaacaggacagagaaattaaagcctcagcccatgccatcactgggccgcctacggagttgattacttctgaagtcactgccagaagctttatggttaactggactcatgccccaggaaatgtggaaaaatacagagttgtgtattatcctaccaggggtggaaaaccagacgaggtggtggtagatggaactgtatcttccacagtgttgaaaaacttgatgtctttaactgaatatcagatagcagtctttgcaatctatgcccacactgctagtgaaggcctacggggaactgaaactacacttgctttaccgatggcttctgaccttctactgtacgacgtgactgagaacagcatgcgagtcaaatgggatgcagtgcctggggcctcaggttacctgatcctttatgctcctctaacagagggcctggctggggatgaaaaagagatgaaaattggagagacccacacagatattgaattgagtgggttgttgcccaatacagaatacacagtcacagtttatgccatgtttggagaagaggccagtgatcctgttacgggacaagaaacaacattggctttaagtccaccaagaaacctgagaatctccaatgttggctctaacagtgctcgattaacctgggacccaacttcaagacagatcaatggttatcgaattgtatataacaatgcagatgggactgaaatcaatgaggttgaagtcgatcctattactaccttccctctgaagggcttgacacctctcacagagtatactattgctattttctccatctatgatgaaggacagtcagagcctctgactggagtttttaccaccgaggaagttccagcccagcaatacttagaaattgatgaggtgacgacagacagttttagggtgacctggcatcccctctcagctgatgaagggctacacaaattgatgtggattccagtctatggggggaagactgaggaggttgtcctgaaagaagagcaggactcacatgttattgaaggcctggagcccggtacggagtatgaagtttcactattggccgtacttgatgatggaagcgagagtgaggtggtgactgctgtcgggaccacacttgacagtttttggacagaaccagctacaaccatagtgcctaccacatctgtgacttcagttttccagacgggaatcagaaacctagttgtaggtgatgaaactacttctagcctgcgggtaaaatgggacatttctgacagcgatgtgcagcagtttagggtgacctacatgacagctcaaggggaccctgaggaagaagtcataggaacggttatggtgcctggaagccagaacaacctccttctgaagcctctgcttcctgatactgaatacaaagtcacagtgactcccatctacacggatggcgaaggcgtcagcgtctccgctcctggaaaaaccttaccatcctcggggccccagaacttgcgggtgtccgaggaatggtataaccggttgcgcattacgtgggaccccccatcttccccggtgaaaggctatagaattgtctacaaacctgtcagtgttcctggtccaacactggaaacgtttgtgggagctgacattaacaccatccttatcacaaacctcctcagcggaatggactacaatgtgaagatatttgcctcccaggcctcaggcttcagcgacgccctgacaggcatggtgaaaacattgttcttgggtgttaccaatctccaagccaaacatgttgaaatgaccagcttgtgtgcccactggcaggtacatcgccatgccacagcctatagggttgttatagaatccctccaggataggcaaaagcaagaatccactgtgggtggagggacaaccaggcattgcttctatggacttcagcctgattctgaatataaaatcagtgtttatacaaagctccaggagattgaaggacctagtgtgagcataatggaaaaaacacaatcacttcctacacgaccaccaacttttcctccaaccattccaccagcaaaagaagtatgtaaggcggccaaggctgacctggtatttatggtggatggatcctggagcattggagatgaaaatttcaataagatcatcagctttctatacagcactgttggagccctgaacaagattggcacagatggaacccaagttgcaatggttcagttcactgatgatcccagaacagaatttaaactaaatgcttacaaaaccaaagagactcttcttgatgcaattaaacacatttcatacaaaggaggaaatacaaaaacaggaaaagcaattaagtatgttcgagataccttgttcactgcagagtcaggtacaagaaggggcatcccaaaggttatcgtggttataactgatggaagatcacaagatgatgtgaacaaaatctccagggagatgcaattagatggctatagcatttttgcaattggtgtggccgatgcagattactcggagttggttagcattggcagtaagcccagcgcacgccatgtcttctttgtggatgactttgacgcctttaagaaaatcgaagatgagttaattacttttgtctgcgaaacagcatcagcaacctgtccagtggtacacaaggatggcattgatcttgcaggatttaagatgatggaaatgtttggtttggttgaaaaagatttttcatcagtggaaggggtttctatggagcctggtaccttcaatgtgtttccatgttaccaactccataaagatgccctggtttcccagccaaccaggtacttgcacccagaaggattgccctccgactacacaatcagttttctattccggattcttcctgacactccacaggagccatttgctctttgggagattttaaataaaaattctgacccattggttggggttattttagacaatggtgggaaaactctaacatatttcaactatgaccagagtggggattttcaaactgttactttcgaaggacctgaaattaggaaaattttttatggaagctttcacaagctacacattgttgtcagtgagactttggtcaaagtggttattgactgcaagcaagtgggtgagaaggcaatgaacgcatcagctaatatcacgtcagatggtgtagaagtgctagggaaaatggttcgatcaagaggaccaggtggaaactctgcaccgttccagttacagatgtttgatattgtttgctccacatcatgggccaatacagacaaatgctgtgaacttccaggcctgagagatgatgagtcttgcccagaccttccccattcctgctcctgttctgaaaccaatgaagtggctctgggaccagcgggcccaccaggtggtccaggactccgaggaccaaagggccagcaaggtgaaccgggtccaaagggaccagatggccctcggggtgaaattggtctgccaggacctcagggtccacctggacctcaaggaccaagtggtctgtccattcaaggaatgcccggaatgccaggagaaaaaggagagaaaggagatactggccttccaggtccacagggtatcccaggaggcgttggttcaccaggacgtgatggctcaccaggccagaggggccttccgggaaaggatggatcctcgggacctccaggaccaccagggccaataggcattcctggcacccctggagtcccagggatcacaggaagcatgggaccgcaaggcgccctgggaccacctggtgtccctggagcaaagggggaacgaggagagcggggtgacctgcagtctcaagccatggtgagatcagtggcgcgtcaagtatgcgaacagctcatccagagtcacatggccaggtacactgccatcctcaaccagattcccagccactcctcatccatccggactgtccaagggcctcctggggagcctgggaggccaggctcacctggagcccctggtgaacaaggacccccaggcacaccaggcttccccggaaatgcaggcgtgccagggaccccaggagaacgaggtctaactggtatcaaaggagaaaaaggaaatccaggcgttggaacccaaggtccaagaggcccccctggaccagcaggaccttcaggggagagtcggcctggcagccctgggccccctggctctcctggaccaagaggcccaccaggtcatctgggggttcctggaccccaaggtccttctggccagcctggatattgtgacccctcatcatgttctgcctatggtgtgagagctccccatccagatcagccagagttcacccctgtccaagatgagctggaagccatggaactgtggggccctggagtctgatagcctcaggagaaatttgaagaccaactgcaagaactcttaaggaatcttgtttgagaaaatgttgttatgtggtttgtatgctacttttggggggcagggctcatttcagcagcctaaatctcctccttggataatgttaatattattattattattaacaaaaaatatatatttttaaaaagttcccttaatctatgacatggtagcaatgatttccctttggtgtcttaatggcatgtcagataatttgtttttccagagaagagagctcaaagaggaattgggaaaaataaattgaactctggaatcttctctctcaagtcctaaaatgaacaaacagatatgattgtgtttgagggaaatatgtccctagcaggaaaagaattcaaagaggttcaaagaatatgtcacttactcctacttgctgtaggaataaccttgctgataagaaaaaaagggacaatattggagaaactacctcttgtttaattgatctgtccaactctgagatcacttggtaactggtttcatgtgtatccaaaaatcagcatttggatttaagctttctgaatttggtagtttaagaaacagatttagtttttcagtggttttaactcatgtgaaataatgattttccaccagctctgatgcaaagagatataattttaatgaacgatttatccagcagtgtgttccaggggttgcctctccttatctacggggattactttgtacatgcagataagttttcgcaaacctatttccattttcttttgtaagcaaataaaacttt

SEQ ID NO: 453 - DNA, 6466 bp, Homo sapiens
atctgatcctgggctcccagctggagaggcggaggcagctccagggggctggaagtggaagcgcagcggcagaaggagagggagagagaaagagagagaggctaattaaaaaaggatactccgagggaagagagcaagggcggtgcgccgccaaggaccaactagcggcggagcttcgatcttgcctaggcgcggagagctcccaacctgggctggaaccttgcccagcacaggtggctgctacaccccatgtaaaaagcggaaaataaaatgaagattttccagcgcaagatgcggtactggttgcttccaccttttttggcaattgtttatttctgcaccattgtccaaggtcaagtggctccacccacaaggttaagatataatgtaatatctcatgacagtatacagatttcatggaaggctccaagagggaaatttggtggttacaaacttcttgtgactccaacttcaggtggaaaaactaaccagctgaatctgcagaacactgcaactaaagcaattattcaaggccttatgccagaccagaattacacagttcaaattattgcatacaataaagataaagaaagcaagccagctcaaggccaattcagaattaaagatttagaaaaaagaaaggatccaaagcccagagtcaaagttgtggacagaggaaatgggagtagaccatcttcaccagaagaagtgaaatttgtctgtcaaactccagcaattgctgacattgtaatcctggtcgatggttcatggagtattggaagattcaacttcagactggttcggcatttcttggaaaacctggttacagcattcgatgtgggctcagagaagacacgaattggtcttgcacagtatagtggtgaccccagaatagaatggcacttgaatgcatttagcacaaaagatgaagtgattgaagctgtccgaaacctcccatataaaggaggaaatacactaacaggtcttgctttgaactacatttttgaaaatagcttcaaaccagaagcaggatcaaggactggagtatccaaaattggcattttaatcacagatggaaaatcccaagatgacattattccaccatctagaaatcttcgtgagtctggtgtagaactgtttgccataggggtgaaaaacgcggatgtgaatgagctgcaggagatcgcctctgaaccagacagcactcatgtgtacaatgttgccgaattcgatctgatgcacacagttgtggagagtctgaccaggactctctgctctagagtggaagaacaggacagagaaattaaagcctcagcccatgccatcactgggccgcctacggagttgattacttctgaagtcactgccagaagctttatggttaactggactcatgccccaggaaatgtggaaaaatacagagttgtgtattatcctaccaggggtggaaaaccagacgaggtggtggtagatggaactgtatcttccacagtgttgaaaaacttgatgtctttaactgaatatcagatagcagtctttgcaatctatgcccacactgctagtgaaggcctacggggaactgaaactacacttgctttaccgatggcttctgaccttctactgtacgacgtgactgagaacagcatgcgagtcaaatgggatgcagtgcctggggcctcaggttacctgatcctttatgctcctctaacagagggcctggctggggatgaaaaagagatgaaaattggagagacccacacagatattgaattgagtgggttgttgcccaatacagaatacacagtcacagtttatgccatgtttggagaagaggccagtgatcctgttacgggacaagaaacaacattggctttaagtccaccaagaaacctgagaatctccaatgttggctctaacagtgctcgattaacctgggacccaacttcaagacagatcaatggttatcgaattgtatataacaatgcagatgggactgaaatcaatgaggttgaagtcgatcctattactaccttccctctgaagggcttgacacctctcacagagtatactattgctattttctccatctatgatgaaggacagtcagagcctctgactggagtttttaccaccgaggaagttccagcccagcaatacttagaaattgatgaggtgacgacagacagttttagggtgacctggcatcccctctcagctgatgaagggctacacaaattgatgtggattccagtctatggggggaagactgaggaggttgtcctgaaagaagagcaggactcacatgttattgaaggcctggagcccggtacggagtatgaagtttcactattggccgtacttgatgatggaagcgagagtgaggtggtgactgctgtcgggaccacacttgacagtttttggacagaaccagctacaaccatagtgcctaccacatctgtgacttcagttttccagacgggaatcagaaacctagttgtaggtgatgaaactacttctagcctgcgggtaaaatgggacatttctgacagcgatgtgcagcagtttagggtgacctacatgacagctcaaggggaccctgaggaagaagtcataggaacggttatggtgcctggaagccagaacaacctccttctgaagcctctgcttcctgatactgaatacaaagtcacagtgactcccatctacacggatggcgaaggcgtcagcgtctccgctcctggaaaaaccttaccatcctcggggccccagaacttgcgggtgtccgaggaatggtataaccggttgcgcattacgtgggaccccccatcttccccggtgaaaggctatagaattgtctacaaacctgtcagtgttcctggtccaacactggaaacgtttgtgggagctgacattaacaccatccttatcacaaacctcctcagcggaatggactacaatgtgaagatatttgcctcccaggcctcaggcttcagcgacgccctgacaggcatggtgaaaacattgttcttgggtgttaccaatctccaagccaaacatgttgaaatgaccagcttgtgtgcccactggcaggtacatcgccatgccacagcctatagggttgttatagaatccctccaggataggcaaaagcaagaatccactgtgggtggagggacaaccaggcattgcttctatggacttcagcctgattctgaatataaaatcagtgtttatacaaagctccaggagattgaaggacctagtgtgagcataatggaaaaaacacaatcacttcctacacgaccaccaacttttcctccaaccattccaccagcaaaagaagtatgtaaggcggccaaggctgacctggtatttatggtggatggatcctggagcattggagatgaaaatttcaataagatcatcagctttctatacagcactgttggagccctgaacaagattggcacagatggaacccaagttgcaatggttcagttcactgatgatcccagaacagaatttaaactaaatgcttacaaaaccaaagagactcttcttgatgcaattaaacacatttcatacaaaggaggaaatacaaaaacaggaaaagcaattaagtatgttcgagataccttgttcactgcagagtcaggtacaagaaggggcatcccaaaggttatcgtggttataactgatggaagatcacaagatgatgtgaacaaaatctccagggagatgcaattagatggctatagcatttttgcaattggtgtggccgatgcagattactcggagttggttagcattggcagtaagcccagcgcacgccatgtcttctttgtggatgactttgacgcctttaagaaaatcgaagatgagttaattacttttgtctgcgaaacagcatcagcaacctgtccagtggtacacaaggatggcattgatcttgcaggatttaagatgatggaaatgtttggtttggttgaaaaagatttttcatcagtggaaggggtttctatggagcctggtaccttcaatgtgtttccatgttaccaactccataaagatgccctggtttcccagccaaccaggtacttgcacccagaaggattgccctccgactacacaatcagttttctattccggattcttcctgacactccacaggagccatttgctctttgggagattttaaataaaaattctgacccattggttggggttattttagacaatggtgggaaaactctaacatatttcaactatgaccagagtggggattttcaaactgttactttcgaaggacctgaaattaggaaaattttttatggaagctttcacaagctacacattgttgtcagtgagactttggtcaaagtggttattgactgcaagcaagtgggtgagaaggcaatgaacgcatcagctaatatcacgtcagatggtgtagaagtgctagggaaaatggttcgatcaagaggaccaggtggaaactctgcaccgttccagttacagatgtttgatattgtttgctccacatcatgggccaatacagacaaatgctgtgaacttccaggcctgagagatgatgagtcttgcccagaccttccccattcctgctcctgttctgaaaccaatgaagtggctctgggaccagcgggcccaccaggtggtccaggactccgaggaccaaagggccagcaaggtgaaccgggtccaaagggaccagatggccctcggggtgaaattggtctgccaggacctcagggtccacctggacctcaaggaccaagtggtctgtccattcaaggaatgcccggaatgccaggagaaaaaggagagaaaggagatactggccttccaggtccacagggtatcccaggaggcgttggttcaccaggacgtgatggctcaccaggccagaggggccttccgggaaaggatggatcctcgggacctccaggaccaccagggccaataggcattcctggcacccctggagtcccagggatcacaggaagcatgggaccgcaaggcgccctgggaccacctggtgtccctggagcaaagggggaacgaggagagcggggtgacctgcagtctcaagccatggtgagatcagtggcgcgtcaagtatgcgaacagctcatccagagtcacatggccaggtacactgccatcctcaaccagattcccagccactcctcatccatccggactgtccaagggcctcctggggagcctgggaggccaggctcacctggagcccctggtgaacaaggacccccaggcacaccaggcttccccggaaatgcaggcgtgccagggaccccaggagaacgaggtctaactggtatcaaaggagaaaaaggaaatccaggcgttggaacccaaggtccaagaggcccccctggaccagcaggaccttcaggggagagtcggcctggcagccctgggccccctggctctcctggaccaagaggcccaccaggtcatctgggggttcctggaccccaaggtccttctggccagcctggatattgtgacccctcatcatgttctgcctatggtgtgagagctccccatccagatcagccagagttcacccctgtccaagatgagctggaagccatggaactgtggggccctggagtctgatagcctcaggagaaatttgaagaccaactgcaagaactcttaaggaatcttgtttgagaaaatgttgttatgtggtttgtatgctacttttggggggcagggctcatttcagcagcctaaatctcctccttggataatgttaatattattattattattaacaaaaaatatatatttttaaaaagttcccttaatctatgacatggtagcaatgatttccctttggtgtcttaatggcatgtcagataatttgtttttccagagaagagagctcaaagaggaattgggaaaaataaattgaactctggaatcttctctctcaagtcctaaaatgaacaaacagatatgattgtgtttgagggaaatatgtccctagcaggaaaagaattcaaagaggttcaaagaatatgtcacttactcctacttgctgtaggaataaccttgctgataagaaaaaaagggacaatattggagaaactacctcttgtttaattgatctgtccaactctgagatcacttggtaactggtttcatgtgtatccaaaaatcagcatttggatttaagctttctgaatttggtagtttaagaaacagatttagtttttcagtggttttaactcatgtgaaataatgattttccaccagctctgatgcaaagagatataattttaatgaacgatttatccagcagtgtgttccaggggttgcctctccttatctacggggattactttgtacatgcagataagttttcgcaaacctatttccattttcttttgtaagcaaataaaactttaaaacaatg

SEQ ID NO: 454 - DNA, 6163 bp, Homo sapiens
atctgatcctgggctcccagctggagaggcggaggcagctccagggggctggaagtggaagcgcagcggcagaaggagagggagagagaaagagagagaggctaattaaaaaaggatactccgagggaagagagcaagggcggtgcgccgccaaggaccaactagcggcggagcttcgatcttgcctaggcgcggagagctcccaacctgggctggaaccttgcccagcacaggtggctgctacaccccatgtaaaaagcggaaaataaaatgaagattttccagcgcaagatgcggtactggttgcttccaccttttttggcaattgtttatttctgcaccattgtccaaggtcaagtggctccacccacaaggttaagatataatgtaatatctcatgacagtatacagatttcatggaaggctccaagagggaaatttggtggttacaaacttcttgtgactccaacttcaggtggaaaaactaaccagctgaatctgcagaacactgcaactaaagcaattattcaaggccttatgccagaccagaattacacagttcaaattattgcatacaataaagataaagaaagcaagccagctcaaggccaattcagaattaaagatttagaaaaaagaaaggatccaaagcccagagtcaaagttgtggacagaggaaatgggagtagaccatcttcaccagaagaagtgaaatttgtctgtcaaactccagcaattgctgacattgtaatcctggtcgatggttcatggagtattggaagattcaacttcagactggttcggcatttcttggaaaacctggttacagcattcgatgtgggctcagagaagacacgaattggtcttgcacagtatagtggtgaccccagaatagaatggcacttgaatgcatttagcacaaaagatgaagtgattgaagctgtccgaaacctcccatataaaggaggaaatacactaacaggtcttgctttgaactacatttttgaaaatagcttcaaaccagaagcaggatcaaggactggagtatccaaaattggcattttaatcacagatggaaaatcccaagatgacattattccaccatctagaaatcttcgtgagtctggtgtagaactgtttgccataggggtgaaaaacgcggatgtgaatgagctgcaggagatcgcctctgaaccagacagcactcatgtgtacaatgttgccgaattcgatctgatgcacacagttgtggagagtctgaccaggactctctgctctagagtggaagaacaggacagagaaattaaagcctcagcccatgccatcactgggccgcctacggagttgattacttctgaagtcactgccagaagctttatggttaactggactcatgccccaggaaatgtggaaaaatacagagttgtgtattatcctaccaggggtggaaaaccagacgaggtggtggtagatggaactgtatcttccacagtgttgaaaaacttgatgtctttaactgaatatcagatagcagtctttgcaatctatgcccacactgctagtgaaggcctacggggaactgaaactacacttgctttaccgatggcttctgaccttctactgtacgacgtgactgagaacagcatgcgagtcaaatgggatgcagtgcctggggcctcaggttacctgatcctttatgctcctctaacagagggcctggctggggatgaaaaagagatgaaaattggagagacccacacagatattgaattgagtgggttgttgcccaatacagaatacacagtcacagtttatgccatgtttggagaagaggccagtgatcctgttacgggacaagaaacaacattggctttaagtccaccaagaaacctgagaatctccaatgttggctctaacagtgctcgattaacctgggacccaacttcaagacagatcaatggttatcgaattgtatataacaatgcagatgggactgaaatcaatgaggttgaagtcgatcctattactaccttccctctgaagggcttgacacctctcacagagtatactattgctattttctccatctatgatgaaggacagtcagagcctctgactggagtttttaccaccgaggaagttccagcccagcaatacttagaaattgatgaggtgacgacagacagttttagggtgacctggcatcccctctcagctgatgaagggctacacaaattgatgtggattccagtctatggggggaagactgaggaggttgtcctgaaagaagagcaggactcacatgttattgaaggcctggagcccggtacggagtatgaagtttcactattggccgtacttgatgatggaagcgagagtgaggtggtgactgctgtcgggaccacacttgacagtttttggacagaaccagctacaaccatagtgcctaccacatctgtgacttcagttttccagacgggaatcagaaacctagttgtaggtgatgaaactacttctagcctgcgggtaaaatgggacatttctgacagcgatgtgcagcagtttagggtgacctacatgacagctcaaggggaccctgaggaagaagtcataggaacggttatggtgcctggaagccagaacaacctccttctgaagcctctgcttcctgatactgaatacaaagtcacagtgactcccatctacacggatggcgaaggcgtcagcgtctccgctcctggaaaaaccttaccatcctcggggccccagaacttgcgggtgtccgaggaatggtataaccggttgcgcattacgtgggaccccccatcttccccggtgaaaggctatagaattgtctacaaacctgtcagtgttcctggtccaacactggaaacgtttgtgggagctgacattaacaccatccttatcacaaacctcctcagcggaatggactacaatgtgaagatatttgcctcccaggcctcaggcttcagcgacgccctgacaggcatggtgaaaacattgttcttgggtgttaccaatctccaagccaaacatgttgaaatgaccagcttgtgtgcccactggcaggtacatcgccatgccacagcctatagggttgttatagaatccctccaggataggcaaaagcaagaatccactgtgggtggagggacaaccaggcattgcttctatggacttcagcctgattctgaatataaaatcagtgtttatacaaagctccaggagattgaaggacctagtgtgagcataatggaaaaaacacaatcacttcctacacgaccaccaacttttcctccaaccattccaccagcaaaagaagtatgtaaggcggccaaggctgacctggtatttatggtggatggatcctggagcattggagatgaaaatttcaataagatcatcagctttctatacagcactgttggagccctgaacaagattggcacagatggaacccaagttgcaatggttcagttcactgatgatcccagaacagaatttaaactaaatgcttacaaaaccaaagagactcttcttgatgcaattaaacacatttcatacaaaggaggaaatacaaaaacaggaaaagcaattaagtatgttcgagataccttgttcactgcagagtcaggtacaagaaggggcatcccaaaggttatcgtggttataactgatggaagatcacaagatgatgtgaacaaaatctccagggagatgcaattagatggctatagcatttttgcaattggtgtggccgatgcagattactcggagttggttagcattggcagtaagcccagcgcacgccatgtcttctttgtggatgactttgacgcctttaagaaaatcgaagatgagttaattacttttgtctgcgaaacagcatcagcaacctgtccagtggtacacaaggatggcattgatcttgcaggatttaagatgatggaaatgtttggtttggttgaaaaagatttttcatcagtggaaggggtttctatggagcctggtaccttcaatgtgtttccatgttaccaactccataaagatgccctggtttcccagccaaccaggtacttgcacccagaaggattgccctccgactacacaatcagttttctattccggattcttcctgacactccacaggagccatttgctctttgggagattttaaataaaaattctgacccattggttggggttattttagacaatggtgggaaaactctaacatatttcaactatgaccagagtggggattttcaaactgttactttcgaaggacctgaaattaggaaaattttttatggaagctttcacaagctacacattgttgtcagtgagactttggtcaaagtggttattgactgcaagcaagtgggtgagaaggcaatgaacgcatcagctaatatcacgtcagatggtgtagaagtgctagggaaaatggttcgatcaagaggaccaggtggaaactctgcaccgttccagttacagatgtttgatattgtttgctccacatcatgggccaatacagacaaatgctgtgaacttccaggcctgagagatgatgagtcttgcccagaccttccccattcctgctcctgttctgaaaccaatgaagtggctctgggaccagcgggcccaccaggtggtccaggactccgaggaccaaagggccagcaaggtgaaccgggtccaaagggaccagatggccctcggggtgaaattggtctgccaggacctcagggtccacctggacctcaaggaccaagtggtctgtccattcaaggaatgcccggaatgccaggagaaaaaggagagaaaggagatactggccttccaggtccacagggtatcccaggaggcgttggttcaccaggacgtgatggctcaccaggccagaggggccttccgggaaaggatggatcctcgggacctccaggaccaccagggccaataggcattcctggcacccctggagtcccagggatcacaggaagcatgggaccgcaaggcgccctgggaccacctggtgtccctggagcaaagggggaacgaggagagcggggtgacctgcagtctcaagccatggtgagatcagtggcgcgtcaagtatgcgaacagctcatccagagtcacatggccaggtacactgccatcctcaaccagattcccagccactcctcatccatccggactgtccaagggcctcctggggagcctgggaggccaggctcacctggagcccctggtgaacaaggacccccaggcacaccaggcttccccggaaatgcaggcgtgccagggaccccaggagaacgaggtctaactggtatcaaaggagaaaaaggaaatccaggcgttggaacccaaggtccaagaggcccccctggaccagcaggaccttcaggggagagtcggcctggcagccctgggccccctggctctcctggaccaagaggcccaccaggtcatctgggggttcctggaccccaaggtccttctggccagcctggatattgtgacccctcatcatgttctgcctatggtgtgagagatctgatcccctacaatgattaccagcactgaagtggaaatcctccactctggttccattggccccagacatttagctgtggatacagaactgtcctgtcaaccaccaccaccaccaagcccctgcccctaacaatggacactctgcttccctgcttcttctgcatccctgccttcccactttcaaacctcttgcccactctgctccaaacatgatggagtgataacatcggaacttaaccaaatcatatatgtctattttaatagacactgactgctccatgtcagcctggatagaggtatatgatcgtgtgccaagaatttatcccagactcccctgtgtgacagcttcataataaagttacttaactgtgcctcttcctccttcctctccccacacaggatggatgggcatctttctccttgaccaccctactctcccttcctcccctgatcacctcccctccctgctcttccctggtgatggacttctaacatgagattttttaaaaaaatttctatttcttttataattttgctgagttttcagggtttcttctgtaaataaaacataatatttaaa

SEQ ID NO: 455 - DNA, 3085 bp, Homo sapiens
ctctagatttttagacatattttgaaagtctttcatcaccagatttcaaaggtgttgatagatatctatttttaaacatggaaagatggtggtgcaatggccagtggctgctacaccccatgtaaaaagcggaaaataaaatgaagattttccagcgcaagatgcggtactggttgcttccaccttttttggcaattgtttatttctgcaccattgtccaaggtcaagtggctccacccacaaggttaagatataatgtaatatctcatgacagtatacagatttcatggaaggctccaagagggaaatttggtggttacaaacttcttgtgactccaacttcaggtggaaaaactaaccagctgaatctgcagaacactgcaactaaagcaattattcaaggccttatgccagaccagaattacacagttcaaattattgcatacaataaagataaagaaagcaagccagctcaaggccaattcagaattaaagatttagaaaaaagaaaggatccaaagcccagagtcaaagttgtggacagaggaaatgggagtagaccatcttcaccagaagaagtgaaatttgtctgtcaaactccagcaattgctgacattgtaatcctggtcgatggttcatggagtattggaagattcaacttcagactggttcggcatttcttggaaaacctggttacagcattcgatgtgggctcagagaagacacgaattggtcttgcacagtatagtggtgaccccagaatagaatggcacttgaatgcatttagcacaaaagatgaagtgattgaagctgtccgaaacctcccatataaaggaggaaatacactaacaggtcttgctttgaactacatttttgaaaatagcttcaaaccagaagcaggatcaaggactggagtatccaaaattggcattttaatcacagatggaaaatcccaagatgacattattccaccatctagaaatcttcgtgagtctggtgtagaactgtttgccataggggtgaaaaacgcggatgtgaatgagctgcaggagatcgcctctgaaccagacagcactcatgtgtacaatgttgccgaattcgatctgatgcacacagttgtggagagtctgaccaggactctctgctctagagtggaagaacaggacagagaaattaaagcctcagcccatgccatcactgggccgcctacggagttgattacttctgaagtcactgccagaagctttatggttaactggactcatgccccaggaaatgtggaaaaatacagagttgtgtattatcctaccaggggtggaaaaccagacgaggtggtggtagatggaactgtatcttccacagtgttgaaaaacttgatgtctttaactgaatatcagatagcagtctttgcaatctatgcccacactgctagtgaaggcctacggggaactgaaactacacttgctttaccgatggcttctgaccttctactgtacgacgtgactgagaacagcatgcgagtcaaatgggatgcagtgcctggggcctcaggttacctgatcctttatgctcctctaacagagggcctggctggggatgaaaaagagatgaaaattggagagacccacacagatattgaattgagtgggttgttgcccaatacagaatacacagtcacagtttatgccatgtttggagaagaggccagtgatcctgttacgggacaagaaacaacatcaccttaattattaagagattcactaactcctacaagatctttattgtcaaagaatcagtatgtattgaattaatgaaagaactgggctttgaggttaggaaacatcatgcttcgtggctatggctgtggctttaagtccaccaagaaacctgagaatctccaatgttggctctaacagtgctcgattaacctgggacccaacttcaagacagatcaatggttatcgaattgtatataacaatgcagatgggactgaaatcaatgaggttgaagtcgatcctattactaccttccctctgaagggcttgacacctctcacagagtatactattgctattttctccatctatgatgaaggacagtcagagcctctgactggagtttttaccaccgaggaagttccagcccagcaatacttagaaattgatgaggtgacgacagacagttttagggtgacctggcatcccctctcagctgatgaagggctacacaaattgatgtggattccagtctatggggggaagactgaggaggttgtcctgaaagaagagcaggactcacatgttattgaaggcctggagcccggtacggagtatgaagtttcactattggccgtacttgatgatggaagcgagagtgaggtggtgactgctgtcgggaccacacttgacagtttttggacagaaccagctacaaccatagtgcctaccacatctgtgacttcagttttccagacgggaatcagaaacctagttgtaggtgatgaaactacttctagcctgcgggtaaaatgggacatttctgacagcgatgtgcagcagtttagggtgacctacatgacagctcaaggggaccctgaggaagaagtcataggaacggtctgtataaattcaactgactagaaactctgcagatgttactaacacagctaataagactgtcttcggagatcaatgcaaactttactgctcttttctcagtgactctgccatctccagaaactaatgttctctgttaatctgactccactactggcttcttagtgacctttataaatccaaaacttgctccatgtacaacttgctccaagttaataacctctgaacattgtttcaaatattgcttctcttctgctgccttgcacctgttcgagcaccaaagttgggtcataaaaggccatatgcacttgtgtctgtatatatgtatgtatagacatgtataaaagtttaatatagaaaataatttcttctgcccttggaaatctgataaaaaaacttttaagcaaaggacacagaaaaggtcttctatatggtatagtgaaaatattcttaataaaataccatccgt

SEQ ID NO: 456 - DNA, 6232 bp, Homo sapiens
actcctcggcggtgccgcagccctgtccggactccactgcgcctctgaggggctcaaatacgaattcaagatccgtggccgttcacatggtttcaaggcacaatgagactcactggcccttggaaactttggctttggatgtcaatatttctgcttcctgcttccacttccgtgaccgttagggacaagacagaagagtcatgccctatcctgagaatagagggacatcagctgacatatgacaacataaacaaacttgaagtttcaggttttgatctaggagacagcttttctctaagacgtgcattttgtgaaagtgataaaacctgtttcaaattgggaagtgcacttcttattagagacactattaagatatttcccaaaggccttcctgaggagtactcagtagctgccatgtttcgagtacgaagaaacgccaaaaaggaacggtggtttctgtggcaggttttaaaccagcagaatattccacagatttctatagtagttgatggtggaaagaaggtggtggaatttatgtttcaagccacagagggagatgtgttgaactacatttttagaaatcgagaactccgtcctttgtttgatcgtcagtggcacaaacttggcattagtatacaatcccaggtcatttcactttatatggattgtaatttaattgcgaggaggcagactgatgaaaaggacactgtggatttccatggacggacagttattgctacgcgagcttcagatggcaagcctgtggatattgaacttcaccaacttaaaatctactgcagtgcaaacctcatagctcaagaaacatgttgtgaaatatcagatactaagtgcccagagcaggatggctttggaaatattgcatcatcatgggtaactgctcatgccagtaaaatgtcttcatatctgccagcaaagcaggaacttaaagaccagtgccagtgcattccaaacaagggagaagcaggattaccaggagctccgggttcacctgggcagaaagggcataaaggagagccgggtgaaaatggtttacatggtgctccaggattccctggtcaaaagggagagcaaggttttgaaggcagcaaaggagaaactggtgaaaagggtgaacaaggagaaaaaggagatccagctctggctggccttaatggagaaaatggtttgaaaggtgacttgggtcctcatggtccacctggcccaaaaggagaaaagggagatacaggacccccaggaccaccagccttacctggttccctggggatacaaggcccccaaggtccacctggaaaagagggtcagaggggaagacgagggaaaacaggacctcccggaaaaccaggacccccaggaccacctggacctcctggaatacaaggaatacaccaaactcttggtggatattataacaaggataacaagggaaatgatgaacatgaagctggaggcctgaaaggagacaagggtgaaactggactaccaggatttccagggtctgttggccctaaaggacaaaaaggagaacctggagagccttttacaaaaggagaaaaaggagatagaggagaacctggggtaataggatcacagggagtaaagggtgaacctggagatcccggaccccctggtttaataggaagcccaggactaaagggtcagcaaggatctgcaggctccatgggacccagaggaccgccaggagatgttggattgccaggagaacatggtatcccaggaaaacaaggcattaaaggagaaaagggagatccgggtgggatcataggccctcccgggcttccaggtccaaaaggtgaggctggtcctccagggaaaagcctgccaggggaaccaggattagatggaaatcctggagcacctggtccacgtgggccaaagggtgaaagaggacttccaggtgttcacggttccccaggggacataggcccacaagggataggaattcctggcagaacaggcgcccaaggaccagctggagagccaggtattcagggtcctcgaggtctccctgggttgccaggaactccagggactccagggaatgatggagttccagggagagatggaaagccaggcctgccaggccccccaggtgacccgattgcacttcctctcttgggagacatcggtgctttgctcaagaatttctgtggcaactgccaagccagtgtcccagggctgaaaagcaacaaaggagaagaaggaggtgctggtgagcctggaaagtatgattccatggcccggaagggtgatatagggccacggggtcctccaggaatcccaggaagagagggaccaaagggaagcaaaggagagcggggctaccctgggatacctggggagaaaggcgatgagggtcttcaaggaattccaggcattccaggtgctccaggcccgactggaccccctggcttaatgggaagaactggacatcctggtcccacaggagcaaaaggtgaaaagggcagcgacggaccccctgggaaacccggaccacctggaccacctggtattccatttaatgaacgaaacggcatgagcagtttatataaaattaagggaggtgtgaatgttcccagttacccagggccacccggtcctcctggcccaaaaggcgatcctggcccagtgggagagcctggtgcaatggggttgccaggattagaaggatttccaggtgtaaagggagatcgaggcccagcaggtcccccaggaatagcagggatgtcgggaaaacctggtgccccagggcctccaggagttccaggggaaccgggtgagagaggacctgttggagatataggtttccctggaccagaaggaccctcaggaaagccaggaataaatggaaaagatggaataccaggtgctcagggcatcatgggtaagcctggagacagaggccccaaaggagaacgtggtgatcaggggattccaggagacagaggctcacaaggtgaacggggaaaaccaggccttacaggcatgaagggggccatcggtcctatgggtccaccaggaaacaagggctccatgggatcccctggccaccaaggccctccaggctctccaggcatccctggcattccggctgatgcagtttcatttgaagaaataaagaagtatattaatcaagaggtcctaaggatttttgaagagaggatggctgtattcctatcccagctcaagctgccagcagcaatgttggctgcccaagcttatgggagacctgggccaccagggaaggatgggttgcctgggccaccaggagaccctggaccccaaggctacagaggacagaagggagaaagaggtgaacctggaattgggctgccagggagtccaggtcttcctgggacttcagctctgggtttgccaggctcaccaggtgccccaggcccacagggccccccaggacccagtggaagatgtaacccagaagattgcctctatcctgtgtctcatgcccatcagcgcacaggtgggaattgaacacacctgaagaagacttggttcctggtaacatttccttgccactggagctctcttaataccgtcaaaccctcatcatctgtgggttgctttttttttttttttttttttttgggagtaagccaggcattaaaagcaaccgtttgaatcctattcctatagcaattgcaaatcagcattttttgatttttcccaaattcattccatatgttttgctttacaattgctatgatttttactcagagttttatatgaaatatgcaagtaaatcttatcgttagttcttcttcaaaaggaaattgcatcttgtgacttagtagactgatgatgatatccattttgtagactcatcaacatgtggttggcctttgatttctgaattttaaagtttcagacttatcttttccttggtgtttaaatttactatcattgctaaacatctcgtcaacttttttgatatagtgcattgctcctgttgaatgttttttgactactttttataacttaagaatttttataccatctacatctatcctacttatgcagaaaaataggcaataagaacttcattttacaatttagttttcaaaaaaaaaatgcaggaaactgttttatcagggagcccaaacacccagcatagccaactactgaaatgattttgttaattctgtataatgagctcaattcaaagcaatcaccactggcatgaataagtactgcatgaaaagggagtatcaaattccagttttgtatgagttctgcaaaaaaagcctaatattctgtggtcccctcactcagtctctcatttggtaaacagaaagctgttttccctacaaggtgcttggtggtgaagccaccaagctgtctttggtactcttaaagcttcagtggcctagcaagatctttgggcccttgtatccattatccttatgacctcatcaccctcagactttaagacaagaagccaccatcaaaacaaaggatgggatacgtatagaatggactcacttgtcctagaagatgaatgtgtagtgtcagcaaatgcatgttaagaaggtgaagcccaaaagctcttaaggagaattgtatttctccagaagctgcagcaagaggtacagctcaacaaaggaaaaccacaggactggatatgcaactagtgctcagaccaaagagttcacacccactctaaaaccatgtcctctgaaaagaaacaaaaatacagtgatcatcaaatgcctaaacagtctttctgttggttagctgtacattcattgaggaactgttgattggcaggcactgattctctagaacactgggcatgaggatgttgcagaaatctagatggtgggtcccacagatgtgagaacatgctgcaagagcctgccagccacagcaatcaggactcacagctcttcaaggagcagtgcagatttcaatttggctaaaacaggatgattgcttttgtctgtttactgaaaaatgagtttagaaaggctagcccactgacattggaaaaagctgtgaacagagttgtgtctgaggaatgtgcctaatttaaggcagggtttgttccaatgcatccgtgatttgaaccggttttcattatagattaatgaactgctggtcaggtactgtctacaatggctgtgcatacctataacattttaggtatttcatattgaattatgctgtatatttcaattccaagtttatttattttccaaggttattttatttattgtaagcattttgacattgattttttttttttcgttttctttcttgtgcaatacctacaatggtgctgtgttttaaacttacacaattgggacatacgtatgtgttttcttagtaaaatggtaatttatcccgaaaaagtgtacatagatctaaaatttggtgctatgtgtatatcttgagcttttaatttgttgaattttctaaacgcttacaacttatctgccactcatattaatttacttgaatttgtcataaagctaaatattttatatgttttcaaagattattttttcatattaataggttgtttatctttttgcctgtttgctaatttaaaaatatttattttatcattttaatgttttcatggacttttttgctgatggtaatcaactttttttgttttttggtttttgagttgttcttgtcatagacataaaaagacaattcattttcttgttttattaactctgttcatttttattctacaaaatatgtcatgcattctttcttatgaattgtatatttagaaatctttctaaataccattaaggcttgactggttaattcctatttcaaggatttggatttattcaggtaatttgatgggatggggaaatataatattgtgtgatgcatattacaaagtggacttgtcacaatgacacaaactcattttttgtaactgggaaatatgactaaatttgacgtaactagagaaacaaggctgtatccacatggtacaagcctttctcaccctactctattatttaccttcagatactttttcctgcctcagctctgtacacatgatatgcaacaaagggcagcaagaaatgctgggtccacctaatttaacacaaaatgaagttgagattcggcagttgcccaattcctttaataaaaagaaactaaataatttgggccccaaagtagggtgggaagttttcctctaaatgac

SEQ ID NO: 457 - DNA, 462 bp, Homo sapiens
ggaataaatggaaaagatggaataccaggtgctcagggcatcatgggtaagcctggagacagaggccccaaaggagaacgtggtgatcaggggattccaggagacagaggctcacaaggtgaacggggaaaaccaggccttacaggcatgaagggggccatcggtcctatgggtccaccaggaaacaagggctccatgggatcccctggccaccaaggccctccaggctctccaggcatccctggcattccggctgatgcagtttcatttgaagaaataaagaagtatattaatcaagaggtcctaaggatttttgaagagaggatggctgtattcctatcccagctcaagctgccagcagcaatgttggctgcccaagcttatgggagacctgggccaccagggaaggatgggttgcctgggccaccaggagaccctggaccccaagaagtagatgtttaa

SEQ ID NO: 458 - DNA, 5491 bp, Homo sapiens
acaggacagacttaagggcgggagggagcccatcccgcttgccccaacgaacgcgggcgcggggctttcctcgcaggttacataaggcagccgcgggtggaggcagcagaggcgagcgcacgtccgtcgagggggaaaggggcgtggggaggcggccggggcggccggtatcccccgggcgtgagtgcgcagcgcgcgggggagcgcagggcgcggcggagtcgggtttcagagcgcgggtgactcggggcgcgggccgggagccgggattctgcccgccgccgccgctgccgagcgccgcctttgttccctgcaggaagggcgagcgcggcggccagcgctcagcgacccttcgtcctccgctaagctccaacgctctgctcgactagccgcgcgccttccggggctccgcagacccgcgagatggcaccaaggaggaacaacgggcagtgctggtgtctgctgatgctgctctcggtctccacgcccctccctgctgtcacccagacccgcggtgcgacagagactgcttcccagggtcacctggacctcacgcagctcatcggtgtcccgctgccctcgtccgtatcctttgtcacaggctatggtggcttcccggcctacagtttcgggcctggtgccaatgttggccgcccagccaggactctcatcccatccaccttcttcagggacttcgccatcagcgtcgtggtgaagcccagcagcacccgtggtggcgtgctcttcgccatcactgacgccttccagaaggtcatctacctgggcctgcggctctcaggtgtggaggacggccaccagcggatcatcctctactacacggagccaggctcccatgtgtcccaagaggctgctgccttctcggtgcctgtgatgacccacaggtggaaccgcttcgccatgattgtccagggtgaggaagtgaccctcctcgtgaactgtgaggagcacagccgcatccccttccagcggtcctcccaggctttggcttttgagtccagcgctggaatcttcatgggcaatgcaggagctacagggctcgagagattcactggctccctccagcagctcaccgtgcaccccgaccccaggactcccgaggagctgtgtgaccctgaagagtcctcggcatctggagagaccagtgggctgcaggaggcagacggagtagctgagatcttagaagccgtcacctacactcaagcctcgcccaaagaagcaaaagttgaacccataaacacacctccaactccatcctccccctttgaagacatggaactttctggtgaacctgtacccgaggggaccctggaaaccaccaacatgagcatcatccagcacagcagccccaaacaagggtctggtgagatcctgaatgacacactggagggggttcattctgtggatggtgaccccattactgacagcggctcaggggctggggccttccttgacattgctgaagaaaagaatttagcagcaacagcagcggggctggccgaggtgcccatcagcactgctggagaagcagaggccagcagtgtgcccaccgggggaccaaccctctctatgtccacggagaacccagaggaaggggtcactccaggtccagataatgaagagcgtttagcagcaacagcagcaggggaggccgaggcactcgccagcatgcctggggaagtggaggccagtggtgtggcccccggggagctggacctctccatgtccgcccagagcctcggggaagaggccactgtgggtccaagcagtgaagacagtttaacaacagctgcagctgcaaccgaagtgtccctcagtacttttgaggatgaggaagccagtggggtccccacagatggcctggctcccctcacagccaccatggcccctgagcgggcagtcacttctggtcctggtgatgaagaagacttggcagcagccacaacagaggagcccctcatcacagctgggggtgaagagtccggcagccctccccctgatgggccaccgctgcccctgcccacagtggctcctgaaagatggatcactccagctcaaagagaacatgtgggaatgaaaggacaggctgggcccaaaggagaaaagggtgatgctggggaggagcttcctggccctcctgaaccttctgggcctgttggacccacggcaggagcagaagcagagggctctggcctaggctggggctcggacgtcggctctggctctggtgacctggtgggcagtgagcagctgctgagaggtcctccaggacccccagggccacctggcttacctgggattccaggaaaaccaggaactgatgttttcatgggaccccctggatctcctggagaggatggacctgctggtgaacctgggcccccgggccctgagggacagcctggagttgatggagccaccggccttcccgggatgaaaggggagaagggagcaagagggcctaatggctcagttggtgaaaagggtgaccctggcaacagaggcttacctggacccccggggaaaaagggacaagctggccctcctggggtcatgggacccccagggcctcctggaccccctgggcccccaggccctggatgcacaatgggacttggattcgaggataccgaaggctctggaagcacccagctattgaatgaacccaaactctccagaccaacggctgcaattggtctcaaaggagagaaaggagaccggggacccaagggagaaagggggatggatggagccagtattgtgggaccccctgggccgagagggccacctgggcacatcaaggtcttgtctaattccttgatcaatatcacccatggattcatgaatttctcggacattcctgagctggtggggcctccggggccggacgggttgcctgggctgccaggatttccaggtcctagaggaccaaaaggtgacactggtttacctggctttccaggactaaaaggagaacagggcgagaagggagagccgggtgccatcctgacagaggacattcctctggaaaggctgatggggaaaaagggtgaacctggaatgcatggagccccaggaccaatggggcccaaaggaccaccaggacataaaggagaatttggccttcccgggcgacctggtcgcccaggactgaatggcctcaagggtaccaaaggagatccaggggtcattatgcagggcccacctggcttacctggccctccaggcccccctgggccacctggagctgtgattaacatcaaaggagccattttcccaatacccgtccgaccacactgcaaaatgccagttgatactgctcatcctgggagtccagagctcatcacttttcacggtgttaaaggagagaaaggatcctggggtcttcctggctcaaagggagaaaaaggcgaccagggagcccagggaccaccaggtcctccacttgatctagcttacctgagacactttctgaacaacttgaagggggagaatggagacaaggggttcaaaggtgaaaaaggagaaaaaggagacattaatggcagcttccttatgtctgggcctccaggcctgcccggaaatccaggcccggctggccaaaaaggggagacagtcgttgggccccaaggacccccaggtgctcctggtctgcctgggccacctggctttggaagacctggtgatcctgggccaccggggcccccggggccaccaggacctccagctatcctgggagcagctgtggcccttccaggtccccctggccctccaggacagccagggcttcccggatccagaaacctggtcacagcattcagcaacatggatgacatgctgcagaaagcgcatttggttatagaaggaacattcatctacctgagggacagcactgagtttttcattcgtgttagagatggctggaaaaaattacagctgggagaactgatccccattcctgccgacagccctccaccccctgcgctttccagcaacccacatcagcttctgcctccaccaaaccctatttcaagtgccaattatgagaagcctgctctgcatttggctgctctgaacatgccattttctggggacattcgagctgattttcagtgcttcaagcaggccagagctgcaggactgttgtccacctaccgagcattcttatcttcccatttgcaagatctgtccaccattgtgaggaaagcagagagatacagccttcccatagtgaacctcaagggccaagtactttttaataattgggactcaattttttctggccacggaggtcagttcaatatgcatattccaatatactcctttgatggtcgagacataatgacagatccttcttggccccagaaagtcatttggcatggctccagcccccatggcgtccgccttgtggataactactgtgaagcatggcgaaccgcggacacagcggtcacgggacttgcctccccgctgagcacggggaagattctggaccagaaagcatacagctgtgctaatcggctaattgtcctatgtatcgaaaacagtttcatgacagacgctaggaagtaatggccttctgatgattcttaaagagttttcaattttttcttatgtgaagagttgacactgaaatctaaaatgtttaattgttgtaaatattacagttttttttttttactacatattctttacaacagcaaccaaagaaaacatacctcaatacactcaaaactgaagacatagaggactcagatcaaagacaaaatctgatccatatattggtgctagattctgcaggaaaccccagcagtgtgaacgcatcccaacataggttaagagcaagttgaaaacaaaggccatggcattctgccactgcatccttcagacagttatatcctccttttaaaccattgttgttgagtgtaagatgtccttcatgttttcttataaagtcagtgtttagaaatgttaccctttctaagttatatacagatcaaatgcttttttctttcacgtacatccatcatttgcaactgctgttcgtacacagaaacaggactgctcaaatgatcctatttgtattttctgatgctatcagactctaatgtttttttccctaaaatattattgccatcatgctttaggaattttatatttttacacaatcatattttagtatggtgtctgtttatgtaactctgacttgctggaaaagttgaaactccaaataatctgaaactagaaaagaaatagcacataattactaccttccccttggcggctctcctccccaacccccaccccacaattttatgacttccatttggcaattgttgaattataactgcgactgaaacaaacaggttcatagagatgaattttctgagaaacatatatctacatgttgtataattggattttttttccatgtaagtgaacataaaaacatcttttccgggtgctttcttca

SEQ ID NO: 459 - DNA, 2508 bp, Homo sapiens
attctgcccgccgccgccgctgccgagcgccgcctttgttccctgcaggaagggcgagcgcggcggccagcgctcagcgacccttcgtcctccgctaagctccaacgctctgctcgactagccgcgcgccttccggggctccgcagacccgcgagatggcaccaaggaggaacaacgggcagtgctggtgtctgctgatgctgctctcagtcccgctgccctcgtccgtatcctttgtcacaggctatggtggcttcccggcctacagtttcgggcctggtgccaatgttggccgcccagccaggactctcatcccatccaccttcttcagggacttcgccatcagcgtcgtggtgaagcccagcagcacccgtggtggcgtgctcttcgccatcactgacgccttccagaaggtcatctacctgggcctgcggctctcaggtgtggaggacggccaccagcggatcatcctctactacacggagccaggctcccatgtgtcccaagaggctgctgccttctcggtgcctgtgatgacccacaggtggaaccgcttcgccatgattgtccagggtgaggaagtgaccctcctcgtgaactgtgaggagcacagccgcatccccttccagcggtcctcccaggctttggcttttgagtccagcgctggaatcttcatgggcaatgcaggagctacagggctcgagagattcactggctccctccagcagctcaccgtgcaccccgaccccaggactcccgaggagctgtgtgaccctgaagagtcctcggcatctggagagaccagtgggctgcaggaggcagacggagtagctgagatcttagaagccgtcacctacactcaagcctcgcccaaagaagcaaaagttgaacccataaacacacctccaactccatcctccccctttgaagacatggaactttctggtgaacctgtacccgaggggaccctggaaaccaccaacatgagcatcatccagcacagcagccccaaacaagggtctggtgagatcctgaatgacacactggagggggttcattctgtggatggtgaccccattactgacagcggctcaggggctggggccttccttgacattgctgaagaaaagaatttagcagcaacagcagcggggctggccgaggtgcccatcagcactgctggagaagcagaggccagcagtgtgcccaccgggggaccaaccctctctatgtccacggagaacccagaggaaggggtcactccaggtccagataatgaagagcgtttagcagcaacagcagcaggggaggccgaggcactcgccagcatgcctggggaagtggaggccagtggtgtggcccccggggagctggacctctccatgtccgcccagagcctcggggaagaggccactgtgggtccaagcagtgaagacagtttaacaacagctgcagctgcaaccgaagtgtccctcagtacttttgaggatgaggaagccagtggggtccccacagatggcctggctcccctcacagccaccatggcccctgagcgggcagtcacttctggtcctggtgatgaagaagacttggcagcagccacaacagaggagcccctcatcacagctgggggtgaagagtccggcagccctccccctgatgggccaccgctgcccctgcccacagtggctcctgaaagatggatcactccagctcaaagagaacatgtgggaatgaaaggacaggctgggcccaaaggagaaaagggtgatgctggggaggagcttcctggccctcctgaaccttctgggcctgttggacccacggcaggagcagaagcagagggctctggcctaggctggggctcggacgtcggctctggctctggtgacctggtgggcagtgagcagctgctgagaggtcctccaggacccccagggccacctggcttacctgggattccaggaaaaccaggaactgatgttttcatgggaccccctggatctcctggagaggatggacctgctggtgaacctgggcccccgggccctgagggacagcctggagttgatggagccaccggccttcccgggatgaaaggggagaagggagcaagagggcctaatggctcagttggtgaaaagggtgaccctggcaacagaggcttacctggacccccggggaaaaagggacaagctggccctcctggggtcatgggacccccagggcctcctggaccccctgggcccccaggccctggatgcacaatgggacttggattcgaggataccgaaggctctggaagcacccagctattgaatgaacccaaactctcctccccaacccccaccccacaattttatgacttccatttggcaattgttgaattataactgcgactgaaacaaacaggttcatagagatgaattttctgagaaacatatatctacatgttgtataattggattttttttccatgtaagtgaacataaaaacatcttttccggg

SEQ ID NO: 460 - DNA, 5584 bp, Homo sapiens
agtctagccgcctctggtgccgctggagccccctctaggccctcctcctcctcctccctggcgggccggtccagctgtgttccattagtgtccctggcaggcccccagccccctggaaccgcctctcttcccccacccggagtggccggcagtccccggcaggcgtgcgccgggcagcagacagccgggagagctcgagcgccaggaagctggggacccgtgaccgtcacggagagatagagaacccctagcggacctgaggaacctgggctctgcttcctccgcctgctgcctggactgctcagtgaggtggggggatccccggccaccggtgctgtggctgtagctgacctctttggaccgggatgtgggtatcctgggctcctggcctgtggctgctcggtctttgggctaccttcggccatggggcaaatacaggtgcacaatgcccaccttcacagcaggaaggactcaaattggaacacagtagtagcctgccagccaacgtgactggcttcaacctcatccaccgactcagcctcatgaagacgtctgccatcaagaagatccgcaaccccaaggggcctctcatcctgcgcctgggggcggcccccgtgacccagcccacgcgaagagtattccctcggggtctcccggaggagtttgccctggtgctgacactactgctgaagaaacacacccaccagaagacgtggtatctgtttcaagtgaccgatgcaaatgggtatccacagatatccctggaagtcaacagccaagagcggagcctggagctcagggcccagggccaggatggcgactttgtgtcctgcatcttcccagtgccccagctcttcgacttgcgttggcacaagctgatgctgagtgtggctggacgtgtggcctctgtgcacgtggactgcagctcagcctcctcccagcctctggggccccgacgacccatgaggcctgtgggccatgtatttctaggcttggatgctgagcagggcaagcctgtctcgtttgaccttcagcaggtgcacatctactgtgacccggagctcgtgctggaggagggctgctgtgagattttaccagcagggtgccccccagagacctccaaggcccgccgggacacccagagcaatgagctcattgagatcaatccacagtctgaaggcaaggtctacacccgctgcttctgcctggaggagcctcaaaacagcgaggtggatgcccagctgacgggaagaatcagccagaaggcagaaaggggagcaaaggtccatcaggagacagcagccgatgagtgtccgccctgtgtccatggtgcccgggacagcaatgtgagtgaatggagggtggggccagaaggagggaaaggtgagcggggcctgcctggtccaccaggctccaagggagagaagggagcacggggcaatgactgtgttcgaatctccccggatgccccacttcagtgtgcagaaggcccgaagggagagaagggggagtcaggagctctgggaccctcaggactcccaggctcaacaggcgagaagggccagaaaggcgagaagggcgacggaggcatcaagggcgtgccgggaaagccaggccgggacggccggccaggagagatctgtgtcattgggcccaaagggcagaagggagaccctggctttgttgggcctgaggggctggcaggagagcctgggccccccggcctccctggaccccctgggataggactgcctgggaccccgggggatccaggtggcccaccaggccccaagggagacaagggcagctcggggatcccaggaaaggaaggccctggtgggaaacctgggaagccaggtgtgaagggagagaagggtgacccctgtgaagtgtgcccaacactgcctgaagggttccagaactttgttggacttcctggaaagccagggcccaaaggggagcctggtgatcctgtaccagccaggggagaccctggcatccaaggcatcaaaggagagaagggggagccctgcttgtcctgcagctcggttgtaggggcccagcatcttgtgtcctccacaggggccagtggagatgtgggttcccctggctttggtctgcctggccttccggtgaaggcaggtgtcccaggcctgtctcctgggggtaacttcggggaggcagggccagctggcagtccagggccaccaggaccagtggggccagcaggcatcaaaggggcgaagggggagccctgtgagccgtgcccagccctgtccaaccttcaggatggggatgtccgtgtggtggccttgcctggcccatccggagagaagggggaacctgggcctccaggctttggcttgccaggaaaacagggcaaggctggagagcgtggactgaaggggcagaagggtgatgctgggaatcctggagaccctggaacgccgggcaccacagggcggccaggactgtcaggagagcctggagttcagggccccgcggggccaaaaggagaaaagggtgatggctgcactgcctgccccagcctgcaggggacagtgacagacatggcaggacggcctgggcagcccggccccaaaggagagcagggccccgaaggcgtgggccgacctggtaaacccggccaacccggtctaccaggagttcaagggcccccaggactgaagggcgtgcagggagagccagggcctccaggaaggggagtccagggaccccagggggagcctggagccccgggtttgcctggcattcagggacttccgggacctcggggaccacctggccccactggagagaagggtgcccagggatctccaggggtgaaaggagccaccggacctgtgggacctcctggggccagtgtctctgggcctccgggccgtgatgggcagcaaggacagacgggactcagaggaacaccaggtgaaaaaggaccacgaggagagaagggtgagccaggggagtgctcctgcccctctcaaggagacctcatcttctctggcatgccgggtgctccgggactttggatgggcagctcctggcagccgggcccgcagggtccaccaggtattcccggaccaccaggcccccctggagtacctgggctgcagggagtgcctggaaacaacggtttgccaggacagcctgggctcactgcagaactgggagccctggctctgggttctcactggggctccccaagtatctgcggggactgtgtccaggggcagagggcccacccagggtacctcgtggagaagggagagaagggagaccagggcatccctggtgtgccaggcctcgacaactgcgcccagtgctttttgtcactggagcgcccaagagccgaggaggcccggggtgacaacagtgagggagatcctggctgtgttgggagcccaggcctacctggtcctccgggattgccaggccagagaggagaagagggtccgcctggcatgaggggctccccgggtcctccaggccctatcggccccccaggttttcctggtgctgttggctcccccggattgcctggccttcaaggagagcgaggtctcacgggcctgactggagacaagggggagccgggtcctccagggcaaccaggttacccaggtgccacgggccccccaggactgcctggcatcaagggggagcgtggctacaccgggtcagcgggagagaaaggagagccgggccccccaggatctgaaggcctcccaggccccccaggcccagcgggtcccagaggagagcgaggaccccaaggtaactccggtgagaagggcgaccagggatttcaaggccagccaggctttccgggcccaccgggtccccctggattcccaggcaaagttggatcacctggcccacctggccctcaagcagagaagggcagcgaagggattcgaggcccatcaggcctgcctggctcccctgggccaccgggacctcctgggattcagggccccgccggtctggatggtttggatgggaaggacggcaagcctggcttgaggggggaccctggtcctgctggcccccctggactcatgggaccaccgggctttaaggggaaaacaggacatcctggcctcccaggacctaagggtgactgtggcaaaccaggtccccctggcagcactggccggcctggcgcagagggtgaacctggtgccatgggaccccagggaagacccggtcccccgggacacgttgggccaccagggcctccaggccagccaggaccagctgggatctctgcagtgggtctgaaaggagaccgaggagccaccggagaaaggggccttgcaggcctcccaggccagcccggcccccctggacaccctggccccccaggcgaacctggtacggatggtgcagctggcaaagagggaccccctggaaagcagggattctatggacctcctggtcccaagggtgatccaggagctgcaggacagaagggccaggcaggagagaaggggagagccggcatgcctggtggacctggcaagagtggttccatggggcctgttgggccaccgggccctgcaggagagagaggccaccctggagctccggggccttcggggagccctggcttgcctggtgtgcctggctccatgggagacatggtgaattatgatgaaatcaagaggttcatcagacaagagatcattaaaatgtttgatgagagaatggcttactacacctccaggatgcagttccccatggagatggcggcagctccgggacgaccagggcctccagggaaggatggtgctccgggcaggccaggtgctccagggtcacctgggctccctggtcagattggcagagaaggacggcagggcttgccaggagtaagaggattgcctggtaccaaaggtgaaaaaggggacattggtattggcattgcaggagaaaatggtcttcccggccccccaggtcctcaaggtcctccaggctatggcaagatgggtgcaacaggaccaatgggccagcaaggcatccctggcatccctgggcccccgggtcccatgggccagccaggcaaggctggccactgtaatccctctgactgctttggggccatgccgatggagcagcagtacccacccatgaaaaccatgaaggggccttttggctgaaattccccacctgcctttggatgaaagactccgttgggaataaatggccaaagcttataggactctgtgacaggttgtgaatgttttttttgttgttgttgttgtttttaattgctgttaatattttttaaataataaagaaacaaaactatctgccctttcccttccagtgggttcctctggtgctgcagccagagctccctgttgccctccttttcccgtttagtcccaggaacaaaaaagggcattttgggtacaggggcatatacctgtaatcctagctattcaaggggctgaggtgggaggatcgcctgagcccaggagtttgagaccagtctaagcaacataatgagactcagtctccgaaaaataaaaattaaaaaataaagggtatttccctcctt

SEQ ID NO: 461 - DNA, 5736 bp, Homo sapiens
cctgactcttaaagggcccgcaggagcccccttccagggcagctctgggcacgtagggtcccgcctagctcgaggatcgctcacctggcggtgaggcaggaggggcgggcctgggagctcggccagacccggggcggggctgtgcaccccgcagtctagccgcctctggtgccgctggagccccctctaggccctcctcctcctcctccctggcgggccggtccagctgtgttccattagtgtccctggcaggcccccagccccctggaaccgcctctcttcccccacccggagtggccggcagtccccggcaggcgtgcgccgggcagcagacagccgggagagctcgagcgccaggaagctggggacccgtgaccgtcacggagagatagagaacccctagcggacctgaggaacctgggctctgcttcctccgcctgctgcctggactgctcagtgaggtggggggatccccggccaccggtgctgtggctgtagctgacctctttggaccgggatgtgggtatcctgggctcctggcctgtggctgctcggtctttgggctaccttcggccatggggcaaatacaggtgcacaatgcccaccttcacagcaggaaggactcaaattggaacacagtagtagcctgccagccaacgtgactggcttcaacctcatccaccgactcagcctcatgaagacgtctgccatcaagaagatccgcaaccccaaggggcctctcatcctgcgcctgggggcggcccccgtgacccagcccacgcgaagagtattccctcggggtctcccggaggagtttgccctggtgctgacactactgctgaagaaacacacccaccagaagacgtggtatctgtttcaagtgaccgatgcaaatgggtatccacagatatccctggaagtcaacagccaagagcggagcctggagctcagggcccagggccaggatggcgactttgtgtcctgcatcttcccagtgccccagctcttcgacttgcgttggcacaagctgatgctgagtgtggctggacgtgtggcctctgtgcacgtggactgcagctcagcctcctcccagcctctggggccccgacgacccatgaggcctgtgggccatgtatttctaggcttggatgctgagcagggcaagcctgtctcgtttgaccttcagcaggtgcacatctactgtgacccggagctcgtgctggaggagggctgctgtgagattttaccagcagggtgccccccagagacctccaaggcccgccgggacacccagagcaatgagctcattgagatcaatccacagtctgaaggcaaggtctacacccgctgcttctgcctggaggagcctcaaaacagcgaggtggatgcccagctgacgggaagaatcagccagaaggcagaaaggggagcaaaggtccatcaggagacagcagccgatgagtgtccgccctgtgtccatggtgcccgggacagcaatgtcacacttgctccctctggccccaagggagggaaaggtgagcggggcctgcctggtccaccaggctccaagggagagaagggagcacggggcaatgactgtgttcgaatctccccggatgccccacttcagtgtgcagaaggcccgaagggagagaagggggagtcaggagctctgggaccctcaggactcccaggctcaacaggcgagaagggccagaaaggcgagaagggcgacggaggcatcaagggcgtgccgggaaagccaggccgggacggccggccaggagagatctgtgtcattgggcccaaagggcagaagggagaccctggctttgttgggcctgaggggctggcaggagagcctgggccccccggcctccctggaccccctgggataggactgcctgggaccccgggggatccaggtggcccaccaggccccaagggagacaagggcagctcggggatcccaggaaaggaaggccctggtgggaaacctgggaagccaggtgtgaagggagagaagggtgacccctgtgaagtgtgcccaacactgcctgaagggttccagaactttgttggacttcctggaaagccagggcccaaaggggagcctggtgatcctgtaccagccaggggagaccctggcatccaaggcatcaaaggagagaagggggagccctgcttgtcctgcagctcggttgtaggggcccagcatcttgtgtcctccacaggggccagtggagatgtgggttcccctggctttggtctgcctggccttccgggtagagctggggttccagggctgaaaggagagaagggtaacttcggggaggcagggccagctggcagtccagggccaccaggaccagtggggccagcaggcatcaaaggggcgaagggggagccctgtgagccgtgcccagccctgtccaaccttcaggatggggatgtccgtgtggtggccttgcctggcccatccggagagaagggggaacctgggcctccaggctttggcttgccaggaaaacagggcaaggctggagagcgtggactgaaggggcagaagggtgatgctgggaatcctggagaccctggaacgccgggcaccacagggcggccaggactgtcaggagagcctggagttcagggccccgcggggccaaaaggagaaaagggtgatggctgcactgcctgccccagcctgcaggggacagtgacagacatggcaggacggcctgggcagcccggccccaaaggagagcagggccccgaaggcgtgggccgacctggtaaacccggccaacccggtctaccaggagttcaagggcccccaggactgaagggcgtgcagggagagccagggcctccaggaaggggagtccagggaccccagggggagcctggagccccgggtttgcctggcattcagggacttccgggacctcggggaccacctggccccactggagagaagggtgcccagggatctccaggggtgaaaggagccaccggacctgtgggacctcctggggccagtgtctctgggcctccgggccgtgatgggcagcaaggacagacgggactcagaggaacaccaggtgaaaaaggaccacgaggagagaagggtgagccaggggagtgctcctgcccctctcaaggagacctcatcttctctggcatgccgggtgctccgggactttggatgggcagctcctggcagccgggcccgcagggtccaccaggtattcccggaccaccaggcccccctggagtacctgggctgcagggagtgcctggaaacaacggtttgccaggacagcctgggctcactgcagaactgggatccttaccaattgaacagcacctccttaagagtatctgcggggactgtgtccaggggcagagggcccacccagggtacctcgtggagaagggagagaagggagaccagggcatccctggtgtgccaggcctcgacaactgcgcccagtgctttttgtcactggagcgcccaagagccgaggaggcccggggtgacaacagtgagggagatcctggctgtgttgggagcccaggcctacctggtcctccgggattgccaggccagagaggagaagagggtccgcctggcatgaggggctccccgggtcctccaggccctatcggccccccaggttttcctggtgctgttggctcccccggattgcctggccttcaaggagagcgaggtctcacgggcctgactggagacaagggggagccgggtcctccagggcaaccaggttacccaggtgccacgggccccccaggactgcctggcatcaagggggagcgtggctacaccgggtcagcgggagagaaaggagagccgggccccccaggatctgaaggcctcccaggccccccaggcccagcgggtcccagaggagagcgaggaccccaaggtaactccggtgagaagggcgaccagggatttcaaggccagccaggctttccgggcccaccgggtccccctggattcccaggcaaagttggatcacctggcccacctggccctcaagcagagaagggcagcgaagggattcgaggcccatcaggcctgcctggctcccctgggccaccgggacctcctgggattcagggccccgccggtctggatggtttggatgggaaggacggcaagcctggcttgaggggggaccctggtcctgctggcccccctggactcatgggaccaccgggctttaaggggaaaacaggacatcctggcctcccaggacctaagggtgactgtggcaaaccaggtccccctggcagcactggccggcctggcgcagagggtgaacctggtgccatgggaccccagggaagacccggtcccccgggacacgttgggccaccagggcctccaggccagccaggaccagctgggatctctgcagtgggtctgaaaggagaccgaggagccaccggagaaaggggccttgcaggcctcccaggccagcccggcccccctggacaccctggccccccaggcgaacctggtacggatggtgcagctggcaaagagggaccccctggaaagcagggattctatggacctcctggtcccaagggtgatccaggagctgcaggacagaagggccaggcaggagagaaggggagagccggcatgcctggtggacctggcaagagtggttccatggggcctgttgggccaccgggccctgcaggagagagaggccaccctggagctccggggccttcggggagccctggcttgcctggtgtgcctggctccatgggagacatggtgaattatgatgaaatcaagaggttcatcagacaagagatcattaaaatgtttgatgagagaatggcttactacacctccaggatgcagttccccatggagatggcggcagctccgggacgaccagggcctccagggaaggatggtgctccgggcaggccaggtgctccagggtcacctgggctccctggtcagattggcagagaaggacggcagggcttgccaggagtaagaggattgcctggtaccaaaggtgaaaaaggggacattggtattggcattgcaggagaaaatggtcttcccggccccccaggtcctcaaggtcctccaggctatggcaagatgggtgcaacaggaccaatgggccagcaaggcatccctggcatccctgggcccccgggtcccatgggccagccaggcaaggctggccactgtaatccctctgactgctttggggccatgccgatggagcagcagtacccacccatgaaaaccatgaaggggccttttggctgaaattccccacctgcctttggatgaaagactccgttgggaataaatggccaaagcttataggactctgtgacaggttgtgaatgttttttttgttgttgttgttgtttttaattgctgttaatattttttaaataataaagaaacaaaactatctgccctttcccttccagtgggttcctctggtgctgcagccagagctccctgttgccctccttttcccgtttagtcccaggaacaaaaaagggcattttgggtacaggggcatatacctgtaatcctagctattcaaggggctgaggtgggaggatcgcctgagcccaggagtttgagaccagtctaagcaacataatgagactcagtctccgaaaaataaaaattaaaaaataaagggtatttccctcctt

SEQ ID NO: 462 - DNA, 5734 bp, Homo sapiens
aaatccagcaagtgtcagataattggaagggtggagtaacgctgtaaaccatgacacacctttgtcaggacatgtttggaagcaaagagttgaaagaaacaaggtggagagaaagaaaagtgaacatttttgaaagatcactcagctttaacacaccttggctgggtctggataaaaaaaaagtgagcactgcaaatttctagaagaaaacatcaggagaagaaagagagagggggatttattcaaagttgtttccaattccttcaaaacctcaaaccaggtggctatggtatggatgtaaccaagaaaaacaaacgagatggaactgaagtcactgagagaattgtcactgaaacagtaaccacaagacttacatccttaccaccaaaaggcgggaccagcaatggctatgctaaaacagcctctcttggtggagggagccggctggagaaacaaagcctgactcatggcagcagcggctacataaactcaactggaagcacacgaggccatgcctccacctctagttacaggagggctcactcacctgcctccactctgcccaactccccaggctcaacctttgaaaggaaaactcacgttacccgccatgcgtatgaagggagctccagtggcaactcttctccggagtaccctcggaaggaatttgcatcttcttcaaccagaggacggagtcaaacacgagagagtgaaattcgagttcgactgcagagtgcgtccccatccacccgatggacagaattggatgatgttaagcgtttgctcaaggggagtcgatcggcaagtgtgagccccacccggaattcctccaacacactccccatccccaagaaaggcactgtggagaccaaaattgtgacagcgagctcccagtcggtgtcaggcacctacgatgcaacgatcctggatgccaaccttccctcccatgtgtggtcctccaccctgcccgcggggtcctccatggggacctatcacaacaacatgacaacccagagctcatccctcctcaacaccaatgcctactctgcgggatcagtcttcggagttccaaacaacatggcgtcctgctcacccactttgcaccctggactcagcacatcctcctcagtgtttggcatgcagaacaatctggcccccagcttgaccaccctgtcccatggcaccaccaccacttccacagcatatggggtgaagaaaaacatgccccagagtcctgcggctgtgaacactggcgtttccacctccgccgcctgcaccacaagtgtgcagagcgatgaccttttgcacaaggactgcaagttcctgatcctagagaaagacaacacacctgccaagaaggagatggagctgctcatcatgaccaaggacagcgggaaggtctttacagcctcccctgccagcatcgctgcaacttctttttcagaagacaccctaaaaaaagaaaagcaagctgcctacaatgctgactcaggcctaaaagccgaagctaatggagacctgaagactgtgtccacaaagggcaagaccaccactgcagatatccacagctacggcagcagtggtggtggtggcagtggaggaggtggcggtgttggtggcgctggcggcggcccttggggaccagcgccagcctggtgcccctgcggctcctgctgcagctggtggaagtggctgctgggcctgctgctcacctggctgctactcctggggctgctcttcggcctcattgctctggcggaggaggtgaggaagctgaaggcgcgtgtggatgagctggagaggatcaggaggagcatactgccctatggggacagcatggatagaatagaaaaggaccgcctccagggcatggcacccgcggcgggagcagacctggacaaaattgggctgcacagtgacagccaggaggagctctggatgttcgtgaggaagaagctaatgatggaacaggaaaatggaaatctccgaggaagccctggccctaaaggtgacatgggaagtccaggccctaaaggagatcgagggttccctgggactccaggtatccctgggcccttgggccacccaggtccacaaggaccaaagggtcaaaaaggcagcgtgggagatcctggcatggaaggccccatgggccagagagggcgagaaggccccatgggacctcgtggtgaggcagggcctcctggatctggagagaaaggggaaagaggggctgctggtgaaccaggtcctcatggcccacctggtgtcccaggttctgtgggtcccaaaggttccagcggctctcctggcccacagggccctccaggtcctgtaggtctccaagggctccgaggtgaagtaggacttcctggtgtcaaaggtgacaaaggaccaatgggaccaccaggacccaaaggtgaccagggtgagaaaggacctcgaggcctcacaggcgagcctggcatgagaggtttgcctggtgctgttggtgagcccggggctaaaggagcaatgggtcctgctggcccagacggacaccaaggcccaagaggtgaacaaggtcttactgggatgcctggaatccgtggcccaccaggaccttctggagacccaggaaagccaggtctcacaggaccccagggacctcagggacttcccggtacccctggccgaccaggaataaaaggtgaaccaggagctccaggcaagatcgtgacttcggaggggtcatcgatgctcactgtcccaggccccccaggacctcctggagccatgggacccccaggacctccaggtgccccaggccctgccggcccagctggtctcccaggacatcaagaagttcttaatttacaaggtcccccaggcccacccggcccacgcgggccaccagggccttccattccaggcccaccaggaccccgaggcccaccaggggagggtttgccaggcccaccaggcccaccaggatcgttcctgtccaactcagaaaccttcctctccggccccccaggcccacctggccccccaggtcccaagggagaccaaggtcccccaggccccagaggacaccaaggcgagcaaggcctcccaggtttctcaacctcagggtccagttctttcggactcaaccttcagggaccaccaggcccacctggcccccagggacccaaaggtgacaaaggtgatccaggtgttccaggggctcttggcattcctagtggtccttctgaagggggatcatcaagtaccatgtacgtgtcaggcccgccagggccccctgggccccctgggcctccgggctctatcagcagctctggccaggagattcagcagtacatctctgagtacatgcagagtgacagtattagatcttacctatccggagttcagggtcccccaggcccacctggtcccccaggacctgtcaccaccatcacaggcgagactttcgactactcagagctggcaagccacgttgtgagctacttacggacttcggggtacggtgtcagcttgttctcgtcctccatctcttctgaagacattctggctgtgctgcagcgggatgacgtgcgtcagtacctacgtcagtacttgatgggccctcggggtccgccagggccaccaggagccagtggagatgggtccctcctgtctttggactatgcagagctgagtagtcgcattctcagctacatgtcgagttctgggatcagcattgggcttcctggtcccccggggccccctggcttgccgggaacctcctatgaggagctcctctccttgctgcgagggtctgaattcagaggcatcgttggacccccaggtcccccgggtccaccagggatcccaggcaatgtgtggtccagcatcagcgtggaggacctctcgtcttacttacatactgccggcttgtcattcatcccaggccctccaggacctcctggtcccccagggcctcgagggcccccgggtgtctcaggagccctggcaacctatgcagctgaaaacagcgacagcttccggagcgagctgatcagctacctcacaagtcctgatgtgcgcagcttcattgttggccccccaggccctcctgggccgcagggaccccctggggacagccgcctcctgtccacggatgcctcccacagtcggggtagcagctcctcctcacacagctcatctgtcaggcggggcagctcctacagctcttccatgagcacaggaggaggtggtgcaggctccctgggtgcaggcggtgcctttggtgaagctgcaggagacaggggtccctatggcactgacatcggcccaggcggaggctatggggcagcagcagaaggcggcatgtatgctggcaatggcggactattgggagctgactttgctggagatctggattacaatgagctggctgtgagggtgtcagagagcatgcagcgtcagggcctactgcaagggatggcctacactgtccagggcccaccaggccagcctgggccacaggggccacccggcatcagcaaggtcttctctgcctacagcaacgtgactgcggacctcatggacttcttccaaacttatggagccattcaaggaccccctgggcaaaaaggagagatgggcactccaggacccaaaggtgacaggggccctgctgggccaccaggtcatcctgggccacctggccctcgaggacacaagggagaaaaaggagacaaaggtgaccaagtctatgctgggcggagaaggagaagaagtattgctgtcaagccgtgagctagccatggcaggacagctcctggaccaggtctcataatgcatgtggcacttaggtccaaggtctccagagggtgaaagctggagtctgtcaatgtcctactgagacagcacagccaacctagctagcaacatttgttttagtctgaacaatatatacttatagaattcagtcaaagatacacaatctgaaacagcttcatggggtggactctaacagtagttgcaatgttttagaatgagacttacttctctgctatctagatctgaactccttggcttctttacttagttcaagccccagcctaggaaagccagttacataaaagttggctcaggagtcttagagctttacctaaatatgagcccagaaaacggaggatgggggtggggcgccttcctggaggtgacacttgatgggggtgtgttctggttactgttctaaggctgtgccatcagctccttcctcccctgttcattctgcattctctagtcagttggctaagaagtgactcttgcaactaaaaaaattaagaaattcacttcccctctaggaggtgatgatagggtttctaatggttatatgtatatcacattcccatttgcttagaaagtctgattgtagctatgattgtccgtaggcccatactagagttcatggatatgttatactgaaccaggccagagcaaacagaaaaagaaggttgagggcaatggacaaggaaggaataaagggagaagagggaaaacagaaaacctgatgctggggacacagcatcagctcaagacgtcaccctccattctgcactcagaaaatggcacttgggggactgggcgcagttggtctttaaccacttttcaatgtctaaaaacatttgtttgtggtctataagatgaaacatcatttcaatcgtaaaatttcccattaaagaagtttttttttctaata

SEQ ID NO: 463 - DNA, 1610 bp, Homo sapiens
agagagagggggatttattcaaagttgtttccaattccttcaaaacctcaaaccaggtggctatggtatggatgtaaccaagaaaaacaaacgagatggaactgaagtcactgagagaattgtcactgaaacagtaaccacaagacttacatccttaccaccaaaaggcgggaccagcaatggctatgctaaaacagcctctcttggtggagggagccggctggagaaacaaagcctgactcatggcagcagcggctacataaactcaactggaagcacacgaggccatgcctccacctctagttacaggagggctcactcacctgcctccactctgcccaactccccaggctcaacctttgaaaggaaaactcacgttacccgccatgcgtatgaagggagctccagtggcaactcttctccggagtaccctcggaaggaatttgcatcttcttcaaccagaggacggagtcaaacacgagagagtgaaattcgagttcgactgcagagtgcgtccccatccacccgatggacagaattggatgatgttaagcgtttgctcaaggggagtcgatcggcaagtgtgagccccacccggaattcctccaacacactccccatccccaagaaaggcactgtggagaccaaaattgtgacagcgagctcccagtcggtgtcaggcacctacgatgcaacgatcctggatgccaaccttccctcccatgtgtggtcctccaccctgcccgcggggtcctccatggggacctatcacaacaacatgacaacccagagctcatccctcctcaacaccaatgcctactctgcgggatcagtcttcggagttccaaacaacatggcgtcctgctcacccactttgcaccctggactcagcacatcctcctcagtgtttggcatgcagaacaatctggcccccagcttgaccaccctgtcccatggcaccaccaccacttccacagcatatggggtgaagaaaaacatgccccagagtcctgcggctgtgaacactggcgtttccacctccgccgcctgcaccacaagtgtgcagagcgatgaccttttgcacaaggactgcaagttcctgatcctagagaaagacaacacacctgccaagaaggagatggagctgctcatcatgaccaaggacagcgggaaggtctttacagcctcccctgccagcatcgctgcaacttctttttcagaagacaccctaaaaaaagaaaagcaagctgcctacaatgctgactcaggcctaaaagccgaagctaatggtaagaacaaatatgattgttgtccaccttgacttcagccaggccacatttcatttcattgtcttcggagaccttgctactcaaagtgtggtccacgggccagcagcatcagccacacctgggagtgtgttataaaagcaggatcccagccctagctcagatctgctgagtcagaagctgcagttcaacaagcttcctaggtgatttgcatttgcattactgaagcaaaagcctgcctctgccatgtctacgaaggcatttgttttctcattttactttttctccataatcttcagaactaatagaaaaatgctttgcaaa

SEQ ID NO: 464 - DNA, 537 bp, Homo sapiens
cttatggagccattcaaggaccccctgggcaaaaaggagagatgggcactccaggacccaaaggtgacaggggccctgctgggccaccaggtcatcctgggccacctggccctcgaggacacaagggagaaaaaggagacaaaggtgaccaagtctatgctgggcggagaaggagaagaagtattgctgtcaagccgtgagctagccatggcaggacagctcctggaccaggcccatactagagttcatggatatgttatactgaaccaggccagagcaaacagaaaaagaaggttgagggcaatggacaaggaaggaataaagggagaagagggaaaacagaaaacctgatgctggggacacagcatcagctcaagacgtcaccctccattctgcactcagaaaatggcacttgggggactgggcgcagttggtctttaaccacttttcaatgtctaaaaacatttgtttgtggtctataagatgaaacatcatttcaatcgtaaaatttcccattaaagaagtttttttttctaa

SEQ ID NO: 465 - DNA, 5553 bp, Homo sapiens
gaaagatcactcagctttaacacaccttggctgggtctggataaaaaaaaagtgagcactgcaaatttctagaagaaaacatcaggagaagaaagagagagggggatttattcaaagttgtttccaattccttcaaaacctcaaaccaggtggctatggtatggatgtaaccaagaaaaacaaacgagatggaactgaagtcactgagagaattgtcactgaaacagtaaccacaagacttacatccttaccaccaaaaggcgggaccagcaatggctatgctaaaacagcctctcttggtggagggagccggctggagaaacaaagcctgactcatggcagcagcggctacataaactcaactggaagcacacgaggccatgcctccacctctagttacaggagggctcactcacctgcctccactctgcccaactccccaggctcaacctttgaaaggaaaactcacgttacccgccatgcgtatgaagcatcttcttcaaccagaggacggagtcaaacacgagagagtgaaattcgagttcgactgcagagtgcgtccccatccacccgatggacagaattggatgatgttaagcgtttgctcaaggggagtcgatcggcaagtgtgagccccacccggaattcctccaacacactccccatccccaagaaaggcactgtggagaccaaaattgtgacagcgagctcccagtcggtgtcaggcacctacgatgcaacgatcctggatgccaaccttccctcccatgtgtggtcctccaccctgcccgcggggtcctccatggggacctatcacaacaacatgacaacccagagctcatccctcctcaacaccaatgcctactctgcgggatcagtcttcggagttccaaacaacatggcgtcctgctcacccactttgcaccctggactcagcacatcctcctcagtgtttggcatgcagaacaatctggcccccagcttgaccaccctgtcccatggcaccaccaccacttccacagcatatggggtgaagaaaaacatgccccagagtcctgcggctgtgaacactggcgtttccacctccgccgcctgcaccacaagtgtgcagagcgatgaccttttgcacaaggactgcaagttcctgatcctagagaaagacaacacacctgccaagaaggagatggagctgctcatcatgaccaaggacagcgggaaggtctttacagcctcccctgccagcatcgctgcaacttctttttcagaagacaccctaaaaaaagaaaagcaagctgcctacaatgctgactcaggcctaaaagccgaagctaatggagacctgaagactgtgtccacaaagggcaagaccaccactgcagatatccacagctacggcagcagtggtggtggtggcagtggaggaggtggcggtgttggtggcgctggcggcggcccttggggaccagcgccagcctggtgcccctgcggctcctgctgcagctggtggaagtggctgctgggcctgctgctcacctggctgctactcctggggctgctcttcggcctcattgctctggcggaggaggtgaggaagctgaaggcgcgtgtggatgagctggagaggatcaggaggagcatactgccctatggggacagcatggatagaatagaaaaggaccgcctccagggcatggcacccgcggcgggagcagacctggacaaaattgggctgcacagtgacagccaggaggagctctggatgttcgtgaggaagaagctaatgatggaacaggaaaatggaaatctccgaggaagccctggccctaaaggtgacatgggaagtccaggccctaaaggagatcgagggttccctgggactccaggtatccctgggcccttgggccacccaggtccacaaggaccaaagggtcaaaaaggcagcgtgggagatcctggcatggaaggccccatgggccagagagggcgagaaggccccatgggacctcgtggtgaggcagggcctcctggatctggagagaaaggggaaagaggggctgctggtgaaccaggtcctcatggcccacctggtgtcccaggttctgtgggtcccaaaggttccagcggctctcctggcccacagggccctccaggtcctgtaggtctccaagggctccgaggtgaagtaggacttcctggtgtcaaaggtgacaaaggaccaatgggaccaccaggacccaaaggtgaccagggtgagaaaggacctcgaggcctcacaggcgagcctggcatgagaggtttgcctggtgctgttggtgagcccggggctaaaggagcaatgggtcctgctggcccagacggacaccaaggcccaagaggtgaacaaggtcttactgggatgcctggaatccgtggcccaccaggaccttctggagacccaggaaagccaggtctcacaggaccccagggacctcagggacttcccggtacccctggccgaccaggaataaaaggtgaaccaggagctccaggcaagatcgtgacttcggaggggtcatcgatgctcactgtcccaggccccccaggacctcctggagccatgggacccccaggacctccaggtgccccaggccctgccggcccagctggtctcccaggacatcaagaagttcttaatttacaaggtcccccaggcccacccggcccacgcgggccaccagggccttccattccaggcccaccaggaccccgaggcccaccaggggagggtttgccaggcccaccaggcccaccaggatcgttcctgtccaactcagaaaccttcctctccggccccccaggcccacctggccccccaggtcccaagggagaccaaggtcccccaggccccagaggacaccaaggcgagcaaggcctcccaggtttctcaacctcagggtccagttctttcggactcaaccttcagggaccaccaggcccacctggcccccagggacccaaaggtgacaaaggtgatccaggtgttccaggggctcttggcattcctagtggtccttctgaagggggatcatcaagtaccatgtacgtgtcaggcccgccagggccccctgggccccctgggcctccgggctctatcagcagctctggccaggagattcagcagtacatctctgagtacatgcagagtgacagtattagatcttacctatccggagttcagggtcccccaggcccacctggtcccccaggacctgtcaccaccatcacaggcgagactttcgactactcagagctggcaagccacgttgtgagctacttacggacttcggggtacggtgtcagcttgttctcgtcctccatctcttctgaagacattctggctgtgctgcagcgggatgacgtgcgtcagtacctacgtcagtacttgatgggccctcggggtccgccagggccaccaggagccagtggagatgggtccctcctgtctttggactatgcagagctgagtagtcgcattctcagctacatgtcgagttctgggatcagcattgggcttcctggtcccccggggccccctggcttgccgggaacctcctatgaggagctcctctccttgctgcgagggtctgaattcagaggcatcgttggacccccaggtcccccgggtccaccagggatcccaggcaatgtgtggtccagcatcagcgtggaggacctctcgtcttacttacatactgccggcttgtcattcatcccaggccctccaggacctcctggtcccccagggcctcgagggcccccgggtgtctcaggagccctggcaacctatgcagctgaaaacagcgacagcttccggagcgagctgatcagctacctcacaagtcctgatgtgcgcagcttcattgttggccccccaggccctcctgggccgcagggaccccctggggacagccgcctcctgtccacggatgcctcccacagtcggggtagcagctcctcctcacacagctcatctgtcaggcggggcagctcctacagctcttccatgagcacaggaggaggtggtgcaggctccctgggtgcaggcggtgcctttggtgaagctgcaggagacaggggtccctatggcactgacatcggcccaggcggaggctatggggcagcagcagaaggcggcatgtatgctggcaatggcggactattgggagctgactttgctggagatctggattacaatgagctggctgtgagggtgtcagagagcatgcagcgtcagggcctactgcaagggatggcctacactgtccagggcccaccaggccagcctgggccacaggggccacccggcatcagcaaggtcttctctgcctacagcaacgtgactgcggacctcatggacttcttccaaacttatggagccattcaaggaccccctgggcaaaaaggagagatgggcactccaggacccaaaggtgacaggggccctgctgggccaccaggtcatcctgggccacctggccctcgaggacacaagggagaaaaaggagacaaaggtgaccaagtctatgctgggcggagaaggagaagaagtattgctgtcaagccgtgagctagccatggcaggacagctcctggaccaggtctcataatgcatgtggcacttaggtccaaggtctccagagggtgaaagctggagtctgtcaatgtcctactgagacagcacagccaacctagctagcaacatttgttttagtctgaacaatatatacttatagaattcagtcaaagatacacaatctgaaacagcttcatggggtggactctaacagtagttgcaatgttttagaatgagacttacttctctgctatctagatctgaactccttggcttctttacttagttcaagccccagcctaggaaagccagttacataaaagttggctcaggagtcttagagctttacctaaatatgagcccagaaaacggaggatgggggtggggcgccttcctggaggtgacacttgatgggggtgtgttctggttactgttctaaggctgtgccatcagctccttcctcccctgttcattctgcattctctagtcagttggctaagaagtgactcttgcaactaaaaaaattaagaaattcacttcccctctaggaggtgatgatagggtttctaatggttatatgtatatcacattcccatttgcttagaaagtctgattgtagctatgattgtccgtaggcccatactagagttcatggatatgttatactgaaccaggccagagcaaacagaaaaagaaggttgagggcaatggacaaggaaggaataaagggagaagagggaaaacagaaaacctgatgctggggacacagcatcagctcaagacgtcaccctccattctgcactcagaaaatggcacttgggggactgggcgcagttggtctttaaccacttttcaatgtctaaaaacatttgtttgtggtctataagatgaaacatcatttcaatcgtaaaatttcccattaaagaagtttttttttctaa

SEQ ID NO: 466 - DNA, 4267 bp, Homo sapiens
ataagctccagccttcctgtggccacagcaggaccagagtggaccagcacaccccaggagagaggactggggtcccaggagtaggaggagcccgagcaccatgagctccggagaccctgcacacctcggcctctgcctctggctgtggctgggcgccaccctgggaagagagcaagttcaagcaagcggtctcctgaggctggctgtgctgcctgaggaccggctgcagatgaagtggagagagtcggaggggagcggcctcggctacctggtgcaggtgaagcccatggcaggggactcggaacaggaggtgatactgaccaccaagacccctaaggccacagtggggggcctgagcccctccaagggctacaccttgcagatcttcgagctcactggctctgggcgcttcctgctagctcggagggagtttgtgattgaggatctgaagagtagctccctggacaggagcagccagaggcccctcggctctggagccccggagcccaccccctcccacacggggagcccagaccctgagcaggcttctgagccccaagttgccttcacaccaagccaggatccgcgcactcctgccggcccccagttccgctgcctgccccccgtgcctgctgacatggtcttcctggtggacgggtcctggagcattggccacagtcacttccagcaggtcaaggacttcctggccagtgtcatcgcaccctttgaaatcgggccggataaggtccaagtaggcctgactcagtacagcggggatgctcagactgagtgggacctgaactccctcagcaccaaggaacaggtgctggcagctgtgcgccgcctccgctacaagggggggaacacgttcacaggccttgccctgacccacgtgctggggcagaacctgcagccggcggctggcctccgtccagaggcagccaaggtggtgattctggtgacggacggcaagtcccaggacgatgtgcacactgctgcccgtgtcctcaaggacctgggcgtgaacgtcttcgctgtgggtgtgaagaacgccgatgaggctgagctgaggctcctggcgtccccgccgagggacatcaccgtccacagcgtgctggacttcctgcagctcggcgcgctggctggcctgctcagccgtctcatctgccagaggctccagggtgggagcccgcggcagggcccagcagcggctccagccctggacaccctccctgcccccaccagcctggtcctgagccaggtgacctcctccagcatccgcctgtcctggactccagccccccggcaccccctcaagtatctgatcgtttggcgagcctctagaggtggcacccccagggaggtggtggtggagggacccgccgcctccacggagctgcacaacctggcctcccgcacagagtacctggtctccgtgttccccatctatgagggcggggttggcgaaggcctgcggggcctggtgaccacagcacctctgcctccgccccgggcgctgaccctggccgcagtgacgcccagaaccgtccacctcacctggcagccctcggccggggccacccactacctggtgcgatgttctcctgcttcccccaagggtgaagaggaggagcgagaggtgcaggtcgggcggcccgaggtgctgctggatggcctggaacctggcagggactatgaggtctcggtgcagagcctgcgaggccctgagggcagcgaggcccggggcatccgtgccaggacccccaccctggcccccccgagacacctgggcttctcagacgtgagccacgacgcggcacgagtgttctgggagggtgccccgaggcctgtgcgcctggtcagggtcacctatgtgtccagcgagggtggacactcggggcagacagaggctcctgggaacgccacctcggccacgctggggcctctctcttcctccaccacctacactgtccgtgtcacctgcctctaccctgggggtggctcctctacgctgactggccgggtgaccaccaagaaagctcccagcccaagccagctgtccatgacggagctgccaggggatgcagtccagctggcgtgggtggccgcagccccgtctggcgtgcttgtctaccagatcacgtggacgcccctgggagaggggaaggctcacgagatctctgtcccagggaacctcggcacggccgtcctgcctggcctagggaggcacacagagtacgacgtcaccatcttggcctactacagggacggggcccgcagtgaccctgtgtccctccgctataccccctccacggtgagcaggagcccaccctccaacctggccctggcctcggagacccccgacagcctgcaggtcagctggacgcccccgcttggccgcgtgctccattactggctcacctacgcccccgcctctggcttgggacccgagaaatccgtctctgtgccaggagccaggagccacgtgacactgcccgacctgcaggcagccacgaagtacagggtcctggtctcagctatctatgcagcaggcaggagtgaggctgtgtctgccacgggccagacagcctgcccagccctccgccctgacggctccctcccagggtttgacctgatggtggccttcagcctggtggaaaaggcttatgcgtccatccggggcgtggccatggagccctctgccttcggtgggaccccgaccttcacgctcttcaaggacgcccagctgacaagacgggtcagtgacgtctacccagcccccctacctccagagcacaccatcgtcttccttgtgcgcctacttcccgagacaccccgtgaggccttcgcgctgtggcagatgacagccgaggacttccagcccctccttggggttctgctggatgccgggaagaagtccctgacctacttccaccgtgaccccagggctgccttgcaggaggccaccttcgacccgcaggaagtgaggaagattttcttcgggagcttccacaaggtgcacgtggctgtgggccgctccaaggtcaggctctatgtggactgccggaaggtggctgagcggccccttggggagatgggcagcccacccgctgcgggcttcgtcacgctggggaggctggccaaggccaggggcccccggagcagttcggccgcgtttcagctccagatgctgcagatcgtgtgcagtgacacctgggccgatgaggaccggtgctgtgagctccctgcctcgagggatggagagacctgccccgccttcgtgtctgcctgttcctgttcctcagagacccctgggcccccaggacctcaaggacccccaggcctccctgggaggaatggcaccccaggagagcagggcttcccagggcccaggggagagcccgggccacccggacagatgggaccagaaggtcctggaggccagcagggctcgccggggacccagggccgtgcagtccaggggcctgtgggtccaccaggggtcaaaggagagaagggagaccatgggcttccaggcttgcagggccaccccggccaccagggcatccccgggagagttggcctccagggaccaaagggaatgagaggcctggagggaactgctggcctgcctggaccccctggccccagggggttccagggcatggcaggggccaggggcactagtggagagcgaggacctccagggaccgtggggcccacaggactgccagggcccaaaggggaacgaggagagaagggcgagccgcagtcccttgccaccctctaccagcttgtgagccaggcctcacacgtgtcaaagttcgactccttccacgagaacaccaggccccccatgcccatcttggagcagaagctggagccgggcactgagcccctggggtcccctggcacccgcagcaaggccctggttcctggagaatgggggcgtggtggccgccaccttgagggcagaggggagcctggagctgttggtcagatgggcagccctgggcagcagggggctagcacccagggcctctgggagtgacaggacattttctgcactgccccgaggaacgctgagccttcctccctgggtttgtctggacaccgagagcgaccacatcctggagaagccaggagaaaagctcaggaagagcctgcaggtggaaggagagggaagcagcggcctcggccaaggcccaccccatactcttggctctgtagcatttccaagttcagataaacccctgagtgctcaccc

SEQ ID NO: 467 - DNA, 4172 bp, Homo sapiens
ataagctccagccttcctgtggccacagcaggaccagagtggaccagcacaccccaggagagaggactggggtcccaggagtaggaggagcccgagcaccatgagctccggagaccctgcacacctcggcctctgcctctggctgtggctgggcgccaccctgggaagagagcaagttcaagcaagcggtctcctgaggctggctgtgctgcctgaggaccggctgcagatgaagtggagagagtcggaggggagcggcctcggctacctggtgcaggtgaagcccatggcaggggactcggaacaggaggtgatactgaccaccaagacccctaaggccacagtggggggcctgagcccctccaagggctacaccttgcagatcttcgagctcactggctctgggcgcttcctgctagctcggagggagtttgtgattgaggatctgaagagtagctccctggacaggagcagccagaggcccctcggctctggagccccggagcccaccccctcccacacggggagcccagaccctgagcaggcttctgagccccaagttgccttcacaccaagccaggatccgcgcactcctgccggcccccagttccgctgcctgccccccgtgcctgctgacatggtcttcctggtggacgggtcctggagcattggccacagtcacttccagcaggtcaaggacttcctggccagtgtcatcgcaccctttgaaatcgggccggataaggtccaagtaggcctgactcagtacagcggggatgctcagactgagtgggacctgaactccctcagcaccaaggaacaggtgctggcagctgtgcgccgcctccgctacaagggggggaacacgttcacaggccttgccctgacccacgtgctggggcagaacctgcagccggcggctggcctccgtccagaggcagccaaggtggtgattctggtgacggacggcaagtcccaggacgatgtgcacactgctgcccgtgtcctcaaggacctgggcgtgaacgtcttcgctgtgggtgtgaagaacgccgatgaggctgagctgaggctcctggcgtccccgccgagggacatcaccgtccacagcgtgctggacttcctgcagctcggcgcgctggctggcctgctcagccgtctcatctgccagaggctccagggtgggagcccgcggcagggcccagcagcggctccagccctggacaccctccctgcccccaccagcctggtcctgagccaggtgacctcctccagcatccgcctgtcctggactccagccccccggcaccccctcaagtatctgatcgtttggcgagcctctagaggtggcacccccagggaggtggtggtggagggacccgccgcctccacggagctgcacaacctggcctcccgcacagagtacctggtctccgtgttccccatctatgagggcggggttggcgaaggcctgcggggcctggtgaccacagcacctctgcctccgccccgggcgctgaccctggccgcagtgacgcccagaaccgtccacctcacctggcagccctcggccggggccacccactacctggtgcgatgttctcctgcttcccccaagggtgaagaggaggagcgagaggtgcaggtcgggcggcccgaggtgctgctggatggcctggaacctggcagggactatgaggtctcggtgcagagcctgcgaggccctgagggcagcgaggcccggggcatccgtgccaggacccccaccctggcccccccgagacacctgggcttctcagacgtgagccacgacgcggcacgagtgttctgggagggtgccccgaggcctgtgcgcctggtcagggtcacctatgtgtccagcgagggtggacactcggggcagacagaggctcctgggaacgccacctcggccacgctggggcctctctcttcctccaccacctacactgtccgtgtcacctgcctctaccctgggggtggctcctctacgctgactggccgggtgaccaccaagaaagctcccagcccaagccagctgtccatgacggagctgccaggggatgcagtccagctggcgtgggtggccgcagccccgtctggcgtgcttgtctaccagatcacgtggacgcccctgggagaggggaaggctcacgagatctctgtcccagggaacctcggcacggccgtcctgcctggcctagggaggcacacagagtacgacgtcaccatcttggcctactacagggacggggcccgcagtgaccctgtgtccctccgctataccccctccacggtgagcaggagcccaccctccaacctggccctggcctcggagacccccgacagcctgcaggtcagctggacgcccccgcttggccgcgtgctccattactggctcacctacgcccccgcctctggcttgggacccgagaaatccgtctctgtgccaggagccaggagccacgtgacactgcccgacctgcaggcagccacgaagtacagggtcctggtctcagctatctatgcagcaggcaggagtgaggctgtgtctgccacgggccagacagcctgcccagccctccgccctgacggctccctcccagggtttgacctgatggtggccttcagcctggtggaaaaggcttatgcgtccatccggggcgtggccatggagccctctgccttcggtgggaccccgaccttcacgctcttcaaggacgcccagctgacaagacgggtcagtgacgtctacccagcccccctacctccagagcacaccatcgtcttccttgtgcgcctacttcccgagacaccccgtgaggccttcgcgctgtggcagatgacagccgaggacttccagcccctccttggggttctgctggatgccgggaagaagtccctgacctacttccaccgtgaccccagggctgccttgcaggaggccaccttcgacccgcaggaagtgaggaagattttcttcgggagcttccacaaggtgcacgtggctgtgggccgctccaaggtcaggctctatgtggactgccggaaggtggctgagcggccccttggggagatgggcagcccacccgctgcgggcttcgtcacgctggggaggctggccaaggccaggggcccccggagcagttcggccgcgtttcagctccagatgctgcagatcgtgtgcagtgacacctgggccgatgaggaccggtgctgtgagctccctgcctcgagggatggagagacctgccccgccttcgtgtctgcctgttcctgttcctcagagacccctgggcccccaggacctcaaggacccccaggcctccctgggaggaatggcaccccaggagagcagggcttcccagggcccaggggtccaccaggggtcaaaggagagaagggagaccatgggcttccaggcttgcagggccaccccggccaccagggcatccccgggagagttggcctccagggaccaaagggaatgagaggcctggagggaactgctggcctgcctggaccccctggccccagggggttccagggcatggcaggggccaggggcactagtggagagcgaggacctccagggaccgtggggcccacaggactgccagggcccaaaggggaacgaggagagaagggcgagccgcagtcccttgccaccctctaccagcttgtgagccaggcctcacacgtgtcaaagttcgactccttccacgagaacaccaggccccccatgcccatcttggagcagaagctggagccgggcactgagcccctggggtcccctggcacccgcagcaaggccctggttcctggagaatgggggcgtggtggccgccaccttgagggcagaggggagcctggagctgttggtcagatgggcagccctgggcagcagggggctagcacccagggcctctgggagtgacaggacattttctgcactgccccgaggaacgctgagccttcctccctgggtttgtctggacaccgagagcgaccacatcctggagaagccaggagaaaagctcaggaagagcctgcaggtggaaggagagggaagcagcggcctcggccaaggcccaccccatactcttggctctgtagcatttccaagttcagataaacccctgagtgctcaccca

SEQ ID NO: 468 - DNA, 8097 bp, Homo sapiens
gtcagggagaggacagacggggggacggctgaagggcatggcctcttccctgccacagcccgagcaccatgagctccggagaccctgcacacctcggcctctgcctctggctgtggctgggcgccaccctgggaagagagcaagttcaagcaagcggtctcctgaggctggctgtgctgcctgaggaccggctgcagatgaagtggagagagtcggaggggagcggcctcggctacctggtgcaggtgaagcccatggcaggggactcggaacaggaggtgatactgaccaccaagacccctaaggccacagtggggggcctgagcccctccaagggctacaccttgcagatcttcgagctcactggctctgggcgcttcctgctagctcggagggagtttgtgattgaggatctgaagagtagctccctggacaggagcagccagaggcccctcggctctggagccccggagcccaccccctcccacacggggagcccagaccctgagcaggcttctgagccccaagttgccttcacaccaagccaggatccgcgcactcctggtgggtcagagtggagagagaccggcccccagttccgctgcctgccccccgtgcctgctgacatggtcttcctggtggacgggtcctggagcattggccacagtcacttccagcaggtcaaggacttcctggccagtgtcatcgcaccctttgaaatcgggccggataaggtccaagtaggcctgactcagtacagcggggatgctcagactgagtgggacctgaactccctcagcaccaaggaacaggtgctggcagctgtgcgccgcctccgctacaagggggggaacacgttcacaggccttgccctgacccacgtgctggggcagaacctgcagccggcggctggcctccgtccagaggcagccaaggtggtgattctggtgacggacggcaagtcccaggacgatgtgcacactgctgcccgtgtcctcaaggacctgggcgtgaacgtcttcgctgtgggtgtgaagaacgccgatgaggctgagctgaggctcctggcgtccccgccgagggacatcaccgtccacagcgtgctggacttcctgcagctcggcgcgctggctggcctgctcagccgtctcatctgccagaggctccagggtgggagcccgcggcagggcccagcagcggctccagccctggacaccctccctgcccccaccagcctggtcctgagccaggtgacctcctccagcatccgcctgtcctggactccagccccccggcaccccctcaagtatctgatcgtttggcgagcctctagaggtggcacccccagggaggtggtggtggagggacccgccgcctccacggagctgcacaacctggcctcccgcacagagtacctggtctccgtgttccccatctatgagggcggggttggcgaaggcctgcggggcctggtgaccacagcacctctgcctccgccccgggcgctgaccctggccgcagtgacgcccagaaccgtccacctcacctggcagccctcggccggggccacccactacctggtgcgatgttctcctgcttcccccaagggtgaagaggaggagcgagaggtgcaggtcgggcggcccgaggtgctgctggatggcctggaacctggcagggactatgaggtctcggtgcagagcctgcgaggccctgagggcagcgaggcccggggcatccgtgccaggacccccaccctggcccccccgagacacctgggcttctcagacgtgagccacgacgcggcacgagtgttctgggagggtgccccgaggcctgtgcgcctggtcagggtcacctatgtgtccagcgagggtggacactcggggcagacagaggctcctgggaacgccacctcggccacgctggggcctctctcttcctccaccacctacactgtccgtgtcacctgcctctaccctgggggtggctcctctacgctgactggccgggtgaccaccaagaaagctcccagcccaagccagctgtccatgacggagctgccaggggatgcagtccagctggcgtgggtggccgcagccccgtctggcgtgcttgtctaccagatcacgtggacgcccctgggagaggggaaggctcacgagatctctgtcccagggaacctcggcacggccgtcctgcctggcctagggaggcacacagagtacgacgtcaccatcttggcctactacagggacggggcccgcagtgaccctgtgtccctccgctataccccctccacggtgagcaggagcccaccctccaacctggccctggcctcggagacccccgacagcctgcaggtcagctggacgcccccgcttggccgcgtgctccattactggctcacctacgcccccgcctctggcttgggacccgagaaatccgtctctgtgccaggagccaggagccacgtgacactgcccgacctgcaggcagccacgaagtacagggtcctggtctcagctatctatgcagcaggcaggagtgaggctgtgtctgccacgggccagacagcctgcccagccctccgccctgacggctccctcccagggtttgacctgatggtggccttcagcctggtggaaaaggcttatgcgtccatccggggcgtggccatggagccctctgccttcggtgggaccccgaccttcacgctcttcaaggacgcccagctgacaagacgggtcagtgacgtctacccagcccccctacctccagagcacaccatcgtcttccttgtgcgcctacttcccgagacaccccgtgaggccttcgcgctgtggcagatgacagccgaggacttccagcccctccttggggttctgctggatgccgggaagaagtccctgacctacttccaccgtgaccccagggctgccttgcaggaggccaccttcgacccgcaggaagtgaggaagattttcttcgggagcttccacaaggtgcacgtggctgtgggccgctccaaggtcaggctctatgtggactgccggaaggtggctgagcggccccttggggagatgggcagcccacccgctgcgggcttcgtcacgctggggaggctggccaaggccaggggcccccggagcagttcggccgcgtttcagctccagatgctgcagatcgtgtgcagtgacacctgggccgatgaggaccggtgctgtgagctccctgcctcgagggatggagagacctgccccgccttcgtgtctgcctgttcctgttcctcagagacccctgggcccccaggacctcaaggacccccaggcctccctgggaggaatggcaccccaggagagcagggcttcccagggcccaggggtccaccaggggtcaaaggagagaagggagaccatgggcttccaggcttgcagggccaccccggccaccagggcatccccgggagagttggcctccagggaccaaagggaatgagaggcctggagggaactgctggcctgcctggaccccctggccccagggggttccagggcatggcaggggccaggggcactagtggagagcgaggacctccagggaccgtggggcccacaggactgccagggcccaaaggggaacgaggagagaagggcgagccgcagtcccttgccaccctctaccagcttgtgagccaggcctgtgagtctgccattcagacacacgtgtcaaagttcgactccttccacgagaacaccaggccccccatgcccatcttggagcagaagctggagccgggcactgagcccctggggtcccctggcacccgcagcaaggccctggttcctggagaatgggggcgtggtggccgccaccttgagggcagaggggagcctggagctgttggtcagatgggcagccctgggcagcagggggctagcacccagggcctctgggagtgacaggacattttctgcactgccccgaggaacgctgagccttcctccctgggtttgtctggacaccgagagcgaccacatcctggagaagccaggagaaaagctcaggaagagcctgcaggtggaaggagagggaagcagcggcctcggccaaggcccaccccatactcttggctctgtagcatttccaagttcagataaacccctgagtgctcacccagccaagcgaggcgggagtcatttcctgggagagtgtcccccaccctggctctgtgcaccccaccttgaggccctgcagcttcagccgcagtggggaaggggaggggctgggctgatggcgaatcgggttcaggagggcagcagtgccctgtggccgtctcagtagctctaaaacaggctcaacaacatgccccgcccctttctctgggcctcatctaagcctggccagggccctgtgggcccgcctctctctgcgcctcacgcaggcaacagatggttccactgctggcccaccagtcacctgcacgatggctcctccctcagaacagcactcccaccccggccccagcaccttcacatctgggcacaggcaggtccctgcctgcctcatcgtcccctctgtccccagcccaagaaggagttcagatcctgtgtgtgaatggccacccctcacccacccagccctgtgctgagttccttgtgcagggacattgctttgagacttggcaccatcagcccctggtccttagggtctcagagcaaggtcatccctcagcaggcttctggcctgtgcgctcctcagcacctctgcccaggtctctcccaaccatcacagacgctgtgtgagcctggacttcctgccttatccccactgtggcccaaacagcatgggggcaagctcagaacacacacctgggcttctgggccttgtggcccgtgggggtgatgtgggaacttctacttcctttccaaacaaatattcagtaactagtccactgttaccacttaggcagctaagcaagaaaggtgccagaaatgaagagggaagccatatcattgaggagagaatgaaaagtattaaaaaggaacaaagagagacccttgatattgacagaaggaaaacccaccaagatcaccagtgcagcattgcgtgcaccaaagcataccccaaagaggtgagcgcaaaacagcttcagggcaaacacttcatctatgattcaactgttccaggaactgaccagacctggagaccaaatagagagtcataggcagggtcagcaggatgggagagagcgcctgcacccacaggagccacagccctgactgaggccaggaagcagccccaaatgccagctcccactgcagcatgagaacagaaacagaccactgaaaattcccaaagtctgtggacaaatcagacgtcgaagaagtcacgtggcatcgagacagattttgcactgagggacaaggagagcatgtggccaaagtaggtgcaggtaaagcagcatctggggcagagttatagccttcagtgcaggtatcagacacagttgttgagagcagcagcccaagccagcccctccgtcctgcagggaggacacctaggtcacttggcttctgttggggagctgagttgcttcagattgtgtgaccagcaaaacagcttggttgctctcacttggtttctccagggcggggaattacatgtccccagctgaactgagaaggctctttgagcagtggagtgagcaggctttgtcatgaggcaggagtggggctagaatcaagcccagagcccacagggcatccagagccttccaaaggagcccctctcctggggctctccaatttgatgaagggactgggcactgggtggctgagaccacattggcagccaggaggaggcagcctggccggggggaaccagggtggctctaatccccaccaccccctcagctgccctacccccgccacgctggtgtgacaccagtgatgctcagcctcaaaaggggagtccggctgtcttcgggaaactgactttatgctggaggccaattaaaatggcacagcaaaggcagcggccagctggtgcccaggcagcttagggactggtccctgaggccccacccgccccagcctgtgcagtggagctgagtacgaatcaaaggtgaggatggcaagggagctgagagcagcctccggatgcaccaaaccggcctggctcctgtttgcaggaaggcagcctccccgagacccagccgacctgcacgtctcccatcagccccgactccaccgcatccctctgggtccttttaggagcccccagggactgagccggggctcacgctcctggccagagcgctgggtttctggcaatgcctcccctcctgcctttacggccacagctctcccctccagaggcccctctgtagtgggcctcggtcccctctccacccccagaggcagcacagcttcagccctacgcagtgtgggggctccgggaggaaatgcagggaggtgcttggtcttggcccagagctcatggccttaggtgctgcccccagtcacccccgtgcccatgcagccggggatgttcagctcaggccagccaccgaggtggtgtgacgcaaggctgatctgacgctcagctcaggccgctggggtcatgggggttgtgggaaggtcatggaatcacggggctcacgctggggtcacagggtggtgtggctgtgtggactgtaaggggcgtgcagccatgcgtatctgacctgccctccctaggtctgcaggcagtgccgagtggctctgcctgaggccccaagagcgaccttggaagctccaggccttcacagcccctctgagagccacctgcaaggtggggagctgggaagaacggctcagtgatgagctcagagggaggggtgggcacagcgcccaggaaggcgggtgcgtgcaggcctgggaggaatgtgtagcaggaggcagggggtgctgtgcccgcaggaccagcaggtgaggcgtgtccacccacagaggatggctctggcccaggcagtgtcagaaatggaagctgaggaaacccaaccccagctgtagaggagcctgccccgatgccatctgcacctggggggcgacgtatggctgccagcctcttcatctaccaaggaccagggcagtggggacgggagagctgggacacgtggactcacaccagggcagatggtgggggaagccagtgtctgtagattcagtgcatttcttggggaagggcgtggaacatttggacttgagccccagcacagagacgatgtcataatacagccccccatcgtgatctgatggtaagtacagaactccttgcccagtggagaaacactctcctctcatgtgtggaatatccacacactaaccatgaactgggccataagaaaccttacattccaaaggatcctgctgttcagaactcactcactcactgatgaaactggaaaaacaaccaatgataacaagctaaagaatgcctctagaagctaaaagacacacccatgactccacagtaattcatgggttaaagagaaaaaaggaaacgtgaagatacttgtaaccaaataatgatggatgcagcgccacgtcagaatctctgtgctgcagctgcagtggtacctagagggcaatttatagctgtaaatacagtgctttgttttgttttcttgttttttgagacaaggtcttgctctgtcacccaggctggagtacagtggcatgatctcggctcaatgcaacctctgtgccaccctgggctcaagtggtcctcctgctccggtcttctgagtagcaggaaccacaggcgtgcgccaccacgcttggctaatgttttttgtatttttttaaatagagacagggtgttgccgtgttacccaggctggtcttgaacttctgagctcaaacgatccaccctccttggcctcccaaagtggtgggattacaggtgtgagtcacctcaccggcccttaaacacagtttttagggaagattccaactcaaacaattttaaatagtagaaaataaaccctgaagcagtgtgcattcattagtactgtgtttgcctgtatttaattaaaacctgattgccattggc

SEQ ID NO: 469 - DNA, 4210 bp, Homo sapiens
ataagctccagccttcctgtggccacagcaggaccagagtggaccagcacaccccaggagagaggactggggtcccaggagtaggaggagcccgagcaccatgagctccggagaccctgcacacctcggcctctgcctctggctgtggctgggcgccaccctgggaagagagcaagttcaagcaagcggtctcctgaggctggctgtgctgcctgaggaccggctgcagatgaagtggagagagtcggaggggagcggcctcggctacctggtgcaggtgaagcccatggcaggggactcggaacaggaggtgatactgaccaccaagacccctaaggccacagtggggggcctgagcccctccaagggctacaccttgcagatcttcgagctcactggctctgggcgcttcctgctagctcggagggagtttgtgattgaggatctgaagagtagctccctggacaggagcagccagaggcccctcggctctggagccccggagcccaccccctcccacacggggagcccagaccctgagcaggcttctgagccccaagttgccttcacaccaagccaggatccgcgcactcctggtgggtcagagtggagagagaccggcccccagttccgctgcctgccccccgtgcctgctgacatggtcttcctggtggacgggtcctggagcattggccacagtcacttccagcaggtcaaggacttcctggccagtgtcatcgcaccctttgaaatcgggccggataaggtccaagtaggcctgactcagtacagcggggatgctcagactgagtgggacctgaactccctcagcaccaaggaacaggtgctggcagctgtgcgccgcctccgctacaagggggggaacacgttcacaggccttgccctgacccacgtgctggggcagaacctgcagccggcggctggcctccgtccagaggcagccaaggtggtgattctggtgacggacggcaagtcccaggacgatgtgcacactgctgcccgtgtcctcaaggacctgggcgtgaacgtcttcgctgtgggtgtgaagaacgccgatgaggctgagctgaggctcctggcgtccccgccgagggacatcaccgtccacagcgtgctggacttcctgcagctcggcgcgctggctggcctgctcagccgtctcatctgccagaggctccagggtgggagcccgcggcagggcccagcagcggctccagccctggacaccctccctgcccccaccagcctggtcctgagccaggtgacctcctccagcatccgcctgtcctggactccagccccccggcaccccctcaagtatctgatcgtttggcgagcctctagaggtggcacccccagggaggtggtggtggagggacccgccgcctccacggagctgcacaacctggcctcccgcacagagtacctggtctccgtgttccccatctatgagggcggggttggcgaaggcctgcggggcctggtgaccacagcacctctgcctccgccccgggcgctgaccctggccgcagtgacgcccagaaccgtccacctcacctggcagccctcggccggggccacccactacctggtgcgatgttctcctgcttcccccaagggtgaagaggaggagcgagaggtgcaggtcgggcggcccgaggtgctgctggatggcctggaacctggcagggactatgaggtctcggtgcagagcctgcgaggccctgagggcagcgaggcccggggcatccgtgccaggacccccaccctggcccccccgagacacctgggcttctcagacgtgagccacgacgcggcacgagtgttctgggagggtgccccgaggcctgtgcgcctggtcagggtcacctatgtgtccagcgagggtggacactcggggcagacagaggctcctgggaacgccacctcggccacgctggggcctctctcttcctccaccacctacactgtccgtgtcacctgcctctaccctgggggtggctcctctacgctgactggccgggtgaccaccaagaaagctcccagcccaagccagctgtccatgacggagctgccaggggatgcagtccagctggcgtgggtggccgcagccccgtctggcgtgcttgtctaccagatcacgtggacgcccctgggagaggggaaggctcacgagatctctgtcccagggaacctcggcacggccgtcctgcctggcctagggaggcacacagagtacgacgtcaccatcttggcctactacagggacggggcccgcagtgaccctgtgtccctccgctataccccctccacggtgagcaggagcccaccctccaacctggccctggcctcggagacccccgacagcctgcaggtcagctggacgcccccgcttggccgcgtgctccattactggctcacctacgcccccgcctctggcttgggacccgagaaatccgtctctgtgccaggagccaggagccacgtgacactgcccgacctgcaggcagccacgaagtacagggtcctggtctcagctatctatgcagcaggcaggagtgaggctgtgtctgccacgggccagacagcctgcccagccctccgccctgacggctccctcccagggtttgacctgatggtggccttcagcctggtggaaaaggcttatgcgtccatccggggcgtggccatggagccctctgccttcggtgggaccccgaccttcacgctcttcaaggacgcccagctgacaagacgggtcagtgacgtctacccagcccccctacctccagagcacaccatcgtcttccttgtgcgcctacttcccgagacaccccgtgaggccttcgcgctgtggcagatgacagccgaggacttccagcccctccttggggttctgctggatgccgggaagaagtccctgacctacttccaccgtgaccccagggctgccttgcaggaggccaccttcgacccgcaggaagtgaggaagattttcttcgggagcttccacaaggtgcacgtggctgtgggccgctccaaggtcaggctctatgtggactgccggaaggtggctgagcggccccttggggagatgggcagcccacccgctgcgggcttcgtcacgctggggaggctggccaaggccaggggcccccggagcagttcggccgcgtttcagctccagatgctgcagatcgtgtgcagtgacacctgggccgatgaggaccggtgctgtgagctccctgcctcgagggatggagagacctgccccgccttcgtgtctgcctgttcctgttcctcagagacccctgggcccccaggacctcaaggacccccaggcctccctgggaggaatggcaccccaggagagcagggcttcccagggcccaggggtccaccaggggtcaaaggagagaagggagaccatgggcttccaggcttgcagggccaccccggccaccagggcatccccgggagagttggcctccagggaccaaagggaatgagaggcctggagggaactgctggcctgcctggaccccctggccccagggggttccagggcatggcaggggccaggggcactagtggagagcgaggacctccagggaccgtggggcccacaggactgccagggcccaaaggggaacgaggagagaagggcgagccgcagtcccttgccaccctctaccagcttgtgagccaggcctgtgagtctgccattcagacacacgtgtcaaagttcgactccttccacgagaacaccaggccccccatgcccatcttggagcagaagctggagccgggcactgagcccctggggtcccctggcacccgcagcaaggccctggttcctggagaatgggggcgtggtggccgccaccttgagggcagaggggagcctggagctgttggtcagatgggcagccctgggcagcagggggctagcacccagggcctctgggagtgacaggacattttctgcactgccccgaggaacgctgagccttcctccctgggtttgtctggacaccgagagcgaccacatcctggagaagccaggagaaaagctcaggaagagcctgcaggtggaaggagagggaagcagcggcctcggccaaggcccaccccatactcttggctctgtagcatttccaagttcagataaacccctgagtgctcaccc

SEQ ID NO: 470 - DNA, 4339 bp, Homo sapiens
attttctgatgctagcaggatttgaactgagtgtttccaccagggcgacactagcagttcgcccttcaagatccagatccaaaatccaccctctggtcttcggccaaggaaagggggcgggtggggagcgcgaaccttatctcccgggctccgcctccagggggctgagagcgagtttctgagcctctgagctctgcactggccgctgcagggagaacggactccgggcggagggcagccaatccgtttcagcgcaggtcttgctcgggttgggcttgccactgcctggaacatacctgtccccctggcgcaacactcagctggctgcgacggcaaccccgagcctggacactgcgccaggaatcctaaaaccaaaatattagaacgaaaacagaaacatggctcactatattacatttctctgcatggttttggtgctgcttcttcagaattctgtgttagctgaagatggggaagtaagatcaagttgtcgtactgctccgacagatttagttttcatcttagatggctcttatagtgttggcccagaaaactttgaaatagtgaaaaagtggcttgtcaatatcacaaaaaactttgacatagggccgaagtttattcaagttggagtggttcaatatagtgactaccctgtgctggagattcctctcggaagctatgattcaggagaacatttgacggcagcagtggaatccatactctacttaggaggaaacacaaagacagggaaggccatccagtttgcgctcgattacctttttgccaagtcctcacgatttctgactaagatagcagtggtacttacggatggcaaatcccaagatgacgtcaaggatgcagctcaagcagcaagagatagtaagataacattatttgctattggtgttggttcagaaacagaagatgccgaacttagagctattgccaacaagccttcgtctacttatgtgttttatgtggaagactatattgcaatatccaaaataagggaagtgatgaagcagaaactttgtgaagaatctgtctgtccaacacgaattccagtggcagctcgtgatgaaaggggatttgatattcttttaggtttagatgtaaataaaaaggttaagaaaagaatacagctttcaccaaaaaagataaaaggatatgaagtaacatcaaaagttgatttatcagaactcacaagcaatgttttcccagaaggtcttcctccatcatatgtatttgtgtctactcaaagatttaaagtcaagaaaatttgggatttatggagaatattaactattgatggaaggccacaaatagcagttaccttaaatggtgtggacaaaatcttattatttacaacaaccagcgtaattaatggctcacaagtggttacctttgctaaccctcaagttaagacgttgtttgatgaaggctggcaccaaattcgtctcttagtaacagaacaagatgtgactttgtatattgatgaccaacaaattgaaaacaagcccttacatccagttttagggatcttgatcaatgggcaaacccaaattggaaaatattctggaaaagaagaaactgttcagtttgatgtccaaaagttgcgaatctactgtgacccagaacagaacaaccgggagacagcatgtgagattcctggatttaatggagagtgccttaatggtcccagtgatgtaggttcaactccagctccctgtatttgtcctccgggaaaaccaggacttcaaggccccaaaggtgaccctggactgcctgggaaccctggctaccctggacaacctggtcaagatggtaagcctggatatcagggaattgcagggacaccaggtgttccaggatctccaggaatacaaggagctcgaggactaccaggttacaaaggagaaccagggcgagatggtgacaagggtgatcgtggacttcctggttttcctgggcttcatggcatgccaggatcaaagggtgaaatgggtgccaaaggagacaaaggatcacctggattttatggcaaaaagggtgcaaaaggtgaaaaggggaatgctggcttccctggcctccctggacctgctggagaaccaggaagacatggaaaggatggattaatgggtagtcccggtttcaagggagaagcaggatcccctggtgctccggggcaggatggaacacggggagagcctggaatcccaggatttcctggaaaccgaggattaatgggccaaaagggagaaattgggcctccaggacagcaaggaaaaaaaggagccccagggatgcctggtttaatgggaagcaatggctcaccaggccagcctggaacaccgggatctaagggaagcaaaggtgaacctggaattcaagggatgcctggggcttctgggctcaagggagaaccaggagcaacgggttccccaggagaaccaggatacatgggtttacccgggattcaaggaaaaaagggggacaaaggaaatcaaggtgaaaaaggtattcagggtcaaaagggagaaaatggaagacagggaattccagggcaacagggaattcaaggccatcatggtgcaaaaggagagagaggtgaaaagggagaacctggtgtccgaggtgccattggatcaaaaggagaatctggggtggatggcttgatggggcccgcaggtcctaaggggcaacctggggatccaggtcctcagggacccccaggtttggatgggaagcccggaagagagttttcagaacaatttattcgacaagtttgcacagatgtaataagagcccagctaccagtcttacttcagagtggaagaattagaaattgtgatcattgcctgtcccaacatggctccccgggtattcctgggccacctggtccgataggcccagagggtcccagaggattacctggtttgccaggaagagatggtgttcctggattagtgggtgtccctggacgtccaggtgtcagaggattaaaaggcctaccaggaagaaatggggaaaaagggagccaagggtttgggtatcctggagaacaaggtcctcctggtcccccaggtccagagggccctcctggaataagcaaagaaggtcctccaggagacccaggtctccctggcaaagatggagaccatggaaaacctggaatccaagggcaaccaggccccccaggcatctgcgacccatcactatgttttagtgtaattgccagaagagatccgttcagaaaaggaccaaactattagtgtctgatgcctcattcagcagcctaggcatggtgctttttctgtggtcttttgcatctcaggaagataaccaacagtaatcccttgaaaagaaacttaagtacctcggtgtttttattttttttttcttatggaaaaaaatataaaagatcacatatactgattttaaaggctcctcagtcatttggagcccttggattagcagcattaattaaatctcaagggtttcttgtaaagtccatttatgttaatcaaagttgaatataaaaatccaccattgcctgttagccagtcagttttagtcactgtgaaatatttcacattcagcctccatgcagtagagatttgagtttaatttcatgtccatgtgactttcatgtttcctatctcatagctcatgctactacataagccaaaacatgtatctcatcattggaagtaagatcagggctgatattcacctgggatagacagtattggtgaactactcatttactacagtgtctcagccttgataaggggcagtggattgcctgttgttcggtgttgtgaatagcacctctgaataagattagagtgtttcttaattcatttcaaactctaaaattagattaatggtggtgctaagaaagagtattaattactttgggaatggtcaaaattaacattaaaaacattttagacaaaaagtttcattgtacattcaaagaaaatgtaagtttggaagtactaaaagactattttatacttgttgattaatcggaatgtttgttgtatgccttcattttccatttcacttatatgtgtatgtccatatatgttaattttcattgtagcaaagctaatggaaataaagctaatgctctagttgaaagaaaaggaaaactcctgaaatcctagaatgtcttgttatttttagctgactgtaaaatattatgaacagtctttgtgtattgtgcttaatgcttttgtaagaaacagaatttgaaatatttcatccttgtcatgctcaaaattttgttacatgcttgttattcagagtataataaagttttgtacaggcctga

SEQ ID NO: 471 - DNA, 2038 bp, Homo sapiens
atgattgcatcaggaatcccaggatttcctggaaaccgaggattaatgggccaaaagggagaaattgggcctccaggacagcaaggaaaaaaaggagccccagggatgcctggtttaatgggaagcaatggctcaccaggccagcctggaacaccgggatctaagggaagcaaaggtgaacctggaattcaagggatgcctggggcttctgggctcaagggagaaccaggagcaacgggttccccaggagaaccaggatacatgggtttacccgggattcaaggaaaaaagggggacaaaggaaatcaaggtgaaaaaggtattcagggtcaaaagggagaaaatggaagacagggaattccagggcaacagggaattcaaggccatcatggtgcaaaaggagagagaggtgaaaagggagaacctggtgtccgaggtgccattggatcaaaaggagaatctggggtggatggcttgatggggcccgcaggtcctaaggggcaacctggggatccaggtcctcagggacccccaggtttggatgggaagcccggaagagagttttcagaacaatttattcgacaagtttgcacagatgtaataagaggcccagagggtcccagaggattacctggtttgccaggaagagatggtgttcctggattagtgggtgtccctggacgtccaggtgtcagaggattaaaaggcctaccaggaagaaatggggaaaaagggagccaagggtttgggtatcctggagaacaaggtcctcctggtcccccaggtccagagggccctcctggaataagcaaagaaggtcctccaggagacccaggtctccctggcaaagatggagaccatggaaaacctggaatccaagggcaaccaggccccccaggcatctgcgacccatcactatgttttagtgtaattgccagaagagatccgttcagaaaaggaccaaactattagtgtctgatgcctcattcagcagcctaggcatggtgctttttctgtggtcttttgcatctcaggaagataaccaacagtaatcccttgaaaagaaacttaagtacctcggtgtttttattttttttttcttatggaaaaaaatataaaagatcacatatactgattttaaaggctcctcagtcatttggagcccttggattagcagcattaattaaatctcaagggtttcttgtaaagtccatttatgttaatcaaagttgaatataaaaatccaccattgcctgttagccagtcagttttagtcactgtgaaatatttcacattcagcctccatgcagtagagatttgagtttaatttcatgtccatgtgactttcatgtttcctatctcatagctcatgctactacataagccaaaacatgtatctcatcattggaagtaagatcagggctgatattcacctgggatagacagtattggtgaactactcatttactacagtgtctcagccttgataaggggcagtggattgcctgttgttcggtgttgtgaatagcacctctgaataagattagagtgtttcttaattcatttcaaactctaaaattagattaatggtggtgctaagaaagagtattaattactttgggaatggtcaaaattaacattaaaaacattttagacaaaaagtttcattgtacattcaaagaaaatgtaagtttggaagtactaaaagactattttatacttgttgattaatcggaatgtttgttgtatgccttcattttccatttcacttatatgtgtatgtccatatatgttaattttcattgtagcaaagctaatggaaataaagctaatgctctagttgaaagaaaaggaaaactcctgaaatcctagaatgtcttgttatttttagctgactgtaaaatattatgaacagtctttgtgtattgtgcttaatgcttttgtaagaaacagaatttgaaatatttcatccttgtcatgctcaaaattttgttacatgcttgttattcagagtataataaagttttgtacaggcctg

SEQ ID NO: 472 - DNA, 4163 bp, Homo sapiens
gagagcgagtttctgagcctctgagctctgcactggccgctgcagggagaacggactccgggcggagggcagccaatccgtttcagcgcaggtcttgctcgggttgggcttgccactgcctggaacatacctgtccccctggcgcaacactcagctggctgcgacggcaaccccgagcctggacactgcgccaggaatcctaaaaccaaaatattagaacgaaaacagaaacatggctcactatattacatttctctgcatggttttggtgctgcttcttcagaattctgtgttagctgaagatggggaagtaagatcaagttgtcgtactgctccgacagatttagttttcatcttagatggctcttatagtgttggcccagaaaactttgaaatagtgaaaaagtggcttgtcaatatcacaaaaaactttgacatagggccgaagtttattcaagttggagtggttcaatatagtgactaccctgtgctggagattcctctcggaagctatgattcaggagaacatttgacggcagcagtggaatccatactctacttaggaggaaacacaaagacagggaaggccatccagtttgcgctcgattacctttttgccaagtcctcacgatttctgactaagatagcagtggtacttacggatggcaaatcccaagatgacgtcaaggatgcagctcaagcagcaagagatagtaagataacattatttgctattggtgttggttcagaaacagaagatgccgaacttagagctattgccaacaagccttcgtctacttatgtgttttatgtggaagactatattgcaatatccaaaataagggaagtgatgaagcagaaactttgtgaagaatctgtctgtccaacacgaattccagtggcagctcgtgatgaaaggggatttgatattcttttaggtttagatgtaaataaaaaggttaagaaaagaatacagctttcaccaaaaaagataaaaggatatgaagtaacatcaaaagttgatttatcagaactcacaagcaatgttttcccagaaggtcttcctccatcatatgtatttgtgtctactcaaagatttaaagtcaagaaaatttgggatttatggagaatattaactattgatggaaggccacaaatagcagttaccttaaatggtgtggacaaaatcttattatttacaacaaccagcgtaattaatggctcacaagtggttacctttgctaaccctcaagttaagacgttgtttgatgaaggctggcaccaaattcgtctcttagtaacagaacaagatgtgactttgtatattgatgaccaacaaattgaaaacaagcccttacatccagttttagggatcttgatcaatgggcaaacccaaattggaaaatattctggaaaagaagaaactgttcagtttgatgtccaaaagttgcgaatctactgtgacccagaacagaacaaccgggagacagcatgtgagattcctggattttgccttaatggtcccagtgatgtaggttcaactccagctccctgtatttgtcctccgggaaaaccaggacttcaaggccccaaaggtgaccctggactgcctgggaaccctggctaccctggacaacctggtcaagatggtaagcctggatatcagggaattgcagggacaccaggtgttccaggatctccaggaatacaaggagctcgaggactaccaggttacaaaggagaaccagggcgagatggtgacaagggtgatcgtggacttcctggttttcctgggcttcatggcatgccaggatcaaagggtgaaatgggtgccaaaggagacaaaggatcacctggattttatggcaaaaagggtgcaaaaggtgaaaaggggaatgctggcttccctggcctccctggacctgctggagaaccaggaagacatggaaaggatggattaatgggtagtcccggtttcaagggagaagcaggatcccctggtgctccggggcaggatggaacacggggagagcctggaatcccaggatttcctggaaaccgaggattaatgggccaaaagggagaaattgggcctccaggacagcaaggaaaaaaaggagccccagggatgcctggtttaatgggaagcaatggctcaccaggccagcctggaacaccgggatctaagggaagcaaaggtgaacctggaattcaagggatgcctggggcttctgggctcaagggagaaccaggagcaacgggttccccaggagaaccaggatacatgggtttacccgggattcaaggaaaaaagggggacaaaggaaatcaaggtgaaaaaggtattcagggtcaaaagggagaaaatggaagacagggaattccagggcaacagggaattcaaggccatcatggtgcaaaaggagagagaggtgaaaagggagaacctggtgtccgaggtgccattggatcaaaaggagaatctggggtggatggcttgatggggcccgcaggtcctaaggggcaacctggggatccaggtcctcagggacccccaggtttggatgggaagcccggaagagagttttcagaacaatttattcgacaagtttgcacagatgtaataagagcccagctaccagtcttacttcagagtggaagaattagaaattgtgatcattgcctgtcccaacatggctccccgggtattcctgggccacctggtccgataggcccagagggtcccagaggattacctggtttgccaggaagagatggtgttcctggattagtgggtgtccctggacgtccaggtgtcagaggattaaaaggcctaccaggaagaaatggggaaaaagggagccaagggtttgggtatcctggagaacaaggtcctcctggtcccccaggtccagagggccctcctggaataagcaaagaaggtcctccaggagacccaggtctccctggcaaagatggagaccatggaaaacctggaatccaagggcaaccaggccccccaggcatctgcgacccatcactatgttttagtgtaattgccagaagagatccgttcagaaaaggaccaaactattagtgtctgatgcctcattcagcagcctaggcatggtgctttttctgtggtcttttgcatctcaggaagataaccaacagtaatcccttgaaaagaaacttaagtacctcggtgtttttattttttttttcttatggaaaaaaatataaaagatcacatatactgattttaaaggctcctcagtcatttggagcccttggattagcagcattaattaaatctcaagggtttcttgtaaagtccatttatgttaatcaaagttgaatataaaaatccaccattgcctgttagccagtcagttttagtcactgtgaaatatttcacattcagcctccatgcagtagagatttgagtttaatttcatgtccatgtgactttcatgtttcctatctcatagctcatgctactacataagccaaaacatgtatctcatcattggaagtaagatcagggctgatattcacctgggatagacagtattggtgaactactcatttactacagtgtctcagccttgataaggggcagtggattgcctgttgttcggtgttgtgaatagcacctctgaataagattagagtgtttcttaattcatttcaaactctaaaattagattaatggtggtgctaagaaagagtattaattactttgggaatggtcaaaattaacattaaaaacattttagacaaaaagtttcattgtacattcaaagaaaatgtaagtttggaagtactaaaagactattttatacttgttgattaatcggaatgtttgttgtatgccttcattttccatttcacttatatgtgtatgtccatatatgttaattttcattgtagcaaagctaatggaaataaagctaatgctctagttgaaagaaaaggaaaactcctgaaatcctagaatgtcttgttatttttagctgactgtaaaatattatgaacagtctttgtgtattgtgcttaatgcttttgtaagaaacagaatttgaaatatttcatccttgtcatgctcaaaattttgttacatgcttgttattcagagtataataaagttttgtacaggcctg

SEQ ID NO: 473 - DNA, 624 bp, Homo sapiens
gcaacactcagctggctgcgacggcaaccccgagcctggacactgcgccaggaaacctcttctggcatccttagtaaatggcagtagagtcatctgggaggtaaaagaagattgtaccatgtgagggatctcctacccaggaaacaaagcccacaggaagaccatcacataggaatggaatcctaaaaccaaaatattagaacgaaaacagaaacatggctcactatattacatttctctgcatggttttggtgctgcttcttcagaattctgtgttagctgaagatggggaagtaagatcaagttgtcgtactgctccgacagatttagttttcatcttagatggctcttatagtgttggcccagaaaactttgaaatagtgaaaaagtggcttgtcaatatcacaaaaaactttgacatagggccgaagtttattcaagttggagtggttcaatatagtgactaccctgtgctggagattcctctcggaagctatgattcaggagaacatttgacggcagcagtggaatccatactctacttaggaggaaacacaaagacagggaaggccatccagtttgcgctcgattacctttttgccaagtcctcacgatttctgacta

SEQ ID NO: 474 - DNA, 4094 bp, Homo sapiens
tggttctggccaagggagttcatacccactcaaagattatattacgaatttcagatgggagcttctctcaacctgcagccaccacatgagttagctggccgacttctgtgaggttcccagtgaggaatcctaaaaccaaaatattagaacgaaaacagaaacatggctcactatattacatttctctgcatggttttggtgctgcttcttcagaattctgtgttagctgaagatggggaagtaagatcaagttgtcgtactgctccgacagatttagttttcatcttagatggctcttatagtgttggcccagaaaactttgaaatagtgaaaaagtggcttgtcaatatcacaaaaaactttgacatagggccgaagtttattcaagttggagtggttcaatatagtgactaccctgtgctggagattcctctcggaagctatgattcaggagaacatttgacggcagcagtggaatccatactctacttaggaggaaacacaaagacagggaaggccatccagtttgcgctcgattacctttttgccaagtcctcacgatttctgactaagatagcagtggtacttacggatggcaaatcccaagatgacgtcaaggatgcagctcaagcagcaagagatagtaagataacattatttgctattggtgttggttcagaaacagaagatgccgaacttagagctattgccaacaagccttcgtctacttatgtgttttatgtggaagactatattgcaatatccaaaataagggaagtgatgaagcagaaactttgtgaagaatctgtctgtccaacacgaattccagtggcagctcgtgatgaaaggggatttgatattcttttaggtttagatgtaaataaaaaggttaagaaaagaatacagctttcaccaaaaaagataaaaggatatgaagtaacatcaaaagttgatttatcagaactcacaagcaatgttttcccagaaggtcttcctccatcatatgtatttgtgtctactcaaagatttaaagtcaagaaaatttgggatttatggagaatattaactattgatggaaggccacaaatagcagttaccttaaatggtgtggacaaaatcttattatttacaacaaccagcgtaattaatggctcacaagtggttacctttgctaaccctcaagttaagacgttgtttgatgaaggctggcaccaaattcgtctcttagtaacagaacaagatgtgactttgtatattgatgaccaacaaattgaaaacaagcccttacatccagttttagggatcttgatcaatgggcaaacccaaattggaaaatattctggaaaagaagaaactgttcagtttgatgtccaaaagttgcgaatctactgtgacccagaacagaacaaccgggagacagcatgtgagattcctggattttgccttaatggtcccagtgatgtaggttcaactccagctccctgtatttgtcctccgggaaaaccaggacttcaaggccccaaaggtgaccctggactgcctgggaaccctggctaccctggacaacctggtcaagatggtaagcctggatatcagggaattgcagggacaccaggtgttccaggatctccaggaatacaaggagctcgaggactaccaggttacaaaggagaaccagggcgagatggtgacaagggtgatcgtggacttcctggttttcctgggcttcatggcatgccaggatcaaagggtgaaatgggtgccaaaggagacaaaggatcacctggattttatggcaaaaagggtgcaaaaggtgaaaaggggaatgctggcttccctggcctccctggacctgctggagaaccaggaagacatggaaaggatggattaatgggtagtcccggtttcaagggagaagcaggatcccctggtgctccggggcaggatggaacacggggagagcctggaatcccaggatttcctggaaaccgaggattaatgggccaaaagggagaaattgggcctccaggacagcaaggaaaaaaaggagccccagggatgcctggtttaatgggaagcaatggctcaccaggccagcctggaacaccgggatctaagggaagcaaaggtgaacctggaattcaagggatgcctggggcttctgggctcaagggagaaccaggagcaacgggttccccaggagaaccaggatacatgggtttacccgggattcaaggaaaaaagggggacaaaggaaatcaaggtgaaaaaggtattcagggtcaaaagggagaaaatggaagacagggaattccagggcaacagggaattcaaggccatcatggtgcaaaaggagagagaggtgaaaagggagaacctggtgtccgaggtgccattggatcaaaaggagaatctggggtggatggcttgatggggcccgcaggtcctaaggggcaacctggggatccaggtcctcagggacccccaggtttggatgggaagcccggaagagagttttcagaacaatttattcgacaagtttgcacagatgtaataagagcccagctaccagtcttacttcagagtggaagaattagaaattgtgatcattgcctgtcccaacatggctccccgggtattcctgggccacctggtccgataggcccagagggtcccagaggattacctggtttgccaggaagagatggtgttcctggattagtgggtgtccctggacgtccaggtgtcagaggattaaaaggcctaccaggaagaaatggggaaaaagggagccaagggtttgggtatcctggagaacaaggtcctcctggtcccccaggtccagagggccctcctggaataagcaaagaaggtcctccaggagacccaggtctccctggcaaagatggagaccatggaaaacctggaatccaagggcaaccaggccccccaggcatctgcgacccatcactatgttttagtgtaattgccagaagagatccgttcagaaaaggaccaaactattagtgtctgatgcctcattcagcagcctaggcatggtgctttttctgtggtcttttgcatctcaggaagataaccaacagtaatcccttgaaaagaaacttaagtacctcggtgtttttattttttttttcttatggaaaaaaatataaaagatcacatatactgattttaaaggctcctcagtcatttggagcccttggattagcagcattaattaaatctcaagggtttcttgtaaagtccatttatgttaatcaaagttgaatataaaaatccaccattgcctgttagccagtcagttttagtcactgtgaaatatttcacattcagcctccatgcagtagagatttgagtttaatttcatgtccatgtgactttcatgtttcctatctcatagctcatgctactacataagccaaaacatgtatctcatcattggaagtaagatcagggctgatattcacctgggatagacagtattggtgaactactcatttactacagtgtctcagccttgataaggggcagtggattgcctgttgttcggtgttgtgaatagcacctctgaataagattagagtgtttcttaattcatttcaaactctaaaattagattaatggtggtgctaagaaagagtattaattactttgggaatggtcaaaattaacattaaaaacattttagacaaaaagtttcattgtacattcaaagaaaatgtaagtttggaagtactaaaagactattttatacttgttgattaatcggaatgtttgttgtatgccttcattttccatttcacttatatgtgtatgtccatatatgttaattttcattgtagcaaagctaatggaaataaagctaatgctctagttgaaagaaaaggaaaactcctgaaatcctagaatgtcttgttatttttagctgactgtaaaatattatgaacagtctttgtgtattgtgcttaatgcttttgtaagaaacagaatttgaaatatttcatccttgtcatgctcaaaattttgttacatgcttgttattcagagtataataaagttttgtacaggcctga

SEQ ID NO: 475 - DNA, 4172 bp, Homo sapiens
gagagcgagtttctgagcctctgagctctgcactggccgctgcagggagaacggactccgggcggagggcagccaatccgtttcagcgcaggtcttgctcgggttgggcttgccactgcctggaacatacctgtccccctggcgcaacactcagctggctgcgacggcaaccccgagcctggacactgcgccaggaatcctaaaaccaaaatattagaacgaaaacagaaacatggctcactatattacatttctctgcatggttttggtgctgcttcttcagaattctgtgttagctgaagatggggaagtaagatcaagttgtcgtactgctccgacagatttagttttcatcttagatggctcttatagtgttggcccagaaaactttgaaatagtgaaaaagtggcttgtcaatatcacaaaaaactttgacatagggccgaagtttattcaagttggagtggttcaatatagtgactaccctgtgctggagattcctctcggaagctatgattcaggagaacatttgacggcagcagtggaatccatactctacttaggaggaaacacaaagacagggaaggccatccagtttgcgctcgattacctttttgccaagtcctcacgatttctgactaagatagcagtggtacttacggatggcaaatcccaagatgacgtcaaggatgcagctcaagcagcaagagatagtaagataacattatttgctattggtgttggttcagaaacagaagatgccgaacttagagctattgccaacaagccttcgtctacttatgtgttttatgtggaagactatattgcaatatccaaaataagggaagtgatgaagcagaaactttgtgaagaatctgtctgtccaacacgaattccagtggcagctcgtgatgaaaggggatttgatattcttttaggtttagatgtaaataaaaaggttaagaaaagaatacagctttcaccaaaaaagataaaaggatatgaagtaacatcaaaagttgatttatcagaactcacaagcaatgttttcccagaaggtcttcctccatcatatgtatttgtgtctactcaaagatttaaagtcaagaaaatttgggatttatggagaatattaactattgatggaaggccacaaatagcagttaccttaaatggtgtggacaaaatcttattatttacaacaaccagcgtaattaatggctcacaagtggttacctttgctaaccctcaagttaagacgttgtttgatgaaggctggcaccaaattcgtctcttagtaacagaacaagatgtgactttgtatattgatgaccaacaaattgaaaacaagcccttacatccagttttagggatcttgatcaatgggcaaacccaaattggaaaatattctggaaaagaagaaactgttcagtttgatgtccaaaagttgcgaatctactgtgacccagaacagaacaaccgggagacagcatgtgagattcctggatttgtaatggaatgccttaatggtcccagtgatgtaggttcaactccagctccctgtatttgtcctccgggaaaaccaggacttcaaggccccaaaggtgaccctggactgcctgggaaccctggctaccctggacaacctggtcaagatggtaagcctggatatcagggaattgcagggacaccaggtgttccaggatctccaggaatacaaggagctcgaggactaccaggttacaaaggagaaccagggcgagatggtgacaagggtgatcgtggacttcctggttttcctgggcttcatggcatgccaggatcaaagggtgaaatgggtgccaaaggagacaaaggatcacctggattttatggcaaaaagggtgcaaaaggtgaaaaggggaatgctggcttccctggcctccctggacctgctggagaaccaggaagacatggaaaggatggattaatgggtagtcccggtttcaagggagaagcaggatcccctggtgctccggggcaggatggaacacggggagagcctggaatcccaggatttcctggaaaccgaggattaatgggccaaaagggagaaattgggcctccaggacagcaaggaaaaaaaggagccccagggatgcctggtttaatgggaagcaatggctcaccaggccagcctggaacaccgggatctaagggaagcaaaggtgaacctggaattcaagggatgcctggggcttctgggctcaagggagaaccaggagcaacgggttccccaggagaaccaggatacatgggtttacccgggattcaaggaaaaaagggggacaaaggaaatcaaggtgaaaaaggtattcagggtcaaaagggagaaaatggaagacagggaattccagggcaacagggaattcaaggccatcatggtgcaaaaggagagagaggtgaaaagggagaacctggtgtccgaggtgccattggatcaaaaggagaatctggggtggatggcttgatggggcccgcaggtcctaaggggcaacctggggatccaggtcctcagggacccccaggtttggatgggaagcccggaagagagttttcagaacaatttattcgacaagtttgcacagatgtaataagagcccagctaccagtcttacttcagagtggaagaattagaaattgtgatcattgcctgtcccaacatggctccccgggtattcctgggccacctggtccgataggcccagagggtcccagaggattacctggtttgccaggaagagatggtgttcctggattagtgggtgtccctggacgtccaggtgtcagaggattaaaaggcctaccaggaagaaatggggaaaaagggagccaagggtttgggtatcctggagaacaaggtcctcctggtcccccaggtccagagggccctcctggaataagcaaagaaggtcctccaggagacccaggtctccctggcaaagatggagaccatggaaaacctggaatccaagggcaaccaggccccccaggcatctgcgacccatcactatgttttagtgtaattgccagaagagatccgttcagaaaaggaccaaactattagtgtctgatgcctcattcagcagcctaggcatggtgctttttctgtggtcttttgcatctcaggaagataaccaacagtaatcccttgaaaagaaacttaagtacctcggtgtttttattttttttttcttatggaaaaaaatataaaagatcacatatactgattttaaaggctcctcagtcatttggagcccttggattagcagcattaattaaatctcaagggtttcttgtaaagtccatttatgttaatcaaagttgaatataaaaatccaccattgcctgttagccagtcagttttagtcactgtgaaatatttcacattcagcctccatgcagtagagatttgagtttaatttcatgtccatgtgactttcatgtttcctatctcatagctcatgctactacataagccaaaacatgtatctcatcattggaagtaagatcagggctgatattcacctgggatagacagtattggtgaactactcatttactacagtgtctcagccttgataaggggcagtggattgcctgttgttcggtgttgtgaatagcacctctgaataagattagagtgtttcttaattcatttcaaactctaaaattagattaatggtggtgctaagaaagagtattaattactttgggaatggtcaaaattaacattaaaaacattttagacaaaaagtttcattgtacattcaaagaaaatgtaagtttggaagtactaaaagactattttatacttgttgattaatcggaatgtttgttgtatgccttcattttccatttcacttatatgtgtatgtccatatatgttaattttcattgtagcaaagctaatggaaataaagctaatgctctagttgaaagaaaaggaaaactcctgaaatcctagaatgtcttgttatttttagctgactgtaaaatattatgaacagtctttgtgtattgtgcttaatgcttttgtaagaaacagaatttgaaatatttcatccttgtcatgctcaaaattttgttacatgcttgttattcagagtataataaagttttgtacaggcctg

SEQ ID NO: 476 - DNA, 6346 bp, Homo sapiens
ggggctggccgaggctgcggcgtttctccccaaggaagtgtcttctccgctttccctgttcttctgtttctcacacactttctatctcattctgtaactttcaagcctttccttctaactgtatgtatttagttacttgttttcaagctggttccctctctggccccctggcctggggaaagcctccacacttactgcgggtcttgtttagagtctgagtttgtgagattatttgggggagagtgggcgagtggctgacaggtgacccccaggaggaggattcctggggctggtgtcttctcccagctgctgcttccagtgggcctgggcccaggactggacctccgctggcacccctgagtgcctccctgccaggccatgctgctgtagaccctaacagcgtctcttcctggccaagagaagcctgtccccaagaacaggagagccatggccggcctccgagggaacgctgtggctggcctcctctggatgctgctgctgtggagtgggggcggcggctgccaggctcagcgggcaggttgcaaaagtgtccactacgatctggtcttcctcctggacacctcctccagcgtgggcaaggaggactttgagaaggtccggcagtgggtggccaacctggtggacaccttcgaggtgggccccgaccgcacccgtgtgggggtcgtgcgctacagcgaccggcccaccacggccttcgagttgggactctttggctcgcaggaggaggtcaaggcggctgcccggcgtctcgcctaccacgggggcaacaccaacacgggagacgcgctccgctacatcacggcccgcagcttctccccacacgccggcggccgccccagggaccgcgcctacaagcaggtggccatcctgctcaccgacggccgcagccaggacctggtgctggacgccgcggcggcagcccaccgcgctggcatccgcatctttgccgtgggcgtgggcgaggcactcaaggaggagctggaggagatcgcctcagagcccaagtccgcccacgtcttccacgtgtccgacttcaatgccatcgacaagatccggggcaagctgcggcgccgtctttgtgaaaatgtgctctgtcctagcgttcgtgtagaaggagatcgctttaagcacaccaatggaggaaccaaggaaatcacaggttttgacctgatggatttgttcagtgtgaaggaaatcttggggaagagagagaatggagctcagagttcctatgtacggatgggatccttccctgtggtgcaaagtactgaggatgtgttcccccaaggtttacctgatgagtacgcctttgtcacaaccttccggttcaggaaaacctctcggaaggaagactggtatatctggcaggtcatcgaccagtacagcatcccacaggtctccatccggctggatggtgaaaacaaggcagtcgagtacaacgctgtgggtgccatgaaagatgctgtcagggtggtcttccgaggttctcgggtcaatgacctctttgaccgggactggcacaagatggccctgagcatccaggcccagaacgtctccctgcacattgactgtgcgctggtgcagacactacccatcgaggaacgggagaacattgacatccagggcaagactgtgattggcaagcgcctctacgacagtgtgcccattgactttgacctacagcggattgtgatctattgtgactcgagacacgcagaattggagacttgttgtgatatcccctcgggtccgtgccaggtgaccgtggtgacagagcctccacctccacccccaccccagcggcctcccaccccaggcagtgaacagattgggtttttgaagaccatcaactgctcctgcccagctggagagaagggtgaaatgggagttgctggccccatggggctccctggtccaaagggagacataggagccattgggccggttggcgctcctggacctaagggagagaaaggtgatgtgggcataggaccttttggccaaggggaaaagggtgaaaagggttccctgggcctgcccggcccccctgggagagacggcagcaaaggcatgagaggggagccaggagagctgggagagccggggctgccgggtgaggtcggcatgcgggggccccaaggaccacctggactccccggacctcctggacgtgtcggagctcctggtctccaaggagaacgaggtgaaaagggaactcgaggagaaaagggagagcgaggcctggatggattccctgggaagcctggggacacaggacagcagggcaggcccggcccttctggtgtggcaggaccccagggagaaaagggtgacgtgggacctgcggggccacctggtgtaccaggctcagtggtgcagcaagagggcttgaaaggggaacagggagctccaggacccagaggtcaccaaggcgcccccggtcctccaggagctcggggtccaataggcccagaaggcagggatggacctcctggtttgcaaggtctccgagggaagaaaggtgacatgggaccacctggaatccctggattgctggggctgcagggccctccaggaccccctggtgtcccaggcccccctggaccgggaggttctccgggtttgcctggagagatcggcttcccgggaaagcctggacctcctgggcccacgggaccccctggaaaggacgggccaaatggaccaccaggtccgccaggaaccaagggagaaccaggagaaagaggggaagatggtctgcctggaaaaccaggccttcggggagaaattggggagcagggcctggcaggccgacctggagagaagggagaagcaggcctcccaggggctccaggcttcccaggtgtgagaggagagaaaggagaccagggagaaaaaggtgaactgggacttccaggactgaaaggtgaccgaggtgaaaagggtgaagctggtcctgcaggccctcccgggttacctggaactacatccctgttcacaccacatccacggatgcccggagaacaagggcccaaaggagagaagggcgatccaggcctgcctggggaaccgggactgcagggccgtcctggagaattggggcctcagggacccactggaccaccgggtgccaagggacaggaaggtgcacatggggctcctggagcagctggaaaccccggtgctcccggacatgtcggtgcccccggtcccagtggccctccaggaagtgtgggtgctcccggcctcagaggcaccccagggaaagatggggagcgtggtgagaagggtgcagcgggggaagaaggcagcccagggccagttggtcccaggggagatcctggtgctcctgggctccctgggccacccggaaaagggaaggatggagagccgggactccgtggatcacctggactccctggacccctaggaaccaaggctgcttgcggaaaagtcagagggtcagaaaactgtgcactgggagggcaatgtgttaagggggatcgaggagctcctgggatccctggttctcctggcagccgtggtgacccaggcattggggttgctggccctcctggcccttccggaccaccaggagacaaaggatccccgggatcacgaggcttacctggattccctggcccccagggcccagccggccgggacggtgcaccaggaaatccaggagaaagagggcctcctggcaagccgggcctctcttcactactgtctccaggggacataaatctcttggctaaggatgtgtgcaatgactgccctcctggccccccaggcctccctggtctaccaggttttaaaggggacaaaggtgtcccaggaaagccagggagagaaggcacagaagggaaaaagggagaggctgggcctccaggcctaccagggcccccaggaatagctggaccacagggaagtcaaggagaacgtggtgcagatggtgaggttgggcagaaaggtgatcagggtcatcctggagttccaggtttcatggggcccccagggaaccctgggccaccaggggcagatggaattgcaggagctgctggaccaccaggaatccaagggtcacctgggaaagaaggccctcctggcccccaaggcccatctggattacccggaatcccaggagaagaaggcaaagagggcagagatggaaagccgggtccccctggagagccgggcaaagcaggagagccaggtctaccaggaccagagggtgcccgaggcccacctggcttcaagggacacacaggcgattctggtgcacccggtccccggggagagtctggtgccatggggcttcctggtcaggaagggttaccaggaaaagatggtgacactggacccactgggccacagggtccccaaggaccaaggggcccaccgggcaagaatggatcaccgggatctccaggagagcctggcccttcaggaacccctggccagaaaggaagcaaaggggaaaatggcagcccaggacttcctggcttcctgggtccccgtgggcctccgggagaaccaggagagaaaggagtcccaggcaaggagggggtccctgggaagcctggagagcctggattcaaaggagaaaggggagatcctgggatcaaaggtgacaaaggacctcctggtggaaaaggccagcctggggaccctggaatcccaggccacaaaggccacacaggcctgatgggtccccaaggactacctggggagaatggaccagttggacccccagggcctccaggccagccgggatttccaggactgaggggggagtctccatccatggaaaccctgcgtcggcttattcaagaagagctggggaagcagcttgaaaccagactcgcctacctcctggcccagatgcccccggcgtacatgaagtcatctcaaggcagacctgggcccccagggccccctggaaaagatgggcttccaggccgggccggccccatgggggagccaggtcgtcctgggcaggggggtctggaaggaccctctggacccataggtcccaaaggtgagcgaggagccaaaggtgacccaggtgcacctggagttggcctccgaggcgagatgggaccccctggaatcccaggtcaacccggggaacctggctatgctaaagatggacttcctgggatccctggccctcaaggggagacaggaccagctggacatcctggcctcccaggacctcccggtcccccaggccaatgtgacccttcccagtgtgcctacttcgccagccttgctgcccggccgggtaatgtgaagggtccctaaaggactctggaaagccagaagactgcagtggatttctgaaacttgaactcagagcccagtgggaagccagaggtcttgaaagacttcagccatgtgttccttttttttttctttcttttatcgtttgctttttgttttattttcttgagagacctcaaaattattaaatccaacagacgctgccggtcggtcagattattattaatattattgttgttgttaattattattattatttcatatgctgatgctttgtgagttcttttccactcctttaaagttgggaaaacttgattcgtggggcaggagattgtttcttcattcttctgacagcccccatctgacgcgtaactgcccattttaaggaaactcttggtgctacaaaaccctgaccagacacttggcaaatttacctctttcttcaaaagaaaaactttaagaaaatgagccaatgggcttcattctcagtcatgcccggagatcacccaggagaaataatacaaacaccaccactgtccagagagagtaaagaagcagaaagagaaagaatttgcaaccatgaggaatgttcccacctcccgacgggacgtgcatttggaaaacacagaatcagccctcagggtgcactccagccacctcagtgctctaagctcacagaagtgaaataatgtctgtgggttggcaatggctttgtgggatcatatgtcttggccaaagatgggaaaacctatgttgaagaggcagcccttgagtgttaatttgtcttctaaactgtgtaaggccccttcaagttcctcttgttggtttcaattatattaattataaaacaagtggatgtggtgaccatccacttgtgtttccctaatgatgggcagttggccagggcactgaccagagctgggaaatttgtatctccaaggcggctctgtctctgaaataaatggcatcaagtgcatgtgtgtatgcgacatgccctgcctgaacaggtgctcaataaatccaagtttccttctcttga

SEQ ID NO: 477 - DNA, 6285 bp, Homo sapiens
ggggctggccgaggctgcggcgtttctccccaaggaagtgtcttctccgctttccctgttcttctgtttctcacacactttctatctcattctgtaactttcaagcctttccttctaactgtatgtatttagttacttgttttcaagctggttccctctctggccccctggcctggggaaagcctccacacttactgcgggtcttgtttagagtctgagtttgtgagattatttgggggagagtgggcgagtggctgacaggtgacccccaggaggaggattcctggggctggtgtcttctcccagctgctgcttccagtgggcctgggcccaggactggacctccgctggcacccctgagtgcctccctgccaggccatgctgctgtagaccctaacagcgtctcttcctggccaagagaagcctgtccccaagaacaggagagccatggccggcctccgagggaacgctgtggctggcctcctctggatgctgctgctgtggagtgggggcggcggctgccaggctcagcgggcaggttgcaaaagtgtccactacgatctggtcttcctcctggacacctcctccagcgtgggcaaggaggactttgagaaggtccggcagtgggtggccaacctggtggacaccttcgaggtgggccccgaccgcacccgtgtgggggtcgtgcgctacagcgaccggcccaccacggccttcgagttgggactctttggctcgcaggaggaggtcaaggcggctgcccggcgtctcgcctaccacgggggcaacaccaacacgggagacgcgctccgctacatcacggcccgcagcttctccccacacgccggcggccgccccagggaccgcgcctacaagcaggtggccatcctgctcaccgacggccgcagccaggacctggtgctggacgccgcggcggcagcccaccgcgctggcatccgcatctttgccgtgggcgtgggcgaggcactcaaggaggagctggaggagatcgcctcagagcccaagtccgcccacgtcttccacgtgtccgacttcaatgccatcgacaagatccggggcaagctgcggcgccgtctttgtgaaaatgtgctctgtcctagcgttcgtgtagaaggagatcgctttaagcacaccaatggaggaaccaaggaaatcacaggttttgacctgatggatttgttcagtgtgaaggaaatcttggggaagagagagaatggagctcagagttcctatgtacggatgggatccttccctgtggtgcaaagtactgaggatgtgttcccccaaggtttacctgatgagtacgcctttgtcacaaccttccggttcaggaaaacctctcggaaggaagactggtatatctggcaggtcatcgaccagtacagcatcccacaggtctccatccggctggatggtgaaaacaaggcagtcgagtacaacgctgtgggtgccatgaaagatgctgtcagggtggtcttccgaggttctcgggtcaatgacctctttgaccgggactggcacaagatggccctgagcatccaggcccagaacgtctccctgcacattgactgtgcgctggtgcagacactacccatcgaggaacgggagaacattgacatccagggcaagactgtgattggcaagcgcctctacgacagtgtgcccattgactttgacctacagcggattgtgatctattgtgactcgagacacgcagaattggagacttgttgtgatatcccctcgggtccgtgccaggtgaccgtggtgacagagcctccacctccacccccaccccagcggcctcccaccccaggcagtgaacagattgggtttttgaagaccatcaactgctcctgcccagctggagagaagggtgaaatgggagttgctggccccatggggctccctggtccaaagggagacataggagccattgggccggttggcgctcctggacctaagggagagaaaggtgatgtgggcataggaccttttggccaaggggaaaagggtgaaaagggttccctgggcctgcccggcccccctgggagagacggcagcaaaggcatgagaggggagccaggagagctgggagagccggggctgccgggtgaggtcggcatgcgggggccccaaggaccacctggactccccggacctcctggacgtgtcggagctcctggtctccaaggagaacgaggtgaaaagggaactcgaggagaaaagggagagcgaggcctggatggattccctgggaagcctggggacacaggacagcagggcaggcccggcccttctggtgtggcaggaccccagggagaaaagggtgacgtgggacctgcggggccacctggtgtaccaggctcagtggtgcagcaagagggcttgaaaggggaacagggagctccaggacccagaggtcaccaaggcgcccccggtcctccaggagctcggggtccaataggcccagaaggcagggatggacctcctggtttgcaaggtctccgagggaagaaaggtgacatgggaccacctggaatccctggattgctggggctgcagggccctccaggaccccctggtgtcccaggcccccctggaccgggaggttctccgggtttgcctggagagatcggcttcccgggaaagcctggacctcctgggcccacgggaccccctggaaaggacgggccaaatggaccaccaggtccgccaggaaccaagggagaaccaggagaaagaggggaagatggtctgcctggaaaaccaggccttcggggagaaattggggagcagggcctggcaggccgacctggagagaagggagaagcaggcctcccaggggctccaggcttcccaggtgtgagaggagagaaaggagaccagggagaaaaaggtgaactgggacttccaggactgaaaggtgaccgaggtgaaaagggtgaagctggtcctgcaggccctcccgggttacctggaactacatccctgttcacaccacatccacggatgcccggagaacaagggcccaaaggagagaagggcgatccaggcctgcctggggaaccgggactgcagggccgtcctggagaattggggcctcagggacccactggaccaccgggtgccaagggacaggaaggtgcacatggggctcctggagcagctggaaaccccggtgctcccggacatgtcggtgcccccggtcccagtggccctccaggaagtgtgggtgctcccggcctcagaggcaccccagggaaagatggggagcgtggtgagaagggtgcagcgggggaagaaggcagcccagggccagttggtcccaggggagatcctggtgctcctgggctccctgggccacccggaaaagggaaggatggagagccgggactccgtggatcacctggactccctggacccctaggaaccaagggggatcgaggagctcctgggatccctggttctcctggcagccgtggtgacccaggcattggggttgctggccctcctggcccttccggaccaccaggagacaaaggatccccgggatcacgaggcttacctggattccctggcccccagggcccagccggccgggacggtgcaccaggaaatccaggagaaagagggcctcctggcaagccgggcctctcttcactactgtctccaggggacataaatctcttggctaaggatgtgtgcaatgactgccctcctggccccccaggcctccctggtctaccaggttttaaaggggacaaaggtgtcccaggaaagccagggagagaaggcacagaagggaaaaagggagaggctgggcctccaggcctaccagggcccccaggaatagctggaccacagggaagtcaaggagaacgtggtgcagatggtgaggttgggcagaaaggtgatcagggtcatcctggagttccaggtttcatggggcccccagggaaccctgggccaccaggggcagatggaattgcaggagctgctggaccaccaggaatccaagggtcacctgggaaagaaggccctcctggcccccaaggcccatctggattacccggaatcccaggagaagaaggcaaagagggcagagatggaaagccgggtccccctggagagccgggcaaagcaggagagccaggtctaccaggaccagagggtgcccgaggcccacctggcttcaagggacacacaggcgattctggtgcacccggtccccggggagagtctggtgccatggggcttcctggtcaggaagggttaccaggaaaagatggtgacactggacccactgggccacagggtccccaaggaccaaggggcccaccgggcaagaatggatcaccgggatctccaggagagcctggcccttcaggaacccctggccagaaaggaagcaaaggggaaaatggcagcccaggacttcctggcttcctgggtccccgtgggcctccgggagaaccaggagagaaaggagtcccaggcaaggagggggtccctgggaagcctggagagcctggattcaaaggagaaaggggagatcctgggatcaaaggtgacaaaggacctcctggtggaaaaggccagcctggggaccctggaatcccaggccacaaaggccacacaggcctgatgggtccccaaggactacctggggagaatggaccagttggacccccagggcctccaggccagccgggatttccaggactgaggggggagtctccatccatggaaaccctgcgtcggcttattcaagaagagctggggaagcagcttgaaaccagactcgcctacctcctggcccagatgcccccggcgtacatgaagtcatctcaaggcagacctgggcccccagggccccctggaaaagatgggcttccaggccgggccggccccatgggggagccaggtcgtcctgggcaggggggtctggaaggaccctctggacccataggtcccaaaggtgagcgaggagccaaaggtgacccaggtgcacctggagttggcctccgaggcgagatgggaccccctggaatcccaggtcaacccggggaacctggctatgctaaagatggacttcctgggatccctggccctcaaggggagacaggaccagctggacatcctggcctcccaggacctcccggtcccccaggccaatgtgacccttcccagtgtgcctacttcgccagccttgctgcccggccgggtaatgtgaagggtccctaaaggactctggaaagccagaagactgcagtggatttctgaaacttgaactcagagcccagtgggaagccagaggtcttgaaagacttcagccatgtgttccttttttttttctttcttttatcgtttgctttttgttttattttcttgagagacctcaaaattattaaatccaacagacgctgccggtcggtcagattattattaatattattgttgttgttaattattattattatttcatatgctgatgctttgtgagttcttttccactcctttaaagttgggaaaacttgattcgtggggcaggagattgtttcttcattcttctgacagcccccatctgacgcgtaactgcccattttaaggaaactcttggtgctacaaaaccctgaccagacacttggcaaatttacctctttcttcaaaagaaaaactttaagaaaatgagccaatgggcttcattctcagtcatgcccggagatcacccaggagaaataatacaaacaccaccactgtccagagagagtaaagaagcagaaagagaaagaatttgcaaccatgaggaatgttcccacctcccgacgggacgtgcatttggaaaacacagaatcagccctcagggtgcactccagccacctcagtgctctaagctcacagaagtgaaataatgtctgtgggttggcaatggctttgtgggatcatatgtcttggccaaagatgggaaaacctatgttgaagaggcagcccttgagtgttaatttgtcttctaaactgtgtaaggccccttcaagttcctcttgttggtttcaattatattaattataaaacaagtggatgtggtgaccatccacttgtgtttccctaatgatgggcagttggccagggcactgaccagagctgggaaatttgtatctccaaggcggctctgtctctgaaataaatggcatcaagtgcatgtgtgtatgcgacatgccctgcctgaacaggtgctcaataaatccaagtttccttctcttg

SEQ ID NO: 478 - DNA, 5424 bp, Homo sapiens
ggggctggccgaggctgcggcgtttctccccaaggaagtgtcttctccgctttccctgttcttctgtttctcacacactttctatctcattctgtaactttcaagcctttccttctaactgtatgtatttagttacttgttttcaagctggttccctctctggccccctggcctggggaaagcctccacacttactgcgggtcttgtttagagtctgagtttgtgagattatttgggggagagtgggcgagtggctgacaggtgacccccaggaggaggattcctggggctggtgtcttctcccagctgctgcttccagtgggcctgggcccaggactggacctccgctggcacccctgagtgcctccctgccaggccatgctgctgtagaccctaacagcgtctcttcctggccaagagaagcctgtccccaagaacaggagagccatggccggcctccgagggaacgctgtggctggcctcctctggatgctgctgctgtggagtgggggcggcggctgccaggctcagcgggcaggttgcaaaagtgtccactacgatctggtcttcctcctggacacctcctccagcgtgggcaaggaggactttgagaaggtccggcagtgggtggccaacctggtggacaccttcgaggtgggccccgaccgcacccgtgtgggggtcgtgcgctacagcgaccggcccaccacggccttcgagttgggactctttggctcgcaggaggaggtcaaggcggctgcccggcgtctcgcctaccacgggggcaacaccaacacgggagacgcgctccgctacatcacggcccgcagcttctccccacacgccggcggccgccccagggaccgcgcctacaagcaggtggccatcctgctcaccgacggccgcagccaggacctggtgctggacgccgcggcggcagcccaccgcgctggcatccgcatctttgccgtgggcgtgggcgaggcactcaaggaggagctggaggagatcgcctcagagcccaagtccgcccacgtcttccacgtgtccgacttcaatgccatcgacaagatccggggcaagctgcggcgccgtctttgtgaaaatgtgctctgtcctagcgttcgtgtagaaggagatcgctttaagcacaccaatggaggaaccaaggaaatcacaggttttgacctgatggatttgttcagtgtgaaggaaatcttggggaagagagagaatggagctcagagttcctatgtacggatgggatccttccctgtggtgcaaagtactgaggatgtgttcccccaaggtttacctgatgagtacgcctttgtcacaaccttccggttcaggaaaacctctcggaaggaagactggtatatctggcaggtcatcgaccagtacagcatcccacaggtctccatccggctggatggtgaaaacaaggcagtcgagtacaacgctgtggcaggaccccagggagaaaagggtgacgtgggacctgcggggccacctggtgtaccaggctcagtggtgcagcaagagggcttgaaaggggaacagggagctccaggacccagaggtcaccaaggcgcccccggtcctccaggagctcggggtccaataggcccagaaggcagggatggacctcctggtttgcaaggtctccgagggaagaaaggtgacatgggaccacctggaatccctggattgctggggctgcagggccctccaggaccccctggtgtcccaggcccccctggaccgggaggttctccgggtttgcctggagagatcggcttcccgggaaagcctggacctcctgggcccacgggaccccctggaaaggacgggccaaatggaccaccaggtccgccaggaaccaagggagaaccaggagaaagaggggaagatggtctgcctggaaaaccaggccttcggggagaaattggggagcagggcctggcaggccgacctggagagaagggagaagcaggcctcccaggggctccaggcttcccaggtgtgagaggagagaaaggagaccagggagaaaaaggtgaactgggacttccaggactgaaaggtgaccgaggtgaaaagggtgaagctggtcctgcaggccctcccgggttacctggaactacatccctgttcacaccacatccacggatgcccggagaacaagggcccaaaggagagaagggcgatccaggcctgcctggggaaccgggactgcagggccgtcctggagaattggggcctcagggacccactggaccaccgggtgccaagggacaggaaggtgcacatggggctcctggagcagctggaaaccccggtgctcccggacatgtcggtgcccccggtcccagtggccctccaggaagtgtgggtgctcccggcctcagaggcaccccagggaaagatggggagcgtggtgagaagggtgcagcgggggaagaaggcagcccagggccagttggtcccaggggagatcctggtgctcctgggctccctgggccacccggaaaagggaaggatggagagccgggactccgtggatcacctggactccctggacccctaggaaccaagggggatcgaggagctcctgggatccctggttctcctggcagccgtggtgacccaggcattggggttgctggccctcctggcccttccggaccaccaggagacaaaggatccccgggatcacgaggcttacctggattccctggcccccagggcccagccggccgggacggtgcaccaggaaatccaggagaaagagggcctcctggcaagccgggcctctcttcactactgtctccaggggacataaatctcttggctaaggatgtgtgcaatgactgccctcctggccccccaggcctccctggtctaccaggttttaaaggggacaaaggtgtcccaggaaagccagggagagaaggcacagaagggaaaaagggagaggctgggcctccaggcctaccagggcccccaggaatagctggaccacagggaagtcaaggagaacgtggtgcagatggtgaggttgggcagaaaggtgatcagggtcatcctggagttccaggtttcatggggcccccagggaaccctgggccaccaggggcagatggaattgcaggagctgctggaccaccaggaatccaagggtcacctgggaaagaaggccctcctggcccccaaggcccatctggattacccggaatcccaggagaagaaggcaaagagggcagagatggaaagccgggtccccctggagagccgggcaaagcaggagagccaggtctaccaggaccagagggtgcccgaggcccacctggcttcaagggacacacaggcgattctggtgcacccggtccccggggagagtctggtgccatggggcttcctggtcaggaagggttaccaggaaaagatggtgacactggacccactgggccacagggtccccaaggaccaaggggcccaccgggcaagaatggatcaccgggatctccaggagagcctggcccttcaggaacccctggccagaaaggaagcaaaggggaaaatggcagcccaggacttcctggcttcctgggtccccgtgggcctccgggagaaccaggagagaaaggagtcccaggcaaggagggggtccctgggaagcctggagagcctggattcaaaggagaaaggggagatcctgggatcaaaggtgacaaaggacctcctggtggaaaaggccagcctggggaccctggaatcccaggccacaaaggccacacaggcctgatgggtccccaaggactacctggggagaatggaccagttggacccccagggcctccaggccagccgggatttccaggactgaggggggagtctccatccatggaaaccctgcgtcggcttattcaagaagagctggggaagcagcttgaaaccagactcgcctacctcctggcccagatgcccccggcgtacatgaagtcatctcaaggcagacctgggcccccagggccccctggaaaagatgggcttccaggccgggccggccccatgggggagccaggtcgtcctgggcaggggggtctggaaggaccctctggacccataggtcccaaaggtgagcgaggagccaaaggtgacccaggtgcacctggagttggcctccgaggcgagatgggaccccctggaatcccaggtcaacccggggaacctggctatgctaaagatggacttcctgggatccctggccctcaaggggagacaggaccagctggacatcctggcctcccaggacctcccggtcccccaggccaatgtgacccttcccagtgtgcctacttcgccagccttgctgcccggccgggtaatgtgaagggtccctaaaggactctggaaagccagaagactgcagtggatttctgaaacttgaactcagagcccagtgggaagccagaggtcttgaaagacttcagccatgtgttccttttttttttctttcttttatcgtttgctttttgttttattttcttgagagacctcaaaattattaaatccaacagacgctgccggtcggtcagattattattaatattattgttgttgttaattattattattatttcatatgctgatgctttgtgagttcttttccactcctttaaagttgggaaaacttgattcgtggggcaggagattgtttcttcattcttctgacagcccccatctgacgcgtaactgcccattttaaggaaactcttggtgctacaaaaccctgaccagacacttggcaaatttacctctttcttcaaaagaaaaactttaagaaaatgagccaatgggcttcattctcagtcatgcccggagatcacccaggagaaataatacaaacaccaccactgtccagagagagtaaagaagcagaaagagaaagaatttgcaaccatgaggaatgttcccacctcccgacgggacgtgcatttggaaaacacagaatcagccctcagggtgcactccagccacctcagtgctctaagctcacagaagtgaaataatgtctgtgggttggcaatggctttgtgggatcatatgtcttggccaaagatgggaaaacctatgttgaagaggcagcccttgagtgttaatttgtcttctaaactgtgtaaggccccttcaagttcctcttgttggtttcaattatattaattataaaacaagtggatgtggtgaccatccacttgtgtttccctaatgatgggcagttggccagggcactgaccagagctgggaaatttgtatctccaaggcggctctgtctctgaaataaatggcatcaagtgcatgtgtgtatgcgacatgccctgcctgaacaggtgctcaataaatccaagtttccttctcttg

SEQ ID NO: 479 - DNA, 6825 bp, Homo sapiens
acagagtcgcctttgaaccgcaagtgaacttgagtgctgcactagcagcccggctcccgctgccgccggcgccccgaggcctcccagtgaggtttacctcctcgcccgccctccccggggagcgcaaccctgggctcgttcgttaccgagccagagagctaggaagcctgtcctccccttcgggtgctatttcctacctcctcccgacttcaccccctcccctcctttttttcttgttgcgggtttgaagcatggttttcatgtgattgttttttccctttttcatggacagtacctgcaccctaagcagttcagagttggcttctgttttccgttagcgctttgctgcacggacaaatgcatacaaatgcatttaagagcccacagaacaaggcgtggaaaagtctcccccacggcaaaaacgaaatcacttcttcattttattgtactatgtgtggctggggtggttgttcatgcacaagaacaaggcatagatattcttcatcaactaggccttggaggcaaagacgtaagacactcatcaccagcgactgctgtaccatcagcatctacaccgttacctcagggggtccatttaacagaatcaggagtcatttttaaaaatgatgcttatatcgagacacctttcgtgaaaattttaccagtcaacttggggcagccgtttacaatattaactgggttacagtcacatcgggtgaacaatgcatttctcttcagcattagaaataaaaatagactgcaattaggagtacaattactacctaaaaaattagtagtacacattagaggaaagcagcctgcagttttcaactacagtgttcatgatgagcaatggcactcatttgccattactattagaaaccaaagtgtctcaatgtttgttgagtgtggaaagaaatattttagcacagagactattccagaagttcagacctttgattctaatagtgtgtttactttaggaagtatgaataataattctatccattttgaaggaatagtatgtcagttagatattattccttctgcagaagcatctgcagactactgcagatatgtgaaacagcagtgtcgccaagcagacaaataccaacctgaaacaagcattccttgtacaactctcataccaacaaagataccggaacactctcccccgcccaaactatttgctgaaaaagtactgtcagaggatacatttactgaaggcaaaagcattccaaatatcataaaaaatgattctgaaaccgtgtataaaagacaagaacaccagatatcaagatctcagttatcttctcttcagtcaggaaatgtctctgctgtggatctcacaaaccatgggattcaggccaaagaaatgatcactgaggaagatactcagacaaatttcagcctgtcagtgaccactcatcgcatcagtgaggcaaaaatgaataccaaagagaaatttagctctctcctaaacatgtctgacaatatcacacaacatgatgatagagtaactggtctgtcactgtttaagaagatgccatctattcttccacaaattaaacaagatacaattactaatctcaagaaggctatcacagcaaatctacacactaacgaactcatggaaatgcaaccaattttaaacacaagcttgcatagagtgacaaatgagccatctgtggataatcaccttgatctaaggaaagaaggtgaattttatcctgatgctacttatcccatcgaaaatagctatgaaactgagctttatgattattattattatgaggatctaaatacaatgcttgaaatggagtatctgagagggccaaaaggagacactggacctcccggtccacctggtccagcaggtatcccaggtccgtcagggaagagaggtccacggggcataccagggccacatggaaatcctggtttacctggattacctggtccaaagggccccaaaggagatccaggattttccccaggtcaacctgttcctggagaaaagggtgatcaaggcctttctggattaatgggcccccctggtatgcaaggtgataagggtctcaaaggacatcctggactcccaggacttccaggtgaacaaggaattccaggatttgctggtaatattggttcacccggttaccctggcaggcagggtttagctggaccagaaggtaatccaggtcctaaaggtgcacaaggttttattggctctcctggagaagcgggacaactgggacctgaaggagaacggggcattcctgggatccgtggaaagaagggttttaaggggagacagggttttccaggtgactttggagacagaggccctgctggtcttgatggcagtcctggacttgtaggtggcactggtcctccggggtttcctgggcttagaggcagtgttggccctgtgggaccaattggacctgctggaattcctggcccaatgggcctttcagggaataaaggactacctggaatcaaaggtgataagggtgaacaaggcacagcaggagagctaggagaacccgggtatcctggagacaagggtgctgttggtttaccaggaccaccagggatgagaggaaagtcagggccttcaggccaaacaggtgacccaggactccaaggaccatctggccctccaggaccagagggttttccaggagatattgggattcctggacaaaacggccctgaaggaccaaagggactccttggaaatagaggacctcctggacctcctggtctcaaaggaactcagggagaagaaggaccaattggagcctttggggaactggggccaagaggaaaaccaggtcaaaaggggtatgcaggtgaaccaggaccagaaggcttaaagggagaagtaggagatcaaggaaatattggaaaaattggtgaaacaggacctgttggcttacctggagaagttgggatgactggaagcattggcgaaaagggagaacgtggaagtccaggcccactaggtccgcagggagaaaaaggtgttatgggatatccaggtcctcctggggttccaggacctatcggtccattgggattacctggtcatgtgggggcaagaggaccacctgggagtcaaggtcctaaaggacaaagaggatcaagaggaccagatggtctcttaggggaacaaggtatacaaggtgccaagggtgaaaaaggagatcaaggaaaaagagggcctcatggtcttattggtaagactggaaaccctggagaaagaggatttcaagggaaaccaggtttacagggattgcctggaagtacaggtgacagaggacttccaggagagccaggactgcgaggactgcaaggtgatgttggacctcctggagaaatgggcatggagggacctccaggcactgagggagagtctggtctgcaaggtgaaccaggtgcaaagggagatgttggaactgctggcagtgttggaggaactggggaaccaggtttacggggtgaaccaggagctcctggagaagaaggtctccagggaaaagatgggttaaagggagtaccaggaggaaggggacttcctggagaggatggagaaaaaggagagatgggcttaccaggaattataggacccttgggtagatcaggccaaacaggccttccgggacctgaaggaattgtgggaattccagggcaaagaggtcgtccaggaaaaaagggtgataaaggacaaataggacccacaggagaagttggaagcagaggtcctcctggaaaaattgggaaaagtggtcctaagggtgccagaggaactagaggtgctgtgggacatttaggattgatgggacctgatggagaaccaggaattccagggtacaggggccatcagggccaaccaggaccctctggattgccaggacctaaaggagaaaagggctacccaggagaagatagcacagtcctaggaccacctgggcctcgaggtgaaccaggtccagtgggggaccaaggagagagaggagagcctggagcagagggatataagggccatgtgggtgtaccaggactaagaggtgccactggacaacaaggacccccaggcgaaccaggtgaccagggtgaacaaggactaaaaggagagagaggatctgaaggtaataaggggaaaaaaggagctcctggtccttctgggaaacctgggattcctggacttcaaggcctacttgggccaaaaggcatacaaggataccatggagcagatggcatttcaggaaaccctggaaaaattgggccaccaggaaaacagggacttcctggcatcagaggcggcccaggaagaacaggtcttgctggggctccaggtcctccaggagtaaagggttcatcaggcttgccaggaagcccaggaattcaaggcccaaagggtgaacaagggctacctggtcaacctggaattcaaggtaaaagaggtcaccgaggagcacaaggtgatcaaggaccatgtggagaccctggcctgaaagggcagcctggagaatatggtgttcaaggtttgacaggtttccaaggattcccaggccctaaaggtcctgaaggggatgctggcattgttgggatatcaggtcctaaaggtcctattggacacagaggaaacactggtccccttggcagagaaggtataataggcccaacaggtagaactggacccagaggtgaaaagggctttagaggtgaaactggtcctcaaggaccaagaggtcaaccagggcctccaggtccacctggagcaccaggcccaagaaagcaaatggatatcaatgctgctattcaagccttgattgaatcaaatactgccctacagatggagagctaccagaatactgaagtgactttaattgaccacagtgaagagatattcaaaaccctgaactaccttagcaatttattgcacagcatcaagaatcctcttggcacacgagataacccagcacgaatctgcaaagatttacttaactgtgaacaaaaagtatcagatggaaaatactggattgacccaaatcttggctgtccttcagatgccattgaggttttctgcaatttcagtgctggtggccagacatgcttacctcctgtttctgtaacaaagttggagtttggagttgggaaagtccagatgaacttccttcatttactgagttcggaagccacccatatcatcaccattcactgtctaaacaccccaaggtggacaagcacacaaacaagtggcccaggattgcctattggtttcaagggatggaatggccagatttttaaagtaaacactctacttgaacctaaagtgctttcagatgactgcaagattcaagatggcagctggcataaggcaacatttctttttcacacccaggaacctaatcaacttccagtgattgaagtacaaaaacttcctcatctcaaaactgaacgaaagtattacattgacagcagttctgtatgctttctgtaaagtctctgaattagttccgaattcaggctgttggccaggtaattgctgcagagggagaaataagacagacagatacagtcattatgaaatgcatgtaataaagcattggctaaatcttaaagaatctcaggaagaacagacttcctcctaagaaggagaaaaggcatttttaaaggactatgattgataaagtatttaattcttttaaaaattatattcatctcagctttcttagagaattccctagaactaaaaatttataaatatggaattcttcagggtatcttatatttttgactgagtgcgtagtacccattagacagctggagatgcagagcactatggagcaatactggctaatgcttccagatgtgcactgcttctgtctaaaaattacaagccacagtctaatatgtcttattttccaaaacactaagctgtattcaggtccccgatgggcatatacatcttagccggtgatacactacctcttacgtgttgcctctttgtgttgcttggtgctctttcgaaaacaaggtgcttatggctttcatagactatttcctttttcatctttgtcattctttaaaagtgtatgtactggttacatcaagatatgttttggttgttagtacttattttaatttgtttggtcacacacttaataacacgtgaaactatttatgtgaagtccttgttttattttaaaattctctttgtgtatttggaatcaaagccagcacattgtaacctgtgcttgtacgcaaaagaattagatttctttgtttttgttttattttttaaattgttgtaaaaattattataggccagctacatctagtagtaggtttggggtacagattgggggttgtgccatactgtttttaaagttcatgatcatctggaatgatacttagtgtatatatattttgtaaagttttaattcagcaaattttttgaaattgctgctgttttaaattataaaacctttatatttctgctttgtagaaattatatgttttgtagtattcattgattttctttcactgtacttaaatttagtgttagtactttaaaatttttaatttaccagtctttaaagcaacatccagaaaaaaaaaagtcttttcccatttaaaataggctcagccagttcaatgtctccttgttatcagagaaatattagttcaatactgaaagaaaaatattatacctcttggtatctagaaaagcttgttcatccattataaatatatctttagccacagcaaaccacacttaacctatctataataaaaatgtgctttaaataa

SEQ ID NO: 480 - DNA, 6437 bp, Homo sapiens
tgttttccgttagcgctttgctgcacggacaaatgcatacaaatgcatttaagagcccacagaacaaggcgtggaaaagtctcccccacggcaaaaacgaaatcacttcttcattttattgtactatgtgtggctggggtggttgttcatgcacaagaacaaggcatagatattcttcatcaactaggccttggaggcaaagacgtaagacactcatcaccagcgactgctgtaccatcagcatctacaccgttacctcagggggtccatttaacagaatcaggagtcatttttaaaaatgatgcttatatcgagacacctttcgtgaaaattttaccagtcaacttggggcagccgtttacaatattaactgggttacagtcacatcgggtgaacaatgcatttctcttcagcattagaaataaaaatagactgcaattaggagtacaattactacctaaaaaattagtagtacacattagaggaaagcagcctgcagttttcaactacagtgttcatgatgagcaatggcactcatttgccattactattagaaaccaaagtgtctcaatgtttgttgagtgtggaaagaaatattttagcacagagactattccagaagttcagacctttgattctaatagtgtgtttactttaggaagtatgaataataattctatccattttgaaggaatagtatgtcagttagatattattccttctgcagaagcatctgcagactactgcagatatgtgaaacagcagtgtcgccaagcagacaaataccaacctgaaacaagcattccttgtacaactctcataccaacaaagataccggaacactctcccccgcccaaactatttgctgaaaaagtactgtcagaggatacatttactgaaggcaaaagcattccaaatatcataaaaaatgattctgaaaccgtgtataaaagacaagaacaccagatatcaagatctcagttatcttctcttcagtcaggaaatgtctctgctgtggatctcacaaaccatgggattcaggccaaagaaatgatcactgaggaagatactcagacaaatttcagcctgtcagtgaccactcatcgcatcagtgaggcaaaaatgaataccaaagagaaatttagctctctcctaaacatgtctgacaatatcacacaacatgatgatagagtaactggtctgtcactgtttaagaagatgccatctattcttccacaaattaaacaagatacaattactaatctcaagaaggctatcacagcaaatctacacactaacgaactcatggaaatgcaaccaattttaaacacaagcttgcatagagtgacaaatgagccatctgtggataatcaccttgatctaaggaaagaaggtgaattttatcctgatgctacttatcccatcgaaaatagctatgaaactgagctttatgattattattattatgaggatctaaatacaatgcttgaaatggagtatctgagagggccaaaaggagacactggacctcccggtccacctggtccagcaggtatcccaggtccgtcagggaagagaggtccacggggcataccagggccacatggaaatcctggtttacctggattacctggtccaaagggccccaaaggagatccaggattttccccaggtcaacctgttcctggagaaaagggtgatcaaggcctttctggattaatgggcccccctggtatgcaaggtgataagggtctcaaaggacatcctggactcccaggacttccaggtgaacaaggaattccaggatttgctggtaatattggttcacccggttaccctggcaggcagggtttagctggaccagaaggtaatccaggtcctaaaggtgcacaaggttttattggctctcctggagaagcgggacaactgggacctgaaggagaacggggcattcctgggatccgtggaaagaagggttttaaggggagacagggttttccaggtgactttggagacagaggccctgctggtcttgatggcagtcctggacttgtaggtggcactggtcctccggggtttcctgggcttagaggcagtgttggccctgtgggaccaattggacctgctggaattcctggcccaatgggcctttcagggaataaaggactacctggaatcaaaggtgataagggtgaacaaggcacagcaggagagctaggagaacccgggtatcctggagacaagggtgctgttggtttaccaggaccaccagggatgagaggaaagtcagggccttcaggccaaacaggtgacccaggactccaaggaccatctggccctccaggaccagagggttttccaggagatattgggattcctggacaaaacggccctgaaggaccaaagggactccttggaaatagaggacctcctggacctcctggtctcaaaggaactcagggagaagaaggaccaattggagcctttggggaactggggccaagaggaaaaccaggtcaaaaggggtatgcaggtgaaccaggaccagaaggcttaaagggagaagtaggagatcaaggaaatattggaaaaattggtgaaacaggacctgttggcttacctggagaagttgggatgactggaagcattggcgaaaagggagaacgtggaagtccaggcccactaggtccgcagggagaaaaaggtgttatgggatatccaggtcctcctggggttccaggacctatcggtccattgggattacctggtcatgtgggggcaagaggaccacctgggagtcaaggtcctaaaggacaaagaggatcaagaggaccagatggtctcttaggggaacaaggtatacaaggtgccaagggtgaaaaaggagatcaaggaaaaagagggcctcatggtcttattggtaagactggaaaccctggagaaagaggatttcaagggaaaccaggtttacagggattgcctggaagtacaggtgacagaggacttccaggagagccaggactgcgaggactgcaaggtgatgttggacctcctggagaaatgggcatggagggacctccaggcactgagggagagtctggtctgcaaggtgaaccaggtgcaaagggagatgttggaactgctggcagtgttggaggaactggggaaccaggtttacggggtgaaccaggagctcctggagaagaaggtctccagggaaaagatgggttaaagggagtaccaggaggaaggggacttcctggagaggatggagaaaaaggagagatgggcttaccaggaattataggacccttgggtagatcaggccaaacaggccttccgggacctgaaggaattgtgggaattccagggcaaagaggtcgtccaggaaaaaagggtgataaaggacaaataggacccacaggagaagttggaagcagaggtcctcctggaaaaattgggaaaagtggtcctaagggtgccagaggaactagaggtgctgtgggacatttaggattgatgggacctgatggagaaccaggaattccagggtacaggggccatcagggccaaccaggaccctctggattgccaggacctaaaggagaaaagggctacccaggagaagatagcacagtcctaggaccacctgggcctcgaggtgaaccaggtccagtgggggaccaaggagagagaggagagcctggagcagagggatataagggccatgtgggtgtaccaggactaagaggtgccactggacaacaaggacccccaggcgaaccaggtgaccagggtgaacaaggactaaaaggagagagaggatctgaaggtaataaggggaaaaaaggagctcctggtccttctgggaaacctgggattcctggacttcaaggcctacttgggccaaaaggcatacaaggataccatggagcagatggcatttcaggaaaccctggaaaaattgggccaccaggaaaacagggacttcctggcatcagaggcggcccaggaagaacaggtcttgctggggctccaggtcctccaggagtaaagggttcatcaggcttgccaggaagcccaggaattcaaggcccaaagggtgaacaagggctacctggtcaacctggaattcaaggtaaaagaggtcaccgaggagcacaaggtgatcaaggaccatgtggagaccctggcctgaaagggcagcctggagaatatggtgttcaaggtttgacaggtttccaaggattcccaggccctaaaggtcctgaaggggatgctggcattgttgggatatcaggtcctaaaggtcctattggacacagaggaaacactggtccccttggcagagaaggtataataggcccaacaggtagaactggacccagaggtgaaaagggctttagaggtgaaactaagcaaatggatatcaatgctgctattcaagccttgattgaatcaaatactgccctacagatggagagctaccagaatactgaagtgactttaattgaccacagtgaagagatattcaaaaccctgaactaccttagcaatttattgcacagcatcaagaatcctcttggcacacgagataacccagcacgaatctgcaaagatttacttaactgtgaacaaaaagtatcagatggaaaatactggattgacccaaatcttggctgtccttcagatgccattgaggttttctgcaatttcagtgctggtggccagacatgcttacctcctgtttctgtaacaaagttggagtttggagttgggaaagtccagatgaacttccttcatttactgagttcggaagccacccatatcatcaccattcactgtctaaacaccccaaggtggacaagcacacaaacaagtggcccaggattgcctattggtttcaagggatggaatggccagatttttaaagtaaacactctacttgaacctaaagtgctttcagatgactgcaagattcaagatggcagctggcataaggcaacatttctttttcacacccaggaacctaatcaacttccagtgattgaagtacaaaaacttcctcatctcaaaactgaacgaaagtattacattgacagcagttctgtatgctttctgtaaagtctctgaattagttccgaattcaggctgttggccaggtaattgctgcagagggagaaataagacagacagatacagtcattatgaaatgcatgtaataaagcattggctaaatcttaaagaatctcaggaagaacagacttcctcctaagaaggagaaaaggcatttttaaaggactatgattgataaagtatttaattcttttaaaaattatattcatctcagctttcttagagaattccctagaactaaaaatttataaatatggaattcttcagggtatcttatatttttgactgagtgcgtagtacccattagacagctggagatgcagagcactatggagcaatactggctaatgcttccagatgtgcactgcttctgtctaaaaattacaagccacagtctaatatgtcttattttccaaaacactaagctgtattcaggtccccgatgggcatatacatcttagccggtgatacactacctcttacgtgttgcctctttgtgttgcttggtgctctttcgaaaacaaggtgcttatggctttcatagactatttcctttttcatctttgtcattctttaaaagtgtatgtactggttacatcaagatatgttttggttgttagtacttattttaatttgtttggtcacacacttaataacacgtgaaactatttatgtgaagtccttgttttattttaaaattctctttgtgtatttggaatcaaagccagcacattgtaacctgtgcttgtacgcaaaagaattagatttctttgtttttgttttattttttaaattgttgtaaaaattattataggccagctacatctagtagtaggtttggggtacagattgggggttgtgccatactgtttttaaagttcatgatcatctggaatgatacttagtgtatatatattttgtaaagttttaattcagcaaattttttgaaattgctgctgttttaaattataaaacctttatatttctgctttgtagaaattatatgttttgtagtattcattgattttctttcactgtacttaaatttagtgttagtactttaaaatttttaatttaccagtctttaaagcaacatccagaaaaaaaaaagtcttttcccatttaaaataggctcagccagttcaatgtctccttgttatcagagaaatattagttcaatactgaaagaaaaatattatacctcttggtatctagaaaagcttgttcatccattataaatatatctttagccacagcaaaccacacttaacctatctataataaaaatgtgctttaaataa

SEQ ID NO: 481 - DNA, 366 bp, Homo sapiens
gcgcctgcagttgccaccggccccctcgcaccgacttgatttccgaatacctgcaccctaagcagttcagagttggcttctgttttccgttagcgctttgctgcacggacaaatgcatacaaatgcatttaagagcccacagaacaaggcgtggaaaagtctcccccacggcaaaaacgaaatcacttcttcattttattgtactatgtgtggctggggtggttgttcatgcacaagaacaaggcatagatattcttcatcaactaggccttggaggcaaagacgtaagacactcatcaccagcgactgctgtaccatcagcatctacaccgttacctcagggggtccatttaacagaatcaggag

SEQ ID NO: 482 - DNA, 1968 bp, Homo sapiens
atgctgctgaagaagcacgcagggaaaggagggggccgggagcccagatccgaggacccgacccctgccgaacagcattgtgcccggaccatgcccccgtgtgccgtcctggcggccctcctgtcagtggtggccgtggtgtcttgcctgtacctgggtgtgaaaaccaacgacctccaggcgaggatcgccgctctcgaatccgccaaaggggccccttccattcatctgctgcctgataccctggatcacctcaagactatggtgcaagagaaagtggagcgacttctggctcagaaatcctatgaacatatggctaaaataagaatcgcaagagaagcaccttcagaatgtaactgcccagcaggccctccagggaaacgaggtaagagaggccgaagaggagaatctgctgggccgccaggggcacctgcccccagtcagggccctcctggtccaaaaggcgataagggagaacaaggtgatcagggacctaggatggtgtttcctaaaatcaatcatgggtttctctctgctgatcagcagctcattaaacgccgcctgattaagggtgaccaaggacaggcagggcctccaggaccccctggccctccaggcccaagagggccacctggggacacagggaaagatggcccccgtggaatgccaggagtacccggtgaaccaggaaagccaggagaacaaggcttgatgggtcctctagggcctccgggacaaaagggttctattggagcacctggaattccagggatgaatgggcaaaagggtgagcccgggttgcctggagcagtaggacagaatggaataccaggacctaagggagaacctggagaacaaggtgaaaagggagacgctggagagaacggccccaagggtgacacaggcgaaaagggtgaccctggatcatctgctgcaggaattaagggagaacctggggaatctggtcgtccagggcaaaagggtgaaccagggcttcctgggcttcctggacttccggggataaagggagaaccaggtttcattggtcctcaaggagaaccaggcttaccaggtttaccaggaacaaaaggtgaacggggggaagcagggcctcctggaagaggtgagcgaggggaacctggagcccccggaccaaaggggaaacaaggtgaatcaggaactagaggcccaaaggggtcaaagggggatcgtggagaaaaaggggactctggagctcagggaccaaggggtccacctggtcaaaaaggggatcaaggagccactgagatcatagactacaacggcaacctccacgaagccttacagaggattaccaccttaactgtcacgggtccccctggacctcctggacctcaaggactacaagggccaaagggagagcagggatctccaggaatcccaggaatggatggagagcagggactcaaaggctcaaagggagacatgggggacccaggtatgacaggtgaaaaaggaggaattggacttcctggattaccgggagccaatggaatgaaaggagaaaaaggagattctggaatgccgggtccacagggtccttctatcataggcccaccaggcccaccaggtccccatggcccacctggccccatgggacctcatggacttcctggaccaaagggtacagatggtcctatgggaccccatggccctgcaggtcccaaaggagaaagaggtgaaaaaggagctatgggagagcctggaccaagagggccctatgggctgcctgggaaagatggagagcctggtcttgatggcttccctggtccacggggtgagaagggtgatctaggagaaaagggagaaaagggattccgtggcgttaagggggaaaaaggggagccaggccagcctggcctggatgggctggatgccccttgccaattggggccagatggcttacccatgcctggctgttggcaaaag

SEQ ID NO: 483 - DNA, 2674 bp, Homo sapiens
ccgcgacttcggcttcgcgagtagcattggttccttgggtttatttcgttttcctctctcttctccaccttagtcgcccctttcgcgctgcgctgtagcgtgctctcacagcctttttgccttgaactgaatgcaggtgggaaacaggtcggcgtgccgaaagacaccgagtaggtagaaataaggcaaactcacagaggcgcaacaggtccggtcctccgtggccagggcgagccgcggccccgcgtggcgcctcggccgttgccctcggaccctgagcggccactgttggggccctcgaaagaggtgtcggtcctctgggagtcggaagagctgtctgggtgggtttcgtcttgctttttaccccaccgccacccagtccccggacggagggtgcttttcacttccagctgggaggagagaagaaagcggggatggtgcacgcctgcgggtctggacgctgagcaaggcaggggattatttgaggtgtagagggtgggaagcgaagccgagacggccgaccccgccacgatgctgctgaagaagcacgcagggaaaggagggggccgggagcccagatccgaggacccgacccctgccgaacagcattgtgcccggaccatgcccccgtgtgccgtcctggcggccctcctgtcagtggtggccgtggtgtcttgcctgtacctgggtgtgaaaaccaacgacctccaggcgaggatcgccgctctcgaatccgccaaaggggccccttccattcatctgctgcctgataccctggatcacctcaagactatggtgcaagagaaagtggagcgacttctggctcagaaatcctatgaacatatggctaaaataagaatcgcaagagaagcaccttcagaatgtaactgcccagcaggccctccagggaaacgaggtaagagaggccgaagaggagaatctggtcctcctggacagcctggtcctcagggccctcctggtccaaaaggcgataagggagaacaaggtgatcagggacctaggatggtgtttcctaaaatcaatcatgggtttctctctgctgatcagcagctcattaaacgccgcctgattaagggtgaccaaggacaggcagggcctccaggaccccctggccctccaggcccaagagggccacctggggacacagggaaagatggcccccgtggaatgccaggagtacccggtgaaccaggaaagccaggagaacaaggcttgatgggtcctctagggcctccgggacaaaagggttctattggagcacctggaattccagggatgaatgggcaaaagggtgagcccgggttgcctggagcagtaggacagaatggaataccaggacctaagggagaacctggagaacaaggtgaaaagggagacgctggagagaacggccccaagggtgacacaggcgaaaagggtgaccctggatcatctgctgcaggaattaagggagaacctggggaatctggtcgtccagggcaaaagggtgaaccagggcttcctgggcttcctggacttccggggataaagggagaaccaggtttcattggtcctcaaggagaaccaggcttaccaggtttaccaggaacaaaaggtgaacggggggaagcagggcctcctggaagaggtgagcgaggggaacctggagcccccggaccaaaggggaaacaaggtgaatcaggaactagaggcccaaaggggtcaaagggggatcgtggagaaaaaggggactctggagctcagggaccaaggggtccacctggtcaaaaaggggatcaaggagccactgagatcatagactacaacggcaacctccacgaagccttacagaggattaccaccttaactgtcacgggtccccctggacctcctggacctcaaggactacaagggccaaagggagagcagggatctccaggaatcccaggaatggatggagagcagggactcaaaggctcaaagggagacatgggggacccaggtatgacaggtgaaaaaggaggaattggacttcctggattaccgggagccaatggaatgaaaggagaaaaaggagattctggaatgccgggtccacagggtccttctatcataggcccaccaggcccaccaggtccccatggcccacctggccccatgggacctcatggacttcctggaccaaagggtacagatggtcctatgggaccccatggccctgcaggtcccaaaggagaaagaggtgaaaaaggagctatgggagagcctggaccaagagggccctatgggctgcctgggaaagatggagagcctggtcttgatggcttccctggtccacggggtgagaagggtgatctaggagaaaagggagaaaaggtgacctctccatcccagcatgtaccttgtttgattcttctcctgctgtctgctttgctgttcagcttgtgtgattccatttgacacttaatctttctccatcctgtgctccaaaaacatactgatgcctgatttaaggaatcaggtcttcagagaggaatgaagaaggctgtactgccagatataagggcactgcctggcatagaagaaaaaattattatcaccagatattctagctacagtttttcaaccacctgacaccaatttatggaaaaataaaggatttttgaaaaaaaaa

SEQ ID NO: 484 - DNA, 2724 bp, Homo sapiens
ccgcgacttcggcttcgcgagtagcattggttccttgggtttatttcgttttcctctctcttctccaccttagtcgcccctttcgcgctgcgctgtagcgtgctctcacagcctttttgccttgaactgaatgcaggtgggaaacaggtcggcgtgccgaaagacaccgagtaggtagaaataaggcaaactcacagaggcgcaacaggtccggtcctccgtggccagggcgagccgcggccccgcgtggcgcctcggccgttgccctcggaccctgagcggccactgttggggccctcgaaagaggtgtcggtcctctgggagtcggaagagctgtctgggtgggtttcgtcttgctttttaccccaccgccacccagtccccggacggagggtgcttttcacttccagctgggaggagagaagaaagcggggatggtgcacgcctgcgggtctggacgctgagcaaggcaggggattatttgaggtgtagagggtgggaagcgaagccgagacggccgaccccgccacgatgctgctgaagaagcacgcagggaaaggagggggccgggagcccagatccgaggacccgacccctgccgaacagcattgtgcccggaccatgcccccgtgtgccgtcctggcggccctcctgtcagtggtggccgtggtgtcttgcctgtacctgggtgtgaaaaccaacgacctccaggcgaggatcgccgctctcgaatccgccaaaggggccccttccattcatctgctgcctgataccctggatcacctcaagactatggtgcaagagaaagtggagcgacttctggctcagaaatcctatgaacatatggctaaaataagaatcgcaagagaagcaccttcagaatgtaactgcccagcaggccctccagggaaacgaggtaagagaggccgaagaggagaatctggtcctcctggacagcctggtcctcagggccctcctggtccaaaaggcgataagggagaacaaggtgatcagggacctaggatggtgtttcctaaaatcaatcatgggtttctctctgctgatcagcagctcattaaacgccgcctgattaagggtgaccaaggacaggcagggcctccaggaccccctggccctccaggcccaagagggccacctggggacacagggaaagatggcccccgtggaatgccaggagtacccggtgaaccaggaaagccaggagaacaaggcttgatgggtcctctagggcctccgggacaaaagggttctattggagcacctggaattccagggatgaatgggcaaaagggtgagcccgggttgcctggagcagtaggacagaatggaataccaggacctaagggagaacctggagaacaaggtgaaaagggagacgctggagagaacggccccaagggtgacacaggcgaaaagggtgaccctggatcatctgctgcaggaattaagggagaacctggggaatctggtcgtccagggcaaaagggtgaaccagggcttcctgggcttcctggacttccggggataaagggagaaccaggtttcattggtcctcaaggagaaccaggcttaccaggtttaccaggaacaaaaggtgaacggggggaagcagggcctcctggaagaggtgagcgaggggaacctggagcccccggaccaaaggggaaacaaggtgaatcaggaactagaggcccaaaggggtcaaagggggatcgtggagaaaaaggggactctggagctcagggaccaaggggtccacctggtcaaaaaggggatcaaggagccactgagatcatagactacaacggcaacctccacgaagccttacagaggattaccaccttaactgtcacgggtccccctggacctcctggacctcaaggactacaagggccaaagggagagcagggatctccaggaatcccaggaatggatggagagcagggactcaaaggctcaaagggagacatgggggacccaggtatgacaggtgaaaaaggaggaattggacttcctggattaccgggagccaatggaatgaaaggagaaaaaggagattctggaatgccgggtccacagggtccttctatcataggcccaccaggcccaccaggtccccatggcccacctggccccatgggacctcatggacttcctggaccaaagggtacagatggtcctatgggaccccatggccctgcaggtcccaaaggagaaagaggtgaaaaaggagctatgggagagcctggaccaagagggccctatgggctgcctgggaaagatggagagcctggtcttgatggcttccctggtccacggggtgagaagggtgatctaggagaaaagggagaaaagggattccgtggcgttaagggggaaaaaggggagccaggccagcctggcctggatgggctggatgccccttgccaattggggccagatggcttacccatgcctggctgttggcaaaagtgatgaatctaacctttcaagcatgaagttgtgtatataagggtccatttttaatatttatagttgaaaactgaattgcagattttacaagtctgagatatgtttacatagggctgcttcttcctgctggcagtagtatacatgtccatttttactccacttacatctgaaattgggcaatttgtgaaaccagtgagaatcctgcaaaaaatatagatcagtatctcctta

SEQ ID NO: 485 - DNA, 1749 bp, Homo sapiens
atgctgctgaagaagcacgcagggaaaggagggggccgggagcccagatccgaggacccgacccctgccgaacagcattgtgcccggaccatgcccccgtgtgccgtcctggcggccctcctgtcagtggtggccgtggtgtcttgcctgtacctgggtgtgaaaaccaacgacctccaggcgaggatcgccgctctcgaatccgccaaaggggccccttccattcatctgctgcctgataccctggatcacctcaagactatggtgcaagagaaagtggagcgacttctggctcagaaatcctatgaacatatggctaaaataagaatcgcaagagaagcaccttcagaatgtaactgcccagcaggccctccagggaaacgaggtaagagaggccgaagaggagaatctgctgggccgccagggggccctcctggtccaaaaggcgataagggagaacaaggtgatcagggacctaggatggtgtttcctaaaatcaatcatgggtttctctctgctgatcagcagctcattaaacgccgcctgattaagggtgaccaaggacaggcagggcctccaggaccccctggccctccaggcccaagagggccacctggggacacagggaaagatggcccccgtggaatgccaggagtacccggtgaaccaggaaagccaggagaacaaggcttgatgggtcctctagggcctccgggacaaaagggttctattggagcacctggaattccagggatgaatgggcaaaagggtgagcccgggttgcctggagcagtaggacagaatggaataccaggacctaagggagaacctggagaacaaggtgaaaagggagacgctggagagaacggccccaagggtgacacaggcgaaaagggtgaccctggatcatctgctgcaggaattaagggagaacctggggaatctggtcgtccagggcaaaagggagaaccaggtttcattggtcctcaaggagaaccaggcttaccaggtttaccaggaacaaaaggtgaacggggggaagcagggcctcctggaagaggtgagcgaggggaacctggagcccccggaccaaaggggaaacaaggtgaatcaggaactagaggcccaaaggggtcaaagggggatcgtggagaaaaaggggactctggagctcagggaccaaggggtccacctggtcaaaaaggggatcaaggagccactgagatcatagactacaacggcaacctccacgaagccttacagaggattaccaccttaactgtcacgggtccccctggacctcctggacctcaaggactacaagggccaaagggagagcagggatctccaggaatcccaggaatggatggagagcagggactcaaaggctcaaagggagacatgggggacccaggtatgacaggtgaaaaaggaggaattggacttcctggattaccgggagccaatggaatgaaaggagaaaaaggagattctggaatgccgggtccacagggtccttctatcataggcccaccaggcccaccaggtccccatggcccacctggccccatgggacctcatggacttcctggaccaaagggtacagatggtcctatgggaccccatggccctgcaggtcccaaaggagaaagaggtgaaaaaggagctatgggagagcctggaccaagagggccctatgggctgcctcaggggccagatggcttacccatgcctggctgttggcaaaag

SEQ ID NO: 486 - DNA, 1494 bp, Homo sapiens
atgctgctgaagaagcacgcagggaaaggagggggccgggagcccagatccgaggacccgacccctgccgaacagcattgtgcccggaccatgcccccgtgtgccgtcctggcggccctcctgtcagtggtggccgtggtgtcttgcctgtacctgggtgtgaaaaccaacgacctccaggcgaggatcgccgctctcgaatccgccaaaggggccccttccattcatctgctgcctgataccctggatcacctcaagactatggtgcaagagaaagtggagcgacttctggctcagaaatcctatgaacatatggctaaaataagaatcgcaagagaagcaccttcagaatgtaactgcccagcaggccctccagggaaacgaggtaagagaggccgaagaggagaatctgctgggccgccaggggcacctgcccccagtcagggccctcctggtccaaaaggcgataagggagaacaaggtgatcagggacctaggggtcctctagggcctccgggacaaaagggttctattggagcacctggaattccagggatgaatgggcaaaagggtgagcccgggttgcctggagcagtaggacagaatggaataccaggacctaagggagaacctggagaacaaggtgaaaagggagacgctggagagaacggccccaagggtgacacaggcgaaaagggtgaccctggatcatctgctgcaggaattaagggagaacctggggaatctggtcgtccagggcaaaagggtgaaccagggcttcctgggcttcctggacttccggggataaagggagaaccaggtttcattggtcctcaaggagaaccaggcttaccaggtttaccaggaacaaaaggtgaacggggggaagcagggcctcctggaagaggtgagcgaggggaacctggagcccccggaccaaaggggaaacaaggtgaatcaggaactagaggcccaaaggggtcaaagggggatcgtggagaaaaaggggactctggagctcagggaccaaggggtccacctggtcaaaaaggggatcaaggagccactgagatcatagactacaacggcaacctccacgaagccttacagaggattaccaccttaactgtcacgggtccccctggacctcctggacctcaaggactacaagggccaaagggagagcagggatctccaggaatcccaggaatggatggagagcagggactcaaaggctcaaagggagacatgggggacccagggagccaatggaatgaaaggagaaaaaggagattctggaatgccgggtccacagggtccttctatcataggcccaccaggcccaccaggtccccatggcccacctggccccatgggacctcatggacttcctggaccaaagggagcatctggcttagacggaaagccaggatcccggggtacagatggtcctatgggaccccatggccctgcaggtcccaaaggagaaagagt

SEQ ID NO: 487 - DNA, 428 bp, Homo sapiens
gatccttcgggcagccgcgacttcggcttcgcgagtagcattggttccttgggtttatttcgttttcctctctcttctccaccttagtcgcccctttcgcgctgcgctgtagcgtgctctcacagcctttttgccttgaactgaatgcaggtgggaaacaggattatttgaggtgtagagggtgggaagcgaagccgagacggccgaccccgccacgatgctgctgaagaagcacgcagggaaaggagggggccgggagcccagatccgaggacccgacccctgccgaacagcattgtgcccggaccatgcccccgtgtgccgtcctggcggccctcctgtcagtggtggccgtggtgtcttgcctgtacctgggtgtgaaaaccaacgacctccaggcgaggatcgccgctctcgaatccgccaaag

SEQ ID NO: 488 - DNA, 316 bp, Homo sapiens
tggtccacggggtgagaagggtgatctaggagaaaagggagaaaaggggccagatggcttacccatgcctggctgttggcaaaagtgatgaatctaacctttcaagcatgaagttgtgtatataagggtccatttttaatatttatagttgaaaactgaattgcagattttacaagtctgagatatgtttacatagggctgcttcttcctgctggcagtagtatacatgtccatttttactccacttacatctgaaattgggcaatttgtgaaaccagtgagaatcctgcaaaaaatatagatcagtatctcctta

SEQ ID NO: 489 - DNA, 7790 bp, Homo sapiens
cggcggggaggcagcttccaccgccctccgcgcgccctcacccggccttgctctgcctccggggaccgccagcagcccgcctccaaaagtttgatcatctctctctctctttttcttgcttcttcttcctttttggtggaagcagaaaaggaccgaggcaggggcgagcgcggcgcccggactcctgggaccatgggcctggcgcgggcgcccgcggggccccagccgcgctgcctgcctgctcgggcgcccctgggcgcggggctgcgctgggggcgcgggggccgcgcgctctaagccggcctggcgcggcggggcggggggctggcggccccatggggcgcgcccacacttgccccccgggctcgggagcatgaagtaggggcctgccatgggagcgggatcggcgcggggggcccgaggcacagcggcggcggcggcggcgcgcgggggggggtttctcttctcctggatcttagtctcgtttgcctgtcacctggcctccacccaaggagctcctgaagatgtggacatcctccagcggctgggcctcagctggacgaaggccgggagccctgcacccccgggagtcattcctttccagtcgggcttcatctttacgcagcgggcccggctccaggctcccacgggcaccgtcattcctgccgccttgggcacagagctggcactggtgctgagcctctgctcccaccgggtgaaccatgccttcctcttcgctgtccgcagccagaaacgcaagctgcagctgggcctgcagttcctccccggcaagacggtcgtccacctcgggtcccggcgctcagtggccttcgacctcgacatgcacgacgggcgctggcaccacctggccctcgagctccgaggccgcacagtcactctggtgactgcctgcgggcagcgccgggtgcctgtcctgctgcctttccacagggaccctgcactcgaccctgggggctccttcctctttgggaagatgaacccgcatgcagtccagtttgaaggtgctctctgccagttcagtatctaccctgtgacgcaggtcgctcacaattactgtacccacctgaggaagcagtgtggacaggctgacacgtaccagtccccactgggacctctcttctcccaagactctggcagaccttttaccttccagtccgacctcgccctgctaggcctggagaacttgaccactgccacaccagccctggggtcactgccagcaggcaggggacccagggggactgtggcacccgccacgcccaccaagccccaaaggactagccccacaaaccctcaccagcatatggcggtgggaggcccagcccaaaccccgctgctacctgccaagctgtcagccagtaacgcacttgatcccatgctcccagcctctgttggcggctctaccagaacgcctcgccctgcggccgctcaaccatcacagaagatcacagccaccaaaatccccaaaagcctccctaccaagccttcggccccttctacttcaattgtgcccatcaaaagcccccatcctacccagaaaacagctccatcttcatttacaaagtcagccctacccactcagaagcaagtgccacctacttcccgtccagttcctgccagagtctcccgtcccgcagagaagcccatccagaggaacccgggaatgcccaggcccccaccgcccagcacccggcccctacctcctaccaccagctcctctaaaaaacccattcccacactagctcggactgaggccaagataaccagccatgccagtaagccggcctctgcccgcaccagcacccacaaacctcccccatttactgctttatcctcatctcctgcccctactcctggttctaccaggagtactcggccaccagccacgatggtacctccaacttcgggcaccagcactcccagaacagcacctgccgtccccactcctggctcagctcccactggaagcaagaagcccattggatcggaagcctcaaagaaagccggacccaagagcagcccccggaagcctgtccccctcagacctgggaaggcagccagggatgtccccttgagcgatctgacaaccaggcctagccccagacagccccagcccagtcagcagaccaccccggccctggtattggccccggcgcaattcctgtcctccagcccccggcccacgagcagtggctattcgatcttccacctggcaggatctacgcctttccctctgctgatggggcctccgggacccaagggagactgtggcttgccgggtccccctgggctacctgggctacctggaatccctggtgcacgtgggcctcggggtcctcctgggccttatggaaatccaggtctccccggccctcctggagccaaaggacagaaaggggacccagggctctcaccaggaaaggcccacgatggggcaaagggtgacatgggcttgcctgggctctccgggaatccaggacctccgggacgaaagggacacaagggctatcctggaccggcagggcaccccggagaacaggggcagccaggacctgagggcagcccaggggccaaaggttaccctggcaggcaggggttacctggaccggtaggagatcccggccccaaaggcagcaggggctacattgggctcccagggctcttcggcctgccagggtctgatggagaacgaggcctgcctggcgttcctggcaagaggggcaagatgggtatgccggggtttcctggagtctttggggaaagaggccctcctggactggatggaaatcctggagaactgggcctgccaggcccccctggagtccccggcctcattggtgacttaggagtgttgggtccgattggctacccgggacccaagggcatgaagggactgatgggcagcgtgggggagcccggactgaaaggtgataagggtgaacaaggggttccaggtgtgtcaggagatcccggattccaaggagacaaggggagccaggggttgccagggttccccggtgcacgggggaagccagggcctctgggcaaagtcggagacaaaggatccattgggtttcccgggccccctggacccgagggattcccaggagacatcggcccccctggcgacaatggcccagaaggcatgaagggtaagcctggagcccgaggcctgccgggaccccgtgggcagctggggcccgagggagatgagggacccatggggccgccaggggcccctggcttggagggtcagcctggcaggaaggggtttcctgggaggcccggcctggatggcgtgaagggggaaccaggggatcctggtcggccggggcctgtgggagagcagggatttatgggattcattggtctggtcggggagccaggaatcgtgggagaaaagggtgatcgtggcatgatgggacccccaggcgtgcctggacccaaggggtcgatgggtcatcctggaatgccaggtggtatggggacccctggagagcctggaccccagggtcctccaggatctcgaggcccaccaggcatgaggggagcaaagggacgtcggggcccccgaggaccggacggaccagctggggagcaagggtccaggggcctgaagggccctccaggaccccagggcagaccgggccggcctggacagcagggtgtggctggtgagcgaggccacttgggctcgagaggctttcctggcatcccgggtccctcaggccccccaggcaccaagggcctcccaggagaaccgggccctcagggaccccaggggccaattgggcctccaggagagatgggacccaaggggccgcctggtgcagtgggagaaccgggccttcctggggaagccgggatgaagggtgaccttggacccctgggcactcctggggagcagggcctcattgggcaacggggagagccaggccttgagggtgacagtggccccatgggacctgatgggctgaagggggacaggggagacccagggcctgatggagaacatggcgagaaaggccaggaagggctgatgggtgaggacgggccccccggcccccctggcgtcactggtgtccggggtcctgaaggaaaatcagggaagcaaggcgagaagggccgcactggagccaagggtgccaagggctatcaaggacagctgggtgagatgggcgtccctggagaccctggaccccctggcactccaggccctaaagggtcccggggcagcctgggaccaacgggtgctccgggacgcatgggggcccaaggagaaccgggactggctggttatgatggacacaaaggcattgtgggaccccttggacctcctggaccaaaaggcgaaaagggggagcagggcgaggacggcaaggctgaggggccccctgggccacctggagatcggggccctgtgggtgatcgaggagaccgcggggaaccgggagaccctgggtaccctggacaggagggtgtgcaaggcctccgtggaaagccaggccagcagggccaacccgggcatccgggaccccgggggtggccgggacccaaaggatcgaaaggcgcagagggaccaaagggaaagcaaggcaaggcaggggccccaggccggaggggggtccagggcctgcaggggctgccagggccccggggcgtggtggggagacagggcctcgagggcatcgctggaccagatgggcttcctggcagggacgggcaagcaggacagcagggggagcagggagacgatggggaccctggccccatgggccctgctgggaagagaggaaatccaggtgtggccggcttacctggagcacagggacccccaggattcaagggtgagagtgggttacccggacagctgggtccccctggcaagcgaggaacagagggcagaacggggctccctggaaaccagggggagcctgggtccaaaggccagccgggcgactctggcgagatgggcttcccaggaatggcaggtctcttcggacccaagggcccgcctggagacattggcttcaaaggcatccagggccctcgggggccacctggcttgatgggaaaggaaggcatcgtcgggcccctcggaatcctgggaccttcgggactcccgggtccgaagggtgacaaaggcagccgtggggactggggattgcaaggtccgaggggtcctcccggccccagagggcggcccggccccccgggtcctccagggggtcctatccaattgcaacaagatgatcttggggcagctttccagacgtggatggacaccagtggagcactcaggccagagagttacagctatccagaccggctggtgctggaccagggaggagagatctttaaaaccttacactacctcagcaacctcatccagagcattaagacgcccctgggcaccaaagagaaccccgcccgggtctgcagggacctcatggactgtgagcagaagatggtggatggtacctactgggtggatccaaaccttggctgctcctctgacaccatcgaggtctcctgcaacttcactcatggtggacagacgtgtctcaagcccatcacggcctccaaggtcgagtttgccatcagccgggtccagatgaatttcctgcacctgctaagctccgaggtgacccagcacatcaccatccactgccttaacatgaccgtgtggcaggagggcactgggcagaccccagccaagcaggccgtacgcttccgggcctggaatggacagatttttgaagctgggggtcagttccggcccgaggtgtccatggatggctgcaaggtccaagatggccgctggcatcagacactcttcaccttccggacccaagacccccaacagctgcccatcatcagtgtggacaacctccctcctgcctcatcagggaagcagtaccgcctggaagttggacctgcgtgcttcctctgacctctgacctcgtggccactctaggcctcacggaggagggaagaggaagaggcaaggggagggtactgaggggcagatggctccaggagaggcagctcccctgcccaagggtccttgggcagaccccagctgttgtctgcccagtagaagtgggtgggggtaggaggggatagggtgtccttgggaacaatggatcccagcttagccccaaagaccaaccaaagagccagccagagtaagctggacctgcaacctgcctgagccccgtggcctctcagctctgcggccaccccgttccctccccagcttcctgcccaaagagccccacattcaagccaacttgagggaagggggcgtctcgtcagctggtccctgctagggagctattgatgtgcaatattagaaaggagacatgaaaaaaggagaaaaggaaagacagaagtgtatatatatattatttaaacaaacaaaaagaaggtgcgttactatttttttttcacccgggaaagaggtgagaggatgggaaggagcagccaggcgtgggaagcggcgagatcctcgggctgggggtgcccacgtttgctacctcccactgtgaaatcgctggtgctcacaattgtctctcacagtgtatgtgatttttttaaggaaaaaaaaaaatccctatttaagattctgaaggtgctaccattattttgccacagactttgaagaaacttttggatgtggggcatcatccgcatctttctctctcctccaaatgacaaagtttggggaatttttgaattttcctagcatcgcccttgtgctcatcaggtaatctgctaaggaggaaaaaagaaaagaaaaaaggaaaaaaaaaaaaaaaaagcaaaacaaaaacaaaaacaaaaaccctaccagaaaccagaagtagagagatttaccatataacttatggactttgaaatgtctgtccttttaaggcagcagggaggcctgggtgcgaagcatgttggcttggcccttcacggtcctggagggaggtgaggctggccttggaaggcgtgccctggagaggtcttgggtgaaaacttgaccttgaagaaaccaatcacaaaagcggcgttgggtcagggctaggcttagaggtgaagcatcaacatggaaccatctcaggaagccgcatcgcctcttccgaggtcctcacttccaggagcctgtccttgcaagatgcaatcatcgttcctgctttttcattgtcattaaattctgtagaaacccattgtcattagctccaagtgtaaatttgggtcaaggagacagaataataatgggaatctcggagttcgacaccatagtgacgttcagcgtcctctgaattgtgctacatcagcgaacaagtcggcgcttgaattggattttgaggttattttaaccatggaattatttttatagaaggggaaaatgtatgtgaaagtctctatttgtgtatttctctcctaaagttgtgtctctttgggaattggatttgatttttattatttaatacctcactttggcccgtcccccctcccaacacttctgtatcctcgccctgccgccccagcctggacgctctgcgtggaagtgcgtgtttgtagcagctcgggcctcatctcagcgctcggatccctcctgctgccagaatccactggcctctgtctcattcttgggttttcctgctgtcttcgtttacgtctctgtccacatgtcagtgtattaaaaccccaatgggttccgtttctccttttcccctctggattttaaataaatatttaaaactgaggcaatggaa

SEQ ID NO: 490 - DNA, 5604 bp, Homo sapiens
atgggagcgggatcggcgcggggggcccgaggcacagcggcggcggcggcggcgcgcgggggggggtttctcttctcctggatcttagtctcgtttgcctgtcacctggcctccacccaaggagctcctgaagatgtggacatcctccagcggctgggcctcagctggacgaaggccgggagccctgcacccccgggagtcattcctttccagtcgggcttcatctttacgcagcgggcccggctccaggctcccacgggcaccgtcattcctgccgccttgggcacagagctggcactggtgctgagcctctgctcccaccgggtgaaccatgccttcctcttcgctgtccgcagccagaaacgcaagctgcagctgggcctgcagttcctccccggcaagacggtcgtccacctcgggtcccggcgctcagtggccttcgacctcgacatgcacgacgggcgctggcaccacctggccctcgagctccgaggccgcacagtcactctggtgactgcctgcgggcagcgccgggtgcctgtcctgctgcctttccacagggaccctgcactcgaccctgggggctccttcctctttgggaagatgaacccgcatgcagtccagtttgaaggtgctctctgccagttcagtatctaccctgtgacgcaggtcgctcacaattactgtacccacctgaggaagcagtgtggacaggctgacacgtaccagtccccactgggacctctcttctcccaagactctggcagaccttttaccttccagtccgacctcgccctgctaggcctggagaacttgaccactgccacaccagccctggggtcactgccagcaggcaggggacccagggggactgtggcacccgccacgcccaccaagccccaaaggactagccccacaaaccctcaccagcatatggcggtgggaggcccagcccaaaccccgctgctacctgccaagctgtcagccagtaacgcacttgatcccatgctcccagcctctgttggcggctctaccagaacgcctcgccctgcggccgctcaaccatcacagaagatcacagccaccaaaatccccaaaagcctccctaccaagccttcggccccttctacttcaattgtgcccatcaaaagcccccatcctacccagaaaacagctccatcttcatttacaaagtcagccctacccactcagaagcaagtgccacctacttcccgtccagttcctgccagagtctcccgtcccgcagagaagcccatccagaggaacccgggaatgcccaggcccccaccgcccagcacccggcccctacctcctaccaccagctcctctaaaaaacccattcccacactagctcggactgaggccaagataaccagccatgccagtaagccggcctctgcccgcaccagcacccacaaacctcccccatttactgctttatcctcatctcctgcccctactcctggttctaccaggagtactcggccaccagccacgatggtacctccaacttcgggcaccagcactcccagaacagcacctgccgtccccactcctggctcagctcccactggaagcaagaagcccattggatcggaagcctcaaagaaagccggacccaagagcagcccccggaagcctgtccccctcagacctgggaaggcagccagggatgtccccttgagcgatctgacaaccaggcctagccccagacagccccagcccagtcagcagaccaccccggccctggtattggccccggcgcaattcctgtcctccagcccccggcccacgagcagtggctattcgatcttccacctggcaggatctacgcctttccctctgctgatggggcctccgggacccaagggagactgtggcttgccgggtccccctgggctacctgggctacctggaatccctggtgcacgtgggcctcggggtcctcctgggccttatggaaatccaggtctccccggccctcctggagccaaaggacagaaaggggacccagggctctcaccaggaaaggcccacgatggggcaaagggtgacatgggcttgcctgggctctccgggaatccaggacctccgggacgaaagggacacaagggctatcctggaccggcagggcaccccggagaacaggggcagccaggacctgagggcagcccaggggccaaaggttaccctggcaggcaggggttacctggaccggtaggagatcccggccccaaaggcagcaggggctacattgggctcccagggctcttcggcctgccagggtctgatggagaacgaggcctgcctggcgttcctggcaagaggggcaagatgggtatgccggggtttcctggagtctttggggaaagaggccctcctggactggatggaaatcctggagaactgggcctgccaggcccccctggagtccccggcctcattggtgacttaggagtgttgggtccgattggctacccgggacccaagggcatgaagggactgatgggcagcgtgggggagcccggactgaaaggtgataagggtgaacaaggggttccaggtgtgtcaggagatcccggattccaaggagacaaggggagccaggggttgccagggttccccggtgcacgggggaagccagggcctctgggcaaagtcggagacaaaggatccattgggtttcccgggccccctggacccgagggattcccaggagacatcggcccccctggcgacaatggcccagaaggcatgaagggtaagcctggagcccgaggcctgccgggaccccgtgggcagctggggcccgagggagatgagggacccatggggccgccaggggcccctggcttggagggtcagcctggcaggaaggggtttcctgggaggcccggcctggatggcgtgaagggggaaccaggggatcctggtcggccggggcctgtgggagagcagggatttatgggattcattggtctggtcggggagccaggaatcgtgggagaaaagggtgatcgtggcatgatgggacccccaggcgtgcctggacccaaggggtcgatgggtcatcctggaatgccaggtggtatggggacccctggagagcctggaccccagggtcctccaggatctcgaggcccaccaggcatgaggggagcaaagggacgtcggggcccccgaggaccggacggaccagctggggagcaagggtccaggggcctgaagggccctccaggaccccagggcagaccgggccggcctggacagcagggtgtggctggtgagcgaggccacttgggctcgagaggctttcctggcatcccgggtccctcaggccccccaggcaccaagggcctcccaggagaaccgggccctcagggaccccaggggccaattgggcctccaggagagatgggacccaaggggccgcctggtgcagtgggagaaccgggccttcctggggaagccgggatgaagggtgaccttggacccctgggcactcctggggagcagggcctcattgggcaacggggagagccaggccttgagggtgacagtggccccatgggacctgatgggctgaagggggacaggggagacccagggcctgatggagaacatggcgagaaaggccaggaagggctgatgggtgaggacgggccccccggcccccctggcgtcactggtgtccggggtcctgaaggaaaatcagggaagcaaggcgagaagggccgcactggagccaagggtgccaagggctatcaaggacagctgggtgagatgggcgtccctggagaccctggaccccctggcactccaggccctaaagggtcccggggcagcctgggaccaacgggtgctccgggacgcatgggggcccaaggagaaccgggactggctggttatgatggacacaaaggcattgtgggaccccttggacctcctggaccaaaaggcgaaaagggggagcagggcgaggacggcaaggctgaggggccccctgggccacctggagatcggggccctgtgggtgatcgaggagaccgcggggaaccgggagaccctgggtaccctggacaggagggtgtgcaaggcctccgtggaaagccaggccagcagggccaacccgggcatccgggaccccgggggtggccgggacccaaaggatcgaaaggcgcagagggaccaaagggaaagcaaggcaaggcaggggccccaggccggaggggggtccagggcctgcaggggctgccagggccccggggcgtggtggggagacagggcctcgagggcatcgctggaccagatgggcttcctggcagggacgggcaagcaggacagcagggggagcagggagacgatggggaccctggccccatgggccctgctgggaagagaggaaatccaggtgtggccggcttacctggagcacagggacccccaggattcaagggtgagagtgggttacccggacagctgggtccccctggcaagcgaggaacagagggcagaacggggctccctggaaaccagggggagcctgggtccaaaggccagccgggcgactctggcgagatgggcttcccaggaatggcaggtctcttcggacccaagggcccgcctggagacattggcttcaaaggcatccagggccctcgggggccacctggcttgatgggaaaggaaggcatcgtcgggcccctcggaatcctgggaccttcgggactcccgggtccgaagggtgacaaaggcagccgtggggactggggattgcaaggtccgaggggtcctcccggccccagagggcggcccggccccccggtagaccctggggggccacgatacataccctgtcttttccttgcccagcaacaagatgatcttggggcagctttccagacgtggatggacaccagtggagcactcaggccagagagttacagctatccagaccggctggtgctggaccagggaggagagatctttaaaaccttacactacctcagcaacctcatccagagcattaagacgcccctgggcaccaaagagaaccccgcccgggtctgcagggacctcatggactgtgagcagaagatggtggatggtacctactgggtggatccaaaccttggctgctcctctgacaccatcgaggtctcctgcaacttcactcatggtggacagacgtgtctcaagcccatcacggcctccaaggtcgagtttgccatcagccgggtccagatgaatttcctgcacctgctaagctccgaggtgacccagcacatcaccatccactgccttaacatgaccgtgtggcaggagggcactgggcagaccccagccaagcaggccgtacgcttccgggcctggaatggacagatttttgaagctgggggtcagttccggcccgaggtgtccatggatggctgcaaggtccaagatggccgctggcatcagacactcttcaccttccggacccaagacccccaacagctgcccatcatcagtgtggacaacctccctcctgcctcatcagggaagcagtaccgcctggaagttggacctgcgtgcttcctctga

SEQ ID NO: 491 - DNA, 2243 bp, Homo sapiens
gggggtttctcttctcctggatcttagtctcgtttgcctgtcacctggcctccacccaaggagctcctgaagatgtggacatcctccagcggctgggcctcagctggacgaaggccgggagccctgcacccccgggagtcattcctttccagtcgggcttcatctttacgcagcgggcccggctccaggctcccacgggcaccgtcattcctgccgccttgggcacagagctggcactggtgctgagcctctgctcccaccgggtgaaccatgccttcctcttcgctgtccgcagccagaaacgcaagctgcagctgggcctgcagttcctccccggcaagacggtcgtccacctcgggtcccggcgctcagtggccttcgacctcgacatgcacgacgggcgctggcaccacctggccctcgagctccgaggccgcacagtcactctggtgactgcctgcgggcagcgccgggtgcctgtcctgctgcctttccacagggaccctgcactcgaccctgggggctccttcctctttgggaagatgaacccgcatgcagtccagtttgaaggtgctctctgccagttcagtatctaccctgtgacgcaggtcgctcacaattactgtacccacctgaggaagcagtgtggacaggctgacacgtaccagtccccactgggacctctcttctcccaagactctggcagaccttttaccttccagtccgacctcgccctgctaggcctggagaacttgaccactgccacaccagccctggggtcactgccagcaggcaggggacccagggggactgtggcacccgccacgcccaccaagccccaaaggactagccccacaaaccctcaccagcatatggcggtgggaggcccagcccaaaccccgctgctacctgccaagctgtcagccagtaacgcacttgatcccatgctcccagcctctgttggcggctctaccagaacgcctcgccctgcggccgctcaaccatcacagaagatcacagccaccaaaatccccaaaagcctccctaccaagccttcggccccttctacttcaattgtgcccatcaaaagcccccatcctacccagaaaacagctccatcttcatttacaaagtcagccctacccactcagaagcaagtgccacctacttcccgtccagttcctgccagagtctcccgtcccgcagagaagcccatccagaggaacccgggaatgcccaggcccccaccgcccagcacccggcccctacctcctaccaccagctcctctaaaaaacccattcccacactagctcggactgaggccaagataaccagccatgccagtaagccggcctctgcccgcaccagcacccacaaacctcccccatttactgctttatcctcatctcctgcccctactcctggttctaccaggagtactcggccaccagccacgatggtacctccaacttcgggcaccagcactcccagaacagcacctgccgtccccactcctggctcagctcccactggaagcaagaagcccattggatcggaagcctcaaagaaagccggacccaagagcagcccccggaagcctgtccccctcagacctgggaaggcagccagggatgtccccttgagcgatctgacaaccaggcctagccccagacagccccagcccagtcagcagaccaccccggccctggtattggccccggcgcaattcctgtcctccagcccccggcccacgagcagtggctattcgatcttccacctggcaggatctacgcctttccctctgctgatggggcctccgggacccaagggagactgtggcttgccgggtccccctgggctacctgggctacctggaatccctggtgcacgtgggcctcggggtcctcctgggccttatggaaatccaggtctccccggccctcctggagccaaaggtgacatgggcttgcctgggctctccgggaatccaggacctccgggacgaaaggggttacctggaccggtaggagatcccggccccaaaggcagcaggggctacattgggctcccagggctcttcggcctgccagggtctgatggagaacgaggcctgcctggcgttcctggcaagaggggcaagatgggtatgccggtccttctaccccaaagttcagaggccagaggtgggaactcaatgccttcagaaggtgccctggctggacgccatggctcacacctgtaa

SEQ ID NO: 492 - DNA, 2259 bp, Homo sapiens
taacttcacccccaaccacagtccttgctgttggcatttactcaactagtctttaattcctgtttgacaaactttataaggtgctacaagacagatgatttttcaccatctaccataatgtggaacagatattttgtcttctatctcctgcttttgtcagcgtttacgagtcaaacagtatccggacaaagaaagaaaggaccaaaatcaaatttgcttgcaaggaaaagtgatgtccagggctccatttgtttcatagatattgtcttcatcgtggacagctctgaaagttctaaaattgccctctttgataaacagaaagattttgtggatagcttgagtgacaagattttccaattgactcctggtcgctccttggaatatgacatcaaactggcagcccttcagtttagcagctctgtccaaattgatccacctttttcttcctggaaggacctgcagacatttaagcagaaggtcaagtctatgaatttaatagggcaaggtaccttctcttattatgccatttccaatgccactaggctacttaagagagaagggcgtaaggatggtgtgaaagtggttttgctgatgactgatggcatcgaccatccaaagaatccagatgttcaaagtatttctgaagatgccagaatttcaggaatatcatttatcaccattgcactttctacggtagtcaatgaagccaaacttcgtttgatttctggggattcatccagtgaacccactttactgttgagtgatccaacccttgtagataaaattcaagatcgtctggaaatgctatttgaaattcagtgtgaacgcaagatttgtgaatgtgagaagggagatccaggtgatccagggcctcctggtacacatggaaatccaggtatcaaaggtgagcgaggaccaaaaggaaacccgggcaacgctcaaaaaggagaagctggagaaagaggtccagggggaattcctgggtacaagggtgacaagggtgaacgtggggaatgtggtaaaccagggataaaaggtgacaagggatccccagggccatatggaccaaagggacccagaggaattcagggaattactggacctccaggagacccaggcccaaaggggtttcaaggcaataagggtgagccaggtcctcctggtccttatggttctccaggagctcctggaattggacagcaaggtattaagggagaaagaggccaagaaggaagaccgggagctccaggacccattggagttggtgagcctggacagccaggtccccgtggtcctgagggagtaccaggagagaggggcttacccggagaaggatttccaggaccaaagggtgaaaaaggttctgaaggaccaactggcccacagggattacaaggcctgtcaatcaaaggggagaagggggatataggacctgtgggaccccaaggaccaatgggtatccctggaatcgggagtcaaggggaacagggaatccaaggtcctattggtccacctggtccacaagggcccgcaggacagggcttacctggttccaagggagaagtaggccaaatgggacctacaggccctcgaggaccagtgggaattggagtacaaggtccaaagggagagccaggctcaatagggctcccaggacaaccaggagtaccaggagaagatggagctgcagggaagaagggagaagcggggcttccgggagcaagaggcccagaaggaccacctggaaaaggacagcctggccccaagggtgacgaaggcaagaaagggagcaaaggaaatcaaggacagaggggacttccagggcccgaaggaccaaagggtgaaccgggcattatgggcccttttggaatgcctggaacatcaattcctggaccacctgggccaaagggagatagaggaggacctgggatacctggatttaagggagaacctggactttctattcgaggaccaaagggtgtccaaggccctcggggaccagtgggtgctccaggactcaaaggtgatggctatcctggtgtgcctggacctcgtggattaccaggaccccctgggccgatgggtttacgtggagtgggagacactggagcaaagactttgaacacttcccatggccttgaagatccttcatgccccgactgcagcttctgtcatttctccctggctgccgacattcagccaaaatggcctgccctacttcagctcattcctgcatcagggactcgccaggatggctga

SEQ ID NO: 493 - DNA, 4277 bp, Homo sapiens
cagaacagaacaatatcaaatagctaacttcacccccaaccacagtccttgctgttggcatttactcaactagtctttaattcctgtttgacaaactttataaggtgctacaagacagatgatttttcaccatctaccataatgtggaacagatattttgtcttctatctcctgcttttgtcagcgtttacgagtcaaacagtatccggacaaagaaagaaaggaccaaaatcaaatttgcttgcaaggaaaagtgatgtccagggctccatttgtttcatagatattgtcttcatcgtggacagctctgaaagttctaaaattgccctctttgataaacagaaagattttgtggatagcttgagtgacaagattttccaattgactcctggtcgctccttggaatatgacatcaaactggcagcccttcagtttagcagctctgtccaaattgatccacctttttcttcctggaaggacctgcagacatttaagcagaaggtcaagtctatgaatttaatagggcaaggtaccttctcttattatgccatttccaatgccactaggctacttaagagagaagggcgtaaggatggtgtgaaagtggttttgctgatgactgatggcatcgaccatccaaagaatccagatgttcaaagtatttctgaagatgccagaatttcaggaatatcatttatcaccattgcactttctacggtagtcaatgaagccaaacttcgtttgatttctggggattcatccagtgaacccactttactgttgagtgatccaacccttgtagataaaattcaagatcgtctggatatcttatttgaaaagaagtgtgaacgcaagatttgtgaatgtgagaagggagatccaggtgatccagggcctcctggtacacatggaaatccaggtatcaaaggtgagcgaggaccaaaaggaaacccgggcaacgctcaaaaaggagaagctggagaaagaggtccagggggaattcctgggtacaagggtgacaagggtgaacgtggggaatgtggtaaaccagggataaaaggtgacaagggatccccagggccatatggaccaaagggacccagaggaattcagggaattactggacctccaggagacccaggcccaaaggggtttcaaggcaataagggtgagccaggtcctcctggtccttatggttctccaggagctcctggaattggacagcaaggtattaagggagaaagaggccaagaaggaagaccgggagctccaggacccattggagttggtgagcctggacagccaggtccccgtggtcctgagggagtaccaggagagaggggcttacccggagaaggatttccaggaccaaagggtgaaaaaggttctgaaggaccaactggcccacagggattacaaggcctgtcaatcaaaggggagaagggggatataggacctgtgggaccccaaggaccaatgggtatccctggaatcgggagtcaaggggaacagggaatccaaggtcctattggtccacctggtccacaagggcccgcaggacagggcttacctggttccaagggagaagtaggccaaatgggacctacaggccctcgaggaccagtgggaattggagtacaaggtccaaagggagagccaggctcaatagggctcccaggacaaccaggagtaccaggagaagatggagctgcagggaagaagggagaagcggggcttccgggagcaagaggcccagaaggaccacctggaaaaggacagcctggccccaagggtgacgaaggcaagaaagggagcaaaggaaatcaaggacagaggggacttccagggcccgaaggaccaaagggtgaaccgggcattatgggcccttttggaatgcctggaacatcaattcctggaccacctgggccaaagggagatagaggaggacctgggatacctggatttaagggagaacctggactttctattcgaggaccaaagggtgtccaaggccctcggggaccagtgggtgctccaggactcaaaggtgatggctatcctggtgtgcctggacctcgtggattaccaggaccccctgggccgatgggtttacgtggagtgggagacactggagcaaagggagagcctggggtcagaggccctccaggtccttctgggcctcggggcgtaggaacccaagggccaaagggtgatactgggcagaaaggcttgcctggccctcctggcccccctggctatggatcacagggaattaaaggggaacaaggaccacaaggcttcccaggcccaaagggcacaatgggccatggcctcccaggccagaagggagagcacggagaacggggcgatgtgggaaagaaaggtgataaaggagaaattggagagcctggatctccaggaaaacagggtttacaaggacccaaaggagacctaggacttacaaaagaagaaattatcaaacttattacagaaatatgtggttgtgggcccaaatgcaaagagactccactagagctggtgtttgtgatcgacagctcagaaagcgtggggccagagaactttcagatcattaaaaattttgtgaagactatggctgaccgggttgctctggaccttgccacggcccgcataggcataatcaactatagccataaggtggagaaggtggctaatttgaagcagttctccagcaaggatgacttcaagttggctgtggacaacatgcagtatctgggggaaggcacatacacagccactgctctgcaagcagccaacgacatgtttgaagatgcaaggccaggtgtaaaaaaagtggccttggtcatcactgatggacagacagattctcgtgataaagagaaactgacagaggtggtgaagaatgccagtgacaccaatgtggagatatttgtgataggggtggtgaagaaaaatgatcccaactttgaaatattccacaaagaaatgaatctaattgctactgacccagagcatgtttaccagtttgatgatttctttaccctgcaagacaccctgaagcaaaaattgtttcaaaaaatttgtgaggattttgattcctatctcgttcaaatttttggttcatcgtcacctcaacctggatttgggatgtcaggggaagaactcagtgaatctactccagagcctcaaaaagaaatttctgagtcattgagtgtcaccagagaccaggatgaagatgataaggctccagagccaacgtgggctgatgatctgcctgccactacctcatctgaggccaccaccacccccaggccactgctcagcacccctgtggatggggcagaggatcctagatgtttggaagccttgaagcctggaaactgtggtgaatatgtggttcgatggtattatgacaaacaggtcaactcttgtgcccgattttggttcagtggctgtaatggctcaggaaatagattcaacagtgaaaaggaatgtcaagaaacctgcattcaaggatgagcaagtaaattggcctgtctctatcaaaagcatagaactccctaatttccacatattcacccaatacaaatacagcactatatttgagtgtatactgagtatttacaacttatacatgtaattgaattctcactacagccctaggatgtacatattattaaccacttatataggtaagaaagctgaggctctgagaagtttagtaacttgtcaactgtcacccaactaaaaagtttcagagctgaggatttagacttagagctgtgtaacttcaatacacagactctatctacttcacaacctgcaatgtgattctgattcctttaattcctgttgtatgtactatgtcagctcaaacccctacccctgtccctgcccatacctccacccactcacctccctaacctccttatgtccctcgcagtagcaagatgtaggtgataggaaggacttcggtgtgagaattagaaatgatgtaaatgtttacgcaggagtgctgggataggagtcgggatggtgagggtagttagatttttgcctcacttgccctgaaagtggtaatagggagaaaccaatctgaattacaattacttaaatgtatcacagactgtcactttgtattcctccaacatgtttggtaacaagtgtttaatgtatgttaaaacaaagaaggtttttatacccttccattaaaatatgtcagtgggcccttccattttatggagtggaatgggaaggcccttgacagccaggaacca

SEQ ID NO: 494 - DNA, 1122 bp, Homo sapiens
taacttcacccccaaccacagtccttgctgttggcatttactcaactagtctttaattcctgtttgacaaactttataaggtgctacaagacagatgatttttcaccatctaccataatgtggaacagatattttgtcttctatctcctgcttttgtcagcgtttacgagtcaaacagtatccggacaaagaaagaaaggaccaaaatcaaatttgcttgcaaggaaaagtgatgtccagggctccatttgtttcatagatattgtcttcatcgtggacagctctgaaagttctaaaattgccctctttgataaacagaaagattttgtggatagcttgagtgacaagattttccaattgactcctggtcgctccttggaatatgacatcaaactggcagcccttcagtttagcagctctgtccaaattgatccacctttttcttcctggaaggacctgcagacatttaagcagaaggtcaagtctatgaatttaatagggcaaggtaccttctcttattatgccatttccaatgccactaggctacttaagagagaagggcgtaaggatggtgtgaaagtggttttgctgatgactgatggcatcgaccatccaaagaatccagatgttcaaagtatttctgaagatgccagaatttcaggaatatcatttatcaccattgcactttctacggtagtcaatgaagccaaacttcgtttgatttctggggattcatccagtgaacccactttactgttgagtgatccaacccttgtagataaaattcaagatcgtctggaaatgctatttgaaattcagtgtgaacgcaagatttgtgaatgtgagaagggagatccaggtgatccagggcctcctggtacacatggaaatccaggtatcaaaggtgagcgaggaccaaaaggaaacccgggcaacgctcaaaaaggagaagctggagaaagaggtccagggggaattcctgggtacaagggtgacaagcaatattctagggaagacagggaagtagagcataataatgaaaaatatgtagcatgcttgctgccaagcccggctctcctacagcagtcctcgctaactcatcatggcacctgttcccactaa

SEQ ID NO: 495 - DNA, 700 bp, Homo sapiens
gccactacctcatctgaggccaccaccacccccaggccactgctcagcacccctgtggatggggcagaggatcctagatgtttggaagccttgaagcctggaaactgtggtgaatatgtggttcgatggtattatgacaaacaggtcaactcttgtgcccgattttggttcagtggctgtaatggctcaggaaatagattcaacagtgaaaaggaatgtcaagaaacctgcattcaaggatgagcaagtctaccctcattcaattcaacagtgcaaaaaagagcactcacggaagaaggagatggaagaatagccatcttggcagaaataatgatatgtataatttttttatttaattaaaattgtattatgtaatatttgatactacaaaagataatgcaacatgtttgtcaattttttttattatactttaagttttagggtacatgtgcacaaagtacaggtttgttacatatgtattcatgtgccatgttggtgtgctgcacccattaactcgtcatttaacattaggtatatttcctaatgctatccctccccactcccccgccaccccacaacaggccctggtgtgtgatgttccccttcctgtgtccatgtgttctcattgttcaactcccacctatgagtgagaacatgcggtgtttggttttttgtccttgtgacagtttgctgagaatga

SEQ ID NO: 496 - DNA, 2549 bp, Homo sapiens
atcagtcaggaggccgtgcagtccgagatgggctcgtctcgggcaccctggatggggcgtgtgggtgggcacgggatgttggcactgctgctggctggtctcctcctgccagggaccttggctaagagcattggcaccttctcagacccctgtaaggaccccacgcgtatcacctcccctaacgacccctgcctcactgggaagggtgactccagcggcttcagtagctacagtggctccagcagttctggcagctccatttccagtgccagaagctctggtggtggctccagtggtagctccagcggatccagcattgcccagggtggttctgcaggatcttttaagccaggaacggggtattcccaggtcagctactcctccggatctggctctagtctacaaggtgcatccggttcctcccagctggggagcagcagctctcactcgggaagcagcggctctcactcgggcagcagctctcattcgagcagcagcagcagctttcagttcagcagcagcagcttccaagtagggaatggctctgctctgccaaccaatgacaactcttaccgcggaatactaaacccttcccagcctggacaaagctcttcctcttcccagacctttggggtatccagcagtggccaaagcgtcagctccaaccagcgtccctgtagttcggacatccccgactctccctgcagtggagggcccatcgtctcgcactccggcccctacatccccagctcccactctgtgtcagggggtcagaggcctgtggtggtggtggtggaccagcacggttctggtgcccctggagtggttcaaggtcccccctgtagcaatggtggccttccaggcaagccctgtcccccaatcacctctgtagacaaatcctatggtggctacgaggtggtgggtggctcctctgacagttatctggttccaggcatgacctacagtaagggtaaaatctaccctgtgggctacttcaccaaagagaaccctgtgaaaggctctccaggggtcccttcctttgcagctgggccccccatctctgagggcaaatacttctccagcaaccccatcatccccagccagtcggcagcttcctcggccattgcattccagccagtggggactggtggggtccagctctgtggaggcggctccacgggctccaagggaccctgctctccctccagttctcgagtccccagcagttctagcatttccagcagctccggtttaccctaccatccctgcggcagtgcttcccagagcccctgctccccaccaggcaccggctccttcagcagcagctccagttcccaatccagtggcaaaatcatccttcagccttgcggcagcaagtccagctcttctggtcacccttgcatgtctgtctcctccttgacactgactgggggccccgatggctctccccatcctgatccctccgctggtgccaagccctgtggctccagcagtgctggaaagatcccctgccgctccatccgggatatcctagcccaagtgaagcctctggggccccagctagctgaccctgaagttttcctaccccaaggagagttactcgacagtccataagaagtcaactgttgtgtgtgtgcatgccttgggcacaaacaagcacatacactatatcccatatgggagaagtccagtgcccaggcatagggttagctcagtttccctccttcccaaaagagtggttctgctttctccactaccccaaggttgcagactctctcttatcaccccttcctccttcctcttctcaaaatggtagattcaaagctcctctcttgattctctcctactgtttaaattcccattccaccacagtgcccctcagccagatcaccaccccttacaattccctctactgtgtggaaatggtccattgagtaacacccccatcagcttctcaactgggaaacccctgaaatgctctcagagcacctctgacgcctgaagaagttataccttcctcttcccctttaccaaataaagcaaagtcaaaccatcatctggaaacagtggccacttttcactgacctttcttcgacatctagtcaacccacccaatatgccactgggctctcgctcccaattccaccccaccctccattacagagctcaccacgccctcctagatcaccgtccccaacacacccattgcctctcaaggcccttatctcagccccttcctgtggccacttccctcagtgctcagatgattccctgggtgagggagacactggggcaccctcagaggttggagcaggctccctgctgtccctggatcctggacagatggctcagtaaactgtggggactaggtgcagactttttgccttcttggagtcctgggtctcctctgagagtctgggtggtgctcctcctacgcctctagaggtctctgtgttcctcattttccttcaaaagcgggctgtatttctcttctaccttccagctcctcccacagaggaggaagacaataaatatttgttgaactgaaa

SEQ ID NO: 497 - DNA, 2552 bp, Homo sapiens
atcagtcaggaggccgtgcagtccgagatgggctcgtctcgggcaccctggatggggcgtgtgggtgggcacgggatgatggcactgctgctggctggtctcctcctgccagggaccttggctaagagcattggcaccttctcagacccttgtaaggaccccacgcgtatcacctcccctaacgacccctgcctcactgggaagggtgactccagcggtttcagtagctacagtggctccagcagttctggcagctccatttccagtgccagaagctctggtggtggctccagtggtagctccagcggatccagcattgcccagggtggttctgcaggatcttttaagccaggaacggggtattcccaggtcagctactcctccggatctggctctagtctacaaggtgcatccggttcctcccagctggggagcagcagctctcactcgggaaacagcggctctcactcgggaagcagcagctctcattcgagcagcagcagcagctttcagttcagcagcagcagcttccaagtagggaatggctctgctctgccaaccaatgacaactcttaccgcggaatactaaacccttcccagcctggacaaagctcttcctcttcccagacctttggggtatccagcagtggccaaagcgtcagctccaaccagcgtccctgtagttcggacatccccgactctccctgcagtggagggcccatcgtctcgcactccggcccctacatccccagctcccactctgtgtcagggggtcagaggcctgtggtggtggtggtggaccagcacggttctggtgcccctggagtggttcaaggtcccccctgtagcaatggtggccttccaggcaagccctgtcccccaatcacctctgtagacaaatcctatggtggctacgaggtggtgggtggctcctctgacagttatctggttccaggcatgacctacagtaagggtaaaatctaccctgtgggctacttcaccaaagagaaccctgtgaaaggctctccaggggtcccttcctttgcagctgggccccccatctctgagggcaaatacttctccagcaaccccatcatccccagccagtcggcagcttcctcggccattgcattccagccagtggggactggtggggtccagctctgtggaggcggctccacgggctccaagggaccctgctctccctccagttctcgagtccccagcagttctagcatttccagcagctccggtttaccctaccatccctgcggcagtgcttcccagagcccctgctccccaccaggcaccggctccttcagcagcagctccagttcccaatccagtggcaaaatcatccttcagccttgtggcagcaagtccagctcttctggtcacccttgcatgtctgtctcctccttgacactgactgggggccccgatggctctccccatcctgatccctccgctggtgccaagccctgtggctccagcagtgctggaaagatcccctgccgctccatccgggatatcctagcccaagtgaagcctctggggccccagctagctgaccctgaagttttcctaccccaaggagagttactcaacagtccataagaagtcaactgttgtgtgtgtgcatgccttgggcacaaacaagcacatacactatatcccatatgggagaagtccagtgcccaggcatagggttagctcagtttccctccttcccaaaagagtggttctgctttctccactaccccaaggttgcagactctctcttatcaccccttcctccttcctcttctcaaaatggtagattcaaagctcctctcttgattctctcctactgtttaaattcccattccaccacagtgcccctcagccagatcaccaccccttacaattccctctactgtgtggaaatggtccattgagtaacacccccatcagcttctcaactgggaaacccctgaaatgctctcagagcacctctgacgcctgaagaagttataccttcctcttcccctttaccaaataaagcaaagtcaaaccatcatctggaaacagtggccacttttcactgacctttcttcgacatctagtcaacccacccaatatgccactgggctctcgctcccaattccaccccaccctccattacagagctcaccacgccctcctagatcaccgtccccaacacacccattgcctctcaaggcccttatctcagccccttcctgtggccacttccctcagtgctcagatgattccctgggtgagggagacactggggcaccctcagaggttgaagcaggctccctgctgtccctggatcctggacagatggctcagtaaactgtggggactaggtgcagactttttgccttcttggagtcctgggtctcctctgagagtctgggtggtgctcttcctacgcctctagaggtctctgtgttcctcattttccttcaaaagcgggctgtgtttctcttctaccttccagctgctcccacagaggaggaagacaataaatatttgttgaactgaaa

SEQ ID NO: 498 - DNA, 2549 bp, Homo sapiens
atcagtcaggaggccgtgcagtccgagatgggctcgtctcgggcaccctggatggggcgtgtgggtgggcacgggatgatggcactgctgctggctggtctcctcctgccagggaccttggctaagagcattggcaccttctcagacccctgtaaggaccccacgcgtatcacctcccctaacgacccctgcctcactgggaagggtgactccagcggcttcagtagctacagtggctccagcagttctggcagctccatttccagtgccagaagctctggtggtggctccagtggtagctccagcggatccagcattgcccagggtggttctgcaggatcttttaagccaggaacggggtattcccaggtcagctactcctccggatctggctctagtctacaaggtgcatccggttcctcccagctggggagcagcagctctcactcgggaagcagcggctctcactcgggaagcagcagctctcattcgagcagcagcagcagctttcagttcagcagcagcagcttccaagtagggaatggctctgctctgccaaccaatgacaactcttaccgcggaatactaaacccttcccagcctggacaaagctcttcctcttcccaaacctttggggtatccagcagtggccaaagcgtcagctccaaccagcgtccctgtagttcggacatccccgactctccctgcagtggagggcccatcgtctcgcactctggcccctacatccccagctcccactctgtgtcagggggtcagagacctgtggtggtggtggtggaccagcacggttctggtgcccctggagtggttcaaggtcccccctgtagcaatggtggccttccaggcaagccctgtcccccaatcacctctgtagacaaatcctatggtggctacgaggtggtgggtggctcctctgacagttatctggttccaggcatgacctacagtaagggtaaaatctaccctgtgggctacttcaccaaagagaaccctgtgaaaggctctccaggggtcccttcctttgcagctgggccccccatctctgagggcaaatacttctccagcaaccccatcatccccagccagtcggcagcttcctcggccattgcgttccagccagtggggactggtggggtccagctctgtggaggcggctccacgggctccaagggaccctgctctccctccagttctcgagtccccagcagttctagcatttccagcagcgccggttcaccctaccatccctgcggcagtgcttcccagagcccctgctccccaccaggcaccggctccttcagcagcagctccagttcccaatcgagtggcaaaatcatccttcagccttgtggcagcaagtccagctcttctggtcacccttgcatgtctgtctcctccttgacactgactgggggccccgatggctctccccatcctgatccctccgctggtgccaagccctgtggctccagcagtgctggaaagatcccctgccgctccatccgggatatcctagcccaagtgaagcctctggggccccagctagctgaccctgaagttttcctaccccaaggagagttactcgacagtccataagtcaactgttgtgtgtgtgcatgccttgggcacaaacaagcacatacactatatcccatatgggagaagtccagtgcccaggcatagggttagctcagtttccctccttcccaaaagagtggttctgctttctctactaccctaaggttgcagactctctcttatcaccccttcctccttcctcttctcaaaatggtagattcaaagctcctctcttgattctctcctactgtttaaattcccattccaccacagtgcccctcagccagatcaccaccccttacaattccctctactgtgttgaaatggtccattgagtaacacccccatcaccttctcaactgggaaacccctgaaatgctctcagagcacctctgacgcctgaagaagttataccttcctcttcccctttaccaaataaagcaaagtcaaaccatcatctggaaacagtggccacttttcactgacctctcttcgacatctagtcaacccacccaatatgccactgggctttcgctcccaattccaccccaccctccattacagagctcaccacgccctcctagatcaccgtccccaacacacccattgcctctcaaggcccttatctcagccccttcctgtggccatttccctcagtgcccagatgattccctgggtgagggagacactggggcaccctcagaggttggagcaggctccctgctgtccctggatcctggacagatggctcagtaaactgtggggactaggtgcagactttttgccttcttggaatcctgggtctcctctgagagtctgggtggtgctcttcctacgcctctagaggtctctgtgtccctcattttccttcaaaagcgggctgtgtttctcttctaccttccagctcctcccacagaggaggaagacaataaatatttgttgaactgaaa

SEQ ID NO: 499 - DNA, 2536 bp, Homo sapiens
ccgtgcagcccgagatgggctcgtctcgggcaccctggatggggcgtgtgggtgggcacgggatgatggcactgctgctggctggtctcctcctgccagggaccttggctaagagcattggcaccttctcagacccctgtaaggaccccacgcgtatcacctcccctaacgacccctgcctcactgggaagggtgactccagcggcttcagtagctacagtggctccagcagttctggcagctccatttccagtgccagaagctctggtggtggctccagtggtagctccagcggatccagcattgcccagggtggttctgcaggatcttttaagccaggaacggggtattcccaggtcagctactcctccggatctggctctagtctacaaggtgcatccggttcctcccagctggggagcagcagctctcactcgggaagcagcggctctcactcgggaagcagcagctctcattcgagcagcagcagcagctttcagttcagcagcagcagcttccaagtagggaatggctctgctctgccaaccaatgacaactcttaccgcggaatactaaacccttcccagcctggacaaagctcttcctcttcccaaacctttggggtatccagcagtggccaaagcgtcagctccaaccagcgtccctgtagttcggacatccccgactctccctgcagtggagggcccatcgtctcgcactctggcccctacatccccagctcccactctgtgtcagggggtcagaggcctgtggtggtggtggtggaccagcacggttctggtgcccctggagtggttcaaggtcccccctgtagcaatggtggccttccaggcaagccctgtcccccaatcacctctgtagacaaatcctatggtggctacgaggtggtgggtggctcctctgacagttatctggttccaggcatgacctacagtaagggtaaaatctatcctgtgggctacttcaccaaagagaaccctgtgaaaggctctccaggggtcccttcctttgcagctgggccccccatctctgagggcaaatacttctccagcaaccccatcatccccagccagtcggcagcttcctcggccattgcgttccagccagtggggactggtggggtccagctctgtggaggcggctccacgggctccaagggaccctgctctccctccagttctcgagtccccagcagttctagcatttccagcagctccggttcaccctaccatccctgcggcagtgcttcccagagcccctgctccccaccaggcaccggctccttcagcagcagctccagttcccaatcgagtggcaaaatcatccttcagccttgtggcagcaagtccagctcttctggtcacccttgcatgtctgtctcctccttgacactgactgggggccccgatggctctccccatcctgatccctccgctggtgccaagccctgtggctccagcagtgctggaaagatcccctgccgctccatccgggatatcctagcccaagtgaagcctctggggccccagctagctgaccctgaagttttcctaccccaaggagagttactcgacagtccataagtcaactgttgtgtgtgtgcatgccttgggcacaaacaagcacatacactatatcccatatgggagaaggccagtgcccaggcatagggttagctcagtttccctccttcccaaaagagtggttctgctttctctactaccctaaggttgcagactctctcttatcaccccttcctccttcctcttctcaaaatggtagattcaaagctcctctcttgattctctcctactgtttaaattcccattccaccacagtgcccctcagccagatcaccaccccttacaattccctctactgtgttgaaatggtccattgagtaacacccccatcaccttctcaactgggaaacccctgaaatgctctcagagcacctctgacgcctgaagaagttataccttcctcttcccctttaccaaataaagcaaagtcaaaccatcatctggaaacagtggccacttttcactgacctctcttcgacatctagtcaacccacccaatatgccactgggctttcgctcccaattccaccccaccctccattacagagctcaccacgccctcctagatcaccgtccccaacacacccattgcctctcaaggcccttatctcagccccttcctgtggccatttccctcagtgcccagatgattccctgggtgagggagacactggggcaccctcagaggttggagcaggctccctgctgtccctggatcctggacagatggctcagtaaactgtggggactaggtgcagactttttgccttcttggagtcctgggtctcctctgagagtctgggtggtgctcttcctacgcctctagaggtctctgtgtccctcattttccttcaaaagcgggctgtgtttctcttctaccttccagctcctcccacagaggaggaagacaataaatatttgttgaactgaaa

SEQ ID NO: 500 - DNA, 2503 bp, Homo sapiens
atcagtcaggaggccgtgcagcccgagatgggctcgtctcgggcaccctggatggggcgtgtgggtgggcacgggatgatggcactgctgctggctggtctcctcctgccagggaccttggctaagagcattggcaccttctcagacccctgtaaggaccccacgcgtatcacctcccctaacgacccctgcctcactgggaagggtgactccagcggcttcagtagctacagtggctccagcagttctggcagctccatttccagtgccagaagctctggtggtggctccagtggtagctccagcggatccagcattgcccagggtggttctgcaggatcttttaagccaggaacggggtattcccaggtcagctactcctccggatctggctctagtctacaaggtgcatccggttcctcccagctggggagcagcagctctcactcgggaagcagcggctctcactcgggaagcagcagctctcattcgagcagcagcagcagctttcagttcagcagcagcagcttccaagtagggaatggctctgctctgccaaccaatgacaactcttaccgcggaatactaaacccttcccagcctggacaaagctcttcctcttcccaaacctctggggtatccagcagtggccaaagcgtcagctccaaccagcgtccctgtagttcggacatccccgactctccctgcagtggagggcccatcgtctcgcactctggcccctacatccccagctcccactctgtgtcagggggtcagaggcctgtggtggtggtggtggaccagcacggttctggtgcccctggagtggttcaaggtcccccctgtagcaatggtggccttccaggcaagccctgtcccccaatcacctctgtagacaaatcctatggtggctacgaggtggtgggtggctcctctgacagttatctggttccaggcatgacctacagtaagggtaaaatctatcctgtgggctacttcaccaaagagaaccctgtgaaaggctctccaggggtcccttcctttgcagctgggccccccatctctgagggcaaatacttctccagcaaccccatcatccccagccagtcggcagcttcctcggccattgcgttccagccagtggggactggtggggtccagctctgtggaggcggctccacgggctccaagggaccctgctctccctccagttctcgagtccccagcagttctagcatttccagcagctccggttcaccctaccatccctgcggcagtgcttcccagagcccctgctccccaccaggcaccggctccttcagcagcagctccagttcccaatcgagtggcaaaatcatccttcagccttgtggcagcaagtccagctcttctggtcacccttgcatgtctgtctcctccttgacactgactgggggccccgatggctctccccatcctgatccctccgctggtgccaagccctgtggctccagcagtgctggaaagatcccctgccgctccatccgggatatcctagcccaagtgaagcctctggggccccagctagctgaccctgaagttttcctaccccaaggagagttactcgacagtccataagtcaactgttgtgtgtgtgcatgccttgggcacaaacaagcacatacactatatcccatatgggagaaggccagtgcccaggcatagggttagctcagtttccctccttcccaaaagagtggttctgctttctctactaccctaaggttgcagactctctcttatcaccccttcctccttcctcttctcaaaatggtagattcaaagctcctctcttgattctctcctactgtttaaattcccattccaccacagtgcccctcagccagatcaccaccccttacaattccctctactgtgttgaaatggtccattgagtaacacccccatcaccttctcaactgggaaacccctgaaatgctctcagagcacctctgacgcctgaagaagttataccttcctcttcccctttaccaaataaagcaaagtcaaaccatcatctggaaacagtggccacttttcactgacctctcttcgacatctagtcaacccacccaatatgccactgggctttcgctcccaattccaccccaccctccattacagagctcaccacgccctcctagatcaccgtccccaacacacccattgcctctcaaggcccttatctcagccccttcctgtggccatttccctcagtgcccagatgattccctgggtgagggagacactggggcaccctcagaggttggagcaggctccctgctgtccctggatcctggacagatggctcagtaaactgtggggactaggtgcagactttttgccttcttggagtcctgggtctcctctgagagtctgggtggtgctcttcctacgcctctagaggtctctgtgtccctcattttccttcaaaagcgggctgtgtttctcttctaccttccag

SEQ ID NO: 501 - DNA, 2549 bp, Homo sapiens
atcagtcaggaggccgtgcagcccgagatgggctcgtctcgggcaccctggatggggcgtgtgggtgggcacgggatgatggcactgctgctggctggtctcctcctgccagggaccttggctaagagcattggcaccttctcagacccctgtaaggaccccacgcgtatcacctcccctaacgacccctgcctcactgggaagggtgactccagcggcttcagtagctacagtggctccagcagttctggcagctccatttccagtgccagaagctctggtggtggctccagtggtagctccagcggatccagcattgcccagggtggttctgcaggatcttttaagccaggaacggggtattcccaggtcagctactcctccggatctggctctagtctacaaggtgcatccggttcctcccagctggggagcagcagctctcactcgggaagcagcggctctcactcgggaagcagcagctctcattcgagcagcagcagcagctttcagttcagcagcagcagcttccaagtagggaatggctctgctctgccaaccaatgacaactcttaccgcggaatactaaacccttcccagcctggacaaagctcttcctcttcccaaacctctggggtatccagcagtggccaaagcgtcagctccaaccagcgtccctgtagttcggacatccccgactctccctgcagtggagggcccatcgtctcgcactctggcccctacatccccagctcccactctgtgtcagggggtcagaggcctgtggtggtggtggtggaccagcacggttctggtgcccctggagtggttcaaggtcccccctgtagcaatggtggccttccaggcaagccctgtcccccaatcacctctgtagacaaatcctatggtggctacgaggtggtgggtggctcctctgacagttatctggttccaggcatgacctacagtaagggtaaaatctatcctgtgggctacttcaccaaagagaaccctgtgaaaggctctccaggggtcccttcctttgcagctgggccccccatctctgagggcaaatacttctccagcaaccccatcatccccagccagtcggcagcttcctcggccattgcgttccagccagtggggactggtggggtccagctctgtggaggcggctccacgggctccaagggaccctgctctccctccagttctcgagtccccagcagttctagcatttccagcagctccggttcaccctaccatccctgcggcagtgcttcccagagcccctgctccccaccaggcaccggctccttcagcagcagctccagttcccaatcgagtggcaaaatcatccttcagccttgtggcagcaagtccagctcttctggtcacccttgcatgtctgtctcctccttgacactgactgggggccccgatggctctccccatcctgatccctccgctggtgccaagccctgtggctccagcagtgctggaaagatcccctgccgctccatccgggatatcctagcccaagtgaagcctctggggccccagctagctgaccctgaagttttcctaccccaaggagagttactcgacagtccataagtcaactgttgtgtgtgtgcatgccttgggcacaaacaagcacatacactatatcccatatgggagaaggccagtgcccaggcatagggttagctcagtttccctccttcccaaaagagtggttctgctttctctactaccctaaggttgcagactctctcttatcaccccttcctccttcctcttctcaaaatggtagattcaaagctcctctcttgattctctcctactgtttaaattcccattccaccacagtgcccctcagccagatcaccaccccttacaattccctctactgtgttgaaatggtccattgagtaacacccccatcaccttctcaactgggaaacccctgaaatgctctcagagcacctctgacgcctgaagaagttataccttcctcttcccctttaccaaataaagcaaagtcaaaccatcatctggaaacagtggccacttttcactgacctctcttcgacatctagtcaacccacccaatatgccactgggctttcgctcccaattccaccccaccctccattacagagctcaccacgccctcctagatcaccgtccccaacacacccattgcctctcaaggcccttatctcagccccttcctgtggccatttccctcagtgcccagatgattccctgggtgagggagacactggggcaccctcagaggttggagcaggctccctgctgtccctggatcctggacagatggctcagtaaactgtggggactaggtgcagactttttgccttcttggagtcctgggtctcctctgagagtctgggtggtgctcttcctacgcctctagaggtctctgtgtccctcattttccttcaaaagcgggctgtgtttctcttctaccttccagctcctcccacagaggaggaagacaataaatatttgttgaactgaaa

SEQ ID NO: 502 - DNA, 274 bp, Homo sapiens
gttcttcattcctttactgatgccatctttgatgagtggatgaaaagatttaatcctcctgcagatgcctggcctcaggagctggcccctattggtcacaatcggatgtacaacatggttcctttcttccctccagtgactaatgaagaactctttttaacctcagaccaacttggctacagctatgccatcgatctgccagatttccaggcaaatttcatctgctcatatctggtttctgtgcatcaggagtgagactgaagttctagggcgt

SEQ ID NO: 503 - DNA, 2291 bp, Homo sapiens
gcaattaaagtcaagagctaaggagggagggagagggtttagaaataccagcataataagtagtatgactgggtgctctgtaaattaactcaattagacaaagcctgacttaacgggggaagatggtgagaagcgctaccctcattaaatttggttgttagaggcgcttctaaggaaattaagtctgttagttgtttgaatcacataaaattgtgtgtgcacgttcatgtacacatgtgcacacatgtaacctctgtgattcttgtgggtatttttttaagaagaaaggaatagaaagcaaagaaaaataaaaaatactgaaaagaaaagactgaaagagtagaagataaggagaaaagtacgacagagacaaggaaagtaagagagagagagagctctcccaattataaagccatgagccccctttggtgggggtttctgctcagttgcttgggctgcaaaatcctgccaggagcccagggtcagttcccccgagtctgcatgacggtggacagcctagtgaacaaggagtgctgcccacgcctgggtgcagagtcggccaatgtctgtggctctcagcaaggccgggggcagtgcacagaggtgcgagccgacacaaggccctggagtggtccctacatcctacgaaaccaggatgaccgtgagctgtggccaagaaaattcttccaccggacctgcaagtgcacaggaaactttgccggctataattgtggagactgcaagtttggctggaccggtcccaactgcgagcggaagaaaccaccagtgattcggcagaacatccattccttgagtcctcaggaaagagagcagttcttgggcgccttagatctcgcgaagaagagagtacaccccgactacgtgatcaccacacaacactggctgggcctgcttgggcccaatggaacccagccgcagtttgccaactgcagtgtttatgatttttttgtgtggctccattattattctgttagagatacattattaggaccaggacgcccctacagggccatagatttctcacatcaaggacctgcatttgttacctggcaccggtaccatttgttgtgtctggaaagagatctccagcgactcattggcaatgagtcttttgctttgccctactggaactttgccactgggaggaacgagtgtgatgtgtgtacagaccagctgtttggggcagcgagaccagacgatccgactctgattagtcggaactcaagattctccagctgggaaactgtctgtgatagcttggatgactacaaccacctggtcaccttgtgcaatggaacctatgaaggtttgctgagaagaaatcaaatgggaagaaacagcatgaaattgccaaccttaaaagacatacgagattgcctgtctctccagaagtttgacaatcctcccttcttccagaactctaccttcagtttcaggaatgctttggaagggtttgataaagcagatgggactctggattctcaagtgatgagccttcataatttggttcattccttcctgaacgggacaaacgctttgccacattcagccgccaatgatcccatttttgtggttcttcattcctttactgatgccatctttgatgagtggatgaaaagatttaatcctcctgcagatgcctggcctcaggagctggcccctattggtcacaatcggatgtacaacatggttcctttcttccctccagtgactaatgaagaactctttttaacctcagaccaacttggctacagctatgccatcgatctgccagtttcagttgaagaaactccaggttggcccacaactctcttagtagtcatgggaacactggtggctttggttggtctttttgtgctgttggcttttcttcaatatagaagacttcgaaaaggatatacacccctaatggagacacatttaagcagcaagagatacacagaagaagcctagggtgctcatgccttacctaagagaagaggctggccaagccacagttctgacgctgacaataaaggaactaatcctcactgttccttcttgagttgaagatctttgacataggttcttctatagtgatgatgatctcattcagaagatgcttagctgtagtttccgctttgcttgcttgtttaacaaacccaactaaagtgcttgaggctacctctaccttcaaataaagatagacctgacaatttgtgatatctaataataaccccccccccaatattgattaagcctcctccttttctgaaagcatttaaaaaaaa

SEQ ID NO: 504 - DNA, 2395 bp, Homo sapiens
aactgagttcaaggcaattaaagtcaagagctaaggagggagggagagggtttagaaataccagcataataagtagtatgactgggtgctctgtaaattaactcaattagacaaagcctgacttaacgggggaagatggtgagaagcgctaccctcattaaatttggttgttagaggcgcttctaaggaaattaagtctgttagttgtttgaatcacataaaattgtgtgtgcacgttcatgtacacatgtgcacacatgtaacctctgtgattcttgtgggtatttttttaagaagaaaggaatagaaagcaaagaaaaataaaaaatactgaaaagaaaagactgaaagagtagaagataaggagaaaagtacgacagagacaaggaaagtaagagagagagagagctctcccaattataaagccatgagccccctttggtgggggtttctgctcagttgcttgggctgcaaaatcctgccaggagcccagggtcagttcccccgagtctgcatgacggtggacagcctagtgaacaaggagtgctgcccacgcctgggtgcagagtcggccaatgtctgtggctctcagcaaggccgggggcagtgcacagaggtgcgagccgacacaaggccctggagtggtccctacatcctacgaaaccaggatgaccgtgagctgtggccaagaaaattcttccaccggacctgcaagtgcacaggaaactttgccggctataattgtggagactgcaagtttggctggaccggtcccaactgcgagcggaagaaaccaccagtgattcggcagaacatccattccttgagtcctcaggaaagagagcagttcttgggcgccttagatctcgcgaagaagagagtacaccccgactacgtgatcaccacacaacactggctgggcctgcttgggcccaatggaacccagccgcagtttgccaactgcagtgtttatgatttttttgtgtggctccattattattctgttagagatacattattaggaccaggacgcccctacagggccatagatttctcacatcaaggacctgcatttgttacctggcaccggtaccatttgttgtgtctggaaagagatctccagcgactcattggcaatgagtcttttgctttgccctactggaactttgccactgggaggaacgagtgtgatgtgtgtacagaccagctgtttggggcagcgagaccagacgatccgactctgattagtcggaactcaagattctccagctgggaaactgtctgtgatagcttggatgactacaaccacctggtcaccttgtgcaatggaacctatgaaggtttgctgagaagaaatcaaatgggaagaaacagcatgaaattgccaaccttaaaagacatacgagattgcctgtctctccagaagtttgacaatcctcccttcttccagaactctaccttcagtttcaggaatgctttggaagggtttgataaagcagatgggactctggattctcaagtgatgagccttcataatttggttcattccttcctgaacgggacaaacgctttgccacattcagccgccaatgatcccatttttgtggtgatttctaatcgtttgctttacaatgctacaacaaacatccttgaacatgtaagaaaagagaaagcgaccaaggaactcccttccctgcatgtgctggttcttcattcctttactgatgccatctttgatgagtggatgaaaagatttaatcctcctgcagatgcctggcctcaggagctggcccctattggtcacaatcggatgtacaacatggttcctttcttccctccagtgactaatgaagaactctttttaacctcagaccaacttggctacagctatgccatcgatctgccagtttcagttgaagaaactccaggttggcccacaactctcttagtagtcatgggaacactggtggctttggttggtctttttgtgctgttggcttttcttcaatatagaagacttcgaaaaggatatacacccctaatggagacacatttaagcagcaagagatacacagaagaagcctagggtgctcatgccttacctaagagaagaggctggccaagccacagttctgacgctgacaataaaggaactaatcctcactgttccttcttgagttgaagatctttgacataggttcttctatagtgatgatgatctcattcagaagatgcttagctgtagtttccgctttgcttgcttgtttaacaaacccaactaaagtgcttgaggctacctctaccttcaaataaagatagacctgacaatttgtgatatctaataataaccccccccccaatattgattaagcctcctccttttctgaaagcattt

SEQ ID NO: 505 - DNA, 4214 bp, Homo sapiens
ggggcagacggccggagagccaggtgtgccagggacctatggcagcagggctgaacgtgcccgctccagcctctccagtgctgggagagacctctagatggtgcaggtgagtttgcaatgagggaaagcccctcggcaaggactgagtttccaaacttgcagacagggcagggagcggtcaaggaagagttcccgggaagccctttaaacggaaaggaagcggggctagtgtcagagaggtgtgccaggtcccaggcagccctgctggcccctaaggacatagagtacctgcttctgagagggctgccacggtggccacctgtgaagcctgtcacccagaactggatggtacctgactttcttcatagacccatcttctgctgggactgaagctgacctccaacagaagccaggtgagcccttgggagaggatggcccatgtgggggactgcacgcagacgccctggctccccgtcctggtggtgtctctgatgtgctcagcccgagcggaatactcaaactgcggtgagaacgagtactacaaccagactacggggctgtgccaggagtgccccccgtgtgggccgggagaggagccctacctgtcctgtggctacggcaccaaagacgaggactacggctgcgtcccctgcccggcggagaagttttccaaaggaggctaccagatatgcaggcgtcacaaagactgtgagggcttcttccgggccaccgtgctgacaccaggggacatggagaatgacgctgagtgtggcccttgcctccctggctactacatgctggagaacagaccgaggaacatctatggcatggtctgctactcctgcctcctggcaccccccaacaccaaggaatgtgtgggagccacttcaggagcttctgccaacttccctggcacctcgggcagcagcaccctgtctcccttccagcacgcccacaaagaactctcaggccaaggacacctggccactgccctgatcattgcaatgtccaccatcttcatcatggccatcgccatcgtcctcatcatcatgttctacatcctgaagacaaagccctctgccccagcctgttgcaccagccacccggggaagagcgtggaggcccaagtgagcaaggacgaggagaagaaagaggccccagacaacgtggtgatgttctccgagaaggatgaatttgagaagctgacagcaactccagcaaagcccaccaagagcgagaacgatgcctcatccgagaatgagcagctgctgagccggagcgtcgacagtgatgaggagcccgcccctgacaagcagggctccccggagctgtgcctgctgtcgctggttcacctggccagggagaagtctgccaccagcaacaagtcagccgggattcaaagccggaggaaaaagatcctcgatgtgtatgccaacgtgtgtggagtcgtggaaggtcttagccccacggagctgccatttgattgcctcgagaagactagccgaatgctcagctccacgtacaactctgagaaggctgttgtgaaaacgtggcgccacctcgccgagagcttcggcctgaagagggatgagattgggggcatgacagacggcatgcaactctttgaccgcatcagcacggcaggctacagcatccctgagctactcacaaaactggtgcagattgagcggctggatgctgtggagtccttgtgtgcagacatactggagtgggcgggggttgtgccacctgcctcccagccacatgctgcatcctgaaaagcatgcctgtgggctgtcctcccaggacaagccaaggagccaacgagggctctggagctgtgagtggtgccaaaagactgccaagaatcaaggcttttgtgatatgtcaccgtatgccttaggatgttcaaggagccagacgaaataaggcctgtcttccaatttaaccaaagataaaggactagagccgggatactttcagatgctcgcctgtacctcaccaggcagagtaaatatctactcactcatacagccagcccaccagcccaccattaactcactgaacaatgagacaatgttgaggactcaaatgaatcaaaccccgtgggaatgacagaagtgaagaatctggtccctgtctttaaggagtttgcactccagtagaagacagaaggaacgtatgtttacaaaccacttcactggaagacgtcaaacaagctgaatgaaggggcgcttagaaaacgttaatagaagttctaagcgggagatgactccctactgggatgatgaaggatggcatcctagtgaagaagcagctcaaacattttgataaaatggcaacaaaatgcagacaccctgctccaggtattatttcaggtttagtacaagtctgttaataccctatgtggtttcattaggataactttttacctatccttgaggtcatccatattcttacaggccttccagtcaataatggaagagctcactctatacaaaaccaatatgcaaggcatgtgtttgtccaagcaattggatgtgtgcagtagccaatttcatttactgcattactctttggcctgggaaccctgtggtctgcactacatgtgaatggccttccacttcagtcttaggcagatttgaccttttaggggcagcaatgctgaaggacacagcaatttaaattataatgtgtcaggctgtgttttcacttcaaacatgtatgagtagtcagctgtaattagagaaatgatgacttcctaagagttcagccacgcataattctagatttcaagagcatctaagacttgtggattagcctcatggcatgagagtttcagactcagccttctgagccagtcagggaaagtggagttctgcagcgcaaatgagagcctgggcttgatgtcgagggagctggcttctagttgtgccaccttgggccttgtcttttcctctctctgcctcagtttctcgtctgccaatgagatgttagttagtgattctataattggggcaggtagggttcaggtgagcaaaaagaaagtggagctataggaaatgccaggcctttgaggtgctctatggaagtcaacacagtgtggtttgtccatttaaatgggaataaaaacagaaaaactcagacttggcattttcacaataactgcaatggtttgacataacatttataggcagaaagttaataaactggcattgttcttggcatattattgtactatccctgtaactgccaagagctcaggagccaggctagtgatcacaccaggggttagagttcactgctgaactccctgatggcaggtctgtgtttattactacattaaaacaaagtctctgacttataaagcgaggttgtaaaaattacaagttgcatgactgaaaaaatgctttagggggaaaatcagtcatatctttaacaccaacaagcaatttcccaccaacgaatgtagtacatactgtgagaggatcataatgaggtcctgaatatttaatatcatcatttactgtgtctgtttgctgctgtttttcgaacctatttggtttaccctgcaagctaaatactccacggcagagcttaattatccttttaattcctctttgaaatcctgtggtgcccccttccccctgccttgtgatgatgatgagtgagtctccccttaattagactgcaaatgtcacttgtgatgagtgtgccattccaggataacagcttgcaccctcctcagaatgttttcagcgaaagagtggggtggctgttctctgctcctggtgctttggcctcatttcacactattagaattctggggctgtaaggccagccagtgtcagctcatgttccattggctctccacctgccatttttagggagctattccttatatagttacaaattcccttgtcatttacttatttggaaacatgggatttactctgacaagctttagcctatgttatgggattcagaacaatgagatcataataattctcactgaccaaagctgggactccatcctgccatttttgtgtggagatattcataattctgcaatactttaaaacatttagaaaacaccccagggtaggtctgtggcccttagacagtgaagtcttaattgtcaatattatttttgtctaattctgtatatatataacttattatattttataatctcaataaacacattaataaga

SEQ ID NO: 506 - DNA, 4303 bp, Homo sapiens
ggggcagacggccggagagccaggtgtgccagggacctatggcagcagggctgaacgtgcccgctccagcctctccagtgctgggagagacctctagatggtgcaggtgagtttgcaatgagggaaagcccctcggcaaggactgagtttccaaacttgcagacagggcagggagcggtcaaggaagagttcccgggaagccctttaaacggaaaggaagcggggctagtgtcagagaggtgtgccaggtcccaggcagccctgctggcccctaaggacatagagtacctgcttctgagagggctgccacggtggccacctgtgaagcctgtcacccagaactggatggtacctgactttcttcatagacccatcttctgctgggactgaagctgacctccaacagaagccaggtgagcccttgggagaggatggcccatgtgggggactgcacgcagacgccctggctccccgtcctggtggtgtctctgatgtgctcagcccgagcggaatactcaaactgcggtgagaacgagtactacaaccagactacggggctgtgccaggagtgccccccgtgtgggccgggagaggagccctacctgtcctgtggctacggcaccaaagacgaggactacggctgcgtcccctgcccggcggagaagttttccaaaggaggctaccagatatgcaggcgtcacaaagactgtgagggcttcttccgggccaccgtgctgacaccaggggacatggagaatgacgctgagtgtggcccttgcctccctggctactacatgctggagaacagaccgaggaacatctatggcatggtctgctactcctgcctcctggcaccccccaacaccaaggaatgtgtgggagccacttcaggagcttctgccaacttccctggcacctcgggcagcagcaccctgtctcccttccagcacgcccacaaagaactctcaggccaaggacacctggccactgccctgatcattgcaatgtccaccatcttcatcatggccatcgccatcgtcctcatcatcatgttctacatcctgaagacaaagccctctgccccaggtgacggcccccatgcgccggtgccctgcttcctggactctccgtcaactccccctgtcggagagcctggctgctcactccctcctctctccccagcctgttgcaccagccacccggggaagagcgtggaggcccaagtgagcaaggacgaggagaagaaagaggccccagacaacgtggtgatgttctccgagaaggatgaatttgagaagctgacagcaactccagcaaagcccaccaagagcgagaacgatgcctcatccgagaatgagcagctgctgagccggagcgtcgacagtgatgaggagcccgcccctgacaagcagggctccccggagctgtgcctgctgtcgctggttcacctggccagggagaagtctgccaccagcaacaagtcagccgggattcaaagccggaggaaaaagatcctcgatgtgtatgccaacgtgtgtggagtcgtggaaggtcttagccccacggagctgccatttgattgcctcgagaagactagccgaatgctcagctccacgtacaactctgagaaggctgttgtgaaaacgtggcgccacctcgccgagagcttcggcctgaagagggatgagattgggggcatgacagacggcatgcaactctttgaccgcatcagcacggcaggctacagcatccctgagctactcacaaaactggtgcagattgagcggctggatgctgtggagtccttgtgtgcagacatactggagtgggcgggggttgtgccacctgcctcccagccacatgctgcatcctgaaaagcatgcctgtgggctgtcctcccaggacaagccaaggagccaacgagggctctggagctgtgagtggtgccaaaagactgccaagaatcaaggcttttgtgatatgtcaccgtatgccttaggatgttcaaggagccagacgaaataaggcctgtcttccaatttaaccaaagataaaggactagagccgggatactttcagatgctcgcctgtacctcaccaggcagagtaaatatctactcactcatacagccagcccaccagcccaccattaactcactgaacaatgagacaatgttgaggactcaaatgaatcaaaccccgtgggaatgacagaagtgaagaatctggtccctgtctttaaggagtttgcactccagtagaagacagaaggaacgtatgtttacaaaccacttcactggaagacgtcaaacaagctgaatgaaggggcgcttagaaaacgttaatagaagttctaagcgggagatgactccctactgggatgatgaaggatggcatcctagtgaagaagcagctcaaacattttgataaaatggcaacaaaatgcagacaccctgctccaggtattatttcaggtttagtacaagtctgttaataccctatgtggtttcattaggataactttttacctatccttgaggtcatccatattcttacaggccttccagtcaataatggaagagctcactctatacaaaaccaatatgcaaggcatgtgtttgtccaagcaattggatgtgtgcagtagccaatttcatttactgcattactctttggcctgggaaccctgtggtctgcactacatgtgaatggccttccacttcagtcttaggcagatttgaccttttaggggcagcaatgctgaaggacacagcaatttaaattataatgtgtcaggctgtgttttcacttcaaacatgtatgagtagtcagctgtaattagagaaatgatgacttcctaagagttcagccacgcataattctagatttcaagagcatctaagacttgtggattagcctcatggcatgagagtttcagactcagccttctgagccagtcagggaaagtggagttctgcagcgcaaatgagagcctgggcttgatgtcgagggagctggcttctagttgtgccaccttgggccttgtcttttcctctctctgcctcagtttctcgtctgccaatgagatgttagttagtgattctataattggggcaggtagggttcaggtgagcaaaaagaaagtggagctataggaaatgccaggcctttgaggtgctctatggaagtcaacacagtgtggtttgtccatttaaatgggaataaaaacagaaaaactcagacttggcattttcacaataactgcaatggtttgacataacatttataggcagaaagttaataaactggcattgttcttggcatattattgtactatccctgtaactgccaagagctcaggagccaggctagtgatcacaccaggggttagagttcactgctgaactccctgatggcaggtctgtgtttattactacattaaaacaaagtctctgacttataaagcgaggttgtaaaaattacaagttgcatgactgaaaaaatgctttagggggaaaatcagtcatatctttaacaccaacaagcaatttcccaccaacgaatgtagtacatactgtgagaggatcataatgaggtcctgaatatttaatatcatcatttactgtgtctgtttgctgctgtttttcgaacctatttggtttaccctgcaagctaaatactccacggcagagcttaattatccttttaattcctctttgaaatcctgtggtgcccccttccccctgccttgtgatgatgatgagtgagtctccccttaattagactgcaaatgtcacttgtgatgagtgtgccattccaggataacagcttgcaccctcctcagaatgttttcagcgaaagagtggggtggctgttctctgctcctggtgctttggcctcatttcacactattagaattctggggctgtaaggccagccagtgtcagctcatgttccattggctctccacctgccatttttagggagctattccttatatagttacaaattcccttgtcatttacttatttggaaacatgggatttactctgacaagctttagcctatgttatgggattcagaacaatgagatcataataattctcactgaccaaagctgggactccatcctgccatttttgtgtggagatattcataattctgcaatactttaaaacatttagaaaacaccccagggtaggtctgtggcccttagacagtgaagtcttaattgtcaatattatttttgtctaattctgtatatatataacttattatattttataatctcaataaacacatt

SEQ ID NO: 507 - DNA, 4323 bp, Homo sapiens
caggtgagtttgcaatgagggaaagcccctcggcaaggactgagtttccaaacttgcagacagggcagggagcggtcaaggaagagttcccgggaagccctttaaacggaaaggaagcggggctagtgtcagagaggtgtgccaggtcccaggcagccctgctggcccctaaggacatagagtacctgcttctgagagggctgccacggtggccacctgtgaagcctgtcacccagaactggatggtacctgactttcttcatagacccatcttctgctgggactgaagctgacctccaacagaagccagaccatccgagccatcctgggaggctcagcctccaccacccatgtgggcaccttctgcattacctacaatagccagcctgagaggagcagcaagccctctgcaggccctcgggacacgtgagcccttgggagaggatggcccatgtgggggactgcacgcagacgccctggctccccgtcctggtggtgtctctgatgtgctcagcccgagcggaatactcaaactgcggtgagaacgagtactacaaccagactacggggctgtgccaggagtgccccccgtgtgggccgggagaggagccctacctgtcctgtggctacggcaccaaagacgaggactacggctgcgtcccctgcccggcggagaagttttccaaaggaggctaccagatatgcaggcgtcacaaagactgtgagggcttcttccgggccaccgtgctgacaccaggggacatggagaatgacgctgagtgtggcccttgcctccctggctactacatgctggagaacagaccgaggaacatctatggcatggtctgctactcctgcctcctggcaccccccaacaccaaggaatgtgtgggagccacttcaggagcttctgccaacttccctggcacctcgggcagcagcaccctgtctcccttccagcacgcccacaaagaactctcaggccaaggacacctggccactgccctgatcattgcaatgtccaccatcttcatcatggccatcgccatcgtcctcatcatcatgttctacatcctgaagacaaagccctctgccccaggtgacggcccccatgcgccggtgccctgcttcctggactctccgtcaactccccctgtcggagagcctggctgctcactccctcctctctccccagcctgttgcaccagccacccggggaagagcgtggaggcccaagtgagcaaggacgaggagaagaaagaggccccagacaacgtggtgatgttctccgagaaggatgaatttgagaagctgacagcaactccagcaaagcccaccaagagcgagaacgatgcctcatccgagaatgagcagctgctgagccggagcgtcgacagtgatgaggagcccgcccctgacaagcagggctccccggagctgtgcctgctgtcgctggttcacctggccagggagaagtctgccaccagcaacaagtcagccgggattcaaagccggaggaaaaagatcctcgatgtgtatgccaacgtgtgtggagtcgtggaaggtcttagccccacggagctgccatttgattgcctcgagaagactagccgaatgctcagctccacgtacaactctgagaaggctgttgtgaaaacgtggcgccacctcgccgagagcttcggcctgaagagggatgagattgggggcatgacagacggcatgcaactctttgaccgcatcagcacggcaggctacagcatccctgagctactcacaaaactggtgcagattgagcggctggatgctgtggagtccttgtgtgcagacatactggagtgggcgggggttgtgccacctgcctcccagccacatgctgcatcctgaaaagcatgcctgtgggctgtcctcccaggacaagccaaggagccaacgagggctctggagctgtgagtggtgccaaaagactgccaagaatcaaggcttttgtgatatgtcaccgtatgccttaggatgttcaaggagccagacgaaataaggcctgtcttccaatttaaccaaagataaaggactagagccgggatactttcagatgctcgcctgtacctcaccaggcagagtaaatatctactcactcatacagccagcccaccagcccaccattaactcactgaacaatgagacaatgttgaggactcaaatgaatcaaaccccgtgggaatgacagaagtgaagaatctggtccctgtctttaaggagtttgcactccagtagaagacagaaggaacgtatgtttacaaaccacttcactggaagacgtcaaacaagctgaatgaaggggcgcttagaaaacgttaatagaagttctaagcgggagatgactccctactgggatgatgaaggatggcatcctagtgaagaagcagctcaaacattttgataaaatggcaacaaaatgcagacaccctgctccaggtattatttcaggtttagtacaagtctgttaataccctatgtggtttcattaggataactttttacctatccttgaggtcatccatattcttacaggccttccagtcaataatggaagagctcactctatacaaaaccaatatgcaaggcatgtgtttgtccaagcaattggatgtgtgcagtagccaatttcatttactgcattactctttggcctgggaaccctgtggtctgcactacatgtgaatggccttccacttcagtcttaggcagatttgaccttttaggggcagcaatgctgaaggacacagcaatttaaattataatgtgtcaggctgtgttttcacttcaaacatgtatgagtagtcagctgtaattagagaaatgatgacttcctaagagttcagccacgcataattctagatttcaagagcatctaagacttgtggattagcctcatggcatgagagtttcagactcagccttctgagccagtcagggaaagtggagttctgcagcgcaaatgagagcctgggcttgatgtcgagggagctggcttctagttgtgccaccttgggccttgtcttttcctctctctgcctcagtttctcgtctgccaatgagatgttagttagtgattctataattggggcaggtagggttcaggtgagcaaaaagaaagtggagctataggaaatgccaggcctttgaggtgctctatggaagtcaacacagtgtggtttgtccatttaaatgggaataaaaacagaaaaactcagacttggcattttcacaataactgcaatggtttgacataacatttataggcagaaagttaataaactggcattgttcttggcatattattgtactatccctgtaactgccaagagctcaggagccaggctagtgatcacaccaggggttagagttcactgctgaactccctgatggcaggtctgtgtttattactacattaaaacaaagtctctgacttataaagcgaggttgtaaaaattacaagttgcatgactgaaaaaatgctttagggggaaaatcagtcatatctttaacaccaacaagcaatttcccaccaacgaatgtagtacatactgtgagaggatcataatgaggtcctgaatatttaatatcatcatttactgtgtctgtttgctgctgtttttcgaacctatttggtttaccctgcaagctaaatactccacggcagagcttaattatccttttaattcctctttgaaatcctgtggtgcccccttccccctgccttgtgatgatgatgagtgagtctccccttaattagactgcaaatgtcacttgtgatgagtgtgccattccaggataacagcttgcaccctcctcagaatgttttcagcgaaagagtggggtggctgttctctgctcctggtgctttggcctcatttcacactattagaattctggggctgtaaggccagccagtgtcagctcatgttccattggctctccacctgccatttttagggagctattccttatatagttacaaattcccttgtcatttacttatttggaaacatgggatttactctgacaagctttagcctatgttatgggattcagaacaatgagatcataataattctcactgaccaaagctgggactccatcctgccatttttgtgtggagatattcataattctgcaatactttaaaacatttagaaaacaccccagggtaggtctgtggcccttagacagtgaagtcttaattgtcaatattatttttgtctaattctgtatatatataacttattatattttataatctcaataaacacattaataaga

SEQ ID NO: 508 - DNA, 957 bp, Homo sapiens
atggattgccaagaaaatgagtactgggaccaatggggacggtgtgtcacctgccaacggtgtggtcctggacaggagctatccaaggattgtggttatggagagggtggagatgcctactgcacagcctgccctcctcgcaggtacaaaagcagctggggccaccacagatgtcagagttgcatcacctgtgctgtcatcaatcgtgttcagaaggtcaactgcacagctacctctaatgctgtctgtggggactgtttgcccaggttctaccgaaagacacgcattggaggcctgcaggaccaagagtgcatcccgtgcacgaagcagacccccacctctgaggttcaatgtgccttccagttgagcttagtggaggcagatacacccacagtgccccctcaggaggccacacttgttgcactggtgagcagcctgctagtggtgtttaccctggccttcctggggctcttcttcctctactgcaagcagttcttcaacagacattgccagcgtgagaaattgattattttctctgatccagtaccagctagcctcaatctgatacctgaatttgcaggaggtttgctgcagtttgaggctgataaaacagcaaaggaggaatctctcttccccgtgccacccagcaaggagaccagtgctgagtcccaagtgagtgagaacatctttcagacccagccacttaaccctatcctcgaggacgactgcagctcgactagtggcttccccacacaggagtcctttaccatggcctcctgcacctcagagagccactcccactgggtccacagccccatcgaatgcacagagctggacctgcaaaagttttccagctctgcctcctatactggagctgagaccttggggggaaacacagtcgaaagcactggagacaggctggagctcaatgtgccctttgaagttcccagcccttaa

SEQ ID NO: 509 - DNA, 3418 bp, Homo sapiens
ccggagtcccatttgggagcaagagccatctactcgtccgttaccggccttcccaccatggattgccaagaaaatgagtactgggaccaatggggacggtgtgtcacctgccaacggtgtggtcctggacaggagctatccaaggattgtggttatggagagggtggagatgcctactgcacagcctgccctcctcgcaggtacaaaagcagctggggccaccacagatgtcagagttgcatcacctgtgctgtcatcaatcgtgttcagaaggtcaactgcacagctacctctaatgctgtctgtggggactgtttgcccaggttctaccgaaagacacgcattggaggcctgcaggaccaagagtgcatcccgtgcacgaagcagacccccacctctgaggttcaatgtgccttccagttgagcttagtggaggcagatacacccacagtgccccctcaggaggccacacttgttgcactggtgagcagcctgctagtggtgtttaccctggccttcctggggctcttcttcctctactgcaagcagttcttcaacagacattgccagcgtggaggtttgctgcagtttgaggctgataaaacagcaaaggaggaatctctcttccccgtgccacccagcaaggagaccagtgctgagtcccaagtgagtgagaacatctttcagacccagccacttaaccctatcctcgaggacgactgcagctcgactagtggcttccccacacaggagtcctttaccatggcctcctgcacctcagagagccactcccactgggtccacagccccatcgaatgcacagagctggacctgcaaaagttttccagctctgcctcctatactggagctgagaccttggggggaaacacagtcgaaagcactggagacaggctggagctcaatgtgccctttgaagttcccagcccttaactctaatgaggtctcttgggcccctggcagccttgcccagttgttctctctggactctgttcctataccacaacagcagcaggggcctgaaatgtgatgtccacaagagctaataccctacagatggggcatatcctatcccatcccaccagaggattgattctccatttcacaaggactgatctggagcatttcttgcttcccttttgtagtctggggagccagattccacattcatgggactaccagacatgttcctagctcaacttgattatagagaagaggagagaggacagtgaatggggtagggttttcatgtctgcatttttggtcaggtaagcctctcaaaattgtgttggcacatctacctagcactttagggacaaaatcaaacccttctccccttttagctcctccacactgtctccctcctcaacacacacacacacacatacacacacatatacatagacacacaaacacacacacacacattaatatctatcttgggggaggcctcgtgccataattcccaagttcatgtctcagactgctgcattgcagcatgaggcagggcaaacactttccctctagatccctggggcctcaccctgtatttgaggttctcaccaccctcagcagggagaagggctgaagttcgccattttggaaccttacagaacatttctgagccaaagtaatcttccttctggggcctgagttccccaaactaccccacagcagtccctcaaagacagccctcaatccatgtagggacatctgagtatgcctctttctattgaaatgtcaattcaatcccagctttctcaccaccgttcccctttgattctttctcaattgtctttttgcctttagctcccacctatacatctcatgctcagagaaaaacaagttccttagaggttgtattctttattctccaagaatctgtctgaaacttgtacagctagttcctgtcccacaactattaagtggtttattaagtacattaggcagaatgtgcacttcatcaccaggttctagctctggcaaaggagtgctgtctacagcaagatttttgcttttagaattttattaactacatcttttgggttcatccatctacaaacactgattaagggcccctggggcaaccaattgatcagattactaaaaggacttgggaaaaagcaaaaaggtcccattgtactggactgaggattagaagcaattgaaatacaagcctgtaccaagcaagcagcctggccccacacaggtattagcaaatatgtggtaaccaaggttttaggccttggcctttaggtttcctgttttttttttgtttttgtttttgtttttgtttttctgcaacaggttattcttatctcactggctttcactgatcatgtttagaccttctggtagaagaaataatatccagacaggggatgatttggcttcagcaggctgcaggtgttcaaaggttgccatgtggctggcagtggttcaagcccacatttgacactgctgctctagaggaaagataatgatggtaacacagtaataataataataataacaaaaatatgataaagtgaaagagtaagacttcttcagtgtgcttgctcatggcatgaatgctatgtggacagcccaagccatacccagaatcaccttaattccaactttttgaggttcagcaattggaggtggcaattggctttgcattttaaagtatttcgggtaaaggtgaagtgaaggattttcgtctttataatttctgtttggccatggcaaataccatagttgagtatttgcttcaggagagttctttttacagttttacttttcaatgctgaggcatatttctttgagcactgtgcttttatgtgtctttctacaaaggggttattggtcagtggaagaacaaagtacacttgataaaaacattttcaacatacattgagcctaaacagcagttaagttgtctctaaatgaactagcaaaaaaaaaaaatgtagtttttgtttgtaaggaaggggaggtatttcctgagaatgaatttttttttttttggattactgtttttctctccatataccttgacttggattttgacaggagggagcctgggaaaataattttttcctccaagattctcagatccaggttaggaaaggattcagcactacagcatacccctctacaacatacagccctgtcacattgagatcataatccctcctgtcccactcctctctaccaaccccaccctactagctaggtcttcagtgttttacattgaatattggtacattttaattattttttctcataaatgggttatttatagaaattttgttaactcttgagccatatgcatgtgtagatactggcagggctatgtttgtttatgatgctctgcaaacatttcatattggccaataaacagaaatatatccaaaaa

SEQ ID NO: 510 - DNA, 3367 bp, Homo sapiens
gccttcccaccatggattgccaagaaaatgagtactgggaccaatggggacggtgtgtcacctgccaacggtgtggtcctggacaggagctatccaaggattgtggttatggagagggtggagatgcctactgcacagcctgccctcctcgcaggtacaaaagcagctggggccaccacagatgtcagagttgcatcacctgtgctgtcatcaatcgtgttcagaaggtcaactgcacagctacctctaatgctgtctgtggggactgtttgcccaggttctaccgaaagacacgcattggaggcctgcaggaccaagagtgcatcccgtgcacgaagcagacccccacctctgaggttcaatgtgccttccagttgagcttagtggaggcagatacacccacagtgccccctcaggaggccacacttgttgcactggtgagcagcctgctagtggtgtttaccctggccttcctggggctcttcttcctctactgcaagcagttcttcaacagacattgccagcgtggaggtttgctgcagtttgaggctgataaaacagcaaaggaggaatctctcttccccgtgccacccagcaaggagaccagtgctgagtcccaagtgagtgagaacatctttcagacccagccacttaaccctatcctcgaggacgactgcagctcgactagtggcttccccacacaggagtcctttaccatggcctcctgcacctcagagagccactcccactgggtccacagccccatcgaatgcacagagctggacctgcaaaagttttccagctctgcctcctatactggagctgagaccttggggggaaacacagtcgaaagcactggagacaggctggagctcaatgtgccctttgaagttcccagcccttaactctaatgaggtctcttgggcccctggcagccttgcccagttgttctctctggactctgttcctataccacaacagcagcaggggcctgaaatgtgatgtccacaagagctaataccctacagatggggcatatcctatcccatcccaccagaggattgattctccatttcacaaggactgatctggagcatttcttgcttcccttttgtagtctggggagccagattccacattcatgggactaccagacatgttcctagctcaacttgattatagagaagaggagagaggacagtgaatggggtagggttttcatgtctgcatttttggtcaggtaagcctctcaaaattgtgttggcacatctacctagcactttagggacaaaatcaaacccttctccccttttagctcctccacactgtctccctcctcaacacacacacacacacatacacacacatatacatagacacacaaacacacacacacacattaatatctatcttgggggaggcctcgtgccataattcccaagttcatgtctcagactgctgcattgcagcatgaggcagggcaaacactttccctctagatccctggggcctcaccctgtatttgaggttctcaccaccctcagcagggagaagggctgaagttcgccattttggaaccttacagaacatttctgagccaaagtaatcttccttctggggcctgagttccccaaactaccccacagcagtccctcaaagacagccctcaatccatgtagggacatctgagtatgcctctttctattgaaatgtcaattcaatcccagctttctcaccaccgttcccctttgattctttctcaattgtctttttgcctttagctcccacctatacatctcatgctcagagaaaaacaagttccttagaggttgtattctttattctccaagaatctgtctgaaacttgtacagctagttcctgtcccacaactattaagtggtttattaagtacattaggcagaatgtgcacttcatcaccaggttctagctctggcaaaggagtgctgtctacagcaagatttttgcttttagaattttattaactacatcttttgggttcatccatctacaaacactgattaagggcccctggggcaaccaattgatcagattactaaaaggacttgggaaaaagcaaaaaggtcccattgtactggactgaggattagaagcaattgaaatacaagcctgtaccaagcaagcagcctggccccacacaggtattagcaaatatgtggtaaccaaggttttaggccttggcctttaggtttcctgttttttttttgtttttgtttttgtttttgtttttctgcaacaggttattcttatctcactggctttcactgatcatgtttagaccttctggtagaagaaataatatccagacaggggatgatttggcttcagcaggctgcaggtgttcaaaggttgccatgtggctggcagtggttcaagcccacatttgacactgctgctctagaggaaagataatgatggtaacacagtaataataataataataacaaaaatatgataaagtgaaagagtaagacttcttcagtgtgcttgctcatggcatgaatgctatgtggacagcccaagccatacccagaatcaccttaattccaactttttgaggttcagcaattggaggtggcaattggctttgcattttaaagtatttcgggtaaaggtgaagtgaaggattttcgtctttataatttctgtttggccatggcaaataccatagttgagtatttgcttcaggagagttctttttacagttttacttttcaatgctgaggcatatttctttgagcactgtgcttttatgtgtctttctacaaaggggttattggtcagtggaagaacaaagtacacttgataaaaacattttcaacatacattgagcctaaacagcagttaagttgtctctaaatgaactagcaaaaaaaaaaaatgtagtttttgtttgtaaggaaggggaggtatttcctgagaatgaatttttttttttttggattactgtttttctctccatataccttgacttggattttgacaggagggagcctgggaaaataattttttcctccaagattctcagatccaggttaggaaaggattcagcactacagcatacccctctacaacatacagccctgtcacattgagatcataatccctcctgtcccactcctctctaccaaccccaccctactagctaggtcttcagtgttttacattgaatattggtacattttaattattttttctcataaatgggttatttatagaaattttgttaactcttgagccatatgcatgtgtagatactggcagggctatgtttgtttatgatgctctgcaaacatttcatattggccaataaacagaaatatatcc

SEQ ID NO: 511 - DNA, 1014 bp, Homo sapiens
ccggagtcccatttgggagcaagagccatctactcgtccgttaccggccttcccaccatggattgccaagaaaatgagtactgggaccaatggggacggtgtgtcacctgccaacggtgtggtcctggacaggagctatccaaggattgtggttatggagagggtggagatgcctactgcacagcctgccctcctcgcaggtacaaaagcagctggggccaccacagatgtcagagttgcatcacctgtgctgtcatcaatcgtgttcagaaggtcaactgcacagctacctctaatgctgtctgtggggactgtttgcccaggttctaccgaaagacacgcattggaggcctgcaggaccaagagtgcatcccgtgcacgaagcagacccccacctctgaggttcaatgtgccttccagttgagcttagtggaggcagatacacccacagtgccccctcaggaggccacacttgttgcactggtgagcagcctgctagtggtgtttaccctggccttcctggggctcttcttcctctactgcaagcagttcttcaacagacattgccagcgtgagaaattgattattttctctgatccagtaccagctagcctcaatctgatacctgaatttgcaggaggtttgctgcagtttgaggctgataaaacagcaaaggaggaatctctcttccccgtgccacccagcaaggagaccagtgctgagtcccaagtgagtgagaacatctttcagacccagccacttaaccctatcctcgaggacgactgcagctcgactagtggcttccccacacaggagtcctttaccatggcctcctgcacctcagagagccactcccactgggtccacagccccatcgaatgcacagagctggacctgcaaaagttttccagctctgcctcctatactggagctgagaccttggggggaaacacagtcgaaagcactggagacaggctggagctcaatgtgccctttgaagttcccagcccttaa

SEQ ID NO: 512 - DNA, 930 bp, Homo sapiens
ggatttgtaccggagtcccatttgggagcaagagccatctactcgtccgttaccggccttcccaccatggattgccaagaaaatgagtactgggaccaatggggacggtgtgtcacctgccaacggtgtggtcctggacaggagctatccaaggtgccttccagttgagcttagtggaggcagatacacccacagtgccccctcaggaggccacacttgttgcactggaggtttgctgcagtttgaggctgataaaacagcaaaggaggaatctctcttccccgtgccacccagcaaggagaccagtgctgagtcccaagtgagtgagaacatctttcagacccagccacttaaccctatcctcgaggacgactgcagctcgactagtggcttccccacacaggagtcctttaccatggcctcctgcacctcagagagccactcccactgggtccacagccccatcgaatgcacagagctggacctgcaaaagttttccagctctgcctcctatactggagctgagaccttggggggaaacacagtcgaaagcactggagacaggctggagctcaatgtgccctttgaagttcccagcccttaactctaatgaggtctcttgggcccctggcagccttgcccagttgttctctctggactctgttcctataccacaacagcagcaggggcctgaaatgtgatgtccacaagagctaataccctacagatggggcatatcctatcccatcccaccagaggattgattctccatttcacaaggactgatctggagcatttcttgcttcccttttgtagtctggggagccagattccacattcatgggactaccagacatgttcctagctcaacttgattatagagaagaggagagaggacagtgaatggggtagggttttcatgtctgcatt

SEQ ID NO: 513 - DNA, 970 bp, Homo sapiens
gttgttgctacacgtggatgtgaaatgagtcaagcggaactttgattacaaggaatttcatatactccttcccaccatggattgccaagaaaatgagtactgggaccaatggggacggtgtgtcacctgccaacggtgtggtcctggacaggagctatccaaggattgtggttatggagagggtggagatgcctactgcacagcctgccctcctcgcaggtacaaaagcagctggggccaccacagatgtcagagttgcatcacctgtgctgtcatcaatcgtgttcagaaggtcaactgcacagctacctctaatgctgtctgtggggactgtttgcccaggttctaccgaaagacacgcattggaggcctgcaggaccaagagtgcatcccgtgcacgaagcagacccccacctctgaggttcaatgtgccttccagttgagcttagtggaggcagatacacccacagtgccccctcaggaggccacacttgttgcactggtgagcagcctgctagtggtgtttaccctggccttcctggggctcttcttcctctactgcaagcagttcttcaacagacattgccagcgtggaggtttgctgcagtttgaggctgataaaacagcaaaggaggaatctctcttccccgtgccacccagcaaggagaccagtgctgagtcccaagtgagtgagaacatctttcagacccagccacttaaccctatcctcgaggacgactgcagctcgactagtggcttccccacacaggagtcctttaccatggcctcctgcacctcagagagccactcccactgggtccacagccccatcgaatgcacagagctggacctgcaaaagttttccagctctgcctcctatactggagctgagaccttggggggaaacacagtcgaaagcactggagacaggctggagctcaatgtgccctttgaagttcccagcccttaa

SEQ ID NO: 514 - DNA, 858 bp, Homo sapiens
ccgaaggcagaccaagaggaagtttatcctcccacctacaaattccccagagagctttcatctagaaggtttgactctggccagacaaccagcgagcatcttctcgcaatctgttgcttcttccatggcaaactccagagaattaagaagccaaactcaacatcgccatgggcctcaggacgactaaacagatggggagaggcactaaagctcctggtcaccaagaggatcatatggtaaaggaaccagtggaagacacagaccctagcactttatcctttaatatgtcagacaaatatcccattcaagatacggaactccctaaagctgaagaatgtgatacaattactttgaactgcccacgaaattcagatatgaaaaatcagggagaagaaaatggctttccagatagcactggagatcctcttccagagatcagcaaggacaactcctgcaaagaaaactgtacttgttcctcctgcttgctccgggcccccaccataagtgacttgctcaatgatcaggacttactagacgtgatcaggataaagctggatccgtgtcacccaacggtgaaaaactggaggaattttgcaagcaaatgggggatgtcctatgacgaattgtgcttcctggagcagaggccacagagccccaccttggagttcttgctccggaacagtcagaggacggtgggccagctgatggagctctgcaggctctaccacagggccgacgtggagaaggttctgcgcaggtgggtggacgaggagtggcccaagcgggagcgtggagacccctccaggcacttctagagctcttcttcttccttcattggcctctccggatgttgaaaca

SEQ ID NO: 515 - DNA, 2909 bp, Homo sapiens
aattgccaaagcaggaagtgagctcgtggaagaagcgaaggaggagaagaagaagggaggggaaggcggaggagggcaggggcgcgcagagccacggtttgctccaggcgcgtcggaaccgcaggacttttcatccccgtggtcccacggtcctcccgcgccccggaggcctgccagccccgctcggacgctcgtttgcccctaacccgccgccatggcttcaccggacgaccctctgcgcgcagatcatatggtaaaggaaccagtggaagacacagaccctagcactttatcctttaatatgtcagacaaatatcccattcaagatacggaactccctaaagctgaagaatgtgatacaattactttgaactgcccacgaaattcagatatgaaaaatcagggagaagaaaatggctttccagatagcactggagatcctcttccagagatcagcaaggacaactcctgcaaagaaaactgtacttgttcctcctgcttgctccgggcccccaccataagtgacttgctcaatgatcaggacttactagacgtgatcaggataaagctggatccgtgtcacccaacggtgaaaaactggaggaattttgcaagcaaatgggggatgtcctatgacgaattgtgcttcctggagcagaggccacagagccccaccttggagttcttgctccggaacagtcagaggacggtgggccagctgatggagctctgcaggctctaccacagggccgacgtggagaaggttctgcgcaggtgggtggacgaggagtggcccaagcgggagcgtggagacccctccaggcacttctagagctcttcttcttccttcattggcctctccggatgttgaaacaaccacaggtcaagaaggaatgtgaatctgttgttttataagagtttaggacaaggacgtggaacagtggacactggttttccccaaagctggcagttttgtggaggggtagcttgtttcggtggtggatctctgtttatttttgcacatctgttataatttaatattcaaatctggaattaagaaaacatattttctagtatcctctaagggccaaagtcctacaatcggaatggattcatgccacgttgaagataaaattatcctctctctgaaatacggtaaagatttaaataggtcctgagactgttgatagccccagacatacccacagcattatatgtaacatctctcctgatcagtgccattcccacggtttcaaagaaaacagctacaaggaatgcttacctgagtgtctgcagcaccctccacttctctcctaggcaatgagacccagtggctagaaattcaccatgtctattctcaagatccatgccagggagctctttgactctcgtgggaatcccactgttgaggttgatctcttcacctcagaaggtctcttcagagctgctgtgcccagtggtgcttcaactggtatctatgaggtcctagagctccaggacaatgataagactcgctatatggggaagggtgtctcaaagcctgttgagcccatcaataaaactattgcacctgtcctggttagcaagaaactgaacgtcacagaacaagagaagattgacaaacttatgatagagatggatggaacagaaaataaatctaaatttggtgcaaatgccattctgggagtgtccctcgctgcctgcaaagctagtgctgttgagaagggggttcccctgtaccaccacatcgccgacttgtctggcaactccaaagtcatcttgccagtcccggtgttcaatgtcatcaatggcagttctcatgctgtcaccaagctggccatgcaggagttcatggtcctcccagtcggtgcagcaaacttcagggaagccatgcccattggagcggaggtttaccacagcctgaagaatgtcatcaaggagaaatatgggaaagatgccaccggtgtgggggatggaggcgcgtttgctcccaacatcctggagaataaagaaggcctggagctgctgaagactgcgattgggaaagctggctacactgataaggtgatcgtcagcatggacgtagaggcctccgagttcttcaggtctggaaagtatgacctggaattcaagtttctcgacgaccccaccaggtacatctcacctgactgtctggctgacctgtacaagtccttcatcaaaaactacccagtggtgtctactgaagatccctttgaccaggatgactggggagcttggcagaagttcacggccagtgcaggaatccaggtagtggaggatgatctcagagtgaccaacccaaagaggacagcctcggccgtgaatgagaagaagtgcaactgcctcctgctcaaagtgaaccagattcgctctgtgactgagtcccttcaggcgtgcaagctggcccaggccaatggttggtgtgtcatggtgcctcatcattctggggagactgaaaataccttcatcactgacctggtggtggggctgtgacctgggcagctcaagactggtgccccttgctgatctgagcgcttggccaagtacaaccagctcctcagaattgaagaggagctgggcagcaaggctaagtttgccggcaggaacttcagaaaccccccagccaagtaagctgtgggcaggcaagcccttcagtcacctggtggctaattagacccctccccttgtgtcaactccggcagctcaagacccccgagcaacatttgtaggggccgctgctagttagctacccttgcccaccgccgtggagttcgcacctcttccttagaacttctacagaagcaggttgcagtgagccgagattgcgccactgcacaccagtctggagacagagtgagagtccgtcccagaaaaaaaaaaaaaaaaaa

SEQ ID NO: 516 - DNA, 658 bp, Homo sapiens
ttctgatcccggacgaccgtaaggtgcaaactcaaagacctacttccaagctgccgtccatgtgctgcccaatgaagctgcaacacgtgaacctctgtggaaggcgcccaccttttctccagtccttctctcactgagtgccctatcaaaatggaagaatccctgaatgaacccatttcaagtttgaattgtggtaaaatattgcaatcccaagtgttggttgcctacagcttcctactgattttggctggtgtctaaaaagaagctttgagagaagaaaaatagctccaagcattctgagctctgtaaagtactcgggaccagagagacaggagtgtgagacttcagtcatgcctgcctccagccctcccctgccccatacctggggtcaattgtttaagatcatatggtaaaggaaccagtggaagacacagaccctagcactttatcctttaatatgtcagacaaatatcccattcaagatacggaactccctaaagctgaagaatgtgatacaattactttgaactgcccacgaaattcagatatgaaaaatcagggagaagaaaatggctttccagatagcactggagatcctcttccagagatcagcaaggacaactcctgcaaagaaaactgtacttgttcctcctgcttg

SEQ ID NO: 517 - DNA, 3781 bp, Homo sapiens
cctcccttctgcttcctctcccgagggctgtcctggcagaggcccccctcgctctttctggcgggaacagggccagcagcgaaagaacagtcgcagagggaaagcgggaaagagatgggggaaagtgtgtgtgtgtgagtgtgtgcttgtgtgcatgtgtgtgcgtgtgtgtgtcaaggaaaaaagctcgcagtccagcagcccgggcctgggaggcttgtgagccgggcctttcgtaattgtcccctccccgcggccccctcccccaggcctcccccctctcccgccctcccgcccgccctctctccctccctctttccctcacagccgacgaggcaacaattaggctttggggataaaacgaggtgcggagagcgggctggggcatttctccccgagatggcgggtctgacggcggcggccccgcggcccggagtcctcctgctcctgctgtccatcctccacccctctcggcctggaggggtccctggggccattcctggtggagttcctggaggagtcttttatccaggggctggtctcggagcccttggaggaggagcgctggggcctggaggcaaacctcttaagccagttcccggagggcttgcgggtgctggccttggggcagggctcggcgccttccccgcagttacctttccgggggctctggtgcctggtggagtggctgacgctgctgcagcctataaagctgctaaggctggcgctgggcttggtggtgtcccaggagttggtggcttaggagtgtctgcaggtgcggtggttcctcagcctggagccggagtgaagcctgggaaagtgccgggtgtggggctgccaggtgtatacccaggtggcgtgctcccaggagctcggttccccggtgtgggggtgctccctggagttcccactggagcaggagttaagcccaaggctccaggtgtaggtggagcttttgctggaatcccaggagttggaccctttgggggaccgcaacctggagtcccactggggtatcccatcaaggcccccaagctgcctggtggctatggactgccctacaccacagggaaactgccctatggctatgggcccggaggagtggctggtgcagcgggcaaggctggttacccaacagggacaggggttggcccccaggcagcagcagcagcggcagctaaagcagcagcaaagttcggtgctggagcagccggagtcctccctggtgttggaggggctggtgttcctggcgtgcctggggcaattcctggaattggaggcatcgcaggcgttgggactccagctgcagctgcagctgcagcagcagccgctaaggcagccaagtatggagctgctgcaggcttagtgcctggtgggccaggctttggcccgggagtagttggtgtcccaggagctggcgttccaggtgttggtgtcccaggagctgggattccagttgtcccaggtgctgggatcccaggtgctgcggttccaggggttgtgtcaccagaagcagctgctaaggcagctgcaaaggcagccaaatacggggccaggcccggagtcggagttggaggcattcctacttacggggttggagctgggggctttcccggctttggtgtcggagtcggaggtatccctggagtcgcaggtgtccctggtgtcggaggtgttcccggagtcggaggtgtcccgggagttggcatttcccccgaagctcaggcagcagctgccgccaaggctgccaagtacggagtggggaccccagcagctgcagctgctaaagcagccgccaaagccgcccagtttgggttagttcctggtgtcggcgtggctcctggagttggcgtggctcctggtgtcggtgtggctcctggagttggcttggctcctggagttggcgtggctcctggagttggtgtggctcctggcgttggcgtggctcccggcattggccctggtggagttgcagctgcagcaaaatccgctgccaaggtggctgccaaagcccagctccgagctgcagctgggcttggtgctggcatccctggacttggagttggtgtcggcgtccctggacttggagttggtgctggtgttcctggacttggagttggtgctggtgttcctggcttcggggcagtacctggagccctggctgccgctaaagcagccaaatatggagcagcagtgcctggggtccttggagggctcggggctctcggtggagtaggcatcccaggcggtgtggtgggagccggacccgccgccgccgctgccgcagccaaagctgctgccaaagccgcccagtttggcctagtgggagccgctgggctcggaggactcggagtcggagggcttggagttccaggtgttgggggccttggaggtatacctccagctgcagccgctaaagcagctaaatacggtgctgctggccttggaggtgtcctagggggtgccgggcagttcccacttggaggagtggcagcaagacctggcttcggattgtctcccattttcccaggtggggcctgcctggggaaagcttgtggccggaagagaaaatgagcttcctaggacccctgactcacgacctcatcaacgttggtgctactgcttggtggagaatgtaaaccctttgtaaccccatcccatgcccctccgactccccaccccaggagggaacgggcaggccgggcggccttgcagatccacagggcaaggaaacaagaggggagcggccaagtgccccgaccaggaggccccctacttcagaggcaagggccatgtggtcctggccccccaccccatcccttcccacctaggagctccccctccacacagcctccatctccaggggaacttggtgctacacgctggtgctcttatcttcctggggggagggaggagggaagggtggcccctcggggaaccccctacctggggctcctctaaagatggtgcagacacttcctgggcagtcccagctccccctgcccaccaggacccaccgttggctgccatccagttggtacccaagcacctgaagcctcaaagctggattcgctctagcatccctcctctcctgggtccacttggccgtctcctccccaccgatcgctgttccccacatctggggcgcttttgggttggaaaaccaccccacactgggaatagccaccttgcccttgtagaatccatccgcccatccgtccattcatccatcggtccgtccatccatgtccccagttgaccgcccggcaccactagctggctgggtgcacccaccatcaacctggttgacctgtcatggccgcctgtgccctgcctccacccccatcctacactcccccagggcgtgcggggctgtgcagactggggtgccaggcatctcctccccacccggggtgtccccacatgcagtactgtataccccccatccctccctcggtccactgaacttcagagcagttcccattcctgccccgcccatctttttgtgtctcgctgtgatagatcaataaatattttattttttgtcctggatatttggggattatttttgattgttgatattctcttttggttttattgttgtggttcattgaaaaaaaaagataatttttttttctgatccggggagctgtatccccagtagaaaaaacattttaatcactctaatataactctggatgaaacacacctttttttttaataagaaaagagaattaactgcttcagaaatgactaataaatgaaaaacctttaaaggaaa

SEQ ID NO: 518 - DNA, 2274 bp, Homo sapiens
atggcgggtctgacggcggcggccccgcggcccggagtcctcctgctcctgctgtccatcctccacccctctcggcctggaggggtccctggggccattcctggtggagttcctggaggagtcttttatccaggggctggtctcggagcccttggaggaggagcgctggggcctggaggcaaacctcttaagccagttcccggagggcttgcgggtgctggccttggggcagggctcggcgccttccccgcagttacctttccgggggctctggtgcctggtggagtggctgacgctgctgcagcctataaagctgctaaggctggcgctgggcttggtggtgtcccaggagttggtggcttaggagtgtctgcaggtgcggtggttcctcagcctggagccggagtgaagcctgggaaagtgccgggtgtggggctgccaggtgtatacccaggtggcgtgctcccaggagctcggttccccggtgtgggggtgctccctggagttcccactggagcaggagttaagcccaaggctccaggtgtaggtggagcttttgctggaatcccaggagttggaccctttgggggaccgcaacctggagtcccactggggtatcccatcaaggcccccaagctgcctggtggctatggactgccctacaccacagggaaactgccctatggctatgggcccggaggagtggctggtgcagcgggcaaggctggttacccaacagggacaggggttggcccccaggcagcagcagcagcggcagctaaagcagcagcaaagttcggtgctggagcagccggagtcctccctggtgttggaggggctggtgttcctggcgtgcctggggcaattcctggaattggaggcatcgcaggcgttgggactccagctgcagctgcagctgcagcagcagccgctaaggcagccaagtatggagctgctgcaggcttagtgcctggtgggccaggctttggcccgggagtagttggtgtcccaggagctggcgttccaggtgttggtgtcccaggagctgggattccagttgtcccaggtgctgggatcccaggtgctgcggttccaggggttgtgtcaccagaagcagctgctaaggcagctgcaaaggcagccaaatacggggccaggcccggagtcggagttggaggcattcctacttacggggttggagctgggggctttcccggctttggtgtcggagtcggaggtatccctggagtcgcaggtgtccctggtgtcggaggtgttcccggagtcggaggtgtcccgggagttggcatttcccccgaagctcaggcagcagctgccgccaaggctgccaagtacggagtggggaccccagcagctgcagctgctaaagcagccgccaaagccgcccagtttgggttagttcctggtgtcggcgtggctcctggagttggcgtggctcctggtgtcggtgtggctcctggagttggcttggctcctggagttggcgtggctcctggagttggtgtggctcctggcgttggcgtggctcccggcattggccctggtggagttgcagctgcagcaaaatccgctgccaaggtggctgccaaagcccagctccgagctgcagctgggcttggtgctggcatccctggacttggagttggtgtcggcgtccctggacttggagttggtgctggtgttcctggacttggagttggtgctggtgttcctggcttcggggcaggtgcagatgagggagttaggcggagcctgtcccctgagctcagggaaggagatccctcctcctctcagcacctccccagcaccccctcatcacccagggtacctggagccctggctgccgctaaagcagccaaatatggagcagcagtgcctggggtccttggagggctcggggctctcggtggagtaggcatcccaggcggtgtggtgggagccggacccgccgccgccgctgccgcagccaaagctgctgccaaagccgcccagtttggcctagtgggagccgctgggctcggaggactcggagtcggagggcttggagttccaggtgttgggggccttggaggtatacctccagctgcagccgctaaagcagctaaatacggtgctgctggccttggaggtgtcctagggggtgccgggcagttcccacttggaggagtggcagcaagacctggcttcggattgtctcccattttcccaggtggggcctgcctggggaaagcttgtggccggaagagaaaatga

SEQ ID NO: 519 - DNA, 3361 bp, Homo sapiens
ggggcatttctccccgagatggcgggtctgacggcggcggccccgcggcccggagtcctcctgctcctgctgtccatcctccacccctctcggcctggaggggtccctggggccattcctggtggagttcctggaggagtcttttatccaggggctggtctcggagcccttggaggaggagcgctggggcctggaggcaaacctcttaagccagttcccggagggcttgcgggtgctggccttggggcagggctcggcgccttccccgcagttacctttccgggggctctggtgcctggtggagtggctgacgctgctgcagcctataaagctgctaaggctggcgctgggcttggtggtgtcccaggagttggtggcttaggagtgtctgcagccccttctgtgccaggtgcggtggttcctcagcctggagccggagtgaagcctgggaaagtgccgggtgtggggctgccaggtgtatacccaggtggcgtgctcccaggagctcggttccccggtgtgggggtgctccctggagttcccactggagcaggagttaagcccaaggctccaggtgtaggtggagcttttgctggaatcccaggagttggaccctttgggggaccgcaacctggagtcccactggggtatcccatcaaggcccccaagctgcctggtggctatggactgccctacaccacagggaaactgccctatggctatgggcccggaggagtggctggtgcagcgggcaaggctggttacccaacagggacaggggttggcccccaggcagcagcagcagcggcagctaaagcagcagcaaagttcggtgctggagcagccggagtcctccctggtgttggaggggctggtgttcctggcgtgcctggggcaattcctggaattggaggcatcgcaggcgttgggactccagctgcagctgcagctgcagcagcagccgctaaggcagccaagtatggagctgctgcaggcttagtgcctggtgggccaggctttggcccgggagtagttggtgtcccaggagctggcgttccaggtgttggtgtcccaggagctgggattccagttgtcccaggtgctgggatcccaggtgctgcggttccaggggttgtgtcaccagaagcagctgctaaggcagctgcaaaggcagccaaatacggggccaggcccggagtcggagttggaggcattcctacttacggggttggagctgggggctttcccggctttggtgtcggagtcggaggtatccctggagtcgcaggtgtccctggtgtcggaggtgttcccggagtcggaggtgtcccgggagttggcatttcccccgaagctcaggcagcagctgccgccaaggctgccaagtacggagtggggaccccagcagctgcagctgctaaagcagccgccaaagccgcccagtttgggttagttcctggtgtcggcgtggctcctggagttggcgtggctcctggtgtcggtgtggctcctggagttggcttggctcctggagttggcgtggctcctggagttggtgtggctcctggcgttggcgtggctcccggcattggccctggtggagttgcagctgcagcaaaatccgctgccaaggtggctgccaaagcccagctccgagctgcagctgggcttggtgctggcatccctggacttggagttggtgtcggcgtccctggacttggagttggtgctggtgttcctggacttggagttggtgctggtgttcctggcttcggggcagtacctggagccctggctgccgctaaagcagccaaatatggagcagcagtgcctggggtccttggagggctcggggctctcggtggagtaggcatcccaggcggtgtggtgggagccggacccgccgccgccgctgccgcagccaaagctgctgccaaagccgcccagtttggcctagtgggagccgctgggctcggaggactcggagtcggagggcttggagttccaggtgttgggggccttggaggtatacctccagctgcagccgctaaagcagctaaatacggagtggcagcaagacctggcttcggattgtctcccattttcccaggtggggcctgcctggggaaagcttgtggccggaagagaaaatgagcttcctaggacccctgactcacgacctcatcaacgttggtgctactgcttggtggagaatgtaaaccctttgtaaccccatcccatgcccctccgactccccaccccaggagggaacgggcaggccgggcggccttgcagatccacagggcaaggaaacaagaggggagcggccaagtgccccgaccaggaggccccctacttcagaggcaagggccatgtggtcctggccccccaccccatcccttcccacctaggagctccccctccacacagcctccatctccaggggaacttggtgctacacgctggtgctcttatcttcctggggggagggaggagggaagggtggcccctcggggaaccccctacctggggctcctctaaagatggtgcagacacttcctgggcagtcccagctccccctgcccaccaggacccaccgttggctgccatccagttggtacccaagcacctgaagcctcaaagctggattcgctctagcatccctcctctcctgggtccacttggccgtctcctccccaccgatcgctgttccccacatctggggcgcttttgggttggaaaaccaccccacactgggaatagccaccttgcccttgtagaatccatccgcccatccgtccattcatccatcggtccgtccatccatgtccccagttgaccgcccggcaccactagctggctgggtgcacccaccatcaacctggttgacctgtcatggccgcctgtgccctgcctccacccccatcctacactcccccagggcgtgcggggctgtgcagactggggtgccaggcatctcctccccacccggggtgtccccacatgcagtactgtataccccccatccctccctcggtccactgaacttcagagcagttcccattcctgccccgcccatctttttgtgtctcgctgtgatagatcaataaatattttattttttgtcctggatatttggggattatttttgattgttgatattctcttttggttttattgttgtggttcattgaaaaaaaaagataatttttttttctgatccggggagctgtatccccagtagaaaaaacattttaatcactctaatataactctggatgaaacacacctttttttttaataagaaaagagaattaactgcttcagaaatgactaataaatgaaaaacctttaaaggaaa

SEQ ID NO: 520 - DNA, 3674 bp, Homo sapiens
ctccctctttccctcacagccgacgaggcaacaattaggctttggggataaaacgaggtgcggagagcgggctggggcatttctccccgagatggcgggtctgacggcggcggccccgcggcccggagtcctcctgctcctgctgtccatcctccacccctctcggcctggaggggtccctggggccattcctggtggagttcctggaggagtcttttatccaggggctggtctcggagcccttggaggaggagcgctggggcctggaggcaaacctcttaagccagttcccggagggcttgcgggtgctggccttggggcagggctcggcgccttccccgcagttacctttccgggggctctggtgcctggtggagtggctgacgctgctgcagcctataaagctgctaaggctggcgctgggcttggtggtgtcccaggagttggtggcttaggagtgtctgcaggtgcggtggttcctcagcctggagccggagtgaagcctgggaaagtgccgggtgtggggctgccaggtgtatacccaggtggcgtgctcccaggagctcggttccccggtgtgggggtgctccctggagttcccactggagcaggagttaagcccaaggctccaggtgtaggtggagcttttgctggaatcccaggagttggaccctttgggggaccgcaacctggagtcccactggggtatcccatcaaggcccccaagctgcctggtggctatggactgccctacaccacagggaaactgccctatggctatgggcccggaggagtggctggtgcagcgggcaaggctggttacccaacagggacaggggttggcccccaggcagcagcagcagcggcagctaaagcagcagcaaagttcggtgctggagcagccggagtcctccctggtgttggaggggctggtgttcctggcgtgcctggggcaattcctggaattggaggcatcgcaggcgttgggactccagctgcagctgcagctgcagcagcagccgctaaggcagccaagtatggagctgctgcaggcttagtgcctggtgggccaggctttggcccgggagtagttggtgtcccaggagctggcgttccaggtgttggtgtcccaggagctgggattccagttgtcccaggtgctgggatcccaggtgctgcggttccaggggttgtgtcaccagaagcagctgctaaggcagctgcaaaggcagccaaatacggggccaggcccggagtcggagttggaggcattcctacttacggggttggagctgggggctttcccggctttggtgtcggagtcggaggtatccctggagtcgcaggtgtccctggtgtcggaggtgttcccggagtcggaggtgtcccgggagttggcatttcccccgaagctcaggcagcagctgccgccaaggctgccaagtacggtgctgcaggagcaggagtgctgggtgggctagtgccaggtgccccaggcgcagtcccaggtgtgccgggcacgggaggagtgccaggagtggggaccccagcagctgcagctgctaaagcagccgccaaagccgcccagtttgctcttctcaatcttgcagggttagttcctggtgtcggcgtggctcctggagttggcgtggctcctggtgtcggtgtggctcctggagttggcttggctcctggagttggcgtggctcctggagttggtgtggctcctggcgttggcgtggctcccggcattggccctggtggagttgcagctgcagcaaaatccgctgccaaggtggctgccaaagcccagctccgagctgcagctgggcttggtgctggcatccctggacttggagttggtgtcggcgtccctggacttggagttggtgctggtgttcctggacttggagttggtgctggtgttcctggcttcggggcaggtgcagatgagggagttaggcggagcctgtcccctgagctcagggaaggagatccctcctcctctcagcacctccccagcaccccctcatcacccagggtacctggagccctggctgccgctaaagcagccaaatatggagcagcagtgcctggggtccttggagggctcggggctctcggtggagtaggcatcccaggcggtgtggtgggagccggacccgccgccgccgctgccgcagccaaagctgctgccaaagccgcccagtttggcctagtgggagccgctgggctcggaggactcggagtcggagggcttggagttccaggtgttgggggccttggaggtatacctccagctgcagccgctaaagcagctaaatacggtgctgctggccttggaggtgtcctagggggtgccgggcagttcccacttggaggagtggcagcaagacctggcttcggattgtctcccattttcccaggtggggcctgcctggggaaagcttgtggccggaagagaaaatgagcttcctaggacccctgactcacgacctcatcaacgttggtgctactgcttggtggagaatgtaaaccctttgtaaccccatcccatgcccctccgactccccaccccaggagggaacgggcaggccgggcggccttgcagatccacagggcaaggaaacaagaggggagcggccaagtgccccgaccaggaggccccctacttcagaggcaagggccatgtggtcctggccccccaccccatcccttcccacctaggagctccccctccacacagcctccatctccaggggaacttggtgctacacgctggtgctcttatcttcctggggggagggaggagggaagggtggcccctcggggaaccccctacctggggctcctctaaagatggtgcagacacttcctgggcagtcccagctccccctgcccaccaggacccaccgttggctgccatccagttggtacccaagcacctgaagcctcaaagctggattcgctctagcatccctcctctcctgggtccacttggccgtctcctccccaccgatcgctgttccccacatctggggcgcttttgggttggaaaaccaccccacactgggaatagccaccttgcccttgtagaatccatccgcccatccgtccattcatccatcggtccgtccatccatgtccccagttgaccgcccggcaccactagctggctgggtgcacccaccatcaacctggttgacctgtcatggccgcctgtgccctgcctccacccccatcctacactcccccagggcgtgcggggctgtgcagactggggtgccaggcatctcctccccacccggggtgtccccacatgcagtactgtataccccccatccctccctcggtccactgaacttcagagcagttcccattcctgccccgcccatctttttgtgtctcgctgtgatagatcaataaatattttattttttgtcctggatatttggggattatttttgattgttgatattctcttttggttttattgttgtggttcattgaaaaaaaaagataatttttttttctgatccggggagctgtatccccagtagaaaaaacattttaatcactctaatataactctggatgaaacacacctttttttttaataagaaaagagaattaactgcttcagaaatgactaataaatgaaaaacctttaaagg

SEQ ID NO: 521 - DNA, 3043 bp, Homo sapiens
cggagagcgggctggggcatttctccccgagatggcgggtctgacggcggcggccccgcggcccggagtcctcctgctcctgctgtccatcctccacccctctcggcctggaggggtccctggggccattcctggtggagttcctggaggagtcttttatccagcgctggggcctggaggcaaacctcttaagccagttcccggagggcttgcgggtgctggccttggggcagggctcggcgccttccccgcagttacctttccgggggctctggtgcctggtggagtggctgacgctgctgcagcctataaagctgctaaggctggcgctgggcttggtggtgtcccaggagttggtggcttaggagtgtctgcaggtgcggtggttcctcagcctggagccggagtgaagcctgggaaagtgccgggtgtggggctgccaggtgtatacccaggtggcgtgctcccaggagctcggttccccggtgtgggggtgctccctggagttcccactggagcaggagttaagcccaaggctccaggtgtaggtggagcttttgctggaatcccaggagttggaccctttgggggaccgcaacctggagtcccactggggtatcccatcaaggcccccaagctgcctggtggctatggactgccctacaccacagggaaactgccctatggctatgggcccggaggagtggctggtgcagcgggcaaggctggttacccaacagggacaggggttggcccccaggcagcagcagcagcggcagctaaagcagcagcaaagttcggtgctggagcagccggagtcctccctggtgttggaggggctggtgttcctggcgtgcctggggcaattcctggaattggaggcatcgcaggcgttgggactccagctgcagctgcagctgcagcagcagccgctaaggcagccaagtatggagctgctgcaggcttagtgcctggtgggccaggctttggcccgggagtagttggtgtcccaggagctggcgttccaggtgttggtgtcccaggagctgggattccagttgtcccaggtgctgggatcccaggtgctgcggttccaggggttgtgtcaccagaagcagctgctaaggcagctgcaaaggcagccaaatacggggccaggcccggagtcggagttggaggcattcctacttacggggttggagctgggggctttcccggctttggtgtcggagtcggaggtatccctggagtcgcaggtgtccctggtgtcggaggtgttcccggagtcggaggtgtcccgggagttggcatttcccccgaagctcaggcagcagctgccgccaaggctgccaagtacgggttagttcctggtgtcggcgtggctcctggagttggcgtggctcctggtgtcggtgtggctcctggagttggcttggctcctggagttggcgtggctcctggagttggtgtggctcctggcgttggcgtggctcccggcattggccctggtggagttgcagctgcagcaaaatccgctgccaaggtggctgccaaagcccagctccgagctgcagctgggcttggtgctggcatccctggacttggagttggtgtcggcgtccctggacttggagttggtgctggtgttcctggacttggagttggtgctggtgttcctggcttcggggcagtacctggagccctggctgccgctaaagcagccaaatatggagcagcagtgcctggggtccttggagggctcggggctctcggtggagtaggcatcccaggcggtgtggtgggagccggacccgccgccgccgctgccgcagccaaagctgctgccaaagccgcccagtttggcctagtgggagccgctgggctcggaggactcggagtcggagggcttggagttccaggtgttgggggccttggaggtatacctccagctgcagccgctaaagcagctaaatacggagtggcagcaagacctggcttcggattgtctcccattttcccaggtggggcctgcctggggaaagcttgtggccggaagagaaaatgagcttcctaggacccctgactcacgacctcatcaacgttggtgctactgcttggtggagaatgtaaaccctttgtaaccccatcccatgcccctccgactccccaccccaggagggaacgggcaggccgggcggccttgcagatccacagggcaaggaaacaagaggggagcggccaagtgccccgaccaggaggccccctacttcagaggcaagggccatgtggtcctggccccccaccccatcccttcccacctaggagctccccctccacacagcctccatctccaggggaacttggtgctacacgctggtgctcttatcttcctggggggagggaggagggaagggtggcccctcggggaaccccctacctggggctcctctaaagatggtgcagacacttcctgggcagtcccagctccccctgcccaccaggacccaccgttggctgccatccagttggtacccaagcacctgaagcctcaaagctggattcgctctagcatccctcctctcctgggtccacttggccgtctcctccccaccgatcgctgttccccacatctggggcgcttttgggttggaaaaccaccccacactgggaatagccaccttgcccttgtagaatccatccgcccatccgtccattcatccatcggtccgtccatccatgtccccagttgaccgcccggcaccactagctggctgggtgcacccaccatcaacctggttgacctgtcatggccgcctgtgccctgcctccacccccatcctacactcccccagggcgtgcggggctgtgcagactggggtgccaggcatctcctccccacccggggtgtccccacatgcagtactgtataccccccatccctccctcggtccactgaacttcagagcagttcccattcctgccccgcccatctttttgtgtctcgctgtgatagatcaataaatattttattttttgtcctgga

SEQ ID NO: 522 - DNA, 3109 bp, Homo sapiens
atttctccccgagatggcgggtctgacggcggcggccccgcggcccggagtcctcctgctcctgctgtccatcctccacccctctcggcctggaggggtccctggggccattcctggtggagttcctggaggagtcttttatccaggggctggtctcggagcccttggaggaggagcgctggggcctggaggcaaacctcttaagccagttcccggagggcttgcgggtgctggccttggggcagggctcggcgccttccccgcagttacctttccgggggctctggtgcctggtggagtggctgacgctgctgcagcctataaagctgctaaggctggcgctgggcttggtggtgtcccaggagttggtggcttaggagtgtctgcaggtgcggtggttcctcagcctggagccggagtgaagcctgggaaagtgccgggtgtggggctgccaggtgtatacccaggtggcgtgctcccaggagctcggttccccggtgtgggggtgctccctggagttcccactggagcaggagttaagcccaaggctccaggtgtaggtggagcttttgctggaatcccaggagttggaccctttgggggaccgcaacctggagtcccactggggtatcccatcaaggcccccaagctgcctggtggctatggactgccctacaccacagggaaactgccctatggctatgggcccggaggagtggctggtgcagcgggcaaggctggttacccaacagggacaggggttggcccccaggcagcagcagcagcggcagctaaagcagcagcaaagttcggtgctggagcagccggagtcctccctggtgttggaggggctggtgttcctggcgtgcctggggcaattcctggaattggaggcatcgcaggcgttgggactccagctgcagctgcagctgcagcagcagccgctaaggcagccaagtatggagctgctgcaggcttagtgcctggtgggccaggctttggcccgggagtagttggtgtcccaggagctggcgttccaggtgttggtgtcccaggagctgggattccagttgtcccaggtgctgggatcccaggtgctgcggttccaggggttgtgtcaccagaagcagctgctaaggcagctgcaaaggcagccaaatacggggccaggcccggagtcggagttggaggcattcctacttacggggttggagctgggggctttcccggctttggtgtcggagtcggaggtatccctggagtcgcaggtgtccctggtgtcggaggtgttcccggagtcggaggtgtcccgggagttggcatttcccccgaagctcaggcagcagctgccgccaaggctgccaagtacgggttagttcctggtgtcggcgtggctcctggagttggcgtggctcctggtgtcggtgtggctcctggagttggcttggctcctggagttggcgtggctcctggagttggtgtggctcctggcgttggcgtggctcccggcattggccctggtggagttgcagctgcagcaaaatccgctgccaaggtggctgccaaagcccagctccgagctgcagctgggcttggtgctggcatccctggacttggagttggtgtcggcgtccctggacttggagttggtgctggtgttcctggacttggagttggtgctggtgttcctggcttcggggcagtacctggagccctggctgccgctaaagcagccaaatatggagcagcagtgcctggggtccttggagggctcggggctctcggtggagtaggcatcccaggcggtgtggtgggagccggacccgccgccgccgctgccgcagccaaagctgctgccaaagccgcccagtttggcctagtgggagccgctgggctcggaggactcggagtcggagggcttggagttccaggtgttgggggccttggaggtatacctccagctgcagccgctaaagcagctaaatacggtgctgctggccttggaggtgtcctagggggtgccgggcagttcccacttggaggagtggcagcaagacctggcttcggattgtctcccattttcccaggtggggcctgcctggggaaagcttgtggccggaagagaaaatgagcttcctaggacccctgactcacgacctcatcaacgttggtgctactgcttggtggagaatgtaaaccctttgtaaccccatcccatgcccctccgactccccaccccaggagggaacgggcaggccgggcggccttgcagatccacagggcaaggaaacaagaggggagcggccaagtgccccgaccaggaggccccctacttcagaggcaagggccatgtggtcctggccccccaccccatcccttcccacctaggagctccccctccacacagcctccatctccaggggaacttggtgctacacgctggtgctcttatcttcctggggggagggaggagggaagggtggcccctcggggaaccccctacctggggctcctctaaagatggtgcagacacttcctgggcagtcccagctccccctgcccaccaggacccaccgttggctgccatccagttggtacccaagcacctgaagcctcaaagctggattcgctctagcatccctcctctcctgggtccacttggccgtctcctccccaccgatcgctgttccccacatctggggcgcttttgggttggaaaaccaccccacactgggaatagccaccttgcccttgtagaatccatccgcccatccgtccattcatccatcggtccgtccatccatgtccccagttgaccgcccggcaccactagctggctgggtgcacccaccatcaacctggttgacctgtcatggccgcctgtgccctgcctccacccccatcctacactcccccagggcgtgcggggctgtgcagactggggtgccaggcatctcctccccacccggggtgtccccacatgcagtactgtataccccccatccctccctcggtccactgaacttcagagcagttcccattcctgccccgcccatctttttgtgtctcgctgtgatagatcaataaatattttattttttgtcctgga

SEQ ID NO: 523 - DNA, 658 bp, Homo sapiens
gcatttctccccgagatggcgggtctgacggcggcggccccgcggcccggagtcctcctgctcctgctgtccatcctccacccctctcggcctggaggggtccctggggccattcctggtggagttcctggaggagtcttttatccaggggctggtctcggagcccttggaggaggagcgctggggcctggaggcaaacctcttaagccagttcccggagggcttgcgggtgctggccttggggcagggctcggcgccttccccgcagttacctttccgggggctctggtgcctggtggagtggctgacgctgctgcagcctataaagctgctaaggctggcgctgggcttggtggtgtcccaggagttggtggcttaggagtgtctgcaggtgcggtggttcctcagcctggagccggagtgaagcctgggaaagtgccgggtgtggggctgccaggtgtatacccaggtggcgtgctcccaggagttggaccctttgggggaccgcaacctggagtcccactggggtatcccatcaaggcccccaagctgcctggtggctatggactgccctacaccacagggaaactgccctatggctatgggcccggaggagtggctggtgcagcgggcaaggctggttacccaacagggacag

SEQ ID NO: 524 - DNA, 512 bp, Homo sapiens
tttctccccgagatggcgggtctgacggcggcggccccgcggcccggagtcctcctgctcctgctgtccatcctccacccctctcggcctggaggggtccctggggccattcctggtggagttcctggaggagtcttttatccaggggctggtctcggagcccttggaggaggagcgctggggcctggaggcaaacctcttaagccagttcccggagggcttgcgggtgctggccttggggcagggctcggcgccttccccgcagttacctttccgggggctctggtgcctggtggagtggctgacgctgctgcagcctataaagctgctaaggctggagttggaccctttgggggaccgcaacctggagtcccactggggtatcccatcaaggcccccaagctgcctggtggctatggactgccctacaccacagggaaactgccctatggctatgggcccggaggagtggctggtgcagcgggcaaggctggttacccaacagggacagg

SEQ ID NO: 525 - DNA, 3298 bp, Homo sapiens
gcatttctccccgagatggcgggtctgacggcggcggccccgcggcccggagtcctcctgctcctgctgtccatcctccacccctctcggcctggaggggtccctggggccattcctggtggagttcctggaggagtcttttatccaggggctggtctcggagcccttggaggaggagcgctggggcctggaggcaaacctcttaagccagttcccggagggcttgcgggtgctggccttggggcagggctcggcgccttccccgcagttacctttccgggggctctggtgcctggtggagtggctgacgctgctgcagcctataaagctgctaaggctggcgctgggcttggtggtgtcccaggagttggtggcttaggagtgtctgcagccccttctgtgccaggtgcggtggttcctcagcctggagccggagtgaagcctgggaaagtgccgggtgtggggctgccaggtgtatacccaggtggcgtgctcccaggagctcggttccccggtgtgggggtgctccctggagttcccactggagcaggagttaagcccaaggctccaggtgtaggtggagcttttgctggaatcccaggagttggaccctttgggggaccgcaacctggagtcccactggggtatcccatcaaggcccccaagctgcctggtggctatggactgccctacaccacagggaaactgccctatggctatgggcccggaggagtggctggtgcagcgggcaaggctggttacccaacagggacaggggttggcccccaggcagcagcagcagcggcagctaaagcagcagcaaagttcggtgctggagcagccggagtcctccctggtgttggaggggctggtgttcctggcgtgcctggggcaattcctggaattggaggcatcgcaggcgttgggactccagctgcagctgcagctgcagcagcagccgctaaggcagccaagtatggagctgctgcaggcttagtgcctggtgggccaggctttggcccgggagtagttggtgtcccaggagctggcgttccaggtgttggtgtcccaggagctgggattccagttgtcccaggtgctgggatcccaggtgctgcggttccaggggttgtgtcaccagaagcagctgctaaggcagctgcaaaggcagccaaatacggggccaggcccggagtcggagttggaggcattcctacttacggggttggagctgggggctttcccggctttggtgtcggagtcggaggtatccctggagtcgcaggtgtccctggtgtcggaggtgttcccggagtcggaggtgtcccgggagttggcatttcccccgaagctcaggcagcagctgccgccaaggctgccaagtacgggttagttcctggtgtcggcgtggctcctggagttggcgtggctcctggtgtcggtgtggctcctggagttggcttggctcctggagttggcgtggctcctggagttggtgtggctcctggcgttggcgtggctcccggcattggccctggtggagttgcagctgcagcaaaatccgctgccaaggtggctgccaaagcccagctccgagctgcagctgggcttggtgctggcatccctggacttggagttggtgtcggcgtccctggacttggagttggtgctggtgttcctggacttggagttggtgctggtgttcctggcttcggggcagtacctggagccctggctgccgctaaagcagccaaatatggagcagcagtgcctggggtccttggagggctcggggctctcggtggagtaggcatcccaggcggtgtggtgggagccggacccgccgccgccgctgccgcagccaaagctgctgccaaagccgcccagtttggcctagtgggagccgctgggctcggaggactcggagtcggagggcttggagttccaggtgttgggggccttggaggtatacctccagctgcagccgctaaagcagctaaatacggagtggcagcaagacctggcttcggattgtctcccattttcccaggtggggcctgcctggggaaagcttgtggccggaagagaaaatgagcttcctaggacccctgactcacgacctcatcaacgttggtgctactgcttggtggagaatgtaaaccctttgtaaccccatcccatgcccctccgactccccaccccaggagggaacgggcaggccgggcggccttgcagatccacagggcaaggaaacaagaggggagcggccaagtgccccgaccaggaggccccctacttcagaggcaagggccatgtggtcctggccccccaccccatcccttcccacctaggagctccccctccacacagcctccatctccaggggaacttggtgctacacgctggtgctcttatcttcctggggggagggaggagggaagggtggcccctcggggaaccccctacctggggctcctctaaagatggtgcagacacttcctgggcagtcccagctccccctgcccaccaggacccaccgttggctgccatccagttggtacccaagcacctgaagcctcaaagctggattcgctctagcatccctcctctcctgggtccacttggccgtctcctccccaccgatcgctgttccccacatctggggcgcttttgggttggaaaaccaccccacactgggaatagccaccttgcccttgtagaatccatccgcccatccgtccattcatccatcggtccgtccatccatgtccccagttgaccgcccggcaccactagctggctgggtgcacccaccatcaacctggttgacctgtcatggccgcctgtgccctgcctccacccccatcctacactcccccagggcgtgcggggctgtgcagactggggtgccaggcatctcctccccacccggggtgtccccacatgcagtactgtataccccccatccctccctcggtccactgaacttcagagcagttcccattcctgccccgcccatctttttgtgtctcgctgtgatagatcaataaatattttattttttgtcctggatatttggggattatttttgattgttgatattctcttttggttttattgttgtggttcattgaaaaaaaaagataatttttttttctgatccggggagctgtatccccagtagaaaaaacattttaatcactctaatataactctggatgaaacacacctttttttttaataagaaaagagaattaactgcttcagaaatgactaataaatgaaaaacctttaaagg

SEQ ID NO: 526 - DNA, 563 bp, Homo sapiens
aattaggctttggggataaaacgaggtgcggagagcgggctggggcatttctccccgagatggcgggtctgacggcggcggccccgcggcccggagtcctcctgctcctgctgtccatcctccacccctctcggcctggaggggtccctggggccattcctggtggagttcctggaggagtcttttatccaggggctggtctcggagcccttggaggaggagcgctggggcctggaggcaaacctcttaagccaggagttggaccctttgggggaccgcaacctggagtcccactggggtatcccatcaaggcccccaagctgcctggctatgggcccggaggagtggctggtgcagcgggcaaggctggttacccaacagggacaggggttggcccccaggcagcagcagcagcggcagctaaagcagcagcaaagttcggtgctggagcagccggagtcctccctggtgttggaggggctggtgttcctggcgtgcctggggcaattcctggaattggaggcatcgcaggcgttgggactccagctgcagctgcagctgca

SEQ ID NO: 527 - DNA, 962 bp, Homo sapiens
ctcacagccgacgaggcaacaattaggctttggggataaaacgaggtgcggagagcgggctggggcatttctccccgagatggcgggtctgacggcggcggccccgcggcccggagtcctcctgctcctgctgtccatcctccacccctctcggcctggaggggtccctggggccattcctggtggagttcctggaggagtcttttatccaggggctggtctcggagcccttggaggaggagcgctggggcctggaggcaaacctcttaagccagggctcggcgccttccccgcagttacctttccgggggctctggtgcctggtggagtggctgacgctgctgcagcctataaagctgctaaggctggcgctgggcttggtggtgtcccaggagttggtggcttaggagtgtctgcaggtgcggtggttcctcagcctggagccggagtgaagcctgggaaagtgccgggtgtggggctgccaggtgtatacccaggtggcgtgctcccaggagctcggttccccggtgtgggggtgctccctggagttcccactggagcaggagttaagcccaaggctccaggagttggaccctttgggggaccgcaacctggagtcccactggggtatcccatcaaggcccccaagctgcctggtggctatggactgccctacaccacagggaaactgccctatggctatgggcccggaggagtggctggtgcagcgggcaaggctggttacccaacagggacaggggttggcccccaggcagcagcagcagcggcagctaaagcagcagcaaagttcggtgctggagcagccggagtcctccctggtgttggaggggctggtgttcctggcgtgcctggggcaattcctggaattggaggcatcgcaggcgttgggactccagctgcagctgcagctgcagcagcagccgctaaggcagccaagtatg

SEQ ID NO: 528 - DNA, 542 bp, Homo sapiens
atttctccccgagatggcgggtctgacggcggcggccccgcggcccggagtcctcctgctcctgctgtccatcctccacccctctcggcctggaggggtccctggggccattcctggtggagttcctggaggagtcttttatccaggggctggtctcggagcccttggaggaggagcgctggggcctggaggcaaacctcttaagccagttcccggagggcttgcgggtgctggccttggggcagggctcggcgccttccccgcagttacctttccgggggctctggtgcctggtggagtggctgacgctgctgcagcctataaagctgctaaggctggcgctgggcttggtggtgtcccaggagttggtggcttaggagtgtctgcaggtgcggtggttcctcagcctggagccggagtgaagcctgggaaagtgccgggtgtaggtggagcttttgctggaatcccaggagttggaccctttgggggaccgcaacctggagtcccactggggtatcccatcaaggcccccaagctgcctg

SEQ ID NO: 529 - DNA, 2984 bp, Homo sapiens
gcatttctccccgagatggcgggtctgacggcggcggccccgcggcccggagtcctcctgctcctgctgtccatcctccacccctctcggcctggaggggtccctggggccattcctggtggagttcctggaggagtcttttatccaggggctggtctcggagcccttggaggaggagcgctggggcctggaggcaaacctcttaagccagttcccggagggcttgcgggtgctggccttggggcaggcgctgggcttggtggtgtcccaggagttggtggcttaggagtgtctgcaggtgcggtggttcctcagcctggagccggagtgaagcctgggaaagtgccgggtgtggggctgccaggtgtatacccaggtggcgtgctcccaggagctcggttccccggtgtgggggtgctccctggagttcccactggagcaggagttaagcccaaggctccaggtgtaggtggagcttttgctggaatcccaggagttggaccctttgggggaccgcaacctggagtcccactggggtatcccatcaaggcccccaagctgcctggtggctatggactgccctacaccacagggaaactgccctatggctatgggcccggaggagtggctggtgcagcgggcaaggctggttacccaacagggacaggggttggcccccaggcagcagcagcagcggcagctaaagcagcagcaaagttcggtgctggagcagccggagtcctccctggtgttggaggggctggtgttcctggcgtgcctggggcaattcctggaattggaggcatcgcaggcgttgggactccagctgcagctgcagctgcagcagcagccgctaaggcagccaagtatggagctgctgcaggcttagtgcctggtgggccaggctttggcccgggagtagttggtgtcccaggagctggcgttccaggtgttggtgtcccaggagctgggattccagttgtcccaggtgctgggatcccaggtgctgcggttccaggggttgtgtcaccagaagcagctgctaaggcagctgcaaaggcagccaaatacggggccaggcccggagtcggagttggaggcattcctacttacggggttggagctgggggctttcccggctttggtgtcggagtcggaggtatccctggagtcgcaggtgtccctggtgtcggaggtgttcccggagtcggaggtgtcccgggagttggcatttcccccgaagctcaggcagcagctgccgccaaggctgccaagtacggagtggggaccccagcagctgcagctgctaaagcagccgccaaagccgcccagtttgggttagttcctggtgttggtgtggctcctggcgttggcgtggctcccggcattggccctggtggagttgcagctgcagcaaaatccgctgccaaggtggctgccaaagcccagctccgagctgcagctgggcttggtgctggcatccctggacttggagttggtgtcggcgtccctggacttggagttggtgctggtgttcctggacttggagttggtgctggtgttcctggcttcggggcagtacctggagccctggctgccgctaaagcagccaaatatggagcagcagtgcctggggtccttggagggctcggggctctcggtggagtaggcatcccaggcggtgtggtgggagccggacccgccgccgccgctgccgcagccaaagctgctgccaaagccgcccagtttggcctagtgggagccgctgggctcggaggactcggagtcggagggcttggagttccaggtgttgggggccttggaggtatacctccagctgcagccgctaaagcagctaaatacggtgctgctggccttggaggtgtcctagggggtgccgggcagttcccacttggaggagtggcagcaagacctggcttcggattgtctcccattttcccaggtggggcctgcctggggaaagcttgtggccggaagagaaaatgagcttcctaggacccctgactcacgacctcatcaacgttggtgctactgcttggtggagaatgtaaaccctttgtaaccccatcccatgcccctccgactccccaccccaggagggaacgggcaggccgggcggccttgcagatccacagggcaaggaaacaagaggggagcggccaagtgccccgaccaggaggccccctacttcagaggcaagggccatgtggtcctggccccccaccccatcccttcccacctaggagctccccctccacacagcctccatctccaggggaacttggtgctacacgctggtgctcttatcttcctggggggagggaggagggaagggtggcccctcggggaaccccctacctggggctcctctaaagatggtgcagacacttcctgggcagtcccagctccccctgcccaccaggacccaccgttggctgccatccagttggtacccaagcacctgaagcctcaaagctggattcgctctagcatccctcctctcctgggtccacttggccgtctcctccccaccgatcgctgttccccacatctggggcgcttttgggttggaaaaccaccccacactgggaatagccaccttgcccttgtagaatccatccgcccatccgtccattcatccatcggtccgtccatccatgtccccagttgaccgcccggcaccactagctggctgggtgcacccaccatcaacctggttgacctgtcatggccgcctgtgccctgcctccacccccatcctacactcccccagggcgtgcggggctgtgcagactggggtgccaggcatctcctccccacccggggtgtccccacatgcagtactgtataccccccatccctccctcggtccactgaacttcagagcagttcccattcctgccccgcccatctttttgtgtctcgctgtgatagatcaataaatattttattttttgtcctgg

SEQ ID NO: 530 - DNA, 2583 bp, Homo sapiens
cctcccttctgcttcctctcccgagggctgtcctggcagaggcccccctcgctctttctggcgggaacagggccagcagcgaaagaacagtcgcagagggaaagcgggaaagagatgggggaaagtgtgtgtgtgtgagtgtgtgcttgtgtgcatgtgtgtgcgtgtgtgtgtcaaggaaaaaagctcgcagtccagcagcccgggcctgggaggcttgtgagccgggcctttcgtaattgtcccctccccgcggccccctcccccaggcctcccccctctcccgccctcccgcccgccctctctccctccctctttccctcacagccgacgaggcaacaattaggctttggggataaaacgaggtgcggagagcgggctggggcatttctccccgagatggcgggtctgacggcggcggccccgcggcccggagtcctcctgctcctgctgtccatcctccacccctctcggcctggaggggtccctggggccattcctggtggagttcctggaggagtcttttatccaggggctggtctcggagcccttggaggaggagcgctggggcctggaggcaaacctcttaagccagttcccggagggcttgcgggtgctggccttggggcagggctcggcgccttccccgcagttacctttccgggggctctggtgcctggtggagtggctgacgctgctgcagcctataaagctgctaaggctggcgctgggcttggtggtgtcccaggagttggtggcttaggagtgtctgcaggtgcggtggttcctcagcctggagccggagtgaagcctgggaaagtgccgggtgtggggctgccaggtgtatacccaggtggcgtgctcccaggagctcggttccccggtgtgggggtgctccctggagttcccactggagcaggagttaagcccaaggctccaggtgtaggtggagcttttgctggaatcccaggagttggaccctttgggggaccgcaacctggagtcccactggggtatcccatcaaggcccccaagctgcctggtggctatggactgccctacaccacagggaaactgccctatggctatgggcccggaggagtggctggtgcagcgggcaaggctggttacccaacagggacaggggttggcccccaggcagcagcagcagcggcagctaaagcagcagcaaagttcggtgctggagcagccggagtcctccctggtgttggaggggctggtgttcctggcgtgcctggggcaattcctggaattggaggcatcgcaggcgttgggactccagctgcagctgcagctgcagcagcagccgctaaggcagccaagtatggagctgctgcaggcttagtgcctggtgggccaggctttggcccgggagtagttggtgtcccaggagctggcgttccaggtgttggtgtcccaggagctgggattccagttgtcccaggtgctgggatcccaggtgctgcggttccaggggttgtgtcaccagaagcagctgctaaggcagctgcaaaggcagccaaatacggggccaggcccggagtcggagttggaggcattcctacttacggggttggagctgggggctttcccggctttggtgtcggagtcggaggtatccctggagtcgcaggtgtccctggtgtcggaggtgttcccggagtcggaggtgtcccgggagttggcatttcccccgaagctcaggcagcagctgccgccaaggctgccaagtacggagtggggaccccagcagctgcagctgctaaagcagccgccaaagccgcccagtttgggttagttcctggtgtcggcgtggctcctggagttggcgtggctcctggtgtcggtgtggctcctggagttggcttggctcctggagttggcgtggctcctggagttggtgtggctcctggcgttggcgtggctcccggcattggccctggtggagttgcagctgcagcaaaatccgctgccaaggtggctgccaaagcccagctccgagctgcagctgggcttggtgctggcatccctggacttggagttggtgtcggcgtccctggacttggagttggtgctggtgttcctggacttggagttggtgctggtgttcctggcttcggggcagtacctggagccctggctgccgctaaagcagccaaatatggagcagcagtgcctggggtccttggagggctcggggctctcggtggagtaggcatcccaggcggtgtggtgggagccggacccgccgccgccgctgccgcagccaaagctgctgccaaagccgcccagtttggcctagtgggagccgctgggctcggaggactcggagtcggagggcttggagttccaggtgttgggggccttggaggtatacctccagctgcagccgctaaagcagctaaatacggagtggcagcaagacctggcttcggattgtctcccattttcccaggtggggcctgcctggggaaagcttgtggccggaagagaaaatgagcttcctaggacccctgactcacgacctcatcaacgttggtgctactgcttggtggagaatgt

SEQ ID NO: 531 - DNA, 3147 bp, Homo sapiens
gcgggctggggcatttctccccgagatggcgggtctgacggcggcggccccgcggcccggagtcctcctgctcctgctgtccatcctccacccctctcggcctggaggggtccctggggccattcctggtggagttcctggaggagtcttttatccagcgctggggcctggaggcaaacctcttaagccagttcccggagggcttgcgggtgctggccttggggcagggctcggcgccttccccgcagttacctttccgggggctctggtgcctggtggagtggctgacgctgctgcagcctataaagctgctaaggctggcgctgggcttggtggtgtcccaggagttggtggcttaggagtgtctgcaggtgcggtggttcctcagcctggagccggagtgaagcctgggaaagtgccgggtgtggggctgccaggtgtatacccaggtggcgtgctcccaggagctcggttccccggtgtgggggtgctccctggagttcccactggagcaggagttaagcccaaggctccaggtgtaggtggagcttttgctggaatcccaggagttggaccctttgggggaccgcaacctggagtcccactggggtatcccatcaaggcccccaagctgcctggtggctatggactgccctacaccacagggaaactgccctatggctatgggcccggaggagtggctggtgcagcgggcaaggctggttacccaacagggacaggggttggcccccaggcagcagcagcagcggcagctaaagcagcagcaaagttcggtgctggagcagccggagtcctccctggtgttggaggggctggtgttcctggcgtgcctggggcaattcctggaattggaggcatcgcaggcgttgggactccagctgcagctgcagctgcagcagcagccgctaaggcagccaagtatggagctgctgcaggcttagtgcctggtgggccaggctttggcccgggagtagttggtgtcccaggagctggcgttccaggtgttggtgtcccaggagctgggattccagttgtcccaggtgctgggatcccaggtgctgcggttccaggggttgtgtcaccagaagcagctgctaaggcagctgcaaaggcagccaaatacggggccaggcccggagtcggagttggaggcattcctacttacggggttggagctgggggctttcccggctttggtgtcggagtcggaggtatccctggagtcgcaggtgtccctggtgtcggaggtgttcccggagtcggaggtgtcccgggagttggcatttcccccgaagctcaggcagcagctgccgccaaggctgccaagtacggagtggggaccccagcagctgcagctgctaaagcagccgccaaagccgcccagtttgggttagttcctggtgtcggcgtggctcctggagttggcgtggctcctggtgtcggtgtggctcctggagttggcttggctcctggagttggcgtggctcctggagttggtgtggctcctggcgttggcgtggctcccggcattggccctggtggagttgcagctgcagcaaaatccgctgccaaggtggctgccaaagcccagctccgagctgcagctgggcttggtgctggcatccctggacttggagttggtgtcggcgtccctggacttggagttggtgctggtgttcctggacttggagttggtgctggtgttcctggcttcggggcagtacctggagccctggctgccgctaaagcagccaaatatggagcagcagtgcctggggtccttggagggctcggggctctcggtggagtaggcatcccaggcggtgtggtgggagccggacccgccgccgccgctgccgcagccaaagctgctgccaaagccgcccagtttggcctagtgggagccgctgggctcggaggactcggagtcggagggcttggagttccaggtgttgggggccttggaggtatacctccagctgcagccgctaaagcagctaaatacggtgctgctggccttggaggtgtcctagggggtgccgggcagttcccacttggaggagtggcagcaagacctggcttcggattgtctcccattttcccaggtggggcctgcctggggaaagcttgtggccggaagagaaaatgagcttcctaggacccctgactcacgacctcatcaacgttggtgctactgcttggtggagaatgtaaaccctttgtaaccccatcccatgcccctccgactccccaccccaggagggaacgggcaggccgggcggccttgcagatccacagggcaaggaaacaagaggggagcggccaagtgccccgaccaggaggccccctacttcagaggcaagggccatgtggtcctggccccccaccccatcccttcccacctaggagctccccctccacacagcctccatctccaggggaacttggtgctacacgctggtgctcttatcttcctggggggagggaggagggaagggtggcccctcggggaaccccctacctggggctcctctaaagatggtgcagacacttcctgggcagtcccagctccccctgcccaccaggacccaccgttggctgccatccagttggtacccaagcacctgaagcctcaaagctggattcgctctagcatccctcctctcctgggtccacttggccgtctcctccccaccgatcgctgttccccacatctggggcgcttttgggttggaaaaccaccccacactgggaatagccaccttgcccttgtagaatccatccgcccatccgtccattcatccatcggtccgtccatccatgtccccagttgaccgcccggcaccactagctggctgggtgcacccaccatcaacctggttgacctgtcatggccgcctgtgccctgcctccacccccatcctacactcccccagggcgtgcggggctgtgcagactggggtgccaggcatctcctccccacccggggtgtccccacatgcagtactgtataccccccatccctccctcggtccactgaacttcagagcagttcccattcctgccccgcccatctttttgtgtctcgctgtgatagatcaataaatattttattttttgtcctgg

SEQ ID NO: 532 - DNA, 2720 bp, Homo sapiens
gtgggatccactgaggagtacataggctgctggatctggtggagccagcactgggcccacgggtggtaactggctgctgtggaggggggtacgtgagggggggggtctggggcttatcctcaggtcctgtgggtggggcagcgagtcggggcctgagcgtcaagagcatgccctagtgagcgggctcctctgggggagcccagcgcgctccgggcgcctgccggtttgggggtgtctcctcccggggcgctatggcggcgctggccagtagcctgatccggcagaagcgggaggtccgcgagcccgggggcagccggccggtgtcggcgcagcggcgcgtgtgtccccgcggcaccaagtccctttgccagaagcagctcctcatcctgctgtccaaggtgcgactgtgcggggggcggcccgcgcggccggaccgcggcccggagcctcagctcaaaggcatcgtcaccaaactgttctgccgccagggtttctacctccaggcgaatcccgacggaagcatccagggcaccccagaggataccagctccttcacccacttcaacctgatccctgtgggcctccgtgtggtcaccatccagagcgccaagctgggtcactacatggccatgaatgctgagggactgctctacagttcgccgcatttcacagctgagtgtcgctttaaggagtgtgtctttgagaattactacgtcctgtacgcctctgctctctaccgccagcgtcgttctggccgggcctggtacctcggcctggacaaggagggccaggtcatgaagggaaaccgagttaagaagaccaaggcagctgcccactttctgcccaagctcctggaggtggccatgtaccaggagccttctctccacagtgtccccgaggcctccccttccagtccccctgccccctgaaatgtagtccctggactggaggttccctgcactcccagtgagccagccaccaccacaacctgtctcccagtcctgctctcacccctgctgccacacacatgccctgagcagccaggtcccactaggtgctctaccctgagggagcctaggggctgactgtgacttccgaggctgctgagacccttagatctttgggcctaggagggagtcagagagggggatgtctgaagatggtcctggctgatcacttctttctttccacactcacacaacgccatgccttttcctgagatggcgctgggagttcccacatggacagccagggcataaacacttcccaccccggctcagccagttcctggagtcctgtgccccttttcattgccactgagccatttctagattcactggagctcaggattcatgtgtccttctttccctactctaccttctaccttggtctggacacattctggaacactggacaccctcgccagggccacttctgcactagggctctgtgctggaacccaggcatgctgccagccttttctctggatctgtcaggcctctgtcattgactcagatggacccctggtttccaagtagaaagaggctagatttgggccttgtctagctgttggctttggcctgaaccggaaccagtctcagatgaccacgggtttaaccttcttatcccagagacacccaattctagagctttatggagccgtacttccccctgaatcctagctctaggacatagatcatgactctcagcccttttacccaggatggagctggggcctgtatagccatattattgttctaagtaagttctagccccaccctcccgccttcttgagtgatacctattacggatgagttctggaaaagacccagctatgattcataaaaacacttctggatgaatcaagaaccatttcttgtttttcctagataattctctaaaaatatgattcttccatatagaatgctaagcttatttttacatgcagtttctagctccttcaacccagctgaggtcgtgccagggagacagagtctggagaagggcagaggaattttggaaggatccctggctcatagtagggaagctgggatgggggaggggtcaaaattatggcatgactgaacctgcatctgtgttgggtggacatgaatacttagctacctcagcaggaattccttccaggtcccctttaaagctgaggtccttagagtaatatgtccttaataaaaaggacaaatggatacagccttgaccctcccagtgaggagaccccaattcagcaataagtctcacccttctcccctacaggtcaggccaagaagggtgaaggcctcttgcactccagacctcatacgccccaacagcttctaattggatagaacttgctttaccttacagctcacaacctcagctgggttttaggtacccaaaaagggcctgtctagattttttcagaaaaacgtggagtgctaggggcagcctggaaaagatggggaacctgctagtgaactaggagggagacttccatagcctcagacttggatagggtaggctgagggggccctaagggagggactaaggctccaaggcaggtcacttttccttaggctgttctacttctggcttgttgcaagaggagtagatgccccctcacccacacaaaccccactcagtctccacccaactcctggcactgctcccaggggatcgggtctccactccagctttctcaattaaagacgatttatacaactgaa

SEQ ID NO: 533 - DNA, 2660 bp, Homo sapiens
atggagagcaaagaaccccagctcaaagggattgtgacaaggttattcagccagcagggatacttcctgcagatgcacccagatggtaccattgatgggaccaaggacgaaaacagcgactacactctcttcaatctaattcccgtgggcctgcgtgtagtggccatccaaggagtgaaggctagcctctatgtggccatgaatggtgaaggctatctctacagttcagatgttttcactccagaatgcaaattcaaggaatctgtgtttgaaaactactatgtgatctattcttccacactgtaccgccagcaagaatcaggccgagcttggtttctgggactcaataaagaaggtcaaattatgaaggggaacagagtgaagaaaaccaagccctcatcacattttgtaccgaaacctattgaagtgtgtatgtacagagaaccatcgctacatgaaattggagaaaaacaagggcgttcaaggaaaagttctggaacaccaaccatgaatggaggcaaagttgtgaatcaagattcaacatagctgagaactctccccttcttccctctctcatcccttccccttcccttccttcccatttacccatttccttccagtaaatccacccaaggagaggaaaataaaatgacaacgcaagacctagtggctaagattctgcactcaaaatcttcctttgtgtaggacaagaaaattgaaccaaagcttgcttgttgcaatgtggtagaaaattcacgtgcacaaagattagcacacttaaaagcaaaggaaaaaataaatcagaactccataaatattaaattaaactgtattgttattagtagaaggctaattgtaatgaagacattaataaagatgaaataaacttattactttaaaggaaaggatttggagaattgaactcacaaactgatgttatatactcaatagcttaaactcatgataatgctgcgatgtgtggttttgcttgattttgtattttatttgggcatctggaattgacacaccattacattctgtttgcaggattttttttgtaaccatgaaattgaacatttccaaattataaactatgttaatacctataaaatatatagccaggaaccatttatcatcaagaaaagtgtaagaaattatttttgagatgtaatttaagattgttttatgtaaaaggaaaatcttgtatggcatcgaatagccttaatgagtttaattctttcacaaaaatgatttcaaattatcctagagtataacatttttatcaaagatattatttccggagttcttctttctttcttttttttttttttttagtaatttagcaaaaacattactgttctaatgctgaagtgacttttgccagtgccatgtccaggtggtgaggtataagttacttgctcttagcatttggtctgatttttttgctttgtggacacctttgagagtatccacaaagcaatgtctcaggtgtggacacctgagagcatgttttagaaagctttgtaccctgtcttgtggcaggaaagaaagaacaggggttttacataaggaaataagtcctaggaaattagtcaacgcaaattgcatttgcgtttgtaccttaccacagtcttatattgttttttaaactctgccatgaaatttggagacatgactgtgaaattcctaacttactatcttacaaagccagtagctaatttgttgctctatgtatgatcctgttacaagtccagtttgcaattcatttgtttcctagaacacagaagggtaccagtaatacactaaattttcaaggtgtgtagagaaataatatggaattagcagctatgactccaacagacaggattgtgtgagcagctgaaaggagcaaaaaagaactcagtgtaagagaaggcacatacatagttaagaatactaaagtatttttaaaaatcaaggaagaaataaatgttacacaatttgcattggaataaatagatctatttagtcctacaaatcaggagtggtgtagagacatccaaatttaaagaaaaaaaaacacaaaacagaatgttaaaaaatgtatgcagatttatggatattatcaatgagaagacatagcatgtaacttctcctatatctctactgtccagcatgtattgttccaaatatgactccctaaaatatatacactttgcagaagctctaggccctcacctcaaaccttgccattggttgccgtatttcaaggtcaatatagtttccctcactttacacaatcattattcttcaatagtggaccatatccttcaccaggtatcctatttctgttatctagaggttagcagaaaatgaaatgaaggaatttccctaagcagttgggaagaacaaattgtatgcatgtaggcaaagattttgaagatacatttgcaagagatatttgtttaaccaaaatatttggaaagtaacaaataaagacatttaaattttctaaaaatggacttgctcttctaggaaaagaatacccctggggcaaaaatataactctagctgtatttcttcttgtcactcttgattcaacttgattataaatacacctgtcactaccagaaccaaaaaaaaaaagaaaaaaatcccaagcacaaagcttattttatttg

SEQ ID NO: 534 - DNA, 2660 bp, Homo sapiens
atggaaaaaacagaaccccagctcaaagggattgtgacaaggttattcagccagcagggatacttcctgcagatgcacccagatggtaccattgatgggaccaaggacgaaaacagcgactacactctcttcaatctaattcccgtgggcctgcgtgtagtggccatccaaggagtgaaggctagcctctatgtggccatgaatggtgaaggctatctctacagttcagatgttttcactccagaatgcaaattcaaggaatctgtgtttgaaaactactatgtgatctattcttccacactgtaccgccagcaagaatcaggccgagcttggtttctgggactcaataaagaaggtcaaattatgaaggggaacagagtgaagaaaaccaagccctcatcacattttgtaccgaaacctattgaagtgtgtatgtacagagaaccatcgctacatgaaattggagaaaaacaagggcgttcaaggaaaagttctggaacaccaaccatgaatggaggcaaagttgtgaatcaagattcaacatagctgagaactctccccttcttccctctctcatcccttccccttcccttccttcccatttacccatttccttccagtaaatccacccaaggagaggaaaataaaatgacaacgcaagacctagtggctaagattctgcactcaaaatcttcctttgtgtaggacaagaaaattgaaccaaagcttgcttgttgcaatgtggtagaaaattcacgtgcacaaagattagcacacttaaaagcaaaggaaaaaataaatcagaactccataaatattaaattaaactgtattgttattagtagaaggctaattgtaatgaagacattaataaagatgaaataaacttattactttaaaggaaaggatttggagaattgaactcacaaactgatgttatatactcaatagcttaaactcatgataatgctgcgatgtgtggttttgcttgattttgtattttatttgggcatctggaattgacacaccattacattctgtttgcaggattttttttgtaaccatgaaattgaacatttccaaattataaactatgttaatacctataaaatatatagccaggaaccatttatcatcaagaaaagtgtaagaaattatttttgagatgtaatttaagattgttttatgtaaaaggaaaatcttgtatggcatcgaatagccttaatgagtttaattctttcacaaaaatgatttcaaattatcctagagtataacatttttatcaaagatattatttccggagttcttctttctttcttttttttttttttttagtaatttagcaaaaacattactgttctaatgctgaagtgacttttgccagtgccatgtccaggtggtgaggtataagttacttgctcttagcatttggtctgatttttttgctttgtggacacctttgagagtatccacaaagcaatgtctcaggtgtggacacctgagagcatgttttagaaagctttgtaccctgtcttgtggcaggaaagaaagaacaggggttttacataaggaaataagtcctaggaaattagtcaacgcaaattgcatttgcgtttgtaccttaccacagtcttatattgttttttaaactctgccatgaaatttggagacatgactgtgaaattcctaacttactatcttacaaagccagtagctaatttgttgctctatgtatgatcctgttacaagtccagtttgcaattcatttgtttcctagaacacagaagggtaccagtaatacactaaattttcaaggtgtgtagagaaataatatggaattagcagctatgactccaacagacaggattgtgtgagcagctgaaaggagcaaaaaagaactcagtgtaagagaaggcacatacatagttaagaatactaaagtatttttaaaaatcaaggaagaaataaatgttacacaatttgcattggaataaatagatctatttagtcctacaaatcaggagtggtgtagagacatccaaatttaaagaaaaaaaaacacaaaacagaatgttaaaaaatgtatgcagatttatggatattatcaatgagaagacatagcatgtaacttctcctatatctctactgtccagcatgtattgttccaaatatgactccctaaaatatatacactttgcagaagctctaggccctcacctcaaaccttgccattggttgccgtatttcaaggtcaatatagtttccctcactttacacaatcattattcttcaatagtggaccatatccttcaccaggtatcctatttctgttatctagaggttagcagaaaatgaaatgaaggaatttccctaagcagttgggaagaacaaattgtatgcatgtaggcaaagattttgaagatacatttgcaagagatatttgtttaaccaaaatatttggaaagtaacaaataaagacatttaaattttctaaaaatggacttgctcttctaggaaaagaatacccctggggcaaaaatataactctagctgtatttcttcttgtcactcttgattcaacttgattataaatacacctgtcactaccagaaccaaaaaaaaaaagaaaaaaatcccaagcacaaagcttattttatttg

SEQ ID NO: 535 - DNA, 653 bp, Homo sapiens
cacgctcggaggacagctcctgcctgcagcttccagacccaggtaaaaaaaaaaaaaaaaaaatctgagcgggcactgtgcatgcatttcagtatcagatgcgcgtcgcaacgtatcccctgtagaggcaatctgctgctgctcctaagtgtcctttggtggctgattgcagcttcaaggtttaagaaatcccatctttcaggaagcctgaggggaaggaaggaagtacgggcgaaatcatcagattggcttcccagatttgggaatctgaagcgggcccacatcttccggccaacttccattgaacttcccagcactcgaaagggaccgaaatggagagcaaagaaccccagctcaaagggattgtgacaaggttattcagccagcagggatacttcctgcagatgcacccagatggtaccattgatgggaccaaggacgaaaacagcgactacactctcttcaatctaattcccgtgggcctgcgtgtagtggccatccaaggagtgaaggctagcctctatgtggccatgaatggtgaaggctatctctacagttcagatgttttcactccagaatgcaaattcaaggaatctgtgtttgaaaactactatgtgatctattcttccacactgtaccgccagcaagaatca

SEQ ID NO: 536 - DNA, 2743 bp, Homo sapiens
gtgccagcgcccatgcaaatctgctgtgcatccagagagcaaagtgggatgatctgtcactacacctgcagcaccacgctcggaggacagctcctgcctgcagcttccagacccaggaagcctgaggggaaggaaggaagtacgggcgaaatcatcagattggcttcccagatttgggaatctgaagcgggcccacatcttccggccaacttccattgaacttcccagcactcgaaagggaccgaaatggagagcaaagaaccccagctcaaagggattgtgacaaggttattcagccagcagggatacttcctgcagatgcacccagatggtaccattgatgggaccaaggacgaaaacagcgactacactctcttcaatctaattcccgtgggcctgcgtgtagtggccatccaaggagtgaaggctagcctctatgtggccatgaatggtgaaggctatctctacagttcagatgttttcactccagaatgcaaattcaaggaatctgtgtttgaaaactactatgtgatctattcttccacactgtaccgccagcaagaatcaggccgagcttggtttctgggactcaataaagaaggtcaaattatgaaggggaacagagtgaagaaaaccaagccctcatcacattttgtaccgaaacctattgaagtgtgtatgtacagagaaccatcgctacatgaaattggagaaaaacaagggcgttcaaggaaaagttctggaacaccaaccatgaatggaggcaaagttgtgaatcaagattcaacatagctgagaactctccccttcttccctctctcatcccttccccttcccttccttcccatttacccatttccttccagtaaatccacccaaggagaggaaaataaaatgacaacgcaagacctagtggctaagattctgcactcaaaatcttcctttgtgtaggacaagaaaattgaaccaaagcttgcttgttgcaatgtggtagaaaattcacgtgcacaaagattagcacacttaaaagcaaaggaaaaaataaatcagaactccataaatattaaattaaactgtattgttattagtagaaggctaattgtaatgaagacattaataaagatgaaataaacttattactttaaaggaaaggatttggagaattgaactcacaaactgatgttatatactcaatagcttaaactcatgataatgctgcgatgtgtggttttgcttgattttgtattttatttgggcatctggaattgacacaccattacattctgtttgcaggattttttttgtaaccatgaaattgaacatttccaaattataaactatgttaatacctataaaatatatagccaggaaccatttatcatcaagaaaagtgtaagaaattatttttgagatgtaatttaagattgttttatgtaaaaggaaaatcttgtatggcatcgaatagccttaatgagtttaattctttcacaaaaatgatttcaaattatcctagagtataacatttttatcaaagatattatttccggagttcttctttctttcttttttttttttttttagtaatttagcaaaaacattactgttctaatgctgaagtgacttttgccagtgccatgtccaggtggtgaggtataagttacttgctcttagcatttggtctgatttttttgctttgtggacacctttgagagtatccacaaagcaatgtctcaggtgtggacacctgagagcatgttttagaaagctttgtaccctgtcttgtggcaggaaagaaagaacaggggttttacataaggaaataagtcctaggaaattagtcaacgcaaattgcatttgcgtttgtaccttaccacagtcttatattgttttttaaactctgccatgaaatttggagacatgactgtgaaattcctaacttactatcttacaaagccagtagctaatttgttgctctatgtatgatcctgttacaagtccagtttgcaattcatttgtttcctagaacacagaagggtaccagtaatacactaaattttcaaggtgtgtagagaaataatatggaattagcagctatgactccaacagacaggattgtgtgagcagctgaaaggagcaaaaaagaactcagtgtaagagaaggcacatacatagttaagaatactaaagtatttttaaaaatcaaggaagaaataaatgttacacaatttgcattggaataaatagatctatttagtcctacaaatcaggagtggtgtagagacatccaaatttaaagaaaaaaaaacacaaaacagaatgttaaaaaatgtatgcagatttatggatattatcaatgagaagacatagcatgtaacttctcctatatctctactgtccagcatgtattgttccaaatatgactccctaaaatatatacactttgcagaagctctaggccctcacctcaaaccttgccattggttgccgtatttcaaggtcaatatagtttccctcactttacacaatcattattcttcaatagtggaccatatccttcaccaggtatcctatttctgttatctagaggttagcagaaaatgaaatgaaggaatttccctaagcagttgggaagaacaaattgtatgcatgtaggcaaagattttgaagatacatttgcaagagatatttgtttaaccaaaatatttggaaagtaacaaataaagacatttaaattttctaaaaa

SEQ ID NO: 537 - DNA, 768 bp, Homo sapiens
ttaaagcaggagccttgagagcctgataagctgttgacacaagtgcttttgagaatagcaggaagcctgaggggaaggaaggaagtacgggcgaaatcatcagattggcttcccagatttgggaatctgaagcgggcccacatcttccggccaacttccattgaacttcccagcactcgaaagggaccgaaatggagagcaaagaaccccagctcaaagggattgtgacaaggttattcagccagcagggatacttcctgcagatgcacccagatggtaccattgatgggaccaaggacgaaaacagcgactacactctcttcaatctaattcccgtgggcctgcgtgtagtggccatccaaggagtgaaggctagcctctatgtggccatgaatggtgaaggctatctctacagttcagatgttttcactccagaatgcaaattcaaggaatctgtgtttgaaaactactatgtgatctattcttccacactgtaccgccagcaagaatcaggccgagcttggtttctgggactcaataaagaaggtcaaattatgaaggggaacagagtgaagaaaaccaagccctcatcacattttgtaccgaaacctattgaagtgtgtatgtacagagaaccatcgctacatgaaattggagaaaaacaagggcgttcaaggaaaagttctggaacaccaaccatgaatggaggcaaagttgtgaatcaagattcaacatagctgagaactctccccttcttccctctctcat

SEQ ID NO: 538 - DNA, 3058 bp, Homo sapiens
agtgctgctggccgggagttgctctcaccgcagctggaaacagctgcccccgccccgcgcccctacccagactccgggtaaccgctcccacttcgcgcctctcggaattccagaactcgggtggccggcccctggaaagccgcagccggcgcgatgcattctgtagacctcaccctgctgggacggacctcctaatcttcagaaccgcgggccgcagggagttaaattgctgccttcctctccttctctcgtgcggttggtggcttgttttctaaaggaacgttttattcactttttagtattttctaccgggggcgcgctacccgcctgggtccagactctgctttgtaaacgggttttctatgtatgtatgtgtaggtatactttggacaccttacaacgcttgcgcctctccaacagaggcacgtcttgttattttgggcatcgttcttccccttccacttggtaccccgaacgcagtgtgactaaactccccactgccccttggacgccgatcgccttggggtgcaagtttggggtgcaaacgtctacttcgcaagagggcctgggaccgccccgccccgccccccggccgccagaggttggggaagtttacatctggattttcacacattttgtcgccactgcccagactttgactaaccttgtgagcgccgggttttcgatactgcagcctcctcaaattttagcactgcctccccgcgactgccctttccctggccgcccaggtcctgccctcgccccggcggagcgcaagccggagggcgcagtagaggctggggcctgaggccctcgctgagcagctatggctgcggcgatagccagctccttgatccggcagaagcggcaggcgagggagtccaacagcgaccgagtgtcggcctccaagcgccgctccagccccagcaaagacgggcgctccctgtgcgagaggcacgtcctcggggtgttcagcaaagtgcgcttctgcagcggccgcaagaggccggtgaggcggagaccagaaccccagctcaaagggattgtgacaaggttattcagccagcagggatacttcctgcagatgcacccagatggtaccattgatgggaccaaggacgaaaacagcgactacactctcttcaatctaattcccgtgggcctgcgtgtagtggccatccaaggagtgaaggctagcctctatgtggccatgaatggtgaaggctatctctacagttcagatgttttcactccagaatgcaaattcaaggaatctgtgtttgaaaactactatgtgatctattcttccacactgtaccgccagcaagaatcaggccgagcttggtttctgggactcaataaagaaggtcaaattatgaaggggaacagagtgaagaaaaccaagccctcatcacattttgtaccgaaacctattgaagtgtgtatgtacagagaaccatcgctacatgaaattggagaaaaacaagggcgttcaaggaaaagttctggaacaccaaccatgaatggaggcaaagttgtgaatcaagattcaacatagctgagaactctccccttcttccctctctcatcccttccccttcccttccttcccatttacccatttccttccagtaaatccacccaaggagaggaaaataaaatgacaacgcaagacctagtggctaagattctgcactcaaaatcttcctttgtgtaggacaagaaaattgaaccaaagcttgcttgttgcaatgtggtagaaaattcacgtgcacaaagattagcacacttaaaagcaaaggaaaaaataaatcagaactccataaatattaaattaaactgtattgttattagtagaaggctaattgtaatgaagacattaataaagatgaaataaacttattactttaaaggaaaggatttggagaattgaactcacaaactgatgttatatactcaatagcttaaactcatgataatgctgcgatgtgtggttttgcttgattttgtattttatttgggcatctggaattgacacaccattacattctgtttgcaggattttttttgtaaccatgaaattgaacatttccaaattataaactatgttaatacctataaaatatatagccaggaaccatttatcatcaagaaaagtgtaagaaattatttttgagatgtaatttaagattgttttatgtaaaaggaaaatcttgtatggcatcgaatagccttaatgagtttaattctttcacaaaaatgatttcaaattatcctagagtataacatttttatcaaagatattatttccggagttcttctttctttcttttttttttttttttagtaatttagcaaaaacattactgttctaatgctgaagtgacttttgccagtgccatgtccaggtggtgaggtataagttacttgctcttagcatttggtctgatttttttgctttgtggacacctttgagagtatccacaaagcaatgtctcaggtgtggacacctgagagcatgttttagaaagctttgtaccctgtcttgtggcaggaaagaaagaacaggggttttacataaggaaataagtcctaggaaattagtcaacgcaaattgcatttgcgtttgtaccttaccacagtcttatattgttttttaaactctgccatgaaatttggagacatgactgtgaaattcctaacttactatcttacaaagccagtagctaatttgttgctctatgtatgatcctgttacaagtccagtttgcaattcatttgtttcctagaacacagaagggtaccagtaatacactaaattttcaaggtgtgtagagaaataatatggaattagcagctatgactccaacagacaggattgtgtgagcagctgaaaggagcaaaaaagaactcagtgtaagagaaggcacatacatagttaagaatactaaagtatttttaaaaatcaaggaagaaataaatgttacacaatttgcattggaataaatagatctatttagtcctacaaatcaggagtggtgtagagacatccaaattt

SEQ ID NO: 539 - DNA, 1939 bp, Homo sapiens
aaactttctctgatctcctctctctctgtgtctgctccaaatgtagacagcaattgtctgggtaggaccagcttataaagaagcatggctttgttaaggaagtcgtattcagagcctcagcttaagggtatagttaccaagctatacagccgacaaggctaccacttgcagctgcaggcggatggaaccattgatggcaccaaagatgaggacagcacttacactctgtttaacctcatccctgtgggtctgcgagtggtggctatccaaggagttcaaaccaagctgtacttggcaatgaacagtgagggatacttgtacacctcggaacttttcacacctgagtgcaaattcaaagaatcagtgtttgaaaattattatgtgacatattcatcaatgatataccgtcagcagcagtcaggccgagggtggtatctgggtctgaacaaagaaggagagatcatgaaaggcaaccatgtgaagaagaacaagcctgcagctcattttctgcctaaaccactgaaagtggccatgtacaaggagccatcactgcacgatctcacggagttctcccgatctggaagcgggaccccaaccaagagcagaagtgtctctggcgtgctgaacggaggcaaatccatgagccacaatgaatcaacgtagccagtgagggcaaaagaagggctctgtaacagaaccttacctccaggtgctgttgaattcttctagcagtccttcacccaaaagttcaaatttgtcagtgacatttaccaaacaaacaggcagagttcactattctatctgccattagaccttcttatcatccatactaaagccccattatttagattgagcttgtgcataagaatgccaagcattttagtgaactaaatctgagagaaggactgccaaattttctcatgatctcacctatactttggggatgataatccaaaagtatttcacagcactaatgctgatcaaaatttgctctcccaccaagaaaatgtaaaagaccacaattgttcttcaaaaacaaacaaaacaaaacaaaacaaaattaactgcttaaatgttttgtcggggcaaacaaaattatgtgaattgtgttgttttcttggcttgatgttttctatctacgcttgattcacatgtactcttttctttggcatagtgcaactttatgatttctgaaattcaatggttctattgactttttgcgtcacttaatccaaatcaaccaaattcagggttgaatctgaattggcttctcaggctcaaggtaacagtgttcttgtggtttgaccaattgtttttctttctttttttttttttttagatttgtggtattctggtcaagttattgtgctgtactttgtgcgtagaaattgagttgtattgtcaaccccagtcagtaaagagaacttcaaaaaattatcctcaagtgtagatttctcttaattccatttgtgtatcatgttaaactattgttgtggcttcttgtgtaaagacaggaactgtggaactgtgatgttgtcttttgtgttgttaaaataagaaatgtcttatctgtatatgtatgagtcttcctgtcattgtatttggcacatgaatattgtgtacaaggaattgttaagactggttttccctcaacaacatatattatacttgctactggaaaagtgtttaagacttagctaggtttccatttagatcttcatatctgttgcatggaagaaagttgggttcttggcatagagttgcatgatatgtaagattttgtgcattcataattgttaaaaatctgtgttccaaaagtggacatagcatgtacaggcagttttctgtcctgtgcacaaaaagtttaaaaaagttgtttaatatttgttgttgtatacccaaatacgcaccgaataaactctttatattcattcaaaga

SEQ ID NO: 540 - DNA, 2676 bp, Homo sapiens
gtgccgcgcccagagcagcagcaacagcgaagatgcgaggccattacctgtttgatccctgtcggaaacctggcacgggccaacttttcccgattatcacgccaagaagttgcaaggactagtcgaagactcggaggggccagggcgagggcgcgctcccccgcgcgctgcctcgtccctcctccgtccggccgcccgagctcccggcctctctcccgcccgcgctcactccctccgcccgcctccctcctctggcccccatcagaagggcaacagggcgagggggtccggcgaaattcggaccggagcagctggacatgcacggtgtccgccgggcgcaggggccgaccacacgcagtcgcgcagttcagcatccgcgtgccagtctcgcccgcgatcccgggcccggggctgtggcgtcgactccgacccaggcagccagcagcccgcgcgggagccggaccgccgccggaggagctcggacggcatgctgagccccctccttggctgaagcccgagtgcggagaagcccgggcaaacgcaggctaaggagaccaaagcggcgaagtcgcgagacagcggacaagcagcggaggagaaggaggaggaggcgaacccagagaggggcagcaaaagaagcggtggtggtgggcgtcgtggccatggcggcggctatcgccagctcgctcatccgtcagaagaggcaagcccgcgagcgcgagaaatccaacgcctgcaagtgtgtcagcagccccagcaaaggcaagaccagctgcgacaaaaacaagttaaatgtcttttcccgggtcaaactcttcggctccaagaagaggcgcagaagaagaccagagcctcagcttaagggtatagttaccaagctatacagccgacaaggctaccacttgcagctgcaggcggatggaaccattgatggcaccaaagatgaggacagcacttacactctgtttaacctcatccctgtgggtctgcgagtggtggctatccaaggagttcaaaccaagctgtacttggcaatgaacagtgagggatacttgtacacctcggaacttttcacacctgagtgcaaattcaaagaatcagtgtttgaaaattattatgtgacatattcatcaatgatataccgtcagcagcagtcaggccgagggtggtatctgggtctgaacaaagaaggagagatcatgaaaggcaaccatgtgaagaagaacaagcctgcagctcattttctgcctaaaccactgaaagtggccatgtacaaggagccatcactgcacgatctcacggagttctcccgatctggaagcgggaccccaaccaagagcagaagtgtctctggcgtgctgaacggaggcaaatccatgagccacaatgaatcaacgtagccagtgagggcaaaagaagggctctgtaacagaaccttacctccaggtgctgttgaattcttctagcagtccttcacccaaaagttcaaatttgtcagtgacatttaccaaacaaacaggcagagttcactattctatctgccattagaccttcttatcatccatactaaagccccattatttagattgagcttgtgcataagaatgccaagcattttagtgaactaaatctgagagaaggactgccaaattttctcatgatctcacctatactttggggatgataatccaaaagtatttcacagcactaatgctgatcaaaatttgctctcccaccaagaaaatgtaaaagaccacaattgttcttcaaaaacaaacaaaacaaaacaaaacaaaattaactgcttaaatgttttgtcggggcaaacaaaattatgtgaattgtgttgttttcttggcttgatgttttctatctacgcttgattcacatgtactcttttctttggcatagtgcaactttatgatttctgaaattcaatggttctattgactttttgcgtcacttaatccaaatcaaccaaattcagggttgaatctgaattggcttctcaggctcaaggtaacagtgttcttgtggtttgaccaattgtttttctttctttttttttttttttagatttgtggtattctggtcaagttattgtgctgtactttgtgcgtagaaattgagttgtattgtcaaccccagtcagtaaagagaacttcaaaaaattatcctcaagtgtagatttctcttaattccatttgtgtatcatgttaaactattgttgtggcttcttgtgtaaagacaggaactgtggaactgtgatgttgtcttttgtgttgttaaaataagaaatgtcttatctgtatatgtatgagtcttcctgtcattgtatttggcacatgaatattgtgtacaaggaattgttaagactggttttccctcaacaacatatattatacttgctactggaaaagtgtttaagacttagctaggtttccatttagatcttcatatctgttgcatggaagaaagttgggttcttggcatagagttgcatgatatgtaagattttgtgcattcataattgttaaaaatctgtgttccaaaagtggacatagcatgtacaggcagttttctgtcctgtgcacaaaaagtttaaaaaagttgtttaatatttgttgttgtatacccaaatacgcaccgaataaactctttatattcattcaaaga

SEQ ID NO: 541 - DNA, 768 bp, Homo sapiens
atgagtggaaaggtgaccaagcccaaagaggagaaagatgcttctaaggttctggatgacgccccccctggcacacaggaatacattatgttacgacaagattccatccaatctgcggaattaaagaaaaaagagtccccctttcgtgctaagtgtcacgaaatcttctgctgcccgctgaagcaagtacaccacaaagagaacacagagccggaagagcctcagcttaagggtatagttaccaagctatacagccgacaaggctaccacttgcagctgcaggcggatggaaccattgatggcaccaaagatgaggacagcacttacactctgtttaacctcatccctgtgggtctgcgagtggtggctatccaaggagttcaaaccaagctgtacttggcaatgaacagtgagggatacttgtacacctcggaacttttcacacctgagtgcaaattcaaagaatcagtgtttgaaaattattatgtgacatattcatcaatgatataccgtcagcagcagtcaggccgagggtggtatctgggtctgaacaaagaaggagagatcatgaaaggcaaccatgtgaagaagaacaagcctgcagctcattttctgcctaaaccactgaaagtggccatgtacaaggagccatcactgcacgatctcacggagttctcccgatctggaagcgggaccccaaccaagagcagaagtgtctctggcgtgctgaacggaggcaaatccatgagccacaatgaatcaacgtag

SEQ ID NO: 542 - DNA, 352 bp, Homo sapiens
acctccttccccccccccgccacccgacacctcctaatcctaaactccttatccaccccaaccctccgggaaggcaggagtttgcacccttcgacacgccgcgtgcaaagcagggggatctatcctccctggccacatgggcctttggctgatggaaaggctgggctttgaggaagctgcatagttctggatgacgccccccctggcacacaggaatacattatgttacgacaagattccatccaatctgcggaattaaagaaaaaagagtccccctttcgtgctaagtgtcacgaaatcttctgctgcccgctgaagcaagtacaccacaaagagaacacagagccggaag

SEQ ID NO: 543 - DNA, 913 bp, Homo sapiens
gagagttctttggaaggagagcgcgagcgagggagcgggcgagctccgagggggtgtgggtgtagggagagagagaaagagagcaggcagcggcggcggcggcagcggtggggaaaagcggattccgccccgaaccacaccgaggggagctcgtggtcgagacttgccgccctaagcactctcccaagtccgacccgctcggcgaggacttccgtcttctgagcgaaccttgtcaagcaagctgggatctatgagtggaaaggtgaccaagcccaaagaggagaaagatgcttctaaggttctggatgacgccccccctggcacacaggaatacattatgttacgacaagattccatccaatctgcggaattaaagaaaaaagagtccccctttcgtgctaagtgtcacgaaatcttctgctgcccgctgaagcaagtacaccacaaagagaacacagagccggaagagcctcagcttaagggtatagttaccaagctatacagccgacaaggctaccacttgcagctgcaggcggatggaaccattgatggcaccaaagatgaggacagcacttacactctgtttaacctcatccctgtgggtctgcgagtggtggctatccaaggagttcaaaccaagctgtacttggcaatgaacagtgagggatacttgtacacctcggaacttttcacacctgagtgcaaattcaaagaatcagtgtttgaaaattattatgtgacatattcatcaatgatataccgtcagcagcagtcaggccgagggtggtatctgggtctgaacaaagaaggagagatcatgaaaggcaaccatgtgaagaagaacaagcctgcagctcattttctgcctaaaccactgaaagtggccatgtacaaggagccatcactgcacgat

SEQ ID NO: 544 - DNA, 1990 bp, Homo sapiens
ttctggatgacgccccccctggcacacaggaatacattatgttacgacaagattccatccaatctgcggaattaaagaaaaaagagtccccctttcgtgctaagtgtcacgaaatcttctgctgcccgctgaagcaagtacaccacaaagagaacacagagccggaagagcctcagcttaagggtatagttaccaagctatacagccgacaaggctaccacttgcagctgcaggcggatggaaccattgatggcaccaaagatgaggacagcacttacactctgtttaacctcatccctgtgggtctgcgagtggtggctatccaaggagttcaaaccaagctgtacttggcaatgaacagtgagggatacttgtacacctcggaacttttcacacctgagtgcaaattcaaagaatcagtgtttgaaaattattatgtgacatattcatcaatgatataccgtcagcagcagtcaggccgagggtggtatctgggtctgaacaaagaaggagagatcatgaaaggcaaccatgtgaagaagaacaagcctgcagctcattttctgcctaaaccactgaaagtggccatgtacaaggagccatcactgcacgatctcacggagttctcccgatctggaagcgggaccccaaccaagagcagaagtgtctctggcgtgctgaacggaggcaaatccatgagccacaatgaatcaacgtagccagtgagggcaaaagaagggctctgtaacagaaccttacctccaggtgctgttgaattcttctagcagtccttcacccaaaagttcaaatttgtcagtgacatttaccaaacaaacaggcagagttcactattctatctgccattagaccttcttatcatccatactaaagccccattatttagattgagcttgtgcataagaatgccaagcattttagtgaactaaatctgagagaaggactgccaaattttctcatgatctcacctatactttggggatgataatccaaaagtatttcacagcactaatgctgatcaaaatttgctctcccaccaagaaaatgtaaaagaccacaattgttcttcaaaaacaaacaaaacaaaacaaaacaaaattaactgcttaaatgttttgtcggggcaaacaaaattatgtgaattgtgttgttttcttggcttgatgttttctatctacgcttgattcacatgtactcttttctttggcatagtgcaactttatgatttctgaaattcaatggttctattgactttttgcgtcacttaatccaaatcaaccaaattcagggttgaatctgaattggcttctcaggctcaaggtaacagtgttcttgtggtttgaccaattgtttttctttctttttttttttttttagatttgtggtattctggtcaagttattgtgctgtactttgtgcgtagaaattgagttgtattgtcaaccccagtcagtaaagagaacttcaaaaaattatcctcaagtgtagatttctcttaattccatttgtgtatcatgttaaactattgttgtggcttcttgtgtaaagacaggaactgtggaactgtgatgttgtcttttgtgttgttaaaataagaaatgtcttatctgtatatgtatgagtcttcctgtcattgtatttggcacatgaatattgtgtacaaggaattgttaagactggttttccctcaacaacatatattatacttgctactggaaaagtgtttaagacttagctaggtttccatttagatcttcatatctgttgcatggaagaaagttgggttcttggcatagagttgcatgatatgtaagattttgtgcattcataattgttaaaaatctgtgttccaaaagtggacatagcatgtacaggcagttttctgtcctgtgcacaaaaagtttaaaaaagttgtttaatatttgttgttgtatacccaaatacgcaccgaataaactctttatattcattc

SEQ ID NO: 545 - DNA, 652 bp, Homo sapiens
gtgctttggctcagatgcagactattgcaaaccgcagaaactcacagtgacgacatgaccaagaagcttcctacccctggcctgggagcaagtgaccgtgggcgctaataacaacagggccctttaagattttggtccatggtgggatcttgcttgtttctcaccaccaggcccattgcgtctccacttctaaggcagcggcggcggcggcagcggtggggaaaagcggattccgccccgaaccacaccgaggggagctcgtggtcgagacttgccgccctaagcactctcccaagtccgacccgctcggcgaggacttccgtcttctgagcgaaccttgtcaagcaagctgggatctatgagtggaaaggtgaccaagcccaaagaggagaaagatgcttctaaggttctggatgacgccccccctggcacacaggaatacattatgttacgacaagattccatccaatctgcggaattaaagaaaaaagagtccccctttcgtgctaagtgtcacgaaatcttctgctgcccgctgaagcaagtacaccacaaagagaacacagagccggaagagcctcagcttaagggtatagttaccaagctatacagccgacaaggctaccacttgcagctgcaggcggatggaacc

SEQ ID NO: 546 - DNA, 687 bp, Homo sapiens
gtgacttgctcctgcttgccttcctccatgattgtgaggcctccccagccacgtggaactaggtgtcatgaggacaagcatgaaaaaagtagggatgcatcatttgagttcttcaggaggaagctactacctaattctggatgacgccccccctggcacacaggaatacattatgttacgacaagattccatccaatctgcggaattaaagaaaaaagagtccccctttcgtgctaagtgtcacgaaatcttctgctgcccgctgaagcaagtacaccacaaagagaacacagagccggaagagcctcagcttaagggtatagttaccaagctatacagccgacaaggctaccacttgcagctgcaggcggatggaaccattgatggcaccaaagatgaggacagcacttacactctgtttaacctcatccctgtgggtctgcgagtggtggctatccaaggagttcaaaccaagctgtacttggcaatgaacagtgagggatacttgtacacctcggaacttttcacacctgagtgcaaattcaaagaatcagtgtttgaaaattattatgtgacatattcatcaatgatataccgtcagcagcagtcaggccgagggtggtatctgggtctgaacaaagaaggagagatcatgaaaggcaaccatgtgaagaagaacaagcctgc

SEQ ID NO: 547 - DNA, 600 bp, Homo sapiens
atgagtggaaaggtgaccaagcccaaagaggagaaagatgcttctaaggagcctcagcttaagggtatagttaccaagctatacagccgacaaggctaccacttgcagctgcaggcggatggaaccattgatggcaccaaagatgaggacagcacttacactctgtttaacctcatccctgtgggtctgcgagtggtggctatccaaggagttcaaaccaagctgtacttggcaatgaacagtgagggatacttgtacacctcggaacttttcacacctgagtgcaaattcaaagaatcagtgtttgaaaattattatgtgacatattcatcaatgatataccgtcagcagcagtcaggccgagggtggtatctgggtctgaacaaagaaggagagatcatgaaaggcaaccatgtgaagaagaacaagcctgcagctcattttctgcctaaaccactgaaagtggccatgtacaaggagccatcactgcacgatctcacggagttctcccgatctggaagcgggaccccaaccaagagcagaagtgtctctggcgtgctgaacggaggcaaatccatgagccacaatgaatcaacgtag

SEQ ID NO: 548 - DNA, 1001 bp, Homo sapiens
ctggccgaaaacaaacaatcactgagaagtctcaaagaaatataccacgtgaggggaaaaaactgggagaagatccggaatattatcgtttttcctatggtaaaaccggtgcccctcttcaggagaactgatttcaaattattattatgcaaccacaaggatctcttctttctcagggtgtctaagctgctggattgcttttcgcccaaatcaatgtggtttctttggaacattttcagcaaaggaacgcatatgctgcagtgtctttgtggcaagagtcttaagaaaaacaagaacccaactgatccccagctcaagggtatagtgaccaggttatattgcaggcaaggctactacttgcaaatgcaccccgatggagctctcgatggaaccaaggatgacagcactaattctacactcttcaacctcataccagtgggactacgtgttgttgccatccagggagtgaaaacagggttgtatatagccatgaatggagaaggttacctctacccatcagaactttttacccctgaatgcaagtttaaagaatctgtttttgaaaattattatgtaatctactcatccatgttgtacagacaacaggaatctggtagagcctggtttttgggattaaataaggaagggcaagctatgaaagggaacagagtaaagaaaaccaaaccagcagctcattttctacccaagccattggaagttgccatgtaccgagaaccatctttgcatgatgttggggaaacggtcccgaagcctggggtgacgccaagtaaaagcacaagtgcgtctgcaataatgaatggaggcaaaccagtcaacaagagtaagacaacatagccagatcctcacaggtgttgtgacttattcgtcctgagcacagttgagtgatttatcctcaccagacattcctgctccgtggctgaagagcagcaggaagtaagctaatgcttattctttgctgtctccgaacttctctgttgcaa

SEQ ID NO: 549 - DNA, 744 bp, Homo sapiens
atggccgcggccatcgctagcggcttgatccgccagaagcggcaggcgcgggagcagcactgggaccggccgtctgccagcaggaggcggagcagccccagcaagaaccgcgggctctgcaacggcaacctggtggatatcttctccaaagtgcgcatcttcggcctcaagaagcgcaggttgcggcgccaagatccccagctcaagggtatagtgaccaggttatattgcaggcaaggctactacttgcaaatgcaccccgatggagctctcgatggaaccaaggatgacagcactaattctacactcttcaacctcataccagtgggactacgtgttgttgccatccagggagtgaaaacagggttgtatatagccatgaatggagaaggttacctctacccatcagaactttttacccctgaatgcaagtttaaagaatctgtttttgaaaattattatgtaatctactcatccatgttgtacagacaacaggaatctggtagagcctggtttttgggattaaataaggaagggcaagctatgaaagggaacagagtaaagaaaaccaaaccagcagctcattttctacccaagccattggaagttgccatgtaccgagaaccatctttgcatgatgttggggaaacggtcccgaagcctggggtgacgccaagtaaaagcacaagtgcgtctgcaataatgaatggaggcaaaccagtcaacaagagtaagacaacatag

SEQ ID NO: 550 - DNA, 1106 bp, Homo sapiens
gaatcctggagtttatcagcctggctgtggggctgatcagcatccggggagtggactctggcctgtacctaggaatgaatgagcgaggagaactctatgggtcgaagaaactcacacgtgaatgtgttttccgggaacagtttgaagaaaactggtacaacacctatgcctcaaccttgtacaaacattcggactcagagagacagtattacgtggccctgaacaaagatggctcaccccgggagggatacaggactaaacgacaccagaaattcactcactttttacccaggcctgtagatccttctaagttgccctccatgtccagagacctctttcactataggtaatgaacctctggtgtgccctctgtgacccatgtaccctggggccacggttgtctctgcaagcactatattcatagcttttcaatccttccttcctatcattttagataacagaaaagcacttactgttgaactcaacccagctgttcccttgttgttcaaagtgtatatcaaggttgggttattttggggagggatggggggctgggctcgagggaatcttgtatatacttttttctttactcatgttccttcccctgaggtagcataacaaagaatgggagcccctgctaagggccaggggtgtcttaccccacaatttactcaaataccttgacaatgggtataaatgaaaggccaaggaatctgccacagatgctacctacagagctttggaaaagtctcattaagaaaatccttggggctacagccttgctgcaagccttccctgcattggctctgcagatttctcatctgtcctgacatgcagttttcctgtcattggaagtgggagatggggtaggttgtaagaaaatgatattaaaatgtaagcatggatactgtgcataaggacaaactatttataaaatgtatatgctatttattttatatatttatttatttcaaaataataattttatttttaatgagagatgcgatggctggattttcatcagaaagaataaggtcctactgaaacaggataaaatgagttattaaaggcttttactgacaataaaatttgtctttatattgtaa

SEQ ID NO: 551 - DNA, 1714 bp, Homo sapiens
tgcggctcacccttggggaggtggggcgccagacctgagtgcaggagacgcagacctggaagggctccccctccctgacctgccacacatcgagtttgtctgcgtcgagtttggccagtctgtgagggtcaggaatagagcaggagacagcagggccacctccttcagaaggcccccaccgctccatccctgcactgggtggcccaggagagactggcagcccagagggcacagcgcgcacgcccccacccgcatctgctttgcagcctcactggccaggaaggtggacacctcatacctcagtctcccaattacgccctcctcctccccctcctcctccctcttttctctcctcctcctcccctttctctcctcctcgcccccctgaaaacctgtggctcggagagaccttggcttctctgggactctacccctggggacttcccacatctgctcctgagcttgggggcaggggggcaaccgcctgaggaacctctccagcgatgggagccgcccgcctgctgcccaacctcactctgtgcttacagctgctgattctctgctgtcaaactcagggggagaatcacccgtctcctaattttaaccagtacgtgagggaccagggcgccatgaccgaccagctgagcaggcggcagatccgcgagtaccaactctacagcaggaccagtggcaagcacgtgcaggtcaccgggcgtcgcatctccgccaccgccgaggacggcaacaagtttgccaagctcatagtggagacggacacgtttggcagccgggttcgcatcaaaggggctgagagtgagaagtacatctgtatgaacaagaggggcaagctcatcgggaagcccagcgggaagagcaaagactgcgtgttcacggagatcgtgctggagaacaactatacggccttccagaacgcccggcacgagggctggttcatggccttcacgcggcaggggcggccccgccaggcttcccgcagccgccagaaccagcgcgaggcccacttcatcaagcgcctctaccaaggccagctgcccttccccaaccacgccgagaagcagaagcagttcgagtttgtgggctccgcccccacccgccggaccaagcgcacacggcggccccagcccctcacgtagtctgggaggcagggggcagcagcccctgggccgcctccccacccctttcccttcttaatccaaggactgggctggggtggcgggaggggagccagatccccgagggaggaccctgagggccgcgaagcatccgagcccccagctgggaaggggcaggccggtgccccaggggcggctggcacagtgcccccttcccggacgggtggcaggccctggagaggaactgagtgtcaccctgatctcaggccaccagcctctgccggcctcccagccgggctcctgaagcccgctgaaaggtcagcgactgaaggccttgcagacaaccgtctggaggtggctgtcctcaaaatctgcttctcggatctccctcagtctgcccccagcccccaaactcctcctggctagactgtaggaagggacttttgtttgtttgtttgtttcaggaaaaaagaaagggagagagaggaaaatagagggttgtccactcctcacattccacgacccaggcctgcaccccacccccaactcccagccccggaataaaaccattttcctgcaaa

SEQ ID NO: 552 - DNA, 1706 bp, Homo sapiens
accagagaccccagccccacttgacacctgcggctcacccttggggaggtggggcgccagacctgagtgcaggagacgcagacctggaagggctccccctccctgacctgccacacatcgagtttgtctgcgtcgagtttggccagtctgtgagggtcaggaatagagcaggagacagcagggccacctccttcagaaggcccccaccgctccatccctgcactgggtggcccaggagagactggcagcccagagggcacagcgcgcacgcccccacccgcatctgctttgcagcctcactggccaggaaggtggacacctcatacctcagtctcccaattacgccctcctcctccccctcctcctccctcttttctctcctcctcctcccctttctctcctcctcgcccccctgaaaacctgtggctcggagagaccttggcttctctgggactctacccctggggacttcccacatctgctcctgagcttgggggcaggggggcaaccgcctgaggaacctctccagcgatgggagccgcccgcctgctgcccaacctcactctgtgcttacagctgctgattctctgctgtcaaactcagtacgtgagggaccagggcgccatgaccgaccagctgagcaggcggcagatccgcgagtaccaactctacagcaggaccagtggcaagcacgtgcaggtcaccgggcgtcgcatctccgccaccgccgaggacggcaacaagtttgccaagctcatagtggagacggacacgtttggcagccgggttcgcatcaaaggggctgagagtgagaagtacatctgtatgaacaagaggggcaagctcatcgggaagcccagcgggaagagcaaagactgcgtgttcacggagatcgtgctggagaacaactatacggccttccagaacgcccggcacgagggctggttcatggccttcacgcggcaggggcggccccgccaggcttcccgcagccgccagaaccagcgcgaggcccacttcatcaagcgcctctaccaaggccagctgcccttccccaaccacgccgagaagcagaagcagttcgagtttgtgggctccgcccccacccgccggaccaagcgcacacggcggccccagcccctcacgtagtctgggaggcagggggcagcagcccctgggccgcctccccacccctttcccttcttaatccaaggactgggctggggtggcgggaggggagccagatccccgagggaggaccctgagggccgcgaagcatccgagcccccagctgggaaggggcaggccggtgccccaggggcggctggcacagtgcccccttcccggacgggtggcaggccctggagaggaactgagtgtcaccctgatctcaggccaccagcctctgccggcctcccagccgggctcctgaagcccgctgaaaggtcagcgactgaaggccttgcagacaaccgtctggaggtggctgtcctcaaaatctgcttctcggatctccctcagtctgcccccagcccccaaactcctcctggctagactgtaggaagggacttttgtttgtttgtttgtttcaggaaaaaagaaagggagagagaggaaaatagagggttgtccactcctcacattccacgacccaggcctgcaccccacccccaactcccagccccggaataaaaccattttcctgc

SEQ ID NO: 553 - DNA, 1986 bp, Homo sapiens
cgatgcgcacggccggagagacgcggaggaggagacatgagccggcgggcgcccagacggagcggccgtgacgctttcgcgctgcagccgcgcgccccgaccccggagcgctgacccctggccccacgcagctccgcgcccgggccggagagcgcaactcggcttccagacccgccgcgcatgctgtccccggactgagccgggcagccagcctcccacggacgcccggacggccggccggccagcagtgagcgagcttccccgcaccggccaggcgcctcctgcacagcggctgccgccccgcagcccctgcgccagcccggagggcgcagcgctcgggaggagccgcgcggggcgctgatgccgcagggcgcgccgcggagcgccccggagcagcagagtctgcagcagcagcagccggcgaggagggagcagcagcagcggcggcggcggcggcggcggcggcggaggcgcccggtcccggccgcgcggagcggacatgtgcaggctgggctaggagccgccgcctccctcccgcccagcgatgtattcagcgccctccgcctgcacttgcctgtgtttacacttcctgctgctgtgcttccaggtacaggtgctggttgccgaggagaacgtggacttccgcatccacgtggagaaccagacgcgggctcgggacgatgtgagccgtaagcagctgcggctgtaccagctctacagccggaccagtgggaaacacatccaggtcctgggccgcaggatcagtgcccgcggcgaggatggggacaagtatgcccagctcctagtggagacagacaccttcggtagtcaagtccggatcaagggcaaggagacggaattctacctgtgcatgaaccgcaaaggcaagctcgtggggaagcccgatggcaccagcaaggagtgtgtgttcatcgagaaggttctggagaacaactacacggccctgatgtcggctaagtactccggctggtacgtgggcttcaccaagaaggggcggccgcggaagggccccaagacccgggagaaccagcaggacgtgcatttcatgaagcgctaccccaaggggcagccggagcttcagaagcccttcaagtacacgacggtgaccaagaggtcccgtcggatccggcccacacaccctgcctaggccaccccgccgcggcccctcaggtcgccctggccacactcacactcccagaaaactgcatcagaggaatatttttacatgaaaaataaggaagaagctctatttttgtacattgtgtttaaaagaagacaaaaactgaaccaaaactcttggggggaggggtgataaggattttattgttgacttgaaacccccgatgacaaaagactcacgcaaagggactgtagtcaacccacaggtgcttgtctctctctaggaacagacaactctaaactcgtccccagaggaggacttgaatgaggaaaccaacactttgagaaaccaaagtcctttttcccaaaggttctgaaaggaaaaaaaaaaaaaacaaaaaaaaagaaaaacaaagagaaagtagtactccgcccaccaacaaactccccctaactttcccaatcctctgttcctgccccaaactccaacaaaaatcgctctctggtttgcagtcatttatttattgtccgctgcaagctgccccgagacaccgcgcagggaaggcgtgcccctgggaattctccgcgcctcgacctcccgacgacagacgcctcgtccaatcatggtgaccctgccttgctcgcagttctggaggatgctgctatcgaccttccgtgactcacgtgacctagtacaccaatgataagggaatattttaaaaccagctatattatatatattatatatatataagctatttatttcacctctctgtatattgcagtttcatgaaccaagtattactgcctcaacaattaaaaacaacagacaaattatttaaaaaa

SEQ ID NO: 554 - DNA, 2447 bp, Homo sapiens
tgaaagaacctgagactgtcggaactgccggggaaaattctacgggacggctttgacgtcagatgtgcggggctgcgaaagtcgggggagggagtgcgagtgggcttttaaggggaagggcactaaggccgaggtgaggcttttcccgacagagggtgaagggggcaaaactcggtgccccccaacctctggccccggggttcctgaccccgcccccgctagtgccccacgccgagtgcatccactgggagcctgaggcctgggggaagggccccagttgtcgattgctttacaaagtcaaactctcccagccaagaacctcggggccgctgcgcggtggggaggagttccccgaaacccggccgctaagcgaggcctcctcctcccgcagatccgaacggcctgggcggggtcaccccggctgggacaagaagccgccgcctgcctgcccgggcccggggagggggctggggctggggccggaggcggggtgtgagtgggtgtgtgcggggggcggaggcttgatgcaatcccgataagaaatgctcgggtgtcttgggcacctacccgtggggcccgtaaggcgctactatataaggctgccggcccggagccgccgcgccgtcagagcaggagcgctgcgtccaggatctagggccacgaccatcccaacccggcactcacagccccgcagcgcatcccggtcgccgcccagcctcccgcacccccatcgccggagctgcgccgagagccccagggaggtgccatgcggagcgggtgtgtggtggtccacgtatggatcctggccggcctctggctggccgtggccgggcgccccctcgccttctcggacgcggggccccacgtgcactacggctggggcgaccccatccgcctgcggcacctgtacacctccggcccccacgggctctccagctgcttcctgcgcatccgtgccgacggcgtcgtggactgcgcgcggggccagagcgcgcacagtttgctggagatcaaggcagtcgctctgcggaccgtggccatcaagggcgtgcacagcgtgcggtacctctgcatgggcgccgacggcaagatgcaggggctgcttcagtactcggaggaagactgtgctttcgaggaggagatccgcccagatggctacaatgtgtaccgatccgagaagcaccgcctcccggtctccctgagcagtgccaaacagcggcagctgtacaagaacagaggctttcttccactctctcatttcctgcccatgctgcccatggtcccagaggagcctgaggacctcaggggccacttggaatctgacatgttctcttcgcccctggagaccgacagcatggacccatttgggcttgtcaccggactggaggccgtgaggagtcccagctttgagaagtaactgagaccatgcccgggcctcttcactgctgccaggggctgtggtacctgcagcgtgggggacgtgcttctacaagaacagtcctgagtccacgttctgtttagctttaggaagaaacatctagaagttgtacatattcagagttttccattggcagtgccagtttctagccaatagacttgtctgatcataacattgtaagcctgtagcttgcccagctgctgcctgggcccccattctgctccctcgaggttgctggacaagctgctgcactgtctcagttctgcttgaatacctccatcgatggggaactcacttcctttggaaaaattcttatgtcaagctgaaattctctaattttttctcatcacttccccaggagcagccagaagacaggcagtagttttaatttcaggaacaggtgatccactctgtaaaacagcaggtaaatttcactcaaccccatgtgggaattgatctatatctctacttccagggaccatttgcccttcccaaatccctccaggccagaactgactggagcaggcatggcccaccaggcttcaggagtaggggaagcctggagccccactccagccctgggacaacttgagaattccccctgaggccagttctgtcatggatgctgtcctgagaataacttgctgtcccggtgtcacctgcttccatctcccagcccaccagccctctgcccacctcacatgcctccccatggattggggcctcccaggccccccaccttatgtcaacctgcacttcttgttcaaaaatcaggaaaagaaaagatttgaagaccccaagtcttgtcaataacttgctgtgtggaagcagcgggggaagacctagaaccctttccccagcacttggttttccaacatgatatttatgagtaatttattttgatatgtacatctcttattttcttacattatttatgcccccaaattatatttatgtatgtaagtgaggtttgttttgtatattaaaatggagtttgtttgtatcaaaa

SEQ ID NO: 555 - DNA, 1688 bp, Homo sapiens
tgcaaagtccctccggagcgacctcagaggagtaaccgggccttaactttttgcgctcgttttgctataatttttctctatccacctccatcccacccccacaacactctttactgggggggtcttttgtgttccggatctccccctccatggctcccttagccgaagtcgggggctttctgggcggcctggagggcttgggccagcaggtgggttcgcatttcctgttgcctcctgccggggagcggccgccgctgctgggcgagcgcaggagcgcggcggagcggagcgcgcgcggcgggccgggggctgcgcagctggcgcacctgcacggcatcctgcgccgccggcagctctattgccgcaccggcttccacctgcagatcctgcccgacggcagcgtgcagggcacccggcaggaccacagcctcttcggtatcttggaattcatcagtgtggcagtgggactggtcagtattagaggtgtggacagtggtctctatcttggaatgaatgacaaaggagaactctatggatcagagaaacttacttccgaatgcatctttagggagcagtttgaagagaactggtataacacctattcatctaacatatataaacatggagacactggccgcaggtattttgtggcacttaacaaagacggaactccaagagatggcgccaggtccaagaggcatcagaaatttacacatttcttacctagaccagtggatccagaaagagttccagaattgtacaaggacctactgatgtacacttgaagtgcgatagtgacattatggaagagtcaaaccacaaccattctttcttgtcatagttcccatcataaaataatgacccaaggagacgttcaaaatattaaagtctattttctactgagagactggatttggaaagaatattgagaaaaaaaaccaaaaaaaattttgactagaaatagatcatgatcactctttatatgtggattaagttcccttagatacattggattagtccttaccagtagactgaagccaaaaatctgttaaactgtggataatgggaaccctcacatggttgctgctggtgcctcacctctctggattatgtttactttaaaatttatgttaaaaatagagacttcatgttgaagaaatggattgacttagccaagagcattgctacataaattctgaggaccttgtagaattcacaggttatggcattatatgttttaagaaaaaaaaaaactaaacaacacctgggtgaaacatgaactatgaaacatgccacaccaagacagaacactttttaaaagaatggacctatttatacactttcaatttgaaaatatttattatatatatttatttattaaagagtttattttttactgggatatgaagataatacaaagagtaaaaaacaacaaaacttccgttattgtgccattactttattgtggtgtcttgctctgtaaagaggacattattataccaccttaaccatagaatcagattttgaatttctttttaaaatatagtatagattatattttttatgcagtcaattgccttctaaatgtaacgttggtttcttttggcctagaaaaatgcctcattgatttgtattaaattcaacacacattcaaaagggaattaaacattttcatgcagtgttttggc

SEQ ID NO: 556 - DNA, 658 bp, Homo sapiens
ttgtgttccggatctccccctccatggctcccttagccgaagtcgggggctttctgggcggcctggagggcttgggccagcaggtgggttcgcatttcctgttgcctcctgccggggagcggccgccggcagctctattgccgcaccggcttccacctgcagatcctgcccgacggcagcgtgcagggcacccggcaggaccacagcctcttcggtatcttggaattcatcagtgtggcagtgggactggtcagtattagaggtgtggacagtggtctctatcttggaatgaatgacaaaggagaactctatggatcagagaaacttacttccgaatgcatctttagggagcagtttgaagagaactggtataacacctattcatctaacatatataaacatggagacactggccgcaggtattttgtggcacttaacaaagacggaactccaagagatggcgccaggtccaagaggcatcagaaatttacacatttcttacctagaccagtggatccagaaagagttccagaattgtacaaggacctactgatgtacacttgaagtgcgatagtgacattatggaagagtcaaaccacaaccattctttcttgtcatagttcccatcataaaataatgacccaaggagacgttcaaa

SEQ ID NO: 557 - DNA, 489 bp, Homo sapiens
atgggggacccagtggtgacagagacgcccaccctcctggggctcccagagcagaggcgcgcagcagttagacacgtgaacaagggcgcaggcatcctggagatccgctctgtacacgtgggcgtcgtggtcatcaaagcagtgtcctcaggcttctacgtggccatgaaccgccggggccgcctctacgggtcgcgactctacaccgtggactgcaggttccgggagcgcatcgaagagaacggccacaacacctacgcctcacagcgctggcgccgccgcggccagcccatgttcctggcgctggacaggaggggggggccccggccaggcggccggacgcggcggtaccacctgtccgcccacttcctgcccgtcctggtctcctgaggccctgagaggccggcggctccccaaggtgcctgggctggtggcgaggggcccggccacgcttgttcttccccctgcgggctctgtaagcgctgagtg

SEQ ID NO: 558 - DNA, 513 bp, Homo sapiens
atgcgccgccgcctgtggctgggcctggcctggctgctgctggcgcgggcgccggacgccgcgggaaccccgagcgcgtcgcggggaccgcgcagctacccgcacctggagggcgacgtgcgctggcggcgcctcttctcctccactcacttcttcctgcgcgtggatcccggcggccgcgtgcagggcacccgctggcgccacggccaggacagcatcctggagatccgctctgtacacgtgggcgtcgtggtcatcaaagcagtgtcctcaggcttctacgtggccatgaaccgccggggccgcctctacgggtcgcgactctacaccgtggactgcaggttccgggagcgcatcgaagagaacggccacaacacctacgcctcacagcgctggcgccgccgcggccagcccatgttcctggcgctggacaggaggggggggccccggccaggcggccggacgcggcggtaccacctgtccgcccacttcctgcccgtcctggtctcctga

SEQ ID NO: 559 - DNA, 3018 bp, Homo sapiens
cggcaaaaaggagggaatccagtctaggatcctcacaccagctacttgcaagggagaaggaaaaggccagtaaggcctgggccaggagagtcccgacaggagtgtcaggtttcaatctcagcaccagccactcagagcagggcacgatgttgggggcccgcctcaggctctgggtctgtgccttgtgcagcgtctgcagcatgagcgtcctcagagcctatcccaatgcctccccactgctcggctccagctggggtggcctgatccacctgtacacagccacagccaggaacagctaccacctgcagatccacaagaatggccatgtggatggcgcaccccatcagaccatctacagtgccctgatgatcagatcagaggatgctggctttgtggtgattacaggtgtgatgagcagaagatacctctgcatggatttcagaggcaacatttttggatcacactatttcgacccggagaactgcaggttccaacaccagacgctggaaaacgggtacgacgtctaccactctcctcagtatcacttcctggtcagtctgggccgggcgaagagagccttcctgccaggcatgaacccacccccgtactcccagttcctgtcccggaggaacgagatccccctaattcacttcaacacccccataccacggcggcacacccggagcgccgaggacgactcggagcgggaccccctgaacgtgctgaagccccgggcccggatgaccccggccccggcctcctgttcacaggagctcccgagcgccgaggacaacagcccgatggccagtgacccattaggggtggtcaggggcggtcgagtgaacacgcacgctgggggaacgggcccggaaggctgccgccccttcgccaagttcatctagggtcgctggaagggcaccctctttaacccatccctcagcaaacgcagctcttcccaaggaccaggtcccttgacgttccgaggatgggaaaggtgacaggggcatgtatggaatttgctgcttctctggggtcccttccacaggaggtcctgtgagaaccaacctttgaggcccaagtcatggggtttcaccgccttcctcactccatatagaacacctttcccaataggaaaccccaacaggtaaactagaaatttccccttcatgaaggtagagagaaggggtctctcccaacatatttctcttccttgtgcctctcctctttatcacttttaagcataaaaaaaaaaaaaaaaaaaaaaaaaaaaaaaagcagtgggttcctgagctcaagactttgaaggtgtagggaagaggaaatcggagatcccagaagcttctccactgccctatgcatttatgttagatgccccgatcccactggcatttgagtgtgcaaaccttgacattaacagctgaatggggcaagttgatgaaaacactactttcaagccttcgttcttccttgagcatctctggggaagagctgtcaaaagactggtggtaggctggtgaaaacttgacagctagacttgatgcttgctgaaatgaggcaggaatcataatagaaaactcagcctccctacagggtgagcaccttctgtctcgctgtctccctctgtgcagccacagccagagggcccagaatggccccactctgttcccaagcagttcatgatacagcctcaccttttggccccatctctggtttttgaaaatttggtctaaggaataaatagcttttacactggctcacgaaaatctgccctgctagaatttgcttttcaaaatggaaataaattccaactctcctaagaggcatttaattaaggctctacttccaggttgagtaggaatccattctgaacaaactacaaaaatgtgactgggaagggggctttgagagactgggactgctctgggttaggttttctgtggactgaaaaatcgtgtccttttctctaaatgaagtggcatcaaggactcagggggaaagaaatcaggggacatgttatagaagttatgaaaagacaaccacatggtcaggctcttgtctgtggtctctagggctctgcagcagcagtggctcttcgattagttaaaactctcctaggctgacacatctgggtctcaatccccttggaaattcttggtgcattaaatgaagccttaccccattactgcggttcttcctgtaagggggctccattttcctccctctctttaaatgaccacctaaaggacagtatattaacaagcaaagtcgattcaacaacagcttcttcccagtcacttttttttttctcactgccatcacatactaaccttatactttgatctattctttttggttatgagagaaatgttgggcaactgtttttacctgatggttttaagctgaacttgaaggactggttcctattctgaaacagtaaaactatgtataatagtatatagccatgcatggcaaatattttaatatttctgttttcatttcctgttggaaatattatcctgcataatagctattggaggctcctcagtgaaagatcccaaaaggattttggtggaaaactagttgtaatctcacaaactcaacactaccatcaggggttttctttatggcaaagccaaaatagctcctacaatttcttatatccctcgtcatgtggcagtatttatttatttatttggaagtttgcctatccttctatatttatagatatttataaaaatgtaacccctttttcctttcttctgtttaaaataaaaataaaatttatctcagcttctgttagcttatcctctttgtagtactacttaaaagcatgtcggaatataagaataaaaaggattatgggaggggaacattagggaaatccagagaaggcaaaattgaaaaaaagattttagaattttaaaattttcaaagatttcttccattcataaggagactcaatgattttaattgatctagacagaattatttaagttttatcaatattggatttctggt

SEQ ID NO: 560 - DNA, 892 bp, Homo sapiens
gagcacctcgcagctgtccggctgccgccccttccatgggcgccgcgctcgcctgcagccgccgccgccgcggggcgggcgcgatgccacgatgggcctaatctggctgctactgctcagcctgctggagcccggctggcccgcagcgggccctggggcgcggttgcggcgcgatgcgggcggccgtggcggcgtctacgagcaccttggcggggcgccccggcgccgcaagctctactgcgccacgaagtaccacctccagctgcacccgagcggccgcgtcaacggcagcctggagaacagcgcctacagtattttggagataacggcagtggaggtgggcattgtggccatcaggggtctcttctccgggcggtacctggccatgaacaagaggggacgactctatgcttcggagcactacagcgccgagtgcgagtttgtggagcggatccacgagctgggctataatacgtatgcctcccggctgtaccggacggtgtctagtacgcctggggcccgccggcagcccagcgccgagagactgtggtacgtgtctgtgaacggcaagggccggccccgcaggggcttcaagacccgccgcacacagaagtcctccctgttcctgccccgcgtgctggaccacagggaccacgagatggtgcggcagctacagagtgggctgcccagaccccctggtaagggggtccagccccgacggcggcggcagaagcagagcccggataacctggagccctctcacgttcaggcttcgagactgggctcccagctggaggccagtgcgcactagctgggcctggtggccaccgccagagctcctggcgacatcttggcgtggcagcctcttgactctgactctcctccttgagcc

SEQ ID NO: 561 - DNA, 1220 bp, Homo sapiens
gggagcgggcgagtaggagggggcgccgggctatatatatagcggctcggcctcgggcgggcctggcgctcagggaggcgcgcactgctcctcagagtcccagctccagccgcgcgctttccgcccggctcgccgctccatgcagccggggtagagcccggcgcccgggggccccgtcgcttgcctcccgcacctcctcggttgcgcactcctgcccgaggtcggccgtgcgctcccgcgggacgccacaggcgcagctctgccccccagcttcccgggcgcactgaccgcctgaccgacgcacggccctcgggccgggatgtcggggcccgggacggccgcggtagcgctgctcccggcggtcctgctggccttgctggcgccctgggcgggccgagggggcgccgccgcacccactgcacccaacggcacgctggaggccgagctggagcgccgctgggagagcctggtggcgctctcgttggcgcgcctgccggtggcagcgcagcccaaggaggcggccgtccagagcggcgccggcgactacctgctgggcatcaagcggctgcggcggctctactgcaacgtgggcatcggcttccacctccaggcgctccccgacggccgcatcggcggcgcgcacgcggacacccgcgacagcctgctggagctctcgcccgtggagcggggcgtggtgagcatcttcggcgtggccagccggttcttcgtggccatgagcagcaagggcaagctctatggctcgcccttcttcaccgatgagtgcacgttcaaggagattctccttcccaacaactacaacgcctacgagtcctacaagtaccccggcatgttcatcgccctgagcaagaatgggaagaccaagaaggggaaccgagtgtcgcccaccatgaaggtcacccacttcctccccaggctgtgaccctccagaggacccttgcctcagcctcgggaagcccctgggagggcagtgccgagggtcaccttggtgcactttcttcggatgaagagtttaatgcaagagtaggtgtaagatatttaaattaattatttaaatgtgtatatattgccaccaaattatttatagttctgcgggtgtgttttttaattttctggggggaaaaaaagacaaaacaaaaaaccaactctgacttttctggtgcaacagtggagaatcttaccattggatttctttaacttgt

SEQ ID NO: 562 - DNA, 4555 bp, Homo sapiens
gcaggcgtgcacggagcagtgagatcactggcgttataaatatcccggtgccagcgcggagatccgctcgggtggcctctctcttcccctctccccttctcttccccgaggctatgtccacccggtgcggcgaggcgggcagagccagaggcacgcagccgcacaggggctacagagcccagaatcagccctacaagatgcacttaggacccccgcggctggaagaatgagcttgtccttcctcctcctcctcttcttcagccacctgatcctcagcgcctgggctcacggggagaagcgtctcgcccccaaagggcaacccggacccgctgccactgataggaaccctagaggctccagcagcagacagagcagcagtagcgctatgtcttcctcttctgcctcctcctcccccgcagcttctctgggcagccaaggaagtggcttggagcagagcagtttccagtggagcccctcggggcgccggaccggcagcctctactgcagagtgggcatcggtttccatctgcagatctacccggatggcaaagtcaatggatcccacgaagccaatatgttaagtgttttggaaatatttgctgtgtctcaggggattgtaggaatacgaggagttttcagcaacaaatttttagcgatgtcaaaaaaaggaaaactccatgcaagtgccaagttcacagatgactgcaagttcagggagcgttttcaagaaaatagctataatacctatgcctcagcaatacatagaactgaaaaaacagggcgggagtggtatgtggccctgaataaaagaggaaaagccaaacgagggtgcagcccccgggttaaaccccagcatatctctacccattttctgccaagattcaagcagtcggagcagccagaactttctttcacggttactgttcctgaaaagaaaaagccacctagccctatcaagccaaagattcccctttctgcacctcggaaaaataccaactcagtgaaatacagactcaagtttcgctttggataatattcctcttggccttgtgagaaaccattctttcccctcaggagtttctataggtgtcttcagagttctgaagaaaaattactggacacagcttcagctatacttacactgtattgaagtcacgtcatttgtttcaatgtgactgaaacaaaatgttttttgataggaaggaaactggaattctttgtactaatacagggagcacactccttcagttcagcaagacataaagccttttgctttatgcttgagggatatttagaactttgtattttcggaaagttaaataacagggactacgtatttttctgacttttacagattaacctgaaagaacatacatgatacatttttatttttggtttccaaagaatattttgatgcagataaaatattttgttaacttttgtttttttttgtttgttttcttaaaagtacctctgcattgagcatattttcttacttttattattttaattaatatgacataagcaatcattttatgctgtttatgaattataaatgtgtttatagctcatttgtaatatggaaatcttttacatttttcctattcactgcacttttttattgtttttatttctagccatacctcagataatatgtttagttttacattttaaaatgtttaaattctctttcacagcaccaaaggctcagcttggatttgtgtgtatgtgtatgtcaattcatgacattatgtggaatcctaaacctttggtggctgggatatgatgggttagaagcaaggagaaaatataaggactttttgatggaattaaatgtgggaggtaaggaaaaggatttagaggtaaaagtacactaagtttgcaacatttattgagatctaagtctgtcttgccttcatttctctttttatctcccccttgccctcattcttgaacagctggaggaatacattttattctgtccatgaagcatacactatgaaattcaagtgcttaaaaatacttctatgactctctgctatcccactgtatagatccacagggagcaaacacttagaaatgatagagaactgaaggagatcaatggtttaacagttatccatgccaagtcccattgtcagaaatattcttattactcagtcaaacactctttgagcttcccttcctaaaggtaaccaatccagtgaatagatgtgcccttttataaggaaacttctgatgtttattaaaaaaactggccttttgatagaggtaacttaatttgggaatttgttgtgttgaaatggcatttaatttcaacctaaatactgactgctggacataaatcacagaaaatttaacttaagaaaatttacaaaatttattctcaggtaatcattttaataaagttctgcaaaatacacgtttatcttacattcagaaatgtggcaaaaaaggcatagctaaaggctaaacatatggctttagtagtaacaaaagggttcatagaaacttcatggtttgcatttaaacatgtttaaagtgtacttataaactatttttttcttaaagcaaactatgatttattttggtgcacaaatacaaagtggaaacttaccaaaattgaactagctaccatataagcagattgctttaatttgatgggaaaatagtacacacatatatataacaaataatatattaaaaaacccatccatcaactaaaacattatatgtatacatcagtatagtgttttattataaagccaattatctgattaagcattctttccactgaatgcataatgtttaaatagcataaaatgaaatgctacaaaaattgaactaatttatactttaaagtatttctgggttaaatgaaacaatgaaattttttagtatgttcaactctcatccaaatggcatatgaccctgtttacacagcctaaagctaaaaatattactctagtttattctaatctattgttaagtattgtgcactgtataccaagttcttagggcacatgaaaaattttagctgccaaacaggaactagtaaacatatgttcctaataagtgaagggaaagataataatgatggtcaacaataagccacgtcaatgcataagttgtataggctaaatgttgcttgtaggctacattaaactcaaatgtaatagtttatcttatactcctggtttgatttgattagcatattaacgtgaaagtaggatagctactaaatatatattatgcaagtcaggaatcattaatttcaaaatttaaagccatgctaaaattaaaaagaaaatattaaattacacaattacacttgtctttactggccatacaaaatgattttttttttttttttgagacagagtcttgctctgtcaccaggctggagtgcagtggcatgatctcggctcactgcaacctccaactccctggtttaagggattctcctgcctcagcctcccaagtagctgggattacagactcatgccaccacgccagctaatttttgtatttttagtagagacggggtttcaccatgttggtcaggatggtctcaatcctggcctcttgatagtcctgacctcatgatctgcccacctcggcctccccaaagtgctgggattacaggtacaatgatgtataattaatgcttagtgaagcataaagttacctacatcaattaattaaatgaacttatgtacagaaaacatgtataaatataagtctatactaatgcttacaactttctaagagggttcttgcttatgtagctttttattattttaagtaactagaaccaccaaatatcaaataaaattatttggttatggttatgttcatctaaacacaacaataacttttatattaatatttaggagtctattttgtctataggtgacaaacatctccagactaacatgtcagttttatcaattatattatgtttaattatttaagatttctttatgtggaacatctatagagataaatagaaattttcaataagatgtagtaacactgtgatttatctttcaagagtctctcttcacttccttctaaagagactaatttgagagtacaggtgcatattaattttcttggttctttcagctgaattatattggtccagaagttcaaaatcatgtgacaataataagggatactgacagaagttatttccaagtttgtgtatatattataaaaattacatatataaaactaaggcttttatttctgttatttttaagcttttatttcttgtagctaaaaataaaacatcataaatctggtaggtaaatttcttattaaatcaatcttgaaatagaaaatgtaataactttcttaccattaacattttttacccttccatagaagggagggaataaatcatgacttatcccattttcaataacaaaacgaaactatggcactaaccaaaaacttgcattctggcataatttttacagttgcagagaattgtttctgggctcattaaaaaaagtagtattgcagacattgctgcaatgggaagcagaca

SEQ ID NO: 563 - DNA, 5234 bp, Homo sapiens
tatcccggtgccagcgcggagatccgctcgggtggcctctctcttcccctctccccttctcttccccgaggctatgtccacccggtgcggcgaggcgggcagagccagaggcacgcagccgcacaggggctacagagcccagaatcagccctacaagatgcacttaggacccccgcggctggaagaatgagcttgtccttcctcctcctcctcttcttcagccacctgatcctcagcgcctgggctcacggggagaagcgtctcgcccccaaagggcaacccggacccgctgccactgataggaaccctagaggctccagcagcagacagagcagcagtagcgctatgtcttcctcttctgcctcctcctcccccgcagcttctctgggcagccaaggaagtggcttggagcagagcagtttccagtggagcccctcggggcgccggaccggcagcctctactgcagagtgggcatcggtttccatctgcagatctacccggatggcaaagtcaatggatcccacgaagccaatatgttaagccaagttcacagatgactgcaagttcagggagcgttttcaagaaaatagctataatacctatgcctcagcaatacatagaactgaaaaaacagggcgggagtggtatgtggccctgaataaaagaggaaaagccaaacgagggtgcagcccccgggttaaaccccagcatatctctacccattttctgccaagattcaagcagtcggagcagccagaactttctttcacggttactgttcctgaaaagaaaaagccacctagccctatcaagccaaagattcccctttctgcacctcggaaaaataccaactcagtgaaatacagactcaagtttcgctttggataatattcctcttggccttgtgagaaaccattctttcccctcaggagtttctataggtgtcttcagagttctgaagaaaaattactggacacagcttcagctatacttacactgtattgaagtcacgtcatttgtttcaatgtgactgaaacaaaatgttttttgataggaaggaaactggaattctttgtactaatacagggagcacactccttcagttcagcaagacataaagccttttgctttatgcttgagggatatttagaactttgtattttcggaaagttaaataacagggactacgtatttttctgacttttacagattaacctgaaagaacatacatgatacatttttatttttggtttccaaagaatattttgatgcagataaaatattttgttaacttttgtttttttttgtttgttttcttaaaagtacctctgcattgagcatattttcttacttttattattttaattaatatgacataagcaatcattttatgctgtttatgaattataaatgtgtttatagctcatttgtaatatggaaatcttttacatttttcctattcactgcacttttttattgtttttatttctagccatacctcagataatatgtttagttttacattttaaaatgtttaaattctctttcacagcaccaaaggctcagcttggatttgtgtgtatgtgtatgtcaattcatgacattatgtggaatcctaaacctttggtggctgggatatgatgggttagaagcaaggagaaaatataaggactttttgatggaattaaatgtgggaggtaaggaaaaggatttagaggtaaaagtacactaagtttgcaacatttattgagatctaagtctgtcttgccttcatttctctttttatctcccccttgccctcattcttgaacagctggaggaatacattttattctgtccatgaagcatacactatgaaattcaagtgcttaaaaatacttctatgactctctgctatcccactgtatagatccacagggagcaaacacttagaaatgatagagaactgaaggagatcaatggtttaacagttatccatgccaagtcccattgtcagaaatattcttattactcagtcaaacactctttgagcttcccttcctaaaggtaaccaatccagtgaatagatgtgcccttttataaggaaacttctgatgtttattaaaaaaactggccttttgatagaggtaacttaatttgggaatttgttgtgttgaaatggcatttaatttcaacctaaatactgactgctggacataaatcacagaaaatttaacttaagaaaatttacaaaatttattctcaggtaatcattttaataaagttctgcaaaatacacgtttatcttacattcagaaatgtggcaaaaaaggcatagctaaaggctaaacatatggctttagtagtaacaaaagggttcatagaaacttcatggtttgcatttaaacatgtttaaagtgtacttataaactatttttttcttaaagcaaactatgatttattttggtgcacaaatacaaagtggaaacttaccaaaattgaactagctaccatataagcagattgctttaatttgatgggaaaatagtacacacatatatataacaaataatatattaaaaaacccatccatcaactaaaacattatatgtatacatcagtatagtgttttattataaagccaattatctgattaagcattctttccactgaatgcataatgtttaaatagcataaaatgaaatgctacaaaaattgaactaatttatactttaaagtatttctgggttaaatgaaacaatgaaattttttagtatgttcaactctcatccaaatggcatatgaccctgtttacacagcctaaagctaaaaatattactctagtttattctaatctattgttaagtattgtgcactgtataccaagttcttagggcacatgaaaaattttagctgccaaacaggaactagtaaacatatgttcctaataagtgaagggaaagataataatgatggtcaacaataagccacgtcaatgcataagttgtataggctaaatgttgcttgtaggctacattaaactcaaatgtaatagtttatcttatactcctggtttgatttgattagcatattaacgtgaaagtaggatagctactaaatatatattatgcaagtcaggaatcattaatttcaaaatttaaagccatgctaaaattaaaaagaaaatattaaattacacaattacacttgtctttactggccatacaaaatgattttttttttttttttgagacagagtcttgctctgtcaccaggctggagtgcagtggcatgatctcggctcactgcaacctccaactccctggtttaagggattctcctgcctcagcctcccaagtagctgggattacagactcatgccaccacgccagctaatttttgtatttttagtagagacggggtttcaccatgttggtcaggatggtctcaatcctggcctcttgatagtcctgacctcatgatctgcccacctcggcctccccaaagtgctgggattacaggtacaatgatgtataattaatgcttagtgaagcataaagttacctacatcaattaattaaatgaacttatgtacagaaaacatgtataaatataagtctatactaatgcttacaactttctaagagggttcttgcttatgtagctttttattattttaagtaactagaaccaccaaatatcaaataaaattatttggttatggttatgttcatctaaacacaacaataacttttatattaatatttaggagtctattttgtctataggtgacaaacatctccagactaacatgtcagttttatcaattatattatgtttaattatttaagatttctttatgtggaacatctatagagataaatagaaattttcaataagatgtagtaacactgtgatttatctttcaagagtctctcttcacttccttctaaagagactaatttgagagtacaggtgcatattaattttcttggttctttcagctgaattatattggtccagaagttcaaaatcatgtgacaataataagggatactgacagaagttatttccaagtttgtgtatatattataaaaattacatatataaaactaaggcttttatttctgttatttttaagcttttatttcttgtagctaaaaataaaacatcataaatctggtaggtaaatttcttattaaatcaatcttgaaatagaaaatgtaataactttcttaccattaacattttttacccttccatagaagggagggaataaatcatgacttatcccattttcaataacaaaacgaaactatggcactaaccaaaaacttgcattctggcataatttttacagttgcagagaattgtttctgggctcattaaaaaaagtagtattgcagacattgctgcaatgggaagcagacaataacttcttaaaggaattctacacctcctttaagatttacttaattgctacatctaaattctgataatttaaaatccattttaggtgataaaattttttaaaagttttgaaggaaacctctggataaatggacaaggcctaatttttttttgtagtcaatccaactgtactggccaatttttgaaataagattatatgattaggtattagcagagacaaagagttacctcctccatcttactctgccctatttgaaagtctcaggggagaaaagggaacaagatgctgatccaacctgagtggagtcaggtgaggcatctttacatctaagaatttttttttaaattttattattattatacttcaagttctagggtacatgtccacaatgcacatgtctgtcacacatgcacacatgtgccatgctggtgtgctgcacccaccaacctgtcatccagcattaggtatatctcctaatgctatccctcccctctccacccaccccacagcaggccccggtatgtgatgttccccttcgtgtgtccatgtgttcttattgttcaattcccacctatgagtgagaatatgtggtgtttggtttttggtccttgcaatagtttgctgagaatgatggtttccagcttcatccatgtccctacaaagaacatgaactcatcattttttatggctgcatagtattccatggtgtatatgtgccacattttcttaatccagtctatcattgttggacatttgggttggttccaagtctttgctattgtgaatagtgctgcaataaacatatgtgtgcatgtgtcttta

SEQ ID NO: 564 - DNA, 743 bp, Homo sapiens
tttagggccattaattctgaccacgtgcctgagaggcaaggtggatggccctgggacagaaactgttcatcactatgtcccggggagcaggacgtctgcagggcacgctgtgggctctcgtcttcctaggcatcctagtgggcatggtggtgccctcgcctgcaggcacccgtgccaacaacacgctgctggactcgaggggctggggcaccctgctgtccaggtctcgcgccgggctagctggagagattgccggggtgaactgggaaagtggctatttggtggggatcaagcggcagcggaggctctactgcaacgtgggcatcggctttcacctccaggtgctccccgacggccggatcagcgggacccacgaggagaacccctacagcctgctggaaatttccactgtggagcgaggcgtggtgagtctctttggagtgagaagtgccctcttcgttgccatgaacagtaaaggaagattgtacgcaacgcccagcttccaagaagaatgcaagttcagagaaaccctcctgcccaacaattacaatgcctacgagtcagacttgtaccaagggacctacattgccctgagcaaatacggacgggtaaagcggggcagcaaggtgtccccgatcatgactgtcactcatttccttcccaggatctaaggacccacaaaagaaggctcacagatttaaagcatcatctgttcgattgaaattttgcaccagcgaagaatt

SEQ ID NO: 565 - DNA, 799 bp, Homo sapiens
gcggcggcccgcgggacggcgtgacccgccgggctctcggtgccccggggccgcgcgccatgggcagcccccgctccgcgctgagctgcctgctgttgcacttgctggtcctctgcctccaagcccaggaaggcccgggcaggggccctgcgctgggcagggagctcgcttccctgttccgggctggccgggagccccagggtgtctcccaacaggtaactgttcagtcctcacctaattttacacagcatgtgagggagcagagcctggtgacggatcagctcagccgccgcctcatccggacctaccaactctacagccgcaccagcgggaagcacgtgcaggtcctggccaacaagcgcatcaacgccatggcagaggacggcgaccccttcgcaaagctcatcgtggagacggacacctttggaagcagagttcgagtccgaggagccgagacgggcctctacatctgcatgaacaagaaggggaagctgatcgccaagagcaacggcaaaggcaaggactgcgtcttcacggagattgtgctggagaacaactacacagcgctgcagaatgccaagtacgagggctggtacatggccttcacccgcaagggccggccccgcaagggctccaagacgcggcagcaccagcgtgaggtccacttcatgaagcggctgccccggggccaccacaccaccgagcagagcctgcgcttcgagttcctcaactacccgcccttcacgcgcagcctgcgcggcagccagaggacttgggcccccgagccccgataggtgct

SEQ ID NO: 566 - DNA, 707 bp, Homo sapiens
atgggcagcccccgctccgcgctgagctgcctgctgttgcacttgctggtcctctgcctccaagcccaggaaggcccgggcaggggccctgcgctgggcagggagctcgcttccctgttccgggctggccgggagccccagggtgtctcccaacagcatgtgagggagcagagcctggtgacggatcagctcagccgccgcctcatccggacctaccaactctacagccgcaccagcgggaagcacgtgcaggtcctggccaacaagcgcatcaacgccatggcagaggacggcgaccccttcgcaaagctcatcgtggagacggacacctttggaagcagagttcgagtccgaggagccgagacgggcctctacatctgcatgaacaagaaggggaagctgatcgccaagagcaacggcaaaggcaaggactgcgtcttcacggagattgtgctggagaacaactacacagcgctgcagaatgccaagtacgagggctggtacatggccttcacccgcaagggccggccccgcaagggctccaagacgcggcagcaccagcgtgaggtccacttcatgaagcggctgccccggggccaccacaccaccgagcagagcctgcgcttcgagttcctcaactacccgcccttcacgcgcagcctgcgcggcagccagaggacttgggcccccgagccccgataggtgct

SEQ ID NO: 567 - DNA, 694 bp, Homo sapiens
tcagcgcgtcctcccgcggcggcccgcgggacggcgtgacccgccgggctctcggtgccccggggccgcgcgccatgggcagcccccgctccgcgctgagctgcctgctgttgcacttgctggtcctctgcctccaagcccagcatgtgagggagcagagcctggtgacggatcagctcagccgccgcctcatccggacctaccaactctacagccgcaccagcgggaagcacgtgcaggtcctggccaacaagcgcatcaacgccatggcagaggacggcgaccccttcgcaaagctcatcgtggagacggacacctttggaagcagagttcgagtccgaggagccgagacgggcctctacatctgcatgaacaagaaggggaagctgatcgccaagagcaacggcaaaggcaaggactgcgtcttcacggagattgtgctggagaacaactacacagcgctgcagaatgccaagtacgagggctggtacatggccttcacccgcaagggccggccccgcaagggctccaagacgcggcagcaccagcgtgaggtccacttcatgaagcggctgccccggggccaccacaccaccgagcagagcctgcgcttcgagttcctcaactacccgcccttcacgcgcagcctgcgcggcagccagaggacttgggcccccgagccccgataggtgct

SEQ ID NO: 568 - DNA, 823 bp, Homo sapiens
gcggcgcggcgagcacgacgttccacgggacccgcggagccgcgtcgtgatcgccgccggcctcccgcacccgcaccctctccgctcgcgccctgctcagcgcgtcctcccgcggcggcccgcgggacggcgtgacccgccgggctctcggtgccccggggccgcgcgccatgggcagcccccgctccgcgctgagctgcctgctgttgcacttgctggtcctctgcctccaagcccaggtaactgttcagtcctcacctaattttacacagcatgtgagggagcagagcctggtgacggatcagctcagccgccgcctcatccggacctaccaactctacagccgcaccagcgggaagcacgtgcaggtcctggccaacaagcgcatcaacgccatggcagaggacggcgaccccttcgcaaagctcatcgtggagacggacacctttggaagcagagttcgagtccgaggagccgagacgggcctctacatctgcatgaacaagaaggggaagctgatcgccaagagcaacggcaaaggcaaggactgcgtcttcacggagattgtgctggagaacaactacacagcgctgcagaatgccaagtacgagggctggtacatggccttcacccgcaagggccggccccgcaagggctccaagacgcggcagcaccagcgtgaggtccacttcatgaagcggctgccccggggccaccacaccaccgagcagagcctgcgcttcgagttcctcaactacccgcccttcacgcgcagcctgcgcggcagccagaggacttgggcccccgagccccgataggtgct

SEQ ID NO: 569 - DNA, 4220 bp, Homo sapiens
ttccccttgaaggattcatgctgatgtctgcagagtcggttagagagtaaaaacagcgcatgccttcctggagtcaggatccgtaaattctgacgtagcccgtgcatcttaaaaatccctataataacgcctaggcatttaagttgctatggtcattctgatctcaaaccaaatggagaaactacggattttttttccttattacggtcggatgggatgaagaccttcctgcctgctaagagctggggatctatctatagagatacatagatatgtttatcaatatgtcagtgtgtgagtataaagtggtggtttcttagactatcagtggtttgaccttgaacctgtgccagtgaaacagcagattacttttatttatgcatttaatggattgaagaaaagaaccttttttttctctctctctctgcaactgcagtaagggaggggagttggatatacctcgcctaatatctcctgggttgacaccatcattattgtttattcttgtgctccaaaagccgagtcctctgatggctcccttaggtgaagttgggaactatttcggtgtgcaggatgcggtaccgtttgggaatgtgcccgtgttgccggtggacagcccggttttgttaagtgaccacctgggtcagtccgaagcaggggggctccccaggggacccgcagtcacggacttggatcatttaaaggggattctcaggcggaggcagctatactgcaggactggatttcacttagaaatcttccccaatggtactatccagggaaccaggaaagaccacagccgatttggcattctggaatttatcagtatagcagtgggcctggtcagcattcgaggcgtggacagtggactctacctcgggatgaatgagaagggggagctgtatggatcagaaaaactaacccaagagtgtgtattcagagaacagttcgaagaaaactggtataatacgtactcatcaaacctatataagcacgtggacactggaaggcgatactatgttgcattaaataaagatgggaccccgagagaagggactaggactaaacggcaccagaaattcacacattttttacctagaccagtggaccccgacaaagtacctgaactgtataaggatattctaagccaaagttgacaaagacagtttcttcacttgagcccttaaaaaagtaaccactataaaggtttcacgcggtgggttcttattgattcgctgtgtcatcacatcagctccactgttgccaaactttgtcgcatgcataatgtatgatggaggcttggatgggaatatgctgattttgttctgcacttaaaggcttctcctcctggagggctgcctagggccacttgcttgatttatcatgagagaagaggagagagagagagactgagcgctaggagtgtgtgtatgtgtgtgtgtgtgtgtgtgtgtgtgtgtgtatgtgtgtagcgggagatgtgggcggagcgagagcaaaaggactgcggcctgatgcatgctggaaaaagacacgcttttcatttctgatcagttgtacttcatcctatatcagcacagctgccatacttcgacttatcaggattctggctggtggcctgcgcgagggtgcagtcttacttaaaagactttcagttaattctcactggtatcatcgcagtgaacttaaagcaaagacctcttagtaaaaaataaaaaaaaataaaaaataaaaataaaaaaagttaaatttatttatagaaattccaaaggcaacattttatttattttatatatttatttattatatagagtttatttttaatgaaacatgtacaggccagataggcattttggaagctttaggctctgtaagcattaaatggcaaagtccgctatgaacctgtggtaaattcatgcaagtagatataatggtgcatggatataagaaattctaatgaccctaatgtactaaaggcgacaatctcttttgtgcccatattattgtaaacttatgcacatcgctcatgacactgagtattcactcttcagactgcttgtttcatagcttatcccagaggattaaagataaactgggtctcaaactttgattctgtgtctgcaatatttcctctctcataagtgactccactattgtaacttcatggttggaaaatatgagggttgatatatgtcttacttgtttaaatctgtcgcagaatataccaaagctaaataataactatgctttcattttagccgatctccagaatgacagtattaacatcaaacattgtattgatttagaattctcaaaaaaggaaaaaaaagtacatagcacagactattttttttaaagacgtaagaatcagattaacaggatcatacttgtaaactttttttggttcacttggctatcaaatatgaaattatagaagtatcataggggtcattgtaacatcttttagagaaaatggctatcagtgtgaactgtcataattacgtggtaatagcacccttagtaaaacttgcaaaatgaaactaataaatcgttatcaataatgacaatgagggggaaagtattatacttgttgactgtgttttgttttttaaaatggtctccacaagcgctcaatttttttagaggggatattactatatagaatatcttttacaaggcttttataacattttatgctgaaaagcataagaatacgtatttctttagtagcaataattttggaacttgcccttgggcaagcgagactatttcttactatatactaaggagaaaagagccaaattcttaaagcaatatttaagaaaaaaggaatttataacaaattctcatctacatatgacactttctagccagttgtgttgagaagtgcaaagtgacggtttaaacatgtgttgggatttattgaactaattttaaaatttactattcaaactttattttgctctgatgcacattctctatgaaaaataaaagtgtgtcactggtgagtgacagctgttatgagctagaagcgcatgacttattgtgacgatgtcttgcctttctgtggtccaagttggagtacatggcaatgccctcctgctgatgtgcattaaggaaaatctaagtctaatatttggaattaagatatattttagggggaggggacagaagcaatgtaaaatagttgatttatgataaagctcagaatgtcctcttcatttattttcttgttttattttcctttctaaacagaaactgcatttaattccaaaaagtagtattcttatttattatttaaccctttgctgctgctaaaatgtgcacatattcaggctttagtttttccaaaaggcattttttttttggctgaaaaatattaaacatttgaccacagggaagaatcaagtttctaggatgtcataggtatactatgtagcactgaaaaaattgattttaggtgacagccaaaagtagtcttaaagtagcatgagaccttagataatcgacctaaaagaaagaaaattgtgaaaaagacaaaaatcttcatgcattcctataaaacgctactttaaggtctacttttggagttaattttgtttggtactttttttttttttaagacgagcaaattgttatatgcttttggcaattgatacaataaactgtaatggtctgtaaataaataaatattgactcatgcgatttatgtaaatagtggaactgggagagtggatggctcagggtttcggtgtgggcattgtctcttgggcagtagagtgagtcatccccagctcatgggtttgcatccagttcttgtcttaagagacccaaagcccagtgaatggcagccctgagccactgtggaatgggggttctggtttcacaaacagatgcttagatagccaaaccactgtcttgttggtgccaacacttgcactgtggtcaaagacttaccgagcatgggctgaacaaccttcccatctgtcatgtgaatgtccccaagcagtggtgaaggacatgctaggtcagtgttggggaacctgccctgccaggtcctgttttgtagataaacaaatggctgccttctggtgtttttattctatttcatctcattaacactacaaccttgtgttatttacttgataatctgtaattgtatgtaaatacatacaggattatgtaatttgtgtaaatacataattacagagttttgaaaa

SEQ ID NO: 570 - DNA, 9122 bp, Homo sapiens
accctgcaagctgcatcaggctttatcctacttgttcctttggtgaaccaggttcacttaaacttgcaaaaagatgaccgacctcttgagaagtgttgtcaccgtaattgatgttttctacaaatacaccaagcaagatggggagtgtggcacactgagcaagggtgaactaaaggaacttctggagaaagagcttcatccagttctgaagaacccagatgatccagacacagtggatgtcatcatgcatatgctggatcgagatcatgacagaagattggactttactgagtttcttttgatgatattcaagctgactatggcctgcaacaaggtcctcagcaaagaatactgcaaagcttcagggtcaaagaagcataggcgtggtcaccgacaccaagaagaagaaagtgaaacagaagaggatgaagaggatacaccaggacataaatcaggttacagacattcaagttggagtgagggagaggagcatggatatagttctgggcactcaaggggaactgtgaaatgtagacatgggtccaactccaggaggctaggaagacaaggtaatttatccagctctgggaaccaagagggatctcagaaaagataccacaggtccagctgtggtcattcatggagtggtggcaaagacagacatggttccagctctgtagaactgagagaaagaataaacaagtcacacattagcccttctagggaatctggggaggagtatgaatctggatctggatcaaacagttgggaaaggaaaggtcatggtggtctgtcatgtggattggagactagtgggcatgaatcaaactctactcagtcaagaattagagaacaaaagcttgggtctagctgttcaggttcaggagacagtgggaggcgaagtcatgcatgtggttatagcaattcaagtgggtgtggaaggccacaaaatgcttcaagttcttgtcagtcacatagatttggagggcaaggaaatcaatttagctatattcagtcaggctgtcagtcaggaattaagggaggacaaggccatggctgtgtctcaggaggtcagccctctggatgtggtcaacctgagtctaacccctgtagtcagtcctatagtcagagaggatatggagctagagaaaatggtcaaccacagaactgtggaggacaatggagaacaggctcaagtcagtcctcttgctgtggacaatatgggtctggaggtagccagtcttgtagtaatggtcaacatgaatatggttcctgtggccgcttttcaaactcttctagttcaaatgaattttccaaatgtgatcaatatgggtctggttcaagtcagtctactagctttgaacaacatggaacaggcttgagtcagtcctctgggttcgaacaacatgtatgtggctcaggtcaaacttgtggccagcatgagtctacatcaagtcaatccttgggctatgaccagcatgggtctagctcaggtaagacatctggctttggacaacatgggtctggctcaggtcagtcctctggctttggacaatgtgggtcaggctcaggtcagtcctctggctttggacagcatgggtctgtctcaggacaatcctctggttttggacagcatgggtctgtctcaggacaatcctctggttttggacaacatgagtctagatcacgtcagtctagctatggccaacatggttctggctcaagtcaatcatctggctatggccaatatgggtctagagagacatctggctttggacaacatgggttgggctcaggtcaatccactggctttggccaatatggatcgggctcaggtcagtcctctggctttggacaacatgggtctggctcaggacaatcctctggctttggacaacatgagtctagatcaggtcagtctagttatggccaacacagttctggctcaagtcagtcatctggctatggccaacatgggtctagacagacatctggctttggacaacatgggtcaggctcaagtcaatccactggctttggccaatatggatcaggctcaggtcagtcctctggctttggacaacatgtttctggctcaggacaatcctctggttttggacaacatgagtctagatcaggtcattctagctatggccaacatggttttggctcaagtcaatcatctggctatggtcaacatgggtcaagttcaggacagacatctggatttggacaacacgagttaagctcaggtcagtcttccagctttggccaacatggatcaggctcaggtcagtcctctggctttggacaacatgggtctggctcaggacaatcctctggctttggacaacatgagtctagatcaggtcagtctagctatggccaacacagttctggctcaagtcagtcatctggctatggccaacatgggtctagacagacatctggctttggacaacatgggtcaggctcaagtcaatccactggctttggccaatatggatcaggctcaggtcagtccgctggctttggacaacatgggtctggctcaggacaatcctctggctttggacagcatgagtctagatcacatcagtccagctatggccaacatggttctggctcaagtcaatcatctggctatggtcaacatgggtcaagttcgggacagacatctggctttggacaacacaggtcaagctcaggtcaatactctggctttggacaacatggatcaggctcaggtcagtccagtggctttggacaacatgggactggctcaggacaatactctggttttggacaacatgagtctagatcacatcagtctagctatggccaacatggttctggctcaagtcagtcatctggctatggtcaacatgggtcaagttcaggacagacttttggatttggacaacacaggtcaggctcaggtcaatcctctggctttggccaacatggatcaggctcaggtcagtcctctggctttggacaacatgagtcaggctcaggaaaatcctctggctttggacagcatgagtctagatcaagtcagtctaattatggccaacatggttctggctcaagtcagtcatctggctatggtcaacatgggtctagttcaggacagacaactggctttggacaacacaggtcaagctcaggccaatactcaggctttggacaacatggatcaggctcagatcagtcctctggctttggacaacatgggactggttcaggacaatcctctggttttggacaatatgagtctagatcacgtcagtctagctatggccaacatggttctggctcaagtcaatcatctggctatggtcaacatgggtcaaattcaggacagacatctggatttggacaacacaggccaggctcaggtcagtcctctggctttggccaatatggatcgggctcaggtcagtcttctggctttggacaacatgggtcaggcacaggtaaatcctctggctttgcacagcatgagtacagatcaggtcagtctagctatggccaacatggtactggctccagtcaatcatctggctgtggccaacatgagtctggctcaggtccaaccacaagttttggacagcatgtgtctggctcagacaatttctctagttctggacaacatatatctgactcaggtcagtccactggatttggccaatatggttcaggctcaggtcaatcaactggcttgggccagggtgaatctcaacaagtagagtcaggatccacagttcatgggagacaggaaactactcatggtcagacaataaataccactagacatagccagtctggtcaaggacaatccacacagacagggtccagggtaactagaagacgaagatctagccaaagtgagaacagtgacagtgaagtgcactcaaaggtctcacacagacattcagaacacattcacacacaagctggatctcactacccaaagtcaggatccacagttcgcagaagacaaggaactactcatggacagagaggagataccactagacatggccattctggtcatggacagtctacacagacaggttccagaacatctggaagacagagatttagccacagtgatgccactgacagtgaagtgcactcaggggtctcacatagaccacactcacaagaacaaactcacagccaagctggatctcaacatggagagtcagaatccacagttcatgagagacatgaaactacttatggacagacaggagaggccactggacatggccactctggtcatggacagtccacacagagagggtccaggacaactggaagaaggggatctggccatagtgagtccagtgacagtgaagtgcactcagggggctcacacagaccacaatcacaagaacaaactcatggccaagccggatctcaacatggagagtcaggatccacagttcatgggagacacggaactactcatggacagacaggagataccactagacatgcccactatcatcatggaaaatccacacagagagggtccagtacaactggaagaaggggatctggccacagtgagtccagtgacagtgaagtgcactcagggggctcgcacacacattcaggacacactcacggccaaagtggatctcaacatggagagtcagaatccataattcatgacagacacagaattactcatggacagacaggagataccactagacattcctactctggtcatgaacaaaccacacagacagggtccaggacaactggaagacagagaactagccacagtgagtccactgacagtgaagtgcactcagggggctcacacagaccacactcacgagaacacacttacggccaagccggatctcaacatgaagagccagaattcacagttcatgagagacacggaactactcatggacagataggagataccactggacattcccactctggtcatggacagtccacacagagagggtccaggacaactggaagacagagatctagccacagtgagtccagtgacagtgaagtgcactcaggggtctcacacacacatacaggacacactcatggtcaagctggatctcaacatggacagtcagaatccatagttcctgagagacatggaactactcatggacagacaggagataccactagacatgcccactatcatcatggattaaccacacagacagggtccaggactactggaagaaggggatctggccacagtgagtacagtgacagtgaagggtactcaggagtctcacatacacattcaggacacactcatggccaagccagatctcaacatggagagtcagaatccatagttcatgagagacatggaactatacatggacagacaggcgataccaccagacatgcccactctggtcatggacagtccacacagacagggtccaggaccactggaagaaggtcatctggccacagtgagtacagtgacagtgaagggcactcagggttctcacaaagaccacactcacgaggacacactcacggccaggctggatctcaacatggagagtcagaatccatagttgacgagagacatggaactactcatggacagacaggagataccagtggacattctcaatctggtcatggacagtccacacagtcaggatccagtacaactggaagaaggagatctggccacagtgagtccagtgacagtgaagtgcactcagggggctcacatacacattcaggacacacacacagccaagccaggtctcaacatggagagtcagaatccacagttcacaagagacaccaaactactcatggacagacaggagataccactgaacatggccaccctagtcatggacaaaccatacagacagggtccaggacaactggaagaaggggatctggccacagtgagtacagtgacagtgaagggccctcaggggtctcacacacacattcaggacacactcacggtcaagctggatctcactatccagagtcaggatcctcagttcatgagagacacggaactactcatggacaaacagcagataccactagacatggccactctggtcatggacagtccacacagagagggtccaggacaactggaagaagggcatctggccacagtgagtacagtgacagtgaagggcactcaggggtctcacacacacattcaggacacgctcatggccaagccggatctcaacatggagagtcaggatcctcagttcatgagagacacggaactactcatggacagacaggagataccactagacatgctcactctggtcatggacagtccacacagagagggtcaaggacagctggaagaaggggatctggccacagtgagtccagtgacagtgaagtgcactcaggggtctcacacacacattcaggacacacttatggccaagccagatctcaacatggagagtcaggatctgccattcacgggagacagggaactatacatggacagacaggagataccactagacatggccagtctggtcatggacagtccacacagacaggttccaggacaactggaagacaaagatctagtcacagtgagtccagtgatagtgaagtgcactcagaggcctcacccacacattcaggacacactcacagccaagccggatctcgacatggacagtcaggatcctcaggtcatgggagacagggaactactcatggacagacaggagataccactagacatgcccactatggttatggacaatccacacagagagggtccaggacaactggaagaaggggatctggccacagtgagtccagtgacagtgaagtgcactcatggggctcacacacacattcaggacacattcagggccaagctggatctcaacaaagacagccaggatccacagttcatgggagactggaaactactcatggacagacaggagataccactagacatggccattctggttatggacaatccacacagacaggttccagatctagtagagcaagtcattttcagtcacatagtagtgaaaggcaaaggcatggatcaagtcaggtttggaaacatggcagctatggacctgcagaatatgactatgggcacactgggtatgggccttctggtggcagcagaaaaagcatcagtaattctcacctttcatggtcaacagacagcactgcaaacaagcaactgtctagacattgacagttattttctagttctgaccttatagtatccaaagcaactaaaagaacaggaagacacagtttaaatcatgaacagtcaatggtaagttatgaacattcagttgattctcagtatcagtctcgacctattattataagaagtcaggaatctagtcatggacattctatagtaactcataaacagtcaaacaacacctatgttcaacctggatataacacagccagaagggagggatgtacacatagccagtcaaatgaccaccttggatttggccatggacaatccatatcagttcatggccattcaaaatctagttcaatcagaaaacaggaatcccatactgataacaaaaagcattcagaagattgggagaaagacactcatgagcaattaggatctaggcatgggaagttagagttcaatacaataggtatacatggatctagccagcaacatttcggagatacaacttttcatgggcaggtaagatccagcacaggttttgccagataggtattaagtcatgggccatcaagagatgcctagggtcagtctggattcagtaccaatgaaagacaagtatacagccatggccaatcaaatgatagttatgagtagtcaaatgacagcaaaagtcaaagatacattttcagtcactttcttgacagccaagaccctgcaggaattgaagagtataggtatagatattcatcaagcagtgcaaccatatgcagtgggggagacaaaggcaagagtcagagtcaagtctgtcaggaggtatcagaatatacggtgaggatgtgggcaaaaaacaaagaggctctgaggccagcggttaccatacaaaggaaagaacaggctctggttccttctgcttagatagcaacaccccactctatgaatatgtccaagaacaaaggagttattactttgaataagaagccaacataaactagcccaagataagaactaacccagagaagaaatgagacacatacatgaaattaaggtatttaacatgatctcctcttttggtagtaagggtatatgtctgttctttcattttaactatagttctgtactatattacttttgtttggtgccaggtgtttttgtaaggctccacattcattgaactccttggttagaaaatagtgaatgaggccgggcgcggtggctcacgcctgtaatcccagcactttgggaggccaagatgggtggatcacgaagtcaggagttcgagaccagcctggccaacatagtgaaatcccgtctctactaaaaatacaaaaattagctgggtgcagtagcgggcacctgtaatcctagctactcaggaggctgaggcaggagaattggttgaacccgggaggcagaggttgcagtgagccgagatcgcaccactgcactccagcctgggtgactgagcaagactccaccttgaaaaaaagaaagaaagaaaatagtgaatggaagaaaaagataaacaccatttggggctatattcagaactatataataaagagagatttgtgtggttgggaataaaattaggttttaaaaaaatttccgaatttcaaaatttggattttccagattttgttttaattaattattgacaaacctatccaaggagctaaatgacgtggtttaggagccaaaacgtctctagaaacattataacacatcccatcctgaacaaagaatgttgtcatagtttcccacatgaatattcagaatatttgcatctttttgtgtcactactggaattctgtacaattatatttaaatttattgtcatggccttctggatataggatccagaaaattgtacttcataaaaattggcaataaacatttcatcaagtta

SEQ ID NO: 571 - DNA, 2386 bp, Homo sapiens
attcccggccgcgagccgggcagcgctcattcggccgaaggagctacgcgggccacgctgctggctggcctgacctaggcgcgcggggtcgggcggccgcgcgggcgggctgagtgagcaagacaagacactcaagaagagcgagctgcgcctgggtcccggccaggcttgcacgcagaggcgggcggcagacggtgcccggcggaatctcctgagctccgccgcccagctctggtgccagcgcccagtggccgccgcttcgaaagtgactggtgcctcgccgcctcctctcggtgcgggaccatgaagctgctgccgtcggtggtgctgaagctctttctggctgcagttctctcggcactggtgactggcgagagcctggagcggcttcggagagggctagctgctggaaccagcaacccggaccctcccactgtatccacggaccagctgctacccctaggaggcggccgggaccggaaagtccgtgacttgcaagaggcagatctggaccttttgagagtcactttatcctccaagccacaagcactggccacaccaaacaaggaggagcacgggaaaagaaagaagaaaggcaaggggctagggaagaagagggacccatgtcttcggaaatacaaggacttctgcatccatggagaatgcaaatatgtgaaggagctccgggctccctcctgcatctgccacccgggttaccatggagagaggtgtcatgggctgagcctcccagtggaaaatcgcttatatacctatgaccacacaaccatcctggccgtggtggctgtggtgctgtcatctgtctgtctgctggtcatcgtggggcttctcatgtttaggtaccataggagaggaggttatgatgtggaaaatgaagagaaagtgaagttgggcatgactaattcccactgagagagacttgtgctcaaggaatcggctggggactgctacctctgagaagacacaaggtgatttcagactgcagaggggaaagacttccatctagtcacaaagactccttcgtccccagttgccgtctaggattgggcctcccataattgctttgccaaaataccagagccttcaagtgccaaacagagtatgtccgatggtatctgggtaagaagaaagcaaaagcaagggaccttcatgcccttctgattcccctccaccaaaccccacttcccctcataagtttgtttaaacacttatcttctggattagaatgccggttaaattccatatgctccaggatctttgactgaaaaaaaaaaagaagaagaagaaggagagcaagaaggaaagatttgtgaactggaagaaagcaacaaagattgagaagccatgtactcaagtaccaccaagggatctgccattgggaccctccagtgctggatttgatgagttaactgtgaaataccacaagcctgagaactgaattttgggacttctacccagatggaaaaataacaactatttttgttgttgttgtttgtaaatgcctcttaaattatatatttattttattctatgtatgttaatttatttagtttttaacaatctaacaataatatttcaagtgcctagactgttactttggcaatttcctggccctccactcctcatccccacaatctggcttagtgccacccacctttgccacaaagctaggatggttctgtgacccatctgtagtaatttattgtctgtctacatttctgcagatcttccgtggtcagagtgccactgcgggagctctgtatggtcaggatgtaggggttaacttggtcagagccactctatgagttggacttcagtcttgcctaggcgattttgtctaccatttgtgttttgaaagcccaaggtgctgatgtcaaagtgtaacagatatcagtgtctccccgtgtcctctccctgccaagtctcagaagaggttgggcttccatgcctgtagctttcctggtccctcacccccatggccccaggcccacagcgtgggaactcactttcccttgtgtcaagacatttctctaactcctgccattcttctggtgctactccatgcaggggtcagtgcagcagaggacagtctggagaaggtattagcaaagcaaaaggctgagaaggaacagggaacattggagctgactgttcttggtaactgattacctgccaattgctaccgagaaggttggaggtggggaaggctttgtataatcccacccacctcaccaaaacgatgaagttatgctgtcatggtcctttctggaagtttctggtgccatttctgaactgttacaacttgtatttccaaacctggttcatatttatactttgcaatccaaataaagataacccttattccata

SEQ ID NO: 572 - DNA, 1298 bp, Homo sapiens
attcggccgaaggagctacgcgggccacgctgctggctggcctgacctaggcgcgcggggtcgggcggccgcgcgggcgggctgagtgagcaagacaagacactcaagaagagcgagctgcgcctgggtcccggccaggcttgcacgcagaggcgggcggcagacggtgcccggcggaatctcctgagctccgccgcccagctctggtgccagcgcccagtggccgccgcttcgaaagtgactggtgcctcgccgcctcctctcggtgcgggaccatgaagctgctgccgtcggtggtgctgaagctctttctggctgcagttctctcggcactggtgactggcgagagcctggagcggcttcggagagggctagctgctggaaccagcaacccggaccctcccactgtatccacggaccagctgctacccctaggaggcggccgggaccggaaagtccgtgacttgcaagaggcagatctggaccttttgagagtcactttatcctccaagccacaagcactggccacaccaaacaaggaggagcacgggaaaagaaagaagaaaggcaaggggctagggaagaagagggacccatgtcttcggaaatacaaggacttctgcatccatggagaatgcaaatatgtgaaggagctccgggctccctcctgcatctgccacccgggttaccatggagagaggtgtcatgggctgagcctcccagtggaaaatcgcttatatacctatgaccacacaaccatcctggccgtggtggctgtggtgctgtcatctgtctgtctgctggtcatcgtggggcttctcatgtttaggtaccataggagaggaggttatgatgtggaaaatgaagagaaagtgaagttgggcatgactaattcccactgagagagacttgtgctcaaggaatcggctggggactgctacctctgagaagacacaaggtgatttcagactgcagatggttctgtgacccatctgtagtaatttattgtctgtctacatttctgcagatcttccgtggtcagagtgccactgcgggagctctgtatggtcaggatgtaggggttaacttggtcagagccactctatgagttggacttcagtcttgcctaggcgattttgtctaccatttgtgttttgaaagcccaaggtgctgatgtcaaagtgtaacagatatcagtgtctccccgtgtcctctccctgccaagtctcagaagaggttgggcttccatgcctgtagctttcctggtccctcacccccatggccccaggcccacagcg

SEQ ID NO: 573 - DNA, 1439 bp, Homo sapiens
ggacccggctgcggcggcgagggaggaggaagaagcggaggaggcggctcccgcgctcgcagggccgtgccacctgcccgcccgcccgctcgctcgctcgcccgccgcgccgcgctgccgaccgccagcatgctgccgagagtgggctgccccgcgctgccgctgccgccgccgccgctgctgccgctgctgctgctgctactgggcgcgagtggcggcggcggcggggcgcgcgcggaggtgctgttccgctgcccgccctgcacacccgagcgcctggccgcctgcgggcccccgccggttgcgccgcccgccgcggtggccgcagtggccggaggcgcccgcatgccatgcgcggagctcgtccgggagccgggctgcggctgctgctcggtgtgcgcccggctggagggcgaggcgtgcggcgtctacaccccgcgctgcggccaggggctgcgctgctatccccacccgggctccgagctgcccctgcaggcgctggtcatgggcgagggcacttgtgagaagcgccgggacgccgagtatggcgccagcccggagcaggttgcagacaatggcgatgaccactcagaaggaggcctggtggagaaccacgtggacagcaccatgaacatgttgggcgggggaggcagtgctggccggaagcccctcaagtcgggtatgaaggagctggccgtgttccgggagaaggtcactgagcagcaccggcagatgggcaagggtggcaagcatcaccttggcctggaggagcccaagaagctgcgaccaccccctgccaggactccctgccaacaggaactggaccaggtcctggagcggatctccaccatgcgccttccggatgagcggggccctctggagcacctctactccctgcacatccccaactgtgacaagcatggcctgtacaacctcaaacagtgcaagatgtctctgaacgggcagcgtggggagtgctggtgtgtgaaccccaacaccgggaagctgatccagggagcccccaccatccggggggaccccgagtgtcatctcttctacaatgagcagcaggaggctcgcggggtgcacacccagcggatgcagtagaccgcagccagccggtgcctggcgcccctgccccccgcccctctccaaacaccggcagaaaacggagagtgcttgggtggtgggtgctggaggattttccagttctgacacacgtatttatatttggaaagagaccagcaccgagctcggcacctccccggcctctctcttcccagctgcagatgccacacctgctccttcttgctttccccgggggaggaagggggttgtggtcggggagctggggtacaggtttggggagggggaagagaaatttttatttttgaacccctgtgtcccttttgcataagattaaaggaaggaaaagtaaa

SEQ ID NO: 574 - DNA, 1169 bp, Homo sapiens
gggaacaaagcaagaaaaatcagagcaatttgggaagtaaacagaaactggaaagggagagggaaagaagagtggggaggacccaggttgggggggccctctccagtcccacccagtttagggaatgcccctgccctctcccccaccccccttcacctggctcttaaagggcccggcccctggccggcggctacttaagacagaggggcggcggcgggcagcagctgcgctgcgactgctctggaaggagaggacggggcacaaaccctgaccatgaccccccacaggctgctgccaccgctgctgctgctgctagctctgctgctcgctgccagcccaggaggcgccttggcgcggtgcccaggctgcgggcaaggggtgcaggcgggttgtccagggggctgcgtggaggaggaggatggggggtcgccagccgagggctgcgcggaagctgagggctgtctcaggagggaggggcaggagtgcggggtctacacccctaactgcgccccaggactgcagtgccatccgcccaaggacgacgaggcgcctttgcgggcgctgctgctcggccgaggccgctgccttccggcccgcgcgcctgctgttgcagaggagaatcctaaggagagtaaaccccaagcaggcactgcccgcccacaggatgtgaaccgcagagaccaacagaggaatccaggcacctctaccacgccctcccagcccaattctgcgggtgtccaagacactgagatgggcccatgccgtagacatctggactcagtgctgcagcaactccagactgaggtctaccgaggggctcaaacactctacgtgcccaattgtgaccatcgaggcttctaccggaagcggcagtgccgctcctcccaggggcagcgccgaggtccctgctggtgtgtggatcggatgggcaagtccctgccagggtctccagatggcaatggaagctcctcctgccccactgggagtagcggctaaagctgggggatagaggggctgcagggccactggaaggaacatggagctgtcatcactcaacaaaaaaccgaggccctcaatccaccttcaggccccgccccatgggcccctcaccgctggttggaaagagtgttggtgttggctggggtgtcaataaagctgtgcttggggtc

SEQ ID NO: 575 - DNA, 712 bp, Homo sapiens
agctgcgctgcgactgctctggaaggagaggacggggcacaaaccctgaccatgaccccccacaggctgctgccaccgctgctgctgctgctagctctgctgctcgctgccagcccaggaggcgccttggcgcggtgcccaggctgcgggcaaggggtgcaggcgggttgtccagggggctgcgtggaggaggaggatggggggtcgccagccgagggctgcgcggaagctgagggctgtctcaggagggaggggcaggagtgcggggtctacacccctaactgcgccccaggactgcagtgccatccgcccaaggacgacgaggcgcctttgcgggcgctgctgctcggccgaggccgctgccttccggcccgcgcgcctgctgtcctgagctctccccggaccctccggaaactttctccagagccaggagcaacctgcagttgcagaggagaatcctaaggagagtaaaccccaagcaggcactgcccgcccacaggatgtgaaccgcagagaccaacagaggaatccaggcacctctaccacgccctcccagcccaattctgcgggtgtccaagacactgagatgggcccatgccgtagacatctggactcagtgctgcagcaactccagactgaggtctaccgaggggctcaaacactctacgtgcccaattgtgaccatcgaggcttctaccggaagcggcaggtg

SEQ ID NO: 576 - DNA, 1177 bp, Homo sapiens
gagattcccgggaacaaagcaagaaaaatcagagcaatttgggaagtaaacagaaactggaaagggagagggaaagaagagtggggaggacccaggttgggggggccctctccagtcccacccagtttagggaatgcccctgccctctcccccaccccccttcacctggctcttaaagggcccggcccctggccggcggctacttaagacagaggggcggcggcgggcagcagctgcgctgcgactgctctggaaggagaggacggggcacaaaccctgaccatgaccccccacaggctgctgccaccgctgctgctgctgctagctctgctgctcgctgccagcccaggaggcgccttggcgcggtgcccaggctgcgggcaaggggtgcaggcgggttgtccagggggctgcgtggaggaggaggatggggggtcgccagccgagggctgcgcggaagctgagggctgtctcaggagggaggggcaggagtgcggggtctacacccctaactgcgccccaggactgcagtgccatccgcccaaggacgacgaggcgcctttgcgggcgctgctgctcggccgaggccgctgccttccggcccgcgcgcctgctgaggagaatcctaaggagagtaaaccccaagcaggcactgcccgcccacaggatgtgaaccgcagagaccaacagaggaatccaggcacctctaccacgccctcccagcccaattctgcgggtgtccaagacactgagatgggcccatgccgtagacatctggactcagtgctgcagcaactccagactgaggtctaccgaggggctcaaacactctacgtgcccaattgtgaccatcgaggcttctaccggaagcggcagtgccgctcctcccaggggcagcgccgaggtccctgctggtgtgtggatcggatgggcaagtccctgccagggtctccagatggcaatggaagctcctcctgccccactgggagtagcggctaaagctgggggatagaggggctgcagggccactggaaggaacatggagctgtcatcactcaacaaaaaaccgaggccctcaatccaccttcaggccccgccccatgggcccctcaccgctggttggaaagagtgttggtgttggctggggtgtcaataaagctgtgcttggggtcgctgg

SEQ ID NO: 577 - DNA, 1093 bp, Homo sapiens
ccgccgctgtcccggagcaagccatgccgcgcttgtctctgctcttgccgctgctgcttctgctgctgctgccgctgctgccgccgctgtccccgagccttgggatccgcgacgtgggcggccggcgccccaagtgtggtccgtgccggccagagggctgcccggcgcctgcgccctgcccggcgcccgggatctcggcgctcgacgagtgcggctgctgcgcccgctgcctgggagccgagggcgcgagctgcgggggccgcgccggcgggcgctgtggccccggcctggtatgcgcgagccaggccgctggggcagcgcccgagggcaccgggctctgcgtgtgcgcgcagcgcggcaccgtctgcggctccgacggtcgctcgtaccccagcgtctgcgcgctgcgcctgcgcgctcggcacacgccccgcgcgcaccccggtcacctgcacaaggcgcgcgacggcccttgcgagttcgctcctgtggtcgtcgttcctccccgaagtgttcacaacgtcaccggggcgcaggtgggcctgtcctgtgaagtgagggctgtgcctaccccagtcatcacgtggagaaaggtcacgaagtcccctgagggcacccaagcactggaggagctgcctggggaccatgtcaatatagctgtccaagtgcgagggggcccttctgaccatgaggccacggcctggattttgatcaaccccctgcgaaaggaggatgagggtgtgtaccagtgccatgcagccaacatggtgggagaggctgagtcccacagcacagtgacggttctagatctgagtaaatacaggagcttccacttcccagctcccgatgaccgcatgtgatggagaaatggtcttagaaacattgatcatgggatgatggaaaagtcaaataacggatctttgtgcttcatgaagagttggaaaacctgtgtgtgtagatgaccccttttgtgtgtttttaaaaattagatgcaaactagatctgtatgcagatgtagtttttagcagggcaaacagtgagaaacggatttgcatgtggcttttttatacttttgaaatgaattgttccatga

SEQ ID NO: 578 - DNA, 1018 bp, Homo sapiens
agttggagtctccagggatcagggttccaggaactcaggatctgcagtgaggaccagacaccactgattgcaggaatgtgttccctccccatggcaagatactacatttccttcctgcctgagcctttacctgccaagagcctgcaacatggggttcccttgtcccttgactcttctctctcttccctcctagagaagatctgcatacttcctaacagaggcttggcccgcaccaaggtccccattttcctggggatccagggagggagccgctgcctggcatgtgtggagacagaagaggggccttccctacagctggaggatgtgaacattgaggaactgtacaaaggtggtgaagaggccacacgcttcaccttcttccagagcagctcaggctccgccttcaggcttgaggctgctgcctggcctggctggttcctgtgtggcccggcagagccccagcagccagtacagctcaccaaggagagtgagccctcagcccgtaccaagttttactttgaacagagctggtagggagacaggaaactgcgttttagccttgtgcccccaaaccaagctcatcctgctcagggtctatggtaggcagaataatgtcccccgaaatatgtccacatcctaatcccaagatctgtgcatatgttaccatacatgtccaaagaggttttgcaaatgtgattatgttaaggatcttgaaatgaggagacaatcctgggttatccttgtgggctcagtttaatcacaagaaggaggcaggaagggagagtcagagagagaatggaagataccatgcttctaattttgaagatggagtgaggggccttgagccaacaaatgcaggtgtttttagaaggtggaaaagccaagggaacggattctcctctagagtctccggaaggaacacagctcttgacacatggatttcagctcagtgacacccatttcagacttctgacctccacaactataaaataataaacttgtgttattgtaaacctct

SEQ ID NO: 579 - DNA, 1013 bp, Homo sapiens
agttggagtctccagggatcagggttccaggaactcaggatctgcagtgaggaccagacaccactgattgcaggaatgtgttccctccccatggcaagatactacataattaaatatgcagaccagaaggctctatacacaagagatggccagctgctggtgggagatcctgttgcagacaactgctgtgcagagaagatctgcatacttcctaacagaggcttggcccgcaccaaggtccccattttcctggggatccagggagggagccgctgcctggcatgtgtggagacagaagaggggccttccctacagctggaggatgtgaacattgaggaactgtacaaaggtggtgaagaggccacacgcttcaccttcttccagagcagctcaggctccgccttcaggcttgaggctgctgcctggcctggctggttcctgtgtggcccggcagagccccagcagccagtacagctcaccaaggagagtgagccctcagcccgtaccaagttttactttgaacagagctggtagggagacaggaaactgcgttttagccttgtgcccccaaaccaagctcatcctgctcagggtctatggtaggcagaataatgtcccccgaaatatgtccacatcctaatcccaagatctgtgcatatgttaccatacatgtccaaagaggttttgcaaatgtgattatgttaaggatcttgaaatgaggagacaatcctgggttatccttgtgggctcagtttaatcacaagaaggaggcaggaagggagagtcagagagagaatggaagataccatgcttctaattttgaagatggagtgaggggccttgagccaacaaatgcaggtgtttttagaaggtggaaaagccaagggaacggattctcctctagagtctccggaaggaacacagctcttgacacatggatttcagctcagtgacacccatttcagacttctgacctccacaactataaaataataaacttgtgttattgtaaa

SEQ ID NO: 580 - DNA, 1366 bp, Homo sapiens
ggcagtgggactgggtttgagctgggcttatcctccaactgtgagggaggctacagcacactccaccccactctcagggctgggaattgttgtggctcagctatttgggggaatctgttttccagtttctcagaaccagcgcaagcacacacatcccaggctcacacccctggtggctggacttgctcccggatagcctcagtcagggagaggcagagctgcctggagcctgctgggctggtggaagccttggtggattctggcaggccaattatagacgaatggcctggggaacccgtgcagcccttggctgagtggttctaagccccagcacgtctgcctctggcttcacccagcctccttttctaactgcccttctctcctccccatcagtgaggaccagacaccactgattgcaggaatgtgttccctccccatggcaagatactacataattaaatatgcagaccagaaggctctatacacaagagatggccagctgctggtgggagatcctgttgcagacaactgctgtgcagagaagatctgcatacttcctaacagaggcttggcccgcaccaaggtccccattttcctggggatccagggagggagccgctgcctggcatgtgtggagacagaagaggggccttccctacagctggaggatgtgaacattgaggaactgtacaaaggtggtgaagaggccacacgcttcaccttcttccagagcagctcaggctccgccttcaggcttgaggctgctgcctggcctggctggttcctgtgtggcccggcagagccccagcagccagtacagctcaccaaggagagtgagccctcagcccgtaccaagttttactttgaacagagctggtagggagacaggaaactgcgttttagccttgtgcccccaaaccaagctcatcctgctcagggtctatggtaggcagaataatgtcccccgaaatatgtccacatcctaatcccaagatctgtgcatatgttaccatacatgtccaaagaggttttgcaaatgtgattatgttaaggatcttgaaatgaggagacaatcctgggttatccttgtgggctcagtttaatcacaagaaggaggcaggaagggagagtcagagagagaatggaagataccatgcttctaattttgaagatggagtgaggggccttgagccaacaaatgcaggtgtttttagaaggtggaaaagccaagggaacggattctcctctagagtctccggaaggaacacagctcttgacacatggatttcagctcagtgacacccatttcagacttctgacctccacaactataaaataataaacttgtgttattgtaaacctctaa

SEQ ID NO: 581 - DNA, 2124 bp, Homo sapiens
ttccctgtaaattccccgttttgacgacgcacttgtagccacgtagccacgcctacttaagacaattacaaaaggcgaagaagactgactcaggcttaagctgccagccagagagggagtcatttcattggcgtttgagtcagcaaagaagtcaagatggccaaagttccagacatgtttgaagacctgaagaactgttacagtgaaaatgaagaagacagttcctccattgatcatctgtctctgaatcagaaatccttctatcatgtaagctatggcccactccatgaaggctgcatggatcaatctgtgtctctgagtatctctgaaacctctaaaacatccaagcttaccttcaaggagagcatggtggtagtagcaaccaacgggaaggttctgaagaagagacggttgagtttaagccaatccatcactgatgatgacctggaggccatcgccaatgactcagaggaagaaatcatcaagcctaggtcagcaccttttagcttcctgagcaatgtgaaatacaactttatgaggatcatcaaatacgaattcatcctgaatgacgccctcaatcaaagtataattcgagccaatgatcagtacctcacggctgctgcattacataatctggatgaagcagtgaaatttgacatgggtgcttataagtcatcaaaggatgatgctaaaattaccgtgattctaagaatctcaaaaactcaattgtatgtgactgcccaagatgaagaccaaccagtgctgctgaaggagatgcctgagatacccaaaaccatcacaggtagtgagaccaacctcctcttcttctgggaaactcacggcactaagaactatttcacatcagttgcccatccaaacttgtttattgccacaaagcaagactactgggtgtgcttggcaggggggccaccctctatcactgactttcagatactggaaaaccaggcgtaggtctggagtctcacttgtctcacttgtgcagtgttgacagttcatatgtaccatgtacatgaagaagctaaatcctttactgttagtcatttgctgagcatgtactgagccttgtaattctaaatgaatgtttacactctttgtaagagtggaaccaacactaacatataatgttgttatttaaagaacaccctatattttgcatagtaccaatcattttaattattattcttcataacaattttaggaggaccagagctactgactatggctaccaaaaagactctacccatattacagatgggcaaattaaggcataagaaaactaagaaatatgcacaatagcagttgaaacaagaagccacagacctaggatttcatgatttcatttcaactgtttgccttctacttttaagttgctgatgaactcttaatcaaatagcataagtttctgggacctcagttttatcattttcaaaatggagggaataatacctaagccttcctgccgcaacagttttttatgctaatcagggaggtcattttggtaaaatacttcttgaagccgagcctcaagatgaaggcaaagcacgaaatgttattttttaattattatttatatatgtatttataaatatatttaagataattataatatactatatttatgggaaccccttcatcctctgagtgtgaccaggcatcctccacaatagcagacagtgttttctgggataagtaagtttgatttcattaatacagggcattttggtccaagttgtgcttatcccatagccaggaaactctgcattctagtacttgggagacctgtaatcatataataaatgtacattaattaccttgagccagtaattggtccgatctttgactcttttgccattaaacttacctgggcattcttgtttcaattccacctgcaatcaagtcctacaagctaaaattagatgaactcaactttgacaaccatgagaccactgttatcaaaactttcttttctggaatgtaatcaatgtttcttctaggttctaaaaattgtgatcagaccataatgttacattattatcaacaatagtgattgatagagtgttatcagtcataactaaataaagcttgcaacaaaattctctgaca

SEQ ID NO: 582 - DNA, 2354 bp, Homo sapiens
gctcagggcacatgcctcccctccccaggccgcggcccagctgaccctcggggctcccccggcagcggacagggaagggttaaaggcccccggctccctgccccctgccctggggaacccctggccctgtggggacatgaactgtgtttgccgcctggtcctggtcgtgctgagcctgtggccagatacagctgtcgcccctgggccaccacctggcccccctcgagtttccccagaccctcgggccgagctggacagcaccgtgctcctgacccgctctctcctggcggacacgcggcagctggctgcacagctgagggacaaattcccagctgacggggaccacaacctggattccctgcccaccctggccatgagtgcgggggcactgggagctctacagctcccaggtgtgctgacaaggctgcgagcggacctactgtcctacctgcggcacgtgcagtggctgcgccgggcaggtggctcttccctgaagaccctggagcccgagctgggcaccctgcaggcccgactggaccggctgctgcgccggctgcagctcctgatgtcccgcctggccctgccccagccacccccggacccgccggcgcccccgctggcgcccccctcctcagcctgggggggcatcagggccgcccacgccatcctgggggggctgcacctgacacttgactgggccgtgaggggactgctgctgctgaagactcggctgtgacccggggcccaaagccaccaccgtccttccaaagccagatcttatttatttatttatttcagtactgggggcgaaacagccaggtgatccccccgccattatctccccctagttagagacagtccttccgtgaggcctggggggcatctgtgccttatttatacttatttatttcaggagcaggggtgggaggcaggtggactcctgggtccccgaggaggaggggactggggtcccggattcttgggtctccaagaagtctgtccacagacttctgccctggctcttccccatctaggcctgggcaggaacatatattatttatttaagcaattacttttcatgttggggtggggacggaggggaaagggaagcctgggtttttgtacaaaaatgtgagaaacctttgtgagacagagaacagggaattaaatgtgtcatacatatccacttgagggcgatttgtctgagagctggggctggatgcttgggtaactggggcagggcaggtggaggggagacctccattcaggtggaggtcccgagtgggcggggcagcgactgggagatgggtcggtcacccagacagctctgtggaggcagggtctgagccttgcctggggccccgcactgcatagggccttttgtttgttttttgagatggagtctcgctctgttgcctaggctggagtgcagtgaggcaatctgaggtcactgcaacctccacctcccgggttcaagcaattctcctgcctcagcctcccgattagctgggatcacaggtgtgcaccaccatgcccagctaattatttatttcttttgtatttttagtagagacagggtttcaccatgttggccaggctggtttcgaactcctgacctcaggtgatcctcctgcctcggcctcccaaagtgctgggattacaggtgtgagccaccacacctgacccataggtcttcaataaatatttaatggaaggttccacaagtcaccctgtgatcaacagtacccgtatgggacaaagctgcaaggtcaagatggttcattatggctgtgttcaccatagcaaactggaaacaatctagatatccaacagtgagggttaagcaacatggtgcatctgtggatagaacgccacccagccgcccggagcagggactgtcattcagggaggctaaggagagaggcttgcttgggatatagaaagatatcctgacattggccaggcatggtggctcacgcctgtaatcctggcactttgggaggacgaagcgagtggatcactgaagtccaagagttcgagaccggcctgcgagacatggcaaaaccctgtctcaaaaaagaaagaatgatgtcctgacatgaaacagcaggctacaaaaccactgcatgctgtgatcccaattttgtgtttttctttctatatatggattaaaacaaaaatcctaaagggaaatacgccaaaatgttgacaatgactgtctccaggtcaaaggagagaggtgggattgtgggtgacttttaatgtgtatgattgtctgtattttacagaatttctgccatgactgtgtattttgcatgacacattttaaaaataataaacactatttttagaat

SEQ ID NO: 583 - DNA, 2761 bp, Homo sapiens
gggcatacagttgttccatcccgacatgaactcagcctcccgtctgaccgccccttggccttccttcttcctcgatctgtggaacccagggaatctgcctagtgctgtctccaagcaccttggccatgatgtaaacccagagaaattagcatctccatctccttccttattccccacccaaaagtcatttcctcttagttcattacctgggattttgatgtctatgttccctcctcgttattgatacacacacagagagagacaaacaaaaaaggaacttcttgaaattcccccagaaggttttgagagttgttttcaatgttgcaacaagtcagtttctagtttaagtttccatcagaaaggagtagagtatataagttccagtaccagcaacagcagcagaagaaacaacatctgtttcagggccattggactctccgtcctgcccagagcaagatgtgtcaccagcagttggtcatctcttggttttccctggtttttctggcatctcccctcgtggccatatgggaactgaagaaagatgtttatgtcgtagaattggattggtatccggatgcccctggagaaatggtggtcctcacctgtgacacccctgaagaagatggtatcacctggaccttggaccagagcagtgaggtcttaggctctggcaaaaccctgaccatccaagtcaaagagtttggagatgctggccagtacacctgtcacaaaggaggcgaggttctaagccattcgctcctgctgcttcacaaaaaggaagatggaatttggtccactgatattttaaaggaccagaaagaacccaaaaataagacctttctaagatgcgaggccaagaattattctggacgtttcacctgctggtggctgacgacaatcagtactgatttgacattcagtgtcaaaagcagcagaggctcttctgacccccaaggggtgacgtgcggagctgctacactctctgcagagagagtcagaggggacaacaaggagtatgagtactcagtggagtgccaggaggacagtgcctgcccagctgctgaggagagtctgcccattgaggtcatggtggatgccgttcacaagctcaagtatgaaaactacaccagcagcttcttcatcagggacatcatcaaacctgacccacccaagaacttgcagctgaagccattaaagaattctcggcaggtggaggtcagctgggagtaccctgacacctggagtactccacattcctacttctccctgacattctgcgttcaggtccagggcaagagcaagagagaaaagaaagatagagtcttcacggacaagacctcagccacggtcatctgccgcaaaaatgccagcattagcgtgcgggcccaggaccgctactatagctcatcttggagcgaatgggcatctgtgccctgcagttaggttctgatccaggatgaaaatttggaggaaaagtggaagatattaagcaaaatgtttaaagacacaacggaatagacccaaaaagataatttctatctgatttgctttaaaacgtttttttaggatcacaatgatatctttgctgtatttgtatagttagatgctaaatgctcattgaaacaatcagctaatttatgtatagattttccagctctcaagttgccatgggccttcatgctatttaaatatttaagtaatttatgtatttattagtatattactgttatttaacgtttgtctgccaggatgtatggaatgtttcatactcttatgacctgatccatcaggatcagtccctattatgcaaaatgtgaatttaattttatttgtactgacaacttttcaagcaaggctgcaagtacatcagttttatgacaatcaggaagaatgcagtgttctgataccagtgccatcatacacttgtgatggatgggaacgcaagagatacttacatggaaacctgacaatgcaaacctgttgagaagatccaggagaacaagatgctagttcccatgtctgtgaagacttcctggagatggtgttgataaagcaatttagggccacttacacttctaagcaagtttaatctttggatgcctgaattttaaaagggctagaaaaaaatgattgaccagcctgggaaacataacaagaccccgtctctacaaaaaaaatttaaaattagccaggcgtggtggctcatgcttgtggtcccagctgttcaggaggatgaggcaggaggatctcttgagcccaggaggtcaaggctatggtgagccgtgattgtgccactgcataccagcctaggtgacagaatgagaccctgtctcaaaaaaaaaaatgattgaaattaaaattcagctttagcttccatggcagtcctcacccccacctctctaaaagacacaggaggatgacacagaaacaccgtaagtgtctggaaggcaaaaagatcttaagattcaagagagaggacaagtagttatggctaaggacatgaaattgtcagaatggcaggtggcttcttaacagccctgtgagaagcagacagatgcaaagaaaatctggaatccctttctcattagcatgaatgaacctgatacacaattatgaccagaaaatatggctccatgaaggtgctacttttaagtaatgtatgtgcgctctgtaaagtgattacatttgtttcctgtttgtttatttatttatttatttttgcattctgaggctgaactaataaaaactcttctttgtaatc

SEQ ID NO: 584 - DNA, 1283 bp, Homo sapiens
aagccacccagcctatgcatccgctcctcaatcctctcctgttggcactgggcctcatggcgcttttgttgaccacggtcattgctctcacttgccttggcggctttgcctccccaggccctgtgcctccctctacagccctcagggagctcattgaggagctggtcaacatcacccagaaccagaaggctccgctctgcaatggcagcatggtatggagcatcaacctgacagctggcatgtactgtgcagccctggaatccctgatcaacgtgtcaggctgcagtgccatcgagaagacccagaggatgctgagcggattctgcccgcacaaggtctcagctgggcagttttccagcttgcatgtccgagacaccaaaatcgaggtggcccagtttgtaaaggacctgctcttacatttaaagaaactttttcgcgagggacagttcaactgaaacttcgaaagcatcattatttgcagagacaggacctgactattgaagttgcagattcatttttctttctgatgtcaaaaatgtcttgggtaggcgggaaggagggttagggaggggtaaaattccttagcttagacctcagcctgtgctgcccgtcttcagcctagccgacctcagccttccccttgcccagggctcagcctggtgggcctcctctgtccagggccctgagctcggtggacccagggatgacatgtccctacacccctcccctgccctagagcacactgtagcattacagtgggtgccccccttgccagacatgtggtgggacagggacccacttcacacacaggcaactgaggcagacagcagctcaggcacacttcttcttggtcttatttattattgtgtgttatttaaatgagtgtgtttgtcaccgttggggattggggaagactgtggctgctagcacttggagccaagggttcagagactcagggccccagcactaaagcagtggacaccaggagtccctggtaataagtactgtgtacagaattctgctacctcactggggtcctggggcctcggagcctcatccgaggcagggtcaggagaggggcagaacagccgctcctgtctgccagccagcagccagctctcagccaacgagtaatttattgtttttccttgtatttaaatattaaatatgttagcaaagagttaatatatagaagggtaccttgaacactgggggaggggacattgaacaagttgtttcattgactatcaaactgaagccagaaataaagttggtgacagata

SEQ ID NO: 585 - DNA, 3999 bp, Homo sapiens
atggagtcgcacagccgcgctggaaagagcagaaaatctgcaaaatttcggtccatctccaggtccctgatgctctgtaatgctaagaccagtgatgatggctctagccctgatgagaaatatcctgatccctttgagatttccttggcccagggcaaggagggaattttccactcatctgtgcagctggcagacacatcggaggctgggcccagcagtgttcctgatctagcactggcctcggaggctgctcaactccaagcagctgggaatgatcgaggcaagacctgtaggaggatattcttcatgaaggaatcttccacagcttcctctcgagaaaagcctggaaaactagaagcacaaagtagtaacttcctgtttcctaaagcctgccaccaaagggcacgcagcaactcaaccagtgttaatccctattgcacaagagaaattgattttccaatgaccaagaaatctgcagcgcccacggacaggcagccttactctctctgcagtaacaggaagtccctctctcaacaattggactgtccagcaggaaaggctgcgggaacttcgagaccaacacggtccctgagcacagctcagctcgtgcagccatctgggggcctccaggcttcagtcatctccaacatcgtgctgatgaagggccaggctaagggtctgggcttcagcatcgttgggggaaaagacagcatttatggccccattgggatttacgtcaaaaccatttttgcagggggagcagcagcagccgatggaaggctacaggaaggtgatgaaattctggagctcaatggtgaatcaatggctggactaacacatcaggatgctttgcagaagttcaagcaagccaaaaaggggctcctcaccctcaccgtgagaacccgcctgacggcgcctccttccctgtgcagccacctgtctcccccactgtgccgctccctgagctccagcacttgtatcaccaaggacagcagctccttcgccttggaaagcccctcggctcccatcagcaccgccaagcccaattacagaatcatggtggaggtttctctgcagaaagaggccggcgtgggcctgggcatcggcctgtgcagcgttccctacttccaatgcatctctggcattttcgtccacacgctgtcaccaggatccgtggcgcacctggacggacgtctccggtgtggggacgagattgtggaaatcagtgattcccctgtgcactgcctgacgctcaatgaagtctacacgatcctgagtcactgtgatcccggtccagtccccatcattgttagccgacatccagacccacaggtctctgaacagcaactcaaagaagctgtggcccaggctgtggaaaacaccaagtttggaaaggagaggcatcagtggagtctggaaggtgtcaaaaggctggaaagcagttggcacgggcggcccaccttggagaaggaacgagagaagaactcagcacccccgcatcgcagggctcagaaggtcatgatccgctccagcagtgacagcagctacatgtctgggtccccagggggaagtcctgggagtggcagtgctgagaagccgtcctctgacgtggacatcagcacacacagccccagcttgcctctggcacgggagccagtggtgctttctatagcatcctccaggctgccccaggagagcccacccctcccagagagccgggacagccacccgccgctgagactgaagaaatcctttgagattttggtgagaaagcctatgtcctccaagcccaagcctccacccagaaaatactttaaaagtgacagtgaccctcagaagagtctggaagagagagagaactcctcatgctcttctgggcacaccccacccacctgtggccaggaagcgagagagctgctgccactgctgctaccacaggaagacacagcagggagaagccctagtgcctctgccggctgcccaggacctggtatcggcccacagaccaagtcctccacagagggcgagccagggtggagaagagccagcccagtgacccaaacatccccgataaaacacccactgcttaagaggcaggctcggatggactatagctttgataccacagccgaagacccttgggttaggatttctgactgcatcaaaaacttatttagccccatcatgagtgagaaccatggccacatgcctctacagcccaatgccagcctgaatgaagaagaagggacacagggccacccagatgggaccccaccaaagctggacaccgccaatggcactcccaaagtttacaagtcagcagacagcagcactgtgaagaaaggtcctcctgtggctcccaagccagcctggtttcgccaaagcttgaaaggtttgaggaatcgtgcttcagacccaagagggctccctgatcctgccttgtccacccagccagcacctgcttccagggagcacctaggatcacacatccgggcctcctcctcctcctcctccatcaggcagagaatcagctcctttgaaacctttggctcctctcaactgcctgacaaaggagcccagagactgagcctccagccctcctctggggaggcagcaaaacctcttgggaagcatgaggaaggacggttttctggactcttggggcgaggggctgcacccactcttgtgccccagcagcctgagcaagtactgtcctcggggtcccctgcagcctccgaggccagagacccaggtgtgtctgagtcccctcccccagggcggcagcccaatcagaaaactctcccccctggcccggacccgctcctaaggctgctgtcaacacaggctgaggaatctcaaggcccagtgctcaagatgcctagccagcgagcacggagcttccccctgaccaggtcccagtcctgtgagacgaagctacttgacgaaaagaccagcaaactctattctatcagcagccaagtgtcatcggctgtcatgaaatccttgctgtgccttccatcttctatctcctgtgcccagactccctgcatccccaaggaaggggcatctccaacatcatcatccaacgaagactcagctgcaaatggttctgctgaaacatctgccttggacacagggttctcgctcaacctttcagagctgagagaatatacagagggtctcacggaagccaaggaagacgatgatggggaccacagttcccttcagtctggtcagtccgttatctccctgctgagctcagaagaattaaaaaaactcatcgaggaggtgaaggttctggatgaagcaacattaaagcaattagacggcatccatgtcaccatcttacacaaggaggaaggtgctggtcttgggttcagcttggcaggaggagcagatctagaaaacaaggtgattacggttcacagagtgtttccaaatgggctggcctcccaggaagggactattcagaagggcaatgaggttctttccatcaacggcaagtctctcaaggggaccacgcaccatgatgccttggccatcctccgccaagctcgagagcccaggcaagctgtgattgtcacaaggaagctgactccagaggccatgcccgacctcaactcctccactgactctgcagcctcagcctctgcagccagtgatgtttctgtagaatctacagcagaggccacagtctgcacggtgacactggagaagatgtcggcagggctgggcttcagcctggaaggagggaagggctccctacacggagacaagcctctcaccattaacaggattttcaaaggagcagcctcagaacaaagtgagacagtccagcctggagatgaaatcttacagctgggtggcactgccatgcagggcctcacacggtttgaagcctggaacatcatcaaggcactgcctgatggacctgtcacgattgtcatcaggagaaaaagcctccagtccaaggaaaccacagctgctggagactcctag

SEQ ID NO: 586 - DNA, 2930 bp, Homo sapiens
agaaagcttgaatgattttcccaacccaaagtcatacagctcgccagggaccaacaccaagactgccatactccagatccacagtgacttcagataagaagcagatggccgatgtgcagtgtgctgcccgtggcagtcacaggtgtcaaaaggctggaaagcagttggcacgggcggcccaccttggagaaggaacgagagaagaactcagcacccccgcatcgcagggctcagaaggtcatgatccgctccagcagtgacagcagctacatgtctgggtccccagggggaagtcctgggagtggcagtgctgagaagccgtcctctgacgtggacatcagcacacacagccccagcttgcctctggcacgggagccagtggtgctttctatagcatcctccaggctgccccaggagagcccacccctcccagagagccgggacagccacccgccgctgagactgaagaaatcctttgagattttggtgagaaagcctatgtcctccaagcccaagcctccacccagaaaatactttaaaagtgacagtgaccctcagaagagtctggaagagagagagaactcctcatgctcttctgggcacaccccacccacctgtggccaggaagcgagagagctgctgccactgctgctaccacaggaagacacagcagggagaagccctagtgcctctgccggctgcccaggacctggtatcggcccacagaccaagtcctccacagagggcgagccagggtggagaagagccagcccagtgacccaaacatccccgataaaacacccactgcttaagaggcaggctcggatggactatagctttgataccacagccgaagacccttgggttaggatttctgactgcatcaaaaacttatttagccccatcatgagtgagaaccatggccacatgcctctacagcccaatgccagcctgaatgaagaagaagggacacagggccacccagatgggaccccaccaaagctggacaccgccaatggcactcccaaagtttacaagtcagcagacagcagcactgtgaagaaaggtcctcctgtggctcccaagccagcctggtttcgccaaagcttgaaaggtttgaggaatcgtgcttcagacccaagagggctccctgatcctgccttgtccacccagccagcacctgcttccagggagcacctaggatcacacatccgggcctcctcctcctcctcctccatcaggcagagaatcagctcctttgaaacctttggctcctctcaactgcctgacaaaggagcccagagactgagcctccagccctcctctggggaggcagcaaaacctcttgggaagcatgaggaaggacggttttctggactcttggggcgaggggctgcacccactcttgtgccccagcagcctgagcaagtactgtcctcggggtcccctgcagcctccgaggccagagacccaggtgtgtctgagtcccctcccccagggcggcagcccaatcagaaaactctcccccctggcccggacccgctcctaaggctgctgtcaacacaggctgaggaatctcaaggcccagtgctcaagatgcctagccagcgagcacggagcttccccctgaccaggtcccagtcctgtgagacgaagctacttgacgaaaagaccagcaaactctattctatcagcagccaagtgtcatcggctgtcatgaaatccttgctgtgccttccatcttctatctcctgtgcccagactccctgcatccccaaggaaggggcatctccaacatcatcatccaacgaagactcagctgcaaatggttctgctgaaacatctgccttggacacagggttctcgctcaacctttcagagctgagagaatatacagagggtctcacggaagccaaggaagacgatgatggggaccacagttcccttcagtctggtcagtccgttatctccctgctgagctcagaagaattaaaaaaactcatcgaggaggtgaaggttctggatgaagcaacattaaagcaattagacggcatccatgtcaccatcttacacaaggaggaaggtgctggtcttgggttcagcttggcaggaggagcagatctagaaaacaaggtgattacggttcacagagtgtttccaaatgggctggcctcccaggaagggactattcagaagggcaatgaggttctttccatcaacggcaagtctctcaaggggaccacgcaccatgcccgacctcaactcctccactgactctgcagcctcagcctctgcagccagtgatgtttctgtagaatctacagaggccacagtctgcacggtgacactggagaagatgtcggcagggctgggcttcagcctggaaggagggaagggctccctacacggagacaagcctctcaccattaacaggattttcaaaggagcagcctcagaacaaagtgagacagtccagcctggagatgaaatcttacagctgggtggcactgccatgcagggcctcacacggtttgaagcctggaacatcatcaaggcactgcctgatggacctgtcacgattgtcatcaggagaaaaagcctccagtccaaggaaaccacagctgctggagactcctaggcaggacatgctgaagccaaagccaataacacacagctaacacacagctcccataaccgctgattctcagggtctctgctgccgccccacccagatgggggaaagcacaggtgggcttcccagtggctgctgcccaggcccagaccttctaggacgccacccagcaaaaggttgttcctaaaataagggcagagtcacacgggggcagctgatacaaattgcagactgtgtaaaaagagagcttaatgataatattgtggtgccacaaataaaatggatttattagaatttc

SEQ ID NO: 587 - DNA, 3996 bp, Homo sapiens
acatttgtcctgagtcacctgtccagagcaggtggtgaatattgtgtcctactcacggcatctcaactatcggagcctgggatctgactcaaaggccggcctccgtctgagaactgagcgtccatttctcaatccttgccggctctgacccaggcctgggccacaggctgtccgggaataagtggtgctgcaatccctgctgggcagatggagagaggagcaagggagatggcagccccgggggactgtccagcaggaaaggctgcgggaacttcgagaccaacacggtccctgagcacagctcagctcgtgcagccatctgggggcctccaggcttcagtcatctccaacatcgtgctgatgaagggccaggctaagggtctgggcttcagcatcgttgggggaaaagacagcatttatggccccattgggatttacgtcaaaaccatttttgcagggggagcagcagcagccgatggaaggctacaggaaggtgatgaaattctggagctcaatggtgaatcaatggctggactaacacatcaggatgctttgcagaagttcaagcaagccaaaaaggggctcctcaccctcaccgtgagaacccgcctgacggcgcctccttccctgtgcagccacctgtctcccccactgtgccgctccctgagctccagcacttgtatcaccaaggacagcagctccttcgccttggaaagcccctcggctcccatcagcaccgccaagcccaattacagaatcatggtggaggtttctctgcagaaagaggccggcgtgggcctgggcatcggcctgtgcagcgttccctacttccaatgcatctctggcattttcgtccacacgctgtcaccaggatccgtggcgcacctggacggacgtctccggtgtggggacgagattgtggaaatcagtgattcccctgtgcactgcctgacgctcaatgaagtctacacgatcctgagtcactgtgatcccggtccagtccccatcattgttagccgacatccagacccacaggtctctgaacagcaactcaaagaagctgtggcccaggctgtggaaaacaccaagtttggaaaggagaggcatcagtggagtctggaaggtgtcaaaaggctggaaagcagttggcacgggcggcccaccttggagaaggaacgagagaagaactcagcacccccgcatcgcagggctcagaaggtcatgatccgctccagcagtgacagcagctacatgtctgggtccccagggggaagtcctgggagtggcagtgctgagaagccgtcctctgacgtggacatcagcacacacagccccagcttgcctctggcacgggagccagtggtgctttctatagcatcctccaggctgccccaggagagcccacccctcccagagagccgggacagccacccgccgctgagactgaagaaatcctttgagattttggtgagaaagcctatgtcctccaagcccaagcctccacccagaaaatactttaaaagtgacagtgaccctcagaagagtctggaagagagagagaactcctcatgctcttctgggcacaccccacccacctgtggccaggaagcgagagagctgctgccactgctgctaccacaggaagacacagcagggagaagccctagtgcctctgccggctgcccaggacctggtatcggcccacagaccaagtcctccacagagggcgagccagggtggagaagagccagcccagtgacccaaacatccccgataaaacacccactgcttaagaggcaggctcggatggactatagctttgataccacagccgaagacccttgggttaggatttctgactgcatcaaaaacttatttagccccatcatgagtgagaaccatggccacatgcctctacagcccaatgccagcctgaatgaagaagaagggacacagggccacccagatgggaccccaccaaagctggacaccgccaatggcactcccaaagtttacaagtcagcagacagcagcactgtgaagaaaggtcctcctgtggctcccaagccagcctggtttcgccaaagcttgaaaggtttgaggaatcgtgcttcagacccaagagggctccctgatcctgccttgtccacccagccagcacctgcttccagggagcacctaggatcacacatccgggcctcctcctcctcctcctccatcaggcagagaatcagctcctttgaaacctttggctcctctcaactgcctgacaaaggagcccagagactgagcctccagccctcctctggggaggcagcaaaacctcttgggaagcatgaggaaggacggttttctggactcttggggcgaggggctgcacccactcttgtgccccagcagcctgagcaagtactgtcctcggggtcccctgcagcctccgaggccagagacccaggtgtgtctgagtcccctcccccagggcggcagcccaatcagaaaactctcccccctggcccggacccgctcctaaggctgctgtcaacacaggctgaggaatctcaaggcccagtgctcaagatgcctagccagcgagcacggagcttccccctgaccaggtcccagtcctgtgagacgaagctacttgacgaaaagaccagcaaactctattctatcagcagccaagtgtcatcggctgtcatgaaatccttgctgtgccttccatcttctatctcctgtgcccagactccctgcatccccaaggaaggggcatctccaacatcatcatccaacgaagactcagctgcaaatggttctgctgaaacatctgccttggacacagggttctcgctcaacctttcagagctgagagaatatacagagggtctcacggaagccaaggaagacgatgatggggaccacagttcccttcagtctggtcagtccgttatctccctgctgagctcagaagaattaaaaaaactcatcgaggaggtgaaggttctggatgaagcaacattaaagcaattagacggcatccatgtcaccatcttacacaaggaggaaggtgctggtcttgggttcagcttggcaggaggagcagatctagaaaacaaggtgattacggttcacagagtgtttccaaatgggctggcctcccaggaagggactattcagaagggcaatgaggttctttccatcaacggcaagtctctcaaggggaccacgcaccatgatgccttggccatcctccgccaagctcgagagcccaggcaagctgtgattgtcacaaggaagctgactccagaggccatgcccgacctcaactcctccactgactctgcagcctcagcctctgcagccagtgatgtttctgtagaatctacagaggccacagtctgcacggtgacactggagaagatgtcggcagggctgggcttcagcctggaaggagggaagggctccctacacggagacaagcctctcaccattaacaggattttcaaaggagcagcctcagaacaaagtgagacagtccagcctggagatgaaatcttacagctgggtggcactgccatgcagggcctcacacggtttgaagcctggaacatcatcaaggcactgcctgatggacctgtcacgattgtcatcaggagaaaaagcctccagtccaaggaaaccacagctgctggagactcctaggcaggacatgctgaagccaaagccaataacacacagctaacacacagctcccataaccgctgattctcagggtctctgctgccgccccacccagatgggggaaagcacaggtgggcttcccagtggctgctgcccaggcccagaccttctaggacgccacccagcaaaaggttgttcctaaaataagggcagagtcacacgggggcagctgatacaaattgcagactgtgtaaaaagagagcttaatgataatattgtggtgccacaaataaaatggatttattagaatttcatatg

SEQ ID NO: 588 - DNA, 2397 bp, Homo sapiens
ctgtttacaccacaggaagcgagagagctgctgccactgctgctaccacaggaagacacagcagggagaagccctagtgcctctgccggctgcccaggacctggtatcggcccacagaccaagtcctccacagagggcgagccagggtggagaagagccagcccagtgacccaaacatccccgataaaacacccactgcttaagaggcaggctcggatggactatagctttgataccacagccgaagacccttgggttaggatttctgactgcatcaaaaacttatttagccccatcatgagtgagaaccatggccacatgcctctacagcccaatgccagcctgaatgaagaagaagggacacagggccacccagatgggaccccaccaaagctggacaccgccaatggcactcccaaagtttacaagtcagcagacagcagcactgtgaagaaaggtcctcctgtggctcccaagccagcctggtttcgccaaagcttgaaaggtttgaggaatcgtgcttcagacccaagagggctccctgatcctgccttgtccacccagccagcacctgcttccagggagcacctaggatcacacatccgggcctcctcctcctcctcctccatcaggcagagaatcagctcctttgaaacctttggctcctctcaactgcctgacaaaggagcccagagactgagcctccagccctcctctggggaggcagcaaaacctcttgggaagcatgaggaaggacggttttctggactcttggggcgaggggctgcacccactcttgtgccccagcagcctgagcaagtactgtcctcggggtcccctgcagcctccgaggccagagacccaggtgtgtctgagtcccctcccccagggcggcagcccaatcagaaaactctcccccctggcccggacccgctcctaaggctgctgtcaacacaggctgaggaatctcaaggcccagtgctcaagatgcctagccagcgagcacggagcttccccctgaccaggtcccagtcctgtgagacgaagctacttgacgaaaagaccagcaaactctattctatcagcagccaagtgtcatcggctgtcatgaaatccttgctgtgccttccatcttctatctcctgtgcccagactccctgcatccccaaggaaggggcatctccaacatcatcatccaacgaagactcagctgcaaatggttctgctgaaacatctgccttggacacagggttctcgctcaacctttcagagctgagagaatatacagagggtctcacggaagccaaggaagacgatgatggggaccacagttcccttcagtctggtcagtccgttatctccctgctgagctcagaagaattaaaaaaactcatcgaggaggtgaaggttctggatgaagcaacattaaagcaattagacggcatccatgtcaccatcttacacaaggaggaaggtgctggtcttgggttcagcttggcaggaggagcagatctagaaaacaaggtgattacggttcacagagtgtttccaaatgggctggcctcccaggaagggactattcagaagggcaatgaggttctttccatcaacggcaagtctctcaaggggaccacgcaccatgatgccttggccatcctccgccaagctcgagagcccaggcaagctgtgattgtcacaaggaagctgactccagaggccatgcccgacctcaactcctccactgactctgcagcctcagcctctgcagccagtgatgtttctgtagaatctacagcagaggccacagtctgcacggtgacactggagaagatgtcggcagggctgggcttcagcctggaaggagggaagggctccctacacggagacaagcctctcaccattaacaggattttcaaaggagcagcctcagaacaaagtgagacagtccagcctggagatgaaatcttacagctgggtggcactgccatgcagggcctcacacggtttgaagcctggaacatcatcaaggcactgcctgatggacctgtcacgattgtcatcaggagaaaaagcctccagtccaaggaaaccacagctgctggagactcctaggcaggacatgctgaagccaaagccaataacacacagctaacacacagctcccataaccgctgattctcagggtctctgctgccgccccacccagatgggggaaagcacaggtgggcttcccagtggctgctgcccaggcccagaccttctaggacgccacccagcaaaaggttgttcctaaaataagggcagagtcacacgggggcagctgatacaaattgcagactgtgtaaaaagagagcttaatgataatattgtggtgccacaaataaaatggatttatta

SEQ ID NO: 589 - DNA, 6131 bp, Homo sapiens
atgtggctgcctgtaaaagagctaacaattcatgaatgtcaacagatgtcaacttacagagctcccaaccaggaagcgagagagctgctgccactgctgctaccacaggaagacacagcagggagaagccctagtgcctctgccggctgcccaggacctggtatcggcccacagaccaagtcctccacagagggcgagccagggtggagaagagccagcccagtgacccaaacatccccgataaaacacccactgcttaagaggcaggctcggatggactatagctttgataccacagccgaagacccttgggttaggatttctgactgcatcaaaaacttatttagccccatcatgagtgagaaccatggccacatgcctctacagcccaatgccagcctgaatgaagaagaagggacacagggccacccagatgggaccccaccaaagctggacaccgccaatggcactcccaaagtttacaagtcagcagacagcagcactgtgaagaaaggtcctcctgtggctcccaagccagcctggtttcgccaaagcttgaaaggtttgaggaatcgtgcttcagacccaagagggctccctgatcctgccttgtccacccagccagcacctgcttccagggagcacctaggatcacacatccgggcctcctcctcctcctcctccatcaggcagagaatcagctcctttgaaacctttggctcctctcaactgcctgacaaaggagcccagagactgagcctccagccctcctctggggaggcagcaaaacctcttgggaagcatgaggaaggacggttttctggactcttggggcgaggggctgcacccactcttgtgccccagcagcctgagcaagtactgtcctcggggtcccctgcagcctccgaggccagagacccaggtgtgtctgagtcccctcccccagggcggcagcccaatcagaaaactctcccccctggcccggacccgctcctaaggctgctgtcaacacaggctgaggaatctcaaggcccagtgctcaagatgcctagccagcgagcacggagcttccccctgaccaggtcccagtcctgtgagacgaagctacttgacgaaaagaccagcaaactctattctatcagcagccaagtgtcatcggctgtcatgaaatccttgctgtgccttccatcttctatctcctgtgcccagactccctgcatccccaaggaaggggcatctccaacatcatcatccaacgaagactcagctgcaaatggttctgctgaaacatctgccttggacacagggttctcgctcaacctttcagagctgagagaatatacagagggtctcacggaagccaaggaagacgatgatggggaccacagttcccttcagtctggtcagtccgttatctccctgctgagctcagaagaattaaaaaaactcatcgaggaggtgaaggttctggatgaagcaacattaaagcaattagacggcatccatgtcaccatcttacacaaggaggaaggtgctggtcttgggttcagcttggcaggaggagcagatctagaaaacaaggtgattacggttcacagagtgtttccaaatgggctggcctcccaggaagggactattcagaagggcaatgaggttctttccatcaacggcaagtctctcaaggggaccacgcaccatgatgccttggccatcctccgccaagctcgagagcccaggcaagctgtgattgtcacaaggaagctgactccagaggccatgcccgacctcaactcctccactgactctgcagcctcagcctctgcagccagtgatgtttctgtagaatctacagaggccacagtctgcacggtgacactggagaagatgtcggcagggctgggcttcagcctggaaggagggaagggctccctacacggagacaagcctctcaccattaacaggattttcaaaggagcagcctcagaacaaagtgagacagtccagcctggagatgaaatcttacagctgggtggcactgccatgcagggcctcacacggtttgaagcctggaacatcatcaaggcactgcctgatggacctgtcacgattgtcatcaggagaaaaagcctccagtccaaggaaaccacagctgctggagactcctaggcaggacatgctgaagccaaagccaataacacacagctaacacacagctcccataaccgctgattctcagggtctctgctgccgccccacccagatgggggaaagcacaggtgggcttcccagtggctgctgcccaggcccagaccttctaggacgccacccagcaaaaggttgttcctaaaataagggcagagtcacacgggggcagctgatacaaattgcagactgtgtaaaaagagagcttaatgataatattgtggtgccacaaataaaatggatttattagaatttcatatgacattcatgcctggcttcgcaaaatgtttcaagtactgtaactgtgtcatgattcacccccaaacagtgacatttatttttctcatgaatctgcaatgtgggcagagattggaatgggcagctcatctctgtcccacttggcatcagctggcgtcatgcaaagtcatgcaaaggctgggaccacgtgagatcattcactcatacatctggccgttgatgttggctgggaactcacctggggctgctggcctgaatgcttataggtggcctctccttgtggcctgggcctcctcacaacatggtgtctggattcccaggatgagcatcccaggatcgcaagagccatgtagaagctgcatcttgtttatacctttgccttggaagttgcatggcatcacctccaccatactccatcagttagagctgacacaaacctgcctgggtttaaggggagaggaaatattgctggggtcatttatgaaaaatacagtttgtcacatgaaacatttgcaaaattgtttttggttggattggagaagtaatcctagggaagggtggtggagccagtaaacagaggagtacaggtgaagcaccaagctcaaagcgtggacaggtgtgccgacagaaggaaccagcgtgtatatgagggtatcaaataaaattgctactacttacctaccacatgccaagcactgtgctcagggctaaacgggcattgcctttagtgatcacagcagcttctacggtgtatggttctgtgccaatgtattgataagagggcacacactgtgtacagtaaatggcttatccagctggtgagtgatgcggcagattgagttttcttctgtgattcggtggagactatcagcccaagatgctttaagtgcacaacattacagggaatgcctgagtgcctggccaaagggatatttggtttggccatctctggatgcctgattgccaagctcaggaccaggcaatgtgactttgcatcagcaacaaccagcatcccttgaccaggcctgggccagagtattggtctcctctcagcccctgatcctgtgaagtaaggatgtgggggaagacctggcaaggacacagatgaaacacaaacaatagtaattctcaggccatcatcagtggagccatgttaatgtaatctgatggcttctccagggtccacaggaagtgaagaatctgtttcccagcagtggactcaaaacccatctgggctcctaaccttcctgtaaacccctttagtggcttcattagagcaggcgttcagctcactgttctattcatctcaaggaataatgggcttagagcagtttctgtcctgctggttaacttgtttggcctattccattctggattttgtcaagcagtagacaagcaattagacaagaacttggaggcaccatttgtatccactttttagacttaatagaaacattgaagatgaacataatctaccaacgaaagacgtgattcaattcaacactcccttcccatgacccaggctgggcaaggaggccacgtgatgtggagggcacattccttgcctgcacaaactcaccatctgtgcacgcagtggccttccctaaaatcagggaattgttttaagtcttatcaagcagccaagggatgaaagagaaggtgggttttcatcaagactggaaggtggggacagggatgagcatggagctggccgtgggcctggggtaccaagagactccttgagagaccaggcaaagcaagtgattgggacagaggttatctgtcccaggttatctgggcatagatgcaggtgagcccatggccctcccagtacctcctgtctctggcctgttttagaaggttctctcctccccaaggagacacaacaactcctagggccactgaagatataactattgcccaggtttctggtctctaggctggggaagtcctctgggtaggaatcagcaagaagatcctaaaacaaaagctcatccatttgcgttccatgatgctgggatttacacttgaggcttagctttgctctgccaacttcttcagagctgacacaggatgaaggcaatgccatcctcaaacactgcaggcatcacagctaacaattgtgaagtcgtcttaactcaccataaaaaggaatccactcccaggcagccctacttctttgctttgcccagcattttactgattcatacattatctcacttgtgccaacactcaagaagcaggctacactgacactggtattcctgcctccatattttctttaaaagacaaatcaaagcagatatattaagtgactgttcaagagcacacttggcccaagtggcagagcttggactggatgcatgttttccagctcctcatccagggctctgaccagtttaacctgatgcagtcacgtggaggagcagtgcaggcacagtatgtcccataggcccagtgagatgcattcttggttggctggccttccacttggctacacagggatgtacaaggcgatcccatcttgataagaccaccacctcagagtatggagctcagagagggcaggcatgaagtttccttggctggtgcacctagaattggctgaactcatgagaagttgatatagaacagtgcttgccacagagcggggactcggtaagcacttaatgaatgaatgaattctaagtcaatccaagagtctgatgatttcttgaaaagggtgttagctaaaggatcttaggcatgactgtagaatttgtagttgcaatagaacagagaaagaggaagctttctgtctccttaacactgagctgtcatgttttaaagcttgctcacatcttggcacatttaagagacagtcaccccaggactcaaaaatagggaagtaacagtaacgcaggggaaacgttttctgtttggaggagcaaaggctgagaacactgtgaaaacattttgcgcgcacaatagtaacctgggtaaatgcagcgtgaagggattttagtcacacgtggtctttcttacaaggaaggtggtgggggtgcagatgaggttgctagagaatgttagaggatccctctctggattggagatagggaaagaaagttgcacggctgctgaggccccttctaggtggcaaggctgtgctccctggttctgatgatgtgcctgggtggacatggcccctgtgagtttgtacagtcttgcagcaggatctagaggggggatttccagccagggctgctagacggaggcctactcttccatctttcctgatggcaggatggcctggccagggcctggaagacagagacctcctgcctccgcctcagtaagacgacaaggaaaggcaaatgcccaagggaaagaaaaggaaggctcttctccccagagttccccatgcagacatgagtgcgtgctcagttcagaatcacttctgagaactcatccctaatgctgcagatttgggctggaacagattcacactgtctggtttcaccgaggacatgaaactccaccttgcggggataaagagagaaaaacaaattcatcaaatggaagacacattgaaagtgtttttccttaatgcttatcctgtttttaaaccattatttccaagttgacaccttttttaaggaaaaataaatattttgcggcattaaagccatata

SEQ ID NO: 590 - DNA, 2825 bp, Homo sapiens
caaatactcccagccgagaagctgccatcgatcctcccatggacccctgatcctggtttggaggaacttttcacagctctctctccctccctcaaaccctgtgcaatgagtttgcagaagagagtcttcccgagaaggcagaacgggactcatgaagtggcagctaagccctgtccagtggccacccgtcagccaagggccagagaccaggaaaggaagaaaggcagcttcacttcctctttgaggatggagtcgcacagccgcgctggaaagagcagaaaatctgcaaaatttcggtccatctccaggtccctgatgctctgtaatgctaagaccagtgatgatggctctagccctgatgagaaatatcctgatccctttgagatttccttggcccagggcaaggagggaattttccactcatctgtgcagctggcagacacatcggaggctgggcccagcagtgttcctgatctagcactggcctcggaggctgctcaactccaagcagctgggaatgatcgaggcaagacctgtaggaggatattcttcatgaaggaatcttccacagcttcctctcgagaaaagcctggaaaactagaagcacaaagtagtaacttcctgtttcctaaagcctgccaccaaagggcacgcagcaactcaaccagtgttaatccctattgcacaagagaaattgattttccaatgaccaagaaatctgcagcgcccacggacaggcagccttactctctctgcagtaacaggaagtccctctctcaacaattggactgtccagcaggaaaggctgcgggaacttcgagaccaacacggtccctgagcacagctcagctcgtgcagccatctgggggcctccaggcttcagtcatctccaacatcgtgctgatgaagggccaggctaagggtctgggcttcagcatcgttgggggaaaagacagcatttatggccccattgggatttacgtcaaaaccatttttgcagggggagcagcagcagccgatggaaggctacaggaaggtgatgaaattctggagctcaatggtgaatcaatggctggactaacacatcaggatgctttgcagaagttcaagcaagccaaaaaggggctcctcaccctcaccgtgagaacccgcctgacggcgcctccttccctgtgcagccacctgtctcccccactgtgccgctccctgagctccagcacttgtatcaccaaggacagcagctccttcgccttggaaagcccctcggctcccatcagcaccgccaagcccaattacagaatcatggtggaggtttctctgcagaaagaggccggcgtgggcctgggcatcggcctgtgcagcgttccctacttccaatgcatctctggcattttcgtccacacgctgtcaccaggatccgtggcgcacctggacggacgtctccggtgtggggacgagattgtggaaatcagtgattcccctgtgcactgcctgacgctcaatgaagtctacacgatcctgagtcactgtgatcccggtccagtccccatcattgttagccgacatccagacccacagaaggaagaaatggaggctcaggaggttaagtaacttgtctaggtgttcacacctagacagtagaggaaccgggactagaacacaagcctttttgactctaggactcatactcttaactattactccaaagtgataataaactgtctctgaacagcaactcaaagaagctgtggcccaggctgtggaaaacaccaagtttggaaaggagaggcatcagtggagtctggaagatgcagaaatggagttgggtcccccaggaagctgactctgagatggagtttggtctgcaggcagtgtcctggggttcactacctgtggcagggaggggagcaggcagggtagacagagggaggacggagctgaggtgcacacccaacagcttcagccaagccctggagctctgcagccaaagtccccattagagttgtcctatgttggccaacatagctgggcctctgtaaccctatctccagcagtccctggagatgggctgccccattggacaaggcagctgtctgcagctgtggcagcccctggagggacccacagctgaaagtagtctgccagcagcactccccacagctgggacaccaagcccttcctcgatgggtgatctgggtggcatatctccatatacatcagtcataggctcagaaagcttgaatgattttcccaacccaaagtcatacagctcgccagggaccaacaccaagactgccatactccagatccacagtgacttcagataagaagcagatggccgatgtgcagtgtgctgcccgtggcagtcacaggtgaggccagggggtatttctgttttctgaagctcagctgtgaagattctcttgtgcttcccacacaggtgtcaaaaggctggaaagcagttggcacgggcggcccaccttggagaaggaacgagagaagaactcagcacccccgcatcgcagggctcagaaggtcatgatccgctccagcagtgacagcagctacatgtctgggtccccagggggaagtcctgggagtggcagtgctgagaagccgtcctctgacgtggacatcagcacacacagccccagcttgcctctggcacgggagccagtggtgctttctatagcatcctccaggctgccccaggagagcccacccctcccagagagccgggacagccacccgccgctgagactgaagaaatcctttgagattttggtgagaaagcctatgtcctccaagcccaagcctccacccag

SEQ ID NO: 591 - DNA, 2018 bp, Homo sapiens
agaggcaggctcggatggactatagctttgataccacagccgaagacccttgggttaggatttctgactgcatcaaaaacttatttagccccatcatgagtgagaaccatggccacatgcctctacagcccaatgccagcctgaatgaagaagaagggacacagggccacccagatgggaccccaccaaagctggacaccgccaatggcactcccaaagtttacaagtcagcagacagcagcactgtgaagaaaggtcctcctgtggctcccaagccagcctggtttcgccaaagcttgaaaggtttgaggaatcgtgcttcagacccaagagggctccctgatcctgccttgtccacccagccagcacctgcttccagggagcacctaggatcacacatccgggcctcctcctcctcctcctccatcaggcagagaatcagctcctttgaaacctttggctcctctcaactgcctgacaaaggagcccagagactgagcctccagccctcctctggggaggcagcaaaacctcttgggaagcatgaggaaggacggttttctggactcttggggcgaggggctgcacccactcttgtgccccagcagcctgagcaagtactgtcctcggggtcccctgcagcctccgaggccagagacccaggtgtgtctgagtcccctcccccagggcggcagcccaatcagaaaactctcccccctggcccggacccgctcctaaggctgctgtcaacacaggctgaggaatctcaaggcccagtgctcaagatgcctagccagcgagcacggagcttccccctgaccaggtcccagtcctgtgagacgaagctacttgacgaaaagaccagcaaactctattctatcagcagccaagtgtcatcggctgtcatgaaatccttgctgtgccttccatcttctatctcctgtgcccagactccctgcatccccaaggaaggggcatctccaacatcatcatccaacgaagactcagctgcaaatggttctgctgaaacatctgccttggacacagggttctcgctcaacctttcagagctgagagaatatacagagggtctcacggaagccaaggaagacgatgatggggaccacagttcccttcagtctggtcagtccgttatctccctgctgagctcagaagaattaaaaaaactcatcgaggaggtgaaggttctggatgaagcaacattaaagcaattagacggcatccatgtcaccatcttacacaaggaggaaggtgctggtcttgggttcagcttggcaggaggagcagatctagaaaacaaggtgattacggttcacagagtgtttccaaatgggctggcctcccaggaagggactattcagaagggcaatgaggttctttccatcaacggcaagtctctcaaggggaccacgcaccatgatgccttggccatcctccgccaagctcgagagcccaggcaagctgtgattgtcacaaggaagctgactccagaggccatgcccgacctcaactcctccactgactctgcagcctcagcctctgcagccagtgatgtttctgtagaatctacagaggccacagtctgcacggtgacactggaagatgtcggcagggctgggcttcagcctggaaggagggaagggctccctacacggagacaagcctctcaccattaacaggattttcaaaggtgtggggtgtgtctggttctttgcgtgctctccagttgtgggcatgtggccaggcccccaaaaggcttctgggcactttctgggctatgttgtttcccacaactccatgtcctcttcataggcatgctggtccttttagggctcaattctgctttttctactttttctcctttgctcagacatcccctcaatcccccctctgttttgatgggtcttcaaaaatacctaagtcctgggcttggttcgggttggcagggccaggactctagagtggggcagtgaggcactggcctgtggggcagaatt

SEQ ID NO: 592 - DNA, 8321 bp, Homo sapiens
acatttgtcctgagtcacctgtccagagcaggtggtgaatattgtgtcctactcacggcatctcaactatcggagcctgggatctgactcaaaggccggcctccgtctgagaactgagcgtccatttctcaatccttgccggctctgacccaggcctgggccacaggctgtccgggaataagtggtgctgcaatccctgctgggcagatggagagaggagcaagggagatggcagccccgggggactgtgcatagggagggactcatgaagtggcagctaagccctgtccagtggccacccgtcagccaagggccagagaccaggaaaggaagaaaggcagcttcacttcctctttgaggatggagtcgcacagccgcgctggaaagagcagaaaatctgcaaaatttcggtccatctccaggtccctgatgctctgtaatgctaagaccagtgatgatggctctagccctgatgagaaatatcctgatccctttgagatttccttggcccagggcaaggagggaattttccactcatctgtgcagctggcagacacatcggaggctgggcccagcagtgttcctgatctagcactggcctcggaggctgctcaactccaagcagctgggaatgatcgaggcaagacctgtaggaggatattcttcatgaaggaatcttccacagcttcctctcgagaaaagcctggaaaactagaagcacaaagtagtaacttcctgtttcctaaagcctgccaccaaagggcacgcagcaactcaaccagtgttaatccctattgcacaagagaaattgattttccaatgaccaagaaatctgcagcgcccacggacaggcagccttactctctctgcagtaacaggaagtccctctctcaacaattggactgtccagcaggaaaggctgcgggaacttcgagaccaacacggtccctgagcacagctcagctcgtgcagccatctgggggcctccaggcttcagtcatctccaacatcgtgctgatgaagggccaggctaagggtctgggcttcagcatcgttgggggaaaagacagcatttatggccccattgggatttacgtcaaaaccatttttgcagggggagcagcagcagccgatggaaggctacaggaaggtgatgaaattctggagctcaatggtgaatcaatggctggactaacacatcaggatgctttgcagaagttcaagcaagccaaaaaggggctcctcaccctcaccgtgagaacccgcctgacggcgcctccttccctgtgcagccacctgtctcccccactgtgccgctccctgagctccagcacttgtatcaccaaggacagcagctccttcgccttggaaagcccctcggctcccatcagcaccgccaagcccaattacagaatcatggtggaggtttctctgcagaaagaggccggcgtgggcctgggcatcggcctgtgcagcgttccctacttccaatgcatctctggcattttcgtccacacgctgtcaccaggatccgtggcgcacctggacggacgtctccggtgtggggacgagattgtggaaatcagtgattcccctgtgcactgcctgacgctcaatgaagtctacacgatcctgagtcactgtgatcccggtccagtccccatcattgttagccgacatccagacccacaggtctctgaacagcaactcaaagaagctgtggcccaggctgtggaaaacaccaagtttggaaaggagaggcatcagtggagtctggaaggtgtcaaaaggctggaaagcagttggcacgggcggcccaccttggagaaggaacgagagaagaactcagcacccccgcatcgcagggctcagaaggtcatgatccgctccagcagtgacagcagctacatgtctgggtccccagggggaagtcctgggagtggcagtgctgagaagccgtcctctgacgtggacatcagcacacacagccccagcttgcctctggcacgggagccagtggtgctttctatagcatcctccaggctgccccaggagagcccacccctcccagagagccgggacagccacccgccgctgagactgaagaaatcctttgagattttggtgagaaagcctatgtcctccaagcccaagcctccacccagaaaatactttaaaagtgacagtgaccctcagaagagtctggaagagagagagaactcctcatgctcttctgggcacaccccacccacctgtggccaggaagcgagagagctgctgccactgctgctaccacaggaagacacagcagggagaagccctagtgcctctgccggctgcccaggacctggtatcggcccacagaccaagtcctccacagagggcgagccagggtggagaagagccagcccagtgacccaaacatccccgataaaacacccactgcttaagaggcaggctcggatggactatagctttgataccacagccgaagacccttgggttaggatttctgactgcatcaaaaacttatttagccccatcatgagtgagaaccatggccacatgcctctacagcccaatgccagcctgaatgaagaagaagggacacagggccacccagatgggaccccaccaaagctggacaccgccaatggcactcccaaagtttacaagtcagcagacagcagcactgtgaagaaaggtcctcctgtggctcccaagccagcctggtttcgccaaagcttgaaaggtttgaggaatcgtgcttcagacccaagagggctccctgatcctgccttgtccacccagccagcacctgcttccagggagcacctaggatcacacatccgggcctcctcctcctcctcctccatcaggcagagaatcagctcctttgaaacctttggctcctctcaactgcctgacaaaggagcccagagactgagcctccagccctcctctggggaggcagcaaaacctcttgggaagcatgaggaaggacggttttctggactcttggggcgaggggctgcacccactcttgtgccccagcagcctgagcaagtactgtcctcggggtcccctgcagcctccgaggccagagacccaggtgtgtctgagtcccctcccccagggcggcagcccaatcagaaaactctcccccctggcccggacccgctcctaaggctgctgtcaacacaggctgaggaatctcaaggcccagtgctcaagatgcctagccagcgagcacggagcttccccctgaccaggtcccagtcctgtgagacgaagctacttgacgaaaagaccagcaaactctattctatcagcagccaagtgtcatcggctgtcatgaaatccttgctgtgccttccatcttctatctcctgtgcccagactccctgcatccccaaggaaggggcatctccaacatcatcatccaacgaagactcagctgcaaatggttctgctgaaacatctgccttggacacagggttctcgctcaacctttcagagctgagagaatatacagagggtctcacggaagccaaggaagacgatgatggggaccacagttcccttcagtctggtcagtccgttatctccctgctgagctcagaagaattaaaaaaactcatcgaggaggtgaaggttctggatgaagcaacattaaagcaattagacggcatccatgtcaccatcttacacaaggaggaaggtgctggtcttgggttcagcttggcaggaggagcagatctagaaaacaaggtgattacggttcacagagtgtttccaaatgggctggcctcccaggaagggactattcagaagggcaatgaggttctttccatcaacggcaagtctctcaaggggaccacgcaccatgatgccttggccatcctccgccaagctcgagagcccaggcaagctgtgattgtcacaaggaagctgactccagaggccatgcccgacctcaactcctccactgactctgcagcctcagcctctgcagccagtgatgtttctgtagaatctacagaggccacagtctgcacggtgacactggagaagatgtcggcagggctgggcttcagcctggaaggagggaagggctccctacacggagacaagcctctcaccattaacaggattttcaaaggagcagcctcagaacaaagtgagacagtccagcctggagatgaaatcttacagctgggtggcactgccatgcagggcctcacacggtttgaagcctggaacatcatcaaggcactgcctgatggacctgtcacgattgtcatcaggagaaaaagcctccagtccaaggaaaccacagctgctggagactcctaggcaggacatgctgaagccaaagccaataacacacagctaacacacagctcccataaccgctgattctcagggtctctgctgccgccccacccagatgggggaaagcacaggtgggcttcccagtggctgctgcccaggcccagaccttctaggacgccacccagcaaaaggttgttcctaaaataagggcagagtcacacgggggcagctgatacaaattgcagactgtgtaaaaagagagcttaatgataatattgtggtgccacaaataaaatggatttattagaatttcatatgacattcatgcctggcttcgcaaaatgtttcaagtactgtaactgtgtcatgattcacccccaaacagtgacatttatttttctcatgaatctgcaatgtgggcagagattggaatgggcagctcatctctgtcccacttggcatcagctggcgtcatgcaaagtcatgcaaaggctgggaccacgtgagatcattcactcatacatctggccgttgatgttggctgggaactcacctggggctgctggcctgaatgcttataggtggcctctccttgtggcctgggcctcctcacaacatggtgtctggattcccaggatgagcatcccaggatcgcaagagccatgtagaagctgcatcttgtttatacctttgccttggaagttgcatggcatcacctccaccatactccatcagttagagctgacacaaacctgcctgggtttaaggggagaggaaatattgctggggtcatttatgaaaaatacagtttgtcacatgaaacatttgcaaaattgtttttggttggattggagaagtaatcctagggaagggtggtggagccagtaaacagaggagtacaggtgaagcaccaagctcaaagcgtggacaggtgtgccgacagaaggaaccagcgtgtatatgagggtatcaaataaaattgctactacttacctaccacatgccaagcactgtgctcagggctaaacgggcattgcctttagtgatcacagcagcttctacggtgtatggttctgtgccaatgtattgataagagggcacacactgtgtacagtaaatggcttatccagctggtgagtgatgcggcagattgagttttcttctgtgattcggtggagactatcagcccaagatgctttaagtgcacaacattacagggaatgcctgagtgcctggccaaagggatatttggtttggccatctctggatgcctgattgccaagctcaggaccaggcaatgtgactttgcatcagcaacaaccagcatcccttgaccaggcctgggccagagtattggtctcctctcagcccctgatcctgtgaagtaaggatgtgggggaagacctggcaaggacacagatgaaacacaaacaatagtaattctcaggccatcatcagtggagccatgttaatgtaatctgatggcttctccagggtccacaggaagtgaagaatctgtttcccagcagtggactcaaaacccatctgggctcctaaccttcctgtaaacccctttagtggcttcattagagcaggcgttcagctcactgttctattcatctcaaggaataatgggcttagagcagtttctgtcctgctggttaacttgtttggcctattccattctggattttgtcaagcagtagacaagcaattagacaagaacttggaggcaccatttgtatccactttttagacttaatagaaacattgaagatgaacataatctaccaacgaaagacgtgattcaattcaacactcccttcccatgacccaggctgggcaaggaggccacgtgatgtggagggcacattccttgcctgcacaaactcaccatctgtgcacgcagtggccttccctaaaatcagggaattgttttaagtcttatcaagcagccaagggatgaaagagaaggtgggttttcatcaagactggaaggtggggacagggatgagcatggagctggccgtgggcctggggtaccaagagactccttgagagaccaggcaaagcaagtgattgggacagaggttatctgtcccaggttatctgggcatagatgcaggtgagcccatggccctcccagtacctcctgtctctggcctgttttagaaggttctctcctccccaaggagacacaacaactcctagggccactgaagatataactattgcccaggtttctggtctctaggctggggaagtcctctgggtaggaatcagcaagaagatcctaaaacaaaagctcatccatttgcgttccatgatgctgggatttacacttgaggcttagctttgctctgccaacttcttcagagctgacacaggatgaaggcaatgccatcctcaaacactgcaggcatcacagctaacaattgtgaagtcgtcttaactcaccataaaaaggaatccactcccaggcagccctacttctttgctttgcccagcattttactgattcatacattatctcacttgtgccaacactcaagaagcaggctacactgacactggtattcctgcctccatattttctttaaaagacaaatcaaagcagatatattaagtgactgttcaagagcacacttggcccaagtggcagagcttggactggatgcatgttttccagctcctcatccagggctctgaccagtttaacctgatgcagtcacgtggaggagcagtgcaggcacagtatgtcccataggcccagtgagatgcattcttggttggctggccttccacttggctacacagggatgtacaaggcgatcccatcttgataagaccaccacctcagagtatggagctcagagagggcaggcatgaagtttccttggctggtgcacctagaattggctgaactcatgagaagttgatatagaacagtgcttgccacagagcggggactcggtaagcacttaatgaatgaatgaattctaagtcaatccaagagtctgatgatttcttgaaaagggtgttagctaaaggatcttaggcatgactgtagaatttgtagttgcaatagaacagagaaagaggaagctttctgtctccttaacactgagctgtcatgttttaaagcttgctcacatcttggcacatttaagagacagtcaccccaggactcaaaaatagggaagtaacagtaacgcaggggaaacgttttctgtttggaggagcaaaggctgagaacactgtgaaaacattttgcgcgcacaatagtaacctgggtaaatgcagcgtgaagggattttagtcacacgtggtctttcttacaaggaaggtggtgggggtgcagatgaggttgctagagaatgttagaggatccctctctggattggagatagggaaagaaagttgcacggctgctgaggccccttctaggtggcaaggctgtgctccctggttctgatgatgtgcctgggtggacatggcccctgtgagtttgtacagtcttgcagcaggatctagaggggggatttccagccagggctgctagacggaggcctactcttccatctttcctgatggcaggatggcctggccagggcctggaagacagagacctcctgcctccgcctcagtaagacgacaaggaaaggcaaatgcccaagggaaagaaaaggaaggctcttctccccagagttccccatgcagacatgagtgcgtgctcagttcagaatcacttctgagaactcatccctaatgctgcagatttgggctggaacagattcacactgtctggtttcaccgaggacatgaaactccaccttgcggggataaagagagaaaaacaaattcatcaaatggaagacacattgaaagtgtttttccttaatgcttatcctgtttttaaaccattatttccaagttgacaccttttttaaggaaaaataaatattttgcggcattaaagccatata

SEQ ID NO: 593 - DNA, 2158 bp, Homo sapiens
cacatttgtcctgagtcacctgtccagagcaggtggtgaatattgtgtcctactcacggcatctcaactatcggagcctgggatctgactcaaaggccggcctccgtctgagaactgagcgtccatttctcaatccttgccggctctgacccaggcctgggccacaggctgtccgggaataagtggtgctgcaatccctgctgggcagatggagagaggagcaagggagatggcagccccgggggactgtgcatagggaggtaggtgggcaccagggactcatgaagtggcagctaagccctgtccagtggccacccgtcagccaagggccagagaccaggaaaggaagaaaggcagcttcacttcctctttgaggatggagtcgcacagccgcgctggaaagagcagaaaatctgcaaaatttcggtccatctccaggtccctgatgctctgtaatgctaagaccagtgatgatggctctagccctgatgagaaatatcctgatccctttgagatttccttggcccagggcaaggagggaattttccactcatctgtgcagctggcagacacatcggaggctgggcccagcagtgttcctgatctagcactggcctcggaggctgctcaactccaagcagctgggaatgatcgaggcaagacctgtaggaggatattcttcatgaaggaatcttccacagcttcctctcgagaaaagcctggaaaactagaagcacaaagtagtaacttcctgtttcctaaagcctgccaccaaagggcacgcagcaactcaaccagtgttaatccctattgcacaagagaaattgattttccaatgaccaagaaatctgcagcgcccacggacaggcagccttactctctctgcagtaacaggaagtccctctctcaacaattggactgtccagcaggaaaggctgcgggaacttcgagaccaacacggtccctgagcacagctcagctcgtgcagccatctgggggcctccaggcttcagtcatctccaacatcgtgctgatgaagggccaggctaagggtctgggcttcagcatcgttgggggaaaagacagcatttatggccccattgggatttacgtcaaaaccatttttgcagggggagcagcagcagccgatggaaggctacaggaaggtgatgaaattctggagctcaatggtgaatcaatggctggactaacacatcaggatgctttgcagaagttcaagcaagccaaaaaggggctcctcaccctcaccgtgagaacccgcctgacggcgcctccttccctgtgcagccacctgtctcccccactgtgccgctccctgagctccagcacttgtatcaccaaggacagcagctccttcgccttggaaagcccctcggctcccatcagcaccgccaagcccaattacagaatcatggtggaggtttctctgcagaaagaggccggcgtgggcctgggcatcggcctgtgcagcgttccctacttccaatgcatctctggcattttcgtccacacgctgtcaccaggatccgtggcgcacctggacggacgtctccggtgtggggacgagattgtggaaatcagtgattcccctgtgcactgcctgacgctcaatgaagtctacacgatcctgagtcactgtgatcccggtccagtccccatcattgttagccgacatccagacccacaggtctctgaacagcaactcaaagaagctgtggcccaggctgtggaaaacaccaagtttggaaaggagaggcatcagtggagtctggaaggtgtcaaaaggctggaaagcagttggcacgggcggcccaccttggagaaggaacgagagaagaactcagcacccccgcatcgcagggctcagaaggtcatgatccgctccagcagtgacagcagctacatgtctgggtccccagggggaagtcctgggagtggcagtgctgagaagccgtcctctgacgtggacatcagcacacacagccccagcttgcctctggcacgggagccagtggtgctttctatagcatcctccaggctgccccaggagagcccacccctcccagagagccgggacagccacccgccgctgagactgaagaaatcctttgagattttggtgagaaagcctatgtcc

SEQ ID NO: 594 - DNA, 1859 bp, Homo sapiens
gcaggcacaaactcatccatccccagttgattggaagaaacaacgatgactcctgggaagacctcattggtgtcactgctactgctgctgagcctggaggccatagtgaaggcaggaatcacaatcccacgaaatccaggatgcccaaattctgaggacaagaacttcccccggactgtgatggtcaacctgaacatccataaccggaataccaataccaatcccaaaaggtcctcagattactacaaccgatccacctcaccttggaatctccaccgcaatgaggaccctgagagatatccctctgtgatctgggaggcaaagtgccgccacttgggctgcatcaacgctgatgggaacgtggactaccacatgaactctgtccccatccagcaagagatcctggtcctgcgcagggagcctccacactgccccaactccttccggctggagaagatactggtgtccgtgggctgcacctgtgtcaccccgattgtccaccatgtggcctaagagctctggggagcccacactccccaaagcagttagactatggagagccgacccagcccctcaggaaccctcatccttcaaagacagcctcatttcggactaaactcattagagttcttaaggcagtttgtccaattaaagcttcagaggtaacacttggccaagatatgagatctgaattacctttccctctttccaagaaggaaggtttgactgagtaccaatttgcttcttgtttacttttttaagggctttaagttatttatgtatttaatatgccctgagataactttggggtataagattccattttaatgaattacctactttattttgtttgtctttttaaagaagataagattctgggcttgggaattttattatttaaaaggtaaaacctgtatttatttgagctatttaaggatctatttatgtttaagtatttagaaaaaggtgaaaaagcactattatcagttctgcctaggtaaatgtaagatagaattaaatggcagtgcaaaatttctgagtctttacaacatacggatatagtatttcctcctctttgtttttaaaagttataacatggctgaaaagaaagattaaacctactttcatatgtattaatttaaattttgcaatttgttgaggttttacaagagatacagcaagtctaactctctgttccattaaacccttataataaaatccttctgtaataataaagtttcaaaagaaaatgtttatttgttctcattaaatgtattttagcaaactcagctcttccctattgggaagagttatgcaaattctcctataagcaaaacaaagcatgtctttgagtaacaatgacctggaaatacccaaaattccaagttctcgatttcacatgccttcaagactgaacaccgactaaggttttcatactattagccaatgctgtagacagaagcattttgataggaatagagcaaataagataatggccctgaggaatggcatgtcattattaaagatcatatggggaaaatgaaaccctccccaaaatacaagaagttctgggaggagacattgtcttcagactacaatgtccagtttctcccctagactcaggcttcctttggagattaaggcccctcagagatcaacagaccaacatttttctcttcctcaagcaacactcctagggcctggcttctgtctgatcaaggcaccacacaacccagaaaggagctgatggggcagaacgaactttaagtatgagaaaagttcagcccaagtaaaataaaaactcaatcacattcaattccagagtagtttcaagtttcacatcgtaaccattttcgccc

SEQ ID NO: 595 - DNA, 696 bp, Homo sapiens
ctggggttccaggcgggcagcagctgcaggctgaccttgcagcttggcggaatggactggcctcacaacctgctgtttcttcttaccatttccatcttcctggggctgggccagcccaggagccccaaaagcaagaggaaggggcaagggcggcctgggcccctggcccctggccctcaccaggtgccactggacctggtgtcacggatgaaaccgtatgcccgcatggaggagtatgagaggaacatcgaggagatggtggcccagctgaggaacagctcagagctggcccagagaaagtgtgaggtcaacttgcagctgtggatgtccaacaagaggagcctgtctccctggggctacagcatcaaccacgaccccagccgtatccccgtggacctgccggaggcacggtgcctgtgtctgggctgtgtgaaccccttcaccatgcaggaggaccgcagcatggtgagcgtgccggtgttcagccaggttcctgtgcgccgccgcctctgcccgccaccgccccgcacagggccttgccgccagcgcgcagtcatggagaccatcgctgtgggctgcacctgcatcttctgaatcacctggcccagaagccaggccagcagcccgagaccatcctccttgcacctttgtgccaagaaaggcctatgaaaagtaaacactgacttttgaaagcaa

SEQ ID NO: 596 - DNA, 1047 bp, Homo sapiens
gccaggtgtgcaggccgctccaagcccagcctgccccgctgccgccaccatgacgctcctccccggcctcctgtttctgacctggctgcacacatgcctggcccaccatgacccctccctcagggggcacccccacagtcacggtaccccacactgctactcggctgaggaactgcccctcggccaggcccccccacacctgctggctcgaggtgccaagtgggggcaggctttgcctgtagccctggtgtccagcctggaggcagcaagccacagggggaggcacgagaggccctcagctacgacccagtgcccggtgctgcggccggaggaggtgttggaggcagacacccaccagcgctccatctcaccctggagataccgtgtggacacggatgaggaccgctatccacagaagctggccttcgccgagtgcctgtgcagaggctgtatcgatgcacggacgggccgcgagacagctgcgctcaactccgtgcggctgctccagagcctgctggtgctgcgccgccggccctgctcccgcgacggctcggggctccccacacctggggcctttgccttccacaccgagttcatccacgtccccgtcggctgcacctgcgtgctgccccgttcagtgtgaccgccgaggccgtggggcccctagactggacacgtgtgctccccagagggcaccccctatttatgtgtatttattgttatttatatgcctcccccaacactacccttggggtctgggcattccccgtgtctggaggacagccccccactgttctcctcatctccagcctcagtagttgggggtagaaggagctcagcacctcttccagcccttaaagctgcagaaaaggtgtcacacggctgcctgtaccttggctccctgtcctgctcccggcttcccttaccctatcactggcctcaggcccccgcaggctgcctcttcccaacctccttggaagtacccctgtttcttaaacaattatttaagtgtacgtgtattattaaactgatgaacacatccccaga

SEQ ID NO: 597 - DNA, 1861 bp, Homo sapiens
aaaatgttttcagctcctggaggcgaaaggtgcagagtcgctctgtgtccgtgaggccgggcggcgacctcgctcagtcggcttctcggtccgagtccccgggtctggatgctggtagccggcttcctgctggcgctgccgccgagctgggccgcgggcgccccgagggcgggcaggcgccccgcgcggccgcggggctgcgcggaccggccggaggagctactggagcagctgtacgggcgcctggcggccggcgtgctcagtgccttccaccacacgctgcagctggggccgcgtgagcaggcgcgcaacgcgagctgcccggcagggggcaggcccgccgaccgccgcttccggccgcccaccaacctgcgcagcgtgtcgccctgggcctacagaatctcctacgacccggcgaggtaccccaggtacctgcctgaagcctactgcctgtgccggggctgcctgaccgggctgttcggcgaggaggacgtgcgcttccgcagcgcccctgtctacatgcccaccgtcgtcctgcgccgcacccccgcctgcgccggcggccgttccgtctacaccgaggcctacgtcaccatccccgtgggctgcacctgcgtccccgagccggagaaggacgcagacagcatcaactccagcatcgacaaacagggcgccaagctcctgctgggccccaacgacgcgcccgctggcccctgaggccggtcctgccccgggaggtctccccggcccgcatcccgaggcgcccaagctggagccgcctggagggctcggtcggcgacctctgaagagagtgcaccgagcaaaccaagtgccggagcaccagcgccgcctttccatggagactcgtaagcagcttcatctgacacgggcatccctggcttgcttttagctacaagcaagcagcgtggctggaagctgatgggaaacgacccggcacgggcatcctgtgtgcggcccgcatggagggtttggaaaagttcacggaggctccctgaggagcctctcagatcggctgctgcgggtgcagggcgtgactcaccgctgggtgcttgccaaagagatagggacgcatatgctttttaaagcaatctaaaaataataataagtatagcgactatatacctacttttaaaatcaactgttttgaatagaggcagagctattttatattatcaaatgagagctactctgttacatttcttaacatataaacatcgttttttacttcttctggtagaattttttaaagcataattggaatccttggataaattttgtagctggtacactctggcctgggtctctgaattcagcctgtcaccgatggctgactgatgaaatggacacgtctcatctgacccactcttccttccactgaaggtcttcacgggcctccaggtggaccaaagggatgcacaggcggctcgcatgccccagggccagctaagagttccaaagatctcagatttggttttagtcatgaatacataaacagtctcaaactcgcacaattttttcccccttttgaaagccactggggccaatttgtggttaagaggtggtgagataagaagtggaacgtgacatctttgccagttgtcagaagaatccaagcaggtattggcttagttgtaagggctttaggatcaggctgaatatgaggacaaagtgggccacgttagcatctgcagagatcaatctggaggcttctgtttctgcattctgccacgagagctaggtccttgatcttttctttagattgaaagtctgtctctgaacacaattatttgtaaaagttagtagttcttttttaaatcattaaaagaggcttgctgaagga

SEQ ID NO: 598 - DNA, 850 bp, Homo sapiens
atgattgctataaaactaacaggtactctcattgatagaacacaggcatacacaggaagatacattcacagaaagagcttcctgcacaaagtaagccaccagcgcaacatgacagtgaagaccctgcatggcccagccatggtcaagtacttgctgctgtcgatattggggcttgcctttctgagtgaggcggcagctcggaaaatccccaaagtaggacatacttttttccaaaagcctgagagttgcccgcctgtgccaggaggtagtatgaagcttgacattggcatcatcaatgaaaaccagcgcgtttccatgtcacgtaacatcgagagccgctccacctccccctggaattacactgtcacttgggaccccaaccggtacccctcggaagttgtacaggcccagtgtaggaacttgggctgcatcaatgctcaaggaaaggaagacatctccatgaattccgttcccatccagcaagagaccctggtcgtccggaggaagcaccaaggctgctctgtttctttccagttggagaaggtgctggtgactgttggctgcacctgcgtcacccctgtcatccaccatgtgcagtaagaggtgcatatccactcagctgaagaagctgtagaaatgccactccttacccagtgctctgcaacaagtcctgtctgacccccaattccctccacttcacaggactcttaataagacctgcacggatggaaacagaaaatattcacaatgtatgtgtgtatgtactacactttatatttgatatctaaaatgttaggagaaaaattaatatattcagtgctaatataataaagtattaataatttaaaaa

SEQ ID NO: 599 - DNA, 925 bp, Homo sapiens
ctttgaattcctagctcctgtggtctccagatttcaggcctaagatgaaagcctctagtcttgccttcagccttctctctgctgcgttttatctcctatggactccttccactggactgaagacactcaatttgggaagctgtgtgatcgccacaaaccttcaggaaatacgaaatggattttctgagatacggggcagtgtgcaagccaaagatggaaacattgacatcagaatcttaaggaggactgagtctttgcaagacacaaagcctgcgaatcgatgctgcctcctgcgccatttgctaagactctatctggacagggtatttaaaaactaccagacccctgaccattatactctccggaagatcagcagcctcgccaattcctttcttaccatcaagaaggacctccggctctgtcatgcccacatgacatgccattgtggggaggaagcaatgaagaaatacagccagattctgagtcactttgaaaagctggaacctcaggcagcagttgtgaaggctttgggggaactagacattcttctgcaatggatggaggagacagaataggaggaaagtgatgctgctgctaagaatattcgaggtcaagagctccagtcttcaatacctgcagaggaggcatgaccccaaaccaccatctctttactgtactagtcttgtgctggtcacagtgtatcttatttatgcattacttgcttccttgcatgattgtctttatgcatccccaatcttaattgagaccatacttgtataagatttttgtaatatctttctgctattggatatatttattagttaatatatttatttattttttgctatttaatgtatttatttttttacttggacatgaaactttaaaaaaattcacagattatatttataacctgactagagca

SEQ ID NO: 600 - DNA, 1553 bp, Homo sapiens
gatggcgcagccacagcttctgtgagattcgatttctccccagttcccctgtgggtctgaggggaccagaagggtgagctacgttggctttctggaaggggaggctatatgcgtcaattccccaaaacaagttttgacatttcccctgaaatgtcattctctatctattcactgcaagtgcctgctgttccaggccttacctgctgggcactaacggcggagccaggatggggacagaataaaggagccacgacctgtgccaccaactcgcactcagactctgaactcagacctgaaatcttctcttcacgggaggcttggcagtttttcttactcctgtggtctccagatttcaggcctaagatgaaagcctctagtcttgccttcagccttctctctgctgcgttttatctcctatggactccttccactggactgaagacactcaatttgggaagctgtgtgatcgccacaaaccttcaggaaatacgaaatggattttctgagatacggggcagtgtgcaagccaaagatggaaacattgacatcagaatcttaaggaggactgagtctttgcaagacacaaagcctgcgaatcgatgctgcctcctgcgccatttgctaagactctatctggacagggtatttaaaaactaccagacccctgaccattatactctccggaagatcagcagcctcgccaattcctttcttaccatcaagaaggacctccggctctgtcatgcccacatgacatgccattgtggggaggaagcaatgaagaaatacagccagattctgagtcactttgaaaagctggaacctcaggcagcagttgtgaaggctttgggggaactagacattcttctgcaatggatggaggagacagaataggaggaaagtgatgctgctgctaagaatattcgaggtcaagagctccagtcttcaatacctgcagaggaggcatgaccccaaaccaccatctctttactgtactagtcttgtgctggtcacagtgtatcttatttatgcattacttgcttccttgcatgattgtctttatgcatccccaatcttaattgagaccatacttgtataagatttttgtaatatctttctgctattggatatatttattagttaatatatttatttattttttgctatttaatgtatttatttttttacttggacatgaaactttaaaaaaattcacagattatatttataacctgactagagcaggtgatgtatttttatacagtaaaaaaaaaaaaccttgtaaattctagaagagtggctaggggggttattcatttgtattcaactaaggacatatttactcatgctgatgctctgtgagatatttgaaattgaaccaatgactacttaggatgggttgtggaataagttttgatgtggaattgcacatctaccttacaattactgaccatccccagtagactccccagtcccataattgtgtatcttccagccaggaatcctacacggccagcatgtatttctacaaataaagttttctttgcataaca

SEQ ID NO: 601 - DNA, 456 bp, Homo sapiens
atgaaagcctctagtcttgccttcagccttctctctgctgcgttttatctcctatggactccttccactggactgaagacactcaatttgggaagctgtgtgatcgccacaaaccttcaggaaatacgaaatggattttctgagatacggggcagtgtgcaagccaaagatggaaacattgacatcagaatcttaaggaggactgagtctttgcaagacacaaagcctgcgaatcgatgctgcctcctgcgccatttgctaagactctatctggacagggtatttaaaaactaccagacccctgaccattatactctccggaagatcagcagcctcgccaattcctttcttaccatcaagaaggacctccggctctgtctggaacctcaggcagcagttgtgaaggctttgggggaactagacattcttctgcaatggatggaggagacagaatag

SEQ ID NO: 602 - DNA, 1147 bp, Homo sapiens
cgaccaggttctccttccccagtcaccagttgctcgagttagaattgtctgcaatggccgccctgcagaaatctgtgagctctttccttatggggaccctggccaccagctgcctccttctcttggccctcttggtacagggaggagcagctgcgcccatcagctcccactgcaggcttgacaagtccaacttccagcagccctatatcaccaaccgcaccttcatgctggctaaggaggctagcttggctgataacaacacagacgttcgtctcattggggagaaactgttccacggagtcagtatgagtgagcgctgctatctgatgaagcaggtgctgaacttcacccttgaagaagtgctgttccctcaatctgataggttccagccttatatgcaggaggtggtgcccttcctggccaggctcagcaacaggctaagcacatgtcatattgaaggtgatgacctgcatatccagaggaatgtgcaaaagctgaaggacacagtgaaaaagcttggagagagtggagagatcaaagcaattggagaactggatttgctgtttatgtctctgagaaatgcctgcatttgaccagagcaaagctgaaaaatgaataactaaccccctttccctgctagaaataacaattagatgccccaaagcgattttttttaaccaaaaggaagatgggaagccaaactccatcatgatgggtggattccaaatgaacccctgcgttagttacaaaggaaaccaatgccacttttgtttataagaccagaaggtagactttctaagcatagatatttattgataacatttcattgtaactggtgttctatacacagaaaacaatttattttttaaataattgtctttttccataaaaaagattactttccattcctttaggggaaaaaacccctaaatagcttcatgtttccataatcagtactttatatttataaatgtatttattattattataagactgcattttatttatatcattttattaatatggatttatttatagaaacatcattcgatattgctacttgagtgtaaggctaatattgatatttatgacaataattatagagctataacatgtttatttgacctcaataaacacttggatatcc

SEQ ID NO: 603 - DNA, 1168 bp, Homo sapiens
gtcacaagcagaatcttcagaacaggttctccttccccagtcaccagttgctcgagttagaattgtctgcaatggccgccctgcagaaatctgtgagctctttccttatggggaccctggccaccagctgcctccttctcttggccctcttggtacagggaggagcagctgcgcccatcagctcccactgcaggcttgacaagtccaacttccagcagccctatatcaccaaccgcaccttcatgctggctaaggaggctagcttggctgataacaacacagacgttcgtctcattggggagaaactgttccacggagtcagtatgagtgagcgctgctatctgatgaagcaggtgctgaacttcacccttgaagaagtgctgttccctcaatctgataggttccagccttatatgcaggaggtggtgcccttcctggccaggctcagcaacaggctaagcacatgtcatattgaaggtgatgacctgcatatccagaggaatgtgcaaaagctgaaggacacagtgaaaaagcttggagagagtggagagatcaaagcaattggagaactggatttgctgtttatgtctctgagaaatgcctgcatttgaccagagcaaagctgaaaaatgaataactaaccccctttccctgctagaaataacaattagatgccccaaagcgattttttttaaccaaaaggaagatgggaagccaaactccatcatgatgggtggattccaaatgaacccctgcgttagttacaaaggaaaccaatgccacttttgtttataagaccagaaggtagactttctaagcatagatatttattgataacatttcattgtaactggtgttctatacacagaaaacaatttattttttaaataattgtctttttccataaaaaagattactttccattcctttaggggaaaaaacccctaaatagcttcatgtttccataatcagtactttatatttataaatgtatttattattattataagactgcattttatttatatcattttattaatatggatttatttatagaaacatcattcgatattgctacttgagtgtaaggctaatattgatatttatgacaataattatagagctataacatgtttatttgacctcaataaacacttggatatcctaa

SEQ ID NO: 604 - DNA, 2912 bp, Homo sapiens
gctgacatttccattgacctcagaagtgaaaatctaaagtgagtgctgacaggcaggcagtgaggaaagaagacatgacacagccaacaagggtggcagcctggctctgaagtggaattatgtgcttcaaacaggttgaaagagggaaacagtcttttcctgcttccagacatgaatcaggtcactattcaatgggatgcagtaatagccctttacatactcttcagctggtgtcatggaggaattacaaatataaactgctctggccacatctgggtagaaccagccacaatttttaagatgggtatgaatatctctatatattgccaagcagcaattaagaactgccaaccaaggaaacttcatttttataaaaatggcatcaaagaaagatttcaaatcacaaggattaataaaacaacagctcggctttggtataaaaactttctggaaccacatgcttctatgtactgcactgctgaatgtcccaaacattttcaagagacactgatatgtggaaaagacatttcttctggatatccgccagatattcctgatgaagtaacctgtgtcatttatgaatattcaggcaacatgacttgcacctggaatgctgggaagctcacctacatagacacaaaatacgtggtacatgtgaagagtttagagacagaagaagagcaacagtatctcacctcaagctatattaacatctccactgattcattacaaggtggcaagaagtacttggtttgggtccaagcagcaaacgcactaggcatggaagagtcaaaacaactgcaaattcacctggatgatatagtgataccttctgcagccgtcatttccagggctgagactataaatgctacagtgcccaagaccataatttattgggatagtcaaacaacaattgaaaaggtttcctgtgaaatgagatacaaggctacaacaaaccaaacttggaatgttaaagaatttgacaccaattttacatatgtgcaacagtcagaattctacttggagccaaacattaagtacgtatttcaagtgagatgtcaagaaacaggcaaaaggtactggcagccttggagttcactgttttttcataaaacacctgaaacagttccccaggtcacatcaaaagcattccaacatgacacatggaattctgggctaacagttgcttccatctctacagggcaccttacttctgacaacagaggagacattggacttttattgggaatgatcgtctttgctgttatgttgtcaattctttctttgattgggatatttaacagatcattccgaactgggattaaaagaaggatcttattgttaataccaaagtggctttatgaagatattcctaatatgaaaaacagcaatgttgtgaaaatgctacaggaaaatagtgaacttatgaataataattccagtgagcaggtcctatatgttgatcccatgattacagagataaaagaaatcttcatcccagaacacaagcctacagactacaagaaggagaatacaggacccctggagacaagagactacccgcaaaactcgctattcgacaatactacagttgtatatattcctgatctcaacactggatataaaccccaaatttcaaattttctgcctgagggaagccatctcagcaataataatgaaattacttccttaacacttaaaccaccagttgattccttagactcaggaaataatcccaggttacaaaagcatcctaattttgctttttctgtttcaagtgtgaattcactaagcaacacaatatttcttggagaattaagcctcatattaaatcaaggagaatgcagttctcctgacatacaaaactcagtagaggaggaaaccaccatgcttttggaaaatgattcacccagtgaaactattccagaacagaccctgcttcctgatgaatttgtctcctgtttggggatcgtgaatgaggagttgccatctattaatacttattttccacaaaatattttggaaagccacttcaataggatttcactcttggaaaagtagagctgtgtggtcaaaatcaatatgagaaagctgccttgcaatctgaacttgggttttccctgcaatagaaattgaattctgcctctttttgaaaaaaatgtattcacatacaaatcttcacatggacacatgttttcatttcccttggataaatacctaggtaggggattgctgggccatatgataagcatatgtttcagttctaccaatcttgtttccagagtagtgacatttctgtgctcctaccatcaccatgtaagaattcccgggagctccatgcctttttaattttagccattcttctgcctcatttcttaaaattagagaattaaggtcccgaaggtggaacatgcttcatggtcacacatacaggcacaaaaacagcattatgtggacgcctcatgtattttttatagagtcaactatttcctctttattttccctcattgaaagatgcaaaacagctctctattgtgtacagaaagggtaaataatgcaaaatacctggtagtaaaataaatgctgaaaattttcctttaaaatagaatcattaggccaggcgtggtggctcatgcttgtaatcccagcactttggtaggctgaggtaggtggatcacctgaggtcaggagttcgagtccagcctggccaatatgctgaaaccctgtctctactaaaattacaaaaattagccggccatggtggcaggtgcttgtaatcccagctacttgggaggctgaggcaggagaatcacttgaaccaggaaggcagaggttgcactgagctgagattgtgccactgcactccagcctgggcaacaagagcaaaactctgtctggaaaaaaaaaaaaaa

SEQ ID NO: 605 - DNA, 2709 bp, Homo sapiens
acaagggtggcagcctggctctgaagtggaattatgtgcttcaaacaggttgaaagagggaaacagtcttttcctgcttccagacatgaatcaggtcactattcaatgggatgcagtaatagccctttacatactcttcagctggtgtcatggaggaattacaaatataaactgctctggccacatctgggtagaaccagccacaatttttaagatgggtatgaatatctctatatattgccaagcagcaattaagaactgccaaccaaggaaacttcatttttataaaaatggcatcaaagaaagatttcaaatcacaaggattaataaaacaacagctcggctttggtataaaaactttctggaaccacatgcttctatgtactgcactgctgaatgtcccaaacattttcaagagacactgatatgtggaaaagacatttcttctggatatccgccagatattcctgatgaagtaacctgtgtcatttatgaatattcaggcaacatgacttgcacctggaatgctgggaagctcacctacatagacacaaaatacgtggtacatgtgaagagtttagagacagaagaagagcaacagtatctcacctcaagctatattaacatctccactgattcattacaaggtggcaagaagtacttggtttgggtccaagcagcaaacgcactaggcatggaagagtcaaaacaactgcaaattcacctggatgatatagtgataccttctgcagccgtcatttccagggctgagactataaatgctacagtgcccaagaccataatttattgggatagtcaaacaacaattgaaaaggtttcctgtgaaatgagatacaaggctacaacaaaccaaacttggaatgttaaagaatttgacaccaattttacatatgtgcaacagtcagaattctacttggagccaaacattaagtacgtatttcaagtgagatgtcaagaaacaggcaaaaggtactggcagccttggagttcactgttttttcataaaacacctgaaacagttccccaggtcacatcaaaagcattccaacatgacacatggaattctgggctaacagttgcttccatctctacagggcaccttacttctggattaaaagaaggatcttattgttaataccaaagtggctttatgaagatattcctaatatgaaaaacagcaatgttgtgaaaatgctacaggaaaatagtgaacttatgaataataattccagtgagcaggtcctatatgttgatcccatgattacagagataaaagaaatcttcatcccagaacacaagcctacagactacaagaaggagaatacaggacccctggagacaagagactacccgcaaaactcgctattcgacaatactacagttgtatatattcctgatctcaacactggatataaaccccaaatttcaaattttctgcctgagggaagccatctcagcaataataatgaaattacttccttaacacttaaaccaccagttgattccttagactcaggaaataatcccaggttacaaaagcatcctaattttgctttttctgtttcaagtgtgaattcactaagcaacacaatatttcttggagaattaagcctcatattaaatcaaggagaatgcagttctcctgacatacaaaactcagtagaggaggaaaccaccatgcttttggaaaatgattcacccagtgaaactattccagaacagaccctgcttcctgatgaatttgtctcctgtttggggatcgtgaatgaggagttgccatctattaatacttattttccacaaaatattttggaaagccacttcaataggatttcactcttggaaaagtagagctgtgtggtcaaaatcaatatgagaaagctgccttgcaatctgaacttgggttttccctgcaatagaaattgaattctgcctctttttgaaaaaaatgtattcacatacaaatcttcacatggacacatgttttcatttcccttggataaatacctaggtaggggattgctgggccatatgataagcatatgtttcagttctaccaatcttgtttccagagtagtgacatttctgtgctcctaccatcaccatgtaagaattcccgggagctccatgcctttttaattttagccattcttctgcctcatttcttaaaattagagaattaaggtcccgaaggtggaacatgcttcatggtcacacatacaggcacaaaaacagcattatgtggacgcctcatgtattttttatagagtcaactatttcctctttattttccctcattgaaagatgcaaaacagctctctattgtgtacagaaagggtaaataatgcaaaatacctggtagtaaaataaatgctgaaaattttcctttaaaatagaatcattaggccaggcgtggtggctcatgcttgtaatcccagcactttggtaggctgaggtaggtggatcacctgaggtcaggagttcgagtccagcctggccaatatgctgaaaccctgtctctactaaaattacaaaaattagccggccatggtggcaggtgcttgtaatcccagctacttgggaggctgaggcaggagaatcacttgaaccaggaaggcagaggttgcactgagctgagattgtgccactgcactccagcctgggcaacaagagcaaaactctgtctgg

SEQ ID NO: 606 - DNA, 1962 bp, Homo sapiens
atgattctgaggccttaccagccatgtggaactgttaaagaatttgacaccaattttacatatgtgcaacagtcagaattctacttggagccaaacattaagtacgtatttcaagtgagatgtcaagaaacaggcaaaaggtactggcagccttggagttcactgttttttcataaaacacctgaaacagttccccaggtcacatcaaaagcattccaacatgacacatggaattctgggctaacagttgcttccatctctacagggcaccttacttctgacaacagaggagacattggacttttattgggaatgatcgtctttgctgttatgttgtcaattctttctttgattgggatatttaacagatcattccgaactgggattaaaagaaggatcttattgttaataccaaagtggctttatgaagatattcctaatatgaaaaacagcaatgttgtgaaaatgctacaggaaaatagtgaacttatgaataataattccagtgagcaggtcctatatgttgatcccatgattacagagataaaagaaatcttcatcccagaacacaagcctacagactacaagaaggagaatacaggacccctggagacaagagactacccgcaaaactcgctattcgacaatactacagttgtatatattcctgatctcaacactggatataaaccccaaatttcaaattttctgcctgagggaagccatctcagcaataataatgaaattacttccttaacacttaaaccaccagttgattccttagactcaggaaataatcccaggttacaaaagcatcctaattttgctttttctgtttcaagtgtgaattcactaagcaacacaatatttcttggagaattaagcctcatattaaatcaaggagaatgcagttctcctgacatacaaaactcagtagaggaggaaaccaccatgcttttggaaaatgattcacccagtgaaactattccagaacagaccctgcttcctgatgaatttgtctcctgtttggggatcgtgaatgaggagttgccatctattaatacttattttccacaaaatattttggaaagccacttcaataggatttcactcttggaaaagtagagctgtgtggtcaaaatcaatatgagaaagctgccttgcaatctgaacttgggttttccctgcaatagaaattgaattctgcctctttttgaaaaaaatgtattcacatacaaatcttcacatggacacatgttttcatttcccttggataaatacctaggtaggggattgctgggccatatgataagcatatgtttcagttctaccaatcttgtttccagagtagtgacatttctgtgctcctaccatcaccatgtaagaattcccgggagctccatgcctttttaattttagccattcttctgcctcatttcttaaaattagagaattaaggtcccgaaggtggaacatgcttcatggtcacacatacaggcacaaaaacagcattatgtggacgcctcatgtattttttatagagtcaactatttcctctttattttccctcattgaaagatgcaaaacagctctctattgtgtacagaaagggtaaataatgcaaaatacctggtagtaaaataaatgctgaaaattttcctttaaaatagaatcattaggccaggcgtggtggctcatgcttgtaatcccagcactttggtaggctgaggtaggtggatcacctgaggtcaggagttcgagtccagcctggccaatatgctgaaaccctgtctctactaaaattacaaaaattagccggccatggtggcaggtgcttgtaatcccagctacttgggaggctgaggcaggagaatcacttgaaccaggaaggcagaggttgcactgagctgagattgtgccactgcactccagcctgggcaacaagagcaaaactctgtctgg

SEQ ID NO: 607 - DNA, 2415 bp, Homo sapiens
acaagggtggcagcctggctctgaagtggaattatgtgcttcaaacaggttgaaagagggaaacagtcttttcctgcttccagacatgaatcaggtcactattcaatgggatgcagtaatagccctttacatactcttcagctggtgtcatggaggaattacaaatataaactgctctggccacatctgggtagaaccagccacaatttttaagatgggtatgaatatctctatatattgccaagcagcaattaagaactgccaaccaaggaaacttcatttttataaaaatggcatcaaagaaagatttcaaatcacaaggattaataaaacaacagctcggctttggtataaaaactttctggaaccacatgcttctatgtactgcactgctgaatgtcccaaacattttcaagagacactgatatgtggaaaagacatttcttctggatatccgccagatattcctgatgaagtaacctgtgtcatttatgaatattcaggcaacatgacttgcacctggaatgctgggaagctcacctacatagacacaaaatacgtggtacatgtgaagagtttagagacagaagaagagcaacagtatctcacctcaagctatattaacatctccactgattcattacaaggtggcaagaagtacgtatttcaagtgagatgtcaagaaacaggcaaaaggtactggcagccttggagttcactgttttttcataaaacacctgaaacagttccccaggtcacatcaaaagcattccaacatgacacatggaattctgggctaacagttgcttccatctctacagggcaccttacttctggattaaaagaaggatcttattgttaataccaaagtggctttatgaagatattcctaatatgaaaaacagcaatgttgtgaaaatgctacaggaaaatagtgaacttatgaataataattccagtgagcaggtcctatatgttgatcccatgattacagagataaaagaaatcttcatcccagaacacaagcctacagactacaagaaggagaatacaggacccctggagacaagagactacccgcaaaactcgctattcgacaatactacagttgtatatattcctgatctcaacactggatataaaccccaaatttcaaattttctgcctgagggaagccatctcagcaataataatgaaattacttccttaacacttaaaccaccagttgattccttagactcaggaaataatcccaggttacaaaagcatcctaattttgctttttctgtttcaagtgtgaattcactaagcaacacaatatttcttggagaattaagcctcatattaaatcaaggagaatgcagttctcctgacatacaaaactcagtagaggaggaaaccaccatgcttttggaaaatgattcacccagtgaaactattccagaacagaccctgcttcctgatgaatttgtctcctgtttggggatcgtgaatgaggagttgccatctattaatacttattttccacaaaatattttggaaagccacttcaataggatttcactcttggaaaagtagagctgtgtggtcaaaatcaatatgagaaagctgccttgcaatctgaacttgggttttccctgcaatagaaattgaattctgcctctttttgaaaaaaatgtattcacatacaaatcttcacatggacacatgttttcatttcccttggataaatacctaggtaggggattgctgggccatatgataagcatatgtttcagttctaccaatcttgtttccagagtagtgacatttctgtgctcctaccatcaccatgtaagaattcccgggagctccatgcctttttaattttagccattcttctgcctcatttcttaaaattagagaattaaggtcccgaaggtggaacatgcttcatggtcacacatacaggcacaaaaacagcattatgtggacgcctcatgtattttttatagagtcaactatttcctctttattttccctcattgaaagatgcaaaacagctctctattgtgtacagaaagggtaaataatgcaaaatacctggtagtaaaataaatgctgaaaattttcctttaaaatagaatcattaggccaggcgtggtggctcatgcttgtaatcccagcactttggtaggctgaggtaggtggatcacctgaggtcaggagttcgagtccagcctggccaatatgctgaaaccctgtctctactaaaattacaaaaattagccggccatggtggcaggtgcttgtaatcccagctacttgggaggctgaggcaggagaatcacttgaaccaggaaggcagaggttgcactgagctgagattgtgccactgcactccagcctgggcaacaagagcaaaactctgtctgg

SEQ ID NO: 608 - DNA, 1295 bp, Homo sapiens
ctcattttctcttgccaccactaagtaagaagagccttttgcctcccaccatgattctgaggccttaccagccatgtggaactgttaaagaatttgacaccaattttacatatgtgcaacagtcagaattctacttggagccaaacattaagtacgtatttcaagtgagatgtcaagaaacaggcaaaaggtactggcagccttggagttcactgttttttcataaaacacctgaaacagttccccaggtcacatcaaaagcattccaacatgacacatggaattctgggctaacagttgcttccatctctacagggcaccttacttctgacaacagaggagacattggacttttattgggaatgatcgtctttgctgttatgttgtcaattctttctttgattgggatatttaacagatcattccgaactgggattaaaagaaggatcttattgttaataccaaagtggctttatgaagatattcctaatatgaaaaacagcaatgttgtgaaaatgctacaggaaaatagtgaacttatgaataataattccagtgagcaggtcctatatgttgatcccatgattacagagataaaagaaatcttcatcccagaacacaagcctacagactacaagaaggagaatacaggacccctggagacaagagactacccgcaaaactcgctattcgacaatactacagttgtatatattcctgatctcaacactggatataaaccccaaatttcaaattttctgcctgagggaagccatctcagcaataataatgaaattacttccttaacacttaaaccaccagttgattccttagactcaggaaataatcccaggttacaaaagcatcctaattttgctttttctgtttcaagtgtgaattcactaagcaacacaatatttcttggagaattaagcctcatattaaatcaaggagaatgcagttctcctgacatacaaaactcagtagaggaggaaaccaccatgcttttggaaaatgattcacccagtgaaactattccagaacagaccctgcttcctgatgaatttgtctcctgtttggggatcgtgaatgaggagttgccatctattaatacttattttccacaaaatattttggaaagccacttcaataggatttcactcttggaaaagtagagctgtgtggtcaaaatcaatatgagaaagctgccttgcaatctgaacttgggttttccctgcaatagaaattgaattctgcctctttttgaaaaaaatgtattcacatacaaatcttca

SEQ ID NO: 609 - DNA, 2722 bp, Homo sapiens
acaagggtggcagcctggctctgaagtggaattatgtgcttcaaacaggttgaaagagggaaacagtcttttcctgcttccagacatgaatcaggtcactattcaatgggatgcagtaatagccctttacatactcttcagctggtgtcatggaggaattacaaatataaactgctctggccacatctgggtagaaccagccacaatttttaagatgggtatgaatatctctatatattgccaagcagcaattaagaactgccaaccaaggaaacttcatttttataaaaatggcatcaaagaaagatttcaaatcacaaggattaataaaacaacagctcggctttggtataaaaactttctggaaccacatgcttctatgtactgcactgctgaatgtcccaaacattttcaagagacactgatatgtggaaaagacatttcttctggatatccgccagatattcctgatgaagtaacctgtgtcatttatgaatattcaggcaacatgacttgcacctggaatgctgggaagctcacctacatagacacaaaatacgtggtacatgtgaagagtttagagacagaagaagagcaacagtatctcacctcaagctatattaacatctccactgattcattacaaggtggcaagaagtacttggtttgggtccaagcagcaaacgcactaggcatggaagagtcaaaacaactgcaaattcacctggatgatatagtgataccttctgcagccgtcatttccagggctgagactataaatgctacagtgcccaagaccataatttattgggatagtcaaacaacaattgaaaaggtttcctgtgaaatgagatacaaggctacaacaaaccaaacttggaatgttaaagaatttgacaccaattttacatatgtgcaacagtcagaattctacttggagccaaacattaagtacgtatttcaagtgagatgtcaagaaacaggcaaaaggtactggcagccttggagttcactgttttttcataaaacacctgaaacagacaacagaggagacattggacttttattgggaatgatcgtctttgctgttatgttgtcaattctttctttgattgggatatttaacagatcattccgaactgggattaaaagaaggatcttattgttaataccaaagtggctttatgaagatattcctaatatgaaaaacagcaatgttgtgaaaatgctacaggaaaatagtgaacttatgaataataattccagtgagcaggtcctatatgttgatcccatgattacagagataaaagaaatcttcatcccagaacacaagcctacagactacaagaaggagaatacaggacccctggagacaagagactacccgcaaaactcgctattcgacaatactacagttgtatatattcctgatctcaacactggatataaaccccaaatttcaaattttctgcctgagggaagccatctcagcaataataatgaaattacttccttaacacttaaaccaccagttgattccttagactcaggaaataatcccaggttacaaaagcatcctaattttgctttttctgtttcaagtgtgaattcactaagcaacacaatatttcttggagaattaagcctcatattaaatcaaggagaatgcagttctcctgacatacaaaactcagtagaggaggaaaccaccatgcttttggaaaatgattcacccagtgaaactattccagaacagaccctgcttcctgatgaatttgtctcctgtttggggatcgtgaatgaggagttgccatctattaatacttattttccacaaaatattttggaaagccacttcaataggatttcactcttggaaaagtagagctgtgtggtcaaaatcaatatgagaaagctgccttgcaatctgaacttgggttttccctgcaatagaaattgaattctgcctctttttgaaaaaaatgtattcacatacaaatcttcacatggacacatgttttcatttcccttggataaatacctaggtaggggattgctgggccatatgataagcatatgtttcagttctaccaatcttgtttccagagtagtgacatttctgtgctcctaccatcaccatgtaagaattcccgggagctccatgcctttttaattttagccattcttctgcctcatttcttaaaattagagaattaaggtcccgaaggtggaacatgcttcatggtcacacatacaggcacaaaaacagcattatgtggacgcctcatgtattttttatagagtcaactatttcctctttattttccctcattgaaagatgcaaaacagctctctattgtgtacagaaagggtaaataatgcaaaatacctggtagtaaaataaatgctgaaaattttcctttaaaatagaatcattaggccaggcgtggtggctcatgcttgtaatcccagcactttggtaggctgaggtaggtggatcacctgaggtcaggagttcgagtccagcctggccaatatgctgaaaccctgtctctactaaaattacaaaaattagccggccatggtggcaggtgcttgtaatcccagctacttgggaggctgaggcaggagaatcacttgaaccaggaaggcagaggttgcactgagctgagattgtgccactgcactccagcctgggcaacaagagcaaaactctgtctgg

SEQ ID NO: 610 - DNA, 2509 bp, Homo sapiens
acaagggtggcagcctggctctgaagtggaattatgtgcttcaaacaggttgaaagagggaaacagtcttttcctgcttccagacatgaatcaggtcactattcaatgggatgcagtaatagccctttacatactcttcagctggtgtcatggaggaattacaaatataaactgctctggccacatctgggtagaaccagccacaatttttaagatgggtatgaatatctctatatattgccaagcagcaattaagaactgccaaccaaggaaacttcatttttataaaaatggcatcaaagaaagatttcaaatcacaaggattaataaaacaacagctcggctttggtataaaaactttctggaaccacatgcttctatgtactgcactgctgaatgtcccaaacattttcaagagacactgatatgtggaaaagacatttcttctggatatccgccagatattcctgatgaagtaacctgtgtcatttatgaatattcaggcaacatgacttgcacctggaatgctgggaagctcacctacatagacacaaaatacgtggtacatgtgaagagtttagagacagaagaagagcaacagtatctcacctcaagctatattaacatctccactgattcattacaaggtggcaagaagtacttggtttgggtccaagcagcaaacgcactaggcatggaagagtcaaaacaactgcaaattcacctggatgatatagttccccaggtcacatcaaaagcattccaacatgacacatggaattctgggctaacagttgcttccatctctacagggcaccttacttctgacaacagaggagacattggacttttattgggaatgatcgtctttgctgttatgttgtcaattctttctttgattgggatatttaacagatcattccgaactgggattaaaagaaggatcttattgttaataccaaagtggctttatgaagatattcctaatatgaaaaacagcaatgttgtgaaaatgctacaggaaaatagtgaacttatgaataataattccagtgagcaggtcctatatgttgatcccatgattacagagataaaagaaatcttcatcccagaacacaagcctacagactacaagaaggagaatacaggacccctggagacaagagactacccgcaaaactcgctattcgacaatactacagttgtatatattcctgatctcaacactggatataaaccccaaatttcaaattttctgcctgagggaagccatctcagcaataataatgaaattacttccttaacacttaaaccaccagttgattccttagactcaggaaataatcccaggttacaaaagcatcctaattttgctttttctgtttcaagtgtgaattcactaagcaacacaatatttcttggagaattaagcctcatattaaatcaaggagaatgcagttctcctgacatacaaaactcagtagaggaggaaaccaccatgcttttggaaaatgattcacccagtgaaactattccagaacagaccctgcttcctgatgaatttgtctcctgtttggggatcgtgaatgaggagttgccatctattaatacttattttccacaaaatattttggaaagccacttcaataggatttcactcttggaaaagtagagctgtgtggtcaaaatcaatatgagaaagctgccttgcaatctgaacttgggttttccctgcaatagaaattgaattctgcctctttttgaaaaaaatgtattcacatacaaatcttcacatggacacatgttttcatttcccttggataaatacctaggtaggggattgctgggccatatgataagcatatgtttcagttctaccaatcttgtttccagagtagtgacatttctgtgctcctaccatcaccatgtaagaattcccgggagctccatgcctttttaattttagccattcttctgcctcatttcttaaaattagagaattaaggtcccgaaggtggaacatgcttcatggtcacacatacaggcacaaaaacagcattatgtggacgcctcatgtattttttatagagtcaactatttcctctttattttccctcattgaaagatgcaaaacagctctctattgtgtacagaaagggtaaataatgcaaaatacctggtagtaaaataaatgctgaaaattttcctttaaaatagaatcattaggccaggcgtggtggctcatgcttgtaatcccagcactttggtaggctgaggtaggtggatcacctgaggtcaggagttcgagtccagcctggccaatatgctgaaaccctgtctctactaaaattacaaaaattagccggccatggtggcaggtgcttgtaatcccagctacttgggaggctgaggcaggagaatcacttgaaccaggaaggcagaggttgcactgagctgagattgtgccactgcactccagcctgggcaacaagagcaaaactctgtctgg

SEQ ID NO: 611 - DNA, 2505 bp, Homo sapiens
acaagggtggcagcctggctctgaagtggaattatgtgcttcaaacaggttgaaagagggaaacagtcttttcctgcttccagacatgaatcaggtcactattcaatgggatgcagtaatagccctttacatactcttcagctggtgtcatggaggaattacaaatataaactgctctggccacatctgggtagaaccagccacaatttttaagatgggtatgaatatctctatatattgccaagcagcaattaagaactgccaaccaaggaaacttcatttttataaaaatggcatcaaagaaagatttcaaatcacaaggattaataaaacaacagctcggctttggtataaaaactttctggaaccacatgcttctatgtactgcactgctgaatgtcccaaacattttcaagagacactgatatgtggaaaagacatttcttctggatatccgccagatattcctgatgaagtaacctgtgtcatttatgaatattcaggcaacatgacttgcacctggaatgctgggaagctcacctacatagacacaaaatacgtggtacatgtgaagaggttaaagaatttgacaccaattttacatatgtgcaacagtcagaattctacttggagccaaacattaagtacgtatttcaagtgagatgtcaagaaacaggcaaaaggtactggcagccttggagttcactgttttttcataaaacacctgaaacagttccccaggtcacatcaaaagcattccaacatgacacatggaattctgggctaacagttgcttccatctctacagggcaccttacttctgacaacagaggagacattggacttttattgggaatgatcgtctttgctgttatgttgtcaattctttctttgattgggatatttaacagatcattccgaactgggattaaaagaaggatcttattgttaataccaaagtggctttatgaagatattcctaatatgaaaaacagcaatgttgtgaaaatgctacaggaaaatagtgaacttatgaataataattccagtgagcaggtcctatatgttgatcccatgattacagagataaaagaaatcttcatcccagaacacaagcctacagactacaagaaggagaatacaggacccctggagacaagagactacccgcaaaactcgctattcgacaatactacagttgtatatattcctgatctcaacactggatataaaccccaaatttcaaattttctgcctgagggaagccatctcagcaataataatgaaattacttccttaacacttaaaccaccagttgattccttagactcaggaaataatcccaggttacaaaagcatcctaattttgctttttctgtttcaagtgtgaattcactaagcaacacaatatttcttggagaattaagcctcatattaaatcaaggagaatgcagttctcctgacatacaaaactcagtagaggaggaaaccaccatgcttttggaaaatgattcacccagtgaaactattccagaacagaccctgcttcctgatgaatttgtctcctgtttggggatcgtgaatgaggagttgccatctattaatacttattttccacaaaatattttggaaagccacttcaataggatttcactcttggaaaagtagagctgtgtggtcaaaatcaatatgagaaagctgccttgcaatctgaacttgggttttccctgcaatagaaattgaattctgcctctttttgaaaaaaatgtattcacatacaaatcttcacatggacacatgttttcatttcccttggataaatacctaggtaggggattgctgggccatatgataagcatatgtttcagttctaccaatcttgtttccagagtagtgacatttctgtgctcctaccatcaccatgtaagaattcccgggagctccatgcctttttaattttagccattcttctgcctcatttcttaaaattagagaattaaggtcccgaaggtggaacatgcttcatggtcacacatacaggcacaaaaacagcattatgtggacgcctcatgtattttttatagagtcaactatttcctctttattttccctcattgaaagatgcaaaacagctctctattgtgtacagaaagggtaaataatgcaaaatacctggtagtaaaataaatgctgaaaattttcctttaaaatagaatcattaggccaggcgtggtggctcatgcttgtaatcccagcactttggtaggctgaggtaggtggatcacctgaggtcaggagttcgagtccagcctggccaatatgctgaaaccctgtctctactaaaattacaaaaattagccggccatggtggcaggtgcttgtaatcccagctacttgggaggctgaggcaggagaatcacttgaaccaggaaggcagaggttgcactgagctgagattgtgccactgcactccagcctgggcaacaagagcaaaactctgtctgg

SEQ ID NO: 612 - DNA, 2655 bp, Homo sapiens
acaagggtggcagcctggctctgaagtggaattatgtgcttcaaacaggttgaaagagggaaacagtcttttcctgcttccagacatgaatcaggtcactattcaatgggatgcagtaatagccctttacatactcttcagctggtgtcatggaggaattacaaatataaactgctctggccacatctgggtagaaccagccacaatttttaagatgggtatgaatatctctatatattgccaagcagcaattaagaactgccaaccaaggaaacttcatttttataaaaatggcatcaaagaaagatttcaaatcacaaggattaataaaacaacagctcggctttggtataaaaactttctggaaccacatgcttctatgtactgcactgctgaatgtcccaaacattttcaagagacactgatatgtggaaaagacatttcttctggatatccgccagatattcctgatgaagtaacctgtgtcatttatgaatattcaggcaacatgacttgcacctggaatgctgggaagctcacctacatagacacaaaatacgtggtacatgtgaagagtttagagacagaagaagagcaacagtatctcacctcaagctatattaacatctccactgattcattacaaggtggcaagaagtacttggtttgggtccaagcagcaaacgcactaggcatggaagagtcaaaacaactgcaaattcacctggatgatatagtgataccttctgcagccgtcatttccagggctgagactataaatgctacagtgcccaagaccataatttattgggatagtcaaacaacaattgaaaaggtttcctgtgaaatgagatacaaggctacaacaaaccaaacttggaatttccccaggtcacatcaaaagcattccaacatgacacatggaattctgggctaacagttgcttccatctctacagggcaccttacttctgacaacagaggagacattggacttttattgggaatgatcgtctttgctgttatgttgtcaattctttctttgattgggatatttaacagatcattccgaactgggattaaaagaaggatcttattgttaataccaaagtggctttatgaagatattcctaatatgaaaaacagcaatgttgtgaaaatgctacaggaaaatagtgaacttatgaataataattccagtgagcaggtcctatatgttgatcccatgattacagagataaaagaaatcttcatcccagaacacaagcctacagactacaagaaggagaatacaggacccctggagacaagagactacccgcaaaactcgctattcgacaatactacagttgtatatattcctgatctcaacactggatataaaccccaaatttcaaattttctgcctgagggaagccatctcagcaataataatgaaattacttccttaacacttaaaccaccagttgattccttagactcaggaaataatcccaggttacaaaagcatcctaattttgctttttctgtttcaagtgtgaattcactaagcaacacaatatttcttggagaattaagcctcatattaaatcaaggagaatgcagttctcctgacatacaaaactcagtagaggaggaaaccaccatgcttttggaaaatgattcacccagtgaaactattccagaacagaccctgcttcctgatgaatttgtctcctgtttggggatcgtgaatgaggagttgccatctattaatacttattttccacaaaatattttggaaagccacttcaataggatttcactcttggaaaagtagagctgtgtggtcaaaatcaatatgagaaagctgccttgcaatctgaacttgggttttccctgcaatagaaattgaattctgcctctttttgaaaaaaatgtattcacatacaaatcttcacatggacacatgttttcatttcccttggataaatacctaggtaggggattgctgggccatatgataagcatatgtttcagttctaccaatcttgtttccagagtagtgacatttctgtgctcctaccatcaccatgtaagaattcccgggagctccatgcctttttaattttagccattcttctgcctcatttcttaaaattagagaattaaggtcccgaaggtggaacatgcttcatggtcacacatacaggcacaaaaacagcattatgtggacgcctcatgtattttttatagagtcaactatttcctctttattttccctcattgaaagatgcaaaacagctctctattgtgtacagaaagggtaaataatgcaaaatacctggtagtaaaataaatgctgaaaattttcctttaaaatagaatcattaggccaggcgtggtggctcatgcttgtaatcccagcactttggtaggctgaggtaggtggatcacctgaggtcaggagttcgagtccagcctggccaatatgctgaaaccctgtctctactaaaattacaaaaattagccggccatggtggcaggtgcttgtaatcccagctacttgggaggctgaggcaggagaatcacttgaaccaggaaggcagaggttgcactgagctgagattgtgccactgcactccagcctgggcaacaagagcaaaactctgtctgg

SEQ ID NO: 613 - DNA, 886 bp, Homo sapiens
acaagggtggcagcctggctctgaagtggaattatgtgcttcaaacaggttgaaagagggaaacagtcttttcctgcttccagacatgaatcaggtcactattcaatgggatgcagtaatagccctttacatactcttcagctggtgtcatggaggaattacaaatataaactgctctggccacatctgggtagaaccagccacaatttttaagatgggtatgaatatctctatatattgccaagcagcaattaagaactgccaaccaaggaaacttcatttttataaaaatggcatcaaagaaagatttcaaatcacaaggattaataaaacaacagctcggctttggtataaaaactttctggaaccacatgcttctatgtactgcactgctgaatgtcccaaacattttcaagagacactgatatgtggaaaagacatttcttctggatatccgccagatattcctgatgaagtaacctgtgtcatttatgaatattcaggcaacatgacttgcacctggaatgctgggaagctcacctacatagacacaaaatacgtggtacatgtgaagagtttagagacagaagaagagcaacagtatctcacctcaagctatattaacatctccactgattcattacaaggtggcaagaagtacttggtttgggtccaagcagcaaacgcactaggcatggaagagtcaaaacaactgcaaattcacctggatgatatagtgataccttctgcagccgtcatttccagggctgagactataaatgctacagtgcccaagaccataatttattgggatagtcaaacaacaattgaaaaggtttcctgtgaaatgagatacaaggctacaacaaaccaaacttggaatgat

SEQ ID NO: 614 - DNA, 1041 bp, Homo sapiens
aaaacaacaggaagcagcttacaaactcggtgaacaactgagggaaccaaaccagagacgcgctgaacagagagaatcaggctcaaagcaagtggaagtgggcagagattccaccaggactggtgcaaggcgcagagccagccagatttgagaagaaggcaaaaagatgctggggagcagagctgtaatgctgctgttgctgctgccctggacagctcagggcagagctgtgcctgggggcagcagccctgcctggactcagtgccagcagctttcacagaagctctgcacactggcctggagtgcacatccactagtgggacacatggatctaagagaagagggagatgaagagactacaaatgatgttccccatatccagtgtggagatggctgtgacccccaaggactcagggacaacagtcagttctgcttgcaaaggatccaccagggtctgattttttatgagaagctgctaggatcggatattttcacaggggagccttctctgctccctgatagccctgtgggccagcttcatgcctccctactgggcctcagccaactcctgcagcctgagggtcaccactgggagactcagcagattccaagcctcagtcccagccagccatggcagcgtctccttctccgcttcaaaatccttcgcagcctccaggcctttgtggctgtagccgcccgggtctttgcccatggagcagcaaccctgagtccctaaaggcagcagctcaaggatggcactcagatctccatggcccagcaaggccaagataaatctaccaccccaggcacctgtgagccaacaggttaattagtccattaattttagtgggacctgcatatgttgaaaattaccaatactgactgacatgtgatgctgacctatgataaggttgagtatttattagatgggaagggaaatttggggattatttatcctcctggggacagtttggggaggattatttattgtatttatattgaattatgtacttttttcaataaagtcttatttttgtggct

SEQ ID NO: 615 - DNA, 1701 bp, Homo sapiens
cttgcctgcaaacctttacttctgaaatgacttccacggctgggacgggaaccttccacccacagctatgcctctgattggtgaatggtgaaggtgcctgtctaacttttctgtaaaaagaaccagctgcctccaggcagccagccctcaagcatcacttacaggaccagagggacaagacatgactgtgatgaggagctgctttcgccaatttaacaccaagaagaattgaggctgcttgggaggaaggccaggaggaacacgagactgagagatgaattttcaacagaggctgcaaagcctgtggactttagccagacccttctgccctcctttgctggcgacagcctctcaaatgcagatggttgtgctcccttgcctgggttttaccctgcttctctggagccaggtatcaggggcccagggccaagaattccactttgggccctgccaagtgaagggggttgttccccagaaactgtgggaagccttctgggctgtgaaagacactatgcaagctcaggataacatcacgagtgcccggctgctgcagcaggaggttctgcagaacgtctcggatgctgagagctgttaccttgtccacaccctgctggagttctacttgaaaactgttttcaaaaactaccacaatagaacagttgaagtcaggactctgaagtcattctctactctggccaacaactttgttctcatcgtgtcacaactgcaacccagtcaagaaaatgagatgttttccatcagagacagtgcacacaggcggtttctgctattccggagagcattcaaacagttggacgtagaagcagctctgaccaaagcccttggggaagtggacattcttctgacctggatgcagaaattctacaagctctgaatgtctagaccaggacctccctccccctggcactggtttgttccctgtgtcatttcaaacagtctcccttcctatgctgttcactggacacttcacgcccttggccatgggtcccattcttggcccaggattattgtcaaagaagtcattctttaagcagcgccagtgacagtcagggaaggtgcctctggatgctgtgaagagtctacagagaagattcttgtatttattacaactctatttaattaatgtcagtatttcaactgaagttctatttatttgtgagactgtaagttacatgaaggcagcagaatattgtgccccatgcttctttacccctcacaatccttgccacagtgtggggcagtggatgggtgcttagtaagtacttaataaactgtggtgctttttttggcctgtctttggattgttaaaaaacagagagggatgcttggatgtaaaactgaacttcagagcatgaaaatcacactgtcttctgatatctgcagggacagagcattggggtgggggtaaggtgcatctgtttgaaaagtaaacgataaaatgtggattaaagtgcccagcacaaagcagatcctcaataaacatttcatttcccacccacactcgccagctcaccccatcatccctttcccttggtgccctccttttttttttatcctagtcattcttccctaatcttccacttgagtgtcaagctgaccttgctgatggtgacattgcacctggatgtactatccaatctgtgatgacattccctgctaataaaagacaacataactcaa

SEQ ID NO: 616 - DNA, 1819 bp, Homo sapiens
cttgcctgcaaacctttacttctgaaatgacttccacggctgggacgggaaccttccacccacagctatgcctctgattggtgaatggtgaaggtgcctgtctaacttttctgtaaaaagaaccagctgcctccaggcagccagccctcaagcatcacttacaggaccagagggacaagacatgactgtgatgaggagctgctttcgccaatttaacaccaagaagaattgaggctgcttgggaggaaggccaggaggaacacgagactgagagatgaattttcaacagaggctgcaaagcctgtggactttagccagcagacccttctgccctcctttgctggcgacagcctctcaaatgcagatggttgtgctcccttgcctgggttttaccctgcttctctggagccaggtatcaggggcccagggccaagaattccactttgggccctgccaagtgaagggggttgttccccagaaactgtgggaagccttctgggctgtgaaagacactatgcaagctcaggataacatcacgagtgcccggctgctgcagcaggaggttctgcagaacgtctcgcaagaaaatgagatgttttccatcagagacagtgcacacaggcggtttctgctattccggagagcattcaaacagttggacgtagaagcagctctgaccaaagcccttggggaagtggacattcttctgacctggatgcagaaattctacaagctctgaatgtctagaccaggacctccctccccctggcactggtttgttccctgtgtcatttcaaacagtctcccttcctatgctgttcactggacacttcacgcccttggccatgggtcccattcttggcccaggattattgtcaaagaagtcattctttaagcagcgccagtgacagtcagggaaggtgcctctggatgctgtgaagagtctacagagaagattcttgtatttattacaactctatttaattaatgtcagtatttcaactgaagttctatttatttgtgagactgtaagttacatgaaggcagcagaatattgtgccccatgcttctttacccctcacaatccttgccacagtgtggggcagtggatgggtgcttagtaagtacttaataaactgtggtgctttttttggcctgtctttggattgttaaaaaacagagagggatgcttggatgtaaaactgaacttcagagcatgaaaatcacactgtcttctgatatctgcagggacagagcattggggtgggggtaaggtgcatctgtttgaaaagtaaacgataaaatgtggattaaagtgcccagcacaaagcagatcctcaataaacatttcatttcccacccacactcgccagctcaccccatcatccctttcccttggtgccctccttttttttttatcctagtcattcttccctaatcttccacttgagtgtcaagctgaccttgctgatggtgacattgcacctggatgtactatccaatctgtgatgacattccctgctaataaaagacaacataactcaagtctggcagactttcttctctatttctggatgaatgcccagtgagactgtgttgtacagctagaaaaggccttcttcccaatagcaaggctgtgcatctagcctcaagctctggctgaactttgtggtcgacatcaatctaaagatacagtgtctgactataaccttgttccaaaaacctaggcaaagagtatatgtaggaggtgggatatcacttccatgacataagtgctattgcagagccgtggccacccaggaactcctgactgctttcc

SEQ ID NO: 617 - DNA, 1320 bp, Homo sapiens
gcttgcctgcaaacctttacttctgaaatgacttccacggctgggacgggaaccttccacccacagctatgcctctgattggtgaatggtgaaggtgcctgtctaacttttctgtaaaaagaaccagctgcctccaggcagccagccctcaagcatcacttacaggaccagagggacaagacatgactgtgatgaggagctgctttcgccaatttaacaccaagaagaattgaggctgcttgggaggaaggccaggaggaacacgagactgagagatgaattttcaacagaggctgcaaagcctgtggactttagccagcagacccttctgccctcctttgctggcgacagcctctcaaatgcagatggttgtgctcccttgcctgggttttaccctgcttctctggagccaggtatcaggggcccagggccaagaattccactttgggccctgccaagtgaagggggttgttccccagaaactgtgggaagccttctgggctgtgaaagacactatgcaagctcaggataacatcacgagtgcccggctgctgcagcaggaggttctgcagaacgtctcggatgctgagagctgttaccttgtccacaccctgctggagttctacttgaaaactgttttcaaaaactaccacaatagaacagttgaagtcaggactctgaagtcattctctactctggccaacaactttgttctcatcgtgtcacaactgcaacccagtcaagaaaatgagatgttttccatcagagacagtgcacacaggcggtttctgctattccggagagcattcaaacagttggacgtagaagcagctctgaccaaagcccttggggaagtggacattcttctgacctggatgcagaaattctacaagctctgaatgtctagaccaggacctccctccccctggcactggtttgttccctgtgtcatttcaaacagtctcccttcctatgctgttcactggacacttcacgcccttggccatgggtcccattcttggcccaggattattgtcaaagaagtcattctttaagcagcgccagtgacagtcagggaaggtgcctctggatgctgtgaagagtctacagagaagattcttgtatttattacaactctatttaattaatgtcagtatttcaactgaagttctatttatttgtgagactgtaagttacatgaaggcagcagaatattgtgccccatgcttctttacccctcacaatccttgccacagtgtggggcagtggatgggtgcttagtaagtacttaataaactgtggtgctttttttggcctgtc

SEQ ID NO: 618 - DNA, 1315 bp, Homo sapiens
ggcttgctgaaaataaaatcaggactcctaacctgctccagtcagcctgcttccacgaggcctgtcagtcagtgccccacttgtgactgagtgtgcagtgcccagcatgtaccaggtcagtgcagagggctgcctgagggctgtgctgagagggagaggagcagagatgctgctgagggtggagggaggccaagctgccaggtttggggctgggggccaagtggagtgagaaactgggatcccagggggagggtgcagatgagggagcgacccagattaggtgaggacagttctctcattagccttttcctacaggtggttgcattcttggcaatggtcatgggaacccacacctacagccactggcccagctgctgccccagcaaagggcaggacacctctgaggagctgctgaggtggagcactgtgcctgtgcctcccctagagcctgctaggcccaaccgccacccagagtcctgtagggccagtgaagatggacccctcaacagcagggccatctccccctggagatatgagttggacagagacttgaaccggctcccccaggacctgtaccacgcccgttgcctgtgcccgcactgcgtcagcctacagacaggctcccacatggacccccggggcaactcggagctgctctaccacaaccagactgtcttctaccggcggccatgccatggcgagaagggcacccacaagggctactgcctggagcgcaggctgtaccgtgtttccttagcttgtgtgtgtgtgcggccccgtgtgatgggctagccggacctgctggaggctggtccctttttgggaaacctggagccaggtgtacaaccacttgccatgaagggccaggatgcccagatgcttggcccctgtgaagtgctgtctggagcagcaggatcccgggacaggatggggggctttggggaaagcctgcacttctgcacattttgaaaagagcagctgctgcttagggccgccggaagctggtgtcctgtcattttctctcaggaaaggttttcaaagttctgcccatttctggaggccaccactcctgtctcttcctcttttcccatcccctgctaccctggcccagcacaggcactttctagatatttcccccttgctggagaagaaagagcccctggttttatttgtttgtttactcatcactcagtgagcatctactttgggtgcattctagtgtagttactagtcttttgacatggatgattctgaggaggaagctgttattgaatgtatagagatttatccaaataaatatctttatttaaaaatg

SEQ ID NO: 619 - DNA, 744 bp, Homo sapiens
ctcaagtcactccctaaaaagacagtggaaataaatttgaataaacaaaacaggcttgctgaaaataaaatcaggactcctaacctgctccagtcagcctgcttccacgaggcctgtcagtcagtgccccacttgtgactgagtgtgcagtgcccagcatgtaccaggtggttgcattcttggcaatggtcatgggaacccacacctacagccactggcccagctgctgccccagcaaagggcaggacacctctgaggagctgctgaggtggagcactgtgcctgtgcctcccctagagcctgctaggcccaaccgccacccagagtcctgtagggccagtgaagatggacccctcaacagcagggccatctccccctggagatatgagttggacagagacttgaaccggctcccccaggacctgtaccacgcccgttgcctgtgcccgcactgcgtcagcctacagacaggctcccacatggacccccggggcaactcggagctgctctaccacaaccagactgtcttctaccggcggccatgccatggcgagaagggcacccacaagggctactgcctggagcgcaggctgtaccgtgtttccttagcttgtgtgtgtgtgcggccccgtgtgatgggctagccggacctgctggaggctggtccctttttgggaaacctggagccaggtgtacaaccacttgccatgaagggccaggatgcccagatgcttggcccctgtg

SEQ ID NO: 620 - DNA, 1075 bp, Homo sapiens
atctaaccggcattagtatctcttgggctgctgtgagtgacacacgctgagtggggtgaagggaaatgctggtgaatttcattttgaggtgtgggttgctgttagtcactctgtctcttgccattgccaagcacaagcaatcttccttcaccaaaagttgttacccaaggggaacattgtcccaagctgttgacgctctctatatcaaagcagcatggctcaaagcaacgattccagaagaccgcataaaaaatatacgattattaaaaaagaaaacaaaaaagcagtttatgaaaaactgtcaatttcaagaacagcttctgtccttcttcatggaagacgtttttggtcaactgcaattgcaaggctgcaagaaaatacgctttgtggaggactttcatagccttaggcagaaattgagccactgtatttcctgtgcttcatcagctagagagatgaaatccattaccaggatgaaaagaatattttataggattggaaacaaaggaatctacaaagccatcagtgaactggatattcttctttcctggattaaaaaattattggaaagcagtcagtaaaccaaagccaagtacattgattttacagttattttgaaatacaataagaactgctagaaatatgtttataacagtctatttcttttaaaaactttttaacataatactgacggcatgttaggtgattcagaatagacaagaaggatttagtaaattaacgttttggatataagttgtcactaatttgcacattttctgtgttttcaaataatgtttccattctgaacatgttttgtcattcacaagtacattgtgtcaacttaatttaaagtatgtaacctgaattaactcgtgtaatatttgtgtgtggagtgggatgtggggggtggagggggaatgacagatttctggaatgcaatgtaatgttactgagacttaaatagatgttatgtatatgattgtctgtttaagtgtttgaaaattgttaattatgcccagtgtgaacttagtacttaacacattttgattttaattaaataaattgggtttccttc

SEQ ID NO: 621 - DNA, 1044 bp, Homo sapiens
gaccaaagaggctgggccccgccatgggccagacggcaggcgaccttggctggcggctcagcctgttgctgcttcccttgctcctggttcaagctggtgtctggggattcccaaggcccccagggaggccccagctgagcctgcaggagctgcggagggagttcacagtcagcctgcatctcgccaggaagctgctctccgaggttcggggccaggcccaccgctttgcggaatctcacctgccaggagtgaacctgtacctcctgcccctgggagagcagctccctgatgtttccctgaccttccaggcctggcgccgcctctctgacccggagcgtctctgcttcatctccaccacgcttcagcccttccatgccctgctgggagggctggggacccagggccgctggaccaacatggagaggatgcagctgtgggccatgaggctggacctccgcgatctgcagcggcacctccgcttccaggtgctggctgcaggattcaacctcccggaggaggaggaggaggaagaggaggaggaggaggaggagaggaaggggctgctcccaggggcactgggcagcgccttacagggcccggcccaggtgtcctggccccagctcctctccacctaccgcctgctgcactccttggagctcgtcttatctcgggccgtgcgggagttgctgctgctgtccaaggctgggcactcagtctggcccttggggttcccaacattgagcccccagccctgatcggtggcttcttagccccctgccccccaccctttagaactttaggactggagtcttggcatcagggcagccttcgcatcatcagccttggacaagggagggctcttccagccccctgccccaggctctacccagtaactgaaagcccctctggtcctcgccagctatttatttcttggatatttatttattgtttagggagatgatggtttatttattgtcttggggcccgatggtcctcctcgggccaagcccccatgctgggtgcccaataaagcactctcatcca

SEQ ID NO: 622 - DNA, 734 bp, Homo sapiens
tgggtgacagcctcagagtgtttcttctgctgacaaagaccagagatcaggaatgaaactagacatgactggggactgcacgccagtgctggtgctgatggccgcagtgctgaccgtgactggagcagttcctgtcgccaggctccacggggctctcccggatgcaaggggctgccacatagcccagttcaagtccctgtctccacaggagctgcaggcctttaagagggccaaagatgccttagaagagtcgcttctgctgaaggactgcaggtgccactcccgcctcttccccaggacctgggacctgaggcagctgcaggtgagggagcgccccatggctttggaggctgagctggccctgacgctgaaggttctggaggccaccgctgacactgacccagccctggtggacgtcttggaccagccccttcacaccctgcaccatatcctctcccagttccgggcctgtatccagcctcagcccacggcagggcccaggacccggggccgcctccaccattggctgtaccggctccaggaggccccaaaaaaggagtcccctggctgcctcgaggcctctgtcaccttcaacctcttccgcctcctcacgcgagacctgaattgtgttgccagtggggacctgtgtgtctgaccctcccaccagtcatgcaacctgagattttatttataaattagccacttgtcttaatttattgccacccagtcgctat

SEQ ID NO: 623 - DNA, 656 bp, Homo sapiens
ctgcattccctcagctccctttctctctgtgacacagacatgaccggggactgcatgccagtgctggtgctgatggccgcagtgctgaccgtgactggagcagttcctgtcgccaggctccgcggggctctcccggatgcaaggggctgccacatagcccagttcaagtccctgtctccacaggagctgcaggcctttaagagggccaaagatgccttagaagagtcgcttctgctgaaggactgcaagtgccgctcccgcctcttccccaggacctgggacctgaggcagctgcaggtgagggagcgccccgtggctttggaggctgagctggccctgacgctgaaggttctggaggccaccgctgacactgacccagccctgggggatgtcttggaccagccccttcacaccctgcaccatatcctctcccagctccgggcctgtatccagcctcagcccacggcagggcccaggacccggggccgcctccaccattggctgcaccggctccaggaggccccaaaaaaggagtcccctggctgcctcgaggcctctgtcaccttcaacctcttccgcctcctcacgcgagacctgaattgtgttgccagcggggacctgtgtgtctgacccttccgccagtcatgcaacctgag

SEQ ID NO: 624 - DNA, 856 bp, Homo sapiens
aattaccttttcactttacacacatcatcttggattgcccattttgcgtggctaaaaagcagagccatgccgctggggaagcagttgcgatttagccatggctgcagcttggaccgtggtgctggtgactttggtgctaggcttggccgtggcaggccctgtccccacttccaagcccaccacaactgggaagggctgccacattggcaggttcaaatctctgtcaccacaggagctagcgagcttcaagaaggccagggacgccttggaagagtcactcaagctgaaaaactggagttgcagctctcctgtcttccccgggaattgggacctgaggcttctccaggtgagggagcgccctgtggccttggaggctgagctggccctgacgctgaaggtcctggaggccgctgctggcccagccctggaggacgtcctagaccagccccttcacaccctgcaccacatcctctcccagctccaggcctgtatccagcctcagcccacagcagggcccaggccccggggccgcctccaccactggctgcaccggctccaggaggcccccaaaaaggagtccgctggctgcctggaggcatctgtcaccttcaacctcttccgcctcctcacgcgagacctcaaatatgtggccgatgggaacctgtgtctgagaacgtcaacccaccctgagtccacctgacaccccacaccttatttatgcgctgagccctactccttccttaatttatttcctctcaccctttatttatgaagctgcagccctgactgagacatagggctgagtttattgttttacttttatacattatgcacaaataaacaacaaggaattgga

SEQ ID NO: 625 - DNA, 904 bp, Homo sapiens
ctgaagctggccttgctctctctcgccatggcctctcactcaggcccctcgacgtctgtgctctttctgttctgctgcctgggaggctggctggcctcccacacgttgcccgtccgtttactacgaccaagtgatgatgtacagaaaatagtcgaggaattacagtccctctcgaagatgcttttgaaagatgtggaggaagagaagggcgtgctcgtgtcccagaattacacgctgccgtgtctcagccctgacgcccagccgccaaacaacatccacagcccagccatccgggcatatctcaagacaatcagacagctagacaacaaatctgttattgatgagatcatagagcacctcgacaaactcatatttcaagatgcaccagaaacaaacatttctgtgccaacagacacccatgaatgtaaacgcttcatcctgactatttctcaacagttttcagagtgcatggacctcgcactaaaatcattgacctctggagcccaacaggccaccacttaaggccatctcttcctttcggattggcaggaacttaaggagccttaaaaagatgaccgacagctaagtgtgggaactctgccgtgattccttaagtacatttttccaatgaataatctcagggacccctcatatgggctagtcccgggagggctgagatgtgaatttgtgaattaccttgaaaaacattaggttattgttattagtcttggtatttatggaatgcttttcttctgcaggcttaagtcttacttattataccctcgtgagggtgggaggtggcagctatgttaatttattgatatttattgtactaagagttgtcaatgctccctgggggagccctcggaatctatttaataaattatattgaatttttctcata

SEQ ID NO: 626 - DNA, 1056 bp, Homo sapiens
gtgccaggaagactgcgtgcagaaggtgactgtctcagtggagctgggtcatctcaggccttggctccttgaacttttggccgccatgtgcttcccgaaggtcctctctgatgacatgaagaagctgaaggcccgaatggtgatgtcgagcctggcagagctggaggacgacttcaaagagggctacctggagacagtggcggcttattatgaggagcagcacccagagctcactcctctacttgaaaaagaaagagatggattacggtgccgaggcaacagatcccctgtcccggatgttgaggatcccgcaaccgaggagcctggggagagcttttgtgacaaggtcatgagatggttccaggccatgctgcagcggctgcagacctggtggcacggggttctggcctgggtgaaggagaaggtggtggccctggtccatgcagtgcaggccctctggaaacagttccagagtttctgctgctctctgtcagagctcttcatgtcctctttccagtcctacggagccccacggggggacaaggaggagctgacaccccagaagtgctctgaaccccaatcctcaaaatgaagatactgacaccacctttgccctccccgtcaccgcgcacccaccctgacccctccctcagctgtcctgtgccccgccctctcccgcacactcagtccccctgcctggcgttcctgccgcagctctgacctggtgctgtcgccctggcatcttaataaaacctgcttatacttccctggcaggggagataccatgatcgcggaggtgggtttcccagggcaaggctgatctgttgccgtattagtccgttttcacacagctataaagaatgcctgagactgggtgatgtataaagaaaagaagtttaactgactcacagttccacatggctggggaagcctgaggaagcttacaatcatgggggaaggcggaagagaagcaaggcacgtcctacatggcagcaggagaagcagggtggggggaactaccaaacacttttgtccgcgtgtttgtgtgtttttttt

SEQ ID NO: 627 - DNA, 1105 bp, Homo sapiens
gtactcagggagtttccccagccagctgtcccgagtctggactttccctctgcccctccccactctcaggctggtggggtggggaaagcagcccattcctgggctcagagactcccaccccagctcagagggagcaggggcccagccagggacggaccctcattcctcccagggaccccagacctctgtctctctcgggccttggctccttgaacttttggccgccatgtgcttcccgaaggtcctctctgatgacatgaagaagctgaaggcccgaatgcaccaggccatagaaagattttatgataaaatgcaaaatgcagaatcaggacgtggacaggtgatgtcgagcctggcagagctggaggacgacttcaaagagggctacctggagacagtggcggcttattatgaggagcagcacccagagctcactcctctacttgaaaaagaaagagatggattacggtgccgaggcaacagatcccctgtcccggatgttgaggatcccgcaaccgaggagcctggggagagcttttgtgacaaggtcatgagatggttccaggccatgctgcagcggctgcagacctggtggcacggggttctggcctgggtgaaggagaaggtggtggccctggtccatgcagtgcaggccctctggaaacagttccagagtttctgctgctctctgtcagagctcttcatgtcctctttccagtcctacggagccccacggggggacaaggaggagctgacaccccagaagtgctctgaaccccaatcctcaaaatgaagatactgacaccacctttgccctccccgtcaccgcgcacccaccctgacccctccctcagctgtcctgtgccccgccctctcccgcacactcagtccccctgcctggcgttcctgccgcagctctgacctggtgctgtcgccctggcatcttaataaaacctgcttatacttccctggcaggggagataccatgatcgcggaggtgggtttcccagggcaaggctgatctgttgccgtattagtccgttttcacacagctataaagaatgcctgagactgggtgatgtataaagaaaagaagtttaactga

SEQ ID NO: 628 - DNA, 880 bp, Homo sapiens
gccttggctccttgaacttttggccgccatgtgcttcccgaaggtcctctctgatgacatgaagaagctgaaggcccgaatgcaccaggccatagaaagattttatgataaaatgcaaaatgcagaatcaggacgtggacaggacgacttcaaagagggctacctggagacagtggcggcttattatgaggagcagcacccagagctcactcctctacttgaaaaagaaagagatggattacggtgccgaggcaacagatcccctgtcccggatgttgaggatcccgcaaccgaggagcctggggagagcttttgtgacaaggtcatgagatggttccaggccatgctgcagcggctgcagacctggtggcacggggttctggcctgggtgaaggagaaggtggtggccctggtccatgcagtgcaggccctctggaaacagttccagagtttctgctgctctctgtcagagctcttcatgtcctctttccagtcctacggagccccacggggggacaaggaggagctgacaccccagaagtgctctgaaccccaatcctcaaaatgaagatactgacaccacctttgccctccccgtcaccgcgcacccaccctgacccctccctcagctgtcctgtgccccgccctctcccgcacactcagtccccctgcctggcgttcctgccgcagctctgacctggtgctgtcgccctggcatcttaataaaacctgcttatacttccctggcaggggagataccatgatcgcggaggtgggtttcccagggcaaggctgatctgttgccgtattagtccgttttcacacagctataaagaatgcctgagactgggtgatgtataaagaaaagaagtttaactga

SEQ ID NO: 629 - DNA, 789 bp, Homo sapiens
ctgtcccgagtctggactttccctctgcccctccccactctcaggctggtggggtggggaaagcagcccattcctgggctcagagactcccaccccagctcagagggagcaggggcccagccagggacggaccctcattcctcccagggaccccagacctctgtctctctcgggccttggctccttgaacttttggccgccatgtgcttcccgaaggtcctctctgatgacatgaagaagctgaaggcccgaatgcaccaggccatagaaagattttatgataaaatgcaaaatgcagaatcaggacgtggacaggtgatgtcgagcctggcagagctggaggacgacttcaaagagggctacctggagacagtggcggcttattatgaggagcagcacccagagctcactcctctacttgaaaaagaaagagatggattacggtgccgaggcaacagatcccctgtcccggatgttgaggatcccgcaaccgaggagcctggggagagcttttgtgacaagtcctacggagccccacggggggacaaggaggagctgacaccccagaagtgctctgaaccccaatcctcaaaatgaagatactgacaccacctttgccctccccgtcaccgcgcacccaccctgacccctccctcagctgtcctgtgccccgccctctcccgcacactcagtccccctgcctggcgttcctgccgcagctctgacctggtgctgtcgccctggcatcttaataaaacctgcttatacttccctggcaggggagatacc

SEQ ID NO: 630 - DNA, 1067 bp, Homo sapiens
aagactgcgtgcagaaggtgactgtctcagtggagctgggtcatctcaggccttggctccttgaacttttggccgccatgtgcttcccgaaggtcctctctgatgacatgaagaagctgaaggcccgaatggtaatgctcctccctacttctgctcaggggttgggggcctgggtctcagcgtgtgacactgaggacactgtgggacacctgggaccctggagggacaaggatccggccctttggtgccaactctgcctctcttcacagcaccaggccatagaaagattttatgataaaatgcaaaatgcagaatcaggacgtggacaggtgatgtcgagcctggcagagctggaggacgacttcaaagagggctacctggagacagtggcggcttattatgaggagcagcacccagagctcactcctctacttgaaaaagaaagagatggattacggtgccgaggcaacagatcccctgtcccggatgttgaggatcccgcaaccgaggagcctggggagagcttttgtgacaaggtcatgagatggttccaggccatgctgcagcggctgcagacctggtggcacggggttctggcctgggtgaaggagaaggtggtggccctggtccatgcagtgcaggccctctggaaacagttccagagtttctgctgctctctgtcagagctcttcatgtcctctttccagtcctacggagccccacggggggacaaggaggagctgacaccccagaagtgctctgaaccccaatcctcaaaatgaagatactgacaccacctttgccctccccgtcaccgcgcacccaccctgacccctccctcagctgtcctgtgccccgccctctcccgcacactcagtccccctgcctggcgttcctgccgcagctctgacctggtgctgtcgccctggcatcttaataaaacctgcttatacttccctggcaggggagataccatgatcgcggaggtgggtttcccagggcaaggctgatctgttgccgtattagtccgttttcacacagctataaagaatgcctgagactgggtg

SEQ ID NO: 631 - DNA, 920 bp, Homo sapiens
ggtggggtggggaaagcagcccattcctgggctcagagactcccaccccagctcagagggagcaggggcccagccagggacggaccctcattcctcccagggaccccagacctctgtctctctcggcaggccttggctccttgaacttttggccgccatgtgcttcccgaaggtcctctctgatgacatgaagaagctgaaggcccgaatgcaccaggccatagaaagattttatgataaaatgcaaaatgcagaatcaggacgtggacaggtgatgtcgagcctggcagagctggaggacgacttcaaagagggctacctggagacagtggcggcttattatgaggagcagcacccagagctcactcctctacttgaaaaagaaagagatggattacggtgccgaggcaacagatcccctgtcccggatgttgaggatcccgcaaccgaggagcctggggagagcttttgtgacaaggtcatgagatggttccaggccatgctgcagcggctgcagacctggtggcacggggttctggcctgggtgaaggagaaggtggtggccctggtccatgcagtgcaggccctctggaaacagttccagagtttctgctgctctctgtcagagctcttcatgtcctctttccagtcctacggagccccacggggggacaaggaggagctgacaccccagaagtgctctgaaccccaatcctcaaaatgaagatactgacaccacctttgccctccccgtcaccgcgcacccaccctgacccctccctcagctgtcctgtgccccgccctctcccgcacactcagtccccctgcctggcgttcctgccgcagctctgacctggtgctgtcgccctggcatcttaataaaacctgcttatacttccctggcaggggagataccatga

SEQ ID NO: 632 - DNA, 892 bp, Homo sapiens
cataaaaccagctgagtatttgtgccaggaagactgcgtgcagaaggtgactgtctcagtggagctgggtcatctcaggtggggagttggggtccccgaaggccttggctccttgaacttttggccgccatgtgcttcccgaaggtcctctctgatgacatgaagaagctgaaggcccgaatgcaccaggccatagaaagattttatgataaaatgcaaaatgcagaatcaggacgtggacaggtgatgtcgagcctggcagagctggaggacgacttcaaagagggctacctggagacagtggcggcttattatgaggagcagcacccagagctcactcctctacttgaaaaagaaagagatggattacggtgccgaggcaacagatcccctgtcccggatgttgaggatcccgcaaccgaggagcctggggagagcttttgtgacaaggtcatgagatggttccaggccatgctgcagcggctgcagacctggtggcacggggttctggcctgggtgaaggagaaggtggtggccctggtccatgcagtgcaggccctctggaaacagttccagagtttctgctgctctctgtcagagctcttcatgtcctctttccagtcctacggagccccacggggggacaaggaggagctgacaccccagaagtgctctgaaccccaatcctcaaaatgaagatactgacaccacctttgccctccccgtcaccgcgcacccaccctgacccctccctcagctgtcctgtgccccgccctctcccgcacactcagtccccctgcctggcgttcctgccgcagctctgacctggtgctgtcgccctggcatcttaataaaacctgcttatacttccctggcaggggagataccatga

SEQ ID NO: 633 - DNA, 1272 bp, Homo sapiens
gcagcccattcctgggctcagagactcccaccccagctcagagggagcaggggcccagccagggacggaccctcattcctcccagggaccccagacctctgtctctctcgggtaagtctccatctctgtctgtctctgtctctgtctctgtctctgtctgtttttcacgcactcagcaaggcctcctgccctgagagaggctccgcccactaccccccactttccccataaaaccagctgagtatttgtgccaggaagactgcgtgcagaaggtgactgtctcagtggagctgggtcatctcaggccttggctccttgaacttttggccgccatgtgcttcccgaaggtcctctctgatgacatgaagaagctgaaggcccgaatgcaccaggccatagaaagattttatgataaaatgcaaaatgcagaatcaggacgtggacaggtgatgtcgagcctggcagagctggaggacgacttcaaagagggctacctggagacagtggcggcttattatgaggagcagcacccagagctcactcctctacttgaaaaagaaagagatggattacggtgccgaggcaacagatcccctgtcccggatgttgaggatcccgcaaccgaggagcctggggagagcttttgtgacaaggtcatgagatggttccaggccatgctgcagcggctgcagacctggtggcacggggttctggcctgggtgaaggagaaggtggtggccctggtccatgcagtgcaggccctctggaaacagttccagagtttctgctgctctctgtcagagctcttcatgtcctctttccagtcctacggagccccacggggggacaaggaggagctgacaccccagaagtgctctgaaccccaatcctcaaaatgaagatactgacaccacctttgccctccccgtcaccgcgcacccaccctgacccctccctcagctgtcctgtgccccgccctctcccgcacactcagtccccctgcctggcgttcctgccgcagctctgacctggtgctgtcgccctggcatcttaataaaacctgcttatacttccctggcaggggagataccatgatcgcggaggtgggtttcccagggcaaggctgatctgttgccgtattagtccgttttcacacagctataaagaatgcctgagactgggtgatgtataaagaaaagaagtttaactgactcacagttccacatggctggggaagcctgaggaagcttacaatcatgggggaaggcggaa

SEQ ID NO: 634 - DNA, 1198 bp, Homo sapiens
ggtggggtggggaaagcagcccattcctgggctcagagactcccaccccagctcagagggagcaggggcccagccagggacggaccctcattcctcccagggaccccagacctctgtctctctcgggtaagtctccatctctgtctgtctctgtctctgtctctgtctctgtctgtttttcacgcactcagcaaggcctcctgccctgagagaggctccgcccactaccccccactttccccataaaaccagctgagtatttgtgccaggaagactgcgtgcagaaggtgactgtctcagtggagctgggtcatctcaggtggggagttggggtccccgaaggtgaggaccctctggggaggagggtgcttctctgagacactttcttttcctcacacctgttcctcgccagcaggccttggctccttgaacttttggccgccatgtgcttcccgaaggtcctctctgatgacatgaagaagctgaaggcccgaatgcaccaggccatagaaagattttatgataaaatgcaaaatgcagaatcaggacgtggacaggtgatgtcgagcctggcagagctggaggacgacttcaaagagggctacctggagacagtggcggcttattatgaggagcagcacccagagctcactcctctacttgaaaaagaaagagatggattacggtgccgaggcaacagatcccctgtcccggatgttgaggatcccgcaaccgaggagcctggggagagcttttgtgacaaggtcatgagatggttccaggccatgctgcagcggctgcagacctggtggcacggggttctggcctgggtgaaggagaaggtggtggccctggtccatgcagtgcaggccctctggaaacagttccagagtttctgctgctctctgtcagagctcttcatgtcctctttccagtcctacggagccccacggggggacaaggaggagctgacaccccagaagtgctctgaaccccaatcctcaaaatgaagatactgacaccacctttgccctccccgtcaccgcgcacccaccctgacccctccctcagctgtcctgtgccccgccctctcccgcacactcagtccccctgcctggcgttcctgccgcagctctgacctggtgctgtcgccctggcatcttaataaaacctgcttatacttccctggcaggggaga

SEQ ID NO: 635 - DNA, 950 bp, Homo sapiens
gagactcccaccccagctcagagggagcaggggcccagccagggacggaccctcattcctcccagggaccccagacctctgtctctctcggctgagtatttgtgccaggaagactgcgtgcagaaggtgactgtctcagtggagctgggtcatctcaggccttggctccttgaacttttggccgccatgtgcttcccgaaggtcctctctgatgacatgaagaagctgaaggcccgaatgcaccaggccatagaaagattttatgataaaatgcaaaatgcagaatcaggacgtggacaggtgatgtcgagcctggcagagctggaggacgacttcaaagagggctacctggagacagtggcggcttattatgaggagcagcacccagagctcactcctctacttgaaaaagaaagagatggattacggtgccgaggcaacagatcccctgtcccggatgttgaggatcccgcaaccgaggagcctggggagagcttttgtgacaaggtcatgagatggttccaggccatgctgcagcggctgcagacctggtggcacggggttctggcctgggtgaaggagaaggtggtggccctggtccatgcagtgcaggccctctggaaacagttccagagtttctgctgctctctgtcagagctcttcatgtcctctttccagtcctacggagccccacggggggacaaggaggagctgacaccccagaagtgctctgaaccccaatcctcaaaatgaagatactgacaccacctttgccctccccgtcaccgcgcacccaccctgacccctccctcagctgtcctgtgccccgccctctcccgcacactcagtccccctgcctggcgttcctgccgcagctctgacctggtgctgtcgccctggcatcttaataaaacctgcttatacttccctggcaggggagataccatgat

SEQ ID NO: 636 - DNA, 772 bp, Homo sapiens
ggggaaagcagcccattcctgggctcagagactcccaccccagctcagagggagcaggggcccagccagggacggaccctcattcctcccagggaccccagacctctgtctctctcggactgcgtgcagaaggtgactgtctcagtggagctgggtcatctcaggccttggctccttgaacttttggccgccatgtgcttcccgaaggtcctctctgatgacatgaagaagctgaaggcccgaatgcaccaggccatagaaagattttatgataaaatgcaaaatgcagaatcaggacgtggacaggtgatgtcgagcctggcagagctggaggacgacttcaaagagggctacctggagacagtggcggcttattatgaggagcagcacccagagctcactcctctacttgaaaaagaaagagatggattacggtgccgaggcaacagatcccctgtcccggatgttgaggatcccgcaaccgaggagcctggggagagcttttgtgacaaggtcatgagatggttccaggccatgctgcagcggctgcagacctggtggcacggggttctggcctgggtgaaggagaaggtggtggccctggtccatgcagtgcaggccctctggaaacagttccagagtttctgctgctctctgtcagagctcttcatgtcctctttccagtcctacggagccccacggggggacaaggaggagctgacaccccagaagtgctctgaaccccaatcctcaaaatgaagatactgacacc

SEQ ID NO: 637 - DNA, 674 bp, Homo sapiens
aaggtgactgtctcagtggagctgggtcatctcagcaggccttggctccttgaacttttggccgccatgtgcttcccgaaggtcctctctgatgacatgaagaagctgaaggcccgaatgcaccaggccatagaaagattttatgataaaatgcaaaatgcagaatcaggacgtggacaggtgatgtcgagcctggcagagctggaggacgacttcaaagagggctacctggagacagtggcggcttattatgaggagcagcacccagagctcactcctctacttgaaaaagaaagagatggattacggtgccgaggcaacagatcccctgtcccggatgttgaggatcccgcaaccgaggagcctggggagagcttttgtgacaaggtcatgagatggttccaggccatgctgcagcggctgcagacctggtggcacggggttctggcctgggtgaaggagaaggtggtggccctggtccatgcagtgcaggccctctggaaacagttccagagtttctgctgctctctgtcagagctcttcatgtcctctttccagtcctacggagccccacggggggacaaggaggagctgacaccccagaagtgctctgaaccccaatcctcaaaatgaagatactgacaccacctttgccctccccgtcaccgcgcacc

SEQ ID NO: 638 - DNA, 774 bp, Homo sapiens
cataaaaccagctgagtatttgtgccaggaagactgcgtgcagaaggccttggctccttgaacttttggccgccatgtgcttcccgaaggtcctctctgatgacatgaagaagctgaaggcccgaatggtgatgtcgagcctggcagagctggaggacgacttcaaagagggctacctggagacagtggcggcttattatgaggagcagcacccagagctcactcctctacttgaaaaagaaagagatggattacggtgccgaggcaacagatcccctgtcccggatgttgaggatcccgcaaccgaggagcctggggagagcttttgtgacaaggtcatgagatggttccaggccatgctgcagcggctgcagacctggtggcacggggttctggcctgggtgaaggagaaggtggtggccctggtccatgcagtgcaggccctctggaaacagttccagagtttctgctgctctctgtcagagctcttcatgtcctctttccagtcctacggagccccacggggggacaaggaggagctgacaccccagaagtgctctgaaccccaatcctcaaaatgaagatactgacaccacctttgccctccccgtcaccgcgcacccaccctgacccctccctcagctgtcctgtgccccgccctctcccgcacactcagtccccctgcctggcgttcctgccgcagctctgacctggtgctgtcgccctggcatcttaataaaacctgcttatacttccctggcaggggagatacca

SEQ ID NO: 639 - DNA, 746 bp, Homo sapiens
ctgtcccgagtctggactttccctctgcccctccccactctcaggctggtggggtggggaaagcagcccattcctgggctcagagactcccaccccagctcagagggagcaggggcccagccagggacggaccctcattcctcccagggaccccagacctctgtctctctcgggtcctctctgatgacatgaagaagctgaaggcccgaatgcaccaggccatagaaagattttatgataaaatgcaaaatgcagaatcaggacgtggacaggtgatgtcgagcctggcagagctggaggacgacttcaaagagggctacctggagacagtggcggcttattatgaggagcagcacccagagctcactcctctacttgaaaaagaaagagatggattacggtgccgaggcaacagatcccctgtcccggatgttgaggatcccgcaaccgaggagcctggggagagcttttgtgacaaggtcatgagatggttccaggccatgctgcagcggctgcagacctggtggcacggggttctggcctgggtgaaggagaaggtggtggccctggtccatgcagtgcaggccctctggaaacagttccagagtttctgctgctctctgtcagagctcttcatgtcctctttccagtcctacggagccccacggggggacaaggaggagctgacaccccagaagtgctctgaaccccaatcctcaaaatgaagatactgacaccacctttgc

SEQ ID NO: 640 - DNA, 814 bp, Homo sapiens
aaaccagctgagtatttgtgccaggaagactgcgtgcagaaggccttggctccttgaacttttggccgccatgtgcttcccgaaggtcctctctgatgacatgaagaagctgaaggcccgaatgcaccaggccatagaaagattttatgataaaatgcaaaatgcagaatcaggacgtggacaggtgatgtcgagcctggcagagctggaggacgacttcaaagagggctacctggagacagtggcggcttattatgaggagcagcacccagagctcactcctctacttgaaaaagaaagagatggattacggtgccgaggcaacagatcccctgtcccggatgttgaggatcccgcaaccgaggagcctggggagagcttttgtgacaaggtcatgagatggttccaggccatgctgcagcggctgcagacctggtggcacggggttctggcctgggtgaaggagaaggtggtggccctggtccatgcagtgcaggccctctggaaacagttccagagtttctgctgctctctgtcagagctcttcatgtcctctttccagtcctacggagccccacggggggacaaggaggagctgacaccccagaagtgctctgaaccccaatcctcaaaatgaagatactgacaccacctttgccctccccgtcaccgcgcacccaccctgacccctccctcagctgtcctgtgccccgccctctcccgcacactcagtccccctgcctggcgttcctgccgcagctctgacctggtgctgtcgccctggcatcttaataaaacctgcttatacttccct

SEQ ID NO: 641 - DNA, 1112 bp, Homo sapiens
ccccagccagctgtcccgagtctggactttccctctgcccctccccactctcaggctggtggggtggggaaagcagcccattcctgggctcagagactcccaccccagctcagagggagcaggggcccagccagggacggaccctcattcctcccagggaccccagacctctgtctctctcgggccttggctccttgaacttttggccgccatgtgcttcccgaaggtcctctctgatgacatgaagaagctgaaggcccgaatggtaatgctcctccctacttctgctcaggggttgggggcctgggtctcagcgtgtgacactgaggacactgtgggacacctgggaccctggagggacaaggatccggccctttggtgccaactctgcctctcttcacagcaccaggccatagaaagattttatgataaaatgcaaaatgcagaatcaggacgtggacaggtgatgtcgagcctggcagagctggaggacgacttcaaagagggctacctggagacagtggcggcttattatgaggagcagcacccagagctcactcctctacttgaaaaagaaagagatggattacggtgccgaggcaacagatcccctgtcccggatgttgaggatcccgcaaccgaggagcctggggagagcttttgtgacaaggtcatgagatggttccaggccatgctgcagcggctgcagacctggtggcacggggttctggcctgggtgaaggagaaggtggtggccctggtccatgcagtgcaggccctctggaaacagttccagagtttctgctgctctctgtcagagctcttcatgtcctctttccagtcctacggagccccacggggggacaaggaggagctgacaccccagaagtgctctgaaccccaatcctcaaaatgaagatactgacaccacctttgccctccccgtcaccgcgcacccaccctgacccctccctcagctgtcctgtgccccgccctctcccgcacactcagtccccctgcctggcgttcctgccgcagctctgacctggtgctgtcgccctggcatcttaataaaacctgcttatacttccctggcaggggagataccatga

SEQ ID NO: 642 - DNA, 1014 bp, Homo sapiens
gtctcagtggagctgggtcatctcaggtggggagttggggtccccgaaggtgaggaccctctggggaggagggtgcttctctgagacactttcttttcctcacacctgttcctcgccagcaggccttggctccttgaacttttggccgccatgtgcttcccgaaggtcctctctgatgacatgaagaagctgaaggcccgaatggtaatgctcctccctacttctgctcaggggttgggggcctgggtctcagcgtgtgacactgaggacactgtgggacacctgggaccctggagggacaaggatccggccctttggtgccaactctgcctctcttcacagcaccaggccatagaaagattttatgataaaatgcaaaatgcagaatcaggacgtggacaggtgatgtcgagcctggcagagctggaggacgacttcaaagagggctacctggagacagtggcggcttattatgaggagcagcacccagagctcactcctctacttgaaaaagaaagagatggattacggtgccgaggcaacagatcccctgtcccggatgttgaggatcccgcaaccgaggagcctggggagagcttttgtgacaaggtcatgagatggttccaggccatgctgcagcggctgcagacctggtggcacggggttctggcctgggtgaaggagaaggtggtggccctggtccatgcagtgcaggccctctggaaacagttccagagtttctgctgctctctgtcagagctcttcatgtcctctttccagtcctacggagccccacggggggacaaggaggagctgacaccccagaagtgctctgaaccccaatcctcaaaatgaagatactgacaccacctttgccctccccgtcaccgcgcacccaccctgacccctccctcagctgtcctgtgccccgccctctcccgcacactcagtccccctgcctggcgttcctgccgcagctctgacctggtgctgtcgccctggcatcttaataaa

SEQ ID NO: 643 - DNA, 812 bp, Homo sapiens
agactgcgtgcagaaggtgactgtctcagtggagctgggtcatctcaggccttggctccttgaacttttggccgccatgtgcttcccgaaggtcctctctgatgacatgaagaagctgaaggcccgaatgcaccaggccatagaaagattttatgataaaatgcaaaatgcagaatcaggacgtggacaggacgacttcaaagagggctacctggagacagtggcggcttattatgaggagcagcacccagagctcactcctctacttgaaaaagaaagagatggattacggtgccgaggcaacagatcccctgtcccggatgttgaggatcccgcaaccgaggagcctggggagagcttttgtgacaaggtcatgagatggttccaggccatgctgcagcggctgcagacctggtggcacggggttctggcctgggtgaaggagaaggtggtggccctggtccatgcagtgcaggccctctggaaacagttccagagtttctgctgctctctgtcagagctcttcatgtcctctttccagtcctacggagccccacggggggacaaggaggagctgacaccccagaagtgctctgaaccccaatcctcaaaatgaagatactgacaccacctttgccctccccgtcaccgcgcacccaccctgacccctccctcagctgtcctgtgccccgccctctcccgcacactcagtccccctgcctggcgttcctgccgcagctctgacctggtgctgtcgccctggcatcttaataaaacctgcttatacttccctggcaggggagataccatga

SEQ ID NO: 644 - DNA, 810 bp, Homo sapiens
ttcctgggctcagagactcccaccccagctcagagggagcaggggcccagccagggacggaccctcattcctcccagggaccccagacctctgtctctctcggcaggccttggctccttgaacttttggccgccatgtgcttcccgaaggtcctctctgatgacatgaagaagctgaaggcccgaatggtaatgctcctccctacttctgctcaggggttgggggcctgggtctcagcgtgtgacactgaggacactgtgggacacctgggaccctggagggacaaggatccggccctttggtgccaactctgcctctcttcacagcaccaggccatagaaagattttatgataaaatgcaaaatgcagaatcaggacgtggacaggtgatgtcgagcctggcagagctggaggacgacttcaaagagggctacctggagacagtggcggcttattatgaggagcagcacccagagctcactcctctacttgaaaaagaaagagatggattacggtgccgaggcaacagatcccctgtcccggatgttgaggatcccgcaaccgaggagcctggggagagcttttgtgacaaggtcatgagatggttccaggccatgctgcagcggctgcagacctggtggcacggggttctggcctgggtgaaggagaaggtggtggccctggtccatgcagtgcaggccctctggaaacagttccagagtttctgctgctctctgtcagagctcttcatgtcctctttccagtcctacggagccccacggggggacaaggaggagctgacaccccaga

SEQ ID NO: 645 - DNA, 654 bp, Homo sapiens
aggtgactgtctcagtggagctgggtcatctcaggccttggctccttgaacttttggccgccatgtgcttcccgaaggtcctctctgatgacatgaagaagctgaaggcccgaatgcaccaggccatagaaagattttatgataaaatgcaaaatgcagaatcaggacgtggacaggtgatgtcgagcctggcagagctggaggacgacttcaaagagggctacctggagacagtggcggcttattatgaggagcagcacccagagctcactcctctacttgaaaaagaaagagatggattacggtgccgaggcaacagatcccctgtcccggatgttgaggatcccgcaaccgaggagcctggggagagcttttgtgacaagtcctacggagccccacggggggacaaggaggagctgacaccccagaagtgctctgaaccccaatcctcaaaatgaagatactgacaccacctttgccctccccgtcaccgcgcacccaccctgacccctccctcagctgtcctgtgccccgccctctcccgcacactcagtccccctgcctggcgttcctgccgcagctctgacctggtgctgtcgccctggcatcttaataaaacctgcttatacttccctggcaggggagataccatga

SEQ ID NO: 646 - DNA, 733 bp, Homo sapiens
gaaagcagcccattcctgggctcagagactcccaccccagctcagagggagcaggggcccagccagggacggaccctcattcctcccagggaccccagacctctgtctctctcggcaggccttggctccttgaacttttggccgccatgtgcttcccgaaggtcctctctgatgacatgaagaagctgaaggcccgaatgcaccaggccatagaaagattttatgataaaatgcaaaatgcagaatcaggacgtggacaggtgatgtcgagcctggcagagctggaggacgacttcaaagagggctacctggagacagtggcggcttattatgaggagcagcacccagagctcactcctctacttgaaaaagaaagagatggattacggtgccgaggcaacagatcccctgtcccggatgttgaggatcccgcaaccgaggagcctggggagagcttttgtgacaagtcctacggagccccacggggggacaaggaggagctgacaccccagaagtgctctgaaccccaatcctcaaaatgaagatactgacaccacctttgccctccccgtcaccgcgcacccaccctgacccctccctcagctgtcctgtgccccgccctctcccgcacactcagtccccctgcctggcgttcctgccgcagctctgacctggtgctgtcgccctggcatcttaataaaacctgcttatacttccctggcaggggagatac

SEQ ID NO: 647 - DNA, 623 bp, Homo sapiens
ggtcatctcaggtggggagttggggtccccgaaggccttggctccttgaacttttggccgccatgtgcttcccgaaggtcctctctgatgacatgaagaagctgaaggcccgaatggtgatgtcgagcctggcagagctggaggacgacttcaaagagggctacctggagacagtggcggcttattatgaggagcagcacccagagctcactcctctacttgaaaaagaaagagatggattacggtgccgaggcaacagatcccctgtcccggatgttgaggatcccgcaaccgaggagcctggggagagcttttgtgacaaggtcatgagatggttccaggccatgctgcagcggctgcagacctggtggcacggggttctggcctgggtgaaggagaaggtggtggccctggtccatgcagtgcaggccctctggaaacagttccagagtttctgctgctctctgtcagagctcttcatgtcctctttccagtcctacggagccccacggggggacaaggaggagctgacaccccagaagtgctctgaaccccaatcctcaaaatgaagatactgacaccacctttgccctccccgtcaccgcgcacccaccctgacccct

SEQ ID NO: 648 - DNA, 731 bp, Homo sapiens
tctcagtggagctgggtcatctcaggtggggagttggggtccccgaagcaggccttggctccttgaacttttggccgccatgtgcttcccgaaggtcctctctgatgacatgaagaagctgaaggcccgaatgcaccaggccatagaaagattttatgataaaatgcaaaatgcagaatcaggacgtggacaggtgatgtcgagcctggcagagctggaggacgacttcaaagagggctacctggagacagtggcggcttattatgaggagcagcacccagagctcactcctctacttgaaaaagaaagagatggattacggtgccgaggcaacagatcccctgtcccggatgttgaggatcccgcaaccgaggagcctggggagagcttttgtgacaaggtcatgagatggttccaggccatgctgcagcggctgcagacctggtggcacggggttctggcctgggtgaaggagaaggtggtggccctggtccatgcagtgcaggccctctggaaacagttccagagtttctgctgctctctgtcagagctcttcatgtcctctttccagtcctacggagccccacggggggacaaggaggagctgacaccccagaagtgctctgaaccccaatcctcaaaatgaagatactgacaccacctttgccctccccgtcaccgcgcacccaccctgacccctccctcagctgtcctgtgccccgccctctccc

SEQ ID NO: 649 - DNA, 2641 bp, Homo sapiens
agaatactgaaaaatgaagcctaaaatgaagtattcaaccaacaaaatttccacagcaaagtggaagaacacagcaagcaaagccttgtgtttcaagctgggaaaatcccaacagaaggccaaagaagtttgccccatgtactttatgaagctccgctctggccttatgataaaaaaggaggcctgttactttaggagagaaaccaccaaaaggccttcactgaaaacaggtagaaagcacaaaagacatctggtactcgctgcctgtcaacagcagtctactgtggagtgctttgcctttggtatatcaggggtccagaaatatactagagcacttcatgattcaagtatcacaggaatttcacctattacagagtatcttgcttctctaagcacatacaatgatcaatccattacttttgctttggaggatgaaagttatgagatatatgttgaagacttgaaaaaagatgaaaagaaagataaggtgttactgagttactatgagtctcaacacccctcaaatgaatcaggtgacggtgttgatggtaagatgttaatggtaaccctgagtcctacaaaagacttctggttgcatgccaacaacaaggaacactctgtggagctccataagtgtgaaaaaccactgccagaccaggccttctttgtccttcataatatgcactccaactgtgtttcatttgaatgcaagactgatcctggagtgtttataggtgtaaaggataatcatcttgctctgattaaagtagactcttctgagaatttgtgtactgaaaatatcttgtttaagctctctgaaacttagttgatggaaacctgtgagtcttgggttgagtacccaaatgctaccactggagaaggaatgagagataaagaaagagacaggtgacatctaagggaaatgaagagtgcttagcatgtgtggaatgttttccatattatgtataaaaatattttttctaatcctccagttattcttttatttccctctgtataactgcatcttcaatacaagtatcagtatattaaatagggtattggtaaagaaacggtcaacattctaaagagatacagtctgacctttacttttctctagtttcagtccagaaagaacttcatatttagagctaaggccactgaggaaagagccatagcttaagtctctatgtagacagggatccattttaaagagctacttagagaaataattttccacagttccaaacgataggctcaaacactagagctgctagtaaaaagaagaccagatgcttcacagaattatcattttttcaactggaataaaacaccaggtttgtttgtagatgtcttaggcaacactcagagcagatctcccttactgtcaggggatatggaacttcaaaggcccacatggcaagccaggtaacataaatgtgtgaaaaagtaaagataactaaaaaatttagaaaaataaatccagtatttgtaaagtgaataacttcatttctaattgtttaatttttaaaattctgatttttatatattgagtttaagcaaggcattcttacacgaggaagtgaagtaaattttagttcagacataaaatttcacttattaggaatatgtaacatgctaaaacttttttttttttaaagagtactgagtcacaacatgttttagagcatccaagtaccatataatccaactatcatggtaaggccagaaatcttctaacctaccagagcctagatgagacaccgaattaacattaaaatttcagtaactgactgtccctcatgtccatggcctaccatcccttctgaccctggcttccagggacctatgtcttttaatactcactgtcacattgggcaaagttgcttctaatccttatttcccatgtgcacaagtctttttgtattccagcttcctgataacactgcttactgtggaatattcatttgacatctgtctcttttcatttcttttaactaccatgcccttgatatatcttttgcacctgctgaacttcatttctgtatcacctgacctctggatgccaaaacgtttattctgctttgtctgttgtagaattttagataaagctattaatggcaatatttttttgctaaacgtttttgttttttactgtcactagggcaataaaatttatactcaaccatataataacattttttaactactaaaggagtagtttttattttaaagtcttagcaatttctattacaacttttcttagacttaacacttatgataaatgactaacatagtaacagaatctttatgaaatatgaccttttctgaaaatacatacttttacatttctactttattgagacctattagatgtaagtgctagtagaatataagataaaagaggctgagaattaccatacaagggtattacaactgtaaaacaatttatctttgtttcattgttctgtcaataattgttaccaaagagataaaaataaaagcagaatgtatatcatcccatctgaaaaacactaattattgacatgtgcatctgtacaataaacttaaaatgattattaaataatcaaatatatctactacattgtttatattattgaataaagtatattttccaaatgta

SEQ ID NO: 650 - DNA, 943 bp, Homo sapiens
acacagagctgcagctcttcagggaagaaatcaaaacaagatcacaagaatactgaaaaatgaagcctaaaatgaagtattcaaccaacaaaatttccacagcaaagtggaagaacacagcaagcaaagccttgtgtttcaagctgggaaataaggtgttactgagttactatgagtctcaacacccctcaaatgaatcaggtgacggtgttgatggtaagatgttaatggtaaccctgagtcctacaaaagacttctggttgcatgccaacaacaaggaacactctgtggagctccataagtgtgaaaaaccactgccagaccaggccttctttgtccttcataatatgcactccaactgtgtttcatttgaatgcaagactgatcctggagtgtttataggtgtaaaggataatcatcttgctctgattaaagtagactcttctgagaatttgtgtactgaaaatatcttgtttaagctctctgaaacttagttgatggaaacctgtgagtcttgggttgagtacccaaatgctaccactggagaaggaatgagagataaagaaagagacaggtgacatctaagggaaatgaagagtgcttagcatgtgtggaatgttttccatattatgtataaaaatattttttctaatcctccagttattcttttatttccctctgtataactgcatcttcaatacaagtatcagtatattaaatagggtattggtaaagaaacggtcaacattctaaagagatacagtctgacctttacttttctctagtttcagtccagaaagaacttcatatttagagctaaggccactgaggaaagagccatagcttaagtctctatgtagacagggatccattttaaagagctacttagagaaataattttccacagttccaaacgataggctcaaacactagagctgctagt

SEQ ID NO: 651 - DNA, 1303 bp, Homo sapiens
agagctgcagctcttcagggaagaaatcaaaacaagatcacaagaatactgaaaaatgaagcctaaaatgaagtattcaaccaacaaaatttccacagcaaagtggaagaacacagcaagcaaagccttgtgtttcaagctgggaaaatcccaacagaaggccaaagaagtttgccccatgtactttatgaagctccgctctggccttatgataaaaaaggaggcctgttactttaggagagaaaccaccaaaaggccttcactgaaaacaggtagaaagcacaaaagacatctggtactcgctgcctgtcaacagcagtctactgtggagtgctttgcctttggtatatcaggggtccagaaatatactagagcacttcatgattcaagtatcacagataaggtgttactgagttactatgagtctcaacacccctcaaatgaatcaggtgacggtgttgatggtaagatgttaatggtaaccctgagtcctacaaaagacttctggttgcatgccaacaacaaggaacactctgtggagctccataagtgtgaaaaaccactgccagaccaggccttctttgtccttcataatatgcactccaactgtgtttcatttgaatgcaagactgatcctggagtgtttataggtgtaaaggataatcatcttgctctgattaaagtagactcttctgagaatttgtgtactgaaaatatcttgtttaagctctctgaaacttagttgatggaaacctgtgagtcttgggttgagtacccaaatgctaccactggagaaggaatgagagataaagaaagagacaggtgacatctaagggaaatgaagagtgcttagcatgtgtggaatgttttccatattatgtataaaaatattttttctaatcctccagttattcttttatttccctctgtataactgcatcttcaatacaagtatcagtatattaaatagggtattggtaaagaaacggtcaacattctaaagagatacagtctgacctttacttttctctagtttcagtccagaaagaacttcatatttagagctaaggccactgaggaaagagccatagcttaagtctctatgtagacagggatccattttaaagagctacttagagaaataattttccacagttccaaacgataggctcaaacactagagctgctagtaaaaagaagaccagatgcttcacagaattatcattttttcaactggaataaaacaccaggtttgtttgtagatgtcttaggcaacactcagagcagatctcccttactgtca

SEQ ID NO: 652 - DNA, 1607 bp, Homo sapiens
agcagctgcagtcggagaaatcagagaaagcgtcacccagccccagattccgaggggcctgccagggactctctcctcctgctccttggaaaggaagaccccgaaagacccccaagccaccggctcagacctgcttctgggctgccatgggacttgcggccaccgccccccggctgtcctccacgctgccgggcagataagggcagctgctgcccttggggcacctgctcactcccgcagcccagccactcctccagggccagcccttccctgactgagtgaccacctctgctgccccgaggccatgtaggccgtgcttaggcctctgtggacacactgctggggacggcgcctgagctctcagggggacgaggaacaccaccatgccccggggcttcacctggctgcgctatcttgggatcttccttggcgtggccttggggaatgagcctttggagatgtggcccttgacgcagaatgaggagtgcactgtcacgggttttctgcgggacaagctgcagtacaggagccgacttcagtacatgaaacactacttccccatcaactacaagatcagtgtgccttacgagggggtgttcagaatcgccaacgtcaccaggctgcagagggcccaggtgagcgagcgggagctgcggtatctgtgggtcttggtgagcctcagtgccactgagtcggtgcaggacgtgctgctcgagggccacccatcctggaagtacctgcaggaggtggagacgctgctgctgaatgtccagcagggcctcacggatgtggaggtcagccccaaggtggaatccgtgttgtccctcttgaatgccccagggccaaacctgaagctggtgcggcccaaagccctgctggacaactgcttccgggtcatggagctgctgtactgctcctgctgtaaacaaagctccgtcctaaactggcaggactgtgaggtgccaagtcctcagtcttgcagcccagagccctcattgcagtatgcggccacccagctgtaccctccgcccccgtggtcccccagctccccgcctcactccacgggctcggtgaggccggtcagggcacagggcgagggcctcttgccctgagcaccctggatggtgactgcggataggggcagccagaccagctcccacaggagttcaactgggtctgagacttcaaggggtggtggtgggagccccccttgggagaggacccctgggaagggtgtttttcctttgagggggattctgtgccacagcagggctcagcttcctgccttccatagctgtcatggcctcacctggagcggaggggacctggggacctgaaggtggatggggacacagctcctggcttctcctggtgctgccctcactgtccccccgcctaaagggggtactgagcctcctgtggcccgcagcagtgagggcacagctgtgggttgcaggggagacagccagcacggcgtggccattctatgaccccccagcctggcagactggggagctgggggcagagggcggtgccaagtgccacatcttgccatagtggatgctcttccagtttcttttttctattaaacaccccacttcctttgg

SEQ ID NO: 653 - DNA, 1779 bp, Homo sapiens
catcagacgggaagcctggactgtgggttgggggcagcctcagcctctccaacctggcacccactgcccgtggcccttaggcacctgcttggggtcctggagccccttaaggccaccagcaaatcctaggagaccgagtcttggcacgtgaacagagccagatttcacactgagcagctgcagtcggagaaatcagagaaagcgtcacccagccccagattccgaggggcctgccagggactctctcctcctgctccttggaaaggaagaccccgaaagacccccaagccaccggctcagacctgcttctgggctgccatgggacttgcggccaccgccccccggctgtcctccacgctgccgggcagataagggcagctgctgcccttggggcacctgctcactcccgcagcccagccactcctccagggccagcccttccctgactgagtgaccacctctgctgccccgaggccatgtaggccgtgcttaggcctctgtggacacactgctggggacggcgcctgagctctcagggggacgaggaacaccaccatgccccggggcttcacctggctgcgctatcttgggatcttccttggcgtggccttggggaatgagcctttggagatgtggcccttgacgcagaatgaggagtgcactgtcacgggttttctgcgggacaagctgcagtacaggagccgacttcagtacatgaaacactacttccccatcaactacaagatcagtgtgccttacgagggggtgttcagaatcgccaacgtcaccaggctgcagagggcccaggtgagcgagcgggagctgcggtatctgtgggtcttggtgagcctcagtgccactgagtcggtgcaggacgtgctgctcgagggccacccatcctggaagtacctgcaggaggtggagacgctgctgctgaatgtccagcagggcctcacggatgtggaggtcagccccaaggtggaatccgtgttgtccctcttgaatgccccagggccaaacctgaagctggtgcggcccaaagccctgctggacaactgcttccgggtcatggagctgctgtactgctcctgctgtaaacaaagctccgtcctaaactggcaggactgtgaggtgccaagtcctcagtcttgcagcccagagccctcattgcagtatgcggccacccagctgtaccctccgcccccgtggtcccccagctccccgcctcactccacgggctcggtgaggccggtcagggcacagggcgagggcctcttgccctgagcaccctggatggtgactgcggataggggcagccagaccagctcccacaggagttcaactgggtctgagacttcaaggggtggtggtgggagccccccttgggagaggacccctgggaagggtgtttttcctttgagggggattctgtgccacagcagggctcagcttcctgccttccatagctgtcatggcctcacctggagcggaggggacctggggacctgaaggtggatggggacacagctcctggcttctcctggtgctgccctcactgtccccccgcctaaagggggtactgagcctcctgtggcccgcagcagtgagggcacagctgtgggttgcaggggagacagccagcacggcgtggccattctatgaccccccagcctggcagactggggagctgggggcagagggcggtgccaagtgccacatcttgccatagtggatgctcttccagtttcttttttctattaaacaccccacttcctttgg

SEQ ID NO: 654 - DNA, 888 bp, Homo sapiens
aaaacccaagtgcagtagaagccattgttcataatggtagggatacagggtccttcgtaacagattatcagtgtggcctatgctggaaagtctggtgacctctgattttttttgcttccaggtctttggccttggcactctttgtcatattagagttcctgggtctaggcctgggcaggattcataggtgcagctgcttctgctggaggtagactgcatccaacaaagtaagggtgctgggtgagttctgggagtatagattctgactggggtcactgctgggctggccgccagtctttcatctgacccagggttaaactgtggcttgggactgactcaggtcctctcttggggtcggtctgcacataaaaggactcctatccttggcagttctgaaacaacaccaccacaatggaaaaagcattgaaaattgacacacctcagcaggggagcattcaggatatcaatcatcgggtgtgggttcttcaggaccagacgctcatagcagtcccgaggaaggaccgtatgtctccagtcactattgccttaatctcatgccgacatgtggagacccttgagaaagacagagggaaccccatctacctgggcctgaatggactcaatctctgcctgatgtgtgctaaagtcggggaccagcccacactgcagctgaaggaaaaggatataatggatttgtacaaccaacccgagcctgtgaagtcctttctcttctaccacagccagagtggcaggaactccaccttcgagtctgtggctttccctggctggttcatcgctgtcagctctgaaggaggctgtcctctcatccttacccaagaactggggaaagccaacactactgactttgggttaactatgctgttttaa

SEQ ID NO: 655 - DNA, 129 bp, Homo sapiens
tccaccttcgagtctgtggctttccctggctggttcatcgctgtcagctctgaaggaggctgtcctctcatccttacccaagaactggggaaagccaacactactgactttgggttaattttagtagag

SEQ ID NO: 656 - DNA, 1186 bp, Homo sapiens
cacgggttcctccccactctgtctttctcacctctccttcacttttcctagcctcctcaccaccatctgatctatcttgttctcttcacaaaaggctctgaagacatcatgaacccacaacgggaggcagcacccaaatcctatgctattcgtgattctcgacagatggtgtgggtcctgagtggaaattctttaatagcagctcctcttagccgcagcattaagcctgtcactcttcatttaatagcctgtagagacacagaattcagtgacaaggaaaagggtaatatggtttacctgggaatcaagggaaaagatctctgtctcttctgtgcagaaattcagggcaagcctactttgcagcttaagcttcagggctcccaagataacatagggaaggacacttgctggaaactagttggaattcacacatgcataaacctggatgtgagagagagctgcttcatgggaacccttgaccaatggggaataggagtgggtagaaagaagtggaagagttcctttcaacatcaccatctcaggaagaaggacaaagatttctcatccatgcggaccaacataggaatgccaggaaggatgtagaaataaggggaggaagattcccatctctacaatctttgagtgggtttgctatcaatgaaatgctacaaatggaataagttgcagaaatttttctcttttcttgggttctggagagtttgtaaaacaaggacactatgtatttttaaagagttggtaaatcttacctgtaaagctagagaaggtcggagtctttttaggagtagatttggactacataacctgtaaatgtgttttgtccagtccttagagtgttttttaaaaaattgtaaagtcaaggttttcatgaaaaatgggaagatcagacaacattgctcctgaattcccacagagcagcaagctactagagctcaatctgttatttcttttcctgatgtacaggggttaagtcctatggaagaaacagcagaattattcaaaattatttacataatgtgcaattattcactagagcatgaggagtgaaacgctctgtttagtatgtataacttaaaaggaacacatacaattaaaagtaattgaaagacatttcttcttaaaaattctataatcttacactggtaaaataaactagtttttcccatgt

SEQ ID NO: 657 - DNA, 1052 bp, Homo sapiens
cacgggttcctccccactctgtctttctcacctctccttcacttttcctagcctcctcaccaccatctgatctatcttgttctcttcacaaaaggctctgaagacatcatgaacccacaacgggaggcagcacccaaatcctatgctattcgtgattctcgacagatggtgtgggtcctgagtggaaattctttaatagcagctcctcttagccgcagcattaagcctgtcactcttcatttaatagcctgtagagacacagaattcagtgacaaggaaaagggtaatatggtttacctgggaatcaagggaaaagatctctgtctcttctgtgcagaaattcagggcaagcctactttgcagcttaaggaaaaaaatatcatggacctgtatgtggagaagaaagcacagaagccctttctctttttccacaataaagaaggctccacttctgtctttcagtcagtctcttaccctggctggttcatagccacctccaccacatcaggacagcccatctttctcaccaaggagagaggcataactaataacactaacttctacttagattctgtggaataaatccagcctaggctgtgggtggctggttccaggatagagaatcaagctgtcagagtcatcttaacagatcattatgcgactgagttcactagcagttcagcccatccatagcttacctcattcttactatccaaaagccacctcctcctccaaacatccatttctgtaccaagaccctcactcgaatgtcactatcccaagatgaaacctaaaaatcactttccattctttcttgatcttaccccaccatccactcagctgccatgcccagtttagtcaaccccccaaatgctgcttcatgcaaccttccattcctattccttttgccaacccatgatgtagagatgtggattcatgacattttgttcatacaacttcttcaataaaacattataatatgtgccccaaagataaagctgaagaatgagatgaatgtgaaattaaaggtttgcatgtctttctaatcctaa

SEQ ID NO: 658 - DNA, 1173 bp, Homo sapiens
gagccacgattcagtcccctggactgtagataaagaccctttcttgccaggtgctgagacaaccacactatgagaggcactccaggagacgctgatggtggaggaagggccgtctatcaatcaatgtgtaaacctattactgggactattaatgatttgaatcagcaagtgtggacccttcagggtcagaaccttgtggcagttccacgaagtgacagtgtgaccccagtcactgttgctgttatcacatgcaagtatccagaggctcttgagcaaggcagaggggatcccatttatttgggaatccagaatccagaaatgtgtttgtattgtgagaaggttggagaacagcccacattgcagctaaaagagcagaagatcatggatctgtatggccaacccgagcccgtgaaacccttccttttctaccgtgccaagactggtaggacctccacccttgagtctgtggccttcccggactggttcattgcctcctccaagagagaccagcccatcattctgacttcagaacttgggaagtcatacaacactgcctttgaattaaatataaatgactgaactcagcctagaggtggcagcttggtctttgtcttaaagtttctggttcccaatgtgttttcgtctacattttcttagtgtcattttcacgctggtgctgagacaggggcaaggctgctgttatcatctcattttataatgaagaagaagcaattacttcatagcaactgaagaacaggatgtggcctcagaagcaggagagctgggtggtataaggctgtcctctcaagctggtgctgtgtaggccacaaggcatctgcatgagtgactttaagactcaaagaccaaacactgagctttcttctaggggtgggtatgaagatgcttcagagctcatgcgcgttacccacgatggcatgactagcacagagctgatctctgtttctgttttgctttattccctcttgggatgatatcatccagtctttatatgttgccaatatacctcattgtgtgtaatagaaccttcttagcattaagaccttgtaaacaaaaataattcttgtgttaagttaaatcatttttgtcctaattgtaatgtgtaatcttaaagttaaataaactttgtgtatttatataataataaagctaaaa

SEQ ID NO: 659 - DNA, 369 bp, Homo sapiens
tttgctttcttgtccagtcttgggagtgcctgaccacagcaggatcttctggtaggaggagctggttttctttcatgtcatacgtttctcatgccccacccaggaagctggagcctccttctctgctcatccagataaatgatccaggctccattagaacccatcactgaccttggaagctgctggagccacgattcagtcccctggactgtagataaagaccctttcttgccaggtgctgagacaaccacactatgagaggcactccaggagacgctgatggtggaggaagggccgtctatcaatcaatgtgtaaacctattactgggactattaatgatttgaatcagcaagtgtggacccttcagg

SEQ ID NO: 660 - DNA, 772 bp, Homo sapiens
cttcattccattttctgttgagtaataaactcaacgttgaaaatgtcctttgtgggggagaactcaggagtgaaaatgggctctgaggactgggaaaaagatgaaccccagtgctgcttagaagacccggctggaagccccctggaaccaggcccaagcctccccaccatgaattttgttcacacaagtccaaaggtgaagaacttaaacccgaagaaattcagcattcatgaccaggatcacaaagtactggtcctggactctgggaatctcatagcagttccagataaaaactacatacgcccagagatcttctttgcattagcctcatccttgagctcagcctctgcggagaaaggaagtccgattctcctgggggtctctaaaggggagttttgtctctactgtgacaaggataaaggacaaagtcatccatcccttcagctgaagaaggagaaactgatgaagctggctgcccaaaaggaatcagcacgccggcccttcatcttttatagggctcaggtgggctcctggaacatgctggagtcggcggctcaccccggatggttcatctgcacctcctgcaattgtaatgagcctgttggggtgacagataaatttgagaacaggaaacacattgaattttcatttcaaccagtttgcaaagctgaaatgagccccagtgaggtcagcgattaggaaactgccccattgaacgccttcctcgctaatttgaactaattgtataaaaacaccaaacctgctcactaaa

SEQ ID NO: 661 - DNA, 652 bp, Homo sapiens
atgtcaggctgtgataggagggaaacagaaaccaaaggaaagaacagctttaagaagcgcttaagaggtccaaaggtgaagaacttaaacccgaagaaattcagcattcatgaccaggatcacaaagtactggtcctggactctgggaatctcatagcagttccagataaaaactacatacgcccagagatcttctttgcattagcctcatccttgagctcagcctctgcggagaaaggaagtccgattctcctgggggtctctaaaggggagttttgtctctactgtgacaaggataaaggacaaagtcatccatcccttcagctgaagaaggagaaactgatgaagctggctgcccaaaaggaatcagcacgccggcccttcatcttttatagggctcaggtgggctcctggaacatgctggagtcggcggctcaccccggatggttcatctgcacctcctgcaattgtaatgagcctgttggggtgacagataaatttgagaacaggaaacacattgaattttcatttcaaccagtttgcaaagctgaaatgagccccagtgaggtcagcgattaggaaactgccccattgaacgccttcctcgctaatttgaactaattgtataaaaacaccaaacctgctcactaaa

SEQ ID NO: 662 - DNA, 589 bp, Homo sapiens
cttcattccattttctgttgagtaataaactcaacgttgaaaatgtcctttgtgggggagaactcaggagtgaaaatgggctctgaggactgggaaaaagatgaaccccagtgctgcttagaagagatcttctttgcattagcctcatccttgagctcagcctctgcggagaaaggaagtccgattctcctgggggtctctaaaggggagttttgtctctactgtgacaaggataaaggacaaagtcatccatcccttcagctgaagaaggagaaactgatgaagctggctgcccaaaaggaatcagcacgccggcccttcatcttttatagggctcaggtgggctcctggaacatgctggagtcggcggctcaccccggatggttcatctgcacctcctgcaattgtaatgagcctgttggggtgacagataaatttgagaacaggaaacacattgaattttcatttcaaccagtttgcaaagctgaaatgagccccagtgaggtcagcgattaggaaactgccccattgaacgccttcctcgctaatttgaactaattgtataaaaacaccaaacctgctcactaaa

SEQ ID NO: 663 - DNA, 709 bp, Homo sapiens
cttcattccattttctgttgagtaataaactcaacgttgaaaatgtcctttgtgggggagaactcaggagtgaaaatgggctctgaggactgggaaaaagatgaaccccagtgctgcttagaaggtccaaaggtgaagaacttaaacccgaagaaattcagcattcatgaccaggatcacaaagtactggtcctggactctgggaatctcatagcagttccagataaaaactacatacgcccagagatcttctttgcattagcctcatccttgagctcagcctctgcggagaaaggaagtccgattctcctgggggtctctaaaggggagttttgtctctactgtgacaaggataaaggacaaagtcatccatcccttcagctgaagaaggagaaactgatgaagctggctgcccaaaaggaatcagcacgccggcccttcatcttttatagggctcaggtgggctcctggaacatgctggagtcggcggctcaccccggatggttcatctgcacctcctgcaattgtaatgagcctgttggggtgacagataaatttgagaacaggaaacacattgaattttcatttcaaccagtttgcaaagctgaaatgagccccagtgaggtcagcgattaggaaactgccccattgaacgccttcctcgctaatttgaactaattgtataaaaacaccaaacctgctcactaaa

SEQ ID NO: 664 - DNA, 652 bp, Homo sapiens
cttcattccattttctgttgagtaataaactcaacgttgaaaatgtcctttgtgggggagaactcaggagtgaaaatgggctctgaggactgggaaaaagatgaaccccagtgctgcttagaagacccggctggaagccccctggaaccaggcccaagcctccccaccatgaattttgttcacacaaagatcttctttgcattagcctcatccttgagctcagcctctgcggagaaaggaagtccgattctcctgggggtctctaaaggggagttttgtctctactgtgacaaggataaaggacaaagtcatccatcccttcagctgaagaaggagaaactgatgaagctggctgcccaaaaggaatcagcacgccggcccttcatcttttatagggctcaggtgggctcctggaacatgctggagtcggcggctcaccccggatggttcatctgcacctcctgcaattgtaatgagcctgttggggtgacagataaatttgagaacaggaaacacattgaattttcatttcaaccagtttgcaaagctgaaatgagccccagtgaggtcagcgattaggaaactgccccattgaacgccttcctcgctaatttgaactaattgtataaaaacaccaaacctgctcactaaa

SEQ ID NO: 665 - DNA, 2344 bp, Homo sapiens
ggcccaccgtactacttctgcgcctgcgcgaccgtgattccccgctcgcgactccccaccccccagggctccctaaagagggccacgagctgcgaaagggcgggaaaggcagttggagaagaggtaagcggttactcactccatggctgcagcaaggagaggcggcggcggcctcggctgaagaaagaaggtgggagcggagagcgcaggcgtgaaacccaccttgtcccatccacatcaggacatcccagctggagttcaaccttcatcccttctgtggcagttaggagactgaatcaaggtccagagaaggtggaggaatcctgatactgagcggaagaaaatacacagatgtgcttccttcccagtcctgacaaatggcctttccttaagttcctcattaattcatatgaagacaacacatttggtgactaaatttggaatcagaggcttttaaagcctcccagctgctctgaccccaatatcaggaacttggcatctctgatctaacaagggcaccactaacaaggacaaagccaccatcattcaccttgattccgcacatgcccaacgatgacttctgtcctgggctaaccataaaggccatgggtgctgagagagccccccagaggcagccatgcaccctgcacctcctcgtcctcgtccccatcctcctcagcctggtggcctcccaggactggaaggctgaacgcagccaagaccccttcgagaaatgcatgcaggatcctgactatgagcagctgctcaaggtggtgacctgggggctcaatcggaccctgaagccccagagggtgattgtggttggcgctggtgtggccgggctggtggccgccaaggtgctcagcgatgctggacacaaggtcaccatcctggaggcagataacaggatcgggggccgcatcttcacctaccgggaccagaacacgggctggattggggagctgggagccatgcgcatgcccagctctcacaggatcctccacaagctctgccagggcctggggctcaacctgaccaagttcacccagtacgacaagaacacgtggacggaggtgcacgaagtgaagctgcgcaactatgtggtggagaaggtgcccgagaagctgggctacgccttgcgtccccaggaaaagggccactcgcccgaagacatctaccagatggctctcaaccaggccctcaaagacctcaaggcactgggctgcagaaaggcgatgaagaagtttgaaaggcacacgctcttggaatatcttctcggggaggggaacctgagccggccggccgtgcagcttctgggagacgtgatgtccgaggatggcttcttctatctcagcttcgccgaggccctccgggcccacagctgcctcagcgacagactccagtacagccgcatcgtgggtggctgggacctgctgccgcgcgcgctgctgagctcgctgtccgggcttgtgctgttgaacgcgcccgtggtggcgatgacccagggaccgcacgatgtgcacgtgcagatcgagacctctcccccggcgcggaatctgaaggtgctgaaggccgacgtggtgctgctgacggcgagcggaccggcggtgaagcgcatcaccttctcgccgccgctgccccgccacatgcaggaggcgctgcggaggctgcactacgtgccggccaccaaggtgttcctaagcttccgcaggcccttctggcgcgaggagcacattgaaggcggccactcaaacaccgatcgcccgtcgcgcatgattttctacccgccgccgcgcgagggcgcgctgctgctggcctcgtacacgtggtcggacgcggcggcagcgttcgccggcttgagccgggaagaggcgttgcgcttggcgctcgacgacgtggcggcattgcacgggcctgtcgtgcgccagctctgggacggcaccggcgtcgtcaagcgttgggcggaggaccagcacagccagggtggctttgtggtacagccgccggcgctctggcaaaccgaaaaggatgactggacggtcccttatggccgcatctactttgccggcgagcacaccgcctacccgcacggctgggtggagacggcggtcaagtcggcgctgcgcgccgccatcaagatcaacagccggaaggggcctgcatcggacacggccagccccgaggggcacgcatctgacatggaggggcaggggcatgtgcatggggtggccagcagcccctcgcatgacctggcaaaggaagaaggcagccaccctccagtccaaggccagttatctctccaaaacacgacccacacgaggacctcgcattaaagtattttcgg

SEQ ID NO: 666 - DNA, 1793 bp, Homo sapiens
gacagtggagggcagtggagaggaccgcgctgtcctgctgtcaccaagagctggagacaccatctcccaccgagagtcatggccccattggccctgcacctcctcgtcctcgtccccatcctcctcagcctggtggcctcccaggactggaaggctgaacgcagccaagaccccttcgagaaatgcatgcaggatcctgactatgagcagctgctcaaggtggtgacctgggggctcaatcggaccctgaagccccagagggtgattgtggttggcgctggtgtggccgggctggtggccgccaaggtgctcagcgatgctggacacaaggtcaccatcctggaggcagataacaggatcgggggccgcatcttcacctaccgggaccagaacacgggctggattggggagctgggagccatgcgcatgcccagctctcacaggatcctccacaagctctgccagggcctggggctcaacctgaccaagttcacccagtacgacaagaacacgtggacggaggtgcacgaagtgaagctgcgcaactatgtggtggagaaggtgcccgagaagctgggctacgccttgcgtccccaggaaaagggccactcgcccgaagacatctaccagatggctctcaaccaggccctcaaagacctcaaggcactgggctgcagaaaggcgatgaagaagtttgaaaggcacacgctcttggaatatcttctcggggaggggaacctgagccggccggccgtgcagcttctgggagacgtgatgtccgaggatggcttcttctatctcagcttcgccgaggccctccgggcccacagctgcctcagcgacagactccagtacagccgcatcgtgggtggctgggacctgctgccgcgcgcgctgctgagctcgctgtccgggcttgtgctgttgaacgcgcccgtggtggcgatgacccagggaccgcacgatgtgcacgtgcagatcgagacctctcccccggcgcggaatctgaaggtgctgaaggccgacgtggtgctgctgacggcgagcggaccggcggtgaagcgcatcaccttctcgccgccgctgccccgccacatgcaggaggcgctgcggaggctgcactacgtgccggccaccaaggtgttcctaagcttccgcaggcccttctggcgcgaggagcacattgaaggcggccactcaaacaccgatcgcccgtcgcgcatgattttctacccgccgccgcgcgagggcgcgctgctgctggcctcgtacacgtggtcggacgcggcggcagcgttcgccggcttgagccgggaagaggcgttgcgcttggcgctcgacgacgtggcggcattgcacgggcctgtcgtgcgccagctctgggacggcaccggcgtcgtcaagcgttgggcggaggaccagcacagccagggtggctttgtggtacagccgccggcgctctggcaaaccgaaaaggatgactggacggtcccttatggccgcatctactttgccggcgagcacaccgcctacccgcacggctgggtggagacggcggtcaagtcggcgctgcgcgccgccatcaagatcaacagccggaaggggcctgcatcggacacggccagccccgaggggcacgcatctgacatggaggggcaggggcatgtgcatggggtggccagcagcccctcgcatgacctggcaaaggaagaaggcagccaccctccagtccaaggccagttatctctccaaaacacgacccacacgaggacctcgcattaaagtattttcgg

SEQ ID NO: 667 - DNA, 2407 bp, Homo sapiens
ggcccaccgtactacttctgcgcctgcgcgaccgtgattccccgctcgcgactccccaccccccagggctccctaaagagggccacgagctgcgaaagggcgggaaaggcagttggagaagaggtaagcggttactcactccatggctgcagcaaggagaggcggcggcggcctcggctgaagaaagaaggtgggagcggagagcgcaggcgtgaaacccaccttgtcccatccacatcaggacatcccagctggagttcaaccttcatcccttctgtggcagttaggagactgaatcaaggtccagagaaggtggaggaatcctgatactgagcggaagaaaatacacagatgtgcttccttcccagtcctgacaaatggcctttccttaagttcctcattaattcatatgaagacaacacatttggtgactaaatttggaatcagaggcttttaaagatgtttgaaagtttccataataaaacacttctgagaaagggggacctgcctttcacagcctcccagctgctctgaccccaatatcaggaacttggcatctctgatctaacaagggcaccactaacaaggacaaagccaccatcattcaccttgattccgcacatgcccaacgatgacttctgtcctgggctaaccataaaggccatgggtgctgagagagccccccagaggcagccatgcaccctgcacctcctcgtcctcgtccccatcctcctcagcctggtggcctcccaggactggaaggctgaacgcagccaagaccccttcgagaaatgcatgcaggatcctgactatgagcagctgctcaaggtggtgacctgggggctcaatcggaccctgaagccccagagggtgattgtggttggcgctggtgtggccgggctggtggccgccaaggtgctcagcgatgctggacacaaggtcaccatcctggaggcagataacaggatcgggggccgcatcttcacctaccgggaccagaacacgggctggattggggagctgggagccatgcgcatgcccagctctcacaggatcctccacaagctctgccagggcctggggctcaacctgaccaagttcacccagtacgacaagaacacgtggacggaggtgcacgaagtgaagctgcgcaactatgtggtggagaaggtgcccgagaagctgggctacgccttgcgtccccaggaaaagggccactcgcccgaagacatctaccagatggctctcaaccaggccctcaaagacctcaaggcactgggctgcagaaaggcgatgaagaagtttgaaaggcacacgctcttggaatatcttctcggggaggggaacctgagccggccggccgtgcagcttctgggagacgtgatgtccgaggatggcttcttctatctcagcttcgccgaggccctccgggcccacagctgcctcagcgacagactccagtacagccgcatcgtgggtggctgggacctgctgccgcgcgcgctgctgagctcgctgtccgggcttgtgctgttgaacgcgcccgtggtggcgatgacccagggaccgcacgatgtgcacgtgcagatcgagacctctcccccggcgcggaatctgaaggtgctgaaggccgacgtggtgctgctgacggcgagcggaccggcggtgaagcgcatcaccttctcgccgccgctgccccgccacatgcaggaggcgctgcggaggctgcactacgtgccggccaccaaggtgttcctaagcttccgcaggcccttctggcgcgaggagcacattgaaggcggccactcaaacaccgatcgcccgtcgcgcatgattttctacccgccgccgcgcgagggcgcgctgctgctggcctcgtacacgtggtcggacgcggcggcagcgttcgccggcttgagccgggaagaggcgttgcgcttggcgctcgacgacgtggcggcattgcacgggcctgtcgtgcgccagctctgggacggcaccggcgtcgtcaagcgttgggcggaggaccagcacagccagggtggctttgtggtacagccgccggcgctctggcaaaccgaaaaggatgactggacggtcccttatggccgcatctactttgccggcgagcacaccgcctacccgcacggctgggtggagacggcggtcaagtcggcgctgcgcgccgccatcaagatcaacagccggaaggggcctgcatcggacacggccagccccgaggggcacgcatctgacatggaggggcaggggcatgtgcatggggtggccagcagcccctcgcatgacctggcaaaggaagaaggcagccaccctccagtccaaggccagttatctctccaaaacacgacccacacgaggacctcgcattaaagtattttcggaaaaa

SEQ ID NO: 668 - DNA, 816 bp, Homo sapiens
atgcactttctttgccaaaggcaaacgcagaacgtttcagagccatgaggatgcttctgcatttgagtttgctagctcttggagctgcctacgtgtatgccatccccacagaaattcccacaagtgcattggtgaaagagaccttggcactgctttctactcatcgaactctgctgatagccaatgagactctgaggattcctgttcctgtacataaaaatcaccaactgtgcactgaagaaatctttcagggaataggcacactggagagtcaaactgtgcaagggggtactgtggaaagactattcaaaaacttgtccttaataaagaaatacattgacggccaaaaaaaaaagtgtggagaagaaagacggagagtaaaccaattcctagactacctgcaagagtttcttggtgtaatgaacaccgagtggataatagaaagttgagactaaactggtttgttgcagccaaagattttggaggagaaggacattttactgcagtgagaatgagggccaagaaagagtcaggccttaattttcagtataatttaacttcagagggaaagtaaatatttcaggcatactgacactttgccagaaagcataaaattcttaaaatatatttcagatatcagaatcattgaagtattttcctccaggcaaaattgatatacttttttcttatttaacttaacattctgtaaaatgtctgttaacttaatagtatttatgaaatggttaagaatttggtaaattagtatttatttaatgttatgttgtgttctaataaaacaaaaatagacaactgttc

SEQ ID NO: 669 - DNA, 591 bp, Homo sapiens
ccgctgtcaagatgcttctggccatggtccttacctctgccctgctcctgtgctccgtggcaggccaggggtgtccaaccttggcggggatcctggacatcaacttcctcatcaacaagatgcaggaagatccagcttccaagtgccactgcagtgctaatgtgaccagttgtctctgtttgggcattccctctgacaactgcaccagaccatgcttcagtgagagactgtctcagatgaccaataccaccatgcaaacaagatacccactgattttcagtcgggtgaaaaaatcagttgaagtactaaagaacaacaagtgtccatatttttcctgtgaacagccatgcaaccaaaccacggcaggcaacgcgctgacatttctgaagagtcttctggaaattttccagaaagaaaagatgagagggatgagaggcaagatatgaagatgaaatattatttatcctatttattaaatttaaaaagctttctctttaagttgctacaatttaaaaatcaagtaagctactctaaatcagtatcagttgtgattatttgtttaacattgtatgtctttattttgaaataaat

SEQ ID NO: 670 - DNA, 2622 bp, Homo sapiens
cttctcgccattgcagttggacccagcagcccggcgcgcaccgcgtggcttttgggggcagaccccggcgggctgtggcaggagggcggcggcggcggctgcggtcgaagaaggggacgccgacaagagttgaagtattgataacaccaaggaactctatcacaatttgaaaagataagcaaaagtttgatttccagacactacagaagaagtaaaaatgcgtccaatgcgaatttttgtgaatgatgaccgccatgtgatggcaaagcattcttccgtttatccaacacaagaggagctggaggcagtccagaacatggtgtcccacacggagcgggcgctcaaagctgtgtccgactggatagacgagcaggaaaagggtagcagcgagcaggcagagtccgataacatggatgtgcccccagaggacgacagtaaagaaggggctggggaacagaagacggagcacatgaccagaaccctgcggggagtgatgcgggtgggcctggtggcaaagggcctcctactcaagggggacttggatctggagctggtgctgctgtgtaaggagaagcccacaaccgccctcctggacaaggtggccgacaacctggccatccagcttgctgctgtaacagaagacaagtacgaaatactgcaatctgtcgacgatgctgcgattgtgataaaaaacacaaaagagcctccattgtccctgaccatccacctgacatcccctgttgtcagagaagaaatggagaaagtattagctggagaaacgctatcagtcaacgaccccccggacgttctggacaggcagaaatgccttgctgccttggcgtccctccgacacgccaagtggttccaggccagagccaacgggctgaagtcttgtgtcattgtgatccgggtcttgagggacctgtgcactcgcgtgcccacctggggtcccctccgaggctggcctctcgagctcctgtgtgagaaatccattggcacggccaacagaccgatgggtgctggcgaggccctgcggagagtgctggagtgcctggcgtcgggcatcgtgatgccagatggttctggcatttatgacccttgtgaaaaagaagccactgatgctattgggcatctagacagacagcaacgggaagatatcacacagagtgcgcagcacgcactgcggctcgctgccttcggccagctccataaagtcctaggcatggaccctctgccttccaagatgcccaagaaaccaaagaatgaaaacccagtggactacaccgttcagatcccaccaagcaccacctatgccattacgcccatgaaacgcccaatggaggaggacggggaggagaagtcgcccagcaaaaagaagaagaagattcagaagaaagaggagaaggcagagcccccccaggctatgaatgccctgatgcggttgaaccagctgaagccagggctgcagtacaagctggtgtcccagactgggcccgtccatgcccccatctttaccatgtctgtggaggttgatggcaattcattcgaggcctctgggccctccaaaaagacggccaagctgcacgtggccgttaaggtgttacaggacatgggcttgccgacgggtgctgaaggcagggactcgagcaagggggaggactcggctgaggagaccgaggcgaagccagcagtggtggcccctgccccagtggtagaagctgtctccacccctagtgcggcctttccctcagatgccactgccgagcaggggccgatcctgacaaagcacggcaagaacccagtcatggagctgaacgagaagaggcgtgggctcaagtacgagctcatctccgagaccgggggcagccacgacaagcgcttcgtcatggaggtcgaagtggatggacagaagttccaaggtgctggttccaacaaaaaggtggcgaaggcctacgctgctcttgctgccctagaaaagcttttccctgacacccctctcgcccttgatgccaacaaaaagaagagagccccagtacccgtcagagggggaccgaaatttgctgctaagccacataaccctggcttcggcatgggaggccccatgcacaacgaagtgcccccaccccccaaccttcgagggcggggaagaggcgggagcatccggggacgagggcgcgggcgaggatttggtggcgccaaccatggaggctacatgaatgccggtgctgggtatggaagctatgggtacggaggcaactcggcgacagcaggctacagtgactttttcacagactgctacggctatcatgattttgggtcttcctagagcgtctaaaagtattgcacacaaaatcaactttttactccaatttcctccaactccaaaacccaaagtgtccgtgctgtgtccctgtgcttcactgggtttctcaaccgtggcttttcaccgcagcttgtctgaaactcttagcctgcagaatttaagacaatggcagtttttatcgtgatttgcctttgaacttggtcctattgaagttcacaataagtggaaaacaattttttcagagaatgtatttttgtgcagaattgcacagaattctagagacagcgttgttcggcatc

SEQ ID NO: 671 - DNA, 3728 bp, Homo sapiens
aaagggggcggggcttcagccggtcacgtgttcccgcacctccccggcgcgcgcctgcccgcccgcccgctcgcccccggtccggactcctcctcctcctcttctcgccattgcagttggacccagcagcccggcgcgcaccgcgtggcttttgggggcagaccccggcgggctgtggcaggagggcggcggcggcggctgcggtcgaagaaggggacgccgacaagagttgaagtattgataacaccaaggaactctatcacaatttgaaaagataagcaaaagtttgatttccagacactacagaagaagtaaaaatgcgtccaatgcgaatttttgtgaatgatgaccgccatgtgatggcaaagcattcttccgtttatccaacacaagaggagctggaggcagtccagaacatggtgtcccacacggagcgggcgctcaaagctgtgtccgactggatagacgagcaggaaaagggtagcagcgagcaggcagagtccgataacatggatgtgcccccagaggacgacagtaaagaaggggctggggaacagaagacggagcacatgaccagaaccctgcggggagtgatgcgggtgggcctggtggcaaagggcctcctactcaagggggacttggatctggagctggtgctgctgtgtaaggagaagcccacaaccgccctcctggacaaggtggccgacaacctggccatccagcttgctgctgtaacagaagacaagtacgaaatactgcaatctgtcgacgatgctgcgattgtgataaaaaacacaaaagagcctccattgtccctgaccatccacctgacatcccctgttgtcagagaagaaatggagaaagtattagctggagaaacgctatcagtcaacgaccccccggacgttctggacaggcagaaatgccttgctgccttggcgtccctccgacacgccaagtggttccaggccagagccaacgggctgaagtcttgtgtcattgtgatccgggtcttgagggacctgtgcactcgcgtgcccacctggggtcccctccgaggctggcctctcgagctcctgtgtgagaaatccattggcacggccaacagaccgatgggtgctggcgaggccctgcggagagtgctggagtgcctggcgtcgggcatcgtgatgccagatggttctggcatttatgacccttgtgaaaaagaagccactgatgctattgggcatctagacagacagcaacgggaagatatcacacagagtgcgcagcacgcactgcggctcgctgccttcggccagctccataaagtcctaggcatggaccctctgccttccaagatgcccaagaaaccaaagaatgaaaacccagtggactacaccgttcagatcccaccaagcaccacctatgccattacgcccatgaaacgcccaatggaggaggacggggaggagaagtcgcccagcaaaaagaagaagaagattcagaagaaagaggagaaggcagagcccccccaggctatgaatgccctgatgcggttgaaccagctgaagccagggctgcagtacaagctggtgtcccagactgggcccgtccatgcccccatctttaccatgtctgtggaggttgatggcaattcattcgaggcctctgggccctccaaaaagacggccaagctgcacgtggccgttaaggtgttacaggacatgggcttgccgacgggtgctgaaggcagggactcgagcaagggggaggactcggctgaggagaccgaggcgaagccagcagtggtggcccctgccccagtggtagaagctgtctccacccctagtgcggcctttccctcagatgccactgccgagcaggggccgatcctgacaaagcacggcaagaacccagtcatggagctgaacgagaagaggcgtgggctcaagtacgagctcatctccgagaccgggggcagccacgacaagcgcttcgtcatggaggtcgaagtggatggacagaagttccaaggtgctggttccaacaaaaaggtggcgaaggcctacgctgctcttgctgccctagaaaagcttttccctgacacccctctcgcccttgatgccaacaaaaagaagagagccccagtacccgtcagagggggaccgaaatttgctgctaagccacataaccctggcttcggcatgggaggccccatgcacaacgaagtgcccccaccccccaaccttcgagggcggggaagaggcgggagcatccggggacgagggcgcgggcgaggatttggtggcgccaaccatggaggctacatgaatgccggtgctgggtatggaagctatgggtacggaggcaactcggcgacagcaggctacagtgactttttcacagactgctacggctatcatgattttgggtcttcctagagcgtctaaaagtattgcacacaaaatcaactttttactccaatttcctccaactccaaaacccaaagtgtccgtgctgtgtccctgtgcttcactgggtttctcaaccgtggcttttcaccgcagcttgtctgaaactcttagcctgcagaatttaagacaatggcagtttttatcgtgatttgcctttgaacttggtcctattgaagttcacaataagtggaaaacaattttttcagagaatgtatttttgtgcagaattgcacagaattctagagacagcgttgttcggcatcaaggcaaaagcccacctttgctttttatggaaagcattactttatttaaagagacagacaatgacgcattttaatctacctttgtcttaatttacagcaggttttgtatgaatttttaaccttttaacaaactcccaaatctggttgatgcctttgacagtgatgaaaacgatttcaccacatctgaatccagagaaaccggctttttttcttattgcgagcatgttaaaacgttgggaacatgtggggaattgtatattgcgctgaattaacttctcccgcctcttgtaatgctctggtgggttcttgtttgggaatgcgatattttgtggctggtttagctagagagtgaactctcaaaggtatcaaaactgtgcttccattattagtgcaagaaacagacaggctttaaggggtagatgacgtgaaattttgcaagtcttaattacagctgcagatgcatgggattctggatttttttgttgctttttagtttaatgggactttaaaagtaattgaggagaaagaaccgtgatgttccctgtttctccagtaaaggactggcttttgcttgggcagaggtggtgctgctgggtgtgcagctgccacagactccaaaggcgtagaagtttgtgccaacacacggagtcattctggctctctgctgaggcccctgttttctggcaggtgccctccttggaaactggttttggctctgatcagcggttctttttgcagcaaagcctgcatctgtgttgacttgcaagattttgcgtttattcaggcaaaaactggtcaaaatggttactacatgatttgttcccagaggtttgaaacattcagtgaaactttttaaaactttgattgcatgatgtattttttttttagaaagttattgtttgagaataatgtctttttataccaggaaaatagttatcctgaatgacgttgaaaactccccctcccctttatttttttttaatcaatacatgtgaaagtaacaagc

SEQ ID NO: 672 - DNA, 6107 bp, Homo sapiens
aaagggggcggggcttcagccggtcacgtgttcccgcacctccccggcgcgcgcctgcccgcccgcccgctcgcccccggtccggactcctcctcctcctcttctcgccattgcagttggacccagcagcccggcgcgcaccgcgtggcttttgggggcagaccccggcgggctgtggcaggagggcggcggcggcggctgcggtcgaagaaggggacgccgacaagagttgaagtattgataacaccaaggaactctatcacaatttgaaaagataagcaaaagtttgatttccagacactacagaagaagtaaaaatgcgtccaatgcgaatttttgtgaatgatgaccgccatgtgatggcaaagcattcttccgtttatccaacacaagaggagctggaggcagtccagaacatggtgtcccacacggagcgggcgctcaaagctgtgtccgactggatagacgagcaggaaaagggtagcagcgagcaggcagagtccgataacatggatgtgcccccagaggacgacagtaaagaaggggctggggaacagaagacggagcacatgaccagaaccctgcggggagtgatgcgggtgggcctggtggcaaagggcctcctactcaagggggacttggatctggagctggtgctgctgtgtaaggagaagcccacaaccgccctcctggacaaggtggccgacaacctggccatccagcttgctgctgtaacagaagacaagtacgaaatactgcaatctgtcgacgatgctgcgattgtgataaaaaacacaaaagagcctccattgtccctgaccatccacctgacatcccctgttgtcagagaagaaatggagaaagtattagctggagaaacgctatcagtcaacgaccccccggacgttctggacaggcagaaatgccttgctgccttggcgtccctccgacacgccaagtggttccaggccagagccaacgggctgaagtcttgtgtcattgtgatccgggtcttgagggacctgtgcactcgcgtgcccacctggggtcccctccgaggctggcctctcgagctcctgtgtgagaaatccattggcacggccaacagaccgatgggtgctggcgaggccctgcggagagtgctggagtgcctggcgtcgggcatcgtgatgccagatggttctggcatttatgacccttgtgaaaaagaagccactgatgctattgggcatctagacagacagcaacgggaagatatcacacagagtgcgcagcacgcactgcggctcgctgccttcggccagctccataaagtcctaggcatggaccctctgccttccaagatgcccaagaaaccaaagaatgaaaacccagtggactacaccgttcagatcccaccaagcaccacctatgccattacgcccatgaaacgcccaatggaggaggacggggaggagaagtcgcccagcaaaaagaagaagaagattcagaagaaagaggagaaggcagagcccccccaggctatgaatgccctgatgcggttgaaccagctgaagccagggctgcagtacaagctggtgtcccagactgggcccgtccatgcccccatctttaccatgtctgtggaggttgatggcaattcattcgaggcctctgggccctccaaaaagacggccaagctgcacgtggccgttaaggtgttacaggacatgggcttgccgacgggtgctgaaggcagggactcgagcaagggggaggactcggctgaggagaccgaggcgaagccagcagtggtggcccctgccccagtggtagaagctgtctccacccctagtgcggcctttccctcagatgccactgccgagcaggggccgatcctgacaaagcacggcaagaacccagtcatggagctgaacgagaagaggcgtgggctcaagtacgagctcatctccgagaccgggggcagccacgacaagcgcttcgtcatggaggtcgaagtggatggacagaagttccaaggtgctggttccaacaaaaaggtggcgaaggcctacgctgctcttgctgccctagaaaagcttttccctgacacccctctcgcccttgatgccaacaaaaagaagagagccccagtacccgtcagagggggaccgaaatttgctgctaagccacataaccctggcttcggcatgggaggccccatgcacaacgaagtgcccccaccccccaaccttcgagggcggggaagaggcgggagcatccggggacgagggcgcgggcgaggatttggtggcgccaaccatggaggctacatgaatgccggtgctgggtatggaagctatgggtacggaggcaactcggcgacagcaggctacagtcagttctacagcaacggagggcattctgggaatgccagtggcggtggcggcgggggcggtggtggctcctccggctatggctcctactaccaaggtgacaactacaactcaccggtgcccccaaaacacgctgggaagaagcagccgcacgggggccagcagaagccctcctacggctcgggctaccagtcccaccagggccagcagcagtcctacaaccagagcccctacagcaactatggccctccacagggcaagcagaaaggctataaccatggacaaggcagctactcctactcgaactcctacaactctcccgggggcgggggcggatccgactacaactacgagagcaaattcaactacagtggtagtggaggccgaagcggcgggaacagctacggctcaggcggggcatcctacaacccagggtcacacgggggctacggcggaggttctgggggcggctcctcataccaaggcaaacaaggaggctactcacagtcgaactacaactccccggggtccggccagaactacagtggccctcccagctcctaccagtcctcacaaggcggctatggcagaaacgcagaccacagcatgaactaccagtacagataagcccccgcggggcggagatttctaccttctgcacttactccccatcagaagatcgagttttatgcatcacagttaacatgtcagctggccctccaggcccccgcccccatcccgtccacgttgctgtgtcgtgaggtgcagcgggtcaccctgtggcccgtcctgtgacccatatttagccgtgtttgggactccgtgtcttcaatggtttgttagttgccattacaactttgtctgggtagagtttttgagtttttgcagttcagtatccctctgtctattcacacttcgtgttagtggtaactcagtttgtctttaaatagttacagaagggatacgtcatttgttaatgcttttgtgaagtgagttaaacgagctttctgtattttaatgctttagtgtttcagttttataagtgaagattttattttaaaaaccagtgggaaagagtggggggtttctttttatgtctgggtcattcaggcagtacatctgaattaagctgaatgtagacaaataaagaaaaacaaaactgcgcccgtcttaggcctgggtgtctgacccaccagcagtgcaatgggcaggtttccccactctattcctgctcttgggaaagcagcgtgggccatcaggatggtccctggtccttagagagggtccagttcaggcttctagacattttactcatgctcagcgaaggctggttcctggtcccctgggctgtgtagacccggtgtcccaccaggctccaggctcccaccatctacagaggggcttacagcgcccattctggtcttggggaacccatcacaaaataggctttttctgctccccgattctggtgtagttctaagtacacagtgatgtcctctgtaggggcgtgcctgtggtggaacataacgcagttacaaaagaaagggcaggtgaggcctgggtaaccccagccatggaccgtcagtggctggagggagcttcgtgtctgtgctggagctgcagcctgctcgccatctggaggctcagtggagtggggagttggggttctcataccagcagatttccctagagcgtgattctcccatctgaggcaatcttgcctcccaggggaaattttgcaatgtttggaggatgttgtcacagctagtagcgggtgctctgggatctggtggatagatgccaaggatgctgtcaagcatactgtactgcccagaacagtggcccatagcagggacctgccctatcaaaatatcaggtgtatggaggtggagtcccaacgctagagcagcccttctcagctccaccctgcccggggagggaggaggagctctggtttcagagcagtgccgggattgcctttccccaggatctgtgtcggccatccaggaagaactgtactggccaagcctgggaccacacgtctgcagagatcctgctctgctggcctgagccccaggccttggcctcctgtgcttgggtaaccatggccactgggaaaagcaaggaccgtgtttgactttcttggagaggtgaaagaggtgaaagaacaagttgtgtgctagaaaacttttgaggaattcttatttgtgttagagcagaggaggtcccagataccaagtggcgcctcccaggaaaggctgggagaagaggtggcctggagtaccccgagatcccagcagcgcacacagtggagggatgaggatggatgggtcctaacccctgattttgatgggatgtgttcatgtcctatctcctctcctggacacattaaggggttgggacaagaagagactcctgtgagatcagcagacctcgtgtttaaggagagaatgcctgcctgcaacactcatggagagggacacttcctggccccacctgctaaatacctccaaactctgggcaggcgcctgcattctcaacacaggacttcccttaacagtttccggatcagtgaccaccaccacgttcaggtttctgaatgcagacccaccacgagggatggattccacccgcccgccctgctgcagatacatgcggcacagcaggcacgtgcctggagagaacagctcctgagcacagcacccttggagccctcaccccgctcacgatcctcaccagtgctgatgatgccgtcatgctgctggcctgagacagtatcccagctacaacaggacgacaccgggttcaggaatatgtggctatcaccttgagcactgacagtggccttccaggctagttgccttccaaacgcaggtagccgacctgcaggagggcctacaaacgggcccagcaagagctgggcaacagctggcttgtgaaatgagacaccttgaccaatatgctttgggtggacggtctcctacatgttcagtggaggccaccaggagcatccatgagcggggaaggggtccacacccttacatggcaagttgatacgatggggtgcttggtggatgggccatggaggtccgtgagctggaactgggcacacgccatcccagagggctcaggatgccccaggaaggaaagaagggcaacagactacacgattggacgtgtgtggttgactgggatgaagttggagggaggggcagggccttgcaggggattggtactgatcccagggaggaagtgttggggcttcatgaactaggatgaaaggaggcccctgagccatgacaaggggcacatccaggatttccgccaccctgaatttagtagagctagtaggccctggtcgtcactctgggcagggatgccgtcagccttgagggtcgccacccacctgtgtgttgccctctgtcctggcagggaaacatacaccccttgtctcaccaccaaccttgcttgtgtagtcagcagggctggccctgccccaaggactcactgcatgtacccggacccctaggcctggcctttgcagcatagttgggagcttctggattccatctgcacctgtgagccccatgctggctgtgcactgcgcgggcctgagactgctggatacaatgttgggcaacaactcagccagcctgatggcagcctcagaggcttactctaacccatcccagaataaatggagacttcatgtgttcattgtttcattcactc

SEQ ID NO: 673 - DNA, 2612 bp, Homo sapiens
aaagggggcggggcttcagccggtcacgtgttcccgcacctccccggcgcgcgcctgcccgcccgcccgctcgcccccggtccggactcctcctcctcctcttctcgccattgcagttggacccagcagcccggcgcgcaccgcgtggcttttgggggcagaccccggcgggctgtggcaggagggcggcggcggcggctgcggtcgaagaaggggacgccgacaagagttgaagtattgataacaccaaggaactctatcacaatttgaaaagataagcaaaagtttgatttccagacactacagaagaagtaaaaatgcgtccaatgcgaatttttgtgaatgatgaccgccatgtgatggcaaagcattcttccgtttatccaacacaagaggagctggaggcagtccagaacatggtgtcccacacggagcgggcgctcaaagctgtgtccgactggatagacgagcaggaaaagggtagcagcgagcaggcagagtccgataacatggatgtgcccccagaggacgacagtaaagaaggggctggggaacagaagacggagcacatgaccagaaccctgcggggagtgatgcgggtgggcctggtggcaaagggcctcctactcaagggggacttggatctggagctggtgctgctgtgtaaggagaagcccacaaccgccctcctggacaaggtggccgacaacctggccatccagcttgctgctgtaacagaagacaagtacgaaatactgcaatctgtcgacgatgctgcgattgtgataaaaaacacaaaagagcctccattgtccctgaccatccacctgacatcccctgttgtcagagaagaaatggagaaagtattagctggagaaacgctatcagtcaacgaccccccggacgttctggacaggcagaaatgccttgctgccttggcgtccctccgacacgccaagtggttccaggccagagccaacgggctgaagtcttgtgtcattgtgatccgggtcttgagggacctgtgcactcgcgtgcccacctggggtcccctccgaggctggcctctcgagctcctgtgtgagaaatccattggcacggccaacagaccgatgggtgctggcgaggccctgcggagagtgctggagtgcctggcgtcgggcatcgtgatgccagatggttctggcatttatgacccttgtgaaaaagaagccactgatgctattgggcatctagacagacagcaacgggaagatatcacacagagtgcgcagcacgcactgcggctcgctgccttcggccagctccataaagtcctaggcatggaccctctgccttccaagatgcccaagaaaccaaagaatgaaaacccagtggactacaccgttcagatcccaccaagcaccacctatgccattacgcccatgaaacgcccaatggaggaggacggggaggagaagtcgcccagcaaaaagaagaagaagattcagaagaaagaggagaaggcagagcccccccaggctatgaatgccctgatgcggttgaaccagctgaagccagggctgcagtacaagctggtgtcccagactgggcccgtccatgcccccatctttaccatgtctgtggaggttgatggcaattcattcgaggcctctgggccctccaaaaagacggccaagctgcacgtggccgttaaggtgttacaggacatgggcttgccgacgggtgctgaaggcagggactcgagcaagggggaggactcggctgaggagaccgaggcgaagccagcagtggtggcccctgccccagtggtagaagctgtctccacccctagtgcggcctttccctcagatgccactgccgagcaggggccgatcctgacaaagcacggcaagaacccagtcatggagctgaacgagaagaggcgtgggctcaagtacgagctcatctccgagaccgggggcagccacgacaagcgcttcgtcatggaggtcgaagtggatggacagaagttccaaggtgctggttccaacaaaaaggtggcgaaggcctacgctgctcttgctgccctagaaaagcttttccctgacacccctctcgcccttgatgccaacaaaaagaagagagccccagtacccgtcagagggggaccgaaatttgctgctaagccacataaccctggcttcggcatgggaggccccatgcacaacgaagtgcccccaccccccaaccttcgagggcggggaagaggcgggagcatccggggacgagggcgcgggcgaggatttggtggcgccaaccatggaggctacatgaatgccggtgctgggtatggaagctatgggtacggaggcaactcggcgacagcaggctacagtaagtcctccaggcccccgcccccatcccgtccacgttgctgtgtcgtgaggtgcagcgggtcaccctgtggcccgtcctgtgacccatatttagccgtgtttgggactccgtgtcttcaatggtttgttagttgccattacaactttgtctgggtagagtttttgagtttttgcagttcagtatccctctgtctattcacacttcgtgttagtggtaactcagtttgtctttaa

SEQ ID NO: 674 - DNA, 3740 bp, Homo sapiens
aaagggggcggggcttcagccggtcacgtgttcccgcacctccccggcgcgcgcctgcccgcccgcccgctcgcccccggtccggactcctcctcctcctcttctcgccattgcagttggacccagcagcccggcgcgcaccgcgtggcttttgggggcagaccccggcgggctgtggcaggagggcggcggcggcggctgcggtcgaagaaggggacgccgacaagagttgaagtattgataacaccaaggaactctatcacaatttgaaaagataagcaaaagtttgatttccagacactacagaagaagtaaaaatgcgtccaatgcgaatttttgtgaatgatgaccgccatgtgatggcaaagcattcttccgtttatccaacacaagaggagctggaggcagtccagaacatggtgtcccacacggagcgggcgctcaaagctgtgtccgactggatagacgagcaggaaaagggtagcagcgagcaggcagagtccgataacatggatgtgcccccagaggacgacagtaaagaaggggctggggaacagaagacggagcacatgaccagaaccctgcggggagtgatgcgggtgggcctggtggcaaagggcctcctactcaagggggacttggatctggagctggtgctgctgtgtaaggagaagcccacaaccgccctcctggacaaggtggccgacaacctggccatccagcttgctgctgtaacagaagacaagtacgaaatactgcaatctgtcgacgatgctgcgattgtgataaaaaacacaaaagagcctccattgtccctgaccatccacctgacatcccctgttgtcagagaagaaatggagaaagtattagctggagaaacgctatcagtcaacgaccccccggacgttctggacaggcagaaatgccttgctgccttggcgtccctccgacacgccaagtggttccaggccagagccaacgggctgaagtcttgtgtcattgtgatccgggtcttgagggacctgtgcactcgcgtgcccacctggggtcccctccgaggctggcctctcgagctcctgtgtgagaaatccattggcacggccaacagaccgatgggtgctggcgaggccctgcggagagtgctggagtgcctggcgtcgggcatcgtgatgccagatggttctggcatttatgacccttgtgaaaaagaagccactgatgctattgggcatctagacagacagcaacgggaagatatcacacagagtgcgcagcacgcactgcggctcgctgccttcggccagctccataaagtcctaggcatggaccctctgccttccaagatgcccaagaaaccaaagaatgaaaacccagtggactacaccgttcagatcccaccaagcaccacctatgccattacgcccatgaaacgcccaatggaggaggacggggaggagaagtcgcccagcaaaaagaagaagaagattcagaagaaagaggagaaggcagagcccccccaggctatgaatgccctgatgcggttgaaccagctgaagccagggctgcagtacaagctggtgtcccagactgggcccgtccatgcccccatctttaccatgtctgtggaggttgatggcaattcattcgaggcctctgggccctccaaaaagacggccaagctgcacgtggccgttaaggtgttacaggacatgggcttgccgacgggtgctgaaggcagggactcgagcaagggggaggactcggctgaggagaccgaggcgaagccagcagtggtggcccctgccccagtggtagaagctgtctccacccctagtgcggcctttccctcagatgccactgccgagaacgtaaaacagcaggggccgatcctgacaaagcacggcaagaacccagtcatggagctgaacgagaagaggcgtgggctcaagtacgagctcatctccgagaccgggggcagccacgacaagcgcttcgtcatggaggtcgaagtggatggacagaagttccaaggtgctggttccaacaaaaaggtggcgaaggcctacgctgctcttgctgccctagaaaagcttttccctgacacccctctcgcccttgatgccaacaaaaagaagagagccccagtacccgtcagagggggaccgaaatttgctgctaagccacataaccctggcttcggcatgggaggccccatgcacaacgaagtgcccccaccccccaaccttcgagggcggggaagaggcgggagcatccggggacgagggcgcgggcgaggatttggtggcgccaaccatggaggctacatgaatgccggtgctgggtatggaagctatgggtacggaggcaactcggcgacagcaggctacagtgactttttcacagactgctacggctatcatgattttgggtcttcctagagcgtctaaaagtattgcacacaaaatcaactttttactccaatttcctccaactccaaaacccaaagtgtccgtgctgtgtccctgtgcttcactgggtttctcaaccgtggcttttcaccgcagcttgtctgaaactcttagcctgcagaatttaagacaatggcagtttttatcgtgatttgcctttgaacttggtcctattgaagttcacaataagtggaaaacaattttttcagagaatgtatttttgtgcagaattgcacagaattctagagacagcgttgttcggcatcaaggcaaaagcccacctttgctttttatggaaagcattactttatttaaagagacagacaatgacgcattttaatctacctttgtcttaatttacagcaggttttgtatgaatttttaaccttttaacaaactcccaaatctggttgatgcctttgacagtgatgaaaacgatttcaccacatctgaatccagagaaaccggctttttttcttattgcgagcatgttaaaacgttgggaacatgtggggaattgtatattgcgctgaattaacttctcccgcctcttgtaatgctctggtgggttcttgtttgggaatgcgatattttgtggctggtttagctagagagtgaactctcaaaggtatcaaaactgtgcttccattattagtgcaagaaacagacaggctttaaggggtagatgacgtgaaattttgcaagtcttaattacagctgcagatgcatgggattctggatttttttgttgctttttagtttaatgggactttaaaagtaattgaggagaaagaaccgtgatgttccctgtttctccagtaaaggactggcttttgcttgggcagaggtggtgctgctgggtgtgcagctgccacagactccaaaggcgtagaagtttgtgccaacacacggagtcattctggctctctgctgaggcccctgttttctggcaggtgccctccttggaaactggttttggctctgatcagcggttctttttgcagcaaagcctgcatctgtgttgacttgcaagattttgcgtttattcaggcaaaaactggtcaaaatggttactacatgatttgttcccagaggtttgaaacattcagtgaaactttttaaaactttgattgcatgatgtattttttttttagaaagttattgtttgagaataatgtctttttataccaggaaaatagttatcctgaatgacgttgaaaactccccctcccctttatttttttttaatcaatacatgtgaaagtaacaagc

SEQ ID NO: 675 - DNA, 3285 bp, Homo sapiens
aaagggggcggggcttcagccggtcacgtgttcccgcacctccccggcgcgcgcctgcccgcccgcccgctcgcccccggtccggactcctcctcctcctcttctcgccattgcagttggacccagcagcccggcgcgcaccgcgtggcttttgggggcagaccccggcgggctgtggcaggagggcggcggcggcggctgcggtcgaagaaggggacgccgacaagagttgaagtattgataacaccaaggaactctatcacaatttgaaaagataagcaaaagtttgatttccagacactacagaagaagtaaaaatgcgtccaatgcgaatttttgtgaatgatgaccgccatgtgatggcaaagcattcttccgtttatccaacacaagaggagctggaggcagtccagaacatggtgtcccacacggagcgggcgctcaaagctgtgtccgactggatagacgagcaggaaaagggtagcagcgagcaggcagagtccgataacatggatgtgcccccagaggacgacagtaaagaaggggctggggaacagaagacggagcacatgaccagaaccctgcggggagtgatgcgggtgggcctggtggcaaagggcctcctactcaagggggacttggatctggagctggtgctgctgtgtaaggagaagcccacaaccgccctcctggacaaggtggccgacaacctggccatccagcttgctgctgtaacagaagacaagtacgaaatactgcaatctgtcgacgatgctgcgattgtgataaaaaacacaaaagagcctccattgtccctgaccatccacctgacatcccctgttgtcagagaagaaatggagaaagtattagctggagaaacgctatcagtcaacgaccccccggacgttctggacaggcagaaatgccttgctgccttggcgtccctccgacacgccaagtggttccaggccagagccaacgggctgaagtcttgtgtcattgtgatccgggtcttgagggacctgtgcactcgcgtgcccacctggggtcccctccgaggctggcctctcgagctcctgtgtgagaaatccattggcacggccaacagaccgatgggtgctggcgaggccctgcggagagtgctggagtgcctggcgtcgggcatcgtgatgccagatggttctggcatttatgacccttgtgaaaaagaagccactgatgctattgggcatctagacagacagcaacgggaagatatcacacagagtgcgcagcacgcactgcggctcgctgccttcggccagctccataaagtcctaggcatggaccctctgccttccaagatgcccaagaaaccaaagaatgaaaacccagtggactacaccgttcagatcccaccaagcaccacctatgccattacgcccatgaaacgcccaatggaggaggacggggaggagaagtcgcccagcaaaaagaagaagaagattcagaagaaagaggagaaggcagagcccccccaggctatgaatgccctgatgcggttgaaccagctgaagccagggctgcagtacaagctggtgtcccagactgggcccgtccatgcccccatctttaccatgtctgtggaggttgatggcaattcattcgaggcctctgggccctccaaaaagacggccaagctgcacgtggccgttaaggtgttacaggacatgggcttgccgacgggtgctgaaggcagggactcgagcaagggggaggactcggctgaggagaccgaggcgaagccagcagtggtggcccctgccccagtggtagaagctgtctccacccctagtgcggcctttccctcagatgccactgccgagcaggggccgatcctgacaaagcacggcaagaacccagtcatggagctgaacgagaagaggcgtgggctcaagtacgagctcatctccgagaccgggggcagccacgacaagcgcttcgtcatggaggtcgaagtggatggacagaagttccaaggtgctggttccaacaaaaaggtggcgaaggcctacgctgctcttgctgccctagaaaagcttttccctgacacccctctcgcccttgatgccaacaaaaagaagagagccccagtacccgtcagagggggaccgaaatttgctgctaagccacataaccctggcttcggcatgggaggccccatgcacaacgaagtgcccccaccccccaaccttcgagggcggggaagaggcgggagcatccggggacgagggcgcgggcgaggatttggtggcgccaaccatggaggctacatgaatgccggtgctgggtatggaagctatgggtacggaggcaactcggcgacagcaggctacacaggttttgtatgaatttttaaccttttaacaaactcccaaatctggttgatgcctttgacagtgatgaaaacgatttcaccacatctgaatccagagaaaccggctttttttcttattgcgagcatgttaaaacgttgggaacatgtggggaattgtatattgcgctgaattaacttctcccgcctcttgtaatgctctggtgggttcttgtttgggaatgcgatattttgtggctggtttagctagagagtgaactctcaaaggtatcaaaactgtgcttccattattagtgcaagaaacagacaggctttaaggggtagatgacgtgaaattttgcaagtcttaattacagctgcagatgcatgggattctggatttttttgttgctttttagtttaatgggactttaaaagtaattgaggagaaagaaccgtgatgttccctgtttctccagtaaaggactggcttttgcttgggcagaggtggtgctgctgggtgtgcagctgccacagactccaaaggcgtagaagtttgtgccaacacacggagtcattctggctctctgctgaggcccctgttttctggcaggtgccctccttggaaactggttttggctctgatcagcggttctttttgcagcaaagcctgcatctgtgttgacttgcaagattttgcgtttattcaggcaaaaactggtcaaaatggttactacatgatttgttcccagaggtttgaaacattcagtgaaactttttaaaactttgattgcatgatgtattttttttttagaaagttattgtttgagaataatgtctttttataccaggaaaatagttatcctgaatgacgttgaaaactccccctcccctttatttttttttaatcaatacatgtgaaagtaacaagc

SEQ ID NO: 676 - DNA, 6119 bp, Homo sapiens
aaagggggcggggcttcagccggtcacgtgttcccgcacctccccggcgcgcgcctgcccgcccgcccgctcgcccccggtccggactcctcctcctcctcttctcgccattgcagttggacccagcagcccggcgcgcaccgcgtggcttttgggggcagaccccggcgggctgtggcaggagggcggcggcggcggctgcggtcgaagaaggggacgccgacaagagttgaagtattgataacaccaaggaactctatcacaatttgaaaagataagcaaaagtttgatttccagacactacagaagaagtaaaaatgcgtccaatgcgaatttttgtgaatgatgaccgccatgtgatggcaaagcattcttccgtttatccaacacaagaggagctggaggcagtccagaacatggtgtcccacacggagcgggcgctcaaagctgtgtccgactggatagacgagcaggaaaagggtagcagcgagcaggcagagtccgataacatggatgtgcccccagaggacgacagtaaagaaggggctggggaacagaagacggagcacatgaccagaaccctgcggggagtgatgcgggtgggcctggtggcaaagggcctcctactcaagggggacttggatctggagctggtgctgctgtgtaaggagaagcccacaaccgccctcctggacaaggtggccgacaacctggccatccagcttgctgctgtaacagaagacaagtacgaaatactgcaatctgtcgacgatgctgcgattgtgataaaaaacacaaaagagcctccattgtccctgaccatccacctgacatcccctgttgtcagagaagaaatggagaaagtattagctggagaaacgctatcagtcaacgaccccccggacgttctggacaggcagaaatgccttgctgccttggcgtccctccgacacgccaagtggttccaggccagagccaacgggctgaagtcttgtgtcattgtgatccgggtcttgagggacctgtgcactcgcgtgcccacctggggtcccctccgaggctggcctctcgagctcctgtgtgagaaatccattggcacggccaacagaccgatgggtgctggcgaggccctgcggagagtgctggagtgcctggcgtcgggcatcgtgatgccagatggttctggcatttatgacccttgtgaaaaagaagccactgatgctattgggcatctagacagacagcaacgggaagatatcacacagagtgcgcagcacgcactgcggctcgctgccttcggccagctccataaagtcctaggcatggaccctctgccttccaagatgcccaagaaaccaaagaatgaaaacccagtggactacaccgttcagatcccaccaagcaccacctatgccattacgcccatgaaacgcccaatggaggaggacggggaggagaagtcgcccagcaaaaagaagaagaagattcagaagaaagaggagaaggcagagcccccccaggctatgaatgccctgatgcggttgaaccagctgaagccagggctgcagtacaagctggtgtcccagactgggcccgtccatgcccccatctttaccatgtctgtggaggttgatggcaattcattcgaggcctctgggccctccaaaaagacggccaagctgcacgtggccgttaaggtgttacaggacatgggcttgccgacgggtgctgaaggcagggactcgagcaagggggaggactcggctgaggagaccgaggcgaagccagcagtggtggcccctgccccagtggtagaagctgtctccacccctagtgcggcctttccctcagatgccactgccgagaacgtaaaacagcaggggccgatcctgacaaagcacggcaagaacccagtcatggagctgaacgagaagaggcgtgggctcaagtacgagctcatctccgagaccgggggcagccacgacaagcgcttcgtcatggaggtcgaagtggatggacagaagttccaaggtgctggttccaacaaaaaggtggcgaaggcctacgctgctcttgctgccctagaaaagcttttccctgacacccctctcgcccttgatgccaacaaaaagaagagagccccagtacccgtcagagggggaccgaaatttgctgctaagccacataaccctggcttcggcatgggaggccccatgcacaacgaagtgcccccaccccccaaccttcgagggcggggaagaggcgggagcatccggggacgagggcgcgggcgaggatttggtggcgccaaccatggaggctacatgaatgccggtgctgggtatggaagctatgggtacggaggcaactcggcgacagcaggctacagtcagttctacagcaacggagggcattctgggaatgccagtggcggtggcggcgggggcggtggtggctcctccggctatggctcctactaccaaggtgacaactacaactcaccggtgcccccaaaacacgctgggaagaagcagccgcacgggggccagcagaagccctcctacggctcgggctaccagtcccaccagggccagcagcagtcctacaaccagagcccctacagcaactatggccctccacagggcaagcagaaaggctataaccatggacaaggcagctactcctactcgaactcctacaactctcccgggggcgggggcggatccgactacaactacgagagcaaattcaactacagtggtagtggaggccgaagcggcgggaacagctacggctcaggcggggcatcctacaacccagggtcacacgggggctacggcggaggttctgggggcggctcctcataccaaggcaaacaaggaggctactcacagtcgaactacaactccccggggtccggccagaactacagtggccctcccagctcctaccagtcctcacaaggcggctatggcagaaacgcagaccacagcatgaactaccagtacagataagcccccgcggggcggagatttctaccttctgcacttactccccatcagaagatcgagttttatgcatcacagttaacatgtcagctggccctccaggcccccgcccccatcccgtccacgttgctgtgtcgtgaggtgcagcgggtcaccctgtggcccgtcctgtgacccatatttagccgtgtttgggactccgtgtcttcaatggtttgttagttgccattacaactttgtctgggtagagtttttgagtttttgcagttcagtatccctctgtctattcacacttcgtgttagtggtaactcagtttgtctttaaatagttacagaagggatacgtcatttgttaatgcttttgtgaagtgagttaaacgagctttctgtattttaatgctttagtgtttcagttttataagtgaagattttattttaaaaaccagtgggaaagagtggggggtttctttttatgtctgggtcattcaggcagtacatctgaattaagctgaatgtagacaaataaagaaaaacaaaactgcgcccgtcttaggcctgggtgtctgacccaccagcagtgcaatgggcaggtttccccactctattcctgctcttgggaaagcagcgtgggccatcaggatggtccctggtccttagagagggtccagttcaggcttctagacattttactcatgctcagcgaaggctggttcctggtcccctgggctgtgtagacccggtgtcccaccaggctccaggctcccaccatctacagaggggcttacagcgcccattctggtcttggggaacccatcacaaaataggctttttctgctccccgattctggtgtagttctaagtacacagtgatgtcctctgtaggggcgtgcctgtggtggaacataacgcagttacaaaagaaagggcaggtgaggcctgggtaaccccagccatggaccgtcagtggctggagggagcttcgtgtctgtgctggagctgcagcctgctcgccatctggaggctcagtggagtggggagttggggttctcataccagcagatttccctagagcgtgattctcccatctgaggcaatcttgcctcccaggggaaattttgcaatgtttggaggatgttgtcacagctagtagcgggtgctctgggatctggtggatagatgccaaggatgctgtcaagcatactgtactgcccagaacagtggcccatagcagggacctgccctatcaaaatatcaggtgtatggaggtggagtcccaacgctagagcagcccttctcagctccaccctgcccggggagggaggaggagctctggtttcagagcagtgccgggattgcctttccccaggatctgtgtcggccatccaggaagaactgtactggccaagcctgggaccacacgtctgcagagatcctgctctgctggcctgagccccaggccttggcctcctgtgcttgggtaaccatggccactgggaaaagcaaggaccgtgtttgactttcttggagaggtgaaagaggtgaaagaacaagttgtgtgctagaaaacttttgaggaattcttatttgtgttagagcagaggaggtcccagataccaagtggcgcctcccaggaaaggctgggagaagaggtggcctggagtaccccgagatcccagcagcgcacacagtggagggatgaggatggatgggtcctaacccctgattttgatgggatgtgttcatgtcctatctcctctcctggacacattaaggggttgggacaagaagagactcctgtgagatcagcagacctcgtgtttaaggagagaatgcctgcctgcaacactcatggagagggacacttcctggccccacctgctaaatacctccaaactctgggcaggcgcctgcattctcaacacaggacttcccttaacagtttccggatcagtgaccaccaccacgttcaggtttctgaatgcagacccaccacgagggatggattccacccgcccgccctgctgcagatacatgcggcacagcaggcacgtgcctggagagaacagctcctgagcacagcacccttggagccctcaccccgctcacgatcctcaccagtgctgatgatgccgtcatgctgctggcctgagacagtatcccagctacaacaggacgacaccgggttcaggaatatgtggctatcaccttgagcactgacagtggccttccaggctagttgccttccaaacgcaggtagccgacctgcaggagggcctacaaacgggcccagcaagagctgggcaacagctggcttgtgaaatgagacaccttgaccaatatgctttgggtggacggtctcctacatgttcagtggaggccaccaggagcatccatgagcggggaaggggtccacacccttacatggcaagttgatacgatggggtgcttggtggatgggccatggaggtccgtgagctggaactgggcacacgccatcccagagggctcaggatgccccaggaaggaaagaagggcaacagactacacgattggacgtgtgtggttgactgggatgaagttggagggaggggcagggccttgcaggggattggtactgatcccagggaggaagtgttggggcttcatgaactaggatgaaaggaggcccctgagccatgacaaggggcacatccaggatttccgccaccctgaatttagtagagctagtaggccctggtcgtcactctgggcagggatgccgtcagccttgagggtcgccacccacctgtgtgttgccctctgtcctggcagggaaacatacaccccttgtctcaccaccaaccttgcttgtgtagtcagcagggctggccctgccccaaggactcactgcatgtacccggacccctaggcctggcctttgcagcatagttgggagcttctggattccatctgcacctgtgagccccatgctggctgtgcactgcgcgggcctgagactgctggatacaatgttgggcaacaactcagccagcctgatggcagcctcagaggcttactctaacccatcccagaataaatggagacttcatgtgttcattgtttcattcactc

SEQ ID NO: 677 - DNA, 1561 bp, Homo sapiens
gccccagggagcagtgggtggttataactcaggcccggtgcccagagcccaggaggaggcagtggccaggaaggcacaggcctgagaagtctgcggctgagctgggagcaaatcccccaccccctacctgggggacagggcaagtgagacctggtgagggtggctcagcaggcagggaaggagaggtgtctgtgcgtcctgcacccacatctttctctgtcccctccttgccctgtctggaggctgctagactcctatcttctgaattctatagtgcctgggtctcagcgcagtgccgatggtggcccgtccttgtggttcctctctacctggggaaataaggtgcagcggccatggctacagcaagacccccctggatgtgggtgctctgtgctctgatcacagccttgcttctgggggtcacagagcatgttctcgccaacaatgatgtttcctgtgaccacccctctaacaccgtgccctctgggagcaaccaggacctgggagctggggccggggaagacgcccggtcggatgacagcagcagccgcatcatcaatggatccgactgcgatatgcacacccagccgtggcaggccgcgctgttgctaaggcccaaccagctctactgcggggcggtgttggtgcatccacagtggctgctcacggccgcccactgcaggaagaaagttttcagagtccgtctcggccactactccctgtcaccagtttatgaatctgggcagcagatgttccagggggtcaaatccatcccccaccctggctactcccaccctggccactctaacaacctcatgctcatcaaactgaacagaagaattcgtcccactaaagatgtcagacccatcaacgtctcctctcattgtccctctgctgggacaaagtgcttggtgtctggctgggggacaaccaagagcccccaagtgcacttccctaaggtcctccagtgcttgaatatcagcgtgctaagtcagaaaaggtgcgaggatgcttacccgagacagatagatgacaccatgttctgcgccggtgacaaagcaggtagagactcctgccagggtgattctggggggcctgtggtctgcaatggctccctgcagggactcgtgtcctggggagattacccttgtgcccggcccaacagaccgggtgtctacacgaacctctgcaagttcaccaagtggatccaggaaaccatccaggccaactcctgagtcatcccaggactcagcacaccggcatccccacctgctgcagggacagccctgacactcctttcagaccctcattccttcccagagatgttgagaatgttcatctctccagcccctgaccccatgtctcctggactcagggtctgcttcccccacattgggctgaccgtgtctctctagttgaaccctgggaacaatttccaaaactgtccagggcgggggttgcgtctcaatctccctggggcactttcatcctcaagctcagggcccatcccttctctgcagctctgacccaaatttagtcccagaaataaactgagaagtgg

SEQ ID NO: 678 - DNA, 1426 bp, Homo sapiens
gccccagggagcagtgggtggttataactcaggcccggtgcccagagcccaggaggaggcagtggccaggaaggcacaggcctgagaagtctgcggctgagctgggagcaaatcccccaccccctacctgggggacaggtgcctgggtctcagcgcagtgccgatggtggcccgtccttgtggttcctctctacctggggaaataaggtgcagcggccatggctacagcaagacccccctggatgtgggtgctctgtgctctgatcacagccttgcttctgggggtcacagagcatgttctcgccaacaatgatgtttcctgtgaccacccctctaacaccgtgccctctgggagcaaccaggacctgggagctggggccggggaagacgcccggtcggatgacagcagcagccgcatcatcaatggatccgactgcgatatgcacacccagccgtggcaggccgcgctgttgctaaggcccaaccagctctactgcggggcggtgttggtgcatccacagtggctgctcacggccgcccactgcaggaagaaagttttcagagtccgtctcggccactactccctgtcaccagtttatgaatctgggcagcagatgttccagggggtcaaatccatcccccaccctggctactcccaccctggccactctaacaacctcatgctcatcaaactgaacagaagaattcgtcccactaaagatgtcagacccatcaacgtctcctctcattgtccctctgctgggacaaagtgcttggtgtctggctgggggacaaccaagagcccccaagtgcacttccctaaggtcctccagtgcttgaatatcagcgtgctaagtcagaaaaggtgcgaggatgcttacccgagacagatagatgacaccatgttctgcgccggtgacaaagcaggtagagactcctgccagggtgattctggggggcctgtggtctgcaatggctccctgcagggactcgtgtcctggggagattacccttgtgcccggcccaacagaccgggtgtctacacgaacctctgcaagttcaccaagtggatccaggaaaccatccaggccaactcctgagtcatcccaggactcagcacaccggcatccccacctgctgcagggacagccctgacactcctttcagaccctcattccttcccagagatgttgagaatgttcatctctccagcccctgaccccatgtctcctggactcagggtctgcttcccccacattgggctgaccgtgtctctctagttgaaccctgggaacaatttccaaaactgtccagggcgggggttgcgtctcaatctccctggggcactttcatcctcaagctcagggcccatcccttctctgcagctctgacccaaatttagtcccagaaataaactgagaagtgg

SEQ ID NO: 679 - DNA, 1365 bp, Homo sapiens
aatgtgccccagggagcagtgggtggttataactcaggcccggtgcccagagcccaggaggaggcagtggccaggaaggcacaggcctgagaagtctgcggctgagctgggagcaaatcccccaccccctacctgggggacagggtgcagcggccatggctacagcaagacccccctggatgtgggtgctctgtgctctgatcacagccttgcttctgggggtcacagagcatgttctcgccaacaatgatgtttcctgtgaccacccctctaacaccgtgccctctgggagcaaccaggacctgggagctggggccggggaagacgcccggtcggatgacagcagcagccgcatcatcaatggatccgactgcgatatgcacacccagccgtggcaggccgcgctgttgctaaggcccaaccagctctactgcggggcggtgttggtgcatccacagtggctgctcacggccgcccactgcaggaagaaagttttcagagtccgtctcggccactactccctgtcaccagtttatgaatctgggcagcagatgttccagggggtcaaatccatcccccaccctggctactcccaccctggccactctaacaacctcatgctcatcaaactgaacagaagaattcgtcccactaaagatgtcagacccatcaacgtctcctctcattgtccctctgctgggacaaagtgcttggtgtctggctgggggacaaccaagagcccccaagtgcacttccctaaggtcctccagtgcttgaatatcagcgtgctaagtcagaaaaggtgcgaggatgcttacccgagacagatagatgacaccatgttctgcgccggtgacaaagcaggtagagactcctgccagggtgattctggggggcctgtggtctgcaatggctccctgcagggactcgtgtcctggggagattacccttgtgcccggcccaacagaccgggtgtctacacgaacctctgcaagttcaccaagtggatccaggaaaccatccaggccaactcctgagtcatcccaggactcagcacaccggcatccccacctgctgcagggacagccctgacactcctttcagaccctcattccttcccagagatgttgagaatgttcatctctccagcccctgaccccatgtctcctggactcagggtctgcttcccccacattgggctgaccgtgtctctctagttgaaccctgggaacaatttccaaaactgtccagggcgggggttgcgtctcaatctccctggggcactttcatcctcaagctcagggcccatcccttctctgcagctctgacccaaatttagtcccagaaataaactgagaagtggaa

SEQ ID NO: 680 - DNA, 3266 bp, Homo sapiens
cggctgcgcactgggcgctctcgcccgagaagccgcagtctcgagagcgtcaacgaggtgtttcggtagtctctggccatcctttctgcgcacccggtgtcgctgggctgcaccccgggcggggacgtccgccgggcacgggagggggccaagatgccgatcaataaatcagagaagccagaaagctgcgataatgtgaaggttgttgttaggtgccggcccctcaatgagagagagaaatcaatgtgctacaaacaggctgtcagtgtggatgagatgaggggaactatcactgtacataagactgattcttccaatgaacctccaaagacatttacttttgatactgtttttggaccagagagtaaacaacttgatgtttataacttaactgcaagacctattattgattctgtacttgaaggctacaatgggactatttttgcatatggacaaaccggaacaggcaaaacttttaccatggaaggtgttcgagctattcctgaacttagaggaataattcccaattcatttgctcacatatttggtcatattgcaaaagcggagggtgatacaagatttttggttcgagtgtcttatttggaaatatataatgaagaagttcgtgaccttttgggcaaggatcagacacaaaggttagaggttaaagaaagacctgatgtgggagtttatatcaaagatttatcagcttatgtggtaaataatgctgatgatatggatagaattatgacgctaggccacaaaaatcgttctgttggtgcaactaatatgaacgaacatagttcccgttcccatgccatctttacaattactatagaatgcagtgaaaaaggcattgatggtaacatgcatgtcaggatggggaagctccatcttgtagatcttgctggttcagaaagacaggcaaaaactggagctactggacagcgcctaaaggaagctacaaaaatcaatctttcactttccacccttggtaatgtaatttctgccttggttgatggaaaaagcactcatgtgccttatcgtaactctaaactgactcgtcttcttcaggattccttaggaggaaattcaaaaaccatgatgtgtgcaaatattgggccagcagattacaattatgatgaaactatcagtacattacggtatgccaatcgtgctaagaatattaaaaataaagctagaattaatgaagatccaaaggatgctttgctgcgtcagttccagaaagaaatagaagaactgaaaaagaagcttgaagaaggagaagaaatatcaggctctgatatcagtgggtcagaggaagatgatgatgaagagggtgaggttggagaagatggagagaaaaggaaaaaaagaagggatcaagcaggaaaaaagaaagtctccccagacaagatgattgaaatgcaagcaaaaattgatgaggagagaaaagcacttgaaacaaagctcgacatggaagaagaagaaagaaacaaggctagagctgaattagagaaacgggaaaaagatcttcttaaagcccaacaagagcatcagtctttgctggaaaaattatctgccctggaaaagaaggtaattgttggtggggttgacttgttggccaaagctgaggaacaagagaaacttcttgaagaatctaacatggaactggaagaaaggaggaaaagagcagagcaacttcgcagagaacttgaggaaaaagagcaagaacgcttggatattgaagaaaaatataccagtttgcaagaggaagcacagggaaagaccaagaagttaaagaaagtttggactatgctgatggctgcaaagtcagagatggctgatctccaacaagaacatcagagggaaattgaaggcctactggagaacattcggcaacttagccgggagcttcgacttcagatgcttattattgataactttatacctcgggattatcaggaaatgattgaaaactatgtccattggaatgaagacataggagaatggcagctaaaatgtgttgcttatacaggaaataacatgaggaagcaaaccccagtacctgataaaaaggagaaagatccctttgaggtggacctttctcacgtgtatcttgcctatactgaggagagtctgcgtcagtctttgatgaaactagaaagaccacgaacttcaaaggggaaagcaaggccaaagacagggagaagaaagcgttctgcaaagcctgaaactgtaattgactctttactgcagtaaatgttacagacttaaagtcacaataaaaattagtgatattctcatgcctggacaaaatctttaattaaaacagtgaagacttctctataatttcaattaatggaagttgtagatcaatgaataagactggaaataataatttgcttaagaacttttagtctacatatattaatataacattaaaattgtacaactggtgattgttcaaattgttgtactactactcttcaattgtactgtgcagggaagttgggggaacagttcatactatagagagttacagtttagatgtatgtgtaaatcgattagctatttatccaactactgtatatttaggtaactagaatttcaaaatagaaaaaaaaaaactgtgtcctgttttgcacatagaaagaagcagatcagattgtcctatgttgcgctgttatatatgaatgtttggactgtacatctaaagaatgattccgtcctaacacccacccagcctgtttgaacacattctaattgtctaacatttgttgcattttaagtatgagatgactgatcttatgaatgttttgtagaaaatgttataatttaacagtctttgcgagtatacatgttttttaacaagttgaaaatgtttcatctgaacctttcctaacttttttttgccagtttgagttcaaatcaaatacaccttaagttctggtttcatgttctcttgaaacattgaattgtacgtaaatataaaggatctactgttgcggaaaattaagaagctaaatactgctcagttatctttgcctgcgtgtatatttttaaaaattcactctgaagtgttatggatgcttttctttgagttctaaattttggtgggaattactttatgtctcccagttaagaagagtctccattttccagaaaatacagctaagcaagaaaaatatcttttaaatactttgcctttaaaacacttttttattttgtttttctattttaaaaataaaatattattttctgaa

SEQ ID NO: 681 - DNA, 6277 bp, Homo sapiens
gcgcaggcgtaattcaagggccgagagagcctgagactgggcttggggcggggcgagctcggaatgcggctgcgcactgggcgctctcgcccgagaagccgcagtctcgagagcgtcaacgaggtgtttcggtagtctctggccatcctttctgcgcacccggtgtcgctgggctgcaccccgggcggggacgtccgccgggcacgggagggggccaagatgccgatcaataaatcagagaagccagaaagctgcgataatgtgaaggttgttgttaggtgccggcccctcaatgagagagagaaatcaatgtgctacaaacaggctgtcagtgtggatgagatgaggggaactatcactgtacataagactgattcttccaatgaacctccaaagacatttacttttgatactgtttttggaccagagagtaaacaacttgatgtttataacttaactgcaagacctattattgattctgtacttgaaggctacaatgggactatttttgcatatggacaaaccggaacaggcaaaacttttaccatggaaggtgttcgagctattcctgaacttagaggaataattcccaattcatttgctcacatatttggtcatattgcaaaagcggagggtgatacaagatttttggttcgagtgtcttatttggaaatatataatgaagaagttcgtgaccttttgggcaaggatcagacacaaaggttagaggttaaagaaagacctgatgtgggagtttatatcaaagatttatcagcttatgtggtaaataatgctgatgatatggatagaattatgacgctaggccacaaaaatcgttctgttggtgcaactaatatgaacgaacatagttcccgttcccatgccatctttacaattactatagaatgcagtgaaaaaggcattgatggtaacatgcatgtcaggatggggaagctccatcttgtagatcttgctggttcagaaagacaggcaaaaactggagctactggacagcgcctaaaggaagctacaaaaatcaatctttcactttccacccttggtaatgtaatttctgccttggttgatggaaaaagcactcatgtgccttatcgtaactctaaactgactcgtcttcttcaggattccttaggaggaaattcaaaaaccatgatgtgtgcaaatattgggccagcagattacaattatgatgaaactatcagtacattacggtatgccaatcgtgctaagaatattaaaaataaagctagaattaatgaagatccaaaggatgctttgctgcgtcagttccagaaagaaatagaagaactgaaaaagaagcttgaagaaggagaagaaatatcaggctctgatatcagtgggtcagaggaagatgatgatgaagagggtgaggttggagaagatggagagaaaaggaaaaaaagaaggggaaaaaagaaagtctccccagacaagatgattgaaatgcaagcaaaaattgatgaggagagaaaagcacttgaaacaaagctcgacatggaagaagaagaaagaaacaaggctagagctgaattagagaaacgggaaaaagatcttcttaaagcccaacaagagcatcagtctttgctggaaaaattatctgccctggaaaagaaggtaattgttggtggggttgacttgttggccaaagctgaggaacaagagaaacttcttgaagaatctaacatggaactggaagaaaggaggaaaagagcagagcaacttcgcagagaacttgaggaaaaagagcaagaacgcttggatattgaagaaaaatataccagtttgcaagaggaagcacagggaaagaccaagaagttaaagaaagtttggactatgctgatggctgcaaagtcagagatggctgatctccaacaagaacatcagagggaaattgaaggcctactggagaacattcggcaacttagccgggagcttcgacttcagatgcttattattgataactttatacctcgggattatcaggaaatgattgaaaactatgtccattggaatgaagacataggagaatggcagctaaaatgtgttgcttatacaggaaataacatgaggaagcaaaccccagtacctgataaaaaggagaaagatccctttgaggtggacctttctcacgtgtatcttgcctatactgaggagagtctgcgtcagtctttgatgaaactagaaagaccacgaacttcaaaggggaaagcaaggccaaagacagggagaagaaagcgttctgcaaagcctgaaactgtaattgactctttactgcagtaaatgttacagacttaaagtcacaataaaaattagtgatattctcatgcctggacaaaatctttaattaaaacagtgaagacttctctataatttcaattaatggaagttgtagatcaatgaataagactggaaataataatttgcttaagaacttttagtctacatatattaatataacattaaaattgtacaactggtgattgttcaaattgttgtactactactcttcaattgtactgtgcagggaagttgggggaacagttcatactatagagagttacagtttagatgtatgtgtaaatcgattagctatttatccaactactgtatatttaggtaactagaatttcaaaatagaaaaaaaaaaactgtgtcctgttttgcacatagaaagaagcagatcagattgtcctatgttgcgctgttatatatgaatgtttggactgtacatctaaagaatgattccgtcctaacacccacccagcctgtttgaacacattctaattgtctaacatttgttgcattttaagtatgagatgactgatcttatgaatgttttgtagaaaatgttataatttaacagtctttgcgagtatacatgttttttaacaagttgaaaatgtttcatctgaacctttcctaacttttttttgccagtttgagttcaaatcaaatacaccttaagttctggtttcatgttctcttgaaacattgaattgtacgtaaatataaaggatctactgttgcggaaaattaagaagctaaatactgctcagttatctttgcctgcgtgtatatttttaaaaattcactctgaagtgttatggatgcttttctttgagttctaaattttggtgggaattactttatgtctcccagttaagaagagtctccattttccagaaaatacagctaagcaagaaaaatatcttttaaatactttgcctttaaaacacttttttattttgtttttctattttaaaaataaaatattattttctgaatttcttctattgggtaatccagttagaccatattcctctacaaataaaaactatgttgatttcatagtaaagtaagttgtaatagagataattatttttttctgttgttagctgcttatgaaacttttattgtatttttttaaagttatgctactcctggccgggcatggtggctcacgcctgtaatcccagcactttgggaggccgaggcacgtggatcacttgatgtcaggagttcgagaccagcctggctaacatggtgaaaccctgtctccagtacaaatacaataattagctgggtgtggtggcgcacacctgtaatcccagctacttgggaggctgaggcaggagaatcacttgaacctgggaggcggaggttgcagtgagctgagatggcatcactgcactccagcctgggtgacagggtgacactccacctcaaaaaataaaaataaaataaaaataaagttatgctactcctaaaccacttaatatatgttttgtggttttcaaaattatgtaatcagccctgaaacacattggttgaaaatattttgagactttataagttagtatttattaaattaatattattttaataagttttgttaaatcctagtttaaatgacaaagctgtgtatagagtaggggtgagtgaaggtggagtactcttgaggtggcgataaaaatgtacccataaatttaaagtccattctgtaattggaatactgaatgtcctgtgtgtggtgaacattttctaggtgattagaattgcatttcactggctgcatttgtttgtggtatgtaagatagctagaaatttattacttaactctgtggggcattgtttagatactgtgaagagttgaggtaaatatgtgtcttgtaaaagctttgtgtgatcagaatattttggtaattataaaatgtttttgatgatacacatttaactctgttagtaattactctaaagaaatcttaattttaccagtttaaaaaaaacgcttctttttaaaagttcatgtttctaacctttaacaattcagttaataggaaaggagtaacttttaaatcaagctttaaaacatggaaatttaagccagtatgttagatattttttctatcccaccctaccatgataataaaaataaatctataaaaagtcaaaataaaaagccgatctataaaaagtcaattgagaagttctaaaagcaggctactatagcaggggtgtttgttttttgtttggagacggagtctggctctattacctaggctggagtgcagtgggacaatctcggctcactgtaacctctgtctcttcagcctcctgagttgctggaactacagctgtatgccatcatgctcggctaatttttgtatttttttgtagagatggggttttgccatgttgcccgggcctgtcttgaactcctagagcttaagtgatccacccgcctcaggctcccgaagtgctgggattacaggcatgattataggcctgagccaccacaccccgcctactatagcagttttttaaaaaaagcattatgttaaaactgattataccagatggacattaaatatccatctcagaaataccaaaatttgatacataagcctggcctgaatatcttttttttttttttgagacggagtcttactctgtcgcccaggctggagtgcagtggcgcgatctcggctcactgcaacctctgcctcctgggttcaagggattctcctgcctcagcctcttgagtagctgggattacaggtttgcgccaccacacccagctaatttttgtattttttttttagtagagaccgggtttcaccatgttggccaggctggtctcacctgactttgtgatccgcccgcctcagcctcccaaagtgctgggattacaggtgtgagccaccacgcctggcctcaagcctggtctgaatatctatatgcaaatatgggacactgacttcagagctattcatttagctccagtcatagcaattctgtagtttcctcacatttactgtgtctttgtccacaaatgaaatatgttgtaaggtcagtgttaatttcgtgagacgatatagatgaacacacttgctcattttttgaaataaatatgcagatttaaaatgagtggcacatatatataaataggttattgaatgggtattctcttttccctttaatttaaaaagtgatatttatttattaaaaggagcattggtagaattattggtttatagtatcttctttaataatccttacaattacatatactaataggatgttaaaattatcatcgtgtttcctatttgtgtttagattcttataaagcatgagatgagtaatcaagggaagggtcgcatctccatgtttgccccatgaatagaatccatttgacaagccatttcatttcctttctggagaaagggagttgttttttttttctttttacagcaaaaatttaaggttttattgggggagggggtggtgctacttcctctgtaacatgtttttaaaactatgattatggtttttggttgttttttgttttgtttgtttccttttagtctgtttttaatatccttccccttaactcttaaggaaagtcttctttcctacagggctgtgaattaaggaatgggtagcgtttacatttaagtacaccaatgtctgcccaatttcctaatgtatacatttgttttattttaaattattttttgttcttaaaaatactagaagaaaacatagatgtttctagtgcctttgaacttatactgtagtctgactaatttaatgaataacttcagtagcattactataatactgtatgctggccaaaattacaaattacagtttgttgcatcagtttcaaaagccatgctttcattgtattttatgtataaattgtatttgttcaagttgtatatattggtattgtatg

SEQ ID NO: 682 - DNA, 1471 bp, Homo sapiens
gcggctgcgcactgggcgctctcgcccgagaagccgcagtctcgagagcgtcaacgaggtgtttcggtagtctctggccatcctttctgcgcacccggtgtcgctgggctgcaccccgggcggggacgtccgccgggcacgggagggggccaagatgccgatcaataaatcagagaagccagaaagctgcgataatgtgaaggttgttgttaggtgccggcccctcaatgagagagagaaatcaatgtgctacaaacaggctgtcagtgtggatgagatgaggggaactatcactgtacataagactgattcttccaatgaacctccaaagacatttacttttgatactgtttttggaccagagagtaaacaacttgatgtttataacttaactgcaagacctattattgattctgtacttgaaggctacaatgggactatttttgcatatggacaaaccggaacaggcaaaacttttaccatggaaggtgttcgagctattcctgaacttagaggaataattcccaattcatttgctcacatatttggtcatattgcaaaagcggagggtgatacaagatttttggttcgagtgtcttatttggaaatatataatgaagaagttcgtgaccttttgggcaaggatcagacacaaaggttagaggttaaagaaagacctgatgtgggagtttatatcaaagatttatcagcttatgtggtaaataatgctgatgatatggatagaattatgacgctaggccacaaaaatcgttctgttggtgcaactaatatgaacgaacatagttcccgttcccatgccatctttacaattactatagaatgcagtgaaaaaggcattgatggtaacatgcatgtcaggatggggaagctccatcttgtagatcttgctggttcagaaagacaggcaaaaactggagctactggacagcgcctaaaggaagctacaaaaatcaatctttcactttccacccttggtaatgtaatttctgccttggttgatggaaaaagcactcatgtgccttatcgtaactctaaactgactcgtcttcttcaggattccttaggaggaaattcaaaaaccatgatgtgtgcaaatattgggccagcagattacaattatgatgaaactatcagtacattacggtatgccaatcgtgctaagaatattaaaaataaagctagaattaatgaagatccaaaggatgctttgctgcgtcagttccagaaagaaatagaagaactgaaaaagaagcttgaagaaggagaagaaatatcaggctctgatatcagtgggtcagaggaagatgatgatgaagagggtgaggttggagaagatggagagaaaaggaaaaaaagaaggggaaaaaagaaagtctccccagacaagatgattgaaatgcaagcaaaaattgatgaggagagaaaaaaaaaaaaaaaaaagaagaagaag

SEQ ID NO: 683 - DNA, 2653 bp, Homo sapiens
agtctcgagagcgtcaacgaggtgtttcggtagtctctggccatcctttctgcgcacccggtgtcgctgggctgcaccccgggcggggacgtccgccgggcacgggagggggccaagatgccgatcaataaatcagagaagccagaaagctgcgataatgtgaaggttgttgttaggtgccggcccctcaatgagagagagaaatcaatgtgctacaaacaggctgtcagtgtggatgagatgaggggaactatcactgtacataagactgattcttccaatgaacctccaaagacatttacttttgatactgtttttggaccagagagtaaacaacttgatgtttataacttaactgcaagacctattattgattctgtacttgaaggctacaatgggactatttttgcatatggacaaaccggaacaggcaaaacttttaccatggaaggtgttcgagctattcctgaacttagaggaataattcccaattcatttgctcacatatttggtcatattgcaaaagcggagggtgatacaagatttttggttcgagtgtcttatttggaaatatataatgaagaagttcgtgaccttttgggcaaggatcagacacaaaggttagaggttaaagaaagacctgatgtgggagtttatatcaaagatttatcagcttatgtggtaaataatgctgatgatatggatagaattatgacgctaggccacaaaaatcgttctgttggtgcaactaatatgaacgaacatagttcccgttcccatgccatctttacaattactatagaatgcagtgaaaaaggcattgatggtaacatgcatgtcaggatggggaagctccatcttgtagatcttgctggttcagaaagacaggcaaaaactggagctactggacagcgcctaaaggaagctacaaaaatcaatctttcactttccacccttggtaatgtaatttctgccttggttgatggaaaaagcactcatgtgccttatcgtaactctaaactgactcgtcttcttcaggattccttaggaggaaattcaaaaaccatgatgtgtgcaaatattgggccagcagattacaattatgatgaaactatcagtacattacggtatgccaatcgtgctaagaatattaaaaataaagctagaattaatgaagatccaaaggatgctttgctgcgtcagttccagaaagaaatagaagaactgaaaaagaagcttgaagaaggagaagaaatatcaggctctgatatcagtgggtcagaggaagatgatgatgaagagggtgaggttggagaagatggagagaaaaggaaaaaaagaaggggcagtagcagcagcagtagttcagactccacatgttctgtcatagagaaacctctggataagttcttgcctattcaaataggaaaaaagaaagtctccccagacaagatgattgaaatgcaagcaaaaattgatgaggagagaaaagcacttgaaacaaagctcgacatggaagaagaagaaagaaacaaggctagagctgaattagagaaacgggaaaaagatcttcttaaagcccaacaagagcatcagtctttgctggaaaaattatctgccctggaaaagaaggtaattgttggtggggttgacttgttggccaaagctgaggaacaagagaaacttcttgaagaatctaacatggaactggaagaaaggaggaaaagagcagagcaacttcgcagagaacttgaggaaaaagagcaagaacgcttggatattgaagaaaaatataccagtttgcaagaggaagcacagggaaagaccaagaagttaaagaaagtttggactatgctgatggctgcaaagtcagagatggctgatctccaacaagaacatcagagggaaattgaaggcctactggagaacattcggcaacttagccgggagcttcgacttcagatgcttattattgataactttatacctcgggattatcaggaaatgattgaaaactatgtccattggaatgaagacataggagaatggcagctaaaatgtgttgcttatacaggaaataacatgaggaagcaaaccccagtacctgataaaaaggagaaagatccctttgaggtggacctttctcacgtgtatcttgcctatactgaggagagtctgcgtcagtctttgatgaaactagaaagaccacgaacttcaaaggggaaagcaaggccaaagacagggagaagaaagcgttctgcaaagcctgaaactgtaattgactctttactgcagtaaatgttacagacttaaagtcacaataaaaattagtgatattctcatgcctggacaaaatctttaattaaaacagtgaagacttctctataatttcaattaatggaagttgtagatcaatgaataagactggaaataataatttgcttaagaacttttagtctacatatattaatataacattaaaattgtacaactggtgattgttcaaattgttgtactactactcttcaattgtactgtgcagggaagttgggggaacagttcatactatagagagttacagtttagatgtatgtgtaaatcgattagctatttatccaactactgtatatttaggtaactagaatttcaaaat

SEQ ID NO: 684 - DNA, 2428 bp, Homo sapiens
gaagctgaggagaagctgatgccatgcttcctgtacagcctgaagaaccacaaggtcttgatctgtcaccaggctgaagtgcagtggtacaatcaaagctcactgcagtctcaacctcctaggctcaaacaatcctcccacttcagcctcccaaccagctgggaccacaggttgacatcaccacacccaggtctgctggaatttgctggaggtccactccagaccctgtttgtctggatatcaccagcagaggttgcagaacaacaaagattgctgcctgttccttcctctggaagctttgtcccagaggggcacccaccagacggcagctggagctctcctgttccctctgctatggctcttcctcagtagaaacaactggcaacaaaattcaagtttatgattcattcatcagcaaacatgtgagaatcatctacaaagaaccaagaattgtgagaaagcgacctcaagatacaactggcaactgaggaaaaggcctcaattcaacaagagctaacaagcttgggagtttatttcggaatctttaaaagactcttctgcttacccacaatctgggatccactgcaggaaaacaaaaaaggaaaacttcatttaaaagaagcaagaagtaaaatgggacaaattgggaatgtttaagtctctgaaactctgcactgaaaagaaaataagattgataacttaagcttaacattctgaggcataaagaaacattaactttggagtattcatcttgactactgaaatacaagtttagaagacaagtggtttcattctggtcacagatcacagcttttctttaaatttataatcctatgggttggactcgttgactgtattttttaaaggttgctcgtcagttaactgagccttggaattcatggattttctaaagactaacaaatgaaaatattttcctgttgaagaacccagcggaaattttacagcaacaaatttcatgtttcttttgggtatttctgagaaaaaggaaatatttataaaaccatccaaagatccagataatttgcaaataaattggaggttatagaggttataatctgaatcccaaaggagactgcagctgatgaaagtgcttccaaactgaaaattggacgtgcctttacgatggtaagcgttaacagctcccactgcttctataatgactcctttaagtacactttgtatgggtgcatgttcagcatggtgtttgtgcttgggttaatatccaattgtgttgccatatacattttcatctgcgtcctcaaagtccgaaatgaaactacaacttacatgattaacttggcaatgtcagacttgctttttgtttttactttacccttcaggattttttacttcacaacacggaattggccatttggagatttactttgtaagatttctgtgatgctgttttataccaacatgtacggaagcattctgttcttaacctgtattagtgtagatcgatttctggcaattgtctacccatttaagtcaaagactctaagaaccaaaagaaatgcaaagattgtttgcactggcgtgtggttaactgtgatcggaggaagtgcacccgccgtttttgttcagtctacccactctcagggtaacaatgcctcagaagcctgctttgaaaattttccagaagccacatggaaaacatatctctcaaggattgtaattttcatcgaaatagtgggattttttattcctctaattttaaatgtaacttgttctagtatggtgctaaaaactttaaccaaacctgttacattaagtagaagcaaaataaacaaaactaaggttttaaaaatgatttttgtacatttgatcatattctgtttctgttttgttccttacaatatcaatcttattttatattctcttgtgagaacacaaacatttgttaattgctcagtagtggcagcagtaaggacaatgtacccaatcactctctgtattgctgtttccaactgttgttttgaccctatagtttactactttacatcggacacaattcagaattcaataaaaatgaaaaactggtctgtcaggagaagtgacttcagattctctgaagttcatggtgcagagaattttattcagcataacctacagaccttaaaaagtaagatatttgacaatgaatctgctgcctgaaataaaaccattaggactcactgggacagaactttcaagttccttcaactgtgaaaagtgtctttttggacaaactatttttccacctccaaaagaaattaacacatggacattttaaagtctttagtataaagaaaatttgtattcaatgtgttaagcattaacatgtattttatttgtgtatccactccatctgatttttctgagccattttgatttgttccttcattaaaaaaaatctcttaaagtt

SEQ ID NO: 685 - DNA, 2911 bp, Homo sapiens
tggattaggagagcttctggatagctgaacacatggaggtttctggagggtgtggcccccagagggcatggaagctctgcacccctgctcccatacctcaccctacgcatctcctcatctgtatcctttgcaatatcctttgtaataaaccgaaaattttatcataatgagcatcaaaagaatcccaaatgagaaaactgctttttgcataagtgtaaattaagagatggaagtcacatttcaccatggcaaacatttgctgcatgcaaaatgactgaaacaaggtcttgatctgtcaccaggctgaagtgcagtggtacaatcaaagctcactgcagtctcaacctcctaggctcaaacaatcctcccacttcagcctcccaaccagctgggaccacaggttgacatcaccacacccaggtctgctggaatttgctggaggtccactccagaccctgtttgtctggatatcaccagcagaggttgcagaacaacaaagattgctgcctgttccttcctctggaagctttgtcccagaggggcacccaccagacggcagctggagctctcctgtgtgccactggagtacgaaaaagaaaaaatcctgcagctagctcggtgtctgcccaaacggctgcccagttttgtgcttgaaacccagggcctgggtggtgtaggcacccgagggaattgcctggtctaagggttgtgaagatcacggaaaaggcatagagtctgggccggaatgcatcgttcctcgtggcacattccctcatggcttcccttagctaggggaggaagttccctggccccttgcacttcccgttccctctgctatggctcttcctcagtagaaacaactggcaacaaaattcaagtttatgattcattcatcagcaaacatgtgagaatcatctacaaagaaccaagaattgtgagaaagcgacctcaagatacaactggcaactgaggaaaaggcctcaattcaacaagagctaacaagcttgggagtttatttcggaatctttaaaagactcttctgcttacccacaatctgggatccactgcaggaaaacaaaaaaggaaaacttcatttaaaagaagcaagaagtaaaatgggacaaattgggaatgtttaagtctctgaaactctgcactgaaaagaaaataagattgataacttaagcttaacattctgaggcataaagaaacattaactttggagtattcatcttgactactgaaatacaagtttagaagacaagtggtttcattctggtcacagatcacagcttttctttaaatttataatcctatgggttggactcgttgactgtattttttaaaggttgctcgtcagttaactgagccttggaattcatggattttctaaagactaacaaatgaaaatattttcctgttgaagaacccagcggaaattttacagcaacaaatttcatgtttcttttgggtatttctgagaaaaaggaaatatttataaaaccatccaaagatccagataatttgcaaataaattggaggttatagaggttataatctgaatcccaaaggagactgcagctgatgaaagtgcttccaaactgaaaattggacgtgcctttacgatggtaagcgttaacagctcccactgcttctataatgactcctttaagtacactttgtatgggtgcatgttcagcatggtgtttgtgcttgggttaatatccaattgtgttgccatatacattttcatctgcgtcctcaaagtccgaaatgaaactacaacttacatgattaacttggcaatgtcagacttgctttttgtttttactttacccttcaggattttttacttcacaacacggaattggccatttggagatttactttgtaagatttctgtgatgctgttttataccaacatgtacggaagcattctgttcttaacctgtattagtgtagatcgatttctggcaattgtctacccatttaagtcaaagactctaagaaccaaaagaaatgcaaagattgtttgcactggcgtgtggttaactgtgatcggaggaagtgcacccgccgtttttgttcagtctacccactctcagggtaacaatgcctcagaagcctgctttgaaaattttccagaagccacatggaaaacatatctctcaaggattgtaattttcatcgaaatagtgggattttttattcctctaattttaaatgtaacttgttctagtatggtgctaaaaactttaaccaaacctgttacattaagtagaagcaaaataaacaaaactaaggttttaaaaatgatttttgtacatttgatcatattctgtttctgttttgttccttacaatatcaatcttattttatattctcttgtgagaacacaaacatttgttaattgctcagtagtggcagcagtaaggacaatgtacccaatcactctctgtattgctgtttccaactgttgttttgaccctatagtttactactttacatcggacacaattcagaattcaataaaaatgaaaaactggtctgtcaggagaagtgacttcagattctctgaagttcatggtgcagagaattttattcagcataacctacagaccttaaaaagtaagatatttgacaatgaatctgctgcctgaaataaaaccattaggactcactgggacagaactttcaagttccttcaactgtgaaaagtgtctttttggacaaactatttttccacctccaaaagaaattaacacatggacattttaaagtctttagtataaagaaaatttgtattcaatgtgttaagcattaacatgtattttatttgtgtatccactccatctgatttttctgagccattttgatttgttccttcattaaaaaaaatctcttaaagtta

SEQ ID NO: 686 - DNA, 1434 bp, Homo sapiens
agtgcagcctccagccagaaggatggggtggctcccactcctgctgcttctgactcaatgcttaggggtccctgggccttccactacaacgtgagcagccatggttgccaactgctgccatggactcaacactcgccccacacgaggctgcggcgttctgggcgctgtgacctcttccagaagaaagactacgtacggacctgcatcatgaacaatggggttgggtaccggggcaccatggccacgaccgtgggtggcctgccctgccaggcttggagccacaagttcccaaatgatcacaagtacacgcccactctccggaatggcctggaagagaacttctgccgtaaccctgatggcgaccccggaggtccttggtgctacacaacagaccctgctgtgcgcttccagagctgcggcatcaaatcctgccgggaggccgcgtgtgtctggtgcaatggcgaggaataccgcggcgcggtagaccgcacggagtcagggcgcgagtgccagcgctgggatcttcagcacccgcaccagcaccccttcgagccgggcaagttcctcgaccaaggtctggacgacaactattgccggaatcctgacggctccgagcggccatggtgctacactacggatccgcagatcgagcgagagttctgtgacctcccccgctgcgggtccgaggcacagccccgccaagaggccacaactgtcagctgcttccgcgggaagggtgagggctaccggggcacagccaataccaccactgcgggcgtaccttgccagcgttgggacgcgcaaatcccgcatcagcaccgatttacgccagaaaaatacgcgtgcaagtgaggtggggggggggggcgggcgttgggacgtgctgctgcgggtgagacgggaggaaggtagtcacgggctcaaggctggaggctggcgggctagggctgagtggagcgcctgcttagagaccttcgggagaacttctgccggaaccccgacggctcagaggcgccctggtgcttcacactgcggcccggcatgcgcgcggccttttgctaccagatccggcgttgtacagacgacgtgcggccccaggactgctaccacggcgcaggggagcagtaccgcggcacggtcagcaagacccgcaagggtgtccagtgccagcgctggtccgctgagacgccgcacaagccgcagttcacgtttacctccgaaccgcatgcacaactggaggagaacttctgccggaacccagatggggatagccatgggccctggtgctacacgatggacccaaggaccccattcgactactgtgccctgcgacgctgcgctgatgaccagccgccatcaatcctggaccccccagaccaggtgcagtttgagaagtgtggcaagagggtggatcggctggatcagcggcgttcc

SEQ ID NO: 687 - DNA, 2621 bp, Homo sapiens
gaagctggggcaagtaattttccccaatttacagggaaaaaccgaaattcagaaaagtttaatgtcacccaggggctggagcccagacctctggcagctctcactttcacaatgcccttgggctgactaggctgcagaggggtttcaccccaaccccagggcacctcaagtgtccccaccaaaccttcctaacacctgtccactaagctgtactaggcccttgcaactgacctatgggacctgaggcctggcccctcatggctcctgtcaccaggtctcaggtcagggtccagcaggccctgagctgacgtgtggagccagagccacccaatcccgtagggacaggtttcacaacttcccggatggggctgtggtgggtcacagtgcagcctccagccagaaggatggggtggctcccactcctgctgcttctgactcaatgcttaggggtccctgggcagcgctcgccattgaatgacttccaagtgctccggggcacagagctacagcacctgctacatgcggtggtgcccgggccttggcaggaggatgtggcagatgctgaagagtgtgctggtcgctgtgggcccttaatggactgccgggccttccactacaacgtgagcagccatggttgccaactgctgccatggactcaacactcgccccacacgaggctgcggcgttctgggcgctgtgacctcttccagaagaaagactacgtacggacctgcatcatgaacaatggggttgggtaccggggcaccatggccacgaccgtgggtggcctgccctgccaggcttggagccacaagttcccaaatgatcacaagtacacgcccactctccggaatggcctggaagagaacttctgccgtaaccctgatggcgaccccggaggtccttggtgctacacaacagaccctgctgtgcgcttccagagctgcggcatcaaatcctgccgggaggccgcgtgtgtctggtgcaatggcgaggaataccgcggcgcggtagaccgcacggagtcagggcgcgagtgccagcgctgggatcttcagcacccgcaccagcaccccttcgagccgggcaagttcctcgaccaaggtctggacgacaactattgccggaatcctgacggctccgagcggccatggtgctacactacggatccgcagatcgagcgagagttctgtgacctcccccgctgcgggtccgaggcacagccccgccaagaggccacaactgtcagctgcttccgcgggaagggtgagggctaccggggcacagccaataccaccactgcgggcgtaccttgccagcgttgggacgcgcaaatcccgcatcagcaccgatttacgccagaaaaatacgcgtgcaaagaccttcgggagaacttctgccggaaccccgacggctcagaggcgccctggtgcttcacactgcggcccggcatgcgcgcggccttttgctaccagatccggcgttgtacagacgacgtgcggccccaggactgctaccacggcgcaggggagcagtaccgcggcacggtcagcaagacccgcaagggtgtccagtgccagcgctggtccgctgagacgccgcacaagccgcagttcacgtttacctccgaaccgcatgcacaactggaggagaacttctgccggaacccagatggggatagccatgggccctggtgctacacgatggacccaaggaccccattcgactactgtgccctgcgacgctgcgctgatgaccagccgccatcaatcctggaccccccagaccaggtgcagtttgagaagtgtggcaagagggtggatcggctggatcagcggcgttccaagctgcgcgtggttgggggccatccgggcaactcaccctggacagtcagcttgcggaatcggcagggccagcatttctgcggggggtctctagtgaaggagcagtggatactgactgcccggcagtgcttctcctcctgccatatgcctctcacgggctatgaggtatggttgggcaccctgttccagaacccacagcatggagagccaagcctacagcgggtcccagtagccaagatggtgtgtgggccctcaggctcccagcttgtcctgctcaagctggagagatctgtgaccctgaaccagcgtgtggccctgatctgcctgccccctgaatggtatgtggtgcctccagggaccaagtgtgagattgcaggctggggtgagaccaaaggtacgggtaatgacacagtcctaaatgtggccttgctgaatgtcatctccaaccaggagtgtaacatcaagcaccgaggacgtgtgcgggagagtgagatgtgcactgagggactgttggcccctgtgggggcctgtgagggtgactacgggggcccacttgcctgctttacccacaactgctgggtcctggaaggaattataatccccaaccgagtatgcgcaaggtcccgctggccagctgtcttcacgcgtgtctctgtgtttgtggactggattcacaaggtcatgagactgggttaggcccagccttgatgccatatgccttggggaggacaaaacttcttgtcagacataaagccatgtttcctctttatgcctgta

SEQ ID NO: 688 - DNA, 887 bp, Homo sapiens
acagtgcagcctccagccagaaggatggggtggctcccactcctgctgcttctgactcaatgcttaggggtccctgggcagcgctcgccattgaatgacttccaagtgctccggggcacagagctacagcacctgctacatgcggtggtgcccgggccttggcaggaggatgtggcagatgctgaagagtgtgctggtcgctgtgggcccttaatggactgccgggccttccactacaacgtgagcagccatggttgccaactgctgccatggactcaacactcgccccacacgaggctgcggcgttctgggcgctgtgacctcttccagaagaaaggtacacgcccactctccggaatggcctggaagagaacttctgccgtaaccctgatggcgaccccggaggtccttggtgctacacaacagaccctgctgtgcgcttccagagctgcggcatcaaatcctgccgggaggccgcgtgtgtctggtgcaatggcgaggaataccgcggcgcggtagaccgcacggagtcagggcgcgagtgccagcgctgggatcttcagcacccgcaccagcaccccttcgagccgggcaagttcctcgaccaaggtctggacgacaactattgccggaatcctgacggctccgagcggccatggtgctacactacggatccgcagatcgagcgagagttctgtgacctcccccgctgcgggtccgaggcacagccccgccaagaggccacaactgtcagctgcttccgcgggaagggtgagggctaccggggcacagccaataccaccactgcgggcgtaccttgccagcgttgggacgcgcaaatcccgcatcagcaccgatttacgccagaaaaatacgcgtgcaagtga

SEQ ID NO: 689 - DNA, 4194 bp, Homo sapiens
atggcgcctgccccagtcaccctgctggcccctggggcagcatcctcaatgtcttgcagccagcccgggcagcgctcgccatcgaatgacttccaggtgctccggggcacagagctacagcacctgctacatgcggtggtgcccgggccttggcaggaggatgtggcagatgctgaagagtgtgctggtcgctgtgggcccttaatggactgctgggcgttccactacaatgtgagcagccatggttgccaactgctgccatggactcaacactcgccccactcaaggctgtggcattctgggcgctgtgacctcttccaggagaaaggcgagtgggggtacatgcccacgctccggaatggcctggaagagaacttctgccgtaaccctgatggcgaccccggaggtccttggtgccacacaacagaccctgccgtgcgcttccagagctgcagcatcaaatcctgccgggtggccgcgtgtgtctggtgcaatggcgaggaataccgcggcgcggtagaccgcaccgagtcagggcgcgagtgccagcgctgggatcttcagcacccgcaccagcaccccttcgagccgggcaagttcctcgaccaaggtctggacgacaactattgccggaatcctgacggctccgagcggccatggtgctacactacggatccgcagatcgagcgagagttctgtgacctcccccgctgcgggtccgaggcacagccccgccaagaggccacaagtgtcagctgcttccgcgggaagggtgagggctaccggggcacagccaataccaccaccgcggcgtaccttgccagcgttgggacgcgcaaatcccacatcagcaccgatttacgccagaaaaatacgcgtgcaagtgaggtgggcgggggggcgggcgttgggacgtgctgctgcggagaccttcgggagaacttctgctggaacctcgacggctcagaggcgccctggtgcttcaccctgcggcccggcacgcgcgtgggcttttgctaccagatccggcgttgtacagacgacgtgcggccccaggactgctaccacggcgcgggggagcagtaccgcggcacggtcagcaagacccgcaagggtgtccagtgccagcgctggtccgctgagacgccgcacaagctgcaggccctaaccctggggcggcatgctttgatgtctgggaccagagcctggaaatggttgagactaccctgccacgattttgctcccgctcccgcctcggttcacatttacctccgaaccgcatgcacaactggaggagaacttctgccagacccagatggggatagccatgggccctggtgctacacgatggacccaaggaccccattcgactactgtgccctgcgacgctgcgaccaggtgcagtttgagaagtgtggcaagagggtggatcggctggatcagcgtcgttccaagctgcgcgtggctgggggccatccgggcaactcaccctggacagtcagcttgcggaatcgccatatgcctctcacgggctatgaggtatggttgggcaccctgttccagaacccacaacatggagagccaggcctacagcgggtcccagtagccaagatgctgtgtgggccctcaggctcccagcttgtcctgctcaagctggagagatctgtgaccctgaaccagcgtgtggccctgatctgcctgccgcctgaatggtatgtggtgcctccagggaccaagtgtgagattgcaggctggggtgagaccaaaggtacgggtaatgacacagtcctaaatgtggccttgctgaacgtcatctccaaccaggagtgtaacatcaagcaccgaggacatgtgcgggagagcgagatgtgcactgagggactgttggcccctgtgggggcctgtgagggtgactacgggggcccacttgcctgctttacccacaactgctgggtcctgaaaggaattagaatccccaaccgagtatgcacaaggtcgcgctggccagccgtcttcacgcgtgtctctgtgtttgtggactggattcacaaggtcatgagactgggttaggcccagccttgacgccatatgctttggggaggacaaaacttgtaagtacagtcaaggacaagacttgtactcaaggttgagatttaataaaattaatatttttactacttcaccaaggactttcttaaacgaaaatggtttttccccctgcaagtaaacagtaatgaagaagagaattattcctagtgcagtttgttttcatggtcttaatttttgctaagactccactgtttttgccttatcaatacaagtgccaacacagtgaaaaggcaaatatcatcttagtattactctgaaaatagttctgagctaatggcctactgaaaggaaaagagtggctcctgctattctattagacttattacaattatcttaagtattctttctaccctcctttaattgaatggaaacagggatggattggaagagctgtttttctcctttctttcccccggcaatatttaccatttaatgccacttactaacactcaaagaaacaaaaccaaacttctcaattgacagtgcagtgacccaacaaagacacgggttcttgaattcaaagtggagcaggagagacggtaaatacacatttactttaatatatatatatttattatttatgtgtttaaagcacaaattagtttggtaaaaaacatctcatgtctgttttatttccacatccctgagactgacaatgggatgcctatcaattaattcatttagagagccatacaccacaagaaacaaattatttgtcctctggagcttgtcacagggggatttttaaaaaaccattaaacagaaagacaactgtgcatcttagaaagataaaaggccaattcttcctctccggctgataggttcttaataatagtgatatctactaataaggtgttttacatagtgtaaagcatgttcacatacaaattacttagcctctttgagcctcagttttcttatatgtaaaactggattaatagtacattttgtgtttaaaaagataatgtatatgaagtgtttaccatttttgcttggcatctagttcagttctcagtaactgatgtggtggtggtggtggtcatagtagcagtaagatccgtagtaatagtagcagcagttgttttagaaattagtaactgaggcctggcaaagttaaaggctctttcattaacacccagaggggaagaaatgaagctggtcttcagaggcaggctattttcactctgtgtcccaaattttcccccctagaccgtttttatacttctggggcctcagaaaatattctcagctattctgttagcttgatctcctaccatctgagagtgggcttccttcaaacaaccaaatttccaggtatttctaaactgcccttcccctacaccattctttggttcagtatttcaagacccctaagagaaatggtacatttacatgtaagcacaggatagtgaagtatttacaacaagtgctttggagccagcaaatatgaatcagaatccagctttcctttcctacatacatgacattgggcagctaatttctaagattttacttctttatctatgaaagtggagtactagtacttgctctgtgcaactgtgatggttgttacatgaggtagcatctagaagcagcttgcacattgccagacacccagtggaaggtcaatgaatgactatttgaggactaactattacagaaatgtttactcttctgagtcctgatttctagtctcctggactaaataggttcactgttttcctcccggttcagtttccagacacatcacagaattataagaatattaaaaactcaggcttatacctacacaggattttctataaccctctttctgctttgagctcctaaaggtatttcatagaaaaatgaccttatttttaaatagagggggcagttgaaaatcagtgaacgggcctaccccctaatgatttttttctcagacctaattataataattagcattataaagtgctaattatctttggacacagaggacctgcacaccagagacagaggtccgcattaagtaaagtggatttcactttcttcagttgtgagatttctcttttttcttctttgtaatgatgcaaagatatatcttcc

SEQ ID NO: 690 - DNA, 4377 bp, Homo sapiens
atgacttccaggtgctccggggcacagagctacctgctacatgcggtggtgcccgggccttggcaggaggatgtggcagatgctgaagagtgtgctggtcgctgtgggcccttaatggactgctgggcgttccactacaatgtgagcagccatggttgccaactgctgccatggactcaacactcgccccactcaaggctgtggcattctgggcgctgtgacctcttccaggagaaagactacatacggacctgcatcatgaacaatggggttgggtaccggggcaccatggccacgaccgtgggtggcctgtcctgccaggcttggagccacaagttcccgaacgatcacaagtacatgcccacgctccggaatggcctggaagagaacttctgccgtaaccctgatggcgaccccggaggtccttggtgccacacaacagaccctgccgtgcgcttccagagctgcagcatcaaatcctgccgggtggccgcgtgtgtctggtgcaatggcgaggaataccgcggcgcggtagaccgcaccgagtcagggcgcgagtgccagcgctgggatcttcagcacccgcaccagcaccccttcgagccgggcaagttcctcgaccaaggtctggacgacaactattgccggaatcctgacggctccgagcggccatggtgctacactacggatccgcagatcgagcgagagttctgtgacctcccccgctgcgggtccgaggcacagccccgccaagaggccacaagtgtcagctgcttccgcgggaagggtgagggctaccggggcacagccaataccaccaccggcgtaccttgccagcgttgggacgcgcaaatcccacatcagcaccgatttacgccagaaaaatacgcgtgcaaagaccttcgggagaacttctgctggaacctcgacggctcagaggcgccctggtgcttcaccctgcggcccggcacgcgcgtgggcttttgctaccagatccggcgttgtacagacgacgtgcggccccaggactgctaccacggcgcgggggagcagtaccgcggcacggtcagcaagacccgcaagggtgtccagtgccagcgctggtccgctgagacgccgcacaagctgcagttcacatttacctccgaaccgcatgcacaactggaggagaacttctgccagccagatggggatagccatgggccctggtgctacacgatggacccaaggaccccattcgactactgtgccctgcgacgctgcgctgatgaccagccgccatcaatcctggacccccccaaccaggtgcagtttgagaagtgtggcaagagggtggatcggctggatcagcgtcgttccaagctgcgcgtggctgggggccatccgggcaactcaccctggacagtcagcttgcggaatcggcagggccagcatttctgcgcggggtctctagtaaaggagcagtggatactgactgcccggcagtgcttctcctcctgccatatgcctctcacgggctatgaggtatggttgggcaccctgttccagaacccacaacatggagagccaggcctacagcgggtcccagtagccaagatgctgtgtgggccctcaggctcccagcttgtcctgctcaagctggagagatctgtgaccctgaaccagcgtgtggccctgatctgcctgccgcctgaatggtatgtggtgcctccagggaccaagtgtgagattgcaggctggggtgagaccaaaggtacgggtaatgacacagtcctaaatgtggccttgctgaacgtcatctccaaccaggagtgtaacatcaagcaccgaggacatgtgcgggagagcgagatgtgcactgagggactgttggcccctgtgggggcctgtgagggtgactacgggggcccacttgcctgctttacccacaactgctgggtcctgaaaggaattagaatccccaaccgagtatgcacaaggtcgcgctggccagccgtcttcacgcgtgtctctgtgtttgtggactggattcacaaggtcatgagactgggttaggcccagccttgacgccatatgctttggggaggacaaaacttgtaagtacagtcaaggacaagacttgtactcaaggttgagatttaataaaattaatatttttactacttcaccaaggactttcttaaacgaaaatggtttttccccctgcaagtaaacagtaatgaagaagagaattattcctagtgcagtttgttttcatggtcttaatttttgctaagactccactgtttttgccttatcaatacaagtgccaacacagtgaaaaggcaaatatcatcttagtattactctgaaaatagttctgagctaatggcctactgaaaggaaaagagtggctcctgctattctattagacttattacaattatcttaagtattctttctaccctcctttaattgaatggaaacagggatggattggaagagctgtttttctcctttctttcccccggcaatatttaccatttaatgccacttactaacactcaaagaaacaaaaccaaacttctcaattgacagtgcagtgacccaacaaagacacgggttcttgaattcaaagtggagcaggagagacggtaaatacacatttactttaatatatatatatttattatttatgtgtttaaagcacaaattagtttggtaaaaaacatctcatgtctgttttatttccacatccctgagactgacaatgggatgcctatcaattaattcatttagagagccatacaccacaagaaacaaattatttgtcctctggagcttgtcacagggggatttttaaaaaaccattaaacagaaagacaactgtgcatcttagaaagataaaaggccaattcttcctctccggctgataggttcttaataatagtgatatctactaataaggtgttttacatagtgtaaagcatgttcacatacaaattacttagcctctttgagcctcagttttcttatatgtaaaactggattaatagtacattttgtgtttaaaaagataatgtatatgaagtgtttaccatttttgcttggcatctagttcagttctcagtaactgatgtggtggtggtggtggtcatagtagcagtaagatccgtagtaatagtagcagcagttgttttagaaattagtaactgaggcctggcaaagttaaaggctctttcattaacacccagaggggaagaaatgaagctggtcttcagaggcaggctattttcactctgtgtcccaaattttcccccctagaccgtttttatacttctggggcctcagaaaatattctcagctattctgttagcttgatctcctaccatctgagagtgggcttccttcaaacaaccaaatttccaggtatttctaaactgcccttcccctacaccattctttggttcagtatttcaagacccctaagagaaatggtacatttacatgtaagcacaggatagtgaagtatttacaacaagtgctttggagccagcaaatatgaatcagaatccagctttcctttcctacatacatgacattgggcagctaatttctaagattttacttctttatctatgaaagtggagtactagtacttgctctgtgcaactgtgatggttgttacatgaggtagcatctagaagcagcttgcacattgccagacacccagtggaaggtcaatgaatgactatttgaggactaactattacagaaatgtttactcttctgagtcctgatttctagtctcctggactaaataggttcactgttttcctcccggttcagtttccagacacatcacagaattataagaatattaaaaactcaggcttatacctacacaggattttctataaccctctttctgctttgagctcctaaaggtatttcatagaaaaatgaccttatttttaaatagagggggcagttgaaaatcagtgaacgggcctaccccctaatgatttttttctcagacctaattataataattagcattataaagtgctaattatctttggacacagaggacctgcacaccagagacagaggtccgcattaagtaaagtggatttcactttcttcagttgtgagatttctcttttttcttctttgtaatgatgcaaagatatatcttccaccaagcctcatttaaaagctttttccagttaaggaaactatctcttggccatccacagccagactgcatattgagattatggatattcaaagaaattgtctttcctttgtatattgtcataactttttgtgaaatgttcgttttatagttccaggccagcacctagaacctggctagaataaaaaactgcagaaatc

SEQ ID NO: 691 - DNA, 2148 bp, Homo sapiens
atggcgcctgccccagtcaccctgctggcccctggggcagcatcctcaatgtcttgcagccagcccgggcagcgctcgccatcgaatgacttccaggtgctccggggcacagagctacagcacctgctacatgcggtggtgcccgggccttggcaggaggatgtggcagatgctgaagagtgtgctggtcgctgtgggcccttaatggactgctgggcgttccactacaatgtgagcagccatggttgccaactgctgccatggactcaacactcgccccactcaaggctgtggcattctgggcgctgtgacctcttccaggagaaaggcgagtgggggtacatgcccacgctccggaatggcctggaagagaacttctgccgtaaccctgatggcgaccccggaggtccttggtgccacacaacagaccctgccgtgcgcttccagagctgcagcatcaaatcctgccgggtggccgcgtgtgtctggtgcaatggcgaggaataccgcggcgcggtagaccgcaccgagtcagggcgcgagtgccagcgctgggatcttcagcacccgcaccagcaccccttcgagccgggcaagttcctcgaccaaggtctggacgacaactattgccggaatcctgacggctccgagcggccatggtgctacactacggatccgcagatcgagcgagagttctgtgacctcccccgctgcgggtccgaggcacagccccgccaagaggccacaagtgtcagctgcttccgcgggaagggtgagggctaccggggcacagccaataccaccaccgcggcgtaccttgccagcgttgggacgcgcaaatcccacatcagcaccgatttacgccagaaaaatacgcgtgcaagtgaggtgggcgggggggcgggcgttgggacgtgctgctgcggagaccttcgggagaacttctgctggaacctcgacggctcagaggcgccctggtgcttcaccctgcggcccggcacgcgcgtgggcttttgctaccagatccggcgttgtacagacgacgtgcggccccaggactgctaccacggcgcgggggagcagtaccgcggcacggtcagcaagacccgcaagggtgtccagtgccagcgctggtccgctgagacgccgcacaagctgcaggccctaaccctggggcggcatgctttgatgtctgggaccagagcctggaaatggttgagactaccctgccacgattttgctcccgctcccgcctcggttcacatttacctccgaaccgcatgcacaactggaggagaacttctgccagacccagatggggatagccatgggccctggtgctacacgatggacccaaggaccccattcgactactgtgccctgcgacgctgcgaccaggtgcagtttgagaagtgtggcaagagggtggatcggctggatcagcgtcgttccaagctgcgcgtggctgggggccatccgggcaactcaccctggacagtcagcttgcggaatcggcagggccagcatttctgcgcggggtctctagtaaaggagcagtggatactgactgcccggcagtgcttctcctcctgccatatgcctctcacgggctatgaggtatggttgggcaccctgttccagaacccacaacatggagagccaggcctacagcgggtcccagtagccaagatgctgtgtgggccctcaggctcccagcttgtcctgctcaagctggagagatctgtgaccctgaaccagcgtgtggccctgatctgcctgccgcctgaatggtatgtggtgcctccagggaccaagtgtgagattgcaggctggggtgagaccaaaggtacgggtaatgacacagtcctaaatgtggccttgctgaacgtcatctccaaccaggagtgtaacatcaagcaccgaggacatgtgcgggagagcgagatgtgcactgagggactgttggcccctgtgggggcctgtgagggtgactacgggggcccacttgcctgctttacccacaactgctgggtcctgaaaggaattagaatccccaaccgagtatgcacaaggtcgcgctggccagccgtcttcacgcgtgtctctgtgtttgtggactggattcacaaggtcatgagactgggttag

SEQ ID NO: 692 - DNA, 1536 bp, Homo sapiens
tccccagaggccgagatgcgggtcatggcgccccgagccctcctcctgctgctctcgggaggcctggccctgaccgagacctgggcctgctcccactccatgaggtatttcgacaccgccgtgtcccggcccggccgcggagagccccgcttcatctcagtgggctacgtggacgacacgcagttcgtgcggttcgacagcgacgccgcgagtccgagaggggagccgcgggcgccgtgggtggagcaggaggggccggagtattgggaccgggagacacagaagtacaagcgccaggcacaggctgaccgagtgagcctgcggaacctgcgcggctactacaaccagagcgaggacgggtctcacaccctccagaggatgtctggctgcgacctggggcccgacgggcgcctcctccgcgggtatgaccagtccgcctacgacggcaaggattacatcgccctgaacgaggacctgcgctcctggaccgccgcggacaccgcggctcagatcacccagcgcaagttggaggcggcccgtgcggcggagcagctgagagcctacctggagggcacgtgcgtggagtggctccgcagatacctggagaacgggaaggagacgctgcagcgcgcagaacccccaaagacacacgtgacccaccaccccctctctgaccatgaggccaccctgaggtgctgggccctgggcttctaccctgcggagatcacactgacctggcagcgggatggggaggaccagacccaggacaccgagcttgtggagaccaggccagcaggagatggaaccttccagaagtgggcagctgtggtggtgccttctggacaagagcagagatacacgtgccatatgcagcacgaggggctgcaagagcccctcaccctgagctgggagccatcttcccagcccaccatccccatcatgggcatcgttgctggcctggctgtcctggttgtcctagctgtccttggagctgtggtcaccgctatgatgtgtaggaggaagagctcaggtggaaaaggagggagctgctctcaggctgcgtgcagcaacagtgcccagggctctgatgagtctctcatcacttgtaaagcctgagacagctgcctgtgtgggactgagatgcaggatttcttcacacctctcctttgtgacttcaagagcctctggcatctctttctgcaaaggcacctgaatgtgtctgcgttcctgttagcataatgtgaggaggtggagagacagcccacccccgtgtccaccgtgacccctgtccccacactgacctgtgttccctccccgatcatctttcctgttccagagaggtggggctggatgtctccatctctgtctcaaattcatggtgcactgagctgcaacttcttacttccctaatgaagttaagaacctgaatataaatttgtgttctcaaatatttgctatgaagcgttgatggattaattaaataagtcaattcctagaagttgagagagcaaataaagacctgagaaccttccagaa

SEQ ID NO: 693 - DNA, 1538 bp, Homo sapiens
cccacccggactcacattctccccagaggccgagatgcgggtcatggcgccccgagccctcctcctgctgctctcgggaggcctggccctgaccgagacctgggcctgctcccactccatgaggtatttcgacaccgccgtgtcccggcccggccgcggagagccccgcttcatctcagtgggctacgtggacgacacgcagttcgtgcggttcgacagcgacgccgcgagtccgagaggggagccgcgggcgccgtgggtggagcaggaggggccggagtattgggaccgggagacacagaagtacaagcgccaggcacaggctgaccgagtgagcctgcggaacctgcgcggctactacaaccagagcgaggacgaggatgtctggctgcgacctggggcccgacgggcgcctcctccgcgggtatgaccagtccgcctacgacggcaaggattacatcgccctgaacgaggacctgcgctcctggaccgccgcggacaccgcggctcagatcacccagcgcaagttggaggcggcccgtgcggcggagcagctgagagcctacctggagggcacgtgcgtggagtggctccgcagatacctggagaacgggaaggagacgctgcagcgcgcagaacccccaaagacacacgtgacccaccaccccctctctgaccatgaggccaccctgaggtgctgggccctgggcttctaccctgcggagatcacactgacctggcagcgggatggggaggaccagacccaggacaccgagcttgtggagaccaggccagcaggagatggaaccttccagaagtgggcagctgtggtggtgccttctggacaagagcagagatacacgtgccatatgcagcacgaggggctgcaagagcccctcaccctgagctgggagccatcttcccagcccaccatccccatcatgggcatcgttgctggcctggctgtcctggttgtcctagctgtccttggagctgtggtcaccgctatgatgtgtaggaggaagagctcaggtggaaaaggagggagctgctctcaggctgcgtgcagcaacagtgcccagggctctgatgagtctctcatcacttgtaaagcctgagacagctgcctgtgtgggactgagatgcaggatttcttcacacctctcctttgtgacttcaagagcctctggcatctctttctgcaaaggcacctgaatgtgtctgcgttcctgttagcataatgtgaggaggtggagagacagcccacccccgtgtccaccgtgacccctgtccccacactgacctgtgttccctccccgatcatctttcctgttccagagaggtggggctggatgtctccatctctgtctcaaattcatggtgcactgagctgcaacttcttacttccctaatgaagttaagaacctgaatataaatttgtgttctcaaatatttgctatgaagcgttgatggattaattaaataagtcaattcctagaagttgagagagcaaataaagacctgagaaccttccagaa

SEQ ID NO: 694 - DNA, 1552 bp, Homo sapiens
tccccagacgccgagatgcgggtcatggcgccccgaaccctcatcctgctgctctcgggagccctggccctgaccgagacctgggcctgctcccactccatgaggtatttctacaccgccgtgtcccggcccggccgcggagagccccgcttcatcgcagtgggctacgtggacgacacgcagttcgtgcagttcgacagcgacgccgcgagtccaagaggggagccgcgggcgccgtgggtggagcaggaggggccggagtattgggaccgggagacacagaagtacaagcgccaggcacagactgaccgagtgaacctgcggaaactgcgcggctactacaaccagagcgaggccgggtctcacaccctccagaggatgtatggctgcgacctggggcccgacgggcgcctcctccgcgggtataaccagttcgcctacgacggcaaggattacatcgccctgaatgaggacctgcgctcctggaccgccgcggacaaggcggctcagatcacccagcgcaagtgggaggcggcccgtgaggcggagcagcggagagcctacctggagggcacgtgcgtggagtggctccgcagatacctggagaacgggaagaagacgctgcagcgcgcggaacacccaaagacacacgtgacccaccatcccgtctctgaccatgaggccaccctgaggtgctgggccctgggcttctaccctgcggagatcacactgacctggcagcgggatggcgaggaccaaactcaggacaccgagcttgtggagaccaggccagcaggagatggaaccttccagaagtgggcagctgtggtggtgccttctggagaagagcagagatacacgtgccatgtgcagcacgaggggctgccagagcccctcaccctgagatgggggccatcttcccagcccaccatccccatcgtgggcatcgttgctggcctggctgtcctggctgtcctagctgtcctaggagctgtgatggctgttgtgatgtgtaggaggaagagctcagggcattttcttcccacaggtggaaaaggagggagctgctctcaggctgcgtccagcaacagtgcccagggctctgatgagtctctcatcgcttgtaaagcctgagacagctgcctgtgtgggactgagatgcaggatttcttcacacctttcctttgtgacttcaagagcctctggcatctctttctgcaaaggcatctgaatgtgtctgcgttcctgttagcataatgtgaggaggtggagagacagcccacccccgtgtccaccgtgacccctgtccccacactgacctgtgttccctccccgatcatctttcctgttccagagaagtgggctggatgtctccatctctgtctcaactttacgtgtactgagctgcaacttcttacttccctactgaaaataagaatctgaatataaatttgttttctcaaatatttgctatgagaggttgatggattaattaaataagtcaattcctggaagttgagagagcaaataaagacctgagaaccttccagaa

SEQ ID NO: 695 - DNA, 1554 bp, Homo sapiens
tccccagaggccgagatgcgggtcatggcgccccgagccctcctcctgctgctctcgggaggcctggccctgaccgagacctgggcctgctcccactccatgaggtatttcgacaccgccgtgtcccggcccggccgcggagagccccgcttcatctcagtgggctacgtggacgacacgcagttcgtgcggttcgacagcgacgccgcgagtccgagaggggagccgcgggcgccgtgggtggagcaggaggggccggagtattgggaccgggagacacagaagtacaagcgccaggcacaggctgaccgagtgagcctgcggaacctgcgcggctactacaaccagagcgaggacgggtctcacaccctccagaggatgtctggctgcgacctggggcccgacgggcgcctcctccgcgggtatgaccagtccgcctacgacggcaaggattacatcgccctgaacgaggacctgcgctcctggaccgccgcggacaccgcggctcagatcacccagcgcaagttggaggcggcccgtgcggcggagcagctgagagcctacctggagggcacgtgcgtggagtggctccgcagatacctggagaacgggaaggagacgctgcagcgcgcagaacccccaaagacacacgtgacccaccaccccctctctgaccatgaggccaccctgaggtgctgggccctgggcttctaccctgcggagatcacactgacctggcagcgggatggggaggaccagacccaggacaccgagcttgtggagaccaggccagcaggagatggaaccttccagaagtgggcagctgtggtggtgccttctggacaagagcagagatacacgtgccatatgcagcacgaggggctgcaagagcccctcaccctgagctgggagccatcttcccagcccaccatccccatcatgggcatcgttgctggcctggctgtcctggttgtcctagctgtccttggagctgtggtcaccgctatgatgtgtaggaggaagagctcagggcattttcttcccacaggtggaaaaggagggagctgctctcaggctgcgtgcagcaacagtgcccagggctctgatgagtctctcatcacttgtaaagcctgagacagctgcctgtgtgggactgagatgcaggatttcttcacacctctcctttgtgacttcaagagcctctggcatctctttctgcaaaggcacctgaatgtgtctgcgttcctgttagcataatgtgaggaggtggagagacagcccacccccgtgtccaccgtgacccctgtccccacactgacctgtgttccctccccgatcatctttcctgttccagagaggtggggctggatgtctccatctctgtctcaaattcatggtgcactgagctgcaacttcttacttccctaatgaagttaagaacctgaatataaatttgtgttctcaaatatttgctatgaagcgttgatggattaattaaataagtcaattcctagaagttgagagagcaaataaagacctgagaaccttccagaa

SEQ ID NO: 696 - DNA, 1530 bp, Homo sapiens
tccccagacgccgagatgcgggtcatggcgccccgaaccctcatcctgctgctctcgggagccctggccctgaccgagacctgggcctgctcccactccatgaggtatttctacaccgccgtgtcccggcccggccgcggagagccccgcttcatcgcagtgggctacgtggacgacacgcagttcgtgcagttcgacagcgacgccgcgagtccaagaggggagccgcgggcgccgtgggtggagcaggaggggccggagtattgggaccgggagacacagaagtacaagcgccaggcacagactgaccgagtgaacctgcggaaactgcgcggctactacaaccagagcgaggccgggtctcacaccctccagaggatgtatggctgcgacctggggcccgacgggcgcctcctccgcgggtataaccagttcgcctacgacggcaaggattacatcgccctgaatgaggacctgcgctcctggaccgccgcggacaaggcggctcagatcacccagcgcaagtgggaggcggcccgtgaggcggagcagcggagagcctacctggagggcacgtgcgtggagtggctccgcagatacctggagaacgggaagaagacgctgcagcgcgcggaacacccaaagacacacgtgacccaccatcccgtctctgaccatgaggccaccctgaggtgctgggccctgggcttctaccctgcggagatcacactgacctggcagcgggatggcgaggaccaaactcaggacaccgagcttgtggagaccaggccagcaggagatggaaccttccagaagtgggcagctgtggtggtgccttctggagaagagcagagatacacgtgccatgtgcagcacgaggggctgccagagcccctcaccctgagatgggggccatcttcccagcccaccatccccatcgtgggcatcgttgctggcctggctgtcctggctgtcctagctgtcctaggagctgtgatggctgttgtgatgtgtaggaggaagagctcaggtagggaaggggtgaggagtggggtctggccagcaacagtgcccagggctctgatgagtctctcatcgcttgtaaagcctgagacagctgcctgtgtgggactgagatgcaggatttcttcacacctttcctttgtgacttcaagagcctctggcatctctttctgcaaaggcatctgaatgtgtctgcgttcctgttagcataatgtgaggaggtggagagacagcccacccccgtgtccaccgtgacccctgtccccacactgacctgtgttccctccccgatcatctttcctgttccagagaagtgggctggatgtctccatctctgtctcaactttacgtgtactgagctgcaacttcttacttccctactgaaaataagaatctgaatataaatttgttttctcaaatatttgctatgagaggttgatggattaattaaataagtcaattcctggaagttgagagagcaaataaagacctgagaaccttccagaa

SEQ ID NO: 697 - DNA, 1552 bp, Homo sapiens; identical to SEQ ID NO: 694

SEQ ID NO: 698 - DNA, 1532 bp, Homo sapiens
tccccagaggccgagatgcgggtcatggcgccccgagccctcctcctgctgctctcgggaggcctggccctgaccgagacctgggcctgctcccactccatgaggtatttcgacaccgccgtgtcccggcccggccgcggagagccccgcttcatctcagtgggctacgtggacgacacgcagttcgtgcggttcgacagcgacgccgcgagtccgagaggggagccgcgggcgccgtgggtggagcaggaggggccggagtattgggaccgggagacacagaagtacaagcgccaggcacaggctgaccgagtgagcctgcggaacctgcgcggctactacaaccagagcgaggacgggtctcacaccctccagaggatgtctggctgcgacctggggcccgacgggcgcctcctccgcgggtatgaccagtccgcctacgacggcaaggattacatcgccctgaacgaggacctgcgctcctggaccgccgcggacaccgcggctcagatcacccagcgcaagttggaggcggcccgtgcggcggagcagctgagagcctacctggagggcacgtgcgtggagtggctccgcagatacctggagaacgggaaggagacgctgcagcgcgcagaacccccaaagacacacgtgacccaccaccccctctctgaccatgaggccaccctgaggtgctgggccctgggcttctaccctgcggagatcacactgacctggcagcgggatggggaggaccagacccaggacaccgagcttgtggagaccaggccagcaggagatggaaccttccagaagtgggcagctgtggtggtgccttctggacaagagcagagatacacgtgccatatgcagcacgaggggctgcaagagcccctcaccctgagctgggagccatcttcccagcccaccatccccatcatgggcatcgttgctggcctggctgtcctggttgtcctagctgtccttggagctgtggtcaccgctatgatgtgtaggaggaagagctcaggtagggaaggggtgaagagcggggtctgggcagcaacagtgcccagggctctgatgagtctctcatcacttgtaaagcctgagacagctgcctgtgtgggactgagatgcaggatttcttcacacctctcctttgtgacttcaagagcctctggcatctctttctgcaaaggcacctgaatgtgtctgcgttcctgttagcataatgtgaggaggtggagagacagcccacccccgtgtccaccgtgacccctgtccccacactgacctgtgttccctccccgatcatctttcctgttccagagaggtggggctggatgtctccatctctgtctcaaattcatggtgcactgagctgcaacttcttacttccctaatgaagttaagaacctgaatataaatttgtgttctcaaatatttgctatgaagcgttgatggattaattaaataagtcaattcctagaagttgagagagcaaataaagacctgagaaccttccagaa

SEQ ID NO: 699 - DNA, 1599 bp, Homo sapiens
aagccaatcagcgtctccgcagtcccggttctaaagtccccagtcacccacccggactcggattctccccagacgccgagatgcgggtcatggcgccccgaaccctcatcctgctgctctcgggagccctggccctgaccgagacctgggcctgctcccactccatgaggtatttctacaccgccgtgtcccggcccggccgcggagagccccgcttcatcgcagtgggctacgtggacgacacgcagttcgtgcagttcgacagcgacgccgcgagtccaagaggggagccgcgggcgccgtgggtggagcaggaggggccggagtattgggaccgggagacacagaagtacaagcgccaggcacagactgaccgagtgaacctgcggaaactgcgcggctactacaaccagagcgaggccgggtctcacaccctccagaggatgtatggctgcgacctggggcccgacgggcgcctcctccgcgggtataaccagttcgcctacgacggcaaggattacatcgccctgaatgaggacctgcgctcctggaccgccgcggacaaggcggctcagatcacccagcgcaagtgggaggcggcccgtgaggcggagcagcggagagcctacctggagggcacgtgcgtggagtggctccgcagatacctggagaacgggaagaagacgctgcagcgcgcggaacacccaaagacacacgtgacccaccatcccgtctctgaccatgaggccaccctgaggtgctgggccctgggcttctaccctgcggagatcacactgacctggcagcgggatggcgaggaccaaactcaggacaccgagcttgtggagaccaggccagcaggagatggaaccttccagaagtgggcagctgtggtggtgccttctggagaagagcagagatacacgtgccatgtgcagcacgaggggctgccagagcccctcaccctgagatgggggccatcttcccagcccaccatccccatcgtgggcatcgttgctggcctggctgtcctggctgtcctagctgtcctaggagctgtgatggctgttgtgatgtgtaggaggaagagctcaggtggaaaaggagggagctgctctcaggctgcgtccagcaacagtgcccagggctctgatgagtctctcatcgcttgtaaagcctgagacagctgcctgtgtgggactgagatgcaggatttcttcacacctttcctttgtgacttcaagagcctctggcatctctttctgcaaaggcatctgaatgtgtctgcgttcctgttagcataatgtgaggaggtggagagacagcccacccccgtgtccaccgtgacccctgtccccacactgacctgtgttccctccccgatcatctttcctgttccagagaagtgggctggatgtctccatctctgtctcaactttacgtgtactgagctgcaacttcttacttccctactgaaaataagaatctgaatataaatttgttttctcaaatatttgctatgagaggttgatggattaattaaataagtcaattcctggaagttgagagagcaaataaagacctgagaaccttccagaa

SEQ ID NO: 700 - DNA, 1578 bp, Homo sapiens
gtcccggttctaaagtccccagtcacccacccggactcggattctccccagacgccgagatgcgggtcatggcgccccgaaccctcatcctgctgctctcgggagccctggccctgaccgagacctgggcctgctcccactccatgaggtatttctacaccgccgtgtcccggcccggccgcggagagccccgcttcatcgcagtgggctacgtggacgacacgcagttcgtgcagttcgacagcgacgccgcgagtccaagaggggagccgcgggcgccgtgggtggagcaggaggggccggagtattgggaccgggagacacagaagtacaagcgccaggcacagactgaccgagtgaacctgcggaaactgcgcggctactacaaccagagcgaggccgggtctcacaccctccagaggatgtatggctgcgacctggggcccgacgggcgcctcctccgcgggtataaccagttcgcctacgacggcaaggattacatcgccctgaatgaggacctgcgctcctggaccgccgcggacaaggcggctcagatcacccagcgcaagtgggaggcggcccgtgaggcggagcagcggagagcctacctggagggcacgtgcgtggagtggctccgcagatacctggagaacgggaagaagacgctgcagcgcgcggaacacccaaagacacacgtgacccaccatcccgtctctgaccatgaggccaccctgaggtgctgggccctgggcttctaccctgcggagatcacactgacctggcagcgggatggcgaggaccaaactcaggacaccgagcttgtggagaccaggccagcaggagatggaaccttccagaagtgggcagctgtggtggtgccttctggagaagagcagagatacacgtgccatgtgcagcacgaggggctgccagagcccctcaccctgagatgggggccatcttcccagcccaccatccccatcgtgggcatcgttgctggcctggctgtcctggctgtcctagctgtcctaggagctgtgatggctgttgtgatgtgtaggaggaagagctcaggtggaaaaggagggagctgctctcaggctgcgtccagcaacagtgcccagggctctgatgagtctctcatcgcttgtaaagcctgagacagctgcctgtgtgggactgagatgcaggatttcttcacacctttcctttgtgacttcaagagcctctggcatctctttctgcaaaggcatctgaatgtgtctgcgttcctgttagcataatgtgaggaggtggagagacagcccacccccgtgtccaccgtgacccctgtccccacactgacctgtgttccctccccgatcatctttcctgttccagagaagtgggctggatgtctccatctctgtctcaactttacgtgtactgagctgcaacttcttacttccctactgaaaataagaatctgaatataaatttgttttctcaaatatttgctatgagaggttgatggattaattaaataagtcaattcctggaagttgagagagcaaataaagacctgagaaccttccagaa

SEQ ID NO: 701 - DNA, 1530 bp, Homo sapiens; identical to SEQ ID NO: 696

SEQ ID NO: 702 - DNA, 1530 bp, Homo sapiens
tccccagacgccgagatgcgggtcatggcgccccgaaccctcatcctgctgctctcgggagccctggccctgaccgagacctgggcctgctcccactccatgaggtatttctacaccgccgtgtcccggcccggccgcggagagccccgcttcatcgcagtgggctacgtggacgacacgcagttcgtgcggttcgacagcgacgccgcgagtccaagaggggagccgcgggcgccgtgggtggagcaggaggggccggagtattgggaccgggagacacagaagtacaagcgccaggcacagactgaccgagtgagcctgcggaacctgcgcggctactacaaccagagcgaggccgggtctcacaccctccagtggatgtatggctgcgacctggggcccgacgggcgcctcctccgcgggtatgaccagtccgcctacgacggcaaggattacatcgccctgaacgaggacctgcgctcctggaccgccgcggacacggcggctcagatcacccagcgcaagtgggaggcggcccgtgcggcggagcagcagagagcctacctggagggcacgtgcgtggagtggctccgcagatacctggagaacgggaaggagacgctgcagcgcgcggaacacccaaagacacacgtgacccaccatctcgtctctgaccatgaggccaccctgaggtgctgggccctgggcttctaccctgcggagatcacactgacctggcagcgggatggcgaggaccaaactcaggacaccgagcttgtggagaccaggccagcaggagatggaaccttccagaagtgggcagctgtggtggtgccttctggagaagagcagagatacacgtgccatgtgcagcacgaggggctgccggagcccctcaccctgagatgggagccatcttcccagcccaccatccccatcgtgggcatcgttgctggcctggctgtcctggctgtcctagctgtcctaggagctgtggtggctgttgttatgtgtaggaggaagagctcaggtagggaaggggtgaggagtggggtctggccagcaacagtgcccagggctctgatgagtctctcatcgcttgtaaagcctgagacagctgcctgtgtgggactgagatgcaggatttcttcacacctctcctttgtgacttcaagagcctctggcatctctttctgcaaaggcatctgaatgcgtctgcgttcctgttagcataatgtgaggaggtggagagacagcccacccccgtgtccaccgtgacccctgtccccacactgacctgtgttccctccccgatcatctttcctgttccagagaagtgggctggatgtctccatctctgtctcaactttacgtgtactgagctgcaacttcttacttccctactgaaaataagaatctgaatataaatttgttttctcaaatatttgctatgagaggttgatggattaattaaataagtcaatccctggaagttgagagagcaaataaagacctgagaaccttccagaa

SEQ ID NO: 703 - DNA, 782 bp, Homo sapiens
gcgggtcatggcgccccgagccctcctcctgctgctctcgggaggcctggccctgaccgagacctgggcctgctcccactccatgaggtatttcgacaccgccgtgtcccggcccggccgcggagagccccgcttcatctcagtgggctacgtggacgacacgcagttcgtgcggttcgacagcgacgccgcgagtccgagaggggagccgcgggcgccgtgggtggagcaggaggggccggagtattgggaccgggagacacagaagtacaagcgccaggcacaggctgaccgagtgagcctgcggaacctgcgcggctactacaaccagagcgaggacgggtctcacaccctccagaggatgtctggctgcgacctggggcccgacgggcgcctcctccgcgggtatgaccagtccgcctacgacggcaaggattacatcgccctgaacgaggacctgcgctcctggaccgccgcggacaccgcggctcagatcacccagcgcaagttggaggcggcccgtgcggcggagcagctgagagcctacctggagggcacgtgcgtggagtggctccgcagatacctggagaacgggaaggagacgctgcagcgcgcagaacccccaaagacacacgtgacccaccaccccctctctgaccatgaggccagcaggagatggaaccttccagaagtgggcagctgtggtggtgccttctggacaagagcagagatacacgtgccatatgcagcacgaggggctgcaagagcccctcaccctgagc

SEQ ID NO: 704 - DNA, 1553 bp, Homo sapiens
tccccagacgccgagatgcgggtcatggcgccccgaaccctcatcctgctgctctcgggagccctggccctgaccgagacctgggccggctcccactccatgaggtatttctacaccgctgtgtcccggcccggccgcggggagccccacttcatcgcagtgggctacgtggacgacacgcagttcgtgcggttcgacagcgacgccgcgagtccgagaggggagccgcgggcgccgtgggtggagcaggaggggccggagtattgggaccgggagacacagaagtacaagcgccaggcacagactgaccgagtgagcctgcggaacctgcgcggctactacaaccagagcgaggccgggtctcacatcatccagaggatgtatggctgcgacgtggggcccgacgggcgcctcctccgcgggtatgaccagtacgcctacgacggcaaggattacatcgccctgaacgaggatctgcgctcctggaccgccgcggacacggcggctcagatcacccagcgcaagtgggaggcggcccgtgaggcggagcagctgagagcctacctggagggcctgtgcgtggagtggctccgcagatacctgaagaatgggaaggagacgctgcagcgcgcggaacacccaaagacacacgtgacccaccatcccgtctctgaccatgaggccaccctgaggtgctgggccctgggcttctaccctgcggagatcacactgacctggcagtgggatggggaggaccaaactcaggacactgagcttgtggagaccaggccagcaggagatggaaccttccagaagtgggcagctgtggtggtgccttctggagaagagcagagatacacgtgccatgtgcagcacgaggggctgccggagcccctcaccctgagatgggagccgtcttcccagcccaccatccccatcgtgggcatcgttgctggcctggctgtcctggctgtcctagctgtcctaggagctgtggtggctgttgtgatgtgtaggaggaagagctcagggcattttcttcccacaggtggaaaaggagggagctgctctcaggctgcgtccagcaacagtgcccagggctctgatgagtctctcatcgcttgtaaagcctgagacagctgcctgtgtgggactgagatgcaggatttcttcacacctctcctttgtgacttcaagagcctctggcatctctttctgcaaaggcatctgaatgtgtctgcgttcctgttagcataatgtgaggaggtggagagacagcccacccccgtgtccaccgtgacccctgtccccacactgacctgtgttccctccccgatcatctttcctgttccagagaagtgggctggatgtctccatctctgtctcaacttcatggtgcgctgagctgcaacttcttacttccctaatgaagttaggaacctgaatataaatttgttttctcaaatatttgctatgaagggttgatggattaattaaataagtcaattcctggaagttgagagagcaaataaagacctgagaactttccagaa

SEQ ID NO: 705 - DNA, 1460 bp, Homo sapiens
cggattctccccagacgccgagatgcgggtcatggcgccccgaaccctcatcctgctgctctcgggagccctggccctgaccgagacctgggcctgctcccactccatgaggtatttctacaccgccgtgtcccggcccggccgcggagagccccgcttcatcgcagtgggctacgtggacgacacgcagttcgtgcggttcgacagcgacgccgcgagtccaagaggggagccgcgggcgccgtgggtggagcaggaggggccggagtattgggaccgggagacacagaagtacaagcgccaggcacagactgaccgagtgagcctgcggaacctgcgcggctactacaaccagagcgaggccgggtctcacaccctccagtggatgtatggctgcgacctggggcccgacgggcgcctcctccgcgggtatgaccagtccgcctacgacggcaaggattacatcgccctgaacgaggacctgcgctcctggaccgccgcggacacggcggctcagatcacccagcgcaagtgggaggcggcccgtgcggcggagcagcagagagcctacctggagggcacgtgcgtggagtggctccgcagatacctggagaacgggaaggagacgctgcagcgcgcggaacacccaaagacacacgtgacccaccatctcgtctctgaccatgaggccaccctgaggtgctgggccctgggcttctaccctgcggagatcacactgacctggcagcgggatggcgaggaccaaactcaggacaccgagcttgtggagaccaggccagcaggagatggaaccttccagaagtgggcagctgtggtggtgccttctggagaagagcagagatacacgtgccatgtgcagcacgaggggctgccggagcccctcaccctgagatgggagccatcttcccagcccaccatccccatcgtgggcatcgttgctggcctggctgtcctggctgtcctagctgtcctaggagctgtggtggctgttgttatgtgtaggaggaagagctcagcctgagacagctgcctgtgtgggactgagatgcaggatttcttcacacctctcctttgtgacttcaagagcctctggcatctctttctgcaaaggcatctgaatgcgtctgcgttcctgttagcataatgtgaggaggtggagagacagcccacccccgtgtccaccgtgacccctgtccccacactgacctgtgttccctccccgatcatctttcctgttccagagaagtgggctggatgtctccatctctgtctcaactttacgtgtactgagctgcaacttcttacttccctactgaaaataagaatctgaatataaatttgttttctcaaatatttgctatgagaggttgatggattaattaaataagtcaatccctggaagttgagagagcaaataaagacctgagaaccttccagaa

SEQ ID NO: 706 - DNA, 1578 bp, Homo sapiens
gtcccggttctaaagtccccagtcacccacccggactcggattctccccagacgccgagatgcgggtcatggcgccccgaaccctcatcctgctgctctcgggagccctggccctgaccgagacctgggcctgctcccactccatgaggtatttcgacaccgccgtgtcccggcccggccgcggagagccccgcttcatctcagtgggctacgtggacgacacgcagttcgtgcggttcgacagcgacgccgcgagtccgagaggggagccccgggcgccgtgggtggagcaggaggggccggagtattgggaccgggagacacagaagtacaagcgccaggcacaggctgaccgagtgaacctgcggaaactgcgcggctactacaaccagagcgaggacgggtctcacaccctccagtggatgtatggctgcgacctggggcccgacgggcgcctcctccgcgggtatgaccagtccgcctacgacggcaaggattacatcgccctgaacgaggacctgcgctcctggaccgccgcggacacggcggctcagatcacccagcgcaagtgggaggcggcccgtgaggcggagcagtggagagcctacctggagggcacgtgcgtggagtggctccgcagatacctggagaacgggaaggagacgctgcagcgcgcggaacacccaaagacacacgtgacccaccatcccgtctctgaccatgaggccaccctgaggtgctgggccctgggcttctaccctgcggagatcacactgacctggcagcgggatggcgaggaccaaactcaggacaccgagcttgtggagaccaggccagcaggagatggaaccttccagaagtgggcagctgtggtggtgccttctggagaagagcagagatacacgtgccatgtgcagcacgaggggctgccagagcccctcaccctgagatgggagccatcttcccagcccaccatccccatcgtgggcatcgttgctggcctggctgtcctggctgtcctagctgtcctaggagctgtgatggctgttgtgatgtgtaggaggaagagctcaggtggaaaaggagggagctgctctcaggctgcgtccagcaacagtgcccagggctctgatgagtctctcatcgcttgtaaagcctgagacagctgcctgtgtgggactgagatgcaggatttcttcacacctctcctttgtgacttcaagagcctctggcatctctttctgcaaaggcatctgaatgtgtctgcgttcctgttagcataatgtgaggaggtggagagacagcccacccccgtgtccaccgtgacccctgtccccacactgacctgtgttccctccccgatcatctttcctgttccagagaagtgggctggatgtctccatctctgtctcaactttacgtgtactgagctgcaacttcttacttccctactgaaaataagaatctgaatataaatttgttttctcaaatatttgctatgagaggttgatggattaattaaataagtcaattcctggaagttgagagagcaaataaagacctgagaaccttccagaa

SEQ ID NO: 707 - DNA, 1452 bp, Homo sapiens
cacattctccccagaggccgagatgcgggtcatggcgccccgagccctcctcctgctgctctcgggaggcctggccctgaccgagacctgggcctgctcccactccatgaggtatttcgacaccgccgtgtcccggcccggccgcggagagccccgcttcatctcagtgggctacgtggacgacacgcagttcgtgcggttcgacagcgacgccgcgagtccgagaggggagccgcgggcgccgtgggtggagcaggaggggccggagtattgggaccgggagacacagaactacaagcgccaggcacaggctgaccgagtgagcctgcggaacctgcgcggctactacaaccagagcgaggacgggtctcacaccctccagaggatgtatggctgcgacctggggcccgacgggcgcctcctccgcgggtatgaccagtccgcctacgacggcaaggattacatcgccctgaacgaggacctgcgctcctggaccgccgcggacaccgcggctcagatcacccagcgcaagttggaggcggcccgtgcggcggagcagctgagagcctacctggagggcacgtgcgtggagtggctccgcagatacctggagaacgggaaggagacgctgcagcgcgcagaacccccaaagacacacgtgacccaccaccccctctctgaccatgaggccaccctgaggtgctgggccctgggcttctaccctgcggagatcacactgacctggcagcgggatggggaggaccagacccaggacaccgagcttgtggagaccaggccagcaggagatggaaccttccagaagtgggcagctgtggtggtgccttctggacaagagcagagatacacgtgccatatgcagcacgaggggctgcaagagcccctcaccctgagctgggagccatcttcccagcccaccatccccatcatgggcatcgttgctggcctggctgtcctggttgtcctagctgtccttggagctgtggtcaccgctatgatgtgtaggaggaagagctcagctgcctgtgtgggactgagatgcaggatttcttcacacctctcctttgtgacttcaagagcctctggcatctctttctgcaaaggcgtctgaatgtgtctgcgttcctgttagcataatgtgaggaggtggagagacagcccacccccgtgtccaccgtgacccctgtccccacactgacctgtgttccctccccgatcatctttcctgttccagagaggtggggctggatgtctccatctctgtctcaaattcatggtgcactgagctgcaacttcttacttccctaatgaagttaagaacctgaatataaatttgtgttctcaaatatttgctatgaagcgttgatggattaattaaataagtcaattcctagaagttgagagagcaaataaagacctgagaaccttccagaa

SEQ ID NO: 708 - DNA, 1530 bp, Homo sapiens
tccccagacgccgagatgcgggtcatggcgccccgaaccctcatcctgctgctctcgggagccctggccctgaccgagacctgggcctgctcccactccatgaggtatttcgacaccgccgtgtcccggcccggccgcggagagccccgcttcatctcagtgggctacgtggacgacacgcagttcgtgcggttcgacagcgacgccgcgagtccgagaggggagccccgggcgccgtgggtggagcaggaggggccggagtattgggaccgggagacacagaagtacaagcgccaggcacaggctgaccgagtgaacctgcggaaactgcgcggctactacaaccagagcgaggacgggtctcacaccctccagtggatgtatggctgcgacctggggcccgacgggcgcctcctccgcgggtatgaccagtccgcctacgacggcaaggattacatcgccctgaacgaggacctgcgctcctggaccgccgcggacacggcggctcagatcacccagcgcaagtgggaggcggcccgtgaggcggagcagtggagagcctacctggagggcacgtgcgtggagtggctccgcagatacctggagaacgggaaggagacgctgcagcgcgcggaacacccaaagacacacgtgacccaccatcccgtctctgaccatgaggccaccctgaggtgctgggccctgggcttctaccctgcggagatcacactgacctggcagcgggatggcgaggaccaaactcaggacaccgagcttgtggagaccaggccagcaggagatggaaccttccagaagtgggcagctgtggtggtgccttctggagaagagcagagatacacgtgccatgtgcagcacgaggggctgccagagcccctcaccctgagatgggagccatcttcccagcccaccatccccatcgtgggcatcgttgctggcctggctgtcctggctgtcctagctgtcctaggagctgtgatggctgttgtgatgtgtaggaggaagagctcaggtagggaaggggtgaggagtggggtctggccagcaacagtgcccagggctctgatgagtctctcatcgcttgtaaagcctgagacagctgcctgtgtgggactgagatgcaggatttcttcacacctctcctttgtgacttcaagagcctctggcatctctttctgcaaaggcatctgaatgtgtctgcgttcctgttagcataatgtgaggaggtggagagacagcccacccccgtgtccaccgtgacccctgtccccacactgacctgtgttccctccccgatcatctttcctgttccagagaagtgggctggatgtctccatctctgtctcaactttacgtgtactgagctgcaacttcttacttccctactgaaaataagaatctgaatataaatttgttttctcaaatatttgctatgagaggttgatggattaattaaataagtcaattcctggaagttgagagagcaaataaagacctgagaaccttccagaa

SEQ ID NO: 709 - DNA, 1554 bp, Homo sapiens
tccccagaggccgagatgcgggtcatggcgccccgagccctcctcctgctgctctcgggaggcctggccctgaccgagacctgggcctgctcccactccatgaggtatttcgacaccgccgtgtcccggcccggccgcggagagccccgcttcatctcagtgggctacgtggacgacacgcagttcgtgcggttcgacagcgacgccgcgagtccgagaggggagccgcgggcgccgtgggtggagcaggaggggccggagtattgggaccgggagacacagaactacaagcgccaggcacaggctgaccgagtgagcctgcggaacctgcgcggctactacaaccagagcgaggacgggtctcacaccctccagaggatgtatggctgcgacctggggcccgacgggcgcctcctccgcgggtatgaccagtccgcctacgacggcaaggattacatcgccctgaacgaggacctgcgctcctggaccgccgcggacaccgcggctcagatcacccagcgcaagttggaggcggcccgtgcggcggagcagctgagagcctacctggagggcacgtgcgtggagtggctccgcagatacctggagaacgggaaggagacgctgcagcgcgcagaacccccaaagacacacgtgacccaccaccccctctctgaccatgaggccaccctgaggtgctgggccctgggcttctaccctgcggagatcacactgacctggcagcgggatggggaggaccagacccaggacaccgagcttgtggagaccaggccagcaggagatggaaccttccagaagtgggcagctgtggtggtgccttctggacaagagcagagatacacgtgccatatgcagcacgaggggctgcaagagcccctcaccctgagctgggagccatcttcccagcccaccatccccatcatgggcatcgttgctggcctggctgtcctggttgtcctagctgtccttggagctgtggtcaccgctatgatgtgtaggaggaagagctcagggcattttcttcccacaggtggaaaaggagggagctgctctcaggctgcgtgcagcaacagtgcccagggctctgatgagtctctcatcacttgtaaagcctgagacagctgcctgtgtgggactgagatgcaggatttcttcacacctctcctttgtgacttcaagagcctctggcatctctttctgcaaaggcgtctgaatgtgtctgcgttcctgttagcataatgtgaggaggtggagagacagcccacccccgtgtccaccgtgacccctgtccccacactgacctgtgttccctccccgatcatctttcctgttccagagaggtggggctggatgtctccatctctgtctcaaattcatggtgcactgagctgcaacttcttacttccctaatgaagttaagaacctgaatataaatttgtgttctcaaatatttgctatgaagcgttgatggattaattaaataagtcaattcctagaagttgagagagcaaataaagacctgagaaccttccagaa

SEQ ID NO: 710 - DNA, 1580 bp, Homo sapiens
gtcccggttctaaagtccccagtcacccacccggactcacattctccccagaggccgagatgcgggtcatggcgccccgagccctcctcctgctgctctcgggaggcctggccctgaccgagacctgggcctgctcccactccatgaggtatttcgacaccgccgtgtcccggcccggccgcggagagccccgcttcatctcagtgggctacgtggacgacacgcagttcgtgcggttcgacagcgacgccgcgagtccgagaggggagccgcgggcgccgtgggtggagcaggaggggccggagtattgggaccgggagacacagaactacaagcgccaggcacaggctgaccgagtgagcctgcggaacctgcgcggctactacaaccagagcgaggacgggtctcacaccctccagaggatgtatggctgcgacctggggcccgacgggcgcctcctccgcgggtatgaccagtccgcctacgacggcaaggattacatcgccctgaacgaggacctgcgctcctggaccgccgcggacaccgcggctcagatcacccagcgcaagttggaggcggcccgtgcggcggagcagctgagagcctacctggagggcacgtgcgtggagtggctccgcagatacctggagaacgggaaggagacgctgcagcgcgcagaacccccaaagacacacgtgacccaccaccccctctctgaccatgaggccaccctgaggtgctgggccctgggcttctaccctgcggagatcacactgacctggcagcgggatggggaggaccagacccaggacaccgagcttgtggagaccaggccagcaggagatggaaccttccagaagtgggcagctgtggtggtgccttctggacaagagcagagatacacgtgccatatgcagcacgaggggctgcaagagcccctcaccctgagctgggagccatcttcccagcccaccatccccatcatgggcatcgttgctggcctggctgtcctggttgtcctagctgtccttggagctgtggtcaccgctatgatgtgtaggaggaagagctcaggtggaaaaggagggagctgctctcaggctgcgtgcagcaacagtgcccagggctctgatgagtctctcatcacttgtaaagcctgagacagctgcctgtgtgggactgagatgcaggatttcttcacacctctcctttgtgacttcaagagcctctggcatctctttctgcaaaggcgtctgaatgtgtctgcgttcctgttagcataatgtgaggaggtggagagacagcccacccccgtgtccaccgtgacccctgtccccacactgacctgtgttccctccccgatcatctttcctgttccagagaggtggggctggatgtctccatctctgtctcaaattcatggtgcactgagctgcaacttcttacttccctaatgaagttaagaacctgaatataaatttgtgttctcaaatatttgctatgaagcgttgatggattaattaaataagtcaattcctagaagttgagagagcaaataaagacctgagaaccttccagaa

SEQ ID NO: 711 - DNA, 1451 bp, Homo sapiens
cagattctccccagacgccgagatgcgggtcatggcgccccgaaccctcatcctgctgctctcgggagccctggccctgaccgagacctgggccggctcccactccatgaggtatttctacaccgctgtgtcccggcccggccgcggggagccccacttcatcgcagtgggctacgtggacgacacgcagttcgtgcggttcgacagcgacgccgcgagtccgagaggggagccgcgggcgccgtgggtggagcaggaggggccggagtattgggaccgggagacacagaagtacaagcgccaggcacagactgaccgagtgagcctgcggaacctgcgcggctactacaaccagagcgaggccgggtctcacatcatccagaggatgtatggctgcgacgtggggcccgacgggcgcctcctccgcgggtatgaccagtacgcctacgacggcaaggattacatcgccctgaacgaggatctgcgctcctggaccgccgcggacacggcggctcagatcacccagcgcaagtgggaggcggcccgtgaggcggagcagctgagagcctacctggagggcctgtgcgtggagtggctccgcagatacctgaagaatgggaaggagacgctgcagcgcgcggaacacccaaagacacacgtgacccaccatcccgtctctgaccatgaggccaccctgaggtgctgggccctgggcttctaccctgcggagatcacactgacctggcagtgggatggggaggaccaaactcaggacactgagcttgtggagaccaggccagcaggagatggaaccttccagaagtgggcagctgtggtggtgccttctggagaagagcagagatacacgtgccatgtgcagcacgaggggctgccggagcccctcaccctgagatgggagccgtcttcccagcccaccatccccatcgtgggcatcgttgctggcctggctgtcctggctgtcctagctgtcctaggagctgtggtggctgttgtgatgtgtaggaggaagagctcagctgcctgtgtgggactgagatgcaggatttcttcacacctctcctttgtgacttcaagagcctctggcatctctttctgcaaaggcatctgaatgtgtctgcgttcctgttagcataatgtgaggaggtggagagacagcccacccccgtgtccaccgtgacccctgtccccacactgacctgtgttccctccccgatcatctttcctgttccagagaagtgggctggatgtctccatctctgtctcaacttcatggtgcgctgagctgcaacttcttacttccctaatgaagttaggaacctgaatataaatttgttttctcaaatatttgctatgaagggttgatggattaattaaataagtcaattcctggaagttgagagagcaaataaagacctgagaactttccagaa

SEQ ID NO: 712 - DNA, 1532 bp, Homo sapiens
tccccagaggccgagatgcgggtcatggcgccccgagccctcctcctgctgctctcgggaggcctggccctgaccgagacctgggcctgctcccactccatgaggtatttcgacaccgccgtgtcccggcccggccgcggagagccccgcttcatctcagtgggctacgtggacgacacgcagttcgtgcggttcgacagcgacgccgcgagtccgagaggggagccgcgggcgccgtgggtggagcaggaggggccggagtattgggaccgggagacacagaactacaagcgccaggcacaggctgaccgagtgagcctgcggaacctgcgcggctactacaaccagagcgaggacgggtctcacaccctccagaggatgtatggctgcgacctggggcccgacgggcgcctcctccgcgggtatgaccagtccgcctacgacggcaaggattacatcgccctgaacgaggacctgcgctcctggaccgccgcggacaccgcggctcagatcacccagcgcaagttggaggcggcccgtgcggcggagcagctgagagcctacctggagggcacgtgcgtggagtggctccgcagatacctggagaacgggaaggagacgctgcagcgcgcagaacccccaaagacacacgtgacccaccaccccctctctgaccatgaggccaccctgaggtgctgggccctgggcttctaccctgcggagatcacactgacctggcagcgggatggggaggaccagacccaggacaccgagcttgtggagaccaggccagcaggagatggaaccttccagaagtgggcagctgtggtggtgccttctggacaagagcagagatacacgtgccatatgcagcacgaggggctgcaagagcccctcaccctgagctgggagccatcttcccagcccaccatccccatcatgggcatcgttgctggcctggctgtcctggttgtcctagctgtccttggagctgtggtcaccgctatgatgtgtaggaggaagagctcaggtagggaaggggtgaagagcggggtctgggcagcaacagtgcccagggctctgatgagtctctcatcacttgtaaagcctgagacagctgcctgtgtgggactgagatgcaggatttcttcacacctctcctttgtgacttcaagagcctctggcatctctttctgcaaaggcgtctgaatgtgtctgcgttcctgttagcataatgtgaggaggtggagagacagcccacccccgtgtccaccgtgacccctgtccccacactgacctgtgttccctccccgatcatctttcctgttccagagaggtggggctggatgtctccatctctgtctcaaattcatggtgcactgagctgcaacttcttacttccctaatgaagttaagaacctgaatataaatttgtgttctcaaatatttgctatgaagcgttgatggattaattaaataagtcaattcctagaagttgagagagcaaataaagacctgagaaccttccagaa

SEQ ID NO: 713 - DNA, 1502 bp, Homo sapiens
tccccagacgccgagatgcgggtcatggcgccccgaaccctcatcctgctgctctcgggagccctggccctgaccgagacctgggccggctcccactccatgaggtatttctacaccgctgtgtcccggcccggccgcggggagccccacttcatcgcagtgggctacgtggacgacacgcagttcgtgcggttcgacagcgacgccgcgagtccgagaggggagccgcgggcgccgtgggtggagcaggaggggccggagtattgggaccgggagacacagaagtacaagcgccaggcacagactgaccgagtgagcctgcggaacctgcgcggctactacaaccagagcgaggccgggtctcacatcatccagaggatgtatggctgcgacgtggggcccgacgggcgcctcctccgcgggtatgaccagtacgcctacgacggcaaggattacatcgccctgaacgaggatctgcgctcctggaccgccgcggacacggcggctcagatcacccagcgcaagtgggaggcggcccgtgaggcggagcagctgagagcctacctggagggcctgtgcgtggagtggctccgcagatacctgaagaatgggaaggagacgctgcagcgcgcggaacacccaaagacacacgtgacccaccatcccgtctctgaccatgaggccaccctgaggtgctgggccctgggcttctaccctgcggagatcacactgacctggcagtgggatggggaggaccaaactcaggacactgagcttgtggagaccaggccagcaggagatggaaccttccagaagtgggcagctgtggtggtgccttctggagaagagcagagatacacgtgccatgtgcagcacgaggggctgccggagcccctcaccctgagatgggagccgtcttcccagcccaccatccccatcgtgggcatcgttgctggcctggctgtcctggctgtcctagctgtcctaggagctgtggtggctgttgtgatgtgtaggaggaagagctcagccagcaacagtgcccagggctctgatgagtctctcatcgcttgtaaagcctgagacagctgcctgtgtgggactgagatgcaggatttcttcacacctctcctttgtgacttcaagagcctctggcatctctttctgcaaaggcatctgaatgtgtctgcgttcctgttagcataatgtgaggaggtggagagacagcccacccccgtgtccaccgtgacccctgtccccacactgacctgtgttccctccccgatcatctttcctgttccagagaagtgggctggatgtctccatctctgtctcaacttcatggtgcgctgagctgcaacttcttacttccctaatgaagttaggaacctgaatataaatttgttttctcaaatatttgctatgaagggttgatggattaattaaataagtcaattcctggaagttgagagagcaaataaagacctgagaactttccagaa

SEQ ID NO: 714 - DNA, 1450 bp, Homo sapiens
cggattctccccagacgccgagatgcgggtcatggcgccccgaaccctcatcctgctgctctcgggagccctggccctgaccgagacctgggcctgctcccactccatgaggtatttctacaccgccgtgtcccggcccggccgcggagagccccgcttcatcgcagtgggctacgtggacgacacgcagttcgtgcagttcgacagcgacgccgcgagtccaagaggggagccgcgggcgccgtgggtggagcaggaggggccggagtattgggaccgggagacacagaagtacaagcgccaggcacagactgaccgagtgaacctgcggaaactgcgcggctactacaaccagagcgaggccgggtctcacaccctccagaggatgtatggctgcgacctggggcccgacgggcgcctcctccgcgggtataaccagttcgcctacgacggcaaggattacatcgccctgaatgaggacctgcgctcctggaccgccgcggacaaggcggctcagatcacccagcgcaagtgggaggcggcccgtgaggcggagcagcggagagcctacctggagggcacgtgcgtggagtggctccgcagatacctggagaacgggaagaagacgctgcagcgcgcggaacacccaaagacacacgtgacccaccatcccgtctctgaccatgaggccaccctgaggtgctgggccctgggcttctaccctgcggagatcacactgacctggcagcgggatggcgaggaccaaactcaggacaccgagcttgtggagaccaggccagcaggagatggaaccttccagaagtgggcagctgtggtggtgccttctggagaagagcagagatacacgtgccatgtgcagcacgaggggctgccagagcccctcaccctgagatgggggccatcttcccagcccaccatccccatcgtgggcatcgttgctggcctggctgtcctggctgtcctagctgtcctaggagctgtgatggctgttgtgatgtgtaggaggaagagctcagctgcctgtgtgggactgagatgcaggatttcttcacacctttcctttgtgacttcaagagcctctggcatctctttctgcaaaggcatctgaatgtgtctgcgttcctgttagcataatgtgaggaggtggagagacagcccacccccgtgtccaccgtgacccctgtccccacactgacctgtgttccctccccgatcatctttcctgttccagagaagtgggctggatgtctccatctctgtctcaactttacgtgtactgagctgcaacttcttacttccctactgaaaataagaatctgaatataaatttgttttctcaaatatttgctatgagaggttgatggattaattaaataagtcaattcctggaagttgagagagcaaataaagacctgagaaccttccagaa

SEQ ID NO: 715 - DNA, 782 bp, Homo sapiens
gcgggtcatggcgccccgaaccctcatcctgctgctctcgggagccctggccctgaccgagacctgggcctgctcccactccatgaggtatttctacaccgccgtgtcccggcccggccgcggagagccccgcttcatcgcagtgggctacgtggacgacacgcagttcgtgcggttcgacagcgacgccgcgagtccaagaggggagccgcgggcgccgtgggtggagcaggaggggccggagtattgggaccgggagacacagaagtacaagcgccaggcacagactgaccgagtgagcctgcggaacctgcgcggctactacaaccagagcgaggccgggtctcacaccctccagtggatgtatggctgcgacctggggcccgacgggcgcctcctccgcgggtatgaccagtccgcctacgacggcaaggattacatcgccctgaacgaggacctgcgctcctggaccgccgcggacacggcggctcagatcacccagcgcaagtgggaggcggcccgtgcggcggagcagcagagagcctacctggagggcacgtgcgtggagtggctccgcagatacctggagaacgggaaggagacgctgcagcgcgcggaacacccaaagacacacgtgacccaccatctcgtctctgaccatgaggccagcaggagatggaaccttccagaagtgggcagctgtggtggtgccttctggagaagagcagagatacacgtgccatgtgcagcacgaggggctgccggagcccctcaccctgaga

SEQ ID NO: 716 - DNA, 1578 bp, Homo sapiens
gtcccggttctaaagtccccagtcacccacccggactcggattctccccagacgccgagatgcgggtcatggcgccccgaaccctcatcctgctgctctcgggagccctggccctgaccgagacctgggcctgctcccactccatgaggtatttctacaccgccgtgtcccggcccggccgcggagagccccgcttcatcgcagtgggctacgtggacgacacgcagttcgtgcggttcgacagcgacgccgcgagtccaagaggggagccgcgggcgccgtgggtggagcaggaggggccggagtattgggaccgggagacacagaagtacaagcgccaggcacagactgaccgagtgagcctgcggaacctgcgcggctactacaaccagagcgaggccgggtctcacaccctccagtggatgtatggctgcgacctggggcccgacgggcgcctcctccgcgggtatgaccagtccgcctacgacggcaaggattacatcgccctgaacgaggacctgcgctcctggaccgccgcggacacggcggctcagatcacccagcgcaagtgggaggcggcccgtgcggcggagcagcagagagcctacctggagggcacgtgcgtggagtggctccgcagatacctggagaacgggaaggagacgctgcagcgcgcggaacacccaaagacacacgtgacccaccatctcgtctctgaccatgaggccaccctgaggtgctgggccctgggcttctaccctgcggagatcacactgacctggcagcgggatggcgaggaccaaactcaggacaccgagcttgtggagaccaggccagcaggagatggaaccttccagaagtgggcagctgtggtggtgccttctggagaagagcagagatacacgtgccatgtgcagcacgaggggctgccggagcccctcaccctgagatgggagccatcttcccagcccaccatccccatcgtgggcatcgttgctggcctggctgtcctggctgtcctagctgtcctaggagctgtggtggctgttgttatgtgtaggaggaagagctcaggtggaaaaggagggagctgctctcaggctgcgtccagcaacagtgcccagggctctgatgagtctctcatcgcttgtaaagcctgagacagctgcctgtgtgggactgagatgcaggatttcttcacacctctcctttgtgacttcaagagcctctggcatctctttctgcaaaggcatctgaatgcgtctgcgttcctgttagcataatgtgaggaggtggagagacagcccacccccgtgtccaccgtgacccctgtccccacactgacctgtgttccctccccgatcatctttcctgttccagagaagtgggctggatgtctccatctctgtctcaactttacgtgtactgagctgcaacttcttacttccctactgaaaataagaatctgaatataaatttgttttctcaaatatttgctatgagaggttgatggattaattaaataagtcaatccctggaagttgagagagcaaataaagacctgagaaccttccagaa

SEQ ID NO: 717 - DNA, 782 bp, Homo sapiens
gcgggtcatggcgccccgaaccctcatcctgctgctctcgggagccctggccctgaccgagacctgggccggctcccactccatgaggtatttctacaccgctgtgtcccggcccggccgcggggagccccacttcatcgcagtgggctacgtggacgacacgcagttcgtgcggttcgacagcgacgccgcgagtccgagaggggagccgcgggcgccgtgggtggagcaggaggggccggagtattgggaccgggagacacagaagtacaagcgccaggcacagactgaccgagtgagcctgcggaacctgcgcggctactacaaccagagcgaggccgggtctcacatcatccagaggatgtatggctgcgacgtggggcccgacgggcgcctcctccgcgggtatgaccagtacgcctacgacggcaaggattacatcgccctgaacgaggatctgcgctcctggaccgccgcggacacggcggctcagatcacccagcgcaagtgggaggcggcccgtgaggcggagcagctgagagcctacctggagggcctgtgcgtggagtggctccgcagatacctgaagaatgggaaggagacgctgcagcgcgcggaacacccaaagacacacgtgacccaccatcccgtctctgaccatgaggccagcaggagatggaaccttccagaagtgggcagctgtggtggtgccttctggagaagagcagagatacacgtgccatgtgcagcacgaggggctgccggagcccctcaccctgaga

SEQ ID NO: 718 - DNA, 782 bp, Homo sapiens
gcgggtcatggcgccccgaaccctcatcctgctgctctcgggagccctggccctgaccgagacctgggcctgctcccactccatgaggtatttctacaccgccgtgtcccggcccggccgcggagagccccgcttcatcgcagtgggctacgtggacgacacgcagttcgtgcagttcgacagcgacgccgcgagtccaagaggggagccgcgggcgccgtgggtggagcaggaggggccggagtattgggaccgggagacacagaagtacaagcgccaggcacagactgaccgagtgaacctgcggaaactgcgcggctactacaaccagagcgaggccgggtctcacaccctccagaggatgtatggctgcgacctggggcccgacgggcgcctcctccgcgggtataaccagttcgcctacgacggcaaggattacatcgccctgaatgaggacctgcgctcctggaccgccgcggacaaggcggctcagatcacccagcgcaagtgggaggcggcccgtgaggcggagcagcggagagcctacctggagggcacgtgcgtggagtggctccgcagatacctggagaacgggaagaagacgctgcagcgcgcggaacacccaaagacacacgtgacccaccatcccgtctctgaccatgaggccagcaggagatggaaccttccagaagtgggcagctgtggtggtgccttctggagaagagcagagatacacgtgccatgtgcagcacgaggggctgccagagcccctcaccctgaga

SEQ ID NO: 719 - DNA, 782 bp, Homo sapiens; identical to SEQ ID NO: 718

SEQ ID NO: 720 - DNA, 1552 bp, Homo sapiens
tccccagacgccgagatgcgggtcatggcgccccgaaccctcatcctgctgctctcgggagccctggccctgaccgagacctgggcctgctcccactccatgaggtatttctacaccgccgtgtcccggcccggccgcggagagccccgcttcatcgcagtgggctacgtggacgacacgcagttcgtgcggttcgacagcgacgccgcgagtccaagaggggagccgcgggcgccgtgggtggagcaggaggggccggagtattgggaccgggagacacagaagtacaagcgccaggcacagactgaccgagtgagcctgcggaacctgcgcggctactacaaccagagcgaggccgggtctcacaccctccagtggatgtatggctgcgacctggggcccgacgggcgcctcctccgcgggtatgaccagtccgcctacgacggcaaggattacatcgccctgaacgaggacctgcgctcctggaccgccgcggacacggcggctcagatcacccagcgcaagtgggaggcggcccgtgcggcggagcagcagagagcctacctggagggcacgtgcgtggagtggctccgcagatacctggagaacgggaaggagacgctgcagcgcgcggaacacccaaagacacacgtgacccaccatctcgtctctgaccatgaggccaccctgaggtgctgggccctgggcttctaccctgcggagatcacactgacctggcagcgggatggcgaggaccaaactcaggacaccgagcttgtggagaccaggccagcaggagatggaaccttccagaagtgggcagctgtggtggtgccttctggagaagagcagagatacacgtgccatgtgcagcacgaggggctgccggagcccctcaccctgagatgggagccatcttcccagcccaccatccccatcgtgggcatcgttgctggcctggctgtcctggctgtcctagctgtcctaggagctgtggtggctgttgttatgtgtaggaggaagagctcagggcattttcttcccacaggtggaaaaggagggagctgctctcaggctgcgtccagcaacagtgcccagggctctgatgagtctctcatcgcttgtaaagcctgagacagctgcctgtgtgggactgagatgcaggatttcttcacacctctcctttgtgacttcaagagcctctggcatctctttctgcaaaggcatctgaatgcgtctgcgttcctgttagcataatgtgaggaggtggagagacagcccacccccgtgtccaccgtgacccctgtccccacactgacctgtgttccctccccgatcatctttcctgttccagagaagtgggctggatgtctccatctctgtctcaactttacgtgtactgagctgcaacttcttacttccctactgaaaataagaatctgaatataaatttgttttctcaaatatttgctatgagaggttgatggattaattaaataagtcaatccctggaagttgagagagcaaataaagacctgagaaccttccagaa

SEQ ID NO: 721 - DNA, 782 bp, Homo sapiens
gcgggtcatggcgccccgaaccctcatcctgctgctctcgggagccctggccctgaccgagacctgggcctgctcccactccatgaggtatttcgacaccgccgtgtcccggcccggccgcggagagccccgcttcatctcagtgggctacgtggacgacacgcagttcgtgcggttcgacagcgacgccgcgagtccgagaggggagccccgggcgccgtgggtggagcaggaggggccggagtattgggaccgggagacacagaagtacaagcgccaggcacaggctgaccgagtgaacctgcggaaactgcgcggctactacaaccagagcgaggacgggtctcacaccctccagtggatgtatggctgcgacctggggcccgacgggcgcctcctccgcgggtatgaccagtccgcctacgacggcaaggattacatcgccctgaacgaggacctgcgctcctggaccgccgcggacacggcggctcagatcacccagcgcaagtgggaggcggcccgtgaggcggagcagtggagagcctacctggagggcacgtgcgtggagtggctccgcagatacctggagaacgggaaggagacgctgcagcgcgcggaacacccaaagacacacgtgacccaccatcccgtctctgaccatgaggccagcaggagatggaaccttccagaagtgggcagctgtggtggtgccttctggagaagagcagagatacacgtgccatgtgcagcacgaggggctgccagagcccctcaccctgaga

SEQ ID NO: 722 - DNA, 1450 bp, Homo sapiens
cggattctccccagacgccgagatgcgggtcatggcgccccgaaccctcatcctgctgctctcgggagccctggccctgaccgagacctgggcctgctcccactccatgaggtatttcgacaccgccgtgtcccggcccggccgcggagagccccgcttcatctcagtgggctacgtggacgacacgcagttcgtgcggttcgacagcgacgccgcgagtccgagaggggagccccgggcgccgtgggtggagcaggaggggccggagtattgggaccgggagacacagaagtacaagcgccaggcacaggctgaccgagtgaacctgcggaaactgcgcggctactacaaccagagcgaggacgggtctcacaccctccagtggatgtatggctgcgacctggggcccgacgggcgcctcctccgcgggtatgaccagtccgcctacgacggcaaggattacatcgccctgaacgaggacctgcgctcctggaccgccgcggacacggcggctcagatcacccagcgcaagtgggaggcggcccgtgaggcggagcagtggagagcctacctggagggcacgtgcgtggagtggctccgcagatacctggagaacgggaaggagacgctgcagcgcgcggaacacccaaagacacacgtgacccaccatcccgtctctgaccatgaggccaccctgaggtgctgggccctgggcttctaccctgcggagatcacactgacctggcagcgggatggcgaggaccaaactcaggacaccgagcttgtggagaccaggccagcaggagatggaaccttccagaagtgggcagctgtggtggtgccttctggagaagagcagagatacacgtgccatgtgcagcacgaggggctgccagagcccctcaccctgagatgggagccatcttcccagcccaccatccccatcgtgggcatcgttgctggcctggctgtcctggctgtcctagctgtcctaggagctgtgatggctgttgtgatgtgtaggaggaagagctcagctgcctgtgtgggactgagatgcaggatttcttcacacctctcctttgtgacttcaagagcctctggcatctctttctgcaaaggcatctgaatgtgtctgcgttcctgttagcataatgtgaggaggtggagagacagcccacccccgtgtccaccgtgacccctgtccccacactgacctgtgttccctccccgatcatctttcctgttccagagaagtgggctggatgtctccatctctgtctcaactttacgtgtactgagctgcaacttcttacttccctactgaaaataagaatctgaatataaatttgttttctcaaatatttgctatgagaggttgatggattaattaaataagtcaattcctggaagttgagagagcaaataaagacctgagaaccttccagaa

SEQ ID NO: 723 - DNA, 782 bp, Homo sapiens
gcgggtcatggcgccccgagccctcctcctgctgctctcgggaggcctggccctgaccgagacctgggcctgctcccactccatgaggtatttcgacaccgccgtgtcccggcccggccgcggagagccccgcttcatctcagtgggctacgtggacgacacgcagttcgtgcggttcgacagcgacgccgcgagtccgagaggggagccgcgggcgccgtgggtggagcaggaggggccggagtattgggaccgggagacacagaactacaagcgccaggcacaggctgaccgagtgagcctgcggaacctgcgcggctactacaaccagagcgaggacgggtctcacaccctccagaggatgtatggctgcgacctggggcccgacgggcgcctcctccgcgggtatgaccagtccgcctacgacggcaaggattacatcgccctgaacgaggacctgcgctcctggaccgccgcggacaccgcggctcagatcacccagcgcaagttggaggcggcccgtgcggcggagcagctgagagcctacctggagggcacgtgcgtggagtggctccgcagatacctggagaacgggaaggagacgctgcagcgcgcagaacccccaaagacacacgtgacccaccaccccctctctgaccatgaggccagcaggagatggaaccttccagaagtgggcagctgtggtggtgccttctggacaagagcagagatacacgtgccatatgcagcacgaggggctgcaagagcccctcaccctgagc

SEQ ID NO: 724 - DNA, 1579 bp, Homo sapiens
gtcccggttctgaagtccccagtcacccacccggactcagattctccccagacgccgagatgcgggtcatggcgccccgaaccctcatcctgctgctctcgggagccctggccctgaccgagacctgggccggctcccactccatgaggtatttctacaccgctgtgtcccggcccggccgcggggagccccacttcatcgcagtgggctacgtggacgacacgcagttcgtgcggttcgacagcgacgccgcgagtccgagaggggagccgcgggcgccgtgggtggagcaggaggggccggagtattgggaccgggagacacagaagtacaagcgccaggcacagactgaccgagtgagcctgcggaacctgcgcggctactacaaccagagcgaggccgggtctcacatcatccagaggatgtatggctgcgacgtggggcccgacgggcgcctcctccgcgggtatgaccagtacgcctacgacggcaaggattacatcgccctgaacgaggatctgcgctcctggaccgccgcggacacggcggctcagatcacccagcgcaagtgggaggcggcccgtgaggcggagcagctgagagcctacctggagggcctgtgcgtggagtggctccgcagatacctgaagaatgggaaggagacgctgcagcgcgcggaacacccaaagacacacgtgacccaccatcccgtctctgaccatgaggccaccctgaggtgctgggccctgggcttctaccctgcggagatcacactgacctggcagtgggatggggaggaccaaactcaggacactgagcttgtggagaccaggccagcaggagatggaaccttccagaagtgggcagctgtggtggtgccttctggagaagagcagagatacacgtgccatgtgcagcacgaggggctgccggagcccctcaccctgagatgggagccgtcttcccagcccaccatccccatcgtgggcatcgttgctggcctggctgtcctggctgtcctagctgtcctaggagctgtggtggctgttgtgatgtgtaggaggaagagctcaggtggaaaaggagggagctgctctcaggctgcgtccagcaacagtgcccagggctctgatgagtctctcatcgcttgtaaagcctgagacagctgcctgtgtgggactgagatgcaggatttcttcacacctctcctttgtgacttcaagagcctctggcatctctttctgcaaaggcatctgaatgtgtctgcgttcctgttagcataatgtgaggaggtggagagacagcccacccccgtgtccaccgtgacccctgtccccacactgacctgtgttccctccccgatcatctttcctgttccagagaagtgggctggatgtctccatctctgtctcaacttcatggtgcgctgagctgcaacttcttacttccctaatgaagttaggaacctgaatataaatttgttttctcaaatatttgctatgaagggttgatggattaattaaataagtcaattcctggaagttgagagagcaaataaagacctgagaactttccagaa

SEQ ID NO: 725 - DNA, 1552 bp, Homo sapiens
tccccagacgccgagatgcgggtcatggcgccccgaaccctcatcctgctgctctcgggagccctggccctgaccgagacctgggcctgctcccactccatgaggtatttcgacaccgccgtgtcccggcccggccgcggagagccccgcttcatctcagtgggctacgtggacgacacgcagttcgtgcggttcgacagcgacgccgcgagtccgagaggggagccccgggcgccgtgggtggagcaggaggggccggagtattgggaccgggagacacagaagtacaagcgccaggcacaggctgaccgagtgaacctgcggaaactgcgcggctactacaaccagagcgaggacgggtctcacaccctccagtggatgtatggctgcgacctggggcccgacgggcgcctcctccgcgggtatgaccagtccgcctacgacggcaaggattacatcgccctgaacgaggacctgcgctcctggaccgccgcggacacggcggctcagatcacccagcgcaagtgggaggcggcccgtgaggcggagcagtggagagcctacctggagggcacgtgcgtggagtggctccgcagatacctggagaacgggaaggagacgctgcagcgcgcggaacacccaaagacacacgtgacccaccatcccgtctctgaccatgaggccaccctgaggtgctgggccctgggcttctaccctgcggagatcacactgacctggcagcgggatggcgaggaccaaactcaggacaccgagcttgtggagaccaggccagcaggagatggaaccttccagaagtgggcagctgtggtggtgccttctggagaagagcagagatacacgtgccatgtgcagcacgaggggctgccagagcccctcaccctgagatgggagccatcttcccagcccaccatccccatcgtgggcatcgttgctggcctggctgtcctggctgtcctagctgtcctaggagctgtgatggctgttgtgatgtgtaggaggaagagctcagggcattttcttcccacaggtggaaaaggagggagctgctctcaggctgcgtccagcaacagtgcccagggctctgatgagtctctcatcgcttgtaaagcctgagacagctgcctgtgtgggactgagatgcaggatttcttcacacctctcctttgtgacttcaagagcctctggcatctctttctgcaaaggcatctgaatgtgtctgcgttcctgttagcataatgtgaggaggtggagagacagcccacccccgtgtccaccgtgacccctgtccccacactgacctgtgttccctccccgatcatctttcctgttccagagaagtgggctggatgtctccatctctgtctcaactttacgtgtactgagctgcaacttcttacttccctactgaaaataagaatctgaatataaatttgttttctcaaatatttgctatgagaggttgatggattaattaaataagtcaattcctggaagttgagagagcaaataaagacctgagaaccttccagaa

SEQ ID NO: 726 - DNA, 1447 bp, Homo sapiens
attctccccagacgccgagatgcgggtcatggcgccccgaaccctcatcctgctgctctcgggagccctggccctgaccgagacctgggcctgctcccactccatgaggtatttctacaccgccgtgtcccggcccggccgcggagagccccgcttcatcgcagtgggctacgtggacgacacgcagttcgtgcagttcgacagcgacgccgcgagtccaagaggggagccgcgggcgccgtgggtggagcaggaggggccggagtattgggaccgggagacacagaagtacaagcgccaggcacagactgaccgagtgaacctgcggaaactgcgcggctactacaaccagagcgaggccgggtctcacaccctccagaggatgtatggctgcgacctggggcccgacgggcgcctcctccgcgggtataaccagttcgcctacgacggcaaggattacatcgccctgaatgaggacctgcgctcctggaccgccgcggacaaggcggctcagatcacccagcgcaagtgggaggcggcccgtgaggcggagcagcggagagcctacctggagggcacgtgcgtggagtggctccgcagatacctggagaacgggaagaagacgctgcagcgcgcggaacacccaaagacacacgtgacccaccatcccgtctctgaccatgaggccaccctgaggtgctgggccctgggcttctaccctgcggagatcacactgacctggcagcgggatggcgaggaccaaactcaggacaccgagcttgtggagaccaggccagcaggagatggaaccttccagaagtgggcagctgtggtggtgccttctggagaagagcagagatacacgtgccatgtgcagcacgaggggctgccagagcccctcaccctgagatgggggccatcttcccagcccaccatccccatcgtgggcatcgttgctggcctggctgtcctggctgtcctagctgtcctaggagctgtgatggctgttgtgatgtgtaggaggaagagctcagctgcctgtgtgggactgagatgcaggatttcttcacacctttcctttgtgacttcaagagcctctggcatctctttctgcaaaggcatctgaatgtgtctgcgttcctgttagcataatgtgaggaggtggagagacagcccacccccgtgtccaccgtgacccctgtccccacactgacctgtgttccctccccgatcatctttcctgttccagagaagtgggctggatgtctccatctctgtctcaactttacgtgtactgagctgcaacttcttacttccctactgaaaataagaatctgaatataaatttgttttctcaaatatttgctatgagaggttgatggattaattaaataagtcaattcctggaagttgagagagcaaataaagacctgagaaccttccagaa

SEQ ID NO: 727 - DNA, 966 bp, Homo sapiens
agatgcgggtcatggcgccccgagccctcctcctgctgctctcgggaggcctggccctgaccgagacctgggcctgctcccactccatgaggtatttcgacaccgccgtgtcccggcccggccgcggagagccccgcttcatctcagtgggctacgtggacgacacgcagttcgtgcggttcgacagcgacgccgcgagtccgagaggggagccgcgggcgccgtgggtggagcaggaggggccggagtattgggaccgggagacacagaagtacaagcgccaggcacaggctgaccgagtgagcctgcggaacctgcgcggctactacaaccagagcgaggacgggtctcacaccctccagaggatgtctggctgcgacctggggcccgacgggcgcctcctccgcgggtatgaccagtccgcctacgacggcaaggattacatcgccctgaacgaggacctgcgctcctggaccgccgcggacaccgcggctcagatcacccagcgcaagttggaggcggcccgtgcggcggagcagctgagagcctacctggagggcacgtgcgtggagtggctccgcagatacctggagaacgggaaggagacgctgcagcgcgcaggtcaggaccagaagtcgctgttcctccctcagagactagaactttccaatgaataggagattatcccagaacccccaaagacacacgtgacccaccaccccctctctgaccatgaggccaccctgaggtgctgggccctgggcttctaccctgcggagatcacactgacctggcagcgggatggggaggaccagacccaggacaccgagcttgtggagaccaggccagcaggagatggaaccttccagaagtgggcagctgtggtggtgccttctggacaagagcagagatacacgtgccatatgcagcacgaggggctgcaagagcccctcaccctgagctggg

SEQ ID NO: 728 - DNA, 966 bp, Homo sapiens
agatgcgggtcatggcgccccgaaccctcatcctgctgctctcgggagccctggccctgaccgagacctgggcctgctcccactccatgaggtatttctacaccgccgtgtcccggcccggccgcggagagccccgcttcatcgcagtgggctacgtggacgacacgcagttcgtgcagttcgacagcgacgccgcgagtccaagaggggagccgcgggcgccgtgggtggagcaggaggggccggagtattgggaccgggagacacagaagtacaagcgccaggcacagactgaccgagtgaacctgcggaaactgcgcggctactacaaccagagcgaggccgggtctcacaccctccagaggatgtatggctgcgacctggggcccgacgggcgcctcctccgcgggtataaccagttcgcctacgacggcaaggattacatcgccctgaatgaggacctgcgctcctggaccgccgcggacaaggcggctcagatcacccagcgcaagtgggaggcggcccgtgaggcggagcagcggagagcctacctggagggcacgtgcgtggagtggctccgcagatacctggagaacgggaagaagacgctgcagcgcgcgggtcaggaccagaagtcgctgttcctccctcagagactagaactttccaatgaataggagattatcccagaacacccaaagacacacgtgacccaccatcccgtctctgaccatgaggccaccctgaggtgctgggccctgggcttctaccctgcggagatcacactgacctggcagcgggatggcgaggaccaaactcaggacaccgagcttgtggagaccaggccagcaggagatggaaccttccagaagtgggcagctgtggtggtgccttctggagaagagcagagatacacgtgccatgtgcagcacgaggggctgccagagcccctcaccctgagatggg

SEQ ID NO: 729 - DNA, 966 bp, Homo sapiens
agatgcgggtcatggcgccccgagccctcctcctgctgctctcgggaggcctggccctgaccgagacctgggcctgctcccactccatgaggtatttcgacaccgccgtgtcccggcccggccgcggagagccccgcttcatctcagtgggctacgtggacgacacgcagttcgtgcggttcgacagcgacgccgcgagtccgagaggggagccgcgggcgccgtgggtggagcaggaggggccggagtattgggaccgggagacacagaactacaagcgccaggcacaggctgaccgagtgagcctgcggaacctgcgcggctactacaaccagagcgaggacgggtctcacaccctccagaggatgtatggctgcgacctggggcccgacgggcgcctcctccgcgggtatgaccagtccgcctacgacggcaaggattacatcgccctgaacgaggacctgcgctcctggaccgccgcggacaccgcggctcagatcacccagcgcaagttggaggcggcccgtgcggcggagcagctgagagcctacctggagggcacgtgcgtggagtggctccgcagatacctggagaacgggaaggagacgctgcagcgcgcaggtcaggaccagaagtcgctgttcctccctcagagactagaactttccaatgaataggagattatcccagaacccccaaagacacacgtgacccaccaccccctctctgaccatgaggccaccctgaggtgctgggccctgggcttctaccctgcggagatcacactgacctggcagcgggatggggaggaccagacccaggacaccgagcttgtggagaccaggccagcaggagatggaaccttccagaagtgggcagctgtggtggtgccttctggacaagagcagagatacacgtgccatatgcagcacgaggggctgcaagagcccctcaccctgagctggg

SEQ ID NO: 730 - DNA, 1536 bp, Homo sapiens
cccacccggactcggattctccccagacgccgagatgcgggtcatggcgccccgaaccctcatcctgctgctctcgggagccctggccctgaccgagacctgggcctgctcccactccatgaggtatttctacaccgccgtgtcccggcccggccgcggagagccccgcttcatcgcagtgggctacgtggacgacacgcagttcgtgcagttcgacagcgacgccgcgagtccaagaggggagccgcgggcgccgtgggtggagcaggaggggccggagtattgggaccgggagacacagaagtacaagcgccaggcacagactgaccgagtgaacctgcggaaactgcgcggctactacaaccagagcgaggccgaggatgtatggctgcgacctggggcccgacgggcgcctcctccgcgggtataaccagttcgcctacgacggcaaggattacatcgccctgaatgaggacctgcgctcctggaccgccgcggacaaggcggctcagatcacccagcgcaagtgggaggcggcccgtgaggcggagcagcggagagcctacctggagggcacgtgcgtggagtggctccgcagatacctggagaacgggaagaagacgctgcagcgcgcggaacacccaaagacacacgtgacccaccatcccgtctctgaccatgaggccaccctgaggtgctgggccctgggcttctaccctgcggagatcacactgacctggcagcgggatggcgaggaccaaactcaggacaccgagcttgtggagaccaggccagcaggagatggaaccttccagaagtgggcagctgtggtggtgccttctggagaagagcagagatacacgtgccatgtgcagcacgaggggctgccagagcccctcaccctgagatgggggccatcttcccagcccaccatccccatcgtgggcatcgttgctggcctggctgtcctggctgtcctagctgtcctaggagctgtgatggctgttgtgatgtgtaggaggaagagctcaggtggaaaaggagggagctgctctcaggctgcgtccagcaacagtgcccagggctctgatgagtctctcatcgcttgtaaagcctgagacagctgcctgtgtgggactgagatgcaggatttcttcacacctttcctttgtgacttcaagagcctctggcatctctttctgcaaaggcatctgaatgtgtctgcgttcctgttagcataatgtgaggaggtggagagacagcccacccccgtgtccaccgtgacccctgtccccacactgacctgtgttccctccccgatcatctttcctgttccagagaagtgggctggatgtctccatctctgtctcaactttacgtgtactgagctgcaacttcttacttccctactgaaaataagaatctgaatataaatttgttttctcaaatatttgctatgagaggttgatggattaattaaataagtcaattcctggaagttgagagagcaaataaagacctgagaaccttccagaa

SEQ ID NO: 731 - DNA, 1538 bp, Homo sapiens
cccacccggactcacattctccccagaggccgagatgcgggtcatggcgccccgagccctcctcctgctgctctcgggaggcctggccctgaccgagacctgggcctgctcccactccatgaggtatttcgacaccgccgtgtcccggcccggccgcggagagccccgcttcatctcagtgggctacgtggacgacacgcagttcgtgcggttcgacagcgacgccgcgagtccgagaggggagccgcgggcgccgtgggtggagcaggaggggccggagtattgggaccgggagacacagaactacaagcgccaggcacaggctgaccgagtgagcctgcggaacctgcgcggctactacaaccagagcgaggacgaggatgtatggctgcgacctggggcccgacgggcgcctcctccgcgggtatgaccagtccgcctacgacggcaaggattacatcgccctgaacgaggacctgcgctcctggaccgccgcggacaccgcggctcagatcacccagcgcaagttggaggcggcccgtgcggcggagcagctgagagcctacctggagggcacgtgcgtggagtggctccgcagatacctggagaacgggaaggagacgctgcagcgcgcagaacccccaaagacacacgtgacccaccaccccctctctgaccatgaggccaccctgaggtgctgggccctgggcttctaccctgcggagatcacactgacctggcagcgggatggggaggaccagacccaggacaccgagcttgtggagaccaggccagcaggagatggaaccttccagaagtgggcagctgtggtggtgccttctggacaagagcagagatacacgtgccatatgcagcacgaggggctgcaagagcccctcaccctgagctgggagccatcttcccagcccaccatccccatcatgggcatcgttgctggcctggctgtcctggttgtcctagctgtccttggagctgtggtcaccgctatgatgtgtaggaggaagagctcaggtggaaaaggagggagctgctctcaggctgcgtgcagcaacagtgcccagggctctgatgagtctctcatcacttgtaaagcctgagacagctgcctgtgtgggactgagatgcaggatttcttcacacctctcctttgtgacttcaagagcctctggcatctctttctgcaaaggcgtctgaatgtgtctgcgttcctgttagcataatgtgaggaggtggagagacagcccacccccgtgtccaccgtgacccctgtccccacactgacctgtgttccctccccgatcatctttcctgttccagagaggtggggctggatgtctccatctctgtctcaaattcatggtgcactgagctgcaacttcttacttccctaatgaagttaagaacctgaatataaatttgtgttctcaaatatttgctatgaagcgttgatggattaattaaataagtcaattcctagaagttgagagagcaaataaagacctgagaaccttccagaa

SEQ ID NO: 732 - DNA, 1536 bp, Homo sapiens
cccacccggactcggattctccccagacgccgagatgcgggtcatggcgccccgaaccctcatcctgctgctctcgggagccctggccctgaccgagacctgggcctgctcccactccatgaggtatttcgacaccgccgtgtcccggcccggccgcggagagccccgcttcatctcagtgggctacgtggacgacacgcagttcgtgcggttcgacagcgacgccgcgagtccgagaggggagccccgggcgccgtgggtggagcaggaggggccggagtattgggaccgggagacacagaagtacaagcgccaggcacaggctgaccgagtgaacctgcggaaactgcgcggctactacaaccagagcgaggacgtggatgtatggctgcgacctggggcccgacgggcgcctcctccgcgggtatgaccagtccgcctacgacggcaaggattacatcgccctgaacgaggacctgcgctcctggaccgccgcggacacggcggctcagatcacccagcgcaagtgggaggcggcccgtgaggcggagcagtggagagcctacctggagggcacgtgcgtggagtggctccgcagatacctggagaacgggaaggagacgctgcagcgcgcggaacacccaaagacacacgtgacccaccatcccgtctctgaccatgaggccaccctgaggtgctgggccctgggcttctaccctgcggagatcacactgacctggcagcgggatggcgaggaccaaactcaggacaccgagcttgtggagaccaggccagcaggagatggaaccttccagaagtgggcagctgtggtggtgccttctggagaagagcagagatacacgtgccatgtgcagcacgaggggctgccagagcccctcaccctgagatgggagccatcttcccagcccaccatccccatcgtgggcatcgttgctggcctggctgtcctggctgtcctagctgtcctaggagctgtgatggctgttgtgatgtgtaggaggaagagctcaggtggaaaaggagggagctgctctcaggctgcgtccagcaacagtgcccagggctctgatgagtctctcatcgcttgtaaagcctgagacagctgcctgtgtgggactgagatgcaggatttcttcacacctctcctttgtgacttcaagagcctctggcatctctttctgcaaaggcatctgaatgtgtctgcgttcctgttagcataatgtgaggaggtggagagacagcccacccccgtgtccaccgtgacccctgtccccacactgacctgtgttccctccccgatcatctttcctgttccagagaagtgggctggatgtctccatctctgtctcaactttacgtgtactgagctgcaacttcttacttccctactgaaaataagaatctgaatataaatttgttttctcaaatatttgctatgagaggttgatggattaattaaataagtcaattcctggaagttgagagagcaaataaagacctgagaaccttccagaa

SEQ ID NO: 733 - DNA, 1536 bp, Homo sapiens; identical to SEQ ID NO: 730

SEQ ID NO: 734 - DNA, 1536 bp, Homo sapiens
cccacccggactcggattctccccagacgccgagatgcgggtcatggcgccccgaaccctcatcctgctgctctcgggagccctggccctgaccgagacctgggcctgctcccactccatgaggtatttctacaccgccgtgtcccggcccggccgcggagagccccgcttcatcgcagtgggctacgtggacgacacgcagttcgtgcggttcgacagcgacgccgcgagtccaagaggggagccgcgggcgccgtgggtggagcaggaggggccggagtattgggaccgggagacacagaagtacaagcgccaggcacagactgaccgagtgagcctgcggaacctgcgcggctactacaaccagagcgaggccgtggatgtatggctgcgacctggggcccgacgggcgcctcctccgcgggtatgaccagtccgcctacgacggcaaggattacatcgccctgaacgaggacctgcgctcctggaccgccgcggacacggcggctcagatcacccagcgcaagtgggaggcggcccgtgcggcggagcagcagagagcctacctggagggcacgtgcgtggagtggctccgcagatacctggagaacgggaaggagacgctgcagcgcgcggaacacccaaagacacacgtgacccaccatctcgtctctgaccatgaggccaccctgaggtgctgggccctgggcttctaccctgcggagatcacactgacctggcagcgggatggcgaggaccaaactcaggacaccgagcttgtggagaccaggccagcaggagatggaaccttccagaagtgggcagctgtggtggtgccttctggagaagagcagagatacacgtgccatgtgcagcacgaggggctgccggagcccctcaccctgagatgggagccatcttcccagcccaccatccccatcgtgggcatcgttgctggcctggctgtcctggctgtcctagctgtcctaggagctgtggtggctgttgttatgtgtaggaggaagagctcaggtggaaaaggagggagctgctctcaggctgcgtccagcaacagtgcccagggctctgatgagtctctcatcgcttgtaaagcctgagacagctgcctgtgtgggactgagatgcaggatttcttcacacctctcctttgtgacttcaagagcctctggcatctctttctgcaaaggcatctgaatgcgtctgcgttcctgttagcataatgtgaggaggtggagagacagcccacccccgtgtccaccgtgacccctgtccccacactgacctgtgttccctccccgatcatctttcctgttccagagaagtgggctggatgtctccatctctgtctcaactttacgtgtactgagctgcaacttcttacttccctactgaaaataagaatctgaatataaatttgttttctcaaatatttgctatgagaggttgatggattaattaaataagtcaatccctggaagttgagagagcaaataaagacctgagaaccttccagaa

SEQ ID NO: 735 - DNA, 1537 bp, Homo sapiens
cccacccggactcagattctccccagacgccgagatgcgggtcatggcgccccgaaccctcatcctgctgctctcgggagccctggccctgaccgagacctgggccggctcccactccatgaggtatttctacaccgctgtgtcccggcccggccgcggggagccccacttcatcgcagtgggctacgtggacgacacgcagttcgtgcggttcgacagcgacgccgcgagtccgagaggggagccgcgggcgccgtgggtggagcaggaggggccggagtattgggaccgggagacacagaagtacaagcgccaggcacagactgaccgagtgagcctgcggaacctgcgcggctactacaaccagagcgaggccgaggatgtatggctgcgacgtggggcccgacgggcgcctcctccgcgggtatgaccagtacgcctacgacggcaaggattacatcgccctgaacgaggatctgcgctcctggaccgccgcggacacggcggctcagatcacccagcgcaagtgggaggcggcccgtgaggcggagcagctgagagcctacctggagggcctgtgcgtggagtggctccgcagatacctgaagaatgggaaggagacgctgcagcgcgcggaacacccaaagacacacgtgacccaccatcccgtctctgaccatgaggccaccctgaggtgctgggccctgggcttctaccctgcggagatcacactgacctggcagtgggatggggaggaccaaactcaggacactgagcttgtggagaccaggccagcaggagatggaaccttccagaagtgggcagctgtggtggtgccttctggagaagagcagagatacacgtgccatgtgcagcacgaggggctgccggagcccctcaccctgagatgggagccgtcttcccagcccaccatccccatcgtgggcatcgttgctggcctggctgtcctggctgtcctagctgtcctaggagctgtggtggctgttgtgatgtgtaggaggaagagctcaggtggaaaaggagggagctgctctcaggctgcgtccagcaacagtgcccagggctctgatgagtctctcatcgcttgtaaagcctgagacagctgcctgtgtgggactgagatgcaggatttcttcacacctctcctttgtgacttcaagagcctctggcatctctttctgcaaaggcatctgaatgtgtctgcgttcctgttagcataatgtgaggaggtggagagacagcccacccccgtgtccaccgtgacccctgtccccacactgacctgtgttccctccccgatcatctttcctgttccagagaagtgggctggatgtctccatctctgtctcaacttcatggtgcgctgagctgcaacttcttacttccctaatgaagttaggaacctgaatataaatttgttttctcaaatatttgctatgaagggttgatggattaattaaataagtcaattcctggaagttgagagagcaaataaagacctgagaactttccagaa

SEQ ID NO: 736 - DNA, 1630 bp, Homo sapiens
atgcgggtcatggcgccccgagccctcctcctgctgctctcgggaggcctggccctgaccgagacctgggcctgtgagtgcggggttgggagggaagcggcctctgcggagaggagcgaggggccccccggggagccgcgcagggaggtgggtcgggcgggtctcagcccctcctcgcccccaggctcccactccatgaggtatttcgacaccgccgtgtcccggcccggccgcggagagccccgcttcatctcagtgggctacgtggacgacacgcagttcgtgcggttcgacagcgacgccgcgagtccgagaggggagccgcgggcgccgtgggtggagcaggaggggccggagtattgggaccgggagacacagaagtacaagcgccaggcacaggctgaccgagtgagcctgcggaacctgcgcggctactacaaccagagcgaggacgggtctcacaccctccagaggatgtctggctgcgacctggggcccgacgggcgcctcctccgcgggtatgaccagtccgcctacgacggcaaggattacatcgccctgaacgaggacctgcgctcctggaccgccgcggacaccgcggctcagatcacccagcgcaagttggaggcggcccgtgcggcggagcagctgagagcctacctggagggcacgtgcgtggagtggctccgcagatacctggagaacgggaaggagacgctgcagcgcgcagaacccccaaagacacacgtgacccaccaccccctctctgaccatgaggccaccctgaggtgctgggccctgggcttctaccctgcggagatcacactgacctggcagcgggatggggaggaccagacccaggacaccgagcttgtggagaccaggccagcaggagatggaaccttccagaagtgggcagctgtggtggtgccttctggacaagagcagagatacacgtgccatatgcagcacgaggggctgcaagagcccctcaccctgagctgggagccatcttcccagcccaccatccccatcatgggcatcgttgctggcctggctgtcctggttgtcctagctgtccttggagctgtggtcaccgctatgatgtgtaggaggaagagctcaggtggaaaaggagggagctgctctcaggctgcgtgcagcaacagtgcccagggctctgatgagtctctcatcacttgtaaagcctgagacagctgcctgtgtgggactgagatgcaggatttcttcacacctctcctttgtgacttcaagagcctctggcatctctttctgcaaaggcacctgaatgtgtctgcgttcctgttagcataatgtgaggaggtggagagacagcccacccccgtgtccaccgtgacccctgtccccacactgacctgtgttccctccccgatcatctttcctgttccagagaggtggggctggatgtctccatctctgtctcaaattcatggtgcactgagctgcaacttcttacttccctaatgaagttaagaacctgaatataaatttgtgttctcaaatatttgctatgaagcgttgatggattaattaaataagtcaattcctagaagttgagagagcaaataaagacctgagaaccttccag

SEQ ID NO: 737 - DNA, 1630 bp, Homo sapiens
atgcgggtcatggcgccccgagccctcctcctgctgctctcgggaggcctggccctgaccgagacctgggcctgtgagtgcggggttgggagggaagcggcctctgcggagaggagcgaggggccccccggggagccgcgcagggaggtgggtcgggcgggtctcagcccctcctcgcccccaggctcccactccatgaggtatttcgacaccgccgtgtcccggcccggccgcggagagccccgcttcatctcagtgggctacgtggacgacacgcagttcgtgcggttcgacagcgacgccgcgagtccgagaggggagccgcgggcgccgtgggtggagcaggaggggccggagtattgggaccgggagacacagaactacaagcgccaggcacaggctgaccgagtgagcctgcggaacctgcgcggctactacaaccagagcgaggacgggtctcacaccctccagaggatgtatggctgcgacctggggcccgacgggcgcctcctccgcgggtatgaccagtccgcctacgacggcaaggattacatcgccctgaacgaggacctgcgctcctggaccgccgcggacaccgcggctcagatcacccagcgcaagttggaggcggcccgtgcggcggagcagctgagagcctacctggagggcacgtgcgtggagtggctccgcagatacctggagaacgggaaggagacgctgcagcgcgcagaacccccaaagacacacgtgacccaccaccccctctctgaccatgaggccaccctgaggtgctgggccctgggcttctaccctgcggagatcacactgacctggcagcgggatggggaggaccagacccaggacaccgagcttgtggagaccaggccagcaggagatggaaccttccagaagtgggcagctgtggtggtgccttctggacaagagcagagatacacgtgccatatgcagcacgaggggctgcaagagcccctcaccctgagctgggagccatcttcccagcccaccatccccatcatgggcatcgttgctggcctggctgtcctggttgtcctagctgtccttggagctgtggtcaccgctatgatgtgtaggaggaagagctcaggtggaaaaggagggagctgctctcaggctgcgtgcagcaacagtgcccagggctctgatgagtctctcatcacttgtaaagcctgagacagctgcctgtgtgggactgagatgcaggatttcttcacacctctcctttgtgacttcaagagcctctggcatctctttctgcaaaggcgtctgaatgtgtctgcgttcctgttagcataatgtgaggaggtggagagacagcccacccccgtgtccaccgtgacccctgtccccacactgacctgtgttccctccccgatcatctttcctgttccagagaggtggggctggatgtctccatctctgtctcaaattcatggtgcactgagctgcaacttcttacttccctaatgaagttaagaacctgaatataaatttgtgttctcaaatatttgctatgaagcgttgatggattaattaaataagtcaattcctagaagttgagagagcaaataaagacctgagaaccttccag

SEQ ID NO: 738 - DNA, 1400 bp, Homo sapiens
ccgagatgcgggtcatggcgccccgaaccctcatcctgctgctctcgggagccctggccctgaccgagacctgggcctgctcccactccatgaggtatttctacaccgccgtgtcccggcccggccgcggagagccccgcttcatcgcagtgggctacgtggacgacacgcagttcgtgcggttcgacagcgacgccgcgagtccaagaggggagccgcgggcgccgtgggtggagcaggaggggccggagtattgggaccgggagacacagaagtacaagcgccaggcacagactgaccgagtgagcctgcggaacctgcgcggctactacaaccagagcgaggccgggtctcacaccctccagtggatgtatggctgcgacctggggcccgacgggcgcctcctccgcgggtatgaccagtccgcctacgacggcaaggattacatcgccctgaacgaggacctgcgctcctggaccgccgcggacacggcggctcagatcacccagcgcaagtgggaggcggcccgtgcggcggagcagcagagagcctacctggagggcacgtgcgtggagtggctccgcagatacctggagaacgggaaggagacgctgcagcgcgcggaacacccaaagacacacgtgacccaccatctcgtctctgaccatgaggccaccctgaggtgctgggccctgggcttctaccctgcggagatcacactgacctggcagcgggatggcgaggaccaaactcaggacaccgagcttgtggagaccaggccagcaggagatggaaccttccagaagtgggcagctgtggtggtgccttctggagaagagcagagatacacgtgccatgtgcagcacgaggggctgccggagcccctcaccctgagatggggtggaaaaggagggagctgctctcaggctgcgtccagcaacagtgcccagggctctgatgagtctctcatcgcttgtaaagcctgagacagctgcctgtgtgggactgagatgcaggatttcttcacacctctcctttgtgacttcaagagcctctggcatctctttctgcaaaggcatctgaatgcgtctgcgttcctgttagcataatgtgaggaggtggagagacagcccacccccgtgtccaccgtgacccctgtccccacactgacctgtgttccctccccgatcatctttcctgttccagagaagtgggctggatgtctccatctctgtctcaactttacgtgtactgagctgcaacttcttacttccctactgaaaataagaatctgaatataaatttgttttctcaaatatttgctatgagaggttgatggattaattaaataagtcaatccctggaagttgagagagcaaataaagacctgagaaccttcc

SEQ ID NO: 739 - DNA, 4250 bp, Homo sapiens
cgcggggtgggctggagaggtttcctgccgtctgggaagcgtaaacggaccgcccacctgtcgggcctcggccgcccgcacctgcttgtgagaagcctgcggctggggcaccgcccccggtccccgcccgggtccgcgcattgggagcacactggccctttaagagcgcggcggccgcggcgcgcggggaggagggctgggagcgcccggagccgcgctgaactcgccggggacgtcgggcgcccgctccttggctggctcgcttgctctctcgctcgctctctcgggtcggctccctgcgcctcctcccgggactgcttggggacccgggcccggtcgggcgcggcggcgagcagaatccccgtgcaggaggcgcgcgctccgggcagcgcccggccccgggcatggacagagggagctgggcgcgcagggagcgccgcgggaccgggcggccggagcgctgagccagacaaaggctccggagttgcgcttgctctcgggagccgggccccaggcgctgggcgccgaggctgcggaacctcgccgggggcagctccggtcggccccctttcccgccggctggttccgagctcccggacctgccctgcccgcttctcctcgggcttgggaatttgccgaggcgacctaggcggctccggcggggaccgggagcccgaggtccgcggcgcgcctgccgggccaggagccagggagcgtcgcaagtttccaaggcgcgtgcgaggatccggcgtgcagtgttccgagctgggctgggcgccgagagcatgggcagcgacccgagcgcgcccggacggccgggctggacgggcagcctcctcggcgaccgggaggaggcggcgcggccgcgactgctgccgctgctcctggtgcttctgggctgcctgggccttggcgtagcggccgaagacgcggaggtccatgccgagaactggctgcggctttatggctacctgcctcagcccagccgccatatgtccaccatgcgttccgcccagatcttggcctcggcccttgcagagatgcagcgcttctacgggatcccagtcaccggtgtgctcgacgaagagaccaaggagtggatgaagcggccccgctgtggggtgccagaccagttcggggtacgagtgaaagccaacctgcggcggcgtcggaagcgctacgccctcaccgggaggaagtggaacaaccaccatctgacctttagcatccagaactacacggagaagttgggctggtaccactcgatggaggcggtgcgcagggccttccgcgtgtgggagcaggccacgcccctggtcttccaggaggtgccctatgaggacatccggctgcggcgacagaaggaggccgacatcatggtactctttgcctctggcttccacggcgacagctcgccgtttgatggcaccggtggctttctggcccacgcctatttccctggccccggcctaggcggggacacccattttgacgcagatgagccctggaccttctccagcactgacctgcatggaaacaacctcttcctggtggcagtgcatgagctgggccacgcgctggggctggagcactccagcaaccccaatgccatcatggcgccgttctaccagtggaaggacgttgacaacttcaagctgcccgaggacgatctccgtggcatccagcagctctacggtaccccagacggtcagccacagcctacccagcctctccccactgtgacgccacggcggccaggccggcctgaccaccggccgccccggcctccccagccaccacccccaggtgggaagccagagcggcccccaaagccgggccccccagtccagccccgagccacagagcggcccgaccagtatggccccaacatctgcgacggggactttgacacagtggccatgcttcgcggggagatgttcgtgttcaagggccgctggttctggcgagtccggcacaaccgcgtcctggacaactatcccatgcccatcgggcacttctggcgtggtctgcccggtgacatcagtgctgcctacgagcgccaagacggtcgttttgtctttttcaaaggtgaccgctactggctctttcgagaagcgaacctggagcccggctacccacagccgctgaccagctatggcctgggcatcccctatgaccgcattgacacggccatctggtgggagcccacaggccacaccttcttcttccaagaggacaggtactggcgcttcaacgaggagacacagcgtggagaccctgggtaccccaagcccatcagtgtctggcaggggatccctgcctcccctaaaggggccttcctgagcaatgacgcagcctacacctacttctacaagggcaccaaatactggaaattcgacaatgagcgcctgcggatggagcccggctaccccaagtccatcctgcgggacttcatgggctgccaggagcacgtggagccaggcccccgatggcccgacgtggcccggccgcccttcaacccccacgggggtgcagagcccggggcggacagcgcagagggcgacgtgggggatggggatggggactttggggccggggtcaacaaggacgggggcagccgcgtggtggtgcagatggaggaggtggcacggacggtgaacgtggtgatggtgctggtgccactgctgctgctgctctgcgtcctgggcctcacctacgcgctggtgcagatgcagcgcaagggtgcgccacgtgtcctgctttactgcaagcgctcgctgcaggagtgggtctgaccacccagcgctcctgctaacggtgctcagggggcgcctgtggttctgagatggctcccaggggctccctccgcccccaggtaggggcccctctcagccctcacacaccctgtctgccccgccctcattatttatgtccaggtgtttgttttgttttgtttttggcaccttacttgaccatttgtttctgtttccccgactggggcagggtgtttagaattttctaaatgtagttctgctccagacagggaattaggcccccatcatcctctggcttggccacagccaggggagcagaggggcagaggcccacattggaagagcagcacctcctcagcctgaaccccagggctgtaactgccaggctctctttgcccagttggagactgtctggcccccctggtcccctccttcccaagtgagtctctctgggccttaggaagagccttccacccaggggcagccccaggccaaaggggacctggaagggaggtgggccgtggcccttgagtccccattgaggcttggttccttcccaatccagtggacttcgcagtccacttctgacagcctcagtgaccctggctccttgtgccagagaacccagcccacccccggcagcagcccccagctcccacctccccttgggcccacacctccttccctctctggagaaagggccctgggcctgcctcaccacggaccaaagggagtctgccagggcccctctccccagggaagcagcagcctcgcccctggcagagatgcctccctgagctagaaccctctgttccttccctgtgcctcctccctccctctccgactcacaccactagcctcaggggtctgagctccagctcctttgggcttcagctgccagtgtcctgagccccagggagagggggctggtgggtgcctaggcctgggcagtggatggccgtgaatgggtgcccacagtgtcaggcactgggcatgaggggttcctcccctccagctccctgtgcccccagggtcctgggaggagagacactggtggggataggccagccgcgcatcagactgtgaaccccacgaaggagcccattgtggcctaagaggctgccctcctgtgctcagccctgaggacagatgcctccttcctcttttccttcccaaagcaagcaagaggccgtggctgctgtgggaaatggtactgtacagctggctctacttccccatggccctgagcgagtggagtctgccacccaggatccccaaggcacttgagggggaaggattctgctggcctctgcgagtggtttcttgtgcactggcaccaagtgcgggtccggcagcttctgccccctgcagaaccggagagccagctaaggggtggggctgcgggggttccgtgtccacccccatacatttatttctgtaaataatgtgcactgaataaattgtacagccggcaaa

SEQ ID NO: 740 - DNA, 11558 bp, Homo sapiens
tctttgagccggaaccgccggtgaacttaggcgccacgttcccggtgactgaccccggaggatggtgaacaggaactactgctgaccctgtcttcgccgctgcctctcgggggctgccgagcgcggggcccctgtctcctccccttgcccggctgtgggtgaacctgcaggctccttacccacccggaggacttttttttgaaaggaaacgagggagggagggagagggagagagggagaaaacgaaggggagctcgtccatccattgaagcacagttcactatgatcttactcacattcagcactggaagacggttggatttcgtgcatcattcgggggtgtttttcttgcaaaccttgctttggattttatgtgctacagtctgcggaacggagcagtatttcaatgtggaggtttggttacaaaagtacggctaccttccaccgactgaccccagaatgtcagtgctgcgctctgcagagaccatgcagtctgccctagctgccatgcagcagttctatggcattaacatgacaggaaaagtggacagaaacacaattgactggatgaagaagccccgatgcggtgtacctgaccagacaagaggtagctccaaatttcatattcgtcgaaagcgatatgcattgacaggacagaaatggcagcacaagcacatcacttacagtataaagaacgtaactccaaaagtaggagaccctgagactcgtaaagctattcgccgtgcctttgatgtgtggcagaatgtaactcctctgacatttgaagaagttccctacagtgaattagaaaatggcaaacgtgatgtggatataaccattatttttgcatctggtttccatggggacagctctccctttgatggagagggaggatttttggcacatgcctacttccctggaccaggaattggaggagatacccattttgactcagatgagccatggacactaggaaatcctaatcatgatggaaatgacttatttcttgtagcagtccatgaactgggacatgctctgggattggagcattccaatgaccccactgccatcatggctccattttaccagtacatggaaacagacaacttcaaactacctaatgatgatttacagggcatccagaagatatatggtccacctgacaagattcctccacctacaagacctctaccgacagtgcccccacaccgctctattcctccggctgacccaaggaaaaatgacaggccaaaacctcctcggcctccaaccggcagaccctcctatcccggagccaaacccaacatctgtgatgggaactttaacactctagctattcttcgtcgtgagatgtttgttttcaaggaccagtggttttggcgagtgagaaacaacagggtgatggatggatacccaatgcaaattacttacttctggcggggcttgcctcctagtatcgatgcagtttatgaaaatagcgacgggaattttgtgttctttaaaggtaacaaatattgggtgttcaaggatacaactcttcaacctggttaccctcatgacttgataacccttggaagtggaattccccctcatggtattgattcagccatttggtgggaggacgtcgggaaaacctatttcttcaagggagacagatattggagatatagtgaagaaatgaaaacaatggaccctggctatcccaagccaatcacagtctggaaagggatccctgaatctcctcagggagcatttgtacacaaagaaaatggctttacgtatttctacaaaggaaaggagtattggaaattcaacaaccagatactcaaggtagaacctggatatccaagatccatcctcaaggattttatgggctgtgatggaccaacagacagagttaaagaaggacacagcccaccagatgatgtagacattgtcatcaaactggacaacacagccagcactgtgaaagccatagctattgtcattccctgcatcttggccttatgcctccttgtattggtttacactgtgttccagttcaagaggaaaggaacaccccgccacatactgtactgtaaacgctctatgcaagagtgggtgtgatgtagggttttttcttctttctttcttttgcaggagtttgtggtaacttgagattcaagacaagagctgttatgctgtttcctagctaggagcaggcttgtggcagcctgattcggggctgacctttcaaacccagagggttgctggtcctgcacatgagtggaaatacactcatggggaagcttccatgatgcacagtatctgctgttcttcagtcctttgtctttctttgtcattcagttctaggcctttcctctgcacgctcaatgcccagtaaaatttcaggattaactaaagaagaggagaaaaagaagaaaagattcttcttaaaagtttctaatgttattttccttctgaagtctgagcccatttctggggggagaaaaaaaaagcaaatcagaaaacccacggtttttctttttttctttttttctttttttctttttttgctttaaaacaaagggaaaaaagagtttaaacaaaaaacccacaattgaacttccaggaaagtgtgaagacccaaaacagctttgtctccaaagaagatagctctctgactgctttggatagtctcctacgcaccattttgtcaggtgggagatttggaatacacatgcaggacgttagactgttgggacagccattttccaacaaccaaggggccaaaatatctgcaatatagtaacagccttaataatacatccatttttcgttttatacagctgttctcagctatgtcctcagtgtttcatcgcatttatattcatagctattttcaaacacgaccttttaattgtttttgaagtatttctaaaccccttctttccaccttactcctccatcattgtgataatcttcccaagttgtattaggccattgccccaggccttccatgggtctgtcaggaatattcgttacaaagcagagcaagaagcagtatgtctctgaagtggattacagtggcagttattttacaaggatttgtgacactagtaacatacccgtgtaaccctttgagaactatcagaccagctttcagagtcttaggattgtcggtcttgcgatctgataaattatagaactgggcaatggtaaaaacagtcacaagttcaagaagttcaggtttttaaaacagatatcctataatgtcatataatttttaaatgatttacaagactacataaatgtgtttataacaaacagaaatgatgttacttgccaaaatttttctggcaaataaaaaaggtattttattaagattctcataaatctgaaattttatttgaaaaactgataatagcctaagtcttcttttcttttttttaggcatactgaatttctgttttaaaatccattgcatgaaaattcaatttgccttggtatatgcagttagcattgccattttaaaaatgaattaaaacggtgactctgaagttgcatgaatatcctccagtgcattacctattgcatgtccaccatagttctcaaagggttagtgtggcttctggcatttagccgtccatttgatcactgacagagccaagagaccaccaaagcatttcattgttgagtgtaatttgtcctaacagcagtattgtcattttcatgtgacctgcagagcaggtttgtatcaatatttttttcctagagaaaagtcagcaactgacagacctctttattgatttttaggagctgcttcttgcagtgaaaggctttacagccactgggctgtgaacttattagagatggtcagaatgaatgcaccccatgagtcagacattggctttgtgtgaaagccagctttgaggggattagcttttgaaacaatgaacagcttgccttgaacttgattattgatctattgactgtcattaacaacaacttaaacattgtcttctgtgaaaattttccttgaagagtcctgttctatgtctttgccctttgacctttaacttgcaaactggcacaaactgaaggaaatctggtgttgcttctccattggattagttgttctctaaaacctagtaagcatgagctgtttccttagagtggagagagtggtgatggcagatctgcagatggacactttgctctttacatgcacactctgaaaatgccctataggtagaagtgaattttaatttcattttaatataatttcaagtctaaattcatcattttagtacaaattacaaaaactataggaaaaaaaaaacctcaaatacttgaatggccagtgtggcttttatataaagcaggaattttatactagtaaaaatttcttactcatttgctaatacacatttccagatgatttttaatgagtgtaggtatacattcttatttggaaatggatagtttggctgccttgaatttatatttatactcaacgtagcatgaaaattagaatgccttttggttaaactacatgtttatgatttggttggggaaaatattttataattgtgggtggcatgctgcaaagccttgcagattgttatttcttacaacctgagcgtatatagtatgagcctaagaaaaaagaagagtaagaaaagaagaatggctttacagtaaaatatcatacaatgcagacaatattttaagaggatattggagattatgtacgcaagggccaagaaagcaagaaatgagaaccagagtcagccctgtagctttacttcagtgcttccattctagatgatgctgatattataaagagttagtcactgctgctaagcatggaggactatatacataagctcgtttatacagtgtttgcttgtgggagggtttaatccttttagggccttgatgtcaagaaaaaaataactggaaactatattttgctaaagatagaaatgaggaactgtgtcattttgggacatgtgcaaatcattgaggaactccatcaccctgcattgaaaattgatttttttttcctctaaaatgagaaagaaactgaataagcaatctgttgcctctttactcattcatcacaatatcctgattcgtcataaggctatcagtatataagggctagaaaataatcatagcattaagaaggaaggagtctatcattatgcttgaattctggcaaatgtcatgaataagggttgggtcatatttactttaatatgagacaagatttatgtgataagcaaaggcatataaggctgctcttttgaacagaacatttcagttatcaggctgtactattacaagagataagaagacaataaggacaatgtaatcacaaacagtgggattccatttgtttattgtacaccagctactttgtgggtatggttcctgactcctcttctacatgaggtttgggaaaaaagtctcaaaccaaatggaacagtgaaagggaaagtaattcatctagcacataagaatagtgattcaaaaccaatgcagaataaatttccatgggtcaataacataaggtgtcagttcagtgttactagagatatgcaaggcataaaatattttcatcaccccatcactaataacatgaaaagctcagacataggatttcccaaattgaaatgaaaacacattcatgcctgcaaaaataattctccttctgcttcatttctcattactttatctaatataaacacaaatgtaaacaaggtaatggtcttcatgtaaaatgaccatatagttaagaattttagtaaaatattgttgttctgtgtattattaaacaaatgcaatgaagtattaaaatagctgatcagtttgaatttcctgtaaagcagtaattccgcatcagaattgtagataaggttgtgaatttattgactcatttcagaacagtgtctgttgacatggcagtcagagcaggtgaatacagatgctctttctgattgcaaaggttatagagctaaattagacagcattatgtgatactagcaaagacaacttctgttataaatcagagggcaaggcttttctgaatcgatgtgataaattactaagtaatgattaccaaaaataattactaagtaataaaagatacagactggtttactgaaataagcaagtgttacatttaataattacctataatctttttttgttaacacataagcaagtgttacctttaataattacctataatctttttttgttaacacataatttggccatttcatatactgtgtacctattttcattccctctctgtgggtcattaaaaaacacaatgtggtggataagaacattgtccaaacttcactgctagttccaatacatagatgatggtgtgtaaactggattgtaggggtagtcatatttgcaagttctacatgttatgctaatatatctagtatggtacacatacacgcccacactttgtggatcttacagtggaataaatagtgtgtccatattaactaaactcaaagtgctatctgaagaggaatggatgttataagcagacagacagactgagttaaactgagtcatgaaaaaatatatattttaaagtttttggaatcatttccagaaactaataaagggaattatttactggtagtattgagtctgtgagattgtagtatatactgaaacaatcttctggatggtggtaaggtcttttttagcaaacacagtaaagagcttatttcatttctgatgctttcaagggcatattccaaagtatcacagatgtcaaatagaatatgctatataaaccaaaaatgtgcatttcagatgacctattacagcaatctcagccaatatgtaatatcacaaaatgtgtcaagtcaatcatataagaggatctaatcattcggctgtatttcatgtaccttcatgttgttgatatattgtgaccacaggaaataggtgccagagcatatgcagttaagttacaggctccacgttgcctaggagggaatcataactacatcagaaaatttttaacagttatatcttaaaaattagaattttatgtaataaataaagcggcaaccaggaatagcaacgcaacaaatatgaaagctaattattatatttagctttcatatttatataatatgatggaaatggaggaggaaaaatgagtcttttgttaaatataaagacaaactataacactccttgataatacaactggaaattttactttagcaagcataaaatagtggaggaaaaaaatccaacttcaagctctttgcactagtgatgattatgtgatatatcaatgtaatatttagccagtggtcattagatgttactgtgcttaaacacatctgatactcatgcattgccttacaggctaaaaatgtaagaggtaggtgttcagtaacctcaagttggaaagatatataatgttagaatcccctgagacaagccatttccctgaaatagaaatttacctcaatactcatgtaatctaagacacttggcgtagtagcaaagaagttgccttcatgttctagtctcatctaattgtgacctttgtctttcatgtacttctgaaatcattttccactttttccactggtgtgattttgaaacaattctgaaatatttcaggtaagattaataacatccaattacaaatatatgtttcaatattttatacgtatgtctactttgaaagttaaaccaatagtatagaaagcctaagaatgaacactgattggacatactcacagaaattaagggaaaaacacatattgtaaaattcctgtcaatgtttgagtagaatacagaagtacatagcagtcttcaatttttaaacacaattatgggcttataactggacgtgacatgcatcatttattagaacaatattatttatttatactaagtaaggatataagatcacagaagcttagtgttataacggagacttcacagacattcataactaatgttttctaaggcaaataagggcataaaccagaactcatggtcagtgcagagtaagtataaaaagttatgtatgaaagacatttatttatagagatttctgaggattctatgccttttcaacttaaagatgagtgtgtcttagaatttgttttatgcatcattggactggggatgatattcaaatgtgcactcagcgtgtcctcacattaaagggcacattgaacagtataggaaaatacatcataaactagaatgttgtacagattcatataactttcccatgtgctctgctgtagagctgaatttatatgcccttaaaaagggataagaatcaattaaatataaatacggaaatatacttatgttaggtcacttagcttcagagcaagatgtcattaacctttatttcacagagaaaaactggaagaaaagaatggtgaacaagaataaaatgataaactttttggcttatagagatgtttcttgggaattttttccacttgtttttatacatgaaaaaaatatcagtcacaatacagacatttctgtagtatttggtctgtgggtaaactggatcccaggcagaatactttttgacacaggcctttttatacatgctttatatatgatgaagctttggtgagatgtgactgcatggtaggatgcattttcctaggataggatatggtgctgcttgtacttgccaccttttatatgaatgtatgtcgctacattggcctgtcttgccaagacatggttgaatgaagcctggtgtgagctgtctatttgaaaagtcactaggatgcatgtttcatttgccgttacataatgccaatttgaacctgtttcctctatatattaacaatccaattgttaagataaaatatactttgcttgaatgaatgattttggtagtaatatgagcgttatccttaaatcaatgttacaatttttgctattactgaaataccgtcacagaggccacattattggctgtctataccattgcctgagtaaaattaggtttttaggtctttttggcatttacttcttttacagctgatgtggaatcaattattcctttatatgttcataagtacaaaatttcactatcttaattacttccaaacaaacaatttccaagcaagggtatgtgtgcctggtttttctgctcctccaattctaagatcgttatttgtttgccttctgtttctcacccaaaaatacagatggttgggaaagatacatcttattgagttgtcctatgcagtctctgtctatatttgcatttctttctattcctatcttgccttttttttttttttttacacagatttggttttcccttccctttgtgaaaaccagaattgagcagcattgtacatcagagatggtacccaggaaatgtctttgttcctcagtatttttcgtcaaaacttccatgcaaagacagtcccagcaaagttgacatacatcccaacctctctcattggcttttctaactttttatagagctattcccctgagaaaagtgaaatgctgagtatgatgggtattgcctgttgataggatagctaaggaaatttgcttttggagaatgtatcttaaataattatacaggaaagtagtcacagtatagtgttctgtttaaggtacatcatgggtacataaatgcctaaaaccttcatcctttggtctatttctctgtaagtgtaaattacatatatattagaaagagagatagaatcaaagaattaggggtgttacagaggcagctttttgctgccttggttttgactgtatcagcatttctattgcagacctctattttcaggggttttagagactcgaccataaaaatttgtttcaggcttaaaagttttgaaagatttttttaggtatctgattttaaacaaatagatcttgtttttatattataggagggaaataaatggagtttactagttcaattttgcgctaatataacttttaataaacttaactttttaaacaaaaacataaaatctaattagttcatagttggttgatgcttttttaaaagaatcaattattgaccttgagaaacttgcctgcttcatcagtatagtaacctatctttaagatattttaaaacgtgtatacctttattaacattatcttgattccagcggtggatcagtatgataatgcagatttatgacatccatataagctatctggtaatatagatttaggaatatatagtatatatgatacatatatatatatatatttactagatagattaaggagaaaaagctcccataaacttagtttgtcaaataaataccatatatttaaaaaatgcacagacatttatcattcagagtcagaatgagattcaagtaattgcaaagggaagttgtctcttgggtaaacaatacacattttatagcttcttgtgaaactaattttttcctttctatattgtggttatgggaaagtaaaagaattaaaattaatacagactttatttaaataacattaaactgtgaagcagagagaaacgccaggaaattaaatatttaggccattatcttgtggttgtctgacaatacttcacctttcttttaattccccatgatgttttcaattatggagagagtattaaaatctagatttaagtttctgcattgttctcattacactcaacactatttcattaagttcttgataatatgtagtcttctgtgtgcaaggaaagaaataaataacacatttatttgctgaatgagttttaaggtgtgcaagttgtagtgatgtttttcccacacaggattctatacacttataccatcttaaatctggcattttttttttcagatagcttctactgacaaacacaaagcttgtttgtgtgcaaatataaggctaaataaatggtgctaaagtgtattatgactgtcagataaaatcaggcaaaattttgtggtgcttaaattaattttttcattgattttattgatcagtgcattgaacagtgtttattattcacaagttgtcttttattagtaaatcaaggcctcatagcacattgttaaataaagtggttgactagtctatgtaacagctcaccaagctactatctcttttaactccttataatgttgcgtcattaaaggtcaaggggtcatgctattaatctcattgctatagaccattaacatgactgaacttttccacaaagtacttatgtttacaatgctataaccctttgactgctgcggcaacctttaaccacacaaatgtcacaagctagaatcatcagcatggttcttgccatggcaatcaaagagttaagggctgtgcagtgatttgttttgtatttattaatttatatttattttgtttccattcaaggaggggattaggggtggggcagtttttgtctgctgtaagtgtcttaacctagggaagggttaaatggctttttatactattgcatcttctgtatttaccatcaattcattgtgttgtaattaaaagaaactgtcaataaataagagaacagaaaaatg

SEQ ID NO: 741 - DNA, 2411 bp, Homo sapiens
agtccggcgggggcgccgcggagagcggagggcgccgggctgcggaacgcgaagcggagggcgcgggaccctgcacgccgcccgcgggcccatgtgagcgccatgcggcgccgcgcagcccggggacccggcccgccgcccccagggcccggactctcgcggctgccgctgccgctgctgctgctgctggcgctggggacccgcgggggctgcgccgcgcccgcacccgcgccgcgcgccgaggacctcagcctgggagtggagtggctaagcaggttcggttacctgcccccggctgaccccacaacagggcagctgcagacgcaagaggagctgtctaaggccatcacagccatgcagcagtttggtggcctggaggccaccggcatcctggacgaggccaccctggccctgatgaaaaccccacgctgctccctgccagacctccctgtcctgacccaggctcgcaggagacgccaggctccagcccccaccaagtggaacaagaggaacctgtcgtggagggtccggacgttcccacgggactcaccactggggcacgacacggtgcgtgcactcatgtactacgccctcaaggtctggagcgacattgcgcccctgaacttccacgaggtggcgggcagcgccgccgacatccagatcgacttctccaaggccgaccataacgacggctaccccttcgacggccccggcggcaccgtggcccacgccttcttccccggccaccaccacaccgccggggacacccactttgacgatgacgaggcctggaccttccgctcctcggatgcccacgggatggacctgtttgcagtggctgtccacgagtttggccacgccattgggttaagccatgtggccgctgcacactccatcatgcggccgtactaccagggcccggtgggtgacccgctgcgctacgggctcccctacgaggacaaggtgcgcgtctggcagctgtacggtgtgcgggagtctgtgtctcccacggcgcagcccgaggagcctcccctgctgccggagcccccagacaaccggtccagcgccccgcccaggaaggacgtgccccacagatgcagcactcactttgacgcggtggcccagatccggggtgaagctttcttcttcaaaggcaagtacttctggcggctgacgcgggaccggcacctggtgtccctgcagccggcacagatgcaccgcttctggcggggcctgccgctgcacctggacagcgtggacgccgtgtacgagcgcaccagcgaccacaagatcgtcttctttaaaggagacaggtactgggtgttcaaggacaataacgtagaggaaggatacccgcgccccgtctccgacttcagcctcccgcctggcggcatcgacgctgccttctcctgggcccacaatgacaggacttatttctttaaggaccagctgtactggcgctacgatgaccacacgaggcacatggaccccggctaccccgcccagagccccctgtggaggggtgtccccagcacgctggacgacgccatgcgctggtccgacggtgcctcctacttcttccgtggccaggagtactggaaagtgctggatggcgagctggaggtggcacccgggtacccacagtccacggcccgggactggctggtgtgtggagactcacaggccgatggatctgtggctgcgggcgtggacgcggcagaggggccccgcgcccctccaggacaacatgaccagagccgctcggaggacggttacgaggtctgctcatgcacctctggggcatcctctcccccgggggccccaggcccactggtggctgccaccatgctgctgctgctgccgccactgtcaccaggcgccctgtggacagcggcccaggccctgacgctatgacacacagcgcgagcccatgagaggacagaggcggtgggacagcctggccacagagggcaaggactgtgccggagtccctgggggaggtgctggcgcgggatgaggacgggccaccctggcaccggaaggccagcagagggcactgtccgccagggctgggcaggctcaggtggcaaggacggagctgtcccctagtgagggactgtgttgactgacgagccgaggggtggccgctccagaagggtgcccagtcaggccgcaccgccgccagcctcctccggccctggagggagcatctcgggctgggggcccacccctctctgtgccggcgccaccaaccccacccacactgctgcctggtgctcccgccggcccacagggcctccgtccccaggtccccagtggggcagccctccccacagacgagccccccacatggtgccgcggcacgtcccccctgtgacgcgttccagaccaacatgacctctccctgcttt

SEQ ID NO: 742 - DNA, 2301 bp, Homo sapiens
aagagacaagaggtgccttgtgggcagatagggggctgggagggggcctgcccggaagcagtggtggcccgtggcaggcttctcactgggtaggaccgggccctctgttgcaccccctcaccctgctctctgccctcaggagtggctaagcaggttcggttacctgcccccggctgaccccacaacagggcagctgcagacgcaagaggagctgtctaaggccatcacagccatgcagcagtttggtggcctggaggccaccggcatcctggacgaggccaccctggccctgatgaaaaccccacgctgctccctgccagacctccctgtcctgacccaggctcgcaggagacgccaggctccagcccccaccaagtggaacaagaggaacctgtcgtggagggtccggacgttcccacgggactcaccactggggcacgacacggtgcgtgcactcatgtactacgccctcaaggtctggagcgacattgcgcccctgaacttccacgaggtggcgggcagcgccgccgacatccagatcgacttctccaaggccgaccataacgacggctaccccttcgacggccccggcggcaccgtggcccacgccttcttccccggccaccaccacaccgccggggacacccactttgacgatgacgaggcctggaccttccgctcctcggatgcccacgggatggacctgtttgcagtggctgtccacgagtttggccacgccattgggttaagccatgtggccgctgcacactccatcatgcggccgtactaccagggcccggtgggtgacccgctgcgctacgggctcccctacgaggacaaggtgcgcgtctggcagctgtacggtgtgcgggagtctgtgtctcccacggcgcagcccgaggagcctcccctgctgccggagcccccagacaaccggtccagcgccccgcccaggaaggacgtgccccacagatgcagcactcactttgacgcggtggcccagatccggggtgaagctttcttcttcaaaggcaagtacttctggcggctgacgcgggaccggcacctggtgtccctgcagccggcacagatgcaccgcttctggcggggcctgccgctgcacctggacagcgtggacgccgtgtacgagcgcaccagcgaccacaagatcgtcttctttaaaggagacaggtactgggtgttcaaggacaataacgtagaggaaggatacccgcgccccgtctccgacttcagcctcccgcctggcggcatcgacgctgccttctcctgggcccacaatgacaggacttatttctttaaggaccagctgtactggcgctacgatgaccacacgaggcacatggaccccggctaccccgcccagagccccctgtggaggggtgtccccagcacgctggacgacgccatgcgctggtccgacggtgcctcctacttcttccgtggccaggagtactggaaagtgctggatggcgagctggaggtggcacccgggtacccacagtccacggcccgggactggctggtgtgtggagactcacaggccgatggatctgtggctgcgggcgtggacgcggcagaggggccccgcgcccctccaggacaacatgaccagagccgctcggaggacggttacgaggtctgctcatgcacctctggggcatcctctcccccgggggccccaggcccactggtggctgccaccatgctgctgctgctgccgccactgtcaccaggcgccctgtggacagcggcccaggccctgacgctatgacacacagcgcgagcccatgagaggacagaggcggtgggacagcctggccacagagggcaaggactgtgccggagtccctgggggaggtgctggcgcgggatgaggacgggccaccctggcaccggaaggccagcagagggcactgtccgccagggctgggcaggctcaggtggcaaggacggagctgtcccctagtgagggactgtgttgactgacgagccgaggggtggccgctccagaagggtgcccagtcaggccgcaccgccgccagcctcctccggccctggagggagcatctcgggctgggggcccacccctctctgtgccggcgccaccaaccccacccacactgctgcctggtgctcccgccggcccacagggcctccgtccccaggtccccagtggggcagccctccccacagacgagccccccacatggtgccgcggcacgtcccccctgtgacgcgttccagaccaacatgacctctccctgctttctagcggctcgg

SEQ ID NO: 743 - DNA, 552 bp, Homo sapiens
cccggactctcgcggctgccgctgccgctgctgctgctgctggcgctggggacccgcgggggctgcgccgcgcccgcacccgcgccgcgcgccgaggacctcagcctgggagtggagtggctaagcaggttcggttacctgcccccggctgaccccacaacagggcagctgcagacgcaagaggagctgtctaaggccatcacagccatgcagcagtttggtggcctggaggccaccggcatcctggacgaggccaccctggccctgatgaaaaccccacgctgctccctgccagacctccctgtcctgacccaggctcgcaggagacgccaggctccagcccccaccaagtggaacaagaggaacctgtcgtggagggtccggacgttcccacgggactcaccactggggcacgacacggtgcgtgcactcatgtactacgccctcaaggtctggagcgacattgcgcccctgaacttccacgaggtggcgggcagcgccgccgacatccagatcgacttctccaaggccgaccataacgacggctacccc

SEQ ID NO: 744 - DNA, 2229 bp, Homo sapiens
gagcccctctgcctagcactgctcccccaaggctcccagaaatctcaggtcagaggcacggacagcctctggagctctcgtctggtgggaccatgaactgccagcagctgtggctgggcttcctactccccatgacagtctcaggccgggtcctggggcttgcagaggtggcgcctgtggactacctgtcacaatatgggtacctacagaagcctctagaaggatctaataacttcaagccagaagatatcaccgaggctctgagagcttttcaggaagcatctgaacttccagtctcaggtcagctggatgatgccacaagggcccgcatgaggcagcctcgttgtggcctagaggatcccttcaaccagaagacccttaaatacctgttgctgggccgctggagaaagaagcacctgactttccgcatcttgaacctgccctccacccttccaccccacacagcccgggcagccctgcgtcaagccttccaggactggagcaatgtggctcccttgaccttccaagaggtgcaggctggtgcggctgacatccgcctctccttccatggccgccaaagctcgtactgttccaatacttttgatgggcctgggagagtcctggcccatgccgacatcccagagctgggcagtgtgcacttcgacgaagacgagttctggactgaggggacctaccgtggggtgaacctgcgcatcattgcagcccatgaagtgggccatgctctggggcttgggcactcccgatattcccaggccctcatggccccagtctacgagggctaccggccccactttaagctgcacccagatgatgtggcagggatccaggctctctatggcaagaagagtccagtgataagggatgaggaagaagaagagacagagctgcccactgtgcccccagtgcccacagaacccagtcccatgccagacccttgcagtagtgaactggatgccatgatgctggggccccgtgggaagacctatgctttcaagggggactatgtgtggactgtatcagattcaggaccgggccccttgttccgagtgtctgccctttgggaggggctccccggaaacctggatgctgctgtctactcgcctcgaacacaatggattcacttctttaagggagacaaggtgtggcgctacattaatttcaagatgtctcctggcttccccaagaagctgaatagggtagaacctaacctggatgcagctctctattggcctctcaaccaaaaggtgttcctctttaagggctccgggtactggcagtgggacgagctagcccgaactgacttcagcagctaccccaaaccaatcaagggtttgtttacgggagtgccaaaccagccctcggctgctatgagttggcaagatggccgagtctacttcttcaagggcaaagtctactggcgcctcaaccagcagcttcgagtagagaaaggctatcccagaaatatttcccacaactggatgcactgtcgtccccggactatagacactaccccatcaggtgggaataccactccctcaggtacgggcataaccttggataccactctctcagccacagaaaccacgtttgaatactgactgctcacccacagacacaatcttggacattaacccctgaggctccaccacccaccctttcatttcccccccagaagcctaaggcctaatagctgaatgaaatacctgtctgctcagtagaaccttgcaggtgctgtagcaggcgcaagaccgtagatctcaggcctctaacacttccaactccagccaccactttcctgtgcattttcactcctgagaagtgctcccctaactcagatcccctaacttagatttggcccccaactccatttcctgtctgtcttagacagcccttccaactgtgtcatctcttctctggaggtcaatggtggagggagatgcctgggtcctgttcttcctacataaaatgcaagaaaacagcatggccagtaaactgagcaagggccttggaatccttgagaatcacatttatgtgcttatgattacgggcaagctaattaaccttgttgaatctcagattccccatttgcaacattaggttaagaccagtactgcaggattgttgcactaaatgaaatactgtatgtgaagtgcctggcacagtgtctggtacatttgtgtttaataaaagctaactccatgttcataa

SEQ ID NO: 745 - DNA, 2245 bp, Homo sapiens
atgggagtgacatgggacttcagcatgagcaatggagggccccgtgggaagacctatgctttcaagggggactatgtgtggactgtatcagattcaggaccgggccccttgttccgagtgtctgccctttgggaggggctccccggaaacctggatgctgctgtctactcgcctcgaacacaatggattcacttctttaagggagacaaggtgtggcgctacattaatttcaagatgtctcctggcttccccaagaagctgaatagggtagaacctaacctggatgcagctctctattggcctctcaaccaaaaggtgttcctctttaagggctccgggtactggcagtgggacgagctagcccgaactgacttcagcagctaccccaaaccaatcaagggtttgtttacgggagtgccaaaccagccctcggctgctatgagttggcaagatggccgagtctacttcttcaagggcaaagtctactggcgcctcaaccagcagcttcgagtagagaaaggctatcccagaaatatttcccacaactggatgcactgtcgtccccggactatagacactaccccatcaggtgggaataccactccctcaggtacgggcataaccttggataccactctctcagccacagaaaccacgtttgaatactgactgctcacccacagacacaatcttggacattaacccctgaggctccaccacccaccctttcatttcccccccagaagcctaaggcctaatagctgaatgaaatacctgtctgctcagtagaaccttgcaggtgctgtagcaggcgcaagaccgtagatctcaggcctctaacacttccaactccagccaccactttcctgtgcattttcactcctgagaagtgctcccctaactcagatcccctaacttagatttggcccccaactccatttcctgtctgtcttagacagcccttccaactgtgtcatctcttctctggaggtcaatggtggagggagatgcctgggtcctgttcttcctacataaaatgcaagaaaacagcatggccagtaaactgagcaagggccttggaatccttgagaatcacatttatgtgcttatgattacgggcaagctaattaaccttgttgaatctcagattccccatttgcaacattaggttaagaccagtactgcaggattgttgcactaaatgaaatactgtatgtgaagtgcctggcacagtgtctggtacatttgtgtttaataaaagctaactccatgttcataagagaggactgaacagctcttcctctagctgtctggctgtataactcttacagtagtctgtataataagggcatctctattagatctttaggggacagaggatttgtcaagatggttagctctttgttttggggtgcagagaaagaaaagagcagcaacagcagaggctggactccctggttcagtatttaatgccattttattcacatgctcccatgttctccctccctcccattgtagccttgctgcccaggggagggatatgtcttcctttatgcatctgggaaaccaggaacagaccctgcgcaggagagtcagagggggaagagttagaatgggtcagtggctggaacaaagttctggttaaggaggaaattagtgccacccacggtgagaagcagagaaggcacttgcatcctatgcagccctgaagaccaggctcctttgggcaaaaggcaagactctggcaggtgggtcaatgctctctccttggagcaagaagccagcttttggggaaggcaggtcctgaggcaggcactgccctgtggtcttccccaggttgaggagagaagtggaagccccatggaagacagtgctcccagctgaggtaggaggcggaggtgggggtgggggtagtttaagcctatggggcccagggggaaaggccaaacagaaacccaactaccccctaatgaagggcctggaggttggggtatcttggagctcctcagagcccttcttcccatcaaaaaggtatcaaatgccttggaagctccctgatcctacaaaacaaaaaaatgcttatttttaccactgtgaggcaagctgaggtgaacatttaaaaggctatttcaagacgaggtgcggtggctataatcctagcactttgggaggctgaagcaggaggatcacttgagcccaggagttcaagaccagcttgggcaacatagggagaccctgtctctgc

SEQ ID NO: 746 - DNA, 1431 bp, Homo sapiens
agaactgggggtaagagcccctctgcctagcactgctcccccaaggctcccagaaatctcaggtcagaggcacggacagcctctggagctctcgtctggtgggaccatgaactgccagcagctgtggctgggcttcctactccccatgacagtctcaggccgggtcctggggcttgcagaggtggcgcctgtggactacctgtcacaatatgggtacctacagaagcctctagaaggatctaataacttcaagccagaagatatcaccgaggctctgagagcttttcaggaagcatctgaacttccagtctcaggtcagctggatgatgccacaagggcccgcatgaggcagcctcgttgtggcctagaggatcccttcaaccagaagacccttaaatacctgttgctgggccgctggagaaagaagcacctgactttccgcatcttgaacctgccctccacccttccaccccacacagcccgggcagccctgcgtcaagccttccaggactggagcaatgtggctcccttgaccttccaagaggtgcaggctggtgcggctgacatccgcctctccttccatggccgccaaagctcgtactgttccaatacttttgatgggcctggcaagaagagtccagtgataagggatgaggaagaagaagagacagagctgcccactgtgcccccagtgcccacagaacccagtcccatgccagacccttgcagtagtgaactggatgccatgatgctgggtgaggcccctcccctccaggctgttggcaggcggtgggggcagcctgctgatcctgaggcctggacaaatgggagtgacatgggacttcagcatgagcaatggagggccccgtgggaagacctatgctttcaagggggactatgtgtggactgtatcagattcaggaccgggccccttgttccgagtgtctgccctttgggaggggctccccggaaacctggatgctgctgtctactcgcctcgaacacaatggattcacttctttaaggggctccgggtactggcagtgggacgagctagcccgaactgacttcagcagctaccccaaaccaatcaagggtttgtttacgggagtgccaaaccagccctcggctgctatgagttggcaagatggccgagtctacttcttcaagggcaaagtctactggcgcctcaaccagcagcttcgagtagagaaaggctatcccagaaatatttcccacaactggatgcactgtcgtccccggactatagacactaccccatcaggtgggaataccactccctcaggtacgggcataaccttggataccactctctcagccacagaaaccacgtttgaatactgactgctcacccacagacacaatcttggacattaacccctgaggctccaccacccaccctttcatttc

SEQ ID NO: 747 - DNA, 1956 bp, Homo sapiens
ctactgtgaggggatgaaggtgctccctgcatctggccttgctgtcttcctcatcatggctttgaagttttccactgcagccccctccctagttgcagcctcccccaggacctggaggaacaactaccgcctcgcacaggcgtatcttgacaaatattacacaaataaagaaggacaccagattggtgagatggttgcaagaggaagcaattccatgataaggaagattaaggagctacaagcgttctttggcctccaagtcaccgggaagttagaccagaccacaatgaacgtgatcaagaagcctcgctgtggagttcctgatgtggccaattatcgcctcttccctggtgaacccaaatggaaaaaaaatactttgacatacagaatatctaaatacacaccttccatgagttctgtcgaggtggacaaagcagtggagatggccttgcaggcctggagtagcgccgtccctctgagctttgtcagaataaactcaggagaagcggatattatgatatcttttgaaaatggagatcacggggattcctatccattcgatgggcctcgggggactctagcccatgcatttgctcctggagaaggcctgggaggagatacacatttcgacaatgctgagaagtggactatgggaacgaatggttttaatttgtttaccgttgctgctcatgaatttggccatgccctgggcctggcccattccacagacccatcagcactgatgtacccaacttataagtacaagaatccctatggattccacctccccaaagatgatgtgaaagggatccaggcattatacggacctcggaaagtattcctggggaagcccactctgccccatgccccccatcacaagccatccatccctgacctctgtgactccagctcatcctttgacgctgtgacaatgctggggaaggagctcctgctcttcaaggaccggattttctggagacggcaggttcacttgcggacaggaattcggcccagcactattaccagctccttcccccagctcatgtccaatgtggatgcagcttacgaagtggctgagaggggcactgcttacttcttcaaaggtccccactactggataacaagaggattccaaatgcaaggtcctcctcggactatttatgactttggatttccaaggcacgtgcagcaaatagatgctgctgtctacctcagggagccacagaagacccttttctttgtgggagatgaatactacagctacgacgaaaggaaaaggaaaatggaaaaagactatccaaagaatactgaagaagaattttcaggagtaaatggccaaatcgatgctgctgtagaattaaatggctacatttacttcttttcaggaccaaaaacatacaagtatgacacagagaaggaagatgtggttagtgtggtgaaatctagttcctggattggttgctaaatagaaaagcctagtcttctcaagcaatgaggatgactacaagcagcctctaactggatcttaaggactaaagcagaatgtaggagagggattcttccaaaggccttcaaatcaaattagaattcactgagaataataatacttccaatttttttcatagttgtataatcagaatttcaatccacattagaaaagtttttatatgggcaactttatgcgaaatccaaatcaacacaatgcactctgcagttagacaccattattttttcttacctaatatactgaagcagattgatccgtttgatttttatttccaggaggaagactagtggtggattccatgacatatattgtaattcttttcataggaaatgtcattacagtatgaattataattatttacaagcaatggcttttgtggccatcatttggccatcatttgttataataaatataaatttcccaatttttacttaaaagacatcacaaca

SEQ ID NO: 748 - DNA, 1919 bp, Homo sapiens
atgctcgccgcctccatcttccgtccgacactgctgctctgctggctggctgctccctggcccacccagcccgagagtctcttccacagccgggaccgctcggacctggagccgtccccactgcgccaggccaagcccattgccgacctccacgctgctcagcggttcctgtccagatacggctggtcaggggtgtgggcggcctgggggcccagtcccgaggggccgccggagacccccaagggcgccgccctggccgaggcggtgcgcaggttccagcgggcgaacgcgctgccggccagcggggagctggacgcggccaccctagcggccatgaaccggccgcgctgcggggtcccggacatgcgcccaccgcccccctccgccccgccttcgcccccgggcccgccccccagagcccgctccaggcgctccccgcgggcgccgctgtccttgtcccggcggggttggcagccccggggctaccccgacggcggagctgcccaggccttctccaagaggacgctgagctggcggctgctgggcgaggccctgagcagccaactgtccgtggccgaccagcggcgcattgtggcgctggccttcaggatgtggagcgaggtgacgccgctggacttccgcgaggacctggccgcccccggggccgcggtcgacatcaagctgggctttgggagaggccggcacctgggctgtccgcgggccttcgatgggagcgggcaggagtttgcacacgcctggcgcctaggtgacattcactttgacgacgacgagcacttcacacctcccaccagtgacacgggcatcagccttctcaaggtggccgtccatgaaattggccatgtcctgggcttgcctcacacctacaggacgggatccataatgcaaccaaattacattccccaggagcctgcctttgagttggactggtcagacaggaaagcaattcaaaagctgtatggctcctgtgagggatcatttgatactgcgtttgactggattcgcaaagagagaaaccaatatggagaggtgatggtgagatttagcacatatttcttccgtaacagctggtactggctttatgaaaatcgaaacaataggacacgctatggggaccctatccaaatcctcactggctggcctggaatcccaacacacaacatagatgcctttgttcacatctggacatggaaaagagatgaacgttatttttttcaaggaaatcaatactggagatatgacagtgacaaggatcaggccctcacagaagatgaacaaggaaaaagctatcccaaattgatttcagaaggatttcctggcatcccaagtcccctagacacggcgttttatgaccgaagacagaagttaatttacttcttcaaggagtcccttgtatttgcatttgatgtcaacagaaatcgagtacttaattcttatccaaagaggattactgaagtttttccagcagtaataccacaaaatcatcctttcagaaatatagattccgcttattactcctatgcatacaactccattttctttttcaaaggcaatgcatactggaaggtagttaatgacaaggacaaacaacagaattcctggcttcctgctaatggcttatttccaaaaaagtttatttcagagaagtggtttgatgtttgtgacgtccatatctccacactgaacatgtaataagaaaaagtaggaaatggagggtcataggacttcgctaaaattctgatactgtttacaaagaaaaccggattttcagtagctgaagaaaatatggcactgtaagttaaaacccaatgggaaaagccttagttgaacttttaaaatacttgatttaaaaacaattgctcaggcaaaacataattcataaactaaaaggtttaaaaaaa

SEQ ID NO: 749 - DNA, 1326 bp, Homo sapiens
caccgggctgtaacccgagccgccgagccactgcctcccctccggatcctccccggaggctctgcggcccgggcccccgcgccttgctgccccatgcagccctgagccccacagcaagtctgccatgggccgcggggcccgtgtcccctcggaggccccgggggcaggcgtcgagcgccgctggcttggagccgcgctggtcgccctgtgcctcctccccgcgctggtgctgctggcccggctgggggccccggcggtgccggcctggagcgcagcgcagggagacgtcgctgcgctgggcctctcggcggtcccccccacccgggtcccgggcccactggccccccgcagacgccgctacacgctgactccagccaggctgcgctgggaccacttcaacctcacctacaggatcctctccttcccgcggaacctgctgagcccgcgggagacgcggcgggccctagctgccgccttccgcatgtggagcgacgtgtcccccttcagcttccgcgaggtggcccccgagcagcccagcgacctccggataggcttctacccgatcaaccacacggactgcctggtctccgcgctgcaccactgcttcgacggccccacgggggagctggcccacgccttcttccccccgcacggcggcatccacttcgacgacagcgagtactgggtcctgggccccacgcgctacagctggaagaaaggcgtgtggctcacggacctggtgcacgtggcggcccacgagatcggccacgcgctgggcctgatgcactcacaacacggccgggcgctcatgcacctgaacgccacgctgcgcggctggaaggcgttgtcccaggacgagctgtgggggctgcaccggctctacggatgcctcgacaggctgttcgtgtgcgcgtcctgggcgcggaggggcttctgcgacgctcgccggcggctcatgaagaggctctgccccagcagctgcgacttctgctacgaattccccttccccacggtggccaccaccccaccgccccccaggaccaaaaccaggctggtgcccgagggcaggaacgtgaccttccgctgcggccagaagatcctccacaagaaagggaaagtgtactggtacaaggaccaggagcccctggagttctcctaccccggctacctggccctgggcgaggcgcacctgagcatcatcgccaacgccgtcaatgagggcacctacacctgcgtggtgcgccgccagcagcgcgtgctgaccacctactcctggcgagtccgtgtgcggggctgagcccggctgataaagcactttctctctga

SEQ ID NO: 750 - DNA, 1309 bp, Homo sapiens
tgctgccccatgcagccctgagccccacagcaagtctgccatgggccgcggggcccgtgtcccctcggaggccccgggggcaggcgtcgagcgccgctggcttggagccgcgctggtcgccctgtgcctcctccccgcgctggtgctgctggcccggctgggggccccggcggtgccggcctggagcgcagcgcagggagacgtcgctgcgctgggcctctcggcggtcccccccacccgggtcccgggcccactggccccccgcagacgccgctacacgctgactccagccaggctgcgctgggaccacttcaacctcacctacaggatcctctccttcccgcggaacctgctgagcccgcgggagacgcggcgggccctagctgccgccttccgcatgtggagcgacgtgtcccccttcagcttccgcgaggtggcccccgagcagcccagcgacctccggataggtgggcgcccgcccccgccccggcccggccctgcgcgcccggcctctcagccccgtgctccccccaggcttctacccgatcaaccacacggactgcctggtctccgcgctgcaccactgcttcgacggccccacgggggagctggcccacgccttcttccccccgcacggcggcatccacttcgacgacagcgagtactgggtcctgggccccacgcgctacagctggaagaaaggcgtgtggctcacggacctggtgcacgtggcggcccacgagatcggccacgcgctgggcctgatgcactcacaacacggccgggcgctcatgcacctgaacgccacgctgcgcggctggaaggcgttgtcccaggacgagctgtgggggctgcaccggctctacggatgcctcgacaggctgttcgtgtgcgcgtcctgggcgcggaggggcttctgcgacgctcgccggcggctcatgaagaggctctgccccagcagctgcgacttctgctacgaattccccttccccacggtggccaccaccccaccgccccccaggaccaaaaccaggctggtgcccgagggcaggaacgtgaccttccgctgcggccagaagatcctccacaagaaagggaaagtgtactggtacaaggaccaggagcccctggagttctcctaccccggctacctggccctgggcgaggcgcacctgagcatcatcgccaacgccgtcaatgagggcacctacacctgcgtggtgcgccgccagcagcgcgtgctgaccacctactcctggcgagtccgtgtgcggggctgagcccggctgataaagcactttctctctga

SEQ ID NO: 751 - DNA, 1331 bp, Homo sapiens
ctgccccatgcagccctgagccccacagcaagtctgccatgggccgcggggcccgtgtcccctcggaggccccgggggcaggcgtcgagcgccgctggcttggagccgcgctggtcgccctgtgcctcctccccgcgctggtgctgctggcccggctgggggccccggcggtgccggcctggagcgcagcgcagggagacgtcgctgcgctgggcctctcggcggtcccccccacccgggtcccgggcccactggccccccgcagacgccgctacacgctgactccagccaggctgcgctgggaccacttcaacctcacctacaggatcctctccttcccgcggaacctgctgagcccgcgggagacgcggcgggccctagctgccgccttccgcatgtggagcgacgtgtcccccttcagcttccgcgaggtggcccccgagcagcccagcgacctccggataggcttctacccgatcaaccacacggactgcctggtctccgcgctgcaccactgcttcgacggccccacgggggagctggcccacgccttcttccccccgcacggcggcatccacttcgacgacagcgagtactgggtcctgggccccacgcgctacagctggaagaaaggtgaccgtccaggctcctggaggcctctcctctgcagcacagtgggctgccgcggtcgggctttggggcagacggcaggagggaccttccggggtggtggctgccactggagtctagcaggcgtgtggctcacggacctggtgcacgtggcggcccacgagatcggccacgcgctgggcctgatgcactcacaacacggccgggcgctcatgcacctgaacgccacgctgcgcggctggaaggcgttgtcccaggacgagctgtgggggctgcaccggctctacggatgcctcgacaggctgttcgtgtgcgcgtcctgggcgcggaggggcttctgcgacgctcgccggcggctcatgaagaggctctgccccagcagctgcgacttctgctacgaattccccttccccacggtggccaccaccccaccgccccccaggaccaaaaccaggctggtgcccgagggcaggaacgtgaccttccgctgcggccagaagatcctccacaagaaagggaaagtgtactggtacaaggaccaggagcccctggagttctcctaccccggctacctggccctgggcgaggcgcacctgagcatcatcgccaacgccgtcaatgagggcacctacacctgcgtggtgcgccgccagcagcgcgtgctgaccacctactcctggcgagtccgtgtgcggggctga

SEQ ID NO: 752 - DNA, 1531 bp, Homo sapiens
ttgctgccccatgcagccctgagccccacagcaagtctgccatgggccgcggggcccgtgtcccctcggaggccccgggggcaggcgtcgagcgccgctggcttggagccgcgctggtcgccctgtgcctcctccccgcgctggtgctgctggcccggctgggggccccggcggtgccggcctggagcgcagcgcagggagacgtcgctgcgctgggcctctcggcggtcccccccacccgggtcccgggcccactggccccccgcagacgccgctacacgctgactccagccaggctgcgctgggaccacttcaacctcacctacaggatcctctccttcccgcggaacctgctgagcccgcgggagacgcggcgggccctagctgccgccttccgcatgtggagcgacgtgtcccccttcagcttccgcgaggtggcccccgagcagcccagcgacctccggataggcttctacccgatcaaccacacggactgcctggtctccgcgctgcaccactgcttcgacggccccacgggggagctggcccacgccttcttccccccgcacggcggcatccacttcgacgacagcgagtactgggtcctgggccccacgcgctacagctggaagaaaggtgaccgtccaggctggcctcctggaggcctctcctctgcagcacagtgggctgccgcggtcgggctttggggcagacggcaggagggaccttccggggtggtggctgccactggagtctagcaggcaaggaggggagcccgtgggagcccccatcccggcagccctgaactccctttcccatccccctgcgcctctggagcgggagctggagctgcattcctgggggccgagctcaccgcctgggcccagaacattcttatctttccgtggctgcggccgagggcggctccgcggctgcgctccagcagatacaccgggcctcggggagctggcccacgggcggcggggctgggcccggggctcccaggcgctgacccccggggcccgcaggcgtgtggctcacggacctggtgcacgtggcggcccacgagatcggccacgcgctgggcctgatgcactcacaacacggccgggcgctcatgcacctgaacgccacgctgcgcggctggaaggcgttgtcccaggacgagctgtgggggctgcaccggctctacggtgagtccctttgtcgggcgggagggcggggaccgggcggtcctgagccaggccgtgctccccacgctcccgacaggatgcctcgacaggctgttcgtgtgcgcgtcctgggcgcggaggggcttctgcgacgctcgccggcggctcatgaagaggctctgccccagcagctgcgacttctgctacgaattccccttccccacggtggccaccaccccaccgccccccaggaccaaaaccaggctggtgcccgagggcaggaacgtgaccttccgctgcggccagaagatcctccacaagaaagggaaagtgtactggtacaaggaccaggagcccct

SEQ ID NO: 753 - DNA, 4412 bp, Homo sapiens
gcgcggaggcgggggcgcgctggcggccgaggcggcggcggcggcggcgaaggcaggcgggccgggcgcgggccccgccgccgggatgccgaggagccggggcggccgcgccgcgccggggccgccgccgccgccgccgccgccgggccaggccccgcgctggagccgctggcgggtccctgggcggctgctgctgctgctgctgcccgcgctctgctgcctcccgggcgccgcgcgggcggcggcggcggcggcgggggcagggaaccgggcagcggtggcggtggcggtggcgcgggcggacgaggcggaggcgcccttcgccgggcagaactggttaaagtcctatggctatctgcttccctatgactcacgggcatctgcgctgcactcagcgaaggccttgcagtcggcagtctccactatgcagcagttttacgggatcccggtcaccggtgtgttggatcagacaacgatcgagtggatgaagaaaccccgatgtggtgtccctgatcacccccacttaagccgtaggcggagaaacaagcgctatgccctgactggacagaagtggaggcaaaaacacatcacctacagcattcacaactataccccaaaagtgggtgagctagacacgcggaaagctattcgccaggctttcgatgtgtggcagaaggtgaccccactgacctttgaagaggtgccataccatgagatcaaaagtgaccggaaggaggcagacatcatgatcttttttgcttctggtttccatggcgacagctccccatttgatggagaagggggattcctggcccatgcctacttccctggcccagggattggaggagacacccactttgactccgatgagccatggacgctaggaaatgccaaccatgacgggaacgacctcttcctggtggctgtgcatgagctgggccacgcgctgggactggagcactccagcgaccccagcgccatcatggcgcccttctaccagtacatggagacgcacaacttcaagctgccccaggacgatctccagggcatccagaagatctatggacccccagccgagcctctggagcccacaaggccactccctacactccccgtccgcaggatccactcaccatcggagaggaaacacgagcgccagcccaggccccctcggccgcccctcggggaccggccatccacaccaggcaccaaacccaacatctgtgacggcaacttcaacacagtggccctcttccggggcgagatgtttgtctttaaggatcgctggttctggcgtctgcgcaataaccgagtgcaggagggctaccccatgcagatcgagcagttctggaagggcctgcctgcccgcatcgacgcagcctatgaaagggccgatgggagatttgtcttcttcaaaggtgacaagtattgggtgtttaaggaggtgacggtggagcctgggtacccccacagcctgggggagctgggcagctgtttgccccgtgaaggcattgacacagctctgcgctgggaacctgtgggcaagacctactttttcaaaggcgagcggtactggcgctacagcgaggagcggcgggccacggaccctggctaccctaagcccatcaccgtgtggaagggcatcccacaggctccccaaggagccttcatcagcaaggaaggatattacacctatttctacaagggccgggactactggaagtttgacaaccagaaactgagcgtggagccaggctacccgcgcaacatcctgcgtgactggatgggctgcaaccagaaggaggtggagcggcggaaggagcggcggctgccccaggacgacgtggacatcatggtgaccatcaacgatgtgccgggctccgtgaacgccgtggccgtggtcatcccctgcatcctgtccctctgcatcctggtgctggtctacaccatcttccagttcaagaacaagacaggccctcagcctgtcacctactataagcggccagtccaggaatgggtgtgagcagcccagagccctctctatccacttggtctggccagccaggcccttcctcaccagggtctgaggggcagctctggccagtgctcaccagggccagcagggccctaggctggggtcgtacagctgaagtggtgggtgcattggcctaggctgagcgtggggcagggaattatgggggctgtgccccagggtgggtgtctggcacccagctgccagccttctgtcctgggcaaactactccctacttaagggaataggccaggctccatccggaggcagggaccatgccaggaggagcccctgtggtcacggcatcctgtggtgtccatgaggtaccacagctccactcctggctggaacccagcaccctctgtgggaagccagcactagctctcatcccccatccgggagataccaccagtcctggtccccttttgccaacacctgctggtcagatgtccccctacccccaccccactgtcctccaaggctacaggacccctgcttctgacacagtgagcaacaagcctgggtttccctgctggcagacggcagatccctcaggaaacctgctccacttgtcagggtctcttcggagacccaggatttagggtcacatgctgcaggcagggctgtggcccagctgggtctgacaaggacccagctgtcacatcgtgaatatttaaatgtcctgtcactactgtcccattttgcaaaggctgcttgaggctttaggtgaactagaggtgactgtcttggtgatgaggccagcatagcggccctcccccaggcgacaaggaccaaggtgctgctaaggccactctagcgcccagacaccccagtagctgagctctgctcctatggctacagagctggggcagaagctgaccccatttctggaggaagatccgagtttgtgaccgtcctccactcccctctattgtcactgtccccagctttgctccagtctgtcacttgcagcctggagctcagcctcaccagttaggtgaggcagagatggctgcagggccaacactggcagagcctgggagtccttcggaaggggaccagggcgtctgaagtgctcagtgcccccactactctgaggccgactccagctactctgaggccgactcaatctctcggctggaagcagtgttttcccagagcttggcccttgctgacctcgctcactgggcccatcttcccacactgctcttagaaggacacccctaccggtagcagccccaagctgagggggctccctttttgaccttcactggcccgcccttcactgtctccagcaggagttcctagggcttggcctgccttgctccacagtacggcggaggcagccctgcttgtcactgaggagccctagacaaggccaatgggttcatcaatgcccactggctctctgccaaagccaaaaaggtgtcaggcagtctccagcgtgctggccgggtctcggatgccacccctgctcactgagcctgcatgggccttgcccccgaccctgtggtctctgggattggggtcggcttaccctgtagcacagacagggactcctgctgccctgggagctgtctcaagcaaaatctcttgtcccagaggtgcccatgtgggtccgctgtgtcccctgtcatcatccttgttttttctcattttggccaagggcaggctccctgggacaggcagggaacaactgcggagatattagtgattcataggtttgtacagtgttttatactttgcaaagcactttattagctcacacctgtccactcacatgaaactcgtgttaggccctgggaggccgacggtaactctcaccgtgccctcagatgaagcacagagaggttgttacttgcccgggccatccagtgggctggctgggtcttgtgtccccatctgtggacccctctagggtctgagatgagatgagaagtgtctcctgtatccacctcttcctggcctcccttcccccacttcctggtccctgtccactcctcaggttggtgctctcacttcttgaaagctctaggcacccccgcctcccgccaggctccccattggctcctggcaggccagctgagaatgaacaggagatggaggcaggcagcccaggctgcagaggtgagggatgtggggccaggcccagagggctcagcctagaggcttccaatctcagattctcctgcctgtggtcatctgtttgtccatcaccccaggacagggcagacagaggggcaaagcactgggggccccagagcctagcttcccctcagcctgggggacatcacagcatttcagtgtcagtcacattttaaactgatcagcctttgtataatgttttttaaatcatttctaaataaaacagaaatacaga

SEQ ID NO: 754 - DNA, 4174 bp, Homo sapiens
atgccgaggagccggggcggccgcgccgcgccggggccgccgctggcggtggcgcgggcggacgaggcggaggcgcccttcgccgggcagaactggttaaagtcctatggctatctgcttccctatgactcacgggcatctgcgctgcactcagcgaaggccttgcagtcggcagtctccactatgcagcagttttacgggatcccggtcaccggtgtgttggatcagacaacgatcgagtggatgaagaaaccccgatgtggtgtccctgatcacccccacttaagccgtaggcggagaaacaagcgctatgccctgactggacagaagtggaggcaaaaacacatcacctacagcattcacaactataccccaaaagtgggtgagctagacacgcggaaagctattcgccaggctttcgatgtgtggcagaaggtgaccccactgacctttgaagaggtgccataccatgagatcaaaagtgaccggaaggaggcagacatcatgatcttttttgcttctggtttccatggcgacagctccccatttgatggagaagggggattcctggcccatgcctacttccctggcccagggattggaggagacacccactttgactccgatgagccatggacgctaggaaatgccaaccatgacgggaacgacctcttcctggtggctgtgcatgagctgggccacgcgctgggactggagcactccagcgaccccagcgccatcatggcgcccttctaccagtacatggagacgcacaacttcaagctgccccaggacgatctccagggcatccagaagatctatggacccccagccgagcctctggagcccacaaggccactccctacactccccgtccgcaggatccactcaccatcggagaggaaacacgagcgccagcccaggccccctcggccgcccctcggggaccggccatccacaccaggcaccaaacccaacatctgtgacggcaacttcaacacagtggccctcttccggggcgagatgtttgtctttaaggatcgctggttctggcgtctgcgcaataaccgagtgcaggagggctaccccatgcagatcgagcagttctggaagggcctgcctgcccgcatcgacgcagcctatgaaagggccgatgggagatttgtcttcttcaaaggtgacaagtattgggtgtttaaggaggtgacggtggagcctgggtacccccacagcctgggggagctgggcagctgtttgccccgtgaaggcattgacacagctctgcgctgggaacctgtgggcaagacctactttttcaaaggcgagcggtactggcgctacagcgaggagcggcgggccacggaccctggctaccctaagcccatcaccgtgtggaagggcatcccacaggctccccaaggagccttcatcagcaaggaaggatattacacctatttctacaagggccgggactactggaagtttgacaaccagaaactgagcgtggagccaggctacccgcgcaacatcctgcgtgactggatgggctgcaaccagaaggaggtggagcggcggaaggagcggcggctgccccaggacgacgtggacatcatggtgaccatcaacgatgtgccgggctccgtgaacgccgtggccgtggtcatcccctgcatcctgtccctctgcatcctggtgctggtctacaccatcttccagttcaagaacaagacaggccctcagcctgtcacctactataagcggccagtccaggaatgggtgtgagcagcccagagccctctctatccacttggtctggccagccaggcccttcctcaccagggtctgaggggcagctctggccagtgctcaccagggccagcagggccctaggctggggtcgtacagctgaagtggtgggtgcattggcctaggctgagcgtggggcagggaattatgggggctgtgccccagggtgggtgtctggcacccagctgccagccttctgtcctgggcaaactactccctacttaagggaataggccaggctccatccggaggcagggaccatgccaggaggagcccctgtggtcacggcatcctgtggtgtccatgaggtaccacagctccactcctggctggaacccagcaccctctgtgggaagccagcactagctctcatcccccatccgggagataccaccagtcctggtccccttttgccaacacctgctggtcagatgtccccctacccccaccccactgtcctccaaggctacaggacccctgcttctgacacagtgagcaacaagcctgggtttccctgctggcagacggcagatccctcaggaaacctgctccacttgtcagggtctcttcggagacccaggatttagggtcacatgctgcaggcagggctgtggcccagctgggtctgacaaggacccagctgtcacatcgtgaatatttaaatgtcctgtcactactgtcccattttgcaaaggctgcttgaggctttaggtgaactagaggtgactgtcttggtgatgaggccagcatagcggccctcccccaggcgacaaggaccaaggtgctgctaaggccactctagcgcccagacaccccagtagctgagctctgctcctatggctacagagctggggcagaagctgaccccatttctggaggaagatccgagtttgtgaccgtcctccactcccctctattgtcactgtccccagctttgctccagtctgtcacttgcagcctggagctcagcctcaccagttaggtgaggcagagatggctgcagggccaacactggcagagcctgggagtccttcggaaggggaccagggcgtctgaagtgctcagtgcccccactactctgaggccgactccagctactctgaggccgactcaatctctcggctggaagcagtgttttcccagagcttggcccttgctgacctcgctcactgggcccatcttcccacactgctcttagaaggacacccctaccggtagcagccccaagctgagggggctccctttttgaccttcactggcccgcccttcactgtctccagcaggagttcctagggcttggcctgccttgctccacagtacggcggaggcagccctgcttgtcactgaggagccctagacaaggccaatgggttcatcaatgcccactggctctctgccaaagccaaaaaggtgtcaggcagtctccagcgtgctggccgggtctcggatgccacccctgctcactgagcctgcatgggccttgcccccgaccctgtggtctctgggattggggtcggcttaccctgtagcacagacagggactcctgctgccctgggagctgtctcaagcaaaatctcttgtcccagaggtgcccatgtgggtccgctgtgtcccctgtcatcatccttgttttttctcattttggccaagggcaggctccctgggacaggcagggaacaactgcggagatattagtgattcataggtttgtacagtgttttatactttgcaaagcactttattagctcacacctgtccactcacatgaaactcgtgttaggccctgggaggccgacggtaactctcaccgtgccctcagatgaagcacagagaggttgttacttgcccgggccatccagtgggctggctgggtcttgtgtccccatctgtggacccctctagggtctgagatgagatgagaagtgtctcctgtatccacctcttcctggcctcccttcccccacttcctggtccctgtccactcctcaggttggtgctctcacttcttgaaagctctaggcacccccgcctcccgccaggctccccattggctcctggcaggccagctgagaatgaacaggagatggaggcaggcagcccaggctgcagaggtgagggatgtggggccaggcccagagggctcagcctagaggcttccaatctcagattctcctgcctgtggtcatctgtttgtccatcaccccaggacagggcagacagaggggcaaagcactgggggccccagagcctagcttcccctcagcctgggggacatcacagcatttcagtgtcagtcacattttaaactgatcagcctttgtataatgttttttaaatcatttctaaataaaacagaaatacagagtg

SEQ ID NO: 755 - DNA, 631 bp, Homo sapiens
accgccaaatgtctcccgcagacccagggacagtggccaccatgcgtaagccccgctgctccctgcctgacgtgctgggggtggcggggctggtcaggcggcgtcgccggtacgctctgagcggcagcgtgtggaagaagcgaaccctgacatggagggtacgttccttcccccagagctcccagctgagccaggagaccgtgcgggtcctcatgagctatgccctgatggcctggggcatggagtcaggcctcacatttcatgaggtggattccccccagggccaggagcccgacatcctcatcgactttgcccgcgccttccaccaggacagctaccccttcgacgggttggggggcaccctagcccatgccttcttccctggggagcaccccatctccggggacactcactttgacgatgaggagacctggacttttgggtcaaaagcctctcagcagctggagcaggagctggcaggcggctcaccggttgatgaggagctgggcttcagccggggctggcgtgtgaatcctctgggtcctggcagtcctgagcgcctgagctgaatacagagggaagaggctgggagcaaggccgggtgctggggccggcaggctgtgttctgaga

SEQ ID NO: 756 - DNA, 3530 bp, Homo sapiens
gattcccgggcccacccgacccagcggcgcgaccctggccctccgggaccctccgctgactccaccgcgcacttcccgggacccccacacacatcccagccctccggccgatccctccctactcggtgccgggtgccccccgccctctccaggcccggatctcctcccccaggtccccggggcggccccagccaggcccccttcgaaccccgccggcggcccgggctggggcgcaccatgcggctgcggctccggcttctggcgctgctgcttctgctgctggcaccgcccgcgcgcgccccgaagccctcggcgcaggacgtgagcctgggcgtggactggctgactcgctatggttacctgccgccaccccaccctgcccaggcccagctgcagagccctgagaagttgcgcgatgccatcaaagtcatgcagaggttcgcggggctgccggagaccggccgcatggacccagggacagtggccaccatgcgtaagccccgctgctccctgcctgacgtgctgggggtggcggggctggtcaggcggcgtcgccggtacgctctgagcggcagcgtgtggaagaagcgaaccctgacatggagggtacgttccttcccccagagctcccagctgagccaggagaccgtgcgggtcctcatgagctatgccctgatggcctggggcatggagtcaggcctcacatttcatgaggtggattccccccagggccaggagcccgacatcctcatcgactttgcccgcgccttccaccaggacagctaccccttcgacgggttggggggcaccctagcccatgccttcttccctggggagcaccccatctccggggacactcactttgacgatgaggagacctggacttttgggtcaaaagacggcgaggggaccgacctgtttgccgtggctgtccatgagtttggccacgccctgggcctgggccactcctcagcccccaactccattatgaggcccttctaccagggtccggtgggcgaccctgacaagtaccgcctgtctcaggatgaccgcgatggcctgcagcaactctatgggaaggcgccccaaaccccatatgacaagcccacaaggaaacccctggctcctccgccccagcccccggcctcgcccacacacagcccatccttccccatccctgatcgatgtgagggcaattttgacgccatcgccaacatccgaggggaaactttcttcttcaaaggcccctggttctggcgcctccagccctccggacagctggtgtccccgcgacccgcacggctgcaccgcttctgggaggggctgcccgcccaggtgagggtggtgcaggccgcctatgctcggcaccgagacggccgaatcctcctctttagcgggccccagttctgggtgttccaggaccggcagctggagggcggggcgcggccgctcacggagctggggctgcccccgggagaggaggtggacgccgtgttctcgtggccacagaacgggaagacctacctggtccgcggccggcagtactggcgctacgacgaggcggcggcgcgcccggaccccggctaccctcgcgacctgagcctctgggaaggcgcgcccccctcccctgacgatgtcaccgtcagcaacgcaggtgacacctacttcttcaagggcgcccactactggcgcttccccaagaacagcatcaagaccgagccggacgccccccagcccatggggcccaactggctggactgccccgccccgagctctggtccccgcgcccccaggccccccaaagcgacccccgtgtccgaaacctgcgattgtcagtgcgagctcaaccaggccgcaggacgttggcctgctcccatcccgctgctcctcttgcccctgctggtggggggtgtagcctcccgctgatggggggagccatccagaccgaacagcgccctccacggccgagtcccccgccgctggacctggtcgggggttgtgaggcgctgcggaggccccttgtctgttcccacggacgggggctcgggcgcggactaagcaggggggatctcccgcgcaggggcggcggcggcggggaccggtcgcctggcgctgggctcagtctcctcagggtctgagaccccggcgctgccaccggaacccgccttcaggggcgcacgcgcgctgggaccatgcgtcggtcgtcgcccccgtcgttccctcccggctgccgccagggggcggtcggaccccgcctcccgagcccggggaggggcggggaggacaaggggcgggcccgcggcctcacccggagggacggcagccccggtcgcgcgctggccccgcaggaccttccttttccaggaagagccagcttttctcggagcgcagtcctgggactctccgcagccccgccccgcctggccactgcgtctggcattcctgggtcgttagaggacaggcctgactgcgaagctgtgccttgcccctctcccacccgcagtttctcaccccgttctgctcccacaaggcccccctacagtcactgccacactggtggggacctgggacccagacccggaaccagcccagatatcacccctgaggacccatgcgccacgtcctgggtggtggaatcagtggctggagggacgacccttgctctccaggctgttaaccttttccgttgctcccccgccacccacctcctcctccccaggccacccaacttgggcacctccctgggcccagaactgccttccattcaatggggaacccttctatccccaagaaccccttccctgcttgcaccctggagagaacagcttgactcccatcaactcaacgctggtggaaagacagggaccgaaccctggctcaggcctggtcattgcctcctcagcactccctcctgggaggccttagctctagagtgaggggtgggtggaacctgggggcacctcgttcaccctgtccccactccccacagttttaggatctaaatgattgcctctggaactattcttctagactatcccacatcagaatcactgggaaatttaagtttgcagatcccacactcaccctgaatcctcactcagggtggggtcaggaatctgcattttaactagtcgcggggattgtggggggcagtagctggctgtttcgtggcatttctgtggctctgcagtgttcctccaccccaggaccaatatgttcaggccacaccgatggcctgaaccccatgggtagagtcacttaggggccacttcctaagttgctgtccagcctcagtgaccccctagtgcttcctggagctgaggctgtgggcggctgtcccagcaaccatgcgaggggttgccccagttgctcatacaaacagatcagcatgaggacagaaggcaggagactttggtcagttacctgggaattctgggctgccaggaaacgatttgggcctctgtcagtttcttttccatgtatgaggagggggaaatttgtatattagaaacttattcatcccactcagg

SEQ ID NO: 757 - DNA, 989 bp, Homo sapiens
gacaaatgagggtttggcatgcagctcgtcatcttaagagttactatcttcttgccctggtgtttcgccgttccagtgccccctgctgcagaccataaaggatgggactttgttgagggctatttccatcaatttttcctgaccaagaaggagtcgccactccttacccaggagacacaaacacagctcctgcaacaattccatcggaatgggacagacctacttgacatgcagatgcatgctctgctacaccagccccactgtggggtgcctgatgggtccgacacctccatctcgccaggaagatgcaagtggaataagcacactctaacttacaggattatcaattacccacatgatatgaagccatccgcagtgaaagacagtatatataatgcagtttccatctggagcaatgtgacccctttgatattccagcaagtgcagaatggagatgcagacatcaaggtttctttctggcagtgggcccatgaagatggttggccctttgatgggccaggtggtatcttaggccatgcctttttaccaaattctggaaatcctggagttgtccattttgacaagaatgaacactggtcagcttcagacactggatataatctgttcctggttgcaactcatgagattgggcattctttgggcctgcagcactctgggaatcagagctccataatgtaccccacttactggtatcacgaccctagaaccttccagctcagtgccgatgatatccaaaggatccagcatttgtatggagaaaaatgttcatctgacataccttaatgttagcacagaggacttattcaacctgtcctttcagggagtttattggaggatcaaagaactgaaagcactagagcagccttggggactgctaggatgaagccctaaagaatgcaacctagtcaggttagctgaaccgacactcaaaacgctactgagtcacaataaagattgttttaaagagt

SEQ ID NO: 758 - DNA, 1189 bp, Homo sapiens
agtttcttacaaaatcgtcctatccagcatgcacttttggatactctttcaactcagaagtcaacataaagggtatggatgatgacgccactcacagattcaaagaaagggcaaactggcagagtgagtcattggatgttgctggcacagctataaagatccagtggcccaagttgtgtacctgaattcaagcagtgggacaaatgagggtttggcatgcagctcgtcatcttaagagttactatcttcttgccctggtgtttcgccgttccagtgccccctgctgcagaccataaaggatgggactttgttgagggctatttccatcaatttttcctgaccaagaaggagtcgccactccttacccaggagacacaaacacagctcctgcaacaattccatcggaatgggacagacctacttgacatgcagatgcatgctctgctacaccagccccactgtggggtgcctgatgggtccgacacctccatctcgccaggaagatgcaagtggaataagcacactctaacttacaggattatcaattacccacatgatatgaagccatccgcagtgaaagacagtatatataatgcagtttccatctggagcaatgtgacccctttgatattccagcaagtgcagaatggagatgcagacatcaaggtttctttctggcagtgggcccatgaagatggttggccctttgatgggccaggtggtatcttaggccatgcctttttaccaaattctggaaatcctggagttgtccattttgacaagaatgaacactggtcagcttcagacactggatataatctgttcctggttgcaactcatgagattgggcattctttgggcctgcagcactctgggaatcagagctccataatgtaccccacttactggtatcacgaccctagaaccttccagctcagtgccgatgatatccaaaggatccagcatttgtatggagaaaaatgttcatctgacataccttaatgttagcacagaggacttattcaacctgtcctttcagggagtttattggaggatcaaagaactgaaagcactagagcagccttggggactgctaggatgaagccctaaagaatgcaacctagtcaggttagctgaaccgacactcaaaacgctactgagtcacaataaagattgttttaaagagtaa

SEQ ID NO: 759 - DNA, 1913 bp, Homo sapiens
aaatgatgatacaagccaattcatgccacgtctcactattattttctaaattctgtgctaacagaaccggcttcagctgaagaaagagaggaatgaagcgccttctgcttctgtttttgttctttataacattttcttctgcatttcccttagtccggatgacggaaaatgaagaaaatatgcaactggctcaggcatatctcaaccagttctactctcttgaaatagaagggaatcatcttgttcaaagcaagaataggagtctcatagatgacaaaattcgggaaatgcaagcattttttggattgacagtgactggaaaactggactcaaacacccttgagatcatgaagacacccaggtgtggggtgcctgatgtgggccagtatggctacaccctccctgggtggagaaaatacaacctcacctacagaataataaactatactccggatatggcacgagctgctgtggatgaggctatccaagaaggtttagaagtgtggagcaaagtcactccactaaaattcaccaagatttcaaaggggattgcagacatcatgattgcctttaggactcgagtccatggtcggtgtcctcgctattttgatggtcccttgggagtgcttggccatgcctttcctcctggtccgggtctgggtggtgacactcattttgatgaggatgaaaactggaccaaggatggagcaggattcaacttgtttcttgtggctgctcatgaatttggtcatgcactggggctctctcactccaatgatcaaacagccttgatgttcccaaattatgtctccctggatcccagaaaatacccactttctcaggatgatatcaatggaatccagtccatctatggaggtctgcctaaggaacctgctaagccaaaggaacccactataccccatgcctgtgaccctgacttgacttttgacgctatcacaactttccgcagagaagtaatgttctttaaaggcaggcacctatggaggatctattatgatatcacggatgttgagtttgaattaattgcttcattctggccatctctgccagctgatctgcaagctgcatacgagaaccccagagataagattctggtttttaaagatgaaaacttctggatgatcagaggatatgctgtcttgccagattatcccaaatccatccatacattaggttttccaggacgtgtgaagaaaatagatgcagccgtctgtgataagaccacaagaaaaacctacttctttgtgggcatttggtgctggaggtttgatgaaatgacccaaaccatggacaaagggttcccgcagagagtggtaaaacactttcctggaatcagtatccgtgttgatgctgctttccagtacaaaggattcttctttttcagccgtggatcaaagcaatttgaatacgacattaagacaaagaatattacccgaatcatgagaactaatacttggtttcaatgcaaagaaccaaagaactcctcatttggttttgatatcaacaaggaaaaagcacattcaggaggcataaagatattgtatcataagagtttaagcttgtttatttttggtattgttcatttgctgaaaaacacttctatttatcaataaattcatagacctaaaataaacctcaacaggtcttttaatataaattctgcttcaaaatagaataaaaccattctttaacaacaagttgctggtcctagttctaaatatccaaattcaatggccattttgagctgcctgattcttttaataggaagttattatgtagaaacaaaaatctctgactgtactttaagcctatttcatgctttgtggacttggagaagacatgtcttataactgaatactgaaacatttattaaaccaatctttagcattcta

SEQ ID NO: 760 - DNA, 1020 bp, Homo sapiens
tccctcggtccccggggccggcggacccgcgggcaggcactgcccgggctggacgacgtctggccggctcccggcgaagggcagcggaggagcggcccagagcgcgcagctagggcactggcgaaaccccgggacagtccctctccgtgcgggggcggcgcagagcagtcccatccccggggtcccgggcgcggctgactgccggctggttccctgcgcgcagtagctccccgagccgggctgcaccggaggcggcgagatggtcgcgcgcgtcggcctcctgctgcgcgccctgcagctgctactgtggggccacctggacgcccagcccgcggagcgcggaggccaggagctgcgcaaggaggcggaggcattcctagagaagtacggatacctcaatgaacaggtccccaaagctcccacctccactcgattcagcgatgccatcagagcgtttcagtgggtgtcccagctacctgtcagcggcgtgttggaccgcgccaccctgcgccagatgactcgtccccgctgcggggttacagataccaacagttatgcggcctgggctgagaggatcagtgacttgtttgctagacaccggaccaaaatgaggcgtaagaaacgctttgcaaagcaaggtgagcactgttaaaatccggctaggccaagatttcccaatgtcttgaagccaatggctaggaaaacagctgagcctgggactggactttgtcagtaacctctcttccctagggcacgggaggagtgggtgaataggacctcttggcttgaggaccatgattgtgaatacagacatttaattcagaatgacacctacattgatgaattttcattgtacaagtgtttttccagatcaaacacaaaacccatgtaattccttgataaattttcaatgcagggcagataaactgttgctaacatttttcatttatatttactgaagttattttcatcagaattcattctttttcataagttattaaacaaatgtgtgatctattg

SEQ ID NO: 761 - DNA, 2462 bp, Homo sapiens
tccctcggtccccggggccggcggacccgcgggcaggcactgcccgggctggacgacgtctggccggctcccggcgaagggcagcggaggagcggcccagagcgcgcagctagggcactggcgaaaccccgggacagtccctctccgtgcgggggcggcgcagagcagtcccatccccggggtcccgggcgcggctgactgccggctggttccctgcgcgcagtagctccccgagccgggctgcaccggaggcggcgagatggtcgcgcgcgtcggcctcctgctgcgcgccctgcagctgctactgtggggccacctggacgcccagcccgcggagcgcggaggccaggagctgcgcaaggaggcggaggcattcctagagaagtacggatacctcaatgaacaggtccccaaagctcccacctccactcgattcagcgatgccatcagagcgtttcagtgggtgtcccagctacctgtcagcggcgtgttggaccgcgccaccctgcgccagatgactcgtccccgctgcggggttacagataccaacagttatgcggcctgggctgagaggatcagtgacttgtttgctagacaccggaccaaaatgaggcgtaagaaacgctttgcaaagcaaggtaacaaatggtacaagcagcacctctcctaccgcctggtgaactggcctgagcatccggagccggcagttcggggcgccgtgcgcgccgccttccagttgtggagcaacgtctcagcgctggagttctgggaggccccagccacaggccccgctgacatccggctcaccttcttccaaggggaccacaacgatgggctgggcaatgcctttgatggcccagggggcgccctggcgcacgccttcctgccccgccgcggcgaagcgcacttcgaccaagatgagcgctggtccctgagccgccgccgcgggcgcaacctgttcgtggtgctggcgcacgagatcggtcacacgcttggcctcacccactcgcccgcgccgcgcgcgctcatggcgccctactacaagaggctgggccgcgacgcgctgctcagctgggacgacgtgctggccgtgcagagcctgtatgggaagcccctagggggctcagtggccgtccagctcccaggaaagctgttcactgactttgagacctgggactcctacagcccccaaggaaggcgccctgaaacgcagggccctaaatactgccactcttccttcgatgccatcactgtagacaggcaacagcaactgtacatttttaaagggagccatttctgggaggtggcagctgatggcaacgtctcagagccccgtccactgcaggaaagatgggtcgggctgccccccaacattgaggctgcggcagtgtcattgaatgatggagatttctacttcttcaaagggggtcgatgctggaggttccggggccccaagccagtgtggggtctcccacagctgtgccgggcagggggcctgccccgccatcctgacgccgccctcttcttccctcctctgcgccgcctcatcctcttcaagggtgcccgctactacgtgctggcccgagggggactgcaagtggagccctactacccccgaagtctgcaggactggggaggcatccctgaggaggtcagcggcgccctgccgaggcccgatggctccatcatcttcttccgagatgaccgctactggcgcctcgaccaggccaaactgcaggcaaccacctcgggccgctgggccaccgagctgccctggatgggctgctggcatgccaactcggggagcgccctgttctgaaggcacctcctcacctcagaaactggtggtgctctcagggcaaaatcatgttccccacccccggggcagaacccctcttagaagcctctgagtccctctgcagaagaccgggcagcaaagcctccatctggaagtctgtctgcctttgttccttgaagaatgcagcattgtctttgtctgtccccaccacatggaggtgggggtgggatcaatcttaggaaaagcaaaaaagggtcccagatcccttggccctttcctccgaggacttctatcctccccaggcctttgtttcttcggctaaaggtacagttcctttcaagaggtaacagcactgggatccaagcagggggatgaaaaactcagcagagaaattcgagaccattttgcaagactgtgcccttctcctcaggaccccctggctcagttcttgaaaaacggtgtcatatttagtcagaggccccacccccaggaagcatggatggggatgaaggcacaggcgtctccaacctcagaggccctttgtggggtcaggacacagagtgggagggagactgatgcaggcctaccagtccctggctttttgtctggggctggaataaagaggtgccttcagctggtgggccgagaggcaggaagcagcctt

SEQ ID NO: 762 - DNA, 1438 bp, Homo sapiens
tccctcggtccccggggccggcggacccgcgggcaggcactgcccgggctggacgacgtctggccggctcccggcgaagggcagcggaggagcggcccagagcgcgcagctagggcactggcgaaaccccgggacagtccctctccgtgcgggggcggcgcagagcagtcccatccccggggtcccgggcgcggctgactgccggctggttccctgcgcgcagtagctccccgagccgggctgcaccggaggcggcgagatggtcgcgcgcgtcggcctcctgctgcgcgccctgcagctgctactgtggggccacctggacgcccagcccgcggagcgcggaggccaggagctgcgcaaggaggcggaggcattcctagagaagtacggatacctcaatgaacaggtccccaaagctcccacctccactcgattcagcgatgccatcagagcgtttcagtgggtgtcccagctacctgtcagcggcgtgttggaccgcgccaccctgcgccagatgactcgtccccgctgcggggttacagataccaacagttatgcggcctgggctgagaggatcagtgacttgtttgctagacaccggaccaaaatgaggcgtaagaaacgctttgcaaagcaaggtaacaaatggtacaagcagcacctctcctaccgcctggtgaactggcctgagcatccggagccggcagttcggggcgccgtgcgcgccgccttccagttgtggagcaacgtctcagcgctggagttctgggaggccccagccacaggccccgctgacatccggctcaccttcttccaaggggaccacaacgatgggctgggcaatgcctttgatggcccagggggcgccctggcgcacgccttcctgccccgccgcggcgaagcgcacttcgaccaagatgagcgctggtccctgagccgccgccgcgggcgcaacctgttcgtggtgctggcgcacgagatcggtcacacgcttggcctcacccactcgcccgcgccgcgcgcgctcatggcgccctactacaagaggctgggccgcgacgcgctgctcagctgggacgacgtgctggccgtgcagagcctgtatgggaagcccctagggggctcagtggccgtccagctcccaggaaagctgttcactgactttgagacctgggactcctacagcccccaaggaaggcgccctgaaacgcagggccctaaatactgccactcttccttcgatgccatcactgtagacaggcaacagcaactgtacatttttaaagggagccatttctgggaggtggcagctgatggcaacgtctcagagccccgtccactgcaggaaagatgggtcgggctgccccccaacattgaggctgcggcagtgtcattgaatgatggagatttctacttcttcaaagtgcaatccgtttga

SEQ ID NO: 763 - DNA, 2459 bp, Homo sapiens
tccttcctccctccctcggtccccggggccggcggacccgcgggcaggcactgcccgggctggacgacgtctggccggctcccggcgaagggcagcggaggagcggcccagagcgcgcagctagggcactggcgaaaccccgggacagtccctctccgtgcgggggcggcgcagagcagtcccatccccggggtcccgggcgcggctgactgccggctggttccctgcgcgcagtagctccccgagccgggctgcaccggaggcggcgagatggtcgcgcgcgtcggcctcctgctgcgcgccctgcagctgctactgtggggccacctggacgcccagcccgcggagcgcggaggccaggagctgcgcaaggaggcggaggcattcctagagaagtacggatacctcaatgaacaggtccccaaagctcccacctccactcgattcagcgatgccatcagagcgtttcagtgggtgtcccagctacctgtcagcggcgtgttggaccgcgccaccctgcgccagatgactcgtccccgctgcggggttacagataccaacagttatgcggcctgggctgagaggatcagtgacttgtttgctagacaccggaccaaaatgaggcgtaagaaacgctttgcaaagcaaggtaacaaatggtacaagcagcacctctcctaccgcctggtgaactggcctgagcatctccggagccggcagttcggggcgccgtgcgcgccgccttccagttgtggagcaacgtctcagcgctggagttctgggaggccccagccacaggccccgctgacatccggctcaccttcttccaaggggaccacaacgatgggctgggcaatgcctttgatggcccagggggcgccctggcgcacgccttcctgccccgccgcggcgaagcgcacttcgaccaagatgagcgctggtccctgagccgccgccgcgggcgcaacctgttcgtggtgctggcgcacgagatcggtcacacgcttggcctcacccactcgcccgcgccgcgcgcgctcatggcgccctactacaagaggctgggccgcgacgcgctgctcagctgggacgacgtgctggccgtgcagagcctgtatgggaagcccctagggggctcagtggccgtccagctcccaggaaagctgttcactgactttgagacctgggactcctacagcccccaaggaaggcgccctgaaacgcagggccctaaatactgccactcttccttcgatgccatcactgtagacaggcaacagcaactgtacatttttaaagggagccatttctgggaggtggcagctgatggcaacgtctcagagccccgtccactgcaggaaagatgggtcgggctgccccccaacattgaggctgcggcagtgtcattgaatgatggagatttctacttcttcaaagggggtcgatgctggaggttccggggccccaagccagtgtggggtctcccacagctgtgccgggcagggggcctgccccgccatcctgacgccgccctcttcttccctcctctgcgccgcctcatcctcttcaagggtgcccgctactacgtgctggcccgagggggactgcaagtggagccctactacccccgaagtctgcaggactggggaggcatccctgaggaggtcagcggcgccctgccgaggcccgatggctccatcatcttcttccgagatgaccgctactggcgcctcgaccaggccaaactgcaggcaaccacctcgggccgctgggccaccgagctgccctggatgggctgctggcatgccaactcggggagcgccctgttctgaaggcacctcctcacctcagaaactggtggtgctctcagggcaaaatcatgttccccacccccggggcagaacccctcttagaagcctctgagtccctctgcagaagaccgggcagcaaagcctccatctggaagtctgtctgcctttgttccttgaagaatgcagcattgtctttgtctgtccccaccacatggaggtgggggtgggatcaatcttaggaaaagcaaaaaagggtcccagatcccttggccctttcctccgaggacttctatcctccccaggcctttgtttcttcggctaaaggtacagttcctttcaagaggtaacagcactgggatccaagcagggggatgaaaaactcagcagagaaattcgagaccattttgcaagactgtgcccttctcctcaggaccccctggctcagttcttgaaaaacggtgtcatatttagtcagaggccccacccccaggaagcatggatggggatgaaggcacaggcgtctccaacctcagaggccctttgtggggtcaggacacagagtgggagggagactgatgcaggcctaccagtccctggctttttgtctggggctggaataaagaggtgccttcagctggtgggccgaga

SEQ ID NO: 764 - DNA, 3056 bp, Homo sapiens
gacacatgatgctgtgaacgtcagggtgctcgccagggaagggccctacccagagggacagaaagaaagccaggaggggtagagtttgaagagaagatcatgttctccctgaagacgcttccatttctgctcttactccatgtgcagatttccaaggcctttcctgtatcttctaaagagaaaaatacaaaaactgttcaggactacctggaaaagttctaccaattaccaagcaaccagtatcagtctacaaggaagaatggcactaatgtgatcgttgaaaagcttaaagaaatgcagcgattttttgggttgaatgtgacggggaagccaaatgaggaaactctggacatgatgaaaaagcctcgctgtggagtgcctgacagtggtggttttatgttaaccccaggaaaccccaagtgggaacgcactaacttgacctacaggattcgaaactataccccacagctgtcagaggctgaggtagaaagagctatcaaggatgcctttgaactctggagtgttgcatcacctctcatcttcaccaggatctcacagggagaggcagatatcaacattgctttttaccaaagagatcacggtgacaattctccatttgatggacccaatggaatccttgctcatgcctttcagccaggccaaggtattggaggagatgctcattttgatgccgaagaaacatggaccaacacctccgcaaattacaacttgtttcttgttgctgctcatgaatttggccattctttggggctcgctcactcctctgaccctggtgccttgatgtatcccaactatgctttcagggaaaccagcaactactcactccctcaagatgacatcgatggcattcaggccatctatggactttcaagcaaccctatccaacctactggaccaagcacacccaaaccctgtgaccccagtttgacatttgatgctatcaccacactccgtggagaaatacttttctttaaagacaggtacttctggagaaggcatcctcagctacaaagagtcgaaatgaattttatttctctattctggccatcccttccaactggtatacaggctgcttatgaagattttgacagagacctcattttcctatttaaaggcaaccaatactgggctctgagtggctatgatattctgcaaggttatcccaaggatatatcaaactatggcttccccagcagcgtccaagcaattgacgcagctgttttctacagaagtaaaacatacttctttgtaaatgaccaattctggagatatgataaccaaagacaattcatggagccaggttatcccaaaagcatatcaggtgcctttccaggaatagagagtaaagttgatgcagttttccagcaagaacatttcttccatgtcttcagtggaccaagatattacgcatttgatcttattgctcagagagttaccagagttgcaagaggcaataaatggcttaactgtagatatggctgaagcaaaatcaaatgtggctgtatccactttcagaatgttgaagggaagttcagcaagcattttcgttacattgtgtcctgcttatacttttctcaatattaagtcattgtttcccatcactgtatccattctacctgtcctccgtgaaaatatgtttggaatattccactatttgcagaggcttattcagttcttacacattccatcttacattagtgattccatcaaagagaaggaaagtaagcctttttgtcacctcaatatttactatttcaatacttacatatctgacttctaggatttattgttatattacttgcctatctgacttcatacatccctcagtttcttaaaatgtcctatgtatatcttctacatgcaatttagaactagattttggttagaagtaaggattataaacaacctagacagtacccttggcctttacagaaaatatggtgctgttttctacccttggaaagaaatgtagatgatatgtttcgtgggttgaattgtgtcccccataaaagatatgttgaagttctaaccccaggtacccatgaatgtgagcttaccagggtctttgcagatgtaattagttaagttaaggtgagatcacactgaattagggtgggctctaaatccattatgactgttgttcttataagaagaagagaggcatagtcacctaggggaggaggccgtatgaagacagaggcagagattggagtgacgcatctccaagccaaggaattccaaggactgtaagccaccagtagaagctttgaagaggcaaggaaggattccctccaatagccttcaagtgtgaccctgctgacacctgcagaattcggacttctatcctccaaaaccgtgagggaataaatttcctttgttttaagccaccaactttgcaatactttgttacagcaaccctagacatgaggtactagacacagtacatctacacatatgaaaatgaatcaacacagaatgcagaagtagaacccttgctaaggactactgggcatcttcccaggacagcagccaaaagagaaccaccacttcctctcctgcctcctccttgctctctcctagagtccaaacccaaatgggccagttggatctgatgttcgtcagttctttacttctatttcctggggtactcaggagggcacacactatagataacttgggttagctgcataaaattcaatgtctcattaagttgcattaaactgagcttagatgtgtaagtttgctaacggatgggtttttttgttaagaactataggatttatgggaccaagtctagcgagtccagatatcaaaatcattataatgttatatttgctgttattagaatataatatagcttattatacaataaatatgtagactgtaaaatatatttctcactagtacctcctattttctttctctgttgaagtttttaaatcccacagataattaaattggcacctttatgcttgttcaaaaattaaaataatctattaaataagttcaaattaaagatttttacttcaaatgac

SEQ ID NO: 765 - DNA, 1514 bp, Homo sapiens
gacacatgatgctgtgaacgtcagggtgctcgccagggaagggccctacccagagggacagaaagaaagccaggaggggtagagtttgaagagaagatcatgttctccctgaagacgcttctaaagagaaaaatacaaaaactgttcaggactacctggaaaagttctaccaattaccaagcaaccagtatcagtctacaaggaagaatggcactaatgtgatcgttgaaaagcttaaagaaatgcagcgattttttgggttgaatgtgacggggaagccaaatgaggaaactctggacatgatgaaaaagcctcgctgtggagtgcctgacagtggtggttttatgttaaccccaggaaaccccaagtgggaacgcactaacttgacctacaggattcgaaactataccccacagctgtcagaggctgaggtagaaagagctatcaaggatgcctttgaactctggagtgttgcatcacctctcatcttcaccaggatctcacagggagaggcagatatcaacattgctttttaccaaagagatcacggtgacaattctccatttgatggacccaatggaatccttgctcatgcctttcagccaggccaaggtattggaggagatgctcattttgatgccgaagaaacatggaccaacacctccgcaaattacaacttgtttcttgttgctgctcatgaatttggccattctttggggctcgctcactcctctgaccctggtgccttgatgtatcccaactatgctttcagggaaaccagcaactactcactccctcaagatgacatcgatggcattcaggccatctatggactttcaagcaaccctatccaacctactggaccaagcacacccaaaccctgtgaccccagtttgacatttgatgctatcaccacactccgtggagaaatacttttctttaaagacaggtacttctggagaaggcatcctcagctacaaagagtcgaaatgaattttatttctctattctggccatcccttccaactggtatacaggctgcttatgaagattttgacagagacctcattttcctatttaaagatatgataaccaaagacaattcatggagccaggttatcccaaaagcatatcaggtgcctttcaggaatagagagtaaagttgatgcagttttccagcaagaacatttcttccatgtcttcagtggaccaagatattacgcatttgatcttattgctcagagagttaccagagttgcaagaggcaataaatggcttaactgtagatatggctgaagcaaaatcaaatgtggctgtatccactttcagaatgttgaagggaagttcagcaagcattttcgttacattgtgtcctgcttatacttttctcaatattaagtcattgtttcccatcactgtatccattctacctgtcctccgtgaaaatatgtttggaatattccactatttgcagaggcttattcagttcttacacattccatcttacattagtg

SEQ ID NO: 766 - DNA, 1930 bp, Homo sapiens
gacacatgatgctgtgaacgtcagggtgctcgccagggaagggccctacccagagggacagaaagaaagccaggaggggtagagtttgaagagaagatcatgttctccctgaagacgcttccatttctgctcttactccatgtgcagatttccaaggcctttcctgtatcttctaaagagaaaaatacaaaaactgttcagcagaataaataagccttttctacagtagtgaagaggataaaaaagaggaactgcactgatgcaacaaatacctcaagagaagtcaattaatgactacctggaaaagttctaccaattaccaagcaaccagtatcagtctacaaggaagaatggcactaatgtgatcgttgaaaagcttaaagaaatgcagcgattttttgggttgaatgtgacggggaagccaaatgaggaaactctggacatgatgaaaaagcctcgctgtggagtgcctgacagtggtggttttatgttaaccccaggaaaccccaagtgggaacgcactaacttgacctacaggattcgaaactataccccacagctgtcagaggctgaggtagaaagagctatcaaggatgcctttgaactctggagtgttgcatcacctctcatcttcaccaggatctcacagggagaggcagatatcaacattgctttttaccaaagagatcacggtgacaattctccatttgatggacccaatggaatccttgctcatgcctttcagccaggccaaggtattggaggagatgctcattttgatgccgaagaaacatggaccaacacctccgcaaattacaacttgtttcttgttgctgctcatgaatttggccattctttggggctcgctcactcctctgaccctggtgccttgatgtatcccaactatgctttcagggaaaccagcaactactcactccctcaagatgacatcgatggcattcaggccatctatggactttcaagcaaccctatccaacctactggaccaagcacacccaaaccctgtgaccccagtttgacatttgatgctatcaccacactccgtggagaaatacttttctttaaagacaggtacttctggagaaggcatcctcagctacaaagagtcgaaatgaattttatttctctattctggccatcccttccaactggtatacaggctgcttatgaagattttgacagagacctcattttcctatttaaaggcaaccaatactgggctctgagtggctatgatattctgcaaggttatcccaaggatatatcaaactatggcttccccagcagcgtccaagcaattgacgcagctgttttctacagaagtaaaacatacttctttgtaaatgaccaattctggagatatgataaccaaagacaattcatggagccaggttatcccaaaagcatatcaggtgcctttccaggaatagagagtaaagttgatgcagttttccagcaagaacatttcttccatgtcttcagtggaccaagatattacgcatttgatcttattgctcagagagttaccagagttgcaagaggcaataaatggcttaactgtagatatggctgaagcaaaatcaaatgtggctgtatccactttcagaatgttgaagggaagttcagcaagcattttcgttacattgtgtcctgcttatacttttctcaatattaagtcattgtttcccatcactgtatccattctacctgtcctccgtgaaaatatgtttggaatattccactatttgcagaggcttattcagttcttacacattccatcttacattagtgattccatcaaagagaaggaaagtaagcctttttgtcacctcaatatttactatttcaatacttacatatctgacttctaggatttattgttatattacttgcctatctgacttcatac

SEQ ID NO: 767 - DNA, 3099 bp, Homo sapiens
agacgcagtcttcagcaaggaagtgctgggaacgccctggagtgaacccaggaagatgcctgcagtgggtgccagggcccctctccaccgtccctgctgggcttcggggccacgcccgactgctgtgaacggcctgcggagcaccacgtgcgacggctggaggcgagaggtctgcctttgatgtggctgttggtgcagggcctgtggtgccttccgcagcggaaatggcgcgccgcccggggagggcgggagcagcgtcccgggtgcccctgtgaggatgagcgacgagatgactggagggtccctgaagacctcactagggtgcccccagccggtccgctcccaggaagcgacacccccacagccccagggctgcagctgagggggtcgccactctggctgggcgaggctgggcccttgggggcaggcgccagagtggcctcaggctctacaagatgcctgaaaacaccaacctctccagggctcactagcattggacgctttcacgctctgccctggccggaagccccctcaccccgcgcgatgtgcaaactcctgcagggctcactcagtttccagaactttaattattggaaagttctccctggtccagcccccaaatctgccgtgaacgttgacagctgagttgctgctccatgcgtgctttggctgagagcagaggggacccctgtcctccctgagctgctgacgaggggaggggtgaagggtggggcctctggagagggcaggtcccggggaagctccggactcctagaggggcggccaggtgggggccctggtgaccaggacagactgtggtgttttttaacgtaaaggagatccgcggtgtgagggaccccctgggtcctgcacgccgcctggtggcaggccgggccatggtgggtgctcacgcccccggcatgtggccgccctcagtgggaggggctctgagaacgactttttaaaacgcagagaaaagctccattcttcccaggacctcagcgcagccctggcccaggaaggcaggagacagaggccaggacggtccagaggtgtcgaaatgtcctggggacctgagcagcagccaccagggaagaggcagggagggagctgaggaccaggcttggttgtgagaatccctgagcccaggcggtagatgccaggaggtgtctggactggctgggccatgcctgggctgacctgtccagccagggagagggtgtgagggcagatctgggggtgcccagatggaaggaggcaggcatgggggacacccaaggccccctggcagcaccatgaactaagcaggacacctggaggggaagaactgtggggacctggaggcctccaacgactccttcctgcttcctggacaggactatggctgtgcagggatcccagagaagacttctgggctccctcaactccacccccacagccatcccccagctggggctggctgccaaccagacaggagcccggtgcctggaggtgtccatctctgacgggctcttcctcagcctggggctggtgagcttggtggagaacgcgctggtggtggccaccatcgccaagaaccggaacctgcactcacccatgtactgcttcatctgctgcctggccttgtcggacctgctggtgagcgggagcaacgtgctggagacggccgtcatcctcctgctggaggccggtgcactggtggcccgggctgcggtgctgcagcagctggacaatgtcattgacgtgatcacctgcagctccatgctgtccagcctctgcttcctgggcgccatcgccgtggaccgctacatctccatcttctacgcactgcgctaccacagcatcgtgaccctgccgcgggcgcggcgagccgttgcggccatctgggtggccagtgtcgtcttcagcacgctcttcatcgcctactacgaccacgtggccgtcctgctgtgcctcgtggtcttcttcctggctatgctggtgctcatggccgtgctgtacgtccacatgctggcccgggcctgccagcacgcccagggcatcgcccggctccacaagaggcagcgcccggtccaccagggctttggccttaaaggcgctgtcaccctcaccatcctgctgggcattttcttcctctgctggggccccttcttcctgcatctcacactcatcgtcctctgccccgagcaccccacgtgcggctgcatcttcaagaacttcaacctctttctcgccctcatcatctgcaatgccatcatcgaccccctcatctacgccttccacagccaggagctccgcaggacgctcaaggaggtgctgacatgctcctggtgagcgcggtgcacgcggctttaagtgtgctgggcagagggaggtggtgatattgtgtggtctggttcctgtgtgaccctgggcagttccttacctccctggtccccgtttgtcaaagaggatggactaaatgatctctgaaagtgttgaagcgcggacccttctgggtccagggaggggtccctgcaaaactccaggcaggacttctcaccagcagtcgtggggaacggaggaggacatggggaggttgtggggcctcaggctccgggcaccaggggccaacctcaggctcctaaagagacattttccgcccactcctgggacactccgtctgctccaatgactgagcagcatccaccccaccccatctttgctgccagctctcaggaccgtgccctcgtcagctgggatgtgaagtctctgggtggaagtgtgtgccaagagctactcccacagcagccccaggagaaggggctttgtgaccagaaagcttcatccacagccttgcagcggctcctgcaaaaggaggtgaaatccctgcctcaggccaagggaccaggtttgcaggagcccccctagtggtatggggctgagccctcctgagggccggttctaaggctcagactgggcactggggcctcagcctgctttcctgcagcagtcgcccaagcagacagccctggcaaatgcctgactcagtgaccagtgcctgtgagcatggggccaggaaagtctggtaataaatgtgactcagcatcacccacctta

SEQ ID NO: 768 - DNA, 3652 bp, Homo sapiens
attccttctcattcattttgcccagaaagttcctgcttcagagctgaaggtgattgggagattttaacttagatctccagcaagtgctacaaggaagaaaagatcctgaagaatcaatcaagttttccgtgaagtcaagtccaagtaacatccccgccttaaccacaagcaggagaaatgaagcacattatcaactcgtatgaaaacatcaacaacacagcaagaaataattccgactgtcctcgtgtggttttgccggaggagatatttttcacaatttccattgttggagttttggagaatctgatcgtcctgctggctgtgttcaagaataagaatctccaggcacccatgtactttttcatctgtagcttggccatatctgatatgctgggcagcctatataagatcttggaaaatatcctgatcatattgagaaacatgggctatctcaagccacgtggcagttttgaaaccacagccgatgacatcatcgactccctgtttgtcctctccctgcttggctccatcttcagcctgtctgtgattgctgcggaccgctacatcaccatcttccacgcactgcggtaccacagcatcgtgaccatgcgccgcactgtggtggtgcttacggtcatctggacgttctgcacggggactggcatcaccatggtgatcttctcccatcatgtgcccacagtgatcaccttcacgtcgctgttcccgctgatgctggtcttcatcctgtgcctctatgtgcacatgttcctgctggctcgatcccacaccaggaagatctccaccctccccagagccaacatgaaaggggccatcacactgaccatcctgctcggggtcttcatcttctgctgggccccctttgtgcttcatgtcctcttgatgacattctgcccaagtaacccctactgcgcctgctacatgtctctcttccaggtgaacggcatgttgatcatgtgcaatgccgtcattgaccccttcatatatgccttccggagcccagagctcagggacgcattcaaaaagatgatcttctgcagcaggtactggtagaatggctgatccctggttttagaatccatgggaataacgttgccaagtgccagaatagtgtaacattccaacaaatgccagtgctcctcactggccttccttccctaatggatgcaaggatgatcccaccagctagtgtttctaatagctaggttctatgtgaacagtcttattgtaggggcaacctcttaactttgtgactggacagataaaacgatgtagtaaaagaaggatagaatacaaagtattaggtaggtacaaaagtaattaaggtttttgccattactttcaatgaccaaaaattgcaattacttttgcaccaatctagtaaaacagcaataaaaattcaagggctttgggctaaggcaaagacttgctttcctgtggacatctaacaagccagttctgaggtggcctttccaggtggaggccattgcagccaatttccagaagttaagtacctggacatgcgactccaggcagaagatgtagggtctctgtaagccaataataaattggaaggaatgcattgctgcagctgaatttgtctgtctcccacagccatgtggaatctccaccctcctctttctccctgttagtctgatgtattgatgccacctcagtttcagaaagtaggctgagtataaactataaatgtcaaataacgagcttcgagtttccaatgataaatggaccttctctgttagtcttctttgctcactcagtatcccactggccttaaaaccctttcctgttacatttcctcatgctttatgagcatacatttcaaaggaagaaatgaaaatttaatccatttagttcccatgtgggaatacataaaggccagatgaaaattgtcactatttgaagaagctgtaaccaaactatgtgtgttacaatgtagaagtacaagaaaagagccccaacatgtattttaagaaataaagagagagagacagagacagacagagagagagagagagagagagagagagagtgtgtgtgtgtgtgtgtgtgtgtgtgtgtgtgtgtgtgtgtgtgtgtgtgtattttccccatgcttttggactatggggaaaaccaaaaccaaagcaagacatcaagcaatggtgctgttattatagccccaagtcaaagacctgagggaggcaaacaccacctcattctgcagatgaatgtgaaagcagacccagtcactgggaaatgtcatcctcccatcagccaagatgccagcaatggaagagtggcaaccccagtaggaataaaagaaacataatttgcaagttcattcatttttaatagctaaaaatcagcttaaaggagaagcacatcctgattgtaagtccccactaagttggagggtgacttgaatggggtgaaaggtgaaagggacagaggagagcagtggggcttcagaggccaccaggctcaggatctgcaggatggatggtatcttccagaacaggcaatgctttgccctcaggagaatttcccagagctgctgaggggagaagacagccacacacaggacagaccatttggtgatgggtttgatattagaagtggcagggacaggaacttcagaagcaaaggaggcaaggcagctggagtcaagtgaggacagtggcaggcgtgctttcacatggcctgtcccacagatggaggtgaaaggtgcaccttcttgtcctctgttctgtagaaatccttccctgtttgatccttcccctgccaaatgaactatgttactctaatactaacctgtattaattaatatatgagatatatataagttaatttttcatgaaatctaaagcacaaccctagaactaatttttaaaagtgttatttctaccattgaaaaagtaatgtataacatattttatgtgattaaagtgcgtattctcaataagaggtaacctttttttgatgctgcaatgctctgtgataccacagaggtaagcaatgccacttaacctgtatcataaatagtcccaaactgctcttcctataaaattctgcctttgtcaacagctttgctgtctcctaatcactctcaagctctctgctgtgcatgtgactgttgtcagaaggaaaatcaccaagaaacttcacctctcactgcctttgatttgttgcagttaatctaagaaacaaaatgaagatggctagtctaatggtggatgaaacaaaaatgaagtctgagtgctaattcagagaacttgcaattccagacattttcaattctaggtcttctgctatattccaatcagaacagaagcttcagggctcatagttactgagaaaactcacgtttttctacctctaacttcatatagaattccaaatgaaagcaccaccaaactgcacatatttgtgtgaggaagatcaacaagcttcagacttttcccatgaggacttaattcttttatcaaattacccaatttttaaactgctgtgtggatactgtgagtgttcagctttatcgatgacctagccttggaccagatagctgaaaatgttcaggatgtgtactcaagctgatagtaattctgagccctgtctaataaaaaaggaaggatgt

SEQ ID NO: 769 - DNA, 1024 bp, Homo sapiens
aggtgattgggagattttaacttagatctccagcaagtgctacaaggaagaaaagatcctgaagaatcaatcaagttttccgtgaagtcaagtccaagtaacatccccgccttaaccacaagcaggagaaatgaagcacattatcaactcgtatgaaaacatcaacaacacagcaagaaataattccgactgtcctcgtgtggttttgccggaggagatatttttcacaatttccattgttggagttttggagaatctgatcgtcctgctggctgtgttcaagaataagaatctccaggcacccatgtactttttcatctgtagcttggccatatctgatatgctgggcagcctatataagatcttggaaaatatcctgatcatattgagaaacatgggctatctcaagccacgtggcagttttgaaaccacagccgatgacatcatcgactccctgtttgtcctctccctgcttggctccatcttcagcctgtctgtgattgctgcggaccgctacatcaccatcttccacgcactgcggtaccacagcatcgtgaccatgcgccgcactgtggtggtgcttacggtcatctggacgttctgcacggggactggcatcaccatggtgatcttctcccatcatgtgcccacagtgatcaccttcacgtcgctgttcccgctgatgctggtcttcatcctgtgcctctatgtgcacatgttcctgctggctcgatcccacaccaggaagatctccaccctccccagagccaacatgaaaggggccatcacactgaccatcctgctcggggtcttcatcttctgctgggccccctttgtgcttcatgtcctcttgatgacattctgcccaagtaacccctactgcgcctgctacatgtctctcttccaggtgaacggcatgttgatcatgtgcaatgccgtcattgaccccttcatatatgccttccggagcccagagctcagggacgcattcaaaaagatgatcttctgcagcaggtactggtag

SEQ ID NO: 770 - DNA, 1084 bp, Homo sapiens
aatgagcatccaaaagacgtatctggagggagattttgtctttcctgtgagcagcagcagcttcctacggaccctgctggagccccagctcggatcagcccttctgacagcaatgaatgcttcgtgctgcctgccctctgttcagccaacactgcctaatggctcggagcacctccaagcccctttcttcagcaaccagagcagcagcgccttctgtgagcaggtcttcatcaagcccgaggttttcctgtctctgggcatcgtcagtctgctggaaaacatcctggttatcctggccgtggtcaggaacggcaacctgcactccccgatgtacttctttctctgcagcctggcggtggccgacatgctggtaagtgtgtccaatgccctggagaccatcatgatcgccatcgtccacagcgactacctgaccttcgaggaccagtttatccagcacatggacaacatcttcgactccatgatctgcatctccctggtggcctccatctgcaacctcctggccatcgccgtcgacaggtacgtcaccatcttttacgcgctccgctaccacagcatcatgaccgtgaggaaggccctcaccttgatcgtggccatctgggtctgctgcggcgtctgtggcgtggtgttcatcgtctactcggagagcaaaatggtcattgtgtgcctcatcaccatgttcttcgccatgatgctcctcatgggcaccctctacgtgcacatgttcctctttgcgcggctgcacgtcaagcgcatagcagcactgccacctgccgacggggtggccccacagcaacactcatgcatgaagggggcagtcaccatcaccattctcctgggcgtgttcatcttctgctgggcccccttcttcctccacctggtcctcatcatcacctgccccaccaacccctactgcatctgctacactgcccacttcaacacctacctggtcctcatcatgtgcaactccgtcatcgacccactcatctacgctttccggagcctggaattgcgcaacacctttagggagattctctgtggctgcaacggcatgaacttgggatag

SEQ ID NO: 771 - DNA, 1438 bp, Homo sapiens
aaagcaacgctcaggctggaaacagaagcttccgagaggcagccgatgtgagcatgtgcgcacagattcgtctcccaatggcatggcagcttcaaggaaaattattttgaacagacttgaatgcataagattaaagttaaagcagaagtgagaacaagaaagcaaagagcagactctttcaactgagaatgaatattttgaagcccaagattttaaagtgatgatgattagagtcgtacctaaaagagactaaaaactccatgtcaagctctggacttgtgacatttactcacagcaggcatggcaattttagcctcacaactttcagacagataaagacttggaggaaataactgagacgactccctgacccaggaggttaaatcaattcagggggacactggaattctcctgccagcatggtgaactccacccaccgtgggatgcacacttctctgcacctctggaaccgcagcagttacagactgcacagcaatgccagtgagtcccttggaaaaggctactctgatggagggtgctacgagcaactttttgtctctcctgaggtgtttgtgactctgggtgtcatcagcttgttggagaatatcttagtgattgtggcaatagccaagaacaagaatctgcattcacccatgtactttttcatctgcagcttggctgtggctgatatgctggtgagcgtttcaaatggatcagaaaccattgtcatcaccctattaaacagtacagatacggatgcacagagtttcacagtgaatattgataatgtcattgactcggtgatctgtagctccttgcttgcatccatttgcagcctgctttcaattgcagtggacaggtactttactatcttctatgctctccagtaccataacattatgacagttaagcgggttgggatcatcataagttgtatctgggcagcttgcacggtttcaggcattttgttcatcatttactcagatagtagtgctgtcatcatctgcctcatcaccatgttcttcaccatgctggctctcatggcttctctctatgtccacatgttcctgatggccaggcttcacattaagaggattgctgtcctccccggcactggtgccatccgccaaggtgccaatatgaagggagcgattaccttgaccatcctgattggcgtctttgttgtctgctgggccccattcttcctccacttaatattctacatctcttgtcctcagaatccatattgtgtgtgcttcatgtctcactttaacttgtatctcatactgatcatgtgtaattcaatcatcgatcctctgatttatgcactccggagtcaagaactgaggaaaaccttcaaagagatcatctgttgctatcccctgggaggcctttgtgacttgtctagcagatattaaatggggacagagcacgcaat

SEQ ID NO: 772 - DNA, 1319 bp, Homo sapiens
catagggagaccctgtctcttaaaaaaaaaaaaaaaaaaggactgagtgagccgagcccagtcctctgatgcactgtgtcattcatcccctttcttaggctgtgttggttctaggctagctgctgtctttctttggtaggctgctaacctctttggattgtgaatttaaaacatgttttacagtaaatttgctgccaagacaagaggtgtatttctccagcaatgaattcctcatttcacctgcatttcttggatctcaacctgaatgccacagagggcaacctttcaggacccaatgtcaaaaacaagtcttcaccatgtgaagacatgggcattgctgtggaggtgtttctcactctgggtgtcatcagcctcttggagaacatcttggtcataggggccatagtgaagaacaaaaacctgcactcccccatgtacttcttcgtgtgcagcctggcagtggcggacatgctggtgagcatgtccagtgcctgggagaccatcaccatctacctactcaacaacaagcacctagtgatagcagacgcctttgtgcgccacattgacaatgtgtttgactccatgatctgcatttccgtggtggcatccatgtgcagcttactggccattgcagtggataggtacgtcaccatcttctacgccctgcgctaccaccacatcatgacggcgaggcgctcaggggccatcatcgccggcatctgggctttctgcacgggctgcggcattgtcttcatcctgtactcagaatccacctacgtcatcctgtgcctcatctccatgttcttcgctatgctgttcctcctggtgtctctgtacatacacatgttcctcctggcgcggactcacgtcaagcggatcgcggctctgcccggggccagctctgcgcggcagaggaccagcatgcagggcgcggtcaccgtcaccatgctgctgggcgtgtttaccgtgtgctgggccccgttcttccttcatctcactttaatgctttcttgccctcagaacctctactgctctcgcttcatgtctcacttcaatatgtacctcatactcatcatgtgtaattccgtgatggaccctctcatatatgccttccgcagccaagagatgcggaagacctttaaggagattatttgctgccgtggtttcaggatcgcctgcagctttcccagaagggattaagcacaaagtgctcctctctgtggctctgttctcctttgtttgctcacctatgacaaagcgacagccaaggggtaggcgggagtgctagcatcccatttttctctttaccagctcagaca

SEQ ID NO: 773 - DNA, 1798 bp, Homo sapiens
tttccggtggtgtctcgggataccttgtttatagtaccttctctttgccagtccatcttcaaattggaattatagaaagtagagggagggatagtctaccgtctctcactggattggtgccacctaaaacattgttatgctggaaatgctagaatataatcactatcaggtgcagacccacctcgaaaaccccaccaagtaccacatacagcaagcccaacggcagcaggtaaagcagtacctttctaccactttagcaaataaacatgccaaccaagtcctgagcttgccatgtccaaaccagcctggcgatcatgtcatgccaccggtgccggggagcagcgcacccaacagccccatggctatgcttacgcttaactccaactgtgaaaaagagggattttataagtttgaagagcaaaacagggcagagagcgagtgcccaggcatgaacacacattcacgagcgtcctgtatgcagatggatgatgtaatcgatgacatcattagcctagaatcaagttataatgaggaaatcttgggcttgatggatcctgctttgcaaatggcaaatacgttgcctgtctcgggaaacttgattgatctttatggaaaccaaggtctgcccccaccaggcctcaccatcagcaactcctgtccagccaaccttcccaacataaaaagggagctcacagagtctgaagcaagagcactggccaaagagaggcagaaaaaggacaatcacaacctgattgaacgaagaagaagatttaacataaatgaccgcattaaagaactaggtactttgattcccaagtcaaatgatccagacatgcgctggaacaagggaaccatcttaaaagcatccgtggactatatccgaaagttgcaacgagaacagcaacgcgcaaaagaacttgaaaaccgacagaagaaactggagcacgccaaccggcatttgttgctcagaatacaggaacttgaaatgcaggctcgagctcatggactttcccttattccatccacgggtctctgctctccagatttggtgaatcggatcatcaagcaagaacccgttcttgagaactgcagccaagacctccttcagcatcatgcagacctaacctgtacaacaactctcgatctcacggatggcaccatcaccttcaacaacaacctcggaactgggactgaggccaaccaagcctatagtgtccccacaaaaatgggatccaaactggaagacatcctgatggacgacaccctttctcccgtcggtgtcactgatccactcctttcctcagtgtcccccggagcttccaaaacaagcagccggaggagcagtatgagcatggaagagacggagcacacttgttagcgaatcctccctgcactgcattcgcacaaactgcttcctttcttgattcgtagatttaataacttacctgaaggggttttcttgataattttcctttaatatgaaattttttttcatgctttatcaatagcccaggatatattttatttttagaattttgtgaaacagacttgtatattctattttacaactacaaatgcctccaaagtattgtacaaataagtgtgcagtatctgtgaactgaattcaccacagactttagctttctgagcaagaggattttgcgtcagagaaatgtctgtccatttttattcaggggaaacttgatttgagatttttatgcctgtgacttccttggaaatcaaatgtaaagtttaattgaaagaatgtaaagcaaccaaaaagaaaaaaaaaaagaaa

SEQ ID NO: 774 - DNA, 1926 bp, Homo sapiens
aaaggaaaaaagatggaggcgcttagagttcagatgttcatgccatgctcctttgaaagcttgtatctcagttccgccgagcatcctggggcctccaagcctccgataagctcctccagtatgacatcacgcatcttgctacgccagcaactcatgcgtgagcagatgcaggagcaggagcgcagggagcagcagcagaagctgcaggcggcccagttcatgcaacagagagtgcccgtgagtcagacaccagccataaacgtcagtgtgcccaccacccttccctctgccacgcaggtgccgatggaagtccttaaggtgcagacccacctcgaaaaccccaccaagtaccacatacagcaagcccaacggcagcaggtaaagcagtacctttctaccactttagcaaataaacatgccaaccaagtcctgagcttgccatgtccaaaccagcctggcgatcatgtcatgccaccggtgccggggagcagcgcacccaacagccccatggctatgcttacgcttaactccaactgtgaaaaagagggattttataagtttgaagagcaaaacagggcagagagcgagtgcccaggcatgaacacacattcacgagcgtcctgtatgcagatggatgatgtaatcgatgacatcattagcctagaatcaagttataatgaggaaatcttgggcttgatggatcctgctttgcaaatggcaaatacgttgcctgtctcgggaaacttgattgatctttatggaaaccaaggtctgcccccaccaggcctcaccatcagcaactcctgtccagccaaccttcccaacataaaaagggagctcacagagtctgaagcaagagcactggccaaagagaggcagaaaaaggacaatcacaacctgattgaacgaagaagaagatttaacataaatgaccgcattaaagaactaggtactttgattcccaagtcaaatgatccagacatgcgctggaacaagggaaccatcttaaaagcatccgtggactatatccgaaagttgcaacgagaacagcaacgcgcaaaagaacttgaaaaccgacagaagaaactggagcacgccaaccggcatttgttgctcagaatacaggaacttgaaatgcaggctcgagctcatggactttcccttattccatccacgggtctctgctctccagatttggtgaatcggatcatcaagcaagaacccgttcttgagaactgcagccaagacctccttcagcatcatgcagacctaacctgtacaacaactctcgatctcacggatggcaccatcaccttcaacaacaacctcggaactgggactgaggccaaccaagcctatagtgtccccacaaaaatgggatccaaactggaagacatcctgatggacgacaccctttctcccgtcggtgtcactgatccactcctttcctcagtgtcccccggagcttccaaaacaagcagccggaggagcagtatgagcatggaagagacggagcacacttgttagcgaatcctccctgcactgcattcgcacaaactgcttcctttcttgattcgtagatttaataacttacctgaaggggttttcttgataattttcctttaatatgaaattttttttcatgctttatcaatagcccaggatatattttatttttagaattttgtgaaacagacttgtatattctattttacaactacaaatgcctccaaagtattgtacaaataagtgtgcagtatctgtgaactgaattcaccacagactttagctttctgagcaagaggattttgcgtcagagaaatgtctgtccatttttattcaggggaaacttgatttgagatttttatgcctgtgacttccttggaaatcaaatgtaaagtttaattgaaagaatgtaaagcaacc

SEQ ID NO: 775 - DNA, 4680 bp, Homo sapiens
cagacctattccgctccatctctgaagtcaaatgggacaccttgaaaatacttcagtggttttcccacgagctattttctctctctgtgaaaaggaaaccaggaaattgactctgtgcctgttttcaagaagcagttccgccgagcatcctggggcctccaagcctccgataagctcctccagtatgacatcacgcatcttgctacgccagcaactcatgcgtgagcagatgcaggagcaggagcgcagggagcagcagcagaagctgcaggcggcccagttcatgcaacagagagtgcccgtgagtcagacaccagccataaacgtcagtgtgcccaccacccttccctctgccacgcaggtgccgatggaagtccttaaggtgcagacccacctcgaaaaccccaccaagtaccacatacagcaagcccaacggcagcaggtaaagcagtacctttctaccactttagcaaataaacatgccaaccaagtcctgagcttgccatgtccaaaccagcctggcgatcatgtcatgccaccggtgccggggagcagcgcacccaacagccccatggctatgcttacgcttaactccaactgtgaaaaagagggattttataagtttgaagagcaaaacagggcagagagcgagtgcccaggcatgaacacacattcacgagcgtcctgtatgcagatggatgatgtaatcgatgacatcattagcctagaatcaagttataatgaggaaatcttgggcttgatggatcctgctttgcaaatggcaaatacgttgcctgtctcgggaaacttgattgatctttatggaaaccaaggtctgcccccaccaggcctcaccatcagcaactcctgtccagccaaccttcccaacataaaaagggagctcacagagtctgaagcaagagcactggccaaagagaggcagaaaaaggacaatcacaacctgattgaacgaagaagaagatttaacataaatgaccgcattaaagaactaggtactttgattcccaagtcaaatgatccagacatgcgctggaacaagggaaccatcttaaaagcatccgtggactatatccgaaagttgcaacgagaacagcaacgcgcaaaagaacttgaaaaccgacagaagaaactggagcacgccaaccggcatttgttgctcagaatacaggaacttgaaatgcaggctcgagctcatggactttcccttattccatccacgggtctctgctctccagatttggtgaatcggatcatcaagcaagaacccgttcttgagaactgcagccaagacctccttcagcatcatgcagacctaacctgtacaacaactctcgatctcacggatggcaccatcaccttcaacaacaacctcggaactgggactgaggccaaccaagcctatagtgtccccacaaaaatgggatccaaactggaagacatcctgatggacgacaccctttctcccgtcggtgtcactgatccactcctttcctcagtgtcccccggagcttccaaaacaagcagccggaggagcagtatgagcatggaagagacggagcacacttgttagcgaatcctccctgcactgcattcgcacaaactgcttcctttcttgattcgtagatttaataacttacctgaaggggttttcttgataattttcctttaatatgaaattttttttcatgctttatcaatagcccaggatatattttatttttagaattttgtgaaacagacttgtatattctattttacaactacaaatgcctccaaagtattgtacaaataagtgtgcagtatctgtgaactgaattcaccacagactttagctttctgagcaagaggattttgcgtcagagaaatgtctgtccatttttattcaggggaaacttgatttgagatttttatgcctgtgacttccttggaaatcaaatgtaaagtttaattgaaagaatgtaaagcaaccaaaaagaaaaaaaaaaagaaagaaagaggaaaagaaatccatactaacccttttccattttataaatgtattgattcattggtactgccttaaagatacagtacccctctagctttgtttagtctttatactgcaaactatttaaagaaatatgtattctgtaaaagaaaaaaaaaatgcggccttttcatgaggatcgtctggttagaaaacataactgataccaaccgaaactgaagggagttagaccaaggctctgaaatataaagtctaatcttgctctcttttattctgtgctgttacagttttcttcatcaatgagtgtgatccagtttttcataagatattttattttgaaatggaaattaatgtcctctcaaagtaaaatattgaggagcactgaaagtatgttttactttttttttattttatttttgcttttgataagaaaaccgaactgggcatatttctaattggctttactatttttatttttaaattatgttttactgttcatttgatttgtacagattctttattatcattgttcttttcaatatatttgtattaatttgtaagaatatgcatcttaaaatggcaagttttccatatttttacaactcactggtggttttccgcattctttgtacacccatgaaagaaaacttttatgcaaggtcttgcatttaaaagacagctttgcgaatattttgtaaattacagtctcactcagaactgtttttggacacatttaaggtgtagtattaataggttaaaaccaggctttctagaaagaataaacttacatatttatttttaggacatgaaaatagcaatattcttggagattgataaccatagcattaatacgcccattatggtcatttaaattggggtttatttcagcaaacttgttgaatttatttttaagaaagaaatactgtattgggaagttactgttacttgataacaatgttttaacaagaagcaatgttataaagttagtttcagtgcattatctacttgtgtagtcctatgcaataacagtagtgttacatgtatcaagcctagatgttttatacagatgccatatagtgttatgagccaggctgttgaatggaatttctcagtagcagcctacaactgaatagcaagtggcataaagcatatccattcagaatgaagtgccttaaatatagcagtagtcttttttggactagcactgactgaactgtaatgtaggggaaagtttcatgatggtatctatagtcaagacgaacatgtagcatggtgcctatgtagacaatataagagcttccaattttccttcagatatttttaatattaaatatattttagtgacagagtgccaacttctttcatcaggaaaccttattcaggagggtttttaaaaagtgtttaaatgtcaaatgtgaattggtgatgggtgatggagggttcagagaggagtgatcgtcagatgtgtgaatggacggtttaggtgaaaataatcaactgcatagttcccatgcacgctgggcaatgagaatccttggaaacattggtgatgctatcagttttatagctttatttcttaagggggtagggaaaattagttcccattctttcaacccccttaactgtatagctcttttcctagaatagtgacgcaaatctgcatgaacagctaattgtaccatagtgttcattgatacaatcatagcattgtctatttttctcttcatatttatatgggggggagggcgctggatgcaaaagttgaagatcgtgatgctatgatgttagttttccttagctgattttgagggtttttaaaaataaagcaaggttgactaacctacggccacgggaacaggaccatggttaagcaaccatatagaaagctttgttgaaagaaagtatggcatcttgtaccactgccctgactgtcacaactcctaaccttgccattgcctgcctccccctccccttctccttaagagacaatttctgcaggtggcaggtgagcaagcccaggagaatgctgcaatcttgggggtggttttatttatttcttttttgccaaatagagtgtggattcatttcaggggctagctaagccaagaggcagtggtttgggcttgttgtttgtaacaagaaaatgatccacaccactcccccgattcccgggtgcagaattgtaactcggggttgggcctctatatggagtgaccaaaatgccaaaattgtccatctgcctctgagtagggcaatggaaataccaaaccttctgactttgccaaaaagcatacaagcaacctggtcatacataggatgacaaaattctttctggttgtttttaaacaataaagcaataagaacaaatacaatacataggaagttaaaagcacaaaggaatgaacttattaatatttttgaaaaatgcactgggaaaaagttgatgtcaataacagtataaaacagccctatttcttgataaaaaatgacaaatgactgtctcttgcggatgcttggtactgtaatgttaataatagtcacctgctgttggatgcagcaataatttctgtatggtccatagcactgtatattatggatcgatattaatgtatccaatgaaataatcgacttgttcttgatagcctcattaaagcatttggtttttcacatag

SEQ ID NO: 776 - DNA, 4814 bp, Homo sapiens
gtaaactccccgcgctggggcgggcggccgcgagccggcgagcgggcagagctcggcactgcgccggggcgcacggctcgggggacccaggcccagctaccttccctccgcccccgggctctgttctcactttccagcagtggaaggacgggaagcgggagccatgcagtccgaatcggggatcgtgccggatttcgaagtcggggaggagtttcatgaagagcccaaaacctattacgaactcaaaagtcaaccgctgaagagcagcagttccgccgagcatcctggggcctccaagcctccgataagctcctccagtatgacatcacgcatcttgctacgccagcaactcatgcgtgagcagatgcaggagcaggagcgcagggagcagcagcagaagctgcaggcggcccagttcatgcaacagagagtgcccgtgagtcagacaccagccataaacgtcagtgtgcccaccacccttccctctgccacgcaggtgccgatggaagtccttaaggtgcagacccacctcgaaaaccccaccaagtaccacatacagcaagcccaacggcagcaggtaaagcagtacctttctaccactttagcaaataaacatgccaaccaagtcctgagcttgccatgtccaaaccagcctggcgatcatgtcatgccaccggtgccggggagcagcgcacccaacagccccatggctatgcttacgcttaactccaactgtgaaaaagagggattttataagtttgaagagcaaaacagggcagagagcgagtgcccaggcatgaacacacattcacgagcgtcctgtatgcagatggatgatgtaatcgatgacatcattagcctagaatcaagttataatgaggaaatcttgggcttgatggatcctgctttgcaaatggcaaatacgttgcctgtctcgggaaacttgattgatctttatggaaaccaaggtctgcccccaccaggcctcaccatcagcaactcctgtccagccaaccttcccaacataaaaagggagctcacagagtctgaagcaagagcactggccaaagagaggcagaaaaaggacaatcacaacctgattgaacgaagaagaagatttaacataaatgaccgcattaaagaactaggtactttgattcccaagtcaaatgatccagacatgcgctggaacaagggaaccatcttaaaagcatccgtggactatatccgaaagttgcaacgagaacagcaacgcgcaaaagaacttgaaaaccgacagaagaaactggagcacgccaaccggcatttgttgctcagaatacaggaacttgaaatgcaggctcgagctcatggactttcccttattccatccacgggtctctgctctccagatttggtgaatcggatcatcaagcaagaacccgttcttgagaactgcagccaagacctccttcagcatcatgcagacctaacctgtacaacaactctcgatctcacggatggcaccatcaccttcaacaacaacctcggaactgggactgaggccaaccaagcctatagtgtccccacaaaaatgggatccaaactggaagacatcctgatggacgacaccctttctcccgtcggtgtcactgatccactcctttcctcagtgtcccccggagcttccaaaacaagcagccggaggagcagtatgagcatggaagagacggagcacacttgttagcgaatcctccctgcactgcattcgcacaaactgcttcctttcttgattcgtagatttaataacttacctgaaggggttttcttgataattttcctttaatatgaaattttttttcatgctttatcaatagcccaggatatattttatttttagaattttgtgaaacagacttgtatattctattttacaactacaaatgcctccaaagtattgtacaaataagtgtgcagtatctgtgaactgaattcaccacagactttagctttctgagcaagaggattttgcgtcagagaaatgtctgtccatttttattcaggggaaacttgatttgagatttttatgcctgtgacttccttggaaatcaaatgtaaagtttaattgaaagaatgtaaagcaaccaaaaagaaaaaaaaaaagaaagaaagaggaaaagaaatccatactaacccttttccattttataaatgtattgattcattggtactgccttaaagatacagtacccctctagctttgtttagtctttatactgcaaactatttaaagaaatatgtattctgtaaaagaaaaaaaaaatgcggccttttcatgaggatcgtctggttagaaaacataactgataccaaccgaaactgaagggagttagaccaaggctctgaaatataaagtctaatcttgctctcttttattctgtgctgttacagttttcttcatcaatgagtgtgatccagtttttcataagatattttattttgaaatggaaattaatgtcctctcaaagtaaaatattgaggagcactgaaagtatgttttactttttttttattttatttttgcttttgataagaaaaccgaactgggcatatttctaattggctttactatttttatttttaaattatgttttactgttcatttgatttgtacagattctttattatcattgttcttttcaatatatttgtattaatttgtaagaatatgcatcttaaaatggcaagttttccatatttttacaactcactggtggttttccgcattctttgtacacccatgaaagaaaacttttatgcaaggtcttgcatttaaaagacagctttgcgaatattttgtaaattacagtctcactcagaactgtttttggacacatttaaggtgtagtattaataggttaaaaccaggctttctagaaagaataaacttacatatttatttttaggacatgaaaatagcaatattcttggagattgataaccatagcattaatacgcccattatggtcatttaaattggggtttatttcagcaaacttgttgaatttatttttaagaaagaaatactgtattgggaagttactgttacttgataacaatgttttaacaagaagcaatgttataaagttagtttcagtgcattatctacttgtgtagtcctatgcaataacagtagtgttacatgtatcaagcctagatgttttatacagatgccatatagtgttatgagccaggctgttgaatggaatttctcagtagcagcctacaactgaatagcaagtggcataaagcatatccattcagaatgaagtgccttaaatatagcagtagtcttttttggactagcactgactgaactgtaatgtaggggaaagtttcatgatggtatctatagtcaagacgaacatgtagcatggtgcctatgtagacaatataagagcttccaattttccttcagatatttttaatattaaatatattttagtgacagagtgccaacttctttcatcaggaaaccttattcaggagggtttttaaaaagtgtttaaatgtcaaatgtgaattggtgatgggtgatggagggttcagagaggagtgatcgtcagatgtgtgaatggacggtttaggtgaaaataatcaactgcatagttcccatgcacgctgggcaatgagaatccttggaaacattggtgatgctatcagttttatagctttatttcttaagggggtagggaaaattagttcccattctttcaacccccttaactgtatagctcttttcctagaatagtgacgcaaatctgcatgaacagctaattgtaccatagtgttcattgatacaatcatagcattgtctatttttctcttcatatttatatgggggggagggcgctggatgcaaaagttgaagatcgtgatgctatgatgttagttttccttagctgattttgagggtttttaaaaataaagcaaggttgactaacctacggccacgggaacaggaccatggttaagcaaccatatagaaagctttgttgaaagaaagtatggcatcttgtaccactgccctgactgtcacaactcctaaccttgccattgcctgcctccccctccccttctccttaagagacaatttctgcaggtggcaggtgagcaagcccaggagaatgctgcaatcttgggggtggttttatttatttcttttttgccaaatagagtgtggattcatttcaggggctagctaagccaagaggcagtggtttgggcttgttgtttgtaacaagaaaatgatccacaccactcccccgattcccgggtgcagaattgtaactcggggttgggcctctatatggagtgaccaaaatgccaaaattgtccatctgcctctgagtagggcaatggaaataccaaaccttctgactttgccaaaaagcatacaagcaacctggtcatacataggatgacaaaattctttctggttgtttttaaacaataaagcaataagaacaaatacaatacataggaagttaaaagcacaaaggaatgaacttattaatatttttgaaaaatgcactgggaaaaagttgatgtcaataacagtataaaacagccctatttcttgataaaaaatgacaaatgactgtctcttgcggatgcttggtactgtaatgttaataatagtcacctgctgttggatgcagcaataatttctgtatggtccatagcactgtatattatggatcgatattaatgtatccaatgaaataatcgacttgttcttgatagcctcattaaagcatttggtttttcacata

SEQ ID NO: 777 - DNA, 1956 bp, Homo sapiens
gggataccttgtttatagtaccttctctttgccagtccatcttcaaattggaattatagaaagtagagggagggatagtctaccgtctctcactggattggtgccacctaaaacattgttatgctggaaatgctagaatataatcactatcaggtgcagacccacctcgaaaaccccaccaagtaccacatacagcaagcccaacggcagcaggtaaagcagtacctttctaccactttagcaaataaacatgccaaccaagtcctgagcttgccatgtccaaaccagcctggcgatcatgtcatgccaccggtgccggggagcagcgcacccaacagccccatggctatgcttacgcttaactccaactgtgaaaaagagggattttataagtttgaagagcaaaacagggcagagagcgagtgcccaggcatgaacacacattcacgagcgtcctgtatgcagatggatgatgtaatcgatgacatcattagcctagaatcaagttataatgaggaaatcttgggcttgatggatcctgctttgcaaatggcaaatacgttgcctgtctcgggaaacttgattgatctttatggaaaccaaggtctgcccccaccaggcctcaccatcagcaactcctgtccagccaaccttcccaacataaaaagggagctcacagcgtgtatttttcccacagagtctgaagcaagagcactggccaaagagaggcagaaaaaggacaatcacaacctgattgaacgaagaagaagatttaacataaatgaccgcattaaagaactaggtactttgattcccaagtcaaatgatccagacatgcgctggaacaagggaaccatcttaaaagcatccgtggactatatccgaaagttgcaacgagaacagcaacgcgcaaaagaacttgaaaaccgacagaagaaactggagcacgccaaccggcatttgttgctcagaatacaggaacttgaaatgcaggctcgagctcatggactttcccttattccatccacgggtctctgctctccagatttggtgaatcggatcatcaagcaagaacccgttcttgagaactgcagccaagacctccttcagcatcatgcagacctaacctgtacaacaactctcgatctcacggatggcaccatcaccttcaacaacaacctcggaactgggactgaggccaaccaagcctatagtgtccccacaaaaatgggatccaaactggaagacatcctgatggacgacaccctttctcccgtcggtgtcactgatccactcctttcctcagtgtcccccggagcttccaaaacaagcagccggaggagcagtatgagcatggaagagacggagcacacttgttagcgaatcctccctgcactgcattcgcacaaactgcttcctttcttgattcgtagatttaataacttacctgaaggggttttcttgataattttcctttaatatgaaattttttttcatgctttatcaatagcccaggatatattttatttttagaattttgtgaaacagacttgtatattctattttacaactacaaatgcctccaaagtattgtacaaataagtgtgcagtatctgtgaactgaattcaccacagactttagctttctgagcaagaggattttgcgtcagagaaatgtctgtccatttttattcaggggaaacttgatttgagatttttatgcctgtgacttccttggaaatcaaatgtaaagtttaattgaaagaatgtaaagcaaccaaaaagaaaaaaaaaaagaaagaaagaggaaaagaaatccatactaacccttttccattttataaatgtattgattcattggtactgccttaaagatacagtacccctctagctttgtttagtctttatactgcaaactatttaaagaaatatgtattctgtaaaagaaaaaaaaaa

SEQ ID NO: 778 - DNA, 4573 bp, Homo sapiens
atgttgtatgcattttggttttcccacagcagttccgccgagcatcctggggcctccaagcctccgataagctcctccagtatgacatcacgcatcttgctacgccagcaactcatgcgtgagcagatgcaggagcaggagcgcagggagcagcagcagaagctgcaggcggcccagttcatgcaacagagagtgcccgtgagtcagacaccagccataaacgtcagtgtgcccaccacccttccctctgccacgcaggtgccgatggaagtccttaaggtgcagacccacctcgaaaaccccaccaagtaccacatacagcaagcccaacggcagcaggtaaagcagtacctttctaccactttagcaaataaacatgccaaccaagtcctgagcttgccatgtccaaaccagcctggcgatcatgtcatgccaccggtgccggggagcagcgcacccaacagccccatggctatgcttacgcttaactccaactgtgaaaaagagggattttataagtttgaagagcaaaacagggcagagagcgagtgcccaggcatgaacacacattcacgagcgtcctgtatgcagatggatgatgtaatcgatgacatcattagcctagaatcaagttataatgaggaaatcttgggcttgatggatcctgctttgcaaatggcaaatacgttgcctgtctcgggaaacttgattgatctttatggaaaccaaggtctgcccccaccaggcctcaccatcagcaactcctgtccagccaaccttcccaacataaaaagggagctcacagagtctgaagcaagagcactggccaaagagaggcagaaaaaggacaatcacaacctgattgaacgaagaagaagatttaacataaatgaccgcattaaagaactaggtactttgattcccaagtcaaatgatccagacatgcgctggaacaagggaaccatcttaaaagcatccgtggactatatccgaaagttgcaacgagaacagcaacgcgcaaaagaacttgaaaaccgacagaagaaactggagcacgccaaccggcatttgttgctcagaatacaggaacttgaaatgcaggctcgagctcatggactttcccttattccatccacgggtctctgctctccagatttggtgaatcggatcatcaagcaagaacccgttcttgagaactgcagccaagacctccttcagcatcatgcagacctaacctgtacaacaactctcgatctcacggatggcaccatcaccttcaacaacaacctcggaactgggactgaggccaaccaagcctatagtgtccccacaaaaatgggatccaaactggaagacatcctgatggacgacaccctttctcccgtcggtgtcactgatccactcctttcctcagtgtcccccggagcttccaaaacaagcagccggaggagcagtatgagcatggaagagacggagcacacttgttagcgaatcctccctgcactgcattcgcacaaactgcttcctttcttgattcgtagatttaataacttacctgaaggggttttcttgataattttcctttaatatgaaattttttttcatgctttatcaatagcccaggatatattttatttttagaattttgtgaaacagacttgtatattctattttacaactacaaatgcctccaaagtattgtacaaataagtgtgcagtatctgtgaactgaattcaccacagactttagctttctgagcaagaggattttgcgtcagagaaatgtctgtccatttttattcaggggaaacttgatttgagatttttatgcctgtgacttccttggaaatcaaatgtaaagtttaattgaaagaatgtaaagcaaccaaaaagaaaaaaaaaaagaaagaaagaggaaaagaaatccatactaacccttttccattttataaatgtattgattcattggtactgccttaaagatacagtacccctctagctttgtttagtctttatactgcaaactatttaaagaaatatgtattctgtaaaagaaaaaaaaaatgcggccttttcatgaggatcgtctggttagaaaacataactgataccaaccgaaactgaagggagttagaccaaggctctgaaatataaagtctaatcttgctctcttttattctgtgctgttacagttttcttcatcaatgagtgtgatccagtttttcataagatattttattttgaaatggaaattaatgtcctctcaaagtaaaatattgaggagcactgaaagtatgttttactttttttttattttatttttgcttttgataagaaaaccgaactgggcatatttctaattggctttactatttttatttttaaattatgttttactgttcatttgatttgtacagattctttattatcattgttcttttcaatatatttgtattaatttgtaagaatatgcatcttaaaatggcaagttttccatatttttacaactcactggtggttttccgcattctttgtacacccatgaaagaaaacttttatgcaaggtcttgcatttaaaagacagctttgcgaatattttgtaaattacagtctcactcagaactgtttttggacacatttaaggtgtagtattaataggttaaaaccaggctttctagaaagaataaacttacatatttatttttaggacatgaaaatagcaatattcttggagattgataaccatagcattaatacgcccattatggtcatttaaattggggtttatttcagcaaacttgttgaatttatttttaagaaagaaatactgtattgggaagttactgttacttgataacaatgttttaacaagaagcaatgttataaagttagtttcagtgcattatctacttgtgtagtcctatgcaataacagtagtgttacatgtatcaagcctagatgttttatacagatgccatatagtgttatgagccaggctgttgaatggaatttctcagtagcagcctacaactgaatagcaagtggcataaagcatatccattcagaatgaagtgccttaaatatagcagtagtcttttttggactagcactgactgaactgtaatgtaggggaaagtttcatgatggtatctatagtcaagacgaacatgtagcatggtgcctatgtagacaatataagagcttccaattttccttcagatatttttaatattaaatatattttagtgacagagtgccaacttctttcatcaggaaaccttattcaggagggtttttaaaaagtgtttaaatgtcaaatgtgaattggtgatgggtgatggagggttcagagaggagtgatcgtcagatgtgtgaatggacggtttaggtgaaaataatcaactgcatagttcccatgcacgctgggcaatgagaatccttggaaacattggtgatgctatcagttttatagctttatttcttaagggggtagggaaaattagttcccattctttcaacccccttaactgtatagctcttttcctagaatagtgacgcaaatctgcatgaacagctaattgtaccatagtgttcattgatacaatcatagcattgtctatttttctcttcatatttatatgggggggagggcgctggatgcaaaagttgaagatcgtgatgctatgatgttagttttccttagctgattttgagggtttttaaaaataaagcaaggttgactaacctacggccacgggaacaggaccatggttaagcaaccatatagaaagctttgttgaaagaaagtatggcatcttgtaccactgccctgactgtcacaactcctaaccttgccattgcctgcctccccctccccttctccttaagagacaatttctgcaggtggcaggtgagcaagcccaggagaatgctgcaatcttgggggtggttttatttatttcttttttgccaaatagagtgtggattcatttcaggggctagctaagccaagaggcagtggtttgggcttgttgtttgtaacaagaaaatgatccacaccactcccccgattcccgggtgcagaattgtaactcggggttgggcctctatatggagtgaccaaaatgccaaaattgtccatctgcctctgagtagggcaatggaaataccaaaccttctgactttgccaaaaagcatacaagcaacctggtcatacataggatgacaaaattctttctggttgtttttaaacaataaagcaataagaacaaatacaatacataggaagttaaaagcacaaaggaatgaacttattaatatttttgaaaaatgcactgggaaaaagttgatgtcaataacagtataaaacagccctatttcttgataaaaaatgacaaatgactgtctcttgcggatgcttggtactgtaatgttaataatagtcacctgctgttggatgcagcaataatttctgtatggtccatagcactgtatattatggatcgatattaatgtatccaatgaaataatcgacttgttcttgatagcctcattaaagcatttggtttttcac

SEQ ID NO: 779 - DNA, 2489 bp, Homo sapiens
ggcgagcgggcagagctcggcactgcgccggggcgcacggctcgggggacccaggcccagctaccttccctccgcccccgggctctgttctcactttccagcagtggaaggacgggaagcgggagccatgcagtccgaatcggggatcgtgccggatttcgaagtcggggaggagtttcatgaagagcccaaaacctattacgaactcaaaagtcaaccgctgaagagcagcagttccgccgagcatcctggggcctccaagcctccgataagctcctccagtatgacatcacgcatcttgctacgccagcaactcatgcgtgagcagatgcaggagcaggagcgcagggagcagcagcagaagctgcaggcggcccagttcatgcaacagagagtgcccgtgagtcagacaccagccataaacgtcagtgtgcccaccacccttccctctgccacgcaggtgccgatggaagtccttaaggtgcagacccacctcgaaaaccccaccaagtaccacatacagcaagcccaacggcagcaggtaaagcagtacctttctaccactttagcaaataaacatgccaaccaagtcctgagcttgccatgtccaaaccagcctggcgatcatgtcatgccaccggtgccggggagcagcgcacccaacagccccatggctatgcttacgcttaactccaactgtgaaaaagagggattttataagtttgaagagcaaaacagggcagagagcgagtgcccaggcatgaacacacattcacgagcgtcctgtatgcagatggatgatgtaatcgatgacatcattagcctagaatcaagttataatgaggaaatcttgggcttgatggatcctgctttgcaaatggcaaatacgttgcctgtctcgggaaacttgattgatctttatggaaaccaaggtctgcccccaccaggcctcaccatcagcaactcctgtccagccaaccttcccaacataaaaagggagctcacagcgtgtatttttcccacagagtctgaagcaagagcactggccaaagagaggcagaaaaaggacaatcacaacctgattgaacgaagaagaagatttaacataaatgaccgcattaaagaactaggtactttgattcccaagtcaaatgatccagacatgcgctggaacaagggaaccatcttaaaagcatccgtggactatatccgaaagttgcaacgagaacagcaacgcgcaaaagaacttgaaaaccgacagaagaaactggagcacgccaaccggcatttgttgctcagaatacaggaacttgaaatgcaggctcgagctcatggactttcccttattccatccacgggtctctgctctccagatttggtgaatcggatcatcaagcaagaacccgttcttgagaactgcagccaagacctccttcagcatcatgcagacctaacctgtacaacaactctcgatctcacggatggcaccatcaccttcaacaacaacctcggaactgggactgaggccaaccaagcctatagtgtccccacaaaaatgggatccaaactggaagacatcctgatggacgacaccctttctcccgtcggtgtcactgatccactcctttcctcagtgtcccccggagcttccaaaacaagcagccggaggagcagtatgagcatggaagagacggagcacacttgttagcgaatcctccctgcactgcattcgcacaaactgcttcctttcttgattcgtagatttaataacttacctgaaggggttttcttgataattttcctttaatatgaaattttttttcatgctttatcaatagcccaggatatattttatttttagaattttgtgaaacagacttgtatattctattttacaactacaaatgcctccaaagtattgtacaaataagtgtgcagtatctgtgaactgaattcaccacagactttagctttctgagcaagaggattttgcgtcagagaaatgtctgtccatttttattcaggggaaacttgatttgagatttttatgcctgtgacttccttggaaatcaaatgtaaagtttaattgaaagaatgtaaagcaaccaaaaagaaaaaaaaaaagaaagaaagaggaaaagaaatccatactaacccttttccattttataaatgtattgattcattggtactgccttaaagatacagtacccctctagctttgtttagtctttatactgcaaactatttaaagaaatatgtattctgtaaaagaaaaaaaaaatgcggccttttcatgaggatcgtctggttagaaaacataactgataccaaccgaaactgaagggagttagaccaaggctctgaaatataaagtctaatcttgctctcttttattctgtgctgttacagttttcttcatcaatgagtgtgatccagtttttcataagatattttattttgaaatggaaattaatgtcctctcaaag

SEQ ID NO: 780 - DNA, 1163 bp, Homo sapiens
agtgacacagccagtgccagaactaactttgactttcactcttcgccaagggcttgcagaacaccttaaaggaaaaaagatggaggcgcttagagttcagatgttcatgccatgctcctttgaaagcttgtatctcagttccgccgagcatcctggggcctccaagcctccgataagctcctccagtatgacatcacgcatcttgctacgccagcaactcatgcgtgagcagatgcaggagcaggagcgcagggagcagcagcagaagctgcaggcggcccagttcatgcaacagagagtgcccgtgagtcagacaccagccataaacgtcagtgtgcccaccacccttccctctgccacgcaggtgccgatggaagtccttaaggtgcagacccacctcgaaaaccccaccaagtaccacatacagcaagcccaacggcagcaggtaaagcagtacctttctaccactttagcaaataaacatgccaaccaagtcctgagcttgccatgtccaaaccagcctggcgatcatgtcatgccaccggtgccggggagcagcgcacccaacagccccatggctatgcttacgcttaactccaactgtgaaaaagagggattttataagtttgaagagcaaaacagggcagagagcgagtgcccaggcatgaacacacattcacgagcgtcctgtatgcagatggatgatgtaatcgatgacatcattagcctagaatcaagttataatgaggaaatcttgggcttgatggatcctgctttgcaaatggcaaatacgttgcctgtctcgggaaacttgattgatctttatggaaaccaaggtctgcccccaccaggcctcaccatcagcaactcctgtccagccaaccttcccaacataaaaagggagctcacagcgtgtatttttcccacagagtctgaagcaagagcactggccaaagagaggcagaaaaaggacaatcacaacctgattgaacgaagaagaagatttaacataaatgaccgcattaaagaactaggtactttgattcccaagtcaaatgatccagacatgcgctggaacaagggaaccatcttaaaagcatccgtggactatatccgaaagttgcaacgagaacagcaacgcgcaaaagaacttgaaaaccgac

SEQ ID NO: 781 - DNA, 382 bp, Homo sapiens
cagacctattccgctccatctctgaagtcaaatgggacaccttgaaaatacttcagtggttttcccacgagctattttctctctctgtgaaaaggaaaccaggaaattgactctgtgcctgttttcaagaagcagttccgccgagcatcctggggcctccaagcctccgataagctcctccagtatgacatcacgcatcttgctacgccagcaactcatgcgtgagcagatgcaggagcaggagcgcagggagcagcagcagaagctgcaggcggcccagttcatgcaacagagagtgcccgtgagtcagacaccagccataaacgtcagtgtgcccaccacccttccctctgccacgcaggtgccgatggaagtccttaag

SEQ ID NO: 782 - DNA, 1074 bp, Homo sapiens
atgctggaaatgctagaatataatcactatcaggtgcagacccacctcgaaaaccccaccaagtaccacatacagcaagcccaacggcagcagggattttataagtttgaagagcaaaacagggcagagagcgagtgcccaggcatgaacacacattcacgagcgtcctgtatgcagatggatgatgtaatcgatgacatcattagcctagaatcaagttataatgaggaaatcttgggcttgatggatcctgctttgcaaatggcaaatacgttgcctgtctcgggaaacttgattgatctttatggaaaccaaggtctgcccccaccaggcctcaccatcagcaactcctgtccagccaaccttcccaacataaaaagggagctcacagagtctgaagcaagagcactggccaaagagaggcagaaaaaggacaatcacaacctgattgaacgaagaagaagatttaacataaatgaccgcattaaagaactaggtactttgattcccaagtcaaatgatccagacatgcgctggaacaagggaaccatcttaaaagcatccgtggactatatccgaaagttgcaacgagaacagcaacgcgcaaaagaacttgaaaaccgacagaagaaactggagcacgccaaccggcatttgttgctcagaatacaggaacttgaaatgcaggctcgagctcatggactttcccttattccatccacgggtctctgctctccagatttggtgaatcggatcatcaagcaagaacccgttcttgagaactgcagccaagacctccttcagcatcatgcagacctaacctgtacaacaactctcgatctcacggatggcaccatcaccttcaacaacaacctcggaactgggactgaggccaaccaagcctatagtgtccccacaaaaatgggatccaaactggaagacatcctgatggacgacaccctttctcccgtcggtgtcactgatccactcctttcctcagtgtcccccggagcttccaaaacaagcagccggaggagcagtatgagcatggaagagacggagcacacttgttag

SEQ ID NO: 783 - DNA, 1995 bp, Homo sapiens
aatttagccttcctagtgttgagagaaggtgcacgtaagcgtgtggcagaacgtctgcaatcgcatctttgtaataatctcctttctgagacggttcagtggactcaatgttccgccaaagggccaaggcagccctgcagttccgccgagcatcctggggcctccaagcctccgataagctcctccagtatgacatcacgcatcttgctacgccagcaactcatgcgtgagcagatgcaggagcaggagcgcagggagcagcagcagaagctgcaggcggcccagttcatgcaacagagagtgcccgtgagtcagacaccagccataaacgtcagtgtgcccaccacccttccctctgccacgcaggtgccgatggaagtccttaaggtgcagacccacctcgaaaaccccaccaagtaccacatacagcaagcccaacggcagcaggtaaagcagtacctttctaccactttagcaaataaacatgccaaccaagtcctgagcttgccatgtccaaaccagcctggcgatcatgtcatgccaccggtgccggggagcagcgcacccaacagccccatggctatgcttacgcttaactccaactgtgaaaaagagggattttataagtttgaagagcaaaacagggcagagagcgagtgcccaggcatgaacacacattcacgagcgtcctgtatgcagatggatgatgtaatcgatgacatcattagcctagaatcaagttataatgaggaaatcttgggcttgatggatcctgctttgcaaatggcaaatacgttgcctgtctcgggaaacttgattgatctttatggaaaccaaggtctgcccccaccaggcctcaccatcagcaactcctgtccagccaaccttcccaacataaaaagggagctcacagagtctgaagcaagagcactggccaaagagaggcagaaaaaggacaatcacaacctgattgaacgaagaagaagatttaacataaatgaccgcattaaagaactaggtactttgattcccaagtcaaatgatccagacatgcgctggaacaagggaaccatcttaaaagcatccgtggactatatccgaaagttgcaacgagaacagcaacgcgcaaaagaacttgaaaaccgacagaagaaactggagcacgccaaccggcatttgttgctcagaatacaggaacttgaaatgcaggctcgagctcatggactttcccttattccatccacgggtctctgctctccagatttggtgaatcggatcatcaagcaagaacccgttcttgagaactgcagccaagacctccttcagcatcatgcagacctaacctgtacaacaactctcgatctcacggatggcaccatcaccttcaacaacaacctcggaactgggactgaggccaaccaagcctatagtgtccccacaaaaatgggatccaaactggaagacatcctgatggacgacaccctttctcccgtcggtgtcactgatccactcctttcctcagtgtcccccggagcttccaaaacaagcagccggaggagcagtatgagcatggaagagacggagcacacttgttagcgaatcctccctgcactgcattcgcacaaactgcttcctttcttgattcgtagatttaataacttacctgaaggggttttcttgataattttcctttaatatgaaattttttttcatgctttatcaatagcccaggatatattttatttttagaattttgtgaaacagacttgtatattctattttacaactacaaatgcctccaaagtattgtacaaataagtgtgcagtatctgtgaactgaattcaccacagactttagctttctgagcaagaggattttgcgtcagagaaatgtctgtccatttttattcaggggaaacttgatttgagatttttatgcctgtgacttccttggaaatcaaatgtaaagtttaattgaaagaatgtaaagcaacc

SEQ ID NO: 784 - DNA, 4422 bp, Homo sapiens
atggctggcggagcctggggccgcctggcctgttacttggagttcctgaagaaggaggagctgaaggagttccagcttctgctcgccaataaagcgcactccaggagctcttcgggtgagacacccgctcagccagagaagacgagtggcatggaggtggcctcgtacctggtggctcagtatggggagcagcgggcctgggacctagccctccatacctgggagcagatggggctgaggtcactgtgcgcccaagcccaggaaggggcaggccactctccctcattcccctacagcccaagtgaaccccacctggggtctcccagccaacccacctccaccgcagtgctaatgccctggatccatgaattgccggcggggtgcacccagggctcagagagaagggttttgagacagctgcctgacacatctggacgccgctggagagaaatctctgcctcactcctctaccaagctcttccaagctccccagaccatgagtctccaagccaggagtcacccaacgcccccacatccacagcagtgctggggagctggggatccccacctcagcccagcctagcacccagagagcaggaggctcctgggacccaatggcctctggatgaaacgtcaggaatttactacacagaaatcagagaaagagagagagagaaatcagagaaaggcaggcccccatgggcagcggtggtaggaacgcccccacaggcgcacaccagcctacagccccaccaccacccatgggagccttctgtgagagagagcctctgttccacatggccctggaaaaatgaggattttaaccaaaaattcacacagctgctacttctacaaagacctcaccccagaagccaagatcccctggtcaagagaagctggcctgattatgtggaggagaatcgaggacatttaattgagatcagagacttatttggcccaggcctggatacccaagaacctcgcatagtcatactgcagggggctgctggaattgggaagtcaacactggccaggcaggtgaaggaagcctgggggagaggccagctgtatggggaccgcttccagcatgtcttctacttcagctgcagagagctggcccagtccaaggtggtgagtctcgctgagctcatcggaaaagatgggacagccactccggctcccattagacagatcctgtctaggccagagcggctgctcttcatcctcgatggtgtagatgagccaggatgggtcttgcaggagccgagttctgagctctgtctgcactggagccagccacagccggcggatgcactgctgggcagtttgctggggaaaactatacttcccgaggcatccttcctgatcacggctcggaccacagctctgcagaacctcattccttctttggagcaggcacgttgggtagaggtcctggggttctctgagtccagcaggaaggaatatttctacagatatttcacagatgaaaggcaagcaattagagcctttaggttggtcaaatcaaacaaagagctctgggccctgtgtcttgtgccctgggtgtcctggctggcctgcacttgcctgatgcagcagatgaagcggaaggaaaaactcacactgacttccaagaccaccacaaccctctgtctacattaccttgcccaggctctccaagctcagccattgggaccccagctcagagacctctgctctctggctgctgagggcatctggcaaaaaaagacccttttcagtccagatgacctcaggaagcatgggttagatggggccatcatctccaccttcttgaagatgggtattcttcaagagcaccccatccctctgagctacagcttcattcacctctgtttccaagagttctttgcagcaatgtcctatgtcttggaggatgagaaggggagaggtaaacattctaattgcatcatagatttggaaaagacgctagaagcatatggaatacatggcctgtttggggcatcaaccacacgtttcctattgggcctgttaagtgatgagggggagagagagatggagaacatctttcactgccggctgtctcaggggaggaacctgatgcagtgggtcccgtccctgcagctgctgctgcagccacactctctggagtccctccactgcttgtacgagactcggaacaaaacgttcctgacacaagtgatggcccatttcgaagaaatgggcatgtgtgtagaaacagacatggagctcttagtgtgcactttctgcattaaattcagccgccacgtgaagaagcttcagctgattgagggcaggcagcacagatcaacatggagccccaccatggtagtcctgttcaggtgggtcccagtcacagatgcctattggcagattctcttctccgtcctcaaggtcaccagaaacctgaaggagctggacctaagtggaaactcgctgagccactctgcagtgaagagtctttgtaagaccctgagacgccctcgctgcctcctggagaccctgcggttggctggctgtggcctcacagctgaggactgcaaggaccttgcctttgggctgagagccaaccagaccctgaccgagctggacctgagcttcaatgtgctcacggatgctggagccaaacacctttgccagagactgagacagccgagctgcaagctacagcgactgcagctggtcagctgtggcctcacgtctgactgctgccaggacctggcctctgtgcttagtgccagccccagcctgaaggagctagacctgcagcagaacaacctggatgacgttggcgtgcgactgctctgtgaggggctcaggcatcctgcctgcaaactcatacgcctggggctggaccagacaactctgagtgatgagatgaggcaggaactgagggccctggagcaggagaaacctcagctgctcatcttcagcagacggaaaccaagtgtgatgacccctactgagggcctggatacgggagagatgagtaatagcacatcctcactcaagcggcagagactcggatcagagagggcggcttcccatgttgctcaggctaatctcaaactcctggacgtgagcaagatcttcccaattgctgagattgcagaggaaagctccccagaggtagtaccggtggaactcttgtgcgtgccttctcctgcctctcaaggggacctgcatacgaagcctttggggactgacgatgacttctggggccccacggggcctgtggctactgaggtagttgacaaagaaaagaacttgtaccgagttcacttccctgtagctggctcctaccgctggcccaacacgggtctctgctttgtgatgagagaagcggtgaccgttgagattgaattctgtgtgtgggaccagttcctgggtgagatcaacccacagcacagctggatggtggcagggcctctgctggacatcaaggctgagcctggagctgtggaagctgtgcacctccctcactttgtggctctccaagggggccatgtggacacatccctgttccaaatggcccactttaaagaggaggggatgctcctggagaagccagccagggtggagctgcatcacatagttctggaaaaccccagcttctcccccttgggagtcctcctgaaaatgatccataatgccctgcgcttcattcccgtcacctctgtggtgttgctttaccaccgcgtccatcctgaggaagtcaccttccacctctacctgatcccaagtgactgctccattcggaaggccatagatgatctagaaatgaaattccagtttgtgcgaatccacaagccacccccgctgaccccactttatatgggctgtcgttacactgtgtctgggtctggttcagggatgctggaaatactccccaaggaactggagctctgctatcgaagccctggagaagaccagctgttctcggagttctacgttggccacttgggatcagggatcaggctgcaagtgaaagacaagaaagatgagactctggtgtgggaggccttggtgaaaccaggagatctcatgcctgcaactactctgatccctccagcccgcatagccgtaccttcacctctggatgccccgcagttgctgcactttgtggaccagtatcgagagcagctgatagcccgagtgacatcggtggaggttgtcttggacaaactgcatggacaggtgctgagccaggagcagtacgagagggtgctggctgagaacacgaggcccagccagatgcggaagctgttcagcttgagccagtcctgggaccggaagtgcaaagatggactctaccaagccctgaaggagacccatcctcacctcattatggaactctgggagaagggcagcaaaaagggactcctgccactcagcagctga

SEQ ID NO: 785 - DNA, 4200 bp, Homo sapiens
atggctggcggagcctggggccgcctggcctgttacttggagttcctgaagaaggaggagctgaaggagttccagcttctgctcgccaataaagcgcactccaggagctcttcgggtgagacacccgctcagccagagaagacgagtggcatggaggtggcctcgtacctggtggctcagtatggggagcagcgggcctgggacctagccctccatacctgggagcagatggggctgaggtcactgtgcgcccaagcccaggaaggggcaggccactctccctcattcccctacagcccaagtgaaccccacctggggtctcccagccaacccacctccaccgcagtgctaatgccctggatccatgaattgccggcggggtgcacccagggctcagagagaagggttttgagacagctgcctgacacatctggacgccgctggagagaaatctctgcctcactcctctaccaagctcttccaagctccccagaccatgagtctccaagccaggagtcacccaacgcccccacatccacagcagtgctggggagctggggatccccacctcagcccagcctagcacccagagagcaggaggctcctgggacccaatggcctctggatgaaacgtcaggaatttactacacagaaatcagagaaagagagagagagaaatcagagaaaggcaggcccccatgggcagcggtggtaggaacgcccccacaggcgcacaccagcctacagccccaccaccacccatgggagccttctgtgagagagagcctctgttccacatggccctggaaaaatgaggattttaaccaaaaattcacacagctgctacttctacaaagacctcaccccagaagccaagatcccctggtcaagagaagctggcctgattatgtggaggagaatcgaggacatttaattgagatcagagacttatttggcccaggcctggatacccaagaacctcgcatagtcatactgcagggggctgctggaattgggaagtcaacactggccaggcaggtgaaggaagcctgggggagaggccagctgtatggggaccgcttccagcatgtcttctacttcagctgcagagagctggcccagtccaaggtggtgagtctcgctgagctcatcggaaaagatgggacagccactccggctcccattagacagatcctgtctaggccagagcggctgctcttcatcctcgatggtgtagatgagccaggatgggtcttgcaggagccgagttctgagctctgtctgcactggagccagccacagccggcggatgcactgctgggcagtttgctggggaaaactatacttcccgaggcatccttcctgatcacggctcggaccacagctctgcagaacctcattccttctttggagcaggcacgttgggtagaggtcctggggttctctgagtccagcaggaaggaatatttctacagatatttcacagatgaaaggcaagcaattagagcctttaggttggtcaaatcaaacaaagagctctgggccctgtgtcttgtgccctgggtgtcctggctggcctgcacttgcctgatgcagcagatgaagcggaaggaaaaactcacactgacttccaagaccaccacaaccctctgtctacattaccttgcccaggctctccaagctcagccattgggaccccagctcagagacctctgctctctggctgctgagggcatctggcaaaaaaagacccttttcagtccagatgacctcaggaagcatgggttagatggggccatcatctccaccttcttgaagatgggtattcttcaagagcaccccatccctctgagctacagcttcattcacctctgtttccaagagttctttgcagcaatgtcctatgtcttggaggatgagaaggggagaggtaaacattctaattgcatcatagatttggaaaagacgctagaagcatatggaatacatggcctgtttggggcatcaaccacacgtttcctattgggcctgttaagtgatgagggggagagagagatggagaacatctttcactgccggctgtctcaggggaggaacctgatgcagtgggtcccgtccctgcagctgctgctgcagccacactctctggagtccctccactgcttgtacgagactcggaacaaaacgttcctgacacaagtgatggcccatttcgaagaaatgggcatgtgtgtagaaacagacatggagctcttagtgtgcactttctgcattaaattcagccgccacgtgaagaagcttcagctgattgagggcaggcagcacagatcaacatggagccccaccatggtagtcctgttcaggtgggtcccagtcacagatgcctattggcagattctcttctccgtcctcaaggtcaccagaaacctgaaggagctggacctaagtggaaactcgctgagccactctgcagtgaagagtctttgtaagaccctgagacgccctcgctgcctcctggagaccctgcggttggctggctgtggcctcacagctgaggactgcaaggaccttgcctttgggctgagagccaaccagaccctgaccgagctggacctgagcttcaatgtgctcacggatgctggagccaaacacctttgccagagactgagacagccgagctgcaagctacagcgactgcagctggtcagctgtggcctcacgtctgactgctgccaggacctggcctctgtgcttagtgccagccccagcctgaaggagctagacctgcagcagaacaacctggatgacgttggcgtgcgactgctctgtgaggggctcaggcatcctgcctgcaaactcatacgcctggggaaaccaagtgtgatgacccctactgagggcctggatacgggagagatgagtaatagcacatcctcactcaagcggcagagactcggatcagagagggcggcttcccatgttgctcaggctaatctcaaactcctggacgtgagcaagatcttcccaattgctgagattgcagaggaaagctccccagaggtagtaccggtggaactcttgtgcgtgccttctcctgcctctcaaggggacctgcatacgaagcctttggggactgacgatgacttctggggccccacggggcctgtggctactgaggtagttgacaaagaaaagaacttgtaccgagttcacttccctgtagctggctcctaccgctggcccaacacgggtctctgctttgtgatgagagaagcggtgaccgttgagattgaattctgtgtgtgggaccagttcctgggtgagatcaacccacagcacagctggatggtggcagggcctctgctggacatcaaggctgagcctggagctgtggaagctgtgcacctccctcactttgtggctctccaagggggccatgtggacacatccctgttccaaatggcccactttaaagaggaggggatgctcctggagaagccagccagggtggagctgcatcacatagttctggaaaaccccagcttctcccccttgggagtcctcctgaaaatgatccataatgccctgcgcttcattcccgtcacctctgtggtgttgctttaccaccgcgtccatcctgaggaagtcaccttccacctctacctgatcccaagtgactgctccattcggaaggaactggagctctgctatcgaagccctggagaagaccagctgttctcggagttctacgttggccacttgggatcagggatcaggctgcaagtgaaagacaagaaagatgagactctggtgtgggaggccttggtgaaaccaggagatctcatgcctgcaactactctgatccctccagcccgcatagccgtaccttcacctctggatgccccgcagttgctgcactttgtggaccagtatcgagagcagctgatagcccgagtgacatcggtggaggttgtcttggacaaactgcatggacaggtgctgagccaggagcagtacgagagggtgctggctgagaacacgaggcccagccagatgcggaagctgttcagcttgagccagtcctgggaccggaagtgcaaagatggactctaccaagccctgaaggagacccatcctcacctcattatggaactctgggagaagggcagcaaaaagggactcctgccactcagcagctga

SEQ ID NO: 786 - DNA, 5098 bp, Homo sapiens
cttgttgactaggcgctgttcttgctggctggtgccccagggcctggagaggtctgaagaaacctgggagccagcagcccggggctccactctgggttctgaaagcccattccctgctctgcggctcctcccaccccacctcttctcagccttgcagctcaagggttgatctcaggagtccaggacccaggagagggaagaatctgaggaacacagaacagtgagcgttgcccacaccccatctcccgtcaccacatctcccctcaccctcaccctccctgcctggccctggaccccatcccaggacctccctatcagctgacttcttccagtgtcttgcaggcccctctgggctcctccctcccctggcttttcctaccactccccctctatcggcgtctatctgtaggtgccctgggatttataaaactgggttccgaatgctgaataagagacggtaagagccaaggcaaaggacagcactgttctctgcctgcctgataccctcaccacctgggaacatcccccagacaccctcttaactccgggacagagatggctggcggagcctggggccgcctggcctgttacttggagttcctgaagaaggaggagctgaaggagttccagcttctgctcgccaataaagcgcactccaggagctcttcgggtgagacacccgctcagccagagaagacgagtggcatggaggtggcctcgtacctggtggctcagtatggggagcagcgggcctgggacctagccctccatacctgggagcagatggggctgaggtcactgtgcgcccaagcccaggaaggggcaggccactctccctcattcccctacagcccaagtgaaccccacctggggtctcccagccaacccacctccaccgcagtgctaatgccctggatccatgaattgccggcggggtgcacccagggctcagagagaagggttttgagacagctgcctgacacatctggacgccgctggagagaaatctctgcctcactcctctaccaagctcttccaagctccccagaccatgagtctccaagccaggagtcacccaacgcccccacatccacagcagtgctggggagctggggatccccacctcagcccagcctagcacccagagagcaggaggctcctgggacccaatggcctctggatgaaacgtcaggaatttactacacagaaatcagagaaagagagagagagaaatcagagaaaggcaggcccccatgggcagcggtggtaggaacgcccccacaggcgcacaccagcctacagccccaccaccacccatgggagccttctgtgagagagagcctctgttccacatggccctggaaaaatgaggattttaaccaaaaattcacacagctgctacttctacaaagacctcaccccagaagccaagatcccctggtcaagagaagctggcctgattatgtggaggagaatcgaggacatttaattgagatcagagacttatttggcccaggcctggatacccaagaacctcgcatagtcatactgcagggggctgctggaattgggaagtcaacactggccaggcaggtgaaggaagcctgggggagaggccagctgtatggggaccgcttccagcatgtcttctacttcagctgcagagagctggcccagtccaaggtggtgagtctcgctgagctcatcggaaaagatgggacagccactccggctcccattagacagatcctgtctaggccagagcggctgctcttcatcctcgatggtgtagatgagccaggatgggtcttgcaggagccgagttctgagctctgtctgcactggagccagccacagccggcggatgcactgctgggcagtttgctggggaaaactatacttcccgaggcatccttcctgatcacggctcggaccacagctctgcagaacctcattccttctttggagcaggcacgttgggtagaggtcctggggttctctgagtccagcaggaaggaatatttctacagatatttcacagatgaaaggcaagcaattagagcctttaggttggtcaaatcaaacaaagagctctgggccctgtgtcttgtgccctgggtgtcctggctggcctgcacttgcctgatgcagcagatgaagcggaaggaaaaactcacactgacttccaagaccaccacaaccctctgtctacattaccttgcccaggctctccaagctcagccattgggaccccagctcagagacctctgctctctggctgctgagggcatctggcaaaaaaagacccttttcagtccagatgacctcaggaagcatgggttagatggggccatcatctccaccttcttgaagatgggtattcttcaagagcaccccatccctctgagctacagcttcattcacctctgtttccaagagttctttgcagcaatgtcctatgtcttggaggatgagaaggggagaggtaaacattctaattgcatcatagatttggaaaagacgctagaagcatatggaatacatggcctgtttggggcatcaaccacacgtttcctattgggcctgttaagtgatgagggggagagagagatggagaacatctttcactgccggctgtctcaggggaggaacctgatgcagtgggtcccgtccctgcagctgctgctgcagccacactctctggagtccctccactgcttgtacgagactcggaacaaaacgttcctgacacaagtgatggcccatttcgaagaaatgggcatgtgtgtagaaacagacatggagctcttagtgtgcactttctgcattaaattcagccgccacgtgaagaagcttcagctgattgagggcaggcagcacagatcaacatggagccccaccatggtagtcctgttcaggtgggtcccagtcacagatgcctattggcagattctcttctccgtcctcaaggtcaccagaaacctgaaggagctggacctaagtggaaactcgctgagccactctgcagtgaagagtctttgtaagaccctgagacgccctcgctgcctcctggagaccctgcggttggctggctgtggcctcacagctgaggactgcaaggaccttgcctttgggctgagagccaaccagaccctgaccgagctggacctgagcttcaatgtgctcacggatgctggagccaaacacctttgccagagactgagacagccgagctgcaagctacagcgactgcagctggtcagctgtggcctcacgtctgactgctgccaggacctggcctctgtgcttagtgccagccccagcctgaaggagctagacctgcagcagaacaacctggatgacgttggcgtgcgactgctctgtgaggggctcaggcatcctgcctgcaaactcatacgcctggggctggaccagacaactctgagtgatgagatgaggcaggaactgagggccctggagcaggagaaacctcagctgctcatcttcagcagacggaaaccaagtgtgatgacccctactgagggcctggatacgggagagatgagtaatagcacatcctcactcaagcggcagagactcggatcagagagggcggcttcccatgttgctcaggctaatctcaaactcctggacgtgagcaagatcttcccaattgctgagattgcaggcaagagccacgaggaaagctccccagaggtagtaccggtggaactcttgtgcgtgccttctcctgcctctcaaggggacctgcatacgaagcctttggggactgacgatgacttctggggccccacggggcctgtggctactgaggtagttgacaaagaaaagaacttgtaccgagttcacttccctgtagctggctcctaccgctggcccaacacgggtctctgctttgtgatgagagaagcggtgaccgttgagattgaattctgtgtgtgggaccagttcctgggtgagatcaacccacagcacagctggatggtggcagggcctctgctggacatcaaggctgagcctggagctgtggaagctgtgcacctccctcactttgtggctctccaagggggccatgtggacacatccctgttccaaatggcccactttaaagaggaggggatgctcctggagaagccagccagggtggagctgcatcacatagttctggaaaaccccagcttctcccccttgggagtcctcctgaaaatgatccataatgccctgcgcttcattcccgtcacctctgtggtgttgctttaccaccgcgtccatcctgaggaagtcaccttccacctctacctgatcccaagtgactgctccattcggaaggccatagatgatctagaaatgaaattccagtttgtgcgaatccacaagccacccccgctgaccccactttatatgggctgtcgttacactgtgtctgggtctggttcagggatgctggaaatactccccaaggaactggagctctgctatcgaagccctggagaagaccagctgttctcggagttctacgttggccacttgggatcagggatcaggctgcaagtgaaagacaagaaagatgagactctggtgtgggaggccttggtgaaaccaggaaggaacaccagccagccgtggaacctcaggtgcaacagagacgccaggagatactagtgcccagcagcctgcggcagtaccaatgaagccagagagggcttggtggatgacaaggaggcctgagtagaccgcaggtgggtctgagaaatgggcttaggtgaggcaggtctttgaaggatttgttcttaatcatatgcgagatgctcaaaaggctggatgcctgcttttgtgggtgaagagcaagaagagaaaacaggttgtacacatacagatgcagatggagagacagagaaaaaaaaggaagaaggcagagaaatgcaccaattcttgagctgtattatctctggaccttgggattgtgggaggctttattttactactgattttgcctacactgttttctcaatttctagttttctacaaagatgatgtgttagctttttcacgcattaagattaaaatttaaaacaga

SEQ ID NO: 787 - DNA, 5612 bp, Homo sapiens
cttgttgactaggcgctgttcttgctggctggtgccccagggcctggagaggtctgaagaaacctgggagccagcagcccggggctccactctgggttctgaaagcccattccctgctctgcggctcctcccaccccacctcttctcagccttgcagctcaagggttgatctcaggagtccaggacccaggagagggaagaatctgaggaacacagaacagtgagcgttgcccacaccccatctcccgtcaccacatctcccctcaccctcaccctccctgcctggccctggaccccatcccaggacctccctatcagctgacttcttccagtgtcttgcaggcccctctgggctcctccctcccctggcttttcctaccactccccctctatcggcgtctatctgtaggtgccctgggatttataaaactgggttccgaatgctgaataagagacggtaagagccaaggcaaaggacagcactgttctctgcctgcctgataccctcaccacctgggaacatcccccagacaccctcttaactccgggacagagatggctggcggagcctggggccgcctggcctgttacttggagttcctgaagaaggaggagctgaaggagttccagcttctgctcgccaataaagcgcactccaggagctcttcgggtgagacacccgctcagccagagaagacgagtggcatggaggtggcctcgtacctggtggctcagtatggggagcagcgggcctgggacctagccctccatacctgggagcagatggggctgaggtcactgtgcgcccaagcccaggaaggggcaggccactctccctcattcccctacagcccaagtgaaccccacctggggtctcccagccaacccacctccaccgcagtgctaatgccctggatccatgaattgccggcggggtgcacccagggctcagagagaagggttttgagacagctgcctgacacatctggacgccgctggagagaaatctctgcctcactcctctaccaagctcttccaagctccccagaccatgagtctccaagccaggagtcacccaacgcccccacatccacagcagtgctggggagctggggatccccacctcagcccagcctagcacccagagagcaggaggctcctgggacccaatggcctctggatgaaacgtcaggaatttactacacagaaatcagagaaagagagagagagaaatcagagaaaggcaggcccccatgggcagcggtggtaggaacgcccccacaggcgcacaccagcctacagccccaccaccacccatgggagccttctgtgagagagagcctctgttccacatggccctggaaaaatgaggattttaaccaaaaattcacacagctgctacttctacaaagacctcaccccagaagccaagatcccctggtcaagagaagctggcctgattatgtggaggagaatcgaggacatttaattgagatcagagacttatttggcccaggcctggatacccaagaacctcgcatagtcatactgcagggggctgctggaattgggaagtcaacactggccaggcaggtgaaggaagcctgggggagaggccagctgtatggggaccgcttccagcatgtcttctacttcagctgcagagagctggcccagtccaaggtggtgagtctcgctgagctcatcggaaaagatgggacagccactccggctcccattagacagatcctgtctaggccagagcggctgctcttcatcctcgatggtgtagatgagccaggatgggtcttgcaggagccgagttctgagctctgtctgcactggagccagccacagccggcggatgcactgctgggcagtttgctggggaaaactatacttcccgaggcatccttcctgatcacggctcggaccacagctctgcagaacctcattccttctttggagcaggcacgttgggtagaggtcctggggttctctgagtccagcaggaaggaatatttctacagatatttcacagatgaaaggcaagcaattagagcctttaggttggtcaaatcaaacaaagagctctgggccctgtgtcttgtgccctgggtgtcctggctggcctgcacttgcctgatgcagcagatgaagcggaaggaaaaactcacactgacttccaagaccaccacaaccctctgtctacattaccttgcccaggctctccaagctcagccattgggaccccagctcagagacctctgctctctggctgctgagggcatctggcaaaaaaagacccttttcagtccagatgacctcaggaagcatgggttagatggggccatcatctccaccttcttgaagatgggtattcttcaagagcaccccatccctctgagctacagcttcattcacctctgtttccaagagttctttgcagcaatgtcctatgtcttggaggatgagaaggggagaggtaaacattctaattgcatcatagatttggaaaagacgctagaagcatatggaatacatggcctgtttggggcatcaaccacacgtttcctattgggcctgttaagtgatgagggggagagagagatggagaacatctttcactgccggctgtctcaggggaggaacctgatgcagtgggtcccgtccctgcagctgctgctgcagccacactctctggagtccctccactgcttgtacgagactcggaacaaaacgttcctgacacaagtgatggcccatttcgaagaaatgggcatgtgtgtagaaacagacatggagctcttagtgtgcactttctgcattaaattcagccgccacgtgaagaagcttcagctgattgagggcaggcagcacagatcaacatggagccccaccatggtagtcctgttcaggtgggtcccagtcacagatgcctattggcagattctcttctccgtcctcaaggtcaccagaaacctgaaggagctggacctaagtggaaactcgctgagccactctgcagtgaagagtctttgtaagaccctgagacgccctcgctgcctcctggagaccctgcggttggctggctgtggcctcacagctgaggactgcaaggaccttgcctttgggctgagagccaaccagaccctgaccgagctggacctgagcttcaatgtgctcacggatgctggagccaaacacctttgccagagactgagacagccgagctgcaagctacagcgactgcagctggtcagctgtggcctcacgtctgactgctgccaggacctggcctctgtgcttagtgccagccccagcctgaaggagctagacctgcagcagaacaacctggatgacgttggcgtgcgactgctctgtgaggggctcaggcatcctgcctgcaaactcatacgcctggggctggaccagacaactctgagtgatgagatgaggcaggaactgagggccctggagcaggagaaacctcagctgctcatcttcagcagacggaaaccaagtgtgatgacccctactgagggcctggatacgggagagatgagtaatagcacatcctcactcaagcggcagagactcggatcagagagggcggcttcccatgttgctcaggctaatctcaaactcctggacgtgagcaagatcttcccaattgctgagattgcagaggaaagctccccagaggtagtaccggtggaactcttgtgcgtgccttctcctgcctctcaaggggacctgcatacgaagcctttggggactgacgatgacttctggggccccacggggcctgtggctactgaggtagttgacaaagaaaagaacttgtaccgagttcacttccctgtagctggctcctaccgctggcccaacacgggtctctgctttgtgatgagagaagcggtgaccgttgagattgaattctgtgtgtgggaccagttcctgggtgagatcaacccacagcacagctggatggtggcagggcctctgctggacatcaaggctgagcctggagctgtggaagctgtgcacctccctcactttgtggctctccaagggggccatgtggacacatccctgttccaaatggcccactttaaagaggaggggatgctcctggagaagccagccagggtggagctgcatcacatagttctggaaaaccccagcttctcccccttgggagtcctcctgaaaatgatccataatgccctgcgcttcattcccgtcacctctgtggtgttgctttaccaccgcgtccatcctgaggaagtcaccttccacctctacctgatcccaagtgactgctccattcggaaggccatagatgatctagaaatgaaattccagtttgtgcgaatccacaagccacccccgctgaccccactttatatgggctgtcgttacactgtgtctgggtctggttcagggatgctggaaatactccccaaggaactggagctctgctatcgaagccctggagaagaccagctgttctcggagttctacgttggccacttgggatcagggatcaggctgcaagtgaaagacaagaaagatgagactctggtgtgggaggccttggtgaaaccaggagatctcatgcctgcaactactctgatccctccagcccgcatagccgtaccttcacctctggatgccccgcagttgctgcactttgtggaccagtatcgagagcagctgatagcccgagtgacatcggtggaggttgtcttggacaaactgcatggacaggtgctgagccaggagcagtacgagagggtgctggctgagaacacgaggcccagccagatgcggaagctgttcagcttgagccagtcctgggaccggaagtgcaaagatggactctaccaagccctgaaggagacccatcctcacctcattatggaactctgggagaagggcagcaaaaagggactcctgccactcagcagctgaagtatcaacaccagcccttgacccttgagtcctggctttggctgacccttctttgggtctcagtttctttctctgcaaacaagttgccatctggtttgccttccagcactaaagtaatggaactttgatgatgcctttgctgggcattatgtgtccatgccagggatgccacagggggccccagtccaggtggcctaacagcatctcagggaatgtccatctggagctggcaagacccctgcagacctcatagagcctcatctggtggccacagcagccaagcctagagccctccggatcccatccaggcgcaaagaggaataggagggacatggaaccatttgcctctggctgtgtcacagggtgagccccaaaattggggttcagcgtgggaggccacgtggattcttggctttgtacaggaagatctacaagagcaagccaacagagtaaagtggaaggaagtttattcagaaaataaaggagtatcacagctcttttagaatttgtctagcaggctttccagtttttaccagaaaacccctataaattaaaaattttttacttaaatttaagaattaaaaaaatacaaaaaagaaaaaatgaaaataaaggaataagaagttacctactcc

SEQ ID NO: 788 - DNA, 5480 bp, Homo sapiens
cttgttgactaggcgctgttcttgctggctggtgccccagggcctggagaggtctgaagaaacctgggagccagcagcccggggctccactctgggttctgaaagcccattccctgctctgcggctcctcccaccccacctcttctcagccttgcagctcaagggttgatctcaggagtccaggacccaggagagggaagaatctgaggaacacagaacagtgagcgttgcccacaccccatctcccgtcaccacatctcccctcaccctcaccctccctgcctggccctggaccccatcccaggacctccctatcagctgacttcttccagtgtcttgcaggcccctctgggctcctccctcccctggcttttcctaccactccccctctatcggcgtctatctgtaggtgccctgggatttataaaactgggttccgaatgctgaataagagacggtaagagccaaggcaaaggacagcactgttctctgcctgcctgataccctcaccacctgggaacatcccccagacaccctcttaactccgggacagagatggctggcggagcctggggccgcctggcctgttacttggagttcctgaagaaggaggagctgaaggagttccagcttctgctcgccaataaagcgcactccaggagctcttcgggtgagacacccgctcagccagagaagacgagtggcatggaggtggcctcgtacctggtggctcagtatggggagcagcgggcctgggacctagccctccatacctgggagcagatggggctgaggtcactgtgcgcccaagcccaggaaggggcaggccactctccctcattcccctacagcccaagtgaaccccacctggggtctcccagccaacccacctccaccgcagtgctaatgccctggatccatgaattgccggcggggtgcacccagggctcagagagaagggttttgagacagctgcctgacacatctggacgccgctggagagaaatctctgcctcactcctctaccaagctcttccaagctccccagaccatgagtctccaagccaggagtcacccaacgcccccacatccacagcagtgctggggagctggggatccccacctcagcccagcctagcacccagagagcaggaggctcctgggacccaatggcctctggatgaaacgtcaggaatttactacacagaaatcagagaaagagagagagagaaatcagagaaaggcaggcccccatgggcagcggtggtaggaacgcccccacaggcgcacaccagcctacagccccaccaccacccatgggagccttctgtgagagagagcctctgttccacatggccctggaaaaatgaggattttaaccaaaaattcacacagctgctacttctacaaagacctcaccccagaagccaagatcccctggtcaagagaagctggcctgattatgtggaggagaatcgaggacatttaattgagatcagagacttatttggcccaggcctggatacccaagaacctcgcatagtcatactgcagggggctgctggaattgggaagtcaacactggccaggcaggtgaaggaagcctgggggagaggccagctgtatggggaccgcttccagcatgtcttctacttcagctgcagagagctggcccagtccaaggtggtgagtctcgctgagctcatcggaaaagatgggacagccactccggctcccattagacagatcctgtctaggccagagcggctgctcttcatcctcgatggtgtagatgagccaggatgggtcttgcaggagccgagttctgagctctgtctgcactggagccagccacagccggcggatgcactgctgggcagtttgctggggaaaactatacttcccgaggcatccttcctgatcacggctcggaccacagctctgcagaacctcattccttctttggagcaggcacgttgggtagaggtcctggggttctctgagtccagcaggaaggaatatttctacagatatttcacagatgaaaggcaagcaattagagcctttaggttggtcaaatcaaacaaagagctctgggccctgtgtcttgtgccctgggtgtcctggctggcctgcacttgcctgatgcagcagatgaagcggaaggaaaaactcacactgacttccaagaccaccacaaccctctgtctacattaccttgcccaggctctccaagctcagccattgggaccccagctcagagacctctgctctctggctgctgagggcatctggcaaaaaaagacccttttcagtccagatgacctcaggaagcatgggttagatggggccatcatctccaccttcttgaagatgggtattcttcaagagcaccccatccctctgagctacagcttcattcacctctgtttccaagagttctttgcagcaatgtcctatgtcttggaggatgagaaggggagaggtaaacattctaattgcatcatagatttggaaaagacgctagaagcatatggaatacatggcctgtttggggcatcaaccacacgtttcctattgggcctgttaagtgatgagggggagagagagatggagaacatctttcactgccggctgtctcaggggaggaacctgatgcagtgggtcccgtccctgcagctgctgctgcagccacactctctggagtccctccactgcttgtacgagactcggaacaaaacgttcctgacacaagtgatggcccatttcgaagaaatgggcatgtgtgtagaaacagacatggagctcttagtgtgcactttctgcattaaattcagccgccacgtgaagaagcttcagctgattgagggcaggcagcacagatcaacatggagccccaccatggtagtcctgttcaggtgggtcccagtcacagatgcctattggcagattctcttctccgtcctcaaggtcaccagaaacctgaaggagctggacctaagtggaaactcgctgagccactctgcagtgaagagtctttgtaagaccctgagacgccctcgctgcctcctggagaccctgcggttggctggctgtggcctcacagctgaggactgcaaggaccttgcctttgggctgagagccaaccagaccctgaccgagctggacctgagcttcaatgtgctcacggatgctggagccaaacacctttgccagagactgagacagccgagctgcaagctacagcgactgcagctggtcagctgtggcctcacgtctgactgctgccaggacctggcctctgtgcttagtgccagccccagcctgaaggagctagacctgcagcagaacaacctggatgacgttggcgtgcgactgctctgtgaggggctcaggcatcctgcctgcaaactcatacgcctggggctggaccagacaactctgagtgatgagatgaggcaggaactgagggccctggagcaggagaaacctcagctgctcatcttcagcagacggaaaccaagtgtgatgacccctactgagggcctggatacgggagagatgagtaatagcacatcctcactcaagcggcagagactcggatcagagagggcggcttcccatgttgctcaggctaatctcaaactcctggacgtgagcaagatcttcccaattgctgagattgcagaggaaagctccccagaggtagtaccggtggaactcttgtgcgtgccttctcctgcctctcaaggggacctgcatacgaagcctttggggactgacgatgacttctggggccccacggggcctgtggctactgaggtagttgacaaagaaaagaacttgtaccgagttcacttccctgtagctggctcctaccgctggcccaacacgggtctctgctttgtgatgagagaagcggtgaccgttgagattgaattctgtgtgtgggaccagttcctgggtgagatcaacccacagcacagctggatggtggcagggcctctgctggacatcaaggctgagcctggagctgtggaagctgtgcacctccctcactttgtggctctccaagggggccatgtggacacatccctgttccaaatggcccactttaaagaggaggggatgctcctggagaagccagccagggtggagctgcatcacatagttctggaaaaccccagcttctcccccttgggagtcctcctgaaaatgatccataatgccctgcgcttcattcccgtcacctctgtggtgttgctttaccaccgcgtccatcctgaggaagtcaccttccacctctacctgatcccaagtgactgctccattcggaaggaactggagctctgctatcgaagccctggagaagaccagctgttctcggagttctacgttggccacttgggatcagggatcaggctgcaagtgaaagacaagaaagatgagactctggtgtgggaggccttggtgaaaccaggagatctcatgcctgcaactactctgatccctccagcccgcatagccgtaccttcacctctggatgccccgcagttgctgcactttgtggaccagtatcgagagcagctgatagcccgagtgacatcggtggaggttgtcttggacaaactgcatggacaggtgctgagccaggagcagtacgagagggtgctggctgagaacacgaggcccagccagatgcggaagctgttcagcttgagccagtcctgggaccggaagtgcaaagatggactctaccaagccctgaaggagacccatcctcacctcattatggaactctgggagaagggcagcaaaaagggactcctgccactcagcagctgaagtatcaacaccagcccttgacccttgagtcctggctttggctgacccttctttgggtctcagtttctttctctgcaaacaagttgccatctggtttgccttccagcactaaagtaatggaactttgatgatgcctttgctgggcattatgtgtccatgccagggatgccacagggggccccagtccaggtggcctaacagcatctcagggaatgtccatctggagctggcaagacccctgcagacctcatagagcctcatctggtggccacagcagccaagcctagagccctccggatcccatccaggcgcaaagaggaataggagggacatggaaccatttgcctctggctgtgtcacagggtgagccccaaaattggggttcagcgtgggaggccacgtggattcttggctttgtacaggaagatctacaagagcaagccaacagagtaaagtggaaggaagtttattcagaaaataaaggagtatcacagctcttttagaatttgtctagcaggctttccagtttttaccagaaaacccctataaattaaaaattttttacttaaatttaagaattaaaaaaatacaaaaaagaaaaaatgaaaataaaggaataagaagttacctactcc

SEQ ID NO: 789 - DNA, 5522 bp, Homo sapiens
cttgttgactaggcgctgttcttgctggctggtgccccagggcctggagaggtctgaagaaacctgggagccagcagcccggggctccactctgggttctgaaagcccattccctgctctgcggctcctcccaccccacctcttctcagccttgcagctcaagggttgatctcaggagtccaggacccaggagagggaagaatctgaggaacacagaacagtgagcgttgcccacaccccatctcccgtcaccacatctcccctcaccctcaccctccctgcctggccctggaccccatcccaggacctccctatcagctgacttcttccagtgtcttgcaggcccctctgggctcctccctcccctggcttttcctaccactccccctctatcggcgtctatctgtaggtgccctgggatttataaaactgggttccgaatgctgaataagagacggtaagagccaaggcaaaggacagcactgttctctgcctgcctgataccctcaccacctgggaacatcccccagacaccctcttaactccgggacagagatggctggcggagcctggggccgcctggcctgttacttggagttcctgaagaaggaggagctgaaggagttccagcttctgctcgccaataaagcgcactccaggagctcttcgggtgagacacccgctcagccagagaagacgagtggcatggaggtggcctcgtacctggtggctcagtatggggagcagcgggcctgggacctagccctccatacctgggagcagatggggctgaggtcactgtgcgcccaagcccaggaaggggcaggccactctccctcattcccctacagcccaagtgaaccccacctggggtctcccagccaacccacctccaccgcagtgctaatgccctggatccatgaattgccggcggggtgcacccagggctcagagagaagggttttgagacagctgcctgacacatctggacgccgctggagagaaatctctgcctcactcctctaccaagctcttccaagctccccagaccatgagtctccaagccaggagtcacccaacgcccccacatccacagcagtgctggggagctggggatccccacctcagcccagcctagcacccagagagcaggaggctcctgggacccaatggcctctggatgaaacgtcaggaatttactacacagaaatcagagaaagagagagagagaaatcagagaaaggcaggcccccatgggcagcggtggtaggaacgcccccacaggcgcacaccagcctacagccccaccaccacccatgggagccttctgtgagagagagcctctgttccacatggccctggaaaaatgaggattttaaccaaaaattcacacagctgctacttctacaaagacctcaccccagaagccaagatcccctggtcaagagaagctggcctgattatgtggaggagaatcgaggacatttaattgagatcagagacttatttggcccaggcctggatacccaagaacctcgcatagtcatactgcagggggctgctggaattgggaagtcaacactggccaggcaggtgaaggaagcctgggggagaggccagctgtatggggaccgcttccagcatgtcttctacttcagctgcagagagctggcccagtccaaggtggtgagtctcgctgagctcatcggaaaagatgggacagccactccggctcccattagacagatcctgtctaggccagagcggctgctcttcatcctcgatggtgtagatgagccaggatgggtcttgcaggagccgagttctgagctctgtctgcactggagccagccacagccggcggatgcactgctgggcagtttgctggggaaaactatacttcccgaggcatccttcctgatcacggctcggaccacagctctgcagaacctcattccttctttggagcaggcacgttgggtagaggtcctggggttctctgagtccagcaggaaggaatatttctacagatatttcacagatgaaaggcaagcaattagagcctttaggttggtcaaatcaaacaaagagctctgggccctgtgtcttgtgccctgggtgtcctggctggcctgcacttgcctgatgcagcagatgaagcggaaggaaaaactcacactgacttccaagaccaccacaaccctctgtctacattaccttgcccaggctctccaagctcagccattgggaccccagctcagagacctctgctctctggctgctgagggcatctggcaaaaaaagacccttttcagtccagatgacctcaggaagcatgggttagatggggccatcatctccaccttcttgaagatgggtattcttcaagagcaccccatccctctgagctacagcttcattcacctctgtttccaagagttctttgcagcaatgtcctatgtcttggaggatgagaaggggagaggtaaacattctaattgcatcatagatttggaaaagacgctagaagcatatggaatacatggcctgtttggggcatcaaccacacgtttcctattgggcctgttaagtgatgagggggagagagagatggagaacatctttcactgccggctgtctcaggggaggaacctgatgcagtgggtcccgtccctgcagctgctgctgcagccacactctctggagtccctccactgcttgtacgagactcggaacaaaacgttcctgacacaagtgatggcccatttcgaagaaatgggcatgtgtgtagaaacagacatggagctcttagtgtgcactttctgcattaaattcagccgccacgtgaagaagcttcagctgattgagggcaggcagcacagatcaacatggagccccaccatggtagtcctgttcaggtgggtcccagtcacagatgcctattggcagattctcttctccgtcctcaaggtcaccagaaacctgaaggagctggacctaagtggaaactcgctgagccactctgcagtgaagagtctttgtaagaccctgagacgccctcgctgcctcctggagaccctgcggttggctggctgtggcctcacagctgaggactgcaaggaccttgcctttgggctgagagccaaccagaccctgaccgagctggacctgagcttcaatgtgctcacggatgctggagccaaacacctttgccagagactgagacagccgagctgcaagctacagcgactgcagctggtcagctgtggcctcacgtctgactgctgccaggacctggcctctgtgcttagtgccagccccagcctgaaggagctagacctgcagcagaacaacctggatgacgttggcgtgcgactgctctgtgaggggctcaggcatcctgcctgcaaactcatacgcctggggaaaccaagtgtgatgacccctactgagggcctggatacgggagagatgagtaatagcacatcctcactcaagcggcagagactcggatcagagagggcggcttcccatgttgctcaggctaatctcaaactcctggacgtgagcaagatcttcccaattgctgagattgcagaggaaagctccccagaggtagtaccggtggaactcttgtgcgtgccttctcctgcctctcaaggggacctgcatacgaagcctttggggactgacgatgacttctggggccccacggggcctgtggctactgaggtagttgacaaagaaaagaacttgtaccgagttcacttccctgtagctggctcctaccgctggcccaacacgggtctctgctttgtgatgagagaagcggtgaccgttgagattgaattctgtgtgtgggaccagttcctgggtgagatcaacccacagcacagctggatggtggcagggcctctgctggacatcaaggctgagcctggagctgtggaagctgtgcacctccctcactttgtggctctccaagggggccatgtggacacatccctgttccaaatggcccactttaaagaggaggggatgctcctggagaagccagccagggtggagctgcatcacatagttctggaaaaccccagcttctcccccttgggagtcctcctgaaaatgatccataatgccctgcgcttcattcccgtcacctctgtggtgttgctttaccaccgcgtccatcctgaggaagtcaccttccacctctacctgatcccaagtgactgctccattcggaaggccatagatgatctagaaatgaaattccagtttgtgcgaatccacaagccacccccgctgaccccactttatatgggctgtcgttacactgtgtctgggtctggttcagggatgctggaaatactccccaaggaactggagctctgctatcgaagccctggagaagaccagctgttctcggagttctacgttggccacttgggatcagggatcaggctgcaagtgaaagacaagaaagatgagactctggtgtgggaggccttggtgaaaccaggagatctcatgcctgcaactactctgatccctccagcccgcatagccgtaccttcacctctggatgccccgcagttgctgcactttgtggaccagtatcgagagcagctgatagcccgagtgacatcggtggaggttgtcttggacaaactgcatggacaggtgctgagccaggagcagtacgagagggtgctggctgagaacacgaggcccagccagatgcggaagctgttcagcttgagccagtcctgggaccggaagtgcaaagatggactctaccaagccctgaaggagacccatcctcacctcattatggaactctgggagaagggcagcaaaaagggactcctgccactcagcagctgaagtatcaacaccagcccttgacccttgagtcctggctttggctgacccttctttgggtctcagtttctttctctgcaaacaagttgccatctggtttgccttccagcactaaagtaatggaactttgatgatgcctttgctgggcattatgtgtccatgccagggatgccacagggggccccagtccaggtggcctaacagcatctcagggaatgtccatctggagctggcaagacccctgcagacctcatagagcctcatctggtggccacagcagccaagcctagagccctccggatcccatccaggcgcaaagaggaataggagggacatggaaccatttgcctctggctgtgtcacagggtgagccccaaaattggggttcagcgtgggaggccacgtggattcttggctttgtacaggaagatctacaagagcaagccaacagagtaaagtggaaggaagtttattcagaaaataaaggagtatcacagctcttttagaatttgtctagcaggctttccagtttttaccagaaaacccctataaattaaaaattttttacttaaatttaagaattaaaaaaatacaaaaaagaaaaaatgaaaataaaggaataagaagttacctactcc

SEQ ID NO: 790 - DNA, 3401 bp, Homo sapiens
caaatcaaacaaagagctctgggccctgtgtcttgtgccctgggtgtcctggctggcctgcacttgcctgatgcagcagatgaagcggaaggaaaaactcacactgacttccaagaccaccacaaccctctgtctacattaccttgcccaggctctccaagctcagccattgggaccccagctcagagacctctgctctctggctgctgagggcatctggcaaaaaaagacccttttcagtccagatgacctcaggaagcatgggttagatggggccatcatctccaccttcttgaagatgggtattcttcaagagcaccccatccctctgagctacagcttcattcacctctgtttccaagagttctttgcagcaatgtcctatgtcttggaggatgagaaggggagaggtaaacattctaattgcatcatagatttggaaaagacgctagaagcatatggaatacatggcctgtttggggcatcaaccacacgtttcctattgggcctgttaagtgatgagggggagagagagatggagaacatctttcactgccggctgtctcaggggaggaacctgatgcagtgggtcccgtccctgcagctgctgctgcagccacactctctggagtccctccactgcttgtacgagactcggaacaaaacgttcctgacacaagtgatggcccatttcgaagaaatgggcatgtgtgtagaaacagacatggagctcttagtgtgcactttctgcattaaattcagccgccacgtgaagaagcttcagctgattgagggcaggcagcacagatcaacatggagccccaccatggtagtcctgttcaggtgggtcccagtcacagatgcctattggcagattctcttctccgtcctcaaggtcaccagaaacctgaaggagctggacctaagtggaaactcgctgagccactctgcagtgaagagtctttgtaagaccctgagacgccctcgctgcctcctggagaccctgcggttggctggctgtggcctcacagctgaggactgcaaggaccttgcctttgggctgagagccaaccagaccctgaccgagctggacctgagcttcaatgtgctcacggatgctggagccaaacacctttgccagagactgagacagccgagctgcaagctacagcgactgcagctggtcagctgtggcctcacgtctgactgctgccaggacctggcctctgtgcttagtgccagccccagcctgaaggagctagacctgcagcagaacaacctggatgacgttggcgtgcgactgctctgtgaggggctcaggcatcctgcctgcaaactcatacgcctggggctggaccagacaactctgagtgatgagatgaggcaggaactgagggccctggagcaggagaaacctcagctgctcatcttcagcagacggaaaccaagtgtgatgacccctactgagggcctggatacgggagagatgagtaatagcacatcctcactcaagcggcagagactcggatcagagagggcggcttcccatgttgctcaggctaatctcaaactcctggacgtgagcaagatcttcccaattgctgagattgcagaggaaagctccccagaggtagtaccggtggaactcttgtgcgtgccttctcctgcctctcaaggggacctgcatacgaagcctttggggactgacgatgacttctggggccccacggggcctgtggctactgaggtagttgacaaagaaaagaacttgtaccgagttcacttccctgtagctggctcctaccgctggcccaacacgggtctctgctttgtgatgagagaagcggtgaccgttgagattgaattctgtgtgtgggaccagttcctgggtgagatcaacccacagcacagctggatggtggcagggcctctgctggacatcaaggctgagcctggagctgtggaagctgtgcacctccctcactttgtggctctccaagggggccatgtggacacatccctgttccaaatggcccactttaaagaggaggggatgctcctggagaagccagccagggtggagctgcatcacatagttctggaaaaccccagcttctcccccttgggagtcctcctgaaaatgatccataatgccctgcgcttcattcccgtcacctctgtggtgttgctttaccaccgcccatcctgaggaagtcaccttccacctctacctgatcccaagtgactgctccattcggaaggccatagatgatctagaaatgaaattccagtttgtgcgaatccacaagccacccccgctgaccccactttatatgggctgtcgttacactgtgtctgggtctggttcagggatgctggaaatactccccaaggaactggagctctgctatcgaagccctggagaagaccagctgttctcggagttctacgttggccacttgggatcagggatcaggctgcaagtgaaagacaagaaagatgagactctggtgtgggaggccttggtgaaaccaggagatctcatgcctgcaactactctgatccctccagcccgcatagccgtaccttcacctctggatgccccgcagttgctgcactttgtggaccagtatcgagagcagctgatagcccgagtgacatcggtggaggttgtcttggacaaactgcatggacaggtgctgagccaggagcagtacgagagggtgctggctgagaacacgaggcccagccagatgcggaagctgttcagcttgagccagtcctgggaccggaagtgcaaagatggactctaccaagccctgaaggagacccatcctcacctcattatggaactctgggagaagggcagcaaaaagggactcctgccactcagcagctgaagtatcaacaccagcccttgacccttgagtcctggctttggctgacccttctttgggtctcagtttctttctctgcaaacaagttgccatctggtttgccttccagcactaaagtaatggaactttgatgatgcctttgctgggcattatgtgtccatgccagggatgccacagggggccccagtccaggtggcctaacagcatctcagggaatgtccatctggagctggcaagacccctgcagacctcatagagcctcatctggtggccacagcagccaagcctagagccctccggatcccatccaggcgcaaagaggaataggagggacatggaaccatttgcctctggctgtgtcacagggtgagccccaaaattggggttcagcgtgggaggccacgtggattcttggctttgtacaggaagatctacaagagcaagccaacagagtaaagtggaaggaagtttattcagaaaataaaggagtatcacagctctttt

SEQ ID NO: 791 - DNA, 5280 bp, Homo sapiens
gttgactaggcgctgttcttgctggctggtgccccagggcctggagaggtctgaagaaacctgggagccagcagcccggggctccactctgggttctgaaagcccattccctgctctgcggctcctcccaccccacctcttctcagccttgcagctcaagggttgatctcaggagtccaggacccaggagagggaagaatctgaggaacacagaacagtgagcgttgcccacaccccatctcccgtcaccacatctcccctcaccctcaccctccctgcctggccctggaccccatcccaggacctccctatcagctgacttcttccagtgtcttgcaggcccctctgggctcctccctcccctggcttttcctaccactccccctctatcggcgtctatctgtaggtgccctgggatttataaaactgggttccgaatgctgaataagagacggtaagagccaaggcaaaggacagcactgttctctgcctgcctgataccctcaccacctgggaacatcccccagacaccctcttaactccgggacagagatggctggcggagcctggggccgcctggcctgttacttggagttcctgaagaaggaggagctgaaggagttccagcttctgctcgccaataaagcgcactccaggagctcttcgggtgagacacccgctcagccagagaagacgagtggcatggaggtggcctcgtacctggtggctcagtatggggagcagcgggcctgggacctagccctccatacctgggagcagatggggctgaggtcactgtgcgcccaagcccaggaaggggcaggccactctccctcattcccctacagcccaagtgaaccccacctggggtctcccagccaacccacctccaccgcagtgctaatgccctggatccatgaattgccggcggggtgcacccagggctcagagagaagggttttgagacagctgcctgacacatctggacgccgctggagagaaatctctgcctcactcctctaccaagctcttccaagctccccagaccatgagtctccaagccaggagtcacccaacgcccccacatccacagcagtgctggggagctggggatccccacctcagcccagcctagcacccagagagcaggaggctcctgggacccaatggcctctggatgaaacgtcaggaatttactacacagaaatcagagaaagagagagagagaaatcagagaaaggcaggcccccatgggcagcggtggtaggaacgcccccacaggcgcacaccagcctacagccccaccaccacccatgggagccttctgtgagagagagcctctgttccacatggccctggaaaaatgaggattttaaccaaaaattcacacagctgctacttctacaaagacctcaccccagaagccaagatcccctggtcaagagaagctggcctgattatgtggaggagaatcgaggacatttaattgagatcagagacttatttggcccaggcctggatacccaagaacctcgcatagtcatactgcagggggctgctggaattgggaagtcaacactggccaggcaggtgaaggaagcctgggggagaggccagctgtatggggaccgcttccagcatgtcttctacttcagctgcagagagctggcccagtccaaggtggtgagtctcgctgagctcatcggaaaagatgggacagccactccggctcccattagacagatcctgtctaggccagagcggctgctcttcatcctcgatggtgtagatgagccaggatgggtcttgcaggagccgagttctgagctctgtctgcactggagccagccacagccggcggatgcactgctgggcagtttgctggggaaaactatacttcccgaggcatccttcctgatcacggctcggaccacagctctgcagaacctcattccttctttggagcaggcacgttgggtagaggtcctggggttctctgagtccagcaggaaggaatatttctacagatatttcacagatgaaaggcaagcaattagagcctttaggttggtcaaatcaaacaaagagctctgggccctgtgtcttgtgccctgggtgtcctggctggcctgcacttgcctgatgcagcagatgaagcggaaggaaaaactcacactgacttccaagaccaccacaaccctctgtctacattaccttgcccaggctctccaagctcagccattgggaccccagctcagagacctctgctctctggctgctgagggcatctggcaaaaaaagacccttttcagtccagatgacctcaggaagcatgggttagatggggccatcatctccaccttcttgaagatgggtattcttcaagagcaccccatccctctgagctacagcttcattcacctctgtttccaagagttctttgcagcaatgtcctatgtcttggaggatgagaaggggagaggtaaacattctaattgcatcatagatttggaaaagacgctagaagcatatggaatacatggcctgtttggggcatcaaccacacgtttcctattgggcctgttaagtgatgagggggagagagagatggagaacatctttcactgccggctgtctcaggggaggaacctgatgcagtgggtcccgtccctgcagctgctgctgcagccacactctctggagtccctccactgcttgtacgagactcggaacaaaacgttcctgacacaagtgatggcccatttcgaagaaatgggcatgtgtgtagaaacagacatggagctcttagtgtgcactttctgcattaaattcagccgccacgtgaagaagcttcagctgattgagggcaggcagcacagatcaacatggagccccaccatggtagtcctgttcaggtgggtcccagtcacagatgcctattggcagattctcttctccgtcctcaaggtcaccagaaacctgaaggagctggacctaagtggaaactcgctgagccactctgcagtgaagagtctttgtaagaccctgagacgccctcgctgcctcctggagaccctgcggttggctggctgtggcctcacagctgaggactgcaaggaccttgcctttgggctgagagccaaccagaccctgaccgagctggacctgagcttcaatgtgctcacggatgctggagccaaacacctttgccagagactgagacagccgagctgcaagctacagcgactgcagctggtcagctgtggcctcacgtctgactgctgccaggacctggcctctgtgcttagtgccagccccagcctgaaggagctagacctgcagcagaacaacctggatgacgttggcgtgcgactgctctgtgaggggctcaggcatcctgcctgcaaactcatacgcctggggctggaccagacaactctgagtgatgagatgaggcaggaactgagggccctggagcaggagaaacctcagctgctcatcttcagcagacggaaaccaagtgtgatgacccctactgagggcctggatacgggagagatgagtaatagcacatcctcactcaagcggcagagactcggatcagagagggcggcttcccatgttgctcaggctaatctcaaactcctggacgtgagcaagatcttcccaattgctgagattgcaggcaagagccacgaggaaagctccccagaggtagtaccggtggaactcttgtgcgtgccttctcctgcctctcaaggggacctgcatacgaagcctttggggactgacgatgacttctggggccccacggggcctgtggctactgaggtagttgacaaagaaaagaacttgtaccgagttcacttccctgtagctggctcctaccgctggcccaacacgggtctctgctttgtgatgagagaagcggtgaccgttgagattgaattctgtgtgtgggaccagttcctgggtgagatcaacccacagcacagctggatggtggcagggcctctgctggacatcaaggctgagcctggagctgtggaagctgtgcacctccctcactttgtggctctccaagggggccatgtggacacatccctgttccaaatggcccactttaaagaggaggggatgctcctggagaagccagccagggtggagctgcatcacatagttctggaaaaccccagcttctcccccttgggagtcctcctgaaaatgatccataatgccctgcgcttcattcccgtcacctctgtggtgttgctttaccaccgcgtccatcctgaggaagtcaccttccacctctacctgatcccaagtgactgctccattcggaaggccatagatgatctagaaatgaaattccagtttgtgcgaatccacaagccacccccgctgaccccactttatatgggctgtcgttacactgtgtctgggtctggttcagggatgctggaaatactccccaaggaactggagctctgctatcgaagccctggagaagaccagctgttctcggagttctacgttggccacttgggatcagggatcaggctgcaagtgaaagacaagaaagatgagactctggtgtgggaggccttggtgaaaccaggaaggaacaccagccagccgtggaacctcaggtgcaacagagacgccaggagatactagtgcccagcagcctgcggcagtaccaatgaagccagagagggcttggtggatgacaaggaggcctgagtagaccgcagactttgttgtcgctgcccggaggagtcgagactggtacccggaggagctgtctcaccaggagaccacgtcctggaagtgtccgggactcgcgggacctgtggctgcagaccccgccggcacgcaggcccagagctggcgcactcctgaggatgagactctgggggccctagccggggtccacgggagggctgtccttggggactctaggatggcttcgttctggcccggctcacttctggagctgtgagacccaagacaaaaggggctgagggatttctcattgacaagagttcgtgcgggaaaaccacctgatccctagggatttgtcatcttaagactcaaaaggcttaataccaggaaccaccttggcaagatatttacccaccggccatctctgtttactcatgaatgttaaatgttaaaacgcagcgctctaaccctgcatattatttacttgcaaatgtctgtaatctgtaattgtgatgcctctgatggaataaattatctttttcagtctcctct

SEQ ID NO: 792 - DNA, 3014 bp, Homo sapiens
actttcctgccccttccccggccaagcccaactccggatctcgctctccaccggatctcacccgccacacccggacaggcggctggaggaggcgggcgtctaaaattctgggaagcagaacctggccggagccactagacagagccgggcctagcccagagacatggagagttgctacaacccaggtctggatggtattattgaatatgatgatttcaaattgaactcctccattgtggaacccaaggagccagccccagaaacagctgatggcccctacctggtgatcgtggaacagcctaagcagagaggcttccgatttcgatatggctgtgaaggcccctcccatggaggactgcccggtgcctccagtgagaagggccgaaagacctatcccactgtcaagatctgtaactacgagggaccagccaagatcgaggtggacctggtaacacacagtgacccacctcgtgctcatgcccacagtctggtgggcaagcaatgctcggagctggggatctgcgccgtttctgtggggcccaaggacatgactgcccaatttaacaacctgggtgtcctgcatgtgactaagaagaacatgatggggactatgatacaaaaacttcagaggcagcggctccgctctaggccccagggccttacggaggccgagcagcgggagctggagcaagaggccaaagaactgaagaaggtgatggatctgagtatagtgcggctgcgcttctctgccttccttagagccagtgatggctccttctccctgcccctgaagccagtcatctcccagcccatccatgacagcaaatctccgggggcatcaaacctgaagatttctcgaatggacaagacagcaggctctgtgcggggtggagatgaagtttatctgctttgtgacaaggtgcagaaagatgacattgaggttcggttctatgaggatgatgagaatggatggcaggcctttggggacttctctcccacagatgtgcataaacagtatgccattgtgttccggacacccccctatcacaagatgaagattgagcggcctgtaacagtgtttctgcaactgaaacgcaagcgaggaggggacgtgtctgattccaaacagttcacctattaccctctggtggaagacaaggaagaggtgcagcggaagcggaggaaggccttgcccaccttctcccagcccttcgggggtggctcccacatgggtggaggctctgggggtgcagccgggggctacggaggagctggaggaggtggcagcctcggtttcttcccctcctccctggcctacagcccctaccagtccggcgcgggccccatgggctgctacccgggaggcgggggcggggcgcagatggccgccacggtgcccagcagggactccggggaggaagccgcggagccaagcgccccctccaggaccccccagtgcgagccgcaggccccggagatgctgcagcgagctcgagagtacaacgcgcgcctgttcggcctggcgcagcgcagcgcccgagccctactcgactacggcgtcaccgcggacgcgcgcgcgctgctggcgggacagcgccacctgctgacggcgcaggacgagaacggagacacaccactgcacctagccatcatccacgggcagaccagtgtcattgagcagatagtctatgtcatccaccacgcccaggacctcggcgttgtcaacctcaccaaccacctgcaccagacgcccctgcacctggcggtgatcacggggcagacgagtgtggtgagctttctgctgcgggtaggtgcagacccagctctgctggatcggcatggagactcagccatgcatctggcgctgcgggcaggcgctggtgctcctgagctgctgcgtgcactgcttcagagtggagctcctgctgtgccccagctgttgcatatgcctgactttgagggactgtatccagtacacctggcagtccgagcccgaagccctgagtgcctggatctgctggtggacagtggggctgaagtggaggccacagagcggcaggggggacgaacagccttgcatctagccacagagatggaggagctggggttggtcacccatctggtcaccaagctccgggccaacgtgaacgctcgcacctttgcgggaaacacacccctgcacctggcagctggactggggtacccgaccctcacccgcctccttctgaaggctggtgctgacatccatgctgaaaacgaggagcccctgtgcccactgccttcaccccctacctctgatagcgactcggactctgaagggcctgagaaggacacccgaagcagcttccggggccacacgcctcttgacctcacttgcagcaccaaggtgaagaccttgctgctaaatgctgctcagaacaccatggagccacccctgaccccgcccagcccagcagggccgggactgtcacttggtgatacagctctgcagaacctggagcagctgctagacgggccagaagcccagggcagctgggcagagctggcagagcgtctggggctgcgcagcctggtagacacgtaccgacagacaacctcacccagtggcagcctcctgcgcagctacgagctggctggcggggacctggcaggtctactggaggccctgtctgacatgggcctagaggagggagtgaggctgctgaggggtccagaaacccgagacaagctgcccagcacagcagaggtgaaggaagacagtgcgtacgggagccagtcagtggagcaggaggcagagaagctgggcccaccccctgagccaccaggagggctctgccacgggcacccccagcctcaggtgcactgacctgctgcctgcccccagcccccttcccggaccccctgtacagcgtccccacctatttcaaatcttatttaacaccccacacccacccctcagttgggacaaataaaggattctcatgggaaggggaggacccctccttcccaactta

SEQ ID NO: 793 - DNA, 3041 bp, Homo sapiens
ggtattttcgggactttcctaagctgctctaactttcctgccccttccccggccaagcccaactccggatctcgctctccaccggatctcacccgccacacccggacaggcggctggaggaggcgggcgtctaaaattctgggaagcagaacctggccggagccactagacagagccgggcctagcccagagacatggagagttgctacaacccaggtctggatggtattattgaatatgatgatttcaaattgaactcctccattgtggaacccaaggagccagccccagaaacagctgatggcccctacctggtgatcgtggaacagcctaagcagagaggcttccgatttcgatatggctgtgaaggcccctcccatggaggactgcccggtgcctccagtgagaagggccgaaagacctatcccactgtcaagatctgtaactacgagggaccagccaagatcgaggtggacctggtaacacacagtgacccacctcgtgctcatgcccacagtctggtgggcaagcaatgctcggagctggggatctgcgccgtttctgtggggcccaaggacatgactgcccaatttaacaacctgggtgtcctgcatgtgactaagaagaacatgatggggactatgatacaaaaacttcagaggcagcggctccgctctaggccccagggccttacggaggccgagcagcgggagctggagcaagaggccaaagaactgaagaaggtgatggatctgagtatagtgcggctgcgcttctctgccttccttagagccagtgatggctccttctccctgcccctgaagccagtcatctcccagcccatccatgacagcaaatctccgggggcatcaaacctgaagatttctcgaatggacaagacagcaggctctgtgcggggtggagatgaagtttatctgctttgtgacaaggtgcagaaagatgacattgaggttcggttctatgaggatgatgagaatggatggcaggcctttggggacttctctcccacagatgtgcataaacagtatgccattgtgttccggacacccccctatcacaagatgaagattgagcggcctgtaacagtgtttctgcaactgaaacgcaagcgaggaggggacgtgtctgattccaaacagttcacctattaccctctggtggaagacaaggaagaggtgcagcggaagcggaggaaggccttgcccaccttctcccagcccttcgggggtggctcccacatgggtggaggctctgggggtgcagccgggggctacggaggagctggaggaggtggcagcctcggtttcttcccctcctccctggcctacagcccctaccagtccggcgcgggccccatgggctgctacccgggaggcgggggcggggcgcagatggccgccacggtgcccagcagggactccggggaggaagccgcggagccaagcgccccctccaggaccccccagtgcgagccgcaggccccggagatgctgcagcgagctcgagagtacaacgcgcgcctgttcggcctggcgcagcgcagcgcccgagccctactcgactacggcgtcaccgcggacgcgcgcgcgctgctggcgggacagcgccacctgctgacggcgcaggacgagaacggagacacaccactgcacctagccatcatccacgggcagaccagtgtcattgagcagatagtctatgtcatccaccacgcccaggacctcggcgttgtcaacctcaccaaccacctgcaccagacgcccctgcacctggcggtgatcacggggcagacgagtgtggtgagctttctgctgcgggtaggtgcagacccagctctgctggatcggcatggagactcagccatgcatctggcgctgcgggcaggcgctggtgctcctgagctgctgcgtgcactgcttcagagtggagctcctgctgtgccccagctgttgcatatgcctgactttgagggactgtatccagtacacctggcagtccgagcccgaagccctgagtgcctggatctgctggtggacagtggggctgaagtggaggccacagagcggcaggggggacgaacagccttgcatctagccacagagatggaggagctggggttggtcacccatctggtcaccaagctccgggccaacgtgaacgctcgcacctttgcgggaaacacacccctgcacctggcagctggactggggtacccgaccctcacccgcctccttctgaaggctggtgctgacatccatgctgaaaacgaggagcccctgtgcccactgccttcaccccctacctctgatagcgactcggactctgaagggcctgagaaggacacccgaagcagcttccggggccacacgcctcttgacctcacttgcagcaccaaggtgaagaccttgctgctaaatgctgctcagaacaccatggagccacccctgaccccgcccagcccagcagggccgggactgtcacttggtgatacagctctgcagaacctggagcagctgctagacgggccagaagcccagggcagctgggcagagctggcagagcgtctggggctgcgcagcctggtagacacgtaccgacagacaacctcacccagtggcagcctcctgcgcagctacgagctggctggcggggacctggcaggtctactggaggccctgtctgacatgggcctagaggagggagtgaggctgctgaggggtccagaaacccgagacaagctgcccagcacagaggtgaaggaagacagtgcgtacgggagccagtcagtggagcaggaggcagagaagctgggcccaccccctgagccaccaggagggctctgccacgggcacccccagcctcaggtgcactgacctgctgcctgcccccagcccccttcccggaccccctgtacagcgtccccacctatttcaaatcttatttaacaccccacacccacccctcagttgggacaaataaaggattctcatgggaaggggaggacccctccttcccaactt

SEQ ID NO: 794 - DNA, 3101 bp, Homo sapiens
cacggtgagtggctggattcagacccctgggtggccgggacaagagaaaagagggaggagggcctttagcggacagcgcctggggctggagagcagcagctgcacacagccggaaagggcgcgcaggcgacgacactcggatccacgtcgacaccgttgtacaaagatacgcggacccgcgggcgtctaaaattctgggaagcagaacctggccggagccactagacagagccgggcctagcccagagacatggagagttgctacaacccaggtctggatggtattattgaatatgatgatttcaaattgaactcctccattgtggaacccaaggagccagccccagaaacagctgatggcccctacctggtgatcgtggaacagcctaagcagagaggcttccgatttcgatatggctgtgaaggcccctcccatggaggactgcccggtgcctccagtgagaagggccgaaagacctatcccactgtcaagatctgtaactacgagggaccagccaagatcgaggtggacctggtaacacacagtgacccacctcgtgctcatgcccacagtctggtgggcaagcaatgctcggagctggggatctgcgccgtttctgtggggcccaaggacatgactgcccaatttaacaacctgggtgtcctgcatgtgactaagaagaacatgatggggactatgatacaaaaacttcagaggcagcggctccgctctaggccccagggccttacggaggccgagcagcgggagctggagcaagaggccaaagaactgaagaaggtgatggatctgagtatagtgcggctgcgcttctctgccttccttagagccagtgatggctccttctccctgcccctgaagccagtcatctcccagcccatccatgacagcaaatctccgggggcatcaaacctgaagatttctcgaatggacaagacagcaggctctgtgcggggtggagatgaagtttatctgctttgtgacaaggtgcagaaagatgacattgaggttcggttctatgaggatgatgagaatggatggcaggcctttggggacttctctcccacagatgtgcataaacagtatgccattgtgttccggacacccccctatcacaagatgaagattgagcggcctgtaacagtgtttctgcaactgaaacgcaagcgaggaggggacgtgtctgattccaaacagttcacctattaccctctggtggaagacaaggaagaggtgcagcggaagcggaggaaggccttgcccaccttctcccagcccttcgggggtggctcccacatgggtggaggctctgggggtgcagccgggggctacggaggagctggaggaggtggcagcctcggtttcttcccctcctccctggcctacagcccctaccagtccggcgcgggccccatgggctgctacccgggaggcgggggcggggcgcagatggccgccacggtgcccagcagggactccggggaggaagccgcggagccaagcgccccctccaggaccccccagtgcgagccgcaggccccggagatgctgcagcgagctcgagagtacaacgcgcgcctgttcggcctggcgcagcgcagcgcccgagccctactcgactacggcgtcaccgcggacgcgcgcgcgctgctggcgggacagcgccacctgctgacggcgcaggacgagaacggagacacaccactgcacctagccatcatccacgggcagaccagtgtcattgagcagatagtctatgtcatccaccacgcccaggacctcggcgttgtcaacctcaccaaccacctgcaccagacgcccctgcacctggcggtgatcacggggcagacgagtgtggtgagctttctgctgcgggtaggtgcagacccagctctgctggatcggcatggagactcagccatgcatctggcgctgcgggcaggcgctggtgctcctgagctgctgcgtgcactgcttcagagtggagctcctgctgtgccccagctgttgcatatgcctgactttgagggactgtatccagtacacctggcagtccgagcccgaagccctgagtgcctggatctgctggtggacagtggggctgaagtggaggccacagagcggcaggggggacgaacagccttgcatctagccacagagatggaggagctggggttggtcacccatctggtcaccaagctccgggccaacgtgaacgctcgcacctttgcgggaaacacacccctgcacctggcagctggactggggtacccgaccctcacccgcctccttctgaaggctggtgctgacatccatgctgaaaacgaggagcccctgtgcccactgccttcaccccctacctctgatagcgactcggactctgaagggcctgagaaggacacccgaagcagcttccggggccacacgcctcttgacctcacttgcagcaccaaggtgaagaccttgctgctaaatgctgctcagaacaccatggagccacccctgaccccgcccagcccagcagggccgggactgtcacttggtgatacagctctgcagaacctggagcagctgctagacgggccagaagcccagggcagctgggcagagctggcagagcgtctggggctgcgcagcctggtagacacgtaccgacagacaacctcacccagtggcagcctcctgcgcagctacgagctggctggcggggacctggcaggtctactggaggccctgtctgacatgggcctagaggagggagtgaggctgctgaggggtccagaaacccgagacaagctgcccagcacagcagaggtgaaggaagacagtgcgtacgggagccagtcagtggagcaggaggcagagaagctgggcccaccccctgagccaccaggagggctctgccacgggcacccccagcctcaggtgcactgacctgctgcctgcccccagcccccttcccggaccccctgtacagcgtccccacctatttcaaatcttatttaacaccccacacccacccctcagttgggacaaataaaggattctcatgggaaggggaggacccctccttcccaactta

SEQ ID NO: 795 - DNA, 3048 bp, Homo sapiens
ggaattcccccctccggggggccgagaaggggctttcccggccctgagccctgctggcaggcgaggtgtcgcgaccggtcccaggtgggtcgggcgcggagagaagccgcaaccagagccgccgccacggcgggcgtctaaaattctgggaagcagaacctggccggagccactagacagagccgggcctagcccagagacatggagagttgctacaacccaggtctggatggtattattgaatatgatgatttcaaattgaactcctccattgtggaacccaaggagccagccccagaaacagctgatggcccctacctggtgatcgtggaacagcctaagcagagaggcttccgatttcgatatggctgtgaaggcccctcccatggaggactgcccggtgcctccagtgagaagggccgaaagacctatcccactgtcaagatctgtaactacgagggaccagccaagatcgaggtggacctggtaacacacagtgacccacctcgtgctcatgcccacagtctggtgggcaagcaatgctcggagctggggatctgcgccgtttctgtggggcccaaggacatgactgcccaatttaacaacctgggtgtcctgcatgtgactaagaagaacatgatggggactatgatacaaaaacttcagaggcagcggctccgctctaggccccagggccttacggaggccgagcagcgggagctggagcaagaggccaaagaactgaagaaggtgatggatctgagtatagtgcggctgcgcttctctgccttccttagagccagtgatggctccttctccctgcccctgaagccagtcatctcccagcccatccatgacagcaaatctccgggggcatcaaacctgaagatttctcgaatggacaagacagcaggctctgtgcggggtggagatgaagtttatctgctttgtgacaaggtgcagaaagatgacattgaggttcggttctatgaggatgatgagaatggatggcaggcctttggggacttctctcccacagatgtgcataaacagtatgccattgtgttccggacacccccctatcacaagatgaagattgagcggcctgtaacagtgtttctgcaactgaaacgcaagcgaggaggggacgtgtctgattccaaacagttcacctattaccctctggtggaagacaaggaagaggtgcagcggaagcggaggaaggccttgcccaccttctcccagcccttcgggggtggctcccacatgggtggaggctctgggggtgcagccgggggctacggaggagctggaggaggtggcagcctcggtttcttcccctcctccctggcctacagcccctaccagtccggcgcgggccccatgggctgctacccgggaggcgggggcggggcgcagatggccgccacggtgcccagcagggactccggggaggaagccgcggagccaagcgccccctccaggaccccccagtgcgagccgcaggccccggagatgctgcagcgagctcgagagtacaacgcgcgcctgttcggcctggcgcagcgcagcgcccgagccctactcgactacggcgtcaccgcggacgcgcgcgcgctgctggcgggacagcgccacctgctgacggcgcaggacgagaacggagacacaccactgcacctagccatcatccacgggcagaccagtgtcattgagcagatagtctatgtcatccaccacgcccaggacctcggcgttgtcaacctcaccaaccacctgcaccagacgcccctgcacctggcggtgatcacggggcagacgagtgtggtgagctttctgctgcgggtaggtgcagacccagctctgctggatcggcatggagactcagccatgcatctggcgctgcgggcaggcgctggtgctcctgagctgctgcgtgcactgcttcagagtggagctcctgctgtgccccagctgttgcatatgcctgactttgagggactgtatccagtacacctggcagtccgagcccgaagccctgagtgcctggatctgctggtggacagtggggctgaagtggaggccacagagcggcaggggggacgaacagccttgcatctagccacagagatggaggagctggggttggtcacccatctggtcaccaagctccgggccaacgtgaacgctcgcacctttgcgggaaacacacccctgcacctggcagctggactggggtacccgaccctcacccgcctccttctgaaggctggtgctgacatccatgctgaaaacgaggagcccctgtgcccactgccttcaccccctacctctgatagcgactcggactctgaagggcctgagaaggacacccgaagcagcttccggggccacacgcctcttgacctcacttgcagcaccaaggtgaagaccttgctgctaaatgctgctcagaacaccatggagccacccctgaccccgcccagcccagcagggccgggactgtcacttggtgatacagctctgcagaacctggagcagctgctagacgggccagaagcccagggcagctgggcagagctggcagagcgtctggggctgcgcagcctggtagacacgtaccgacagacaacctcacccagtggcagcctcctgcgcagctacgagctggctggcggggacctggcaggtctactggaggccctgtctgacatgggcctagaggagggagtgaggctgctgaggggtccagaaacccgagacaagctgcccagcacagaggtgaaggaagacagtgcgtacgggagccagtcagtggagcaggaggcagagaagctgggcccaccccctgagccaccaggagggctctgccacgggcacccccagcctcaggtgcactgacctgctgcctgcccccagcccccttcccggaccccctgtacagcgtccccacctatttcaaatcttatttaacaccccacacccacccctcagttgggacaaataaaggattctcatgggaaggggaggacccctccttcccaactt

SEQ ID NO: 796 - DNA, 3034 bp, Homo sapiens
ccgccgcgagccaataaagcgtgaacccgtccgtccggctcgcactttaagacttcccgagcggcggcggggacgccagtcgagccgggagacgcttacctgccgcttccccgcgccgcccggtgcacctggccgcaagggacctcgttctcagggaagacggcgacattccgcggaggtggaaccgccgcgcgccgtccgggctcggaccttccccggaacgtgggggcgccttagcgactccttccctgttgtgcccccgttcccggcgttcagcccggccccgcaaaggtgggacggctcccggcttcagttacggaagcggcccgtgtccagcgacgagggttcgaaaatgccccgcgcgttcctggtgaagaagccgtgcgtctccacgtgcaagaggaactggagcgagctccccgacgaggagcgcggcgagatctacgtgccagtcagcctgggcttctgcccaccacagccctaccgggagccggaaccctctgtggccgaacccccttcctgcccgctggctttgaacatgagccttcgagactctagctacagcatggcccccgggccctgtgtggtggcccagctgccctctgaagacatgggccacttgacagacccccagagcagagaccatggcttcctgcgcaccaagatgaaggtgacccttggggacagtcccagtggagacctgttcacctgccgtgtctgccagaaggccttcacctaccagcgcatgctgaaccgccacatgaagtgtcacaacgacgtcaagaggcacctctgcacgtactgcgggaagggcttcaatgacaccttcgacctcaagagacacgtccgaactcacactggcgtgcggccctacaagtgcagcctgtgtgacaaggccttcacgcagcgctgctctctggagtctcacctcaagaagatccatggtgtgcagcagaagtacgcgtacaaggagcggcgggccaagctgtacgtgtgtgaggagtgcggctgcacatctgagagccaggagggccacgtcctgcacctgaaggagcaccaccctgacagcccgctgctgcgcaagacctccaagaaggtggccgtggcactacagaacactgtcacttccctgctgcagggcagcccccacctgtgagtggctcgagccctgggggtgctcctggaagccccaagagcatccaggattgcctcccagctgcctggccagcccaccctcctgcaacctctcacccgaacaccagtgatcaggactggagcccccgtgccttggtctcccccctgggcacacgtgctcactcaggcccagcaatgacctctgctcatttttgcatttttgacttatgggccgaggctgttctgagcctgggaagatgtacctatgtcaagagaagggatgaggccaaggctgccttcaattagaagcagccgcccacagagacaggcactgtgtgcctggcagcaggacttcctacccagaggaggttcgagctaggatcccactgcccccgcctctcagcacagggcaggggctgcaggtccccagtggacatcagagtcaaaagcactggcaaagggtacccctgcaaacaactgtggtgggggctggcagcagaccccccacctggcagggcttctaatgctcagggttctggagggctctgtccttccggcaaggagaggcacacatgtgtgcccagccgtgtgtgtgcgtgtgcttgtgtgtgtgcactgctgtgtgtgtgtgcacgcacaggaagcctttccacatatcacctcatttctaagaaataaactacaaggtgccaagaaggttttatttccttttattttttaaagatgacaaatgtacagatgttaatatatttttggtgccaatggcgatgtttttaagagtgggatggagctggcttttctccattcccgtgcgcttctatttatcctggacatttcaaacctcctctgtgccttggctctgggcgggggctgccccaacccacccccgttctttgtacgtgctgagacagccactagaagatcttcctccagcggcgccctggacggctgctcctgcgaacagcccatggcatcttctgctcttccctcccggctctgccctgcacatcctgttgagccaagccccagtgacccggagagctggcctgatgctgagagtgtgtcctcctggggctttagggggcaggaaggtgggacgaatgacgatgcccatccactacctgaagcactaggacactcttgcagggccaggctggaagaccggcccttttcttggttgagtcaaaagccttagcacagtggcaaaaaatgggacagaatgatgaccagcacctcagaaacttccagagggaggagaggatttgatggctaccaaattgtatctgttgccttttttctgactttttcacctgaccaggctggggtttggagtggctgtggggagacccgtcctggctggctggctggctcccttgctcccttgctgcagctgggaaaggggttctgggtgtaaagaggtgtgcgtcttgtgggccaaagggaaaaacaggcaggggtcagagccagcctgccagaggcaaatgcaaaagaggtccccagaacacagccagctgggcagccccttaaagccaaaccccacctgaagcagaaccactttggcctcccctgcccaaaatgggtagtgtctacacgtccccgggctcaggctcaggcccagccctgggctgacctgagaggaaggctccttcctggactgccctctgaaatgtgtatagattgattctaaaatctcttgtttcacttgactttagagtgtctgggacgctgctgtattctgaaagtcacatagcacacagtaatgttatctggaagctctgtttttgtttacatttctgtatccctgggttgactgccaatccgaggccgtcatgaagctctgtgttgtctgttttattttataaccttcctctcaactattaaaattagagatctaatgttt

SEQ ID NO: 797 - DNA, 1282 bp, Homo sapiens
gaacactgacaggccggatgcctctgctgtttacctgcatgacttccagaggtttctcatacatgaacagcaggagcattgggctcaggatctgaacaaagtccgtgagcggatgacaaagttcattgatgacaccatgcgtgaaactgctgagcctttcttgtttgtggatgagttcctcacgtacctgttttcacgagaaaacagcatctgggatgagaagtatgacgcggtggacatgcaggacatgaacaaccccctgtctcattactggatctcctcgtcacataacacgtaccttacaggtgaccagctgcggagcgagtcgtccccagaagcttacatccgctgcctgcgcatgggctgtcgctgcattgaactggactgctgggacgggcccgatgggaagccggtcatctaccatggctggacgcggactaccaagatcaagtttgacgacgtcgtgcaggccatcaaagaccacgcctttgttacctcgagatgtcccttgagctgggtggaggtgttgctgtgagacaatgaaattatggacgtcttttcgcacttggtgaaaacctttcaatgaaggcatatgatttctccatcgcagcattctcccctgtggggtcctagcccttctaagtgccaacctccatcaggcagatggaaggagctggtattaacagacactgtgcagtggcagcttacactctgctttgagagtttgctttcatttgcaggacataggtgcttatggttgtgagctgacagtcattcatcgaacattatctcattcatgactagaggaagttttttctggttaaaatagggctggaatcatctaacacctatagggctagaactctgtaatcaaacattaatgcattaatgttttggcagcaaaagccatccttattggtattaagagggatttaagaaaatgattgcaagcagcgttcattcgaatggttcagattttgctgtcagttacattttgataccaacttactaggtagcctttgttgtaaaagctttttagctgttatgttctagtaagggtgtgtggatcaggatcggggagtgagctgggtccacgcttcccaggagtgatgaggctatgatttacttgagctggaacatggttaaggattttatttttatcatcgtcactttattttcacatttgccttcatttctattgagtgacgtgatttcctatttatggaagtgacatagctgcctttagaataattttgtttcatagtaaatgccatgcacaagc

SEQ ID NO: 798 - DNA, 454 bp, Homo sapiens
ggacatgcaggacatgaacaaccccctgtctcattactggatctcctcgtcacataacactggactgctgggacgggcccgatgggaagccggtcatctaccatggctggacgcggactaccaagatcaagtttgacgacgtcgtgcaggccatcaaagaccacgcctttgttacctcgagcataagaagctgggcccccgaggcgatgtggatgtcaacatggaggacaagaaggacgaacacaagcaacagggggagctgtacatgtgggattccattgaccaggatccagtacccggtgctgccgtgcatttaggttgtcctgactccttcgtgtcctccaactgggggtcgttccaccagaaaccttatttttcagactttaatgctgcctctatccctttacctaatgtgtatatccattttgagtatatttttacatgtccgttctta

SEQ ID NO: 799 - DNA, 912 bp, Homo sapiens
tccctccaggggcccaagagccactggtactcagtgtctgggtgggggcaggggggatttttgttctcccagcacctgcggctgttgagaccagagaagctggtggtcgaccacagcctggggtattagttcacccctagcttctccccagcgagaccccagggcccttgggcacaggggattaagcctctatctgcttacgtgcaagcggaagaaataggcccagagagcaacagtggcgggtctgcagtcacacagccaacttgcgcttgtggcagtggcaaggttgaagttctgagggtacccctcactcaagctccaggcgtcaggaaaagaacattccacgaagtccatctggaagacggtcctttccctgctgcccccagcttcctgatttctcccgattccttccttctccctggagcggccgacaatgtccaccacggtcaatgtagattcccttgcggaatatgagaagagccagatcaagagagccctggagctggggacggtgatgactgtgttcagcttccgcaagtccacccccgagcggagaaccgtccaggtgatcatggagacgcggcaggtggcctggagcaagaccgctgacaagatcgagggcttcttggatatcatggaaataaaagaaatccgcccagggaagaactccaaagatttcgagcgagcaaaagcagttcgccagaaagaagactgctgcttcaccatcctatatggcactcagttcgtcctcagcacgctcagcttggcagctgactctaaagaggatgcagttaactggctctctggcttgaaaatcttacaccaggaagcgatgaatgcgtccacgcccaccattatcgagagttggctgagaaagcagatatattctgtggatcaaaccagaagaaacag

SEQ ID NO: 800 - DNA, 4052 bp, Homo sapiens
ggcagagcaggtttaggcccggcctgggaaactggggagctgaggtgctcgcgccgccgctctgagcccgagtgcgcgcctctcaggggccgcggccggggctggagaacgctgctgctccgctcgcctgccccgctagattcggcgctgcccgccccctgcagcctgtgctgcagctgccggccaccggagggggcgaacaaacaaacgtcaacctgttgtttgtcccgtcaccatttatcagctcagcaccacaaggaagtgcggcacccacacgcgctcggaaagttcagcatgcaggaagtttggggagagctcggcgattagcacagcgacccgggccagcgcagggcgagcgcaggcggcgagagcgcagggcggcgcggcgtcggtcccgggagcagaacccggctttttcttggagcgacgctgtctctagtcgctgatcccaaatgcaccggctcatctttgtctacactctaatctgcgcaaacttttgcagctgtcgggacacttctgcaaccccgcagagcgcatccatcaaagctttgcgcaacgccaacctcaggcgagatgacttgtaccgaagagatgagaccatccaggtgaaaggaaacggctacgtgcagagtcctagattcccgaacagctaccccaggaacctgctcctgacatggcggcttcactctcaggagaatacacggatacagctagtgtttgacaatcagtttggattagaggaagcagaaaatgatatctgtaggtatgattttgtggaagttgaagatatatccgaaaccagtaccattattagaggacgatggtgtggacacaaggaagttcctccaaggataaaatcaagaacgaaccaaattaaaatcacattcaagtccgatgactactttgtggctaaacctggattcaagatttattattctttgctggaagatttccaacccgcagcagcttcagagaccaactgggaatctgtcacaagctctatttcaggggtatcctataactctccatcagtaacggatcccactctgattgcggatgctctggacaaaaaaattgcagaatttgatacagtggaagatctgctcaagtacttcaatccagagtcatggcaagaagatcttgagaatatgtatctggacacccctcggtatcgaggcaggtcataccatgaccggaagtcaaaagttgacctggataggctcaatgatgatgccaagcgttacagttgcactcccaggaattactcggtcaatataagagaagagctgaagttggccaatgtggtcttctttccacgttgcctcctcgtgcagcgctgtggaggaaattgtggctgtggaactgtcaactggaggtcctgcacatgcaattcagggaaaaccgtgaaaaagtatcatgaggtattacagtttgagcctggccacatcaagaggaggggtagagctaagaccatggctctagttgacatccagttggatcaccatgaacgatgtgattgtatctgcagctcaagaccacctcgataagagaatgtgcacatccttacattaagcctgaaagaacctttagtttaaggagggtgagataagagacccttttcctaccagcaaccaaacttactactagcctgcaatgcaatgaacacaagtggttgctgagtctcagccttgctttgttaatgccatggcaagtagaaaggtatatcatcaacttctatacctaagaatataggattgcatttaataatagtgtttgaggttatatatgcacaaacacacacagaaatatattcatgtctatgtgtatatagatcaaatgttttttttggtatatataaccaggtacaccagagcttacatatgtttgagttagactcttaaaatcctttgccaaaataagggatggtcaaatatatgaaacatgtctttagaaaatttaggagataaatttatttttaaattttgaaacacaaaacaattttgaatcttgctctcttaaagaaagcatcttgtatattaaaaatcaaaagatgaggctttcttacatatacatcttagttgattattaaaaaaggaaaaatatggtttccagagaaaaggccaatacctaagcattttttccatgagaagcactgcatacttacctatgtggactataataacctgtctccaaaaccatgccataataatataagtgctttagaaattaaatcattgtgttttttatgcattttgctgaggcatgcttattcatttaacacctatctcaaaaacttacttagaaggttttttattatagtcctacaaaagacaatgtataagctgtaacagaattttgaattgtttttctttgcaaaacccctccacaaaagcaaatcctttcaagaatggcatgggcattctgtatgaacctttccagatggtgttcagtgaaagatgtgggtagttgagaacttaaaaagtgaacattgaaacatcgacgtaactggaaattaggtgggatatttgataggatccatatctaataatggattcgaactctccaaactacaccaattaatttaatgtatcttgcttttgtgttcccgtctttttgaaatatagacatggatttataatggcattttatatttggcaggccatcatagattatttacaacctaaaagcttttgtgtatcaaaaaaatcacattttattaatgtaaatttctaatcgtatacttgctcactgttctgatttcctgtttctgaaccaagtaaaatcagtcctagaggctatggttcttaatctatggagcttgctttaagaagccagttgtcaattgtggtaacacaagtttggccctgctgtcctactgtttaatagaaaactgttttacattggttaatggtatttagagtaattttttctctctgcctcctttgtgtctgttttaaaggagactaactccaggagtaggaaatgattcatcatcctccaaagcaagaggcttaagagagaaacaccgaaattcagatagctcagggactgctaacagagaactacatttttcttattgccttgaaagttaaaaggaaagcagatttcttcagtgactttgtggtcctactaactacaaccagtttgggtgacagggctggtaaagtcccagtgttagatgagtgacctaaatatacttagatttctaagtatggtgctctcaggtccaagttcaactattcttaagcagtgcaattcttcccagttatttgagatgaaagatctctgcttattgaagatgtaccttctaaaactttcctaaaagtgtctgatgtttttactcaagaggggagtggtaaaattaaatactctattgttcaattctctaaaatcccagaacacaatcagaaatagctcaggcagacactaataattaagaacgctcttcctcttcataactgctttgcaagtttcctgtgaaaacatcagtttcctgtaccaaagtcaaaatgaacgttacatcactctaacctgaacagctcacaatgtagctgtaaatataaaaaatgagagtgttctacccagttttcaataaaccttccaggctgcaataaccagcaaggttttcagttaaagccctatctgcactttttatttattagctgaaatgtaagcaggcatattcactcacttttctttgcctttcctgagagttttattaaaacttctcccttggttacctgttatcttttgcacttctaacatgtagccaataaatctatttgatagccatcaaaggaataaaaagctggccgtacaaattacatttcaaaacaaaccctaataaatccacatttccgcatggctcattcacctggaataatgccttttattgaatatgttcttatagggcaaaacactttcataagtagagttttttatgttttttgtcatatcggtaacatgcagctttttcctctcatagcattttctatagcgaatgtaatatgcctcttatcttcatgaaaaataaatattgcttttgaacaaaa

SEQ ID NO: 801 - DNA, 3801 bp, Homo sapiens
acacgcgctcggaaagttcagcatgcaggaagtttggggagagctcggcgattagcacagcgacccgggccagcgcagggcgagcgcaggcggcgagagcgcagggcggcgcggcgtcggtcccgggagcagaacccggctttttcttggagcgacgctgtctctagtcgctgatcccaaatgcaccggctcatctttgtctacactctaatctgcgcaaacttttgcagctgtcgggacacttctgcaaccccgcagagcgcatccatcaaagctttgcgcaacgccaacctcaggcgagatgagagcaatcacctcacagacttgtaccgaagagatgagaccatccaggtgaaaggaaacggctacgtgcagagtcctagattcccgaacagctaccccaggaacctgctcctgacatggcggcttcactctcaggagaatacacggatacagctagtgtttgacaatcagtttggattagaggaagcagaaaatgatatctgtaggtatgattttgtggaagttgaagatatatccgaaaccagtaccattattagaggacgatggtgtggacacaaggaagttcctccaaggataaaatcaagaacgaaccaaattaaaatcacattcaagtccgatgactactttgtggctaaacctggattcaagatttattattctttgctggaagatttccaacccgcagcagcttcagagaccaactgggaatctgtcacaagctctatttcaggggtatcctataactctccatcagtaacggatcccactctgattgcggatgctctggacaaaaaaattgcagaatttgatacagtggaagatctgctcaagtacttcaatccagagtcatggcaagaagatcttgagaatatgtatctggacacccctcggtatcgaggcaggtcataccatgaccggaagtcaaaagttgacctggataggctcaatgatgatgccaagcgttacagttgcactcccaggaattactcggtcaatataagagaagagctgaagttggccaatgtggtcttctttccacgttgcctcctcgtgcagcgctgtggaggaaattgtggctgtggaactgtcaactggaggtcctgcacatgcaattcagggaaaaccgtgaaaaagtatcatgaggtattacagtttgagcctggccacatcaagaggaggggtagagctaagaccatggctctagttgacatccagttggatcaccatgaacgatgtgattgtatctgcagctcaagaccacctcgataagagaatgtgcacatccttacattaagcctgaaagaacctttagtttaaggagggtgagataagagacccttttcctaccagcaaccaaacttactactagcctgcaatgcaatgaacacaagtggttgctgagtctcagccttgctttgttaatgccatggcaagtagaaaggtatatcatcaacttctatacctaagaatataggattgcatttaataatagtgtttgaggttatatatgcacaaacacacacagaaatatattcatgtctatgtgtatatagatcaaatgttttttttggtatatataaccaggtacaccagagcttacatatgtttgagttagactcttaaaatcctttgccaaaataagggatggtcaaatatatgaaacatgtctttagaaaatttaggagataaatttatttttaaattttgaaacacaaaacaattttgaatcttgctctcttaaagaaagcatcttgtatattaaaaatcaaaagatgaggctttcttacatatacatcttagttgattattaaaaaaggaaaaatatggtttccagagaaaaggccaatacctaagcattttttccatgagaagcactgcatacttacctatgtggactataataacctgtctccaaaaccatgccataataatataagtgctttagaaattaaatcattgtgttttttatgcattttgctgaggcatgcttattcatttaacacctatctcaaaaacttacttagaaggttttttattatagtcctacaaaagacaatgtataagctgtaacagaattttgaattgtttttctttgcaaaacccctccacaaaagcaaatcctttcaagaatggcatgggcattctgtatgaacctttccagatggtgttcagtgaaagatgtgggtagttgagaacttaaaaagtgaacattgaaacatcgacgtaactggaaattaggtgggatatttgataggatccatatctaataatggattcgaactctccaaactacaccaattaatttaatgtatcttgcttttgtgttcccgtctttttgaaatatagacatggatttataatggcattttatatttggcaggccatcatagattatttacaacctaaaagcttttgtgtatcaaaaaaatcacattttattaatgtaaatttctaatcgtatacttgctcactgttctgatttcctgtttctgaaccaagtaaaatcagtcctagaggctatggttcttaatctatggagcttgctttaagaagccagttgtcaattgtggtaacacaagtttggccctgctgtcctactgtttaatagaaaactgttttacattggttaatggtatttagagtaattttttctctctgcctcctttgtgtctgttttaaaggagactaactccaggagtaggaaatgattcatcatcctccaaagcaagaggcttaagagagaaacaccgaaattcagatagctcagggactgctaacagagaactacatttttcttattgccttgaaagttaaaaggaaagcagatttcttcagtgactttgtggtcctactaactacaaccagtttgggtgacagggctggtaaagtcccagtgttagatgagtgacctaaatatacttagatttctaagtatggtgctctcaggtccaagttcaactattcttaagcagtgcaattcttcccagttatttgagatgaaagatctctgcttattgaagatgtaccttctaaaactttcctaaaagtgtctgatgtttttactcaagaggggagtggtaaaattaaatactctattgttcaattctctaaaatcccagaacacaatcagaaatagctcaggcagacactaataattaagaacgctcttcctcttcataactgctttgcaagtttcctgtgaaaacatcagtttcctgtaccaaagtcaaaatgaacgttacatcactctaacctgaacagctcacaatgtagctgtaaatataaaaaatgagagtgttctacccagttttcaataaaccttccaggctgcaataaccagcaaggttttcagttaaagccctatctgcactttttatttattagctgaaatgtaagcaggcatattcactcacttttctttgcctttcctgagagttttattaaaacttctcccttggttacctgttatcttttgcacttctaacatgtagccaataaatctatttgatagccatcaaaggaataaaaagctggccgtacaaattacatttcaaaacaaaccctaataaatccacatttccgcatggctcattcacctggaataatgccttttattgaatatgttcttatagggcaaaacactttcataagtagagttttttatgttttttgtcatatcggtaacatgcagctttttcctctcatagcattttctatagcgaatgtaatatgcctcttatcttcatgaaaaataaatattgcttttgaacaaaacta

SEQ ID NO: 802 - DNA, 3497 bp, Homo sapiens
gcagctcgcagctcgcagcccgcagcccgcagaggacgcccagagcggcgagcgggcgggcagacggaccgacggactcgcgccgcgtccacctgtcggccgggcccagccgagcgcgcagcgggcacgccgcgcgcgcggagcagccgtgcccgccgcccgggccccgcgccagggcgcacacgctcccgcccccctacccggcccgggcgggagtttgcacctctccctgcccgggtgctcgagctgccgttgcaaagccaactttggaaaaagttttttgggggagacttgggccttgaggtgcccagctccgcgctttccgattttgggggcctttccagaaaatgttgcaaaaaagctaagccggcgggcagaggaaaacgcctgtagccggcgagtgaagacgaaccatcgactgccgtgttccttttcctcttggaggttggagtcccctgggcgcccccacacggctagacgcctcggctggttcgcgacgcagccccccggccgtggatgctcactcgggctcgggatccgcccaggtagcggcctcggacccaggtcctgcgcccaggtcctcccctgccccccagcgacggagccggggccgggggcggcggcgcccgggggccatgcgggtgagccgcggctgcagaggcctgagcgcctgatcgccgcggacccgagccgagcccacccccctccccagccccccaccctggccgcgggggcggcgcgctcgatctacgcgtccggggccccgcggggccgggcccggagtcggcatgaatcgctgctgggcgctcttcctgtctctctgctgctacctgcgtctggtcagcgccgagggggaccccattcccgaggagctttatgagatgctgagtgaccactcgatccgctcctttgatgatctccaacgcctgctgcacggagaccccggagaggaagatggggccgagttggacctgaacatgacccgctcccactctggaggcgagctggagagcttggctcgtggaagaaggagcctgggttccctgaccattgctgagccggccatgatcgccgagtgcaagacgcgcaccgaggtgttcgagatctcccggcgcctcatagaccgcaccaacgccaacttcctggtgtggccgccctgtgtggaggtgcagcgctgctccggctgctgcaacaaccgcaacgtgcagtgccgccccacccaggtgcagctgcgacctgtccaggtgagaaagatcgagattgtgcggaagaagccaatctttaagaaggccacggtgacgctggaagaccacctggcatgcaagtgtgagacagtggcagctgcacggcctgtgacccgaagcccggggggttcccaggagcagcgagccaaaacgccccaaactcgggtgaccattcggacggtgcgagtccgccggccccccaagggcaagcaccggaaattcaagcacacgcatgacaagacggcactgaaggagacccttggagcctaggggcatcggcaggagagtgtgtgggcagggttatttaatatggtatttgctgtattgcccccatggggtccttggagtgataatattgtttccctcgtccgtctgtctcgatgcctgattcggacggccaatggtgcttcccccacccctccacgtgtccgtccacccttccatcagcgggtctcctcccagcggcctccggcgtcttgcccagcagctcaagaagaaaaagaaggactgaactccatcgccatcttcttcccttaactccaagaacttgggataagagtgtgagagagactgatggggtcgctctttgggggaaacgggctccttcccctgcacctggcctgggccacacctgagcgctgtggactgtcctgaggagccctgaggacctctcagcatagcctgcctgatccctgaacccctggccagctctgaggggaggcacctccaggcaggccaggctgcctcggactccatggctaagaccacagacgggcacacagactggagaaaacccctcccacggtgcccaaacaccagtcacctcgtctccctggtgcctctgtgcacagtggcttcttttcgttttcgttttgaagacgtggactcctcttggtgggtgtggccagcacaccaagtggctgggtgccctctcaggtgggttagagatggagtttgctgttgaggtggctgtagatggtgacctgggtatcccctgcctcctgccaccccttcctccccacactccactctgattcacctcttcctctggttcctttcatctctctacctccaccctgcattttcctcttgtcctggcccttcagtctgctccaccaaggggctcttgaaccccttattaaggccccagatgatcccagtcactcctctctagggcagaagactagaggccagggcagcaagggacctgctcatcatattccaacccagccacgactgccatgtaaggttgtgcagggtgtgtactgcacaaggacattgtatgcagggagcactgttcacatcatagataaagctgatttgtatatttattatgacaatttctggcagatgtaggtaaagaggaaaaggatccttttcctaattcacacaaagactccttgtggactggctgtgcccctgatgcagcctgtggcttggagtggccaaataggagggagactgtggtaggggcagggaggcaacactgctgtccacatgacctccatttcccaaagtcctctgctccagcaactgcccttccaggtgggtgtgggacacctgggagaaggtctccaagggagggtgcagccctcttgcccgcacccctccctgcttgcacacttccccatctttgatccttctgagctccacctctggtggctcctcctaggaaaccagctcgtgggctgggaatgggggagagaagggaaaagatccccaagaccccctggggtgggatctgagctcccacctcccttcccacctactgcactttcccccttcccgccttccaaaacctgcttccttcagtttgtaaagtcggtgattatatttttgggggctttccttttattttttaaatgtaaaatttatttatattccgtatttaaagttgtaaaaaaaaataaccacaaaacaaaaccaaatgaatccgccggaggtctgtctgttggcatcgtgcgtgacaattaacctttctgccttggcaggatgtgccgacagcttgcggcgtgttcctctcactctgggagcctcaggcgtgatctcacacactggcgtgcacatacacacacacacacatacatgctcacacatgcgtgcacatacacgcaggcctgcaacttgggggaggcctctgtctggcgggaagaagagacacacaggctactctgttggtcttggtcctggcacagctcctgacacgtggacttgtgcgtgtctctggcagtgacgagagatgggtttctgcag

SEQ ID NO: 803 - DNA, 1125 bp, Homo sapiens
agagagagagagagactgactgagcaggaatggtgagatgtttatcatgggcctcggggaccccattcccgaggagctttatgagatgctgagtgaccactcgatccgctcctttgatgatctccaacgcctgctgcacggagaccccggagaggaagatggggccgagttggacctgaacatgacccgctcccactctggaggcgagctggagagcttggctcgtggaagaaggagcctgggttccctgaccattgctgagccggccatgatcgccgagtgcaagacgcgcaccgaggtgttcgagatctcccggcgcctcatagaccgcaccaacgccaacttcctggtgtggccgccctgtgtggaggtgcagcgctgctccggctgctgcaacaaccgcaacgtgcagtgccgccccacccaggtgcagctgcgacctgtccaggtgagaaagatcgagattgtgcggaagaagccaatctttaagaaggccacggtgacgctggaagaccacctggcatgcaagtgtgagacagtggcagctgcacggcctgtgacccgaagcccggggggttcccaggagcagcgagccaaaacgccccaaactcgggtgaccattcggacggtgcgagtccgccggccccccaagggcaagcaccggaaattcaagcacacgcatgacaagacggcactgaaggagacccttggagcctaggggcatcggcaggagagtgtgtgggcagggttatttaatatggtatttgctgtattgcccccatggggtccttggagtgataatattgtttccctcgtccgtctgtctcgatgcctgattcggacggccaatggtgcttcccccacccctccacgtgtccgtccacccttccatcagcgggtctcctcccagcggcctccggcgtcttgcccagcagctcaagaagaaaaagaaggactgaactccatcgccatcttcttcccttaactccaagaacttgggataagagtgtgagagagactgatggggtcgctctttgggggaaacgggctccttcccctgcacctggcctgggccacacctgagcgctgtggactgtcctgaggagccctgaggacctctcagca

SEQ ID NO: 804 - DNA, 556 bp, Homo sapiens
acacttcttccgggaaagagtgaagggccccactgccctttgccatccagcttcctctggctttgctaatggccctagggggcaggagaccaactgctggaatcccagagccctggagggggaccccattcccgaggagctttatgagatgctgagtgaccactcgatccgctcctttgatgatctccaacgcctgctgcacggagaccccggagaggaagatggggccgagttggacctgaacatgacccgctcccactctggaggcgagctggagagcttggctcgtggaagaaggagcctgggttccctgaccattgctgagccggccatgatcgccgagtgcaagacgcgcaccgaggtgttcgagatctcccggcgcctcatagaccgcaccaacgccaacttcctggtgtggccgccctgtgtggaggtgcagcgctgctccggctgctgcaacaaccgcaacgtgcagtgccgccccacccaggtgcagctgcgacctgtccaggtgagaaagatcgagattgtgcggaagaagccaatctttaagaag

SEQ ID NO: 805 - DNA, 554 bp, Homo sapiens
aaaaacatctgagggagcgctggggtcggagccgtccccacccctcccagcctcacgtagccgtgagttggcaagtctacccggaatccagggggaccccattcccgaggagctttatgagatgctgagtgaccactcgatccgctcctttgatgatctccaacgcctgctgcacggagaccccggagaggaagatggggccgagttggacctgaacatgacccgctcccactctggaggcgagctggagagcttggctcgtggaagaaggagcctgggttccctgaccattgctgagccggccatgatcgccgagtgcaagacgcgcaccgaggtgttcgagatctcccggcgcctcatagaccgcaccaacgccaacttcctggtgtggccgccctgtgtggaggtgcagcgctgctccggctgctgcaacaaccgcaacgtgcagtgccgccccacccaggtgcagctgcgacctgtccaggtgagaaagatcgagattgtgcggaagaagccaatctttaagaaggccacggtgacgctggaagaccacc

SEQ ID NO: 806 - DNA, 1074 bp, Homo sapiens
ggaggggaagaagagccgcgaccgagagaggccgccgagcgtccccgccctcagagagcagcctcccgagacaggcacttgctggattctccaaaagtatctgcagtggctgttccaccaggaggggtcccaccaatcttgtttgcttctgcagagcctcagcctgcctggaagatgccgagatcgtgctgcagccgctcgggggccctgttgctggccttgctgcttcaggcctccatggaagtgcgtggctggtgcctggagagcagccagtgtcaggacctcaccacggaaagcaacctgctggagtgcatccgggcctgcaagcccgacctctcggccgagactcccatgttcccgggaaatggcgacgagcagcctctgaccgagaacccccggaagtacgtcatgggccacttccgctgggaccgattcggccgccgcaacagcagcagcagcggcagcagcggcgcagggcagaagcgcgaggacgtctcagcgggcgaagactgcggcccgctgcctgagggcggccccgagccccgcagcgatggtgccaagccgggcccgcgcgagggcaagcgctcctactccatggagcacttccgctggggcaagccggtgggcaagaagcggcgcccagtgaaggtgtaccctaacggcgccgaggacgagtcggccgaggccttccccctggagttcaagagggagctgactggccagcgactccgggagggagatggccccgacggccctgccgatgacggcgcaggggcccaggccgacctggagcacagcctgctggtggcggccgagaagaaggacgagggcccctacaggatggagcacttccgctggggcagcccgcccaaggacaagcgctacggcggtttcatgacctccgagaagagccagacgcccctggtgacgctgttcaaaaacgccatcatcaagaacgcctacaagaagggcgagtgagggcacagcggggccccagggctaccctcccccaggaggtcgaccccaaagccccttgctctcccctgccctgctgccgcctcccagcctgggggg

SEQ ID NO: 807 - DNA, 1295 bp, Homo sapiens
ccttcccctggcccggggagctgctccttgtgctgccgggaaggtcaaagtcccgcgcccaccaggagagctcggcaagtatataaggacagaggagcgcgggaccaagcggcggcgaaggaggggaagaagagccgcgaccgagagaggccgccgagcgtccccgccctcagagagcagcctcccgagacaggcacttgctggattctccaaaagtatctgcagtggctgttccaccaggagagcctcagcctgcctggaagatgccgagatcgtgctgcagccgctcgggggccctgttgctggccttgctgcttcaggcctccatggaagtgcgtggctggtgcctggagagcagccagtgtcaggacctcaccacggaaagcaacctgctggagtgcatccgggcctgcaagcccgacctctcggccgagactcccatgttcccgggaaatggcgacgagcagcctctgaccgagaacccccggaagtacgtcatgggccacttccgctgggaccgattcggccgccgcaacagcagcagcagcggcagcagcggcgcagggcagaagcgcgaggacgtctcagcgggcgaagactgcggcccgctgcctgagggcggccccgagccccgcagcgatggtgccaagccgggcccgcgcgagggcaagcgctcctactccatggagcacttccgctggggcaagccggtgggcaagaagcggcgcccagtgaaggtgtaccctaacggcgccgaggacgagtcggccgaggccttccccctggagttcaagagggagctgactggccagcgactccgggagggagatggccccgacggccctgccgatgacggcgcaggggcccaggccgacctggagcacagcctgctggtggcggccgagaagaaggacgagggcccctacaggatggagcacttccgctggggcagcccgcccaaggacaagcgctacggcggtttcatgacctccgagaagagccagacgcccctggtgacgctgttcaaaaacgccatcatcaagaacgcctacaagaagggcgagtgagggcacagcggggccccagggctaccctcccccaggaggtcgaccccaaagccccttgctctcccctgccctgctgccgcctcccagcctggggggtcgtggcagataatcagcctcttaaagctgcctgtagttaggaaataaaacctttcaaatttcacatccacctctgactttgaatgtaaactgtgtgaataaagtaaaaatacgtagccgtcaaataacagc

SEQ ID NO: 808 - DNA, 959 bp, Homo sapiens
ggacagaggagcgcgggaccaagcggcggcgaaggaggggaagaagagccgcgaccgagagaggccgccgagcgtccccgccctcagagagcagcctcccgagacagagcctcagcctgcctggaagatgccgagatcgtgctgcagccgctcgggggccctgttgctggccttgctgcttcaggcctccatggaagtgcgtggctggtgcctggagagcagccagtgtcaggacctcaccacggaaagcaacctgctggagtgcatccgggcctgcaagcccgacctctcggccgagactcccatgttcccgggaaatggcgacgagcagcctctgaccgagaacccccggaagtacgtcatgggccacttccgctgggaccgattcggccgccgcaacagcagcagcagcggcagcagcggcgcagggcagaagcgcgaggacgtctcagcgggcgaagactgcggcccgctgcctgagggcggccccgagccccgcagcgatggtgccaagccgggcccgcgcgagggcaagcgctcctactccatggagcacttccgctggggcaagccggtgggcaagaagcggcgcccagtgaaggtgtaccctaacggcgccgaggacgagtcggccgaggccttccccctggagttcaagagggagctgactggccagcgactccgggagggagatggccccgacggccctgccgatgacggcgcaggggcccaggccgacctggagcacagcctgctggtggcggccgagaagaaggacgagggcccctacaggatggagcacttccgctggggcagcccgcccaaggacaagcgctacggcggtttcatgacctccgagaagagccagacgcccctggtgacgctgttcaaaaacgccatcatcaagaacgcctacaagaagggcgagtgagggcacagcggggccccagggctaccct

SEQ ID NO: 809 - DNA, 1426 bp, Homo sapiens
acctcagaggctgcccggcctgccccacacgggggtgctaagcctcccgcccgttctaagcggagacccaacgccatccataattaagttcttcctgagggcgagcggccaggtgcgccttcggcaggacagtgctaattccagcccctttccagcgcgtctccccgcgctcgtcccccgtctggaagcccccctcccacgccccgcggccccccttcccctggcccggggagctgctccttgtgctgccgggaaggtcaaagtcccgcgcccaccaggagagctcggcaagtatataaggacagaggagcgcgggaccaagcggcggcgaaggaggggaagaagagccgcgaccgagagaggccgccgagcgtccccgccctcagagagcagcctcccgagacaggggtcccaccaatcttgtttgcttctgcagagcctcagcctgcctggaagatgccgagatcgtgctgcagccgctcgggggccctgttgctggccttgctgcttcaggcctccatggaagtgcgtggctggtgcctggagagcagccagtgtcaggacctcaccacggaaagcaacctgctggagtgcatccgggcctgcaagcccgacctctcggccgagactcccatgttcccgggaaatggcgacgagcagcctctgaccgagaacccccggaagtacgtcatgggccacttccgctgggaccgattcggccgccgcaacagcagcagcagcggcagcagcggcgcagggcagaagcgcgaggacgtctcagcgggcgaagactgcggcccgctgcctgagggcggccccgagccccgcagcgatggtgccaagccgggcccgcgcgagggcaagcgctcctactccatggagcacttccgctggggcaagccggtgggcaagaagcggcgcccagtgaaggtgtaccctaacggcgccgaggacgagtcggccgaggccttccccctggagttcaagagggagctgactggccagcgactccgggagggagatggccccgacggccctgccgatgacggcgcaggggcccaggccgacctggagcacagcctgctggtggcggccgagaagaaggacgagggcccctacaggatggagcacttccgctggggcagcccgcccaaggacaagcgctacggcggtttcatgacctccgagaagagccagacgcccctggtgacgctgttcaaaaacgccatcatcaagaacgcctacaagaagggcgagtgagggcacagcggggccccagggctaccctcccccaggaggtcgaccccaaagccccttgctctcccctgccctgctgccgcctcccagcctggggggtcgtggcagataatcagcctcttaaagctgcctgtagttaggaaataaaacctttcaaatttcacatcca

SEQ ID NO: 810 - DNA, 883 bp, Homo sapiens
ggaggggaagaagagccgcgaccgagagaggccgccgagcgtccccgccctcagagagcagcctcccgagacaggcacttgctggattctccaaaagtatctgcagtggctgttccaccaggagagcctcagcctgcctggaagatgccgagatcgtgctgcagccgctcgggggccctgttgctggccttgctgcttcaggcctccatggaagtgcgtggctggtgcctggagagcagccagtgtcaggacctcaccacggaaagcaacctgctggagtgcatccgggcctgcaagcccgacctctcggccgagactcccatgttcccgggaaatggcgacgagcagcctctgaccgagaacccccggaagtacgtcatgggccacttccgctgggaccgattcggccgccgcaacagcagcagcagcggcagcagcggcgcagggcagaagcgcgaggacgtctcagcgggcgaagactgcggcccgctgcctgagggcggccccgagccccgcagcgatggtgccaagccgggcccgcgcgagggcaagcgctcctactccatggagcacttccgctggggcaagccggtgggcaagaagcggcgcccagtgaaggtgtaccctaacggcgccgaggacgagtcggccgaggccttccccctggagttcaagagggagctgactggccagcgactccgggagggagatggccccgacggccctgccgatgacggcgcaggggcccaggccgacctggagcacagcctgctggtggcggccgagaagaaggacgagggcccctacaggatggagcacttccgctggggcagcccgcccaaggacaagcgctacggcggtttcatgacctccgagaagagcc

SEQ ID NO: 811 - DNA, 908 bp, Homo sapiens
ggtgtcccagaaacccaggaaatcgagactcatgactcccagagaggatggcatctagaagtagacgatcaagggtggaatctacagtccgtgagccctgacttcttgccttcgtctcaaatagactctgcagccagccatctatgcagcgccccagtggctttgaaatgcaacagaaaccatcacccccggaccgtgggctccatgccagtgggcaaagcacagcctgggaagaattggtttgcagccaggcagtcctccatccagtcttgactttggcacttgtgatatgacttgcacagaccaaaaaagtcactctcaaagagctctcggcacacagaccccagctttacaaggaccccagctccttaacacagatcccagctccgaggaaactcgtcccccccacgttaatcctgaccgactttgccacatggagccagcaaaccatttctggcatgcaggggacctccaagcaatgatatccaaggaattccatctggcagccacccaggatgactgcagaaaaggaaggacacaggaggatatcctggttccctcttcccacccagagctgtttgcatcagtcctgccaatggctccggaagaagctgccaggctccagcaacctcagccccttcctcctccctcaggaatccacctatccgcctctaggaccttggctccaactctattgtactcgtctcctccctcccattctccttttggtctcagctccttgatctaagcctcccagagagacccctagaacgtttccctcaaggacctttctgcctggaagtctgttagcctttcagaagtaacatgtccaaaataaaatttgattcctcccaggttgttccctgcctggtccgctaccccacagtaaggaacaccttattatgcaa

SEQ ID NO: 812 - DNA, 852 bp, Homo sapiens
ggtgtcccagaaacccaggaaatcgagactcatgactcccagagaggatggcatctagaagtagacgatcaagggtggaatctacagtccatgggccctgacttcttgccttcgtctcaaatagactctgcagccagccatctatgcagcgccccagtggctttgaaatgcaacagaaaccatcacccctggaccatgggctccatgccagtgggcaaagcacagcctgggaagaattggtttgcagccaggcagtcctccatccagtcttgactttggcacttgtgatatgacttgcacagaccaaaaaagtcactctcaaagagctctcggcacacagaccccagctttacaaggaccccagctccttaacacagatcccagctccgaggaaactcatccccccacgttaatcctgaccgactttgccacatggagccagcaaaccatttctggcatgcaggggacctccaagcaatgatatccaaggaattccatctggcagccacccaggatgactgcagaaaaggaaggacacaggaggatatcctggttccctcttcccacccagagctgtttgcatcagtcctgccaatggctccggaagaagctgccaggctccagcaacctcagccccttcctcctccctcaggaatccacctatccgcctctaggaccttggctctaactctattgtactcgtctcctccctcccattctccttttggtctcagctccttgatctaagcctcccagagagaccctagaacgtttccctcaaggacctttctgcctggaagtctgttagcctttcagaagtaacatgtccaaaataaaatttgattcctccca

SEQ ID NO: 813 - DNA, 854 bp, Homo sapiens
ggtgtcccagaaacccaggaaatcgagactcatgactcccagagaggatggcatctagaagtagacgatcaagggtggaatctacagtccatgggccctgacttcttgccttcgtctcaaatagactctgcagccagccatctatgcagcgccccagtggctttgaaatgcaacagaaaccatcacccccggaccatgggctccatgccagtgggcaaagcacagcctgggaagaattggtttgcagccaggcagtcctccatccagtcttgactttggcacttgtgatatgacttgcacagaccaaaaaagtcactctcaaagagctctcggcacacagaccccagctttacaaggaccccagctccttaacacagatcccagctccgaggaaactcgtcccccccacgttaatcctgaccgactttgccacatggagccagcaaaccatttctggcatgcaggggacctccaagcaatgatatccaaggaattccatctggcagccacccaggatgactgcagaaaaggaaggacacaggaggatatcctggttccctcttcccacccagagctgtttgcatcagtcctgccaatggctccggaagaagctgccaggctccagcaacctcagccccttcctcctccctcaggaatccacctatccgcctctaggaccttggctccaactctattgtactcgtctcctccctcccattctccttttggtctcagctccttgatctaagcctcccagagagacccctagaacgtttccctcaaggacctttctgcctggaagtctgttagcctttcagaagtaacatgtccaaaataaaatttgattcctccca

SEQ ID NO: 814 - DNA, 854 bp, Homo sapiens
ggtgtcccagaaacccaggaaatcgagactcatgactcccagagaggatggcatctagaagtagacgatcaagggtggaatctacagtccatgggccctgacttcttgccttcgtctcaaatagactctgcagccagccatctatgcagcgccccagtggctttgaaatgcaacagaaaccatcacccccggaccgtgggctccatgccagtgggcaaagcacagcctgggaagaattggtttgcagccaggcagtcctccatccagtcttgactttggcacttgtgatatgacttgcacagaccaaaaaagtcactctcaaagagctctcggcacacagaccccagctttacaaggaccccagctccttaacacagatcccagctccaaggaaactcgtcccccccacgttaatcctgaccgactttgccacatggagccagcaaaccatttctggcatgcaggggacctccaagcaatgatatccaaggaattccatctggcagccacccaggatgactgcagaaaaggaaggacacaggaggatatcctggttccctcttcccacccagagctgtttgcatcagtcctgccaatggctccggaagaagctgccaggctccagcaacctcagccccttcctcctccctcaggaatccacctatccgcctctaggaccttggctccaactctattgtactcgtctcctccctcccattctccttttggtctcagctccttgatctaagcctcccagagagacccctagaatgtttccctcaaggacctttctgcctggaagtctgttagcctttcagaagtaacatgtccaaaataaaatttgattcctccca

SEQ ID NO: 815 - DNA, 854 bp, Homo sapiens
ggtgtcccagaaacccaggaaatcgagactcatgactcccagagaggatggcatctagaagtagacgatcaagggtggaatctacagtccatgggccctgacttcttgccttcgtctcaaatagactctgcagccagccatctatgcagcgccccagtggctttgaaatgcaacagaaaccatcacccccggaccgtgggctccatgccagtgggcaaagcacagcctgggaagaattggtttgcagccaggcagtcctccatccagtcttgactttggcacttgtgatatgacttgcacagaccaaaaaagtcactctcaaagagctctcggcacacagaccccagctttacaaggaccccagctccttaacacagatcccagctccgaggaaactcgtcccccccacgttaatcctgaccgactttgccacatggagccagcaaaccatttctggcatgcaggggacctccaagcaatgatatccaaggaattccatctggcagccacccaggatgactgcagaaaaggaaggacacaggaggatatcctggttccctcttcccacccagagctgtttgcatcagtcctgccaatggctccggaagaagctgccaggctccagcaacctcagccccttcctcctccctcaggaatccacctatccgcctctaggaccttggctccaactctattgtactcgtctcctccctcccattctccttttggtctcagctccttgatctaagcctcccagagagacccctagaatgtttccctcaaggacctttctgcctggaagtctgttagcctttcagaagtaacatgtccaaaataaaatttgattcctccca

SEQ ID NO: 816 - DNA, 854 bp, Homo sapiens
ggtgtcccagaaacccaggaaatcgagactcatgactcccagagaggatggcatctagaagtagacgatcaagggtggaatctacagtccgtgggccctgacttcttgccttcgtctcaaatagactctgcagccagccatctatgcagcgccccagtggctttgaaatgcaacagaaaccatcacccccggaccgtgggctccatgccagtgggcaaagcacagcctgggaagaattggtttgcagccaggcagtcctccatccagtcttgactttggcacttgtgatatgacttgcacagaccaaaaaagtcactctcaaagagctctcggcacacagaccccagctttacaaggaccccagctccttaacacagatcccagctccgaggaaactcgtcccccccacgttaatcctgaccgactttgccacatggagccagcaaaccatttctggcatgcaggggacctccaagcaatgatatccaaggaattccatctggcagccacccaggatgactgcagaaaaggaaggacacaggaggatatcctggttccctcttcccacccagagctgtttgcatcagtcctgccaatggctccggaagaagctgccaggctccagcaacctcagccccttcctcctccctcaggaatccacctatccgcctctaggaccttggctccaactctattgtactcgtctcctccctcccattctccttttggtctcagctccttgatctaagcctcccagagagacccctagaacgtttccctcaaggacctttctgcctggaagtctgttagcctttcagaagtaacatgtccaaaataaaatttgattcctccca

SEQ ID NO: 817 - DNA, 557 bp, Homo sapiens
ccacaaacagaccaaaaaagtcactctcaaagagctctcggcacacagaccccagctttacaaggaccccagctccttaacacagatcccagctccgaggaaactcatccccacgttaatcctgaccgactttgccacatggagccagcaaaccatttctggcatgcaggggacctccaagcaatgatatccaaggaattccatctggcagccacccaggatgactgcagaaaaggaaggacacaggaggatatcctggttccctcttcccacccagagctgtttgcatcagtcctgccaatggctccggaagaagctgccaggctccagcaacctcagccccttcctcctccctcaggaatccacctatccgcctctaggaccttggctctaactctattgtactcgtctcctccctcccattctccttttggtctcagctccttgatctaagcctcccagagagaccctagaacgtttccctcaaggacctttctgcctggaagtctgttagcctttcagaagtaacatgtccaaaataaaatttgattcctccc

SEQ ID NO: 818 - DNA, 1150 bp, Homo sapiens
gtgattacggagatgccaagtgggtattgactgctccaggatgtggatggagggtgtgaaaaccagggtggggtgacgcaggctctgggtcatgatagggagagcaggcagctgggtcctgggctggaggactaaaataagggacgccaccttcaggggtgacacatcagcccaggccttcccaacgggtttgaccagttctgttctgatggtattcctgtgccactgggctggtccctcctccactcctcccctataaagcctcttggggttcccaggcacccagactcagcccaccccagctttgggggccagtacatagccatgatcctcaactggaagctcctggggatcctggtcctttgcctgcacaccagaggcatctcaggcagcgagggccacccctctcacccacccgcagaggaccgagaggaggcaggctccccaacattgcctcagggccccccagtccccggtgacccttggccaggggcaccccctctctttgaagatcctccgcctacccgccccagtcgtccctggagagacctgcctgaaactggagtctggctccctgaaccgcctagaacggatcctcctcaacctccccggcctgacgacccttggccggcaggaccccagcccccagaaaacccctggcctcctgcccctgaggtggacaaccgacctcaggaggagccagacctagacccaccccgggaagagtacagataatggagtcccctcagccgttctgttcccaggcatctccaggcacccacgccctctccaccctctgattccccgtgaattcttcccaatttagcctgtctccttaaacctcttcctcattccctcggttttattctgaacccgtaaggtggtgttctcaatatttcctgtcccctcctgagatccatacttagtcctcacatcgcccgttttttcctctgacagcctaagcctactctcctacctcgcctccaggcctcggccgcacctacctcccacccggtcttcctgcccgcgcgatcgctggggcagggctatggtactgtgttcccttctgccacctggtggccggcggcaggaactatcagtagacagctgctgcttccatgaaacggaaaaataaaaatcatgttttctt

SEQ ID NO: 819 - DNA, 1151 bp, Homo sapiens
gtgattacggagatgccaagtgggtattgactgctccagggtgtggatggagggtgtgaaaaccagggtggggtgacgcaggctctgggtcatgatagggagagcaggcagctgggtcctgggctggaggactaaaataagggacgccaccttcaggggtgacacatcagcccaggccttcccaacgggtttgaccagttctgttctgatggtattcctgtgccactgggctggcccctcctccactcctcccctataaagcctcttggggttcccaggcacccagactcagcccaccccagctttgggggccagtacatagccatgatcctcaactggaagctcctggggatcctggtcctttgcctgcacaccagaggcatctcaggcagcgagggccacccctctcacccacccgcagaggaccgagaggaggcaggctccccaacattgcctcagggccccccagtccccggtgacccttggccaggggcaccccctctctttgaagatcctccgcctacccgccccagtcgtccctggagagacctgcctgaaactggagtctggccccctgaaccgcctagaacggatcctcctcaacctccccggcctgacgacccttggccggcaggaccccagcccccagaaaacccctggcctcctgcccctgaggtggacaaccgacctcaggaggagccagacctagacccaccccgggaagagtacagataatggagtcccctcagccgttctgttcccaggcatctccaggcacccacgccctctccaccctctgattccccgtgaattcttcccaatttagcctatctccttaaacctcttcctcattccctcggttttattctgaacccgtaaggtggtgttctcaatatttcctgtcccctcctgagatccatacttagtcctcacatcgcccgttttttcctctgacagcctaagcctactctcctacctcgcctccaggcctcggccccacctacctcccacccggtcttcctgcccgcgcgatcgctggggcagggctatggtactgtgttcccttctgccacctggtggccggcggcaggaactatcagtagacgctgctgcttccatgaaacggaaaaataaaaatcatgttttcttaa

SEQ ID NO: 820 - DNA, 1152 bp, Homo sapiens
gtgattacggagatgccaagtgggtattgactgctccagggtgtggatggagggtgtgaaaaccagggtggggtgacgcaggctctgggtcatgatagggagagcaggcagctgggtcctgggctggaggactaaaataagggacgccaccttcaggggtgacacatcagcccaggccttcccaacgggtttgaccagttctgttctgatggtattcctgtgccactgggctggtccctcctccactcctcccctataaagcctcttggggttcccaggcacccagactcagcccaccccagctttgggggccagtacatagccatgatcctcaactggaagctcctggggatcctggtcctttgcctgcacaccagaggcatctcaggcagcgagggccacccctctcacccacccgcagaggaccgagaggaggcaggctccccaacattgcctcagggccccccagtccccggtgacccttggccaggggcaccccctctctttgaagatcctccgcctacccgccccagtcgtccctggagagacctgcctgaaactggagtctggccccctgaaccgcctagaacggatcctcctcaacctccccggcctgacgacccttggccggcaggaccccagcccccagaaaacccctggcctcctgcccctgaggtggacaaccgacctcaggaggagccagacctagacccaccccgggaagagtacagataatggagtcccctcagccgttctgttcccaggcatctccaggcacccacgccctctccaccctctgattccccgtgaattcttcccaatttagcctatctccttaaacctcttcctcattccctcggttttattctgaacccgtaaggtggtgttctcaatatttcctgtcccctcctgagatccatacttagtcctcacatcgcccgttttttcctctgacagcctaagcctactctcctacctcgcctccaggcctcggccccacctacctcccacccggtcttcctgcccgcgcgatcgctggggcagggctacggtactgtgttcccttctgccacctggtggccggcggcaggaactatcagtagacagctgctgcttccatgaaacggaaaaataaaaatcatgttttcttaa

SEQ ID NO: 821 - DNA, 1152 bp, Homo sapiens
gtgattacggagatgccaagtgggtattgactgctccagggtgtggatggagggtgtgaaaaccagggtggggtgacgcaggctctgggtcatgatagggagagcaggcagctgggtcctgggctggaggactaaaataagggacgccaccttcaggggtgacacatcagcccaggccttcccaacgggtttgaccagttctgttctgatggtattcctgtgccactgggctggcccctcctccactcctcccctataaagcctcttggggttcccaggcacccagactcagcccaccccagctttgggggccagtacatagccatgatcctcaactggaagctcctggggatcctggtcctttgcctgcacaccagaggcatctcaggcagcgagggccacccctctcacccacccgcagaggaccgagaggaggcaggctccccaacattgcctcagggccccccagtccccggtgacccttggccaggggcaccccctctctttgaagatcctccgcctacccgccccagtcgtccctggagagacctgcctgaaactggagtctggccccctgaaccgcctagaacggatcctcctcaacctccccggcctgacgacccttggccggcaggaccccagcccccagaaaacccctggcctcctgcccctgaggtggacaaccgacctcaggaggagccagacctagacccaccccgggaagagtacagataatggagtcccctcagccgttctgttcccaggcatctccaggcacccacgccctctccaccctctgattccccgtgaattcttcccaatttagcctatctccttaaacctcttcctcattccctcggttttattctgaacccgtaaggtggtgttctcaatatttcctgtcccctcctgagatccatacttagtcctcacatcgcccgttttttcctctgacagcctaagcctactctcctacctcgcctccaggcctcggccgcacctacctcccacccggtcttcctgcccgcgcgatcgctggggcagggctatggtactgtgttcccttctgccacctggtggccggcggcaggaactatcagtagacagctgctgcttccatgaaacggaaaaataaaaatcatgttttcttaa

SEQ ID NO: 822 - DNA, 1152 bp, Homo sapiens; identical to SEQ ID NO: 820

SEQ ID NO: 823 - DNA, 1152 bp, Homo sapiens
gtgattacggagatgccaagtgggtattgactgctccagggtgtggatggagggtgtgaaaaccagggtggggtgacgcaggctctgggtcatgatagggagagcaggcagctgggtcctgggctggaggactaaaataagggacgccaccttcaggggtgacacatcagcccaggccttcccaacgggtttgaccagttctgttctgatggtattcctgtgccactgggctggcccctcctccactcctcccctataaagcctcttggggttcccaggcacccagactcagcccaccccagctttgggggccagtacatagccatgatcctcaactggaagctcctggggatcctggtcctttgcctgcacaccagaggcatctcaggcagcgagggccacccctctcacccacccgcagaggaccgagaggaggcaggctccccaacattgcctcagggccccccagtccccggtgacccttggccaggggcaccccctctctttgaagatcctccgcctacccgccccagtcgtccctggagagacctgcctgaaactggagtctggccccctgaaccgcctagaacggatcctcctcaacctccccggcctgacgacccttggccggcaggaccccagcccccagaaaacccctggcctcctgcccctgaggtggacaaccgacctcaggaggagccagacctagacccaccccgggaagagtacagataatggagtcccctcagccgttctgttcccaggcatctccaggcacccacgccctctccaccctctgattccccgtgaattcttcccaatttagcctatctccttaaacctcttcctcattccctcggttttattctgaacccgtaaggtggtgttctcaatatttcctgtcccctcctgagatccatacttagtcctcacatcgcccgttttttcctctgacagcctaagcctactctcctacctcgcctccaggcctcggccccacctacctcccacccggtcttcctgcccgcgcgatcgctggggcagggctacggtactgtgttcccttctgccacctggtggccggcggcaggaactatcagtagacagctgctgcttccatgaaacggaaaaataaaaatcatgttttcttaa

SEQ ID NO: 824 - DNA, 1433 bp, Homo sapiens
ggccgctgtagtcactgccctggaggacgtgttccaggccctgggctttgagagctgcgagaggagggaggtcccggtccagggcttcctcgaggaactggcttggttccaggagcagctggatgcccacgggcgccctgtggggtgtgccttagtggccttgatgcccccagagggcagctgaggcagccacagcagctggtccgggagctgagcggctgccgggccctgcggggctgccccaaagtcttcctgctgctctcaagtggtcctgggtcctccctggagcccggagccttccttgctggcctgagagagctgtgtggccgctctcctcactggtccctggtgcagctgctgacgaagctcttccgcagggtggctgaagagtccgcagggggcacctgctgccccgtccttcggagctccttgaggggggcactgtgcctgggaggcgtggagccctggaggcctgagccggcccccggtcccagcacacagtatgacctgtccaaggccagggctgccctcctcctggctgtgatccaaggccggcctggggcccagcatgacgtggaggcgctggggggcctgtgctgggccctgggctttgagaccaccgtgagaacggaccctacagcccaggctttccaggaggagctggcccagttccgggagcaactggacacctgcaggggccctgtgagctgtgcccttgtggccctgatggcccatgggggaccacggggtcagctgctgggggctgacgggcaagaggtgcagcccgaggcactcatgcaggagctgagccgctgccaggtgctgcagggccgccccaagatcttcctgttgcaggcctgccgtgggggaaacagggatgctggtgtggggcccacagctctcccctggtactggagctggctgcgggcacctccatctgtcccctcccatgcagatgtcctgcagatctacgctgaggcccaaggcagctcctgcaggggcacccctccagggagctctgaccaagcagacatcctgacggtctactcagccgcagagggctatgtggcctatcgcgatgacaagggctcagactttatccagacactggtggaggtcctcagagccaaccccgggagagaccttctggagctgctgactgaggtcaacaggcgggtgtgcgagcaggaggtgctgggccccgactgcgatgaactccgcaaggcctgcctggagatccgcagctcgctccggcgccggctctgcctccaggcctgagggtgcggcggccacgggggcgctgctgagacggtggccagatcccagcgccattcttgcctccatccaccccccatccccccggtttcctcatctgagagcgaggcgtggcagcgtgggggtggccgtgcaataaatatctgccgtgaacagtg

SEQ ID NO: 825 - DNA, 5454 bp, Homo sapiens
gctgtgcagctgaggcgccgccgtggagccgccttggagccaccgccccctcgccgcttcgccgctgcgttggggaacctggaccgcggcggcgccgggtttccctcatgatcccgggcgggtggcggcggcggcagaggcggcgggaggatgacctcttaccgggagcggagtgccgacctggcccgtttctacactgtcaccgagccccagcgacacccgaggggctacacagtatataaggtcaccgcccggataattgtatggaagagatacagtgattttaagaaactacacaaagaactatggcaaattcacaaaaacttattccgacattcagagttgtttcctccatttgctaaaggaatagtgtttgggcgatttgatgaaactgttatcgaagagagaagacaatgtgctgaagacctgctacagttctctgccaatattcctgctctttacaatagtaaacagcttgaagactttttcaagggtggaataattaatgatagttctgaattaattggtcctgctgaagctcactcagattccctcattgatacctttcctgagtgtagtacggaaggcttctccagtgacagtgatctggtatctcttactgttgatgtggattctcttgctgagttagatgatggaatggcttccaatcaaaattctcccattagaacttttggtctcaatctttcttcggattcttcagcactaggggctgttgcttctgacagtgaacagagcaaaacagaagaagaacgggaaagtcgtagcctctttcctggcagtttaaagccgaagcttggcaagagagattatttggagaaagcaggagaattaataaagctggctttaaaaaaggaagaagaagacgactatgaagctgcttctgatttttataggaagggagttgatttactcctagaaggtgttcaaggagagtcaagccctacccgtcgagaagctgtgaagagaagaacagccgagtacctcatgcgggcagaaagtatctctagtctttatgggaaacctcagcttgatgatgtatctcagcctccaggatcactaagttcaaggcccctttggaacctaaggagccctgccgaggagctgaaggccttcagagtccttggggtgattgacaaggttttacttgtaatggacacaaggacagaacagactttcattttaaaaggtctaaggaaaagcagtgaatacagcaggaacagaaagaccatcatcccccgctgtgtgcccaacatggtgtgtctgcataagtacatcatctctgaggagtcagtatttcttgtgctgcagcatgcggaaggtggcaaactgtggtcatatatcagtaaatttctaaacagaagtcctgaagaaagctttgacatcaaggaagtgaaaaaacctacacttgcaaaagttcacctgcagcagccaacttctagtcctcaggacagcagtagctttgaatccagaggaagtgatggtggaagcatgcttaaagctctgcctttgaagagtagtcttactccaagttctcaagatgacagcaaccaggaagatgatggccaagatagctctccaaagtggccagattctggttcaagttcagaagaagaatgtactactagttatttaacattatgcaatgaatatgggcaagaaaagattgaaccagggtctttgaatgaggagcccttcatgaagactgaagggaatggtgttgatacaaaagctattaaaagcttcccagcacaccttgctgctgacagtgacagccccagcacacagctgagagctcacgagctgaagttcttccccaacgatgacccagaagcagttagttctccaagaacatcagattccctcagtagatcaaaaaatagccccatggaattctttaggatagacagtaaggatagcgcaagtgaactcctgggacttgactttggagaaaaattgtatagtctaaaatcagaacctttgaaaccattctttactcttccagatggagacagtgcttctaggagttttaatactagtgaaagcaaggtagagtttaaagctcaggacaccattagcaggggctcagatgactcagtgccagttatttcatttaaagatgctgcttttgatgatgtcagtggtactgatgaaggaagacctgatcttcttgtaaatttacctggtgaattggagtcaacaagagaagctgcagcaatgggacctactaagtttacacaaactaatatagggataatagaaaataaactcttggaagcccctgatgttttatgcctcaggcttagtactgaacaatgccaagcacatgaggagaaaggcatagaggaactgagtgatccctctgggcccaaatcctatagtataacagagaaacactatgcacaggaggatcccaggatgttatttgtagcagctgttgatcatagtagttcaggagatatgtctttgttacccagctcagatcctaagtttcaaggacttggagtggttgagtcagcagtaactgcaaacaacacagaagaaagcttattccgtatttgtagtccactctcaggtgctaatgaatatattgcaagcacagacactttaaaaacagaagaagtattgctgtttacagatcagactgatgatttggctaaagaggaaccaacttctttattccagagagactctgagactaagggtgaaagtggtttagtgctagaaggagacaaggaaatacatcagatttttgaggaccttgataaaaaattagcactagcctccaggttttacatcccagagggctgcattcaaagatgggcagctgaaatggtggtagcccttgatgctttacatagagagggaattgtgtgccgcgatttgaacccaaacaacatcttattgaatgatagaggacacattcagctaacgtattttagcaggtggagtgaggttgaagattcctgtgacagcgatgccatagagagaatgtactgtgccccagaggttggagcaatcactgaagaaactgaagcctgtgattggtggagtttgggtgctgtcctctttgaacttctcactggcaagactctggttgaatgccatccagcaggaataaatactcacactactttgaacatgccagaatgtgtctctgaagaggctcgctcactcattcaacagctcttgcagttcaatcctctggaacgacttggtgctggagttgctggtgttgaagatatcaaatctcatccattttttacccctgtggattgggcagaactgatgagatgaacgtaatgcagggttatcttcacacattctgatcttctctgtgacaggcatctccagcactgaggcacctctgactcacagttacttatggagcaccaaagcatttggataaagaccgttataggaaatgggggggaaatggctaaaagagaacaattcgtttacaattacaagatattagctaattgtgccaggggctgttatatacatatatacacaaccaaggtgtgatctgaatttaatccacatttggtgttgcagatgagttgtaaagccaactgaaagagttccttcaagaagttcctctgataggaagctagaagtgtagaatgaagttttacttgacagaaggacctttacatggcagctaacagtgctttttgctgaccaggattggtttatatgattaaattaatatttgcttaataatacactaaaagtatatgaacaatgtcatcaatgaaacttaaaagcgagaaaaaagaatatacacataatttctgacggaaaacctgtaccctgatgctgtataatgtatgttgaatgtggtcccagattatttctgtaagaagacactccatgttgtcagctttgtactctttgttgatactgcttatttagagaagggttcatataaacactcactctgtgtcttcaacagcatctttctttccccatctttctattttctgcaccctctgcttgttccctcatattctgttcttccgactcctgctaacacacatgcaacaaaaaagggaagggagtgcttatttccctttgtgtaaggactaagaaatcatgatatcaaataaacatggtgaaacattagatctcttcttcatttaataaccctcccccctttttttccttgaagaaatgcgtctgttcctttccttgtgaaatattatcagtttctaccattgcttctcatgcttgactttgttttactttttggcttggtatactaagaagcaaaggatctcatctaaatggaattgaatggcagtcctagtttgttacttatggtgatgagattttcagatttgaactaatctatttgacgtgatttagaaagaatgtaagtattcacacatctccaaacatttgtatttgttacttctttttgttgctaaggtagctcctgtagttatgcattgttgcaaaaatttacaaatgttttaaaagtgttaacatctgtttttttttaaacgttagccaaagaagaagtcactatttccaagttagaaaccaccagaaataattgaaatttttgatatgttctaatcttctttgcatttttgagatctgtgtgagagcccaaccccactccaggagcatctgtacagcttccatctgccatcgaccaggtcctctcatcaaattaaatggaacagaaaatgctctagtgaaacaaaggaaatgtgcaagcatttttcctttttctattattctatttccctttttcctttttggcccccttataatccaaaccccagctgaaaggctgcaacaacaccaggttggggagcaggtcaccaggatcatagttcagtcaaaatgacatcactccctggaactagatttcaactcactagtcccctggcctcataacaggaacttatgcaggtgagacacaagaatgacttcctgtgtaggactagtaggaaatctgcaagtacttagagctggccattacagaacttccttccagaagtgccctgtgacatgaaagtaggacttcacaactaaggtgaagatccctgccctaccacatgatttgagtctcttggattcaaaggacattaatgtcaacagatggttgccatgtcagtctgttgacacaattccattgcttcagtttctccccttttctctctatatgtttggttggagcttgtgcctaatgtaaatacatcattcataattagaatggacattaattattttagtaataaacacaggataaatagctttggggtgatgaaccagagtctgtttttattttatggtgtgtacatattttaagctgtacttctgtgaatggtactgatttttgtggttgttttttttttatattttgtttgtttaagcagaagagtggaatatggggtcaaaatcataaaagaagttgccatg

SEQ ID NO: 826 - DNA, 5490 bp, Homo sapiens
gctgtgcagctgaggcgccgccgtggagccgccttggagccaccgccccctcgccgcttcgccgctgcgttggggaacctggaccgcggcggcgccgggtttccctcatgatcccgggcgggtggcggcggcggcagaggcggcgggaggatgacctcttaccgggagcggagtgccgacctggcccgtttctacactgtcaccgagccccagcgacacccgaggggctacacagtatataaggtcaccgcccgggttgtttcacgaagaaatccagaggatgtccaggagataattgtatggaagagatacagtgattttaagaaactacacaaagaactatggcaaattcacaaaaacttattccgacattcagagttgtttcctccatttgctaaaggaatagtgtttgggcgatttgatgaaactgttatcgaagagagaagacaatgtgctgaagacctgctacagttctctgccaatattcctgctctttacaatagtaaacagcttgaagactttttcaagggtggaataattaatgatagttctgaattaattggtcctgctgaagctcactcagattccctcattgatacctttcctgagtgtagtacggaaggcttctccagtgacagtgatctggtatctcttactgttgatgtggattctcttgctgagttagatgatggaatggcttccaatcaaaattctcccattagaacttttggtctcaatctttcttcggattcttcagcactaggggctgttgcttctgacagtgaacagagcaaaacagaagaagaacgggaaagtcgtagcctctttcctggcagtttaaagccgaagcttggcaagagagattatttggagaaagcaggagaattaataaagctggctttaaaaaaggaagaagaagacgactatgaagctgcttctgatttttataggaagggagttgatttactcctagaaggtgttcaaggagagtcaagccctacccgtcgagaagctgtgaagagaagaacagccgagtacctcatgcgggcagaaagtatctctagtctttatgggaaacctcagcttgatgatgtatctcagcctccaggatcactaagttcaaggcccctttggaacctaaggagccctgccgaggagctgaaggccttcagagtccttggggtgattgacaaggttttacttgtaatggacacaaggacagaacagactttcattttaaaaggtctaaggaaaagcagtgaatacagcaggaacagaaagaccatcatcccccgctgtgtgcccaacatggtgtgtctgcataagtacatcatctctgaggagtcagtatttcttgtgctgcagcatgcggaaggtggcaaactgtggtcatatatcagtaaatttctaaacagaagtcctgaagaaagctttgacatcaaggaagtgaaaaaacctacacttgcaaaagttcacctgcagcagccaacttctagtcctcaggacagcagtagctttgaatccagaggaagtgatggtggaagcatgcttaaagctctgcctttgaagagtagtcttactccaagttctcaagatgacagcaaccaggaagatgatggccaagatagctctccaaagtggccagattctggttcaagttcagaagaagaatgtactactagttatttaacattatgcaatgaatatgggcaagaaaagattgaaccagggtctttgaatgaggagcccttcatgaagactgaagggaatggtgttgatacaaaagctattaaaagcttcccagcacaccttgctgctgacagtgacagccccagcacacagctgagagctcacgagctgaagttcttccccaacgatgacccagaagcagttagttctccaagaacatcagattccctcagtagatcaaaaaatagccccatggaattctttaggatagacagtaaggatagcgcaagtgaactcctgggacttgactttggagaaaaattgtatagtctaaaatcagaacctttgaaaccattctttactcttccagatggagacagtgcttctaggagttttaatactagtgaaagcaaggtagagtttaaagctcaggacaccattagcaggggctcagatgactcagtgccagttatttcatttaaagatgctgcttttgatgatgtcagtggtactgatgaaggaagacctgatcttcttgtaaatttacctggtgaattggagtcaacaagagaagctgcagcaatgggacctactaagtttacacaaactaatatagggataatagaaaataaactcttggaagcccctgatgttttatgcctcaggcttagtactgaacaatgccaagcacatgaggagaaaggcatagaggaactgagtgatccctctgggcccaaatcctatagtataacagagaaacactatgcacaggaggatcccaggatgttatttgtagcagctgttgatcatagtagttcaggagatatgtctttgttacccagctcagatcctaagtttcaaggacttggagtggttgagtcagcagtaactgcaaacaacacagaagaaagcttattccgtatttgtagtccactctcaggtgctaatgaatatattgcaagcacagacactttaaaaacagaagaagtattgctgtttacagatcagactgatgatttggctaaagaggaaccaacttctttattccagagagactctgagactaagggtgaaagtggtttagtgctagaaggagacaaggaaatacatcagatttttgaggaccttgataaaaaattagcactagcctccaggttttacatcccagagggctgcattcaaagatgggcagctgaaatggtggtagcccttgatgctttacatagagagggaattgtgtgccgcgatttgaacccaaacaacatcttattgaatgatagaggacacattcagctaacgtattttagcaggtggagtgaggttgaagattcctgtgacagcgatgccatagagagaatgtactgtgccccagaggttggagcaatcactgaagaaactgaagcctgtgattggtggagtttgggtgctgtcctctttgaacttctcactggcaagactctggttgaatgccatccagcaggaataaatactcacactactttgaacatgccagaatgtgtctctgaagaggctcgctcactcattcaacagctcttgcagttcaatcctctggaacgacttggtgctggagttgctggtgttgaagatatcaaatctcatccattttttacccctgtggattgggcagaactgatgagatgaacgtaatgcagggttatcttcacacattctgatcttctctgtgacaggcatctccagcactgaggcacctctgactcacagttacttatggagcaccaaagcatttggataaagaccgttataggaaatgggggggaaatggctaaaagagaacaattcgtttacaattacaagatattagctaattgtgccaggggctgttatatacatatatacacaaccaaggtgtgatctgaatttaatccacatttggtgttgcagatgagttgtaaagccaactgaaagagttccttcaagaagttcctctgataggaagctagaagtgtagaatgaagttttacttgacagaaggacctttacatggcagctaacagtgctttttgctgaccaggattggtttatatgattaaattaatatttgcttaataatacactaaaagtatatgaacaatgtcatcaatgaaacttaaaagcgagaaaaaagaatatacacataatttctgacggaaaacctgtaccctgatgctgtataatgtatgttgaatgtggtcccagattatttctgtaagaagacactccatgttgtcagctttgtactctttgttgatactgcttatttagagaagggttcatataaacactcactctgtgtcttcaacagcatctttctttccccatctttctattttctgcaccctctgcttgttccctcatattctgttcttccgactcctgctaacacacatgcaacaaaaaagggaagggagtgcttatttccctttgtgtaaggactaagaaatcatgatatcaaataaacatggtgaaacattagatctcttcttcatttaataaccctcccccctttttttccttgaagaaatgcgtctgttcctttccttgtgaaatattatcagtttctaccattgcttctcatgcttgactttgttttactttttggcttggtatactaagaagcaaaggatctcatctaaatggaattgaatggcagtcctagtttgttacttatggtgatgagattttcagatttgaactaatctatttgacgtgatttagaaagaatgtaagtattcacacatctccaaacatttgtatttgttacttctttttgttgctaaggtagctcctgtagttatgcattgttgcaaaaatttacaaatgttttaaaagtgttaacatctgtttttttttaaacgttagccaaagaagaagtcactatttccaagttagaaaccaccagaaataattgaaatttttgatatgttctaatcttctttgcatttttgagatctgtgtgagagcccaaccccactccaggagcatctgtacagcttccatctgccatcgaccaggtcctctcatcaaattaaatggaacagaaaatgctctagtgaaacaaaggaaatgtgcaagcatttttcctttttctattattctatttccctttttcctttttggcccccttataatccaaaccccagctgaaaggctgcaacaacaccaggttggggagcaggtcaccaggatcatagttcagtcaaaatgacatcactccctggaactagatttcaactcactagtcccctggcctcataacaggaacttatgcaggtgagacacaagaatgacttcctgtgtaggactagtaggaaatctgcaagtacttagagctggccattacagaacttccttccagaagtgccctgtgacatgaaagtaggacttcacaactaaggtgaagatccctgccctaccacatgatttgagtctcttggattcaaaggacattaatgtcaacagatggttgccatgtcagtctgttgacacaattccattgcttcagtttctccccttttctctctatatgtttggttggagcttgtgcctaatgtaaatacatcattcataattagaatggacattaattattttagtaataaacacaggataaatagctttggggtgatgaaccagagtctgtttttattttatggtgtgtacatattttaagctgtacttctgtgaatggtactgatttttgtggttgttttttttttatattttgtttgtttaagcagaagagtggaatatggggtcaaaatcataaaagaagttgccatg

SEQ ID NO: 827 - DNA, 3032 bp, Homo sapiens
agctgaggcgccgccgtggagccgccttggagccaccgccccctcgccgcttcgccgctgcgttggggaacctggaccgcggcggcgccgggtttccctcatgatcccgggcgggtggcggcggcggcagaggcggcgggaggatgacctcttaccgggagcggagtgccgacctggcccgtttctacactgtcaccgagccccagcgacacccgaggggctacacagtatataaggtcaccgcccggataattgtatggaagagatacagtgattttaagaaactacacaaagaactatggcaaattcacaaaaacttattccgacattcagagttgtttcctccatttgctaaaggaatagtgtttgggcgatttgatgaaactgttatcgaagagagaagacaatgtgctgaagacctgctacagttctctgccaatattcctgctctttacaatagtaaacagcttgaagactttttcaaggagagtcaagccctacccgtcgagaagctgtgaagagaagaacagccgagtacctcatgcgggcagaaagtatctctagtctttatgggaaacctcagcttgatgatgtatctcagcctccaggatcactaagttcaaggcccctttggaacctaaggagccctgccgaggagctgaaggccttcagagtccttggggtgattgacaaggttttacttgtaatggacacaaggacagaacagactttcattttaaaaggtctaaggaaaagcagtgaatacagcaggaacagaaagaccatcatcccccgctgtgtgcccaacatggtgtgtctgcataagtacatcatctctgaggagtcagtatttcttgtgctgcagcatgcggaaggtggcaaactgtggtcatatatcagtaaatttctaaacagaagtcctgaagaaagctttgacatcaaggaagtgaaaaaacctacacttgcaaaagttcacctgcagcagccaacttctagtcctcaggacagcagtagctttgaatccagaggaagtgatggtggaagcatgcttaaagctctgcctttgaagagtagtcttactccaagttctcaagatgacagcaaccaggaagatgatggccaagatagctctccaaagtggccagattctggttcaagttcagaagaagaatgtactactagttatttaacattatgcaatgaatatgggcaagaaaagattgaaccagggtctttgaatgaggagcccttcatgaagactgaagggaatggtgttgatacaaaagctattaaaagcttcccagcacaccttgctgctgacagtgacagccccagcacacagctgagagctcacgagctgaagttcttccccaacgatgacccagaagcagttagttctccaagaacatcagattccctcagtagatcaaaaaatagccccatggaattctttaggatagacagtaaggatagcgcaagtgaactcctgggacttgactttggagaaaaattgtatagtctaaaatcagaacctttgaaaccattctttactcttccagatggagacagtgcttctaggagttttaatactagtgaaagcaaggtagagtttaaagctcaggacaccattagcaggggctcagatgactcagtgccagttatttcatttaaagatgctgcttttgatgatgtcagtggtactgatgaaggaagacctgatcttcttgtaaatttacctggtgaattggagtcaacaagagaagctgcagcaatgggacctactaagtttacacaaactaatatagggataatagaaaataaactcttggaagcccctgatgttttatgcctcaggcttagtactgaacaatgccaagcacatgaggagaaaggcatagaggaactgagtgatccctctgggcccaaatcctatagtataacagagaaacactatgcacaggaggatcccaggatgttatttgtagcagctgttgatcatagtagttcaggagatatgtctttgttacccagctcagatcctaagtttcaaggacttggagtggttgagtcagcagtaactgcaaacaacacagaagaaagcttattccgtatttgtagtccactctcaggtgctaatgaatatattgcaagcacagacactttaaaaacagaagaagtattgctgtttacagatcagactgatgatttggctaaagaggaaccaacttctttattccagagagactctgagactaagggtgaaagtggtttagtgctagaaggagacaaggaaatacatcagatttttgaggaccttgataaaaaattagcactagcctccaggttttacatcccagagggctgcattcaaagatgggcagctgaaatggtggtagcccttgatgctttacatagagagggaattgtgtgccgcgatttgaacccaaacaacatcttattgaatgatagaggtcaggaacttttgcaaatgcatttctttttattcgctgttgcttccaattaactgagtaggcgttttatcttgtaattagtatcttcatttcctgtctagagcttcattatcagtgcagcaaattcacccccagtaatagcttctagtacttaatgatgccattattcttaatgatactgtttttagctacaaaaggagtaattacagttcacttctgcagaaaatggaagagaaaaatgttttgatttctcctgtcgttttgtttttaggacacattcagctaacgtattttagcaggtggagtgaggttgaagattcctgtgacagcgatgccatagagagaatgtactgtgccccagaggttggagcaatcactgaagaaactgaagcctgtgattggtggagtttgggtgctgtcctctttgaacttctcactggcaagactctggttgaatgccatccagcaggaataaatactcacactactttgaacatgccagaatgtgtctctgaagaggctcgctcactcattcaacagctcttgcagttcaatcctctg

SEQ ID NO: 828 - DNA, 3533 bp, Homo sapiens
gaagcagagctgtgcagctgaggcgccgccgtggagccgccttggagccaccgccccctcgccgcttcgccgctgcgttggggaacctggaccgcggcggcgccgggtttccctcatgatcccgggcgggtggcggcggcggcagaggcggcgggaggatgacctcttaccgggagcggagtgccgacctggcccgtttctacactgtcaccgagccccagcgacacccgaggggctacacagtatataaggtcaccgcccgggttgtttcacgaagaaatccagaggatgtccaggagggagaatcctgaaccaacctatccatgaacatactctctgccattttcttagtccttttttcgggaaaactcttttataataacaactgttggtgaaccattcatctgaaaactcttataattgtatggaagagatacagtgattttaagaaactacacaaagaactatggcaaattcacaaaaacttattccgacattcagagttgtttcctccatttgctaaaggaatagtgtttgggcgatttgatgaaactgttatcgaagagagaagacaatgtgctgaagacctgctacagttctctgccaatattcctgctctttacaatagtaaacagcttgaagactttttcaagggtggaataattaatgatagttctgaattaattggtcctgctgaagctcactcagattccctcattgatacctttcctgagtgtagtacggaaggcttctccagtgacagtgatctggtatctcttactgttgatgtggattctcttgctgagttagatgatggaatggcttccaatcaaaattctcccattagaacttttggtctcaatctttcttcggattcttcagcactaggggctgttgcttctgacagtgaacagagcaaaacagaagaagaacgggaaagtcgtagcctctttcctggcagtttaaagccgaagcttggcaagagagattatttggagaaagcaggagaattaataaagctggctttaaaaaaggaagaagaagacgactatgaagctgcttctgatttttataggaagggagttgatttactcctagaaggtgttcaaggagagtcaagccctacccgtcgagaagctgtgaagagaagaacagccgagtacctcatgcgggcagaaagtatctctagtctttatgggaaacctcagcttgatgatgtatctcaggttttacttgtaatggacacaaggacagaacagactttcattttaaaaggtctaaggaaaagcagtgaatacagcaggaacagaaagaccatcatcccccgctgtgtgcccaacatggtgtgtctgcataagtacatcatctctgaggagtcagtatttcttgtgctgcagcatgcggaaggtggcaaactgtggtcatatatcagtaaatttctaaacagaagtcctgaagaaagctttgacatcaaggaagtgaaaaaacctacacttgcaaaagttcacctgcagcagccaacttctagtcctcaggacagcagtagctttgaatccagaggaagtgatggtggaagcatgcttaaagctctgcctttgaagagtagtcttactccaagttctcaagatgacagcaaccaggaagatgatggccaagatagctctccaaagtggccagattctggttcaagttcagaagaagaatgtactactagttatttaacattatgcaatgaatatgggcaagaaaagattgaaccagggtctttgaatgaggagcccttcatgaagactgaagggaatggtgttgatacaaaagctattaaaagcttcccagcacaccttgctgctgacagtgacagccccagcacacagctgagagctcacgagctgaagttcttccccaacgatgacccagaagcagttagttctccaagaacatcagattccctcagtagatcaaaaaatagccccatggaattctttaggatagacagtaaggatagcgcaagtgaactcctgggacttgactttggagaaaaattgtatagtctaaaatcagaacctttgaaaccattctttactcttccagatggagacagtgcttctaggagttttaatactagtgaaagcaaggtagagtttaaagctcaggacaccattagcaggggctcagatgactcagtgccagttatttcatttaaagatgctgcttttgatgatgtcagtggtactgatgaaggaagacctgatcttcttgtaaatttacctggtgaattggagtcaacaagagaagctgcagcaatgggacctactaagtttacacaaactaatatagggataatagaaaataaactcttggaagcccctgatgttttatgcctcaggcttagtactgaacaatgccaagcacatgaggagaaaggcatagaggaactgagtgatccctctgggcccaaatcctatagtataacagagaaacactatgcacaggaggatcccaggatgttatttgtagcagctgttgatcatagtagttcaggagatatgtctttgttacccagctcagatcctaagtttcaaggacttggagtggttgagtcagcagtaactgcaaacaacacagaagaaagcttattccgtatttgtagtccactctcaggtgctaatgaatatattgcaagcacagacactttaaaaacagaagaagtattgctgtttacagatcagactgatgatttggctaaagaggaaccaacttctttattccagagagactctgagactaagggtgaaagtggtttagtgctagaaggagacaaggaaatacatcagatttttgaggaccttgataaaaaattagcactagcctccaggttttacatcccagagggctgcattcaaagatgggcagctgaaatggtggtagcccttgatgctttacatagagagggaattgtgtgccgcgatttgaacccaaacaacatcttattgaatgatagaggacacattcagctaacgtattttagcaggtggagtgaggttgaagattcctgtgacagcgatgccatagagagaatgtactgtgccccagaggttggagcaatcactgaagaaactgaagcctgtgattggtggagtttgggtgctgtcctctttgaacttctcactggcaagactctggttgaatgccatccagcaggaataaatactcacactactttgaacatgccagaatgtgtctctgaagaggctcgctcactcattcaacagctcttgcagttcaatcctctggaacgacttggtgctggagttgctggtgttgaagatatcaaatctcatccattttttacccctgtggattgggcagaactgatgagatgaacgtaatgcagggttatcttcacacattctgatcttctctgtgacaggcatctccagcactgaggcacctctgactcacagttacttatggagcaccaaagcatttggataaagaccgttataggaaatgggggggaaatggctaaaaga

SEQ ID NO: 829 - DNA, 1726 bp, Homo sapiens
gcgcggccaggtacgggccgacgggcccgcggggccggcgccgccatggcggccgtgtttgatttggatttggagacggaggaaggcagcgagggcgagggcgagccagagctcagccccgcggacgcatgtccccttgccgagttgagggcagctggcctagagcctgtgggacactatgaagaggtggagctgactgagaccagcgtgaacgttggcccagagcgcatcgggccccactgctttgagctgctgcgtgtgctgggcaaggggggctatggcaaggtgttccaggtgcgaaaggtgcaaggcaccaacttgggcaaaatatatgccatgaaagtcctaaggaaggccaaaattgtgcgcaatgccaaggacacagcacacacacgggctgagcggaacattctagagtcagtgaagcacccctttattgtggaactggcctatgccttccagactggtggcaaactctacctcatccttgagtgcctcagtggtggcgagctcttcacgcatctggagcgagagggcatcttcctggaagatacggcctgcttctacctggctgagatcacgctggccctgggccatctccactcccagggcatcatctaccgggacctcaagcccgagaacatcatgctcagcagccagggccacatcaaactgaccgactttggactctgcaaggagtctatccatgagggcgccgtcactcacaccttctgcggcaccattgagtacatggcccctgagattctggtgcgcagtggccacaaccgggctgtggactggtggagcctgggggccctgatgtacgacatgctcactggatcgccgcccttcaccgcagagaaccggaagaaaaccatggataagatcatcaggggcaagctggcactgcccccctacctcaccccagatgcccgggaccttgtcaaaaagtttctgaaacggaatcccagccagcggattgggggtggcccaggggatgctgctgatgtgcagagacatccctttttccggcacatgaattgggacgaccttctggcctggcgtgtggacccccctttcaggccctgtctgcagtcagaggaggacgtgagccagtttgatacccgcttcacacggcagacgccggtggacagtcctgatgacacagccctcagcgagagtgccaaccaggccttcctgggcttcacatacgtggcgccgtctgtcctggacagcatcaaggagggcttctccttccagcccaagctgcgctcacccaggcgcctcaacagtagcccccgggcccccgtcagccccctcaagttctccccttttgaggggtttcggcccagccccagcctgccggagcccacggagctacctctacctccactcctgccaccgccgccgccctcgaccaccgcccctctccccatccgtcccccctcagggaccaagaagtccaagaggggccgtgggcgtccagggcgctaggaagccgggtgggggtgagggtagcccttgagccctgtccctgcggctgtgagagcagcaggaccctgggccagttccagagacctgggggtgtgtctgggggtggggtgtgagtgcgtatgaaagtgtgtgtctgctggggcagctgtgcccctgaatcatgggcacggagggccgcccgccacgccccgcgctcaactgctcccgtggaagattaaagggctgaatcatg

SEQ ID NO: 830 - DNA, 1806 bp, Homo sapiens
cggccaggtacgggccgacgggcccgcggggccggcgccgccatggcggccgtgtttgatttggatttggagacggaggaaggcagcgagggcgagggcgagccagagctcagccccgcggacgcatgtccccttgccgagttgagggcagctggcctagagcctgtgggacactatgaagaggtggagctgactgagaccagcgtgaacgttggcccagagcgcatcgggccccactgctttgagctgctgcgtgtgctgggcaaggggggctatggcaaggtgttccaggtgcgaaaggtgcaaggcaccaacttgggcaaaatatatgccatgaaagtcctaaggaaggccaaaattgtgcgcaatgccaaggacacagcacacacacgggctgagcggaacattctagagtcagtgaagcacccctttattgtggaactggcctatgccttccagactggtggcaaactctacctcatccttgagtgcctcagtgtagactgagcgtcctgagggcagtggctgggtctcttcatcctgtccccagcttcacccagcacagggccaggcaccgagtaggcgtcggtagatgtttgctgaattgaattgaatccccacggcagctctgtgaggcaggtggcgagctcttcacgcatctggagcgagagggcatcttcctggaagatacggcctgcttctacctggctgagatcacgctggccctgggccatctccactcccagggcatcatctaccgggacctcaagcccgagaacatcatgctcagcagccagggccacatcaaactgaccgactttggactctgcaaggagtctatccatgagggcgccgtcactcacaccttctgcggcaccattgagtacatggcccctgagattctggtgcgcagtggccacaaccgggctgtggactggtggagcctgggggccctgatgtacgacatgctcactggatcgccgcccttcaccgcagagaaccggaagaaaaccatggataagatcatcaggggcaagctggcactgcccccctacctcaccccagatgcccgggaccttgtcaaaaagtttctgaaacggaatcccagccagcggattgggggtggcccaggggatgctgctgatgtgcagagacatccctttttccggcacatgaattgggacgaccttctggcctggcgtgtggacccccctttcaggccctgtctgcagtcagaggaggacgtgagccagtttgatacccgcttcacacggcagacgccggtggacagtcctgatgacacagccctcagcgagagtgccaaccaggccttcctgggcttcacatacgtggcgccgtctgtcctggacagcatcaaggagggcttctccttccagcccaagctgcgctcacccaggcgcctcaacagtagcccccgggcccccgtcagccccctcaagttctccccttttgaggggtttcggcccagccccagcctgccggagcccacggagctacctctacctccactcctgccaccgccgccgccctcgaccaccgcccctctccccatccgtcccccctcagggaccaagaagtccaagaggggccgtgggcgtccagggcgctaggaagccgggtgggggtgagggtagcccttgagccctgtccctgcggctgtgagagcagcaggaccctgggccagttccagagacctgggggtgtgtctgggggtggggtgtgagtgcgtatgaaagtgtgtgtctgctggggcagctgtgcccctgaatcatgggcacggagggc

SEQ ID NO: 831 - DNA, 918 bp, Homo sapiens
agtgcgcggccaggtacgggccgacgggcccgcggggccggcgccgccatggcggccgtgtttgatttggatttggagacggaggaaggcagcgagggcgagggcgagccagagctcagccccgcggacgcatgtccccttgccgagttgagggcagctggcctagagcctgtgggacactatgaagaggtggagctgactgagaccagcgtgaacgttggcccagagcgcatcgggccccactgctttgagctgctgcgtgtgctgggcaaggggggctatggcaaggtgttccaggtgcgaaaggtgcaaggcaccaacttgggcaaaatatatgccatgaaagtcctaaggaaggccaaaattgtgcgcaatgccaaggacacagcacacacacgggctgagcggaacattctagagtcagtgaagcacccctttattgtggaactggcctatgccttccagactggtggcaaactctacctcatccttgagtgcctcagtgtagactgagcgtcctgagggcagtggctgggtctcttcatcctgtccccagcttcacccagcacagggccaggcaccgagtaggcgtcggtagatgtttgctgaattgaattgaatccccacggcagctctgtgaggcaggtggcgagctcttcacgcatctggagcgagagggcatcttcctggaagatacggcctgcttctacctggctgagatcacgctggccctgggccatctccactcccagggcatcatctaccgggacctcaagcccgagaacatcatgctcagcagccagggccacatcaaactgaccgactttggactctgcaaggagtctatccatgagggcgccgtcactcacaccttctgcggcaccattgagtacatgtaagtggcacctggctggccca

SEQ ID NO: 832 - DNA, 2410 bp, Homo sapiens
atcaccatcatggtttcgtagccatgtttaaatttttgtcttttcgtgttcgctctatacaggaagaagtcagtatcaaagaaattgcaatcacacatcatgtaaaggaaggacatgaaaaggcagatccttcccagtttgaacttttaaaagtattagggcagggatcatttggaaaggttttcttagttaaaaaaatctcaggctctgatgctaggcagctttatgccatgaaggtattgaagaaggccacactgaaagttcgagaccgagttcggacaaaaatggaacgtgatatcttggtagaggttaatcatccttttattgtcaagttgcattatgcttttcaaactgaagggaagttgtatcttattttggattttctcaggggaggagatttgtttacacgcttatccaaagaggtgatgttcacagaagaagatgtcaaattctacttggctgaacttgcacttgctttagaccatctacatagcctgggaataatttatagagacttaaaaccagaaaatatacttcttgatgaagaaggtcacatcaagttaacagatttcggcctaagtaaagagtctattgaccatgaaaagaaggcatattctttttgtggaactgtggagtatatggctccagaagtagttaatcgtcgaggtcatactcagagtgctgactggtggtcttttggtgtgttaatgtttgaaatgcttactggtacactccctttccaaggaaaagatcgaaaagaaacaatgactatgattcttaaagccaaacttggaatgccacagtttttgagtcctgaagcgcagagtcttttacgaatgcttttcaagcgaaatcctgcaaacagattaggtgcaggaccagatggagttgaagaaattaaaagacattcatttttctcaacgatagactggaataaactgtatagaagagaaattcatccgccatttaaacctgcaacgggcaggcctgaagatacattctattttgatcctgagtttactgcaaaaactcccaaagattcacctggcattccacctagtgctaatgcacatcagctttttcgggggtttagttttgttgctattacctcagatgatgaaagccaagctatgcagacagttggtgtacattcaattgttcagttacacaggaacagtattcagtttactgatggatatgaagtaaaagaagatattggagttggctcctactctgtttgcaagagatgtatacataaagctacaaacatggagtttgcagtgaagattattgataaaagcaagagagacccaacagaagaaattgaaattcttcttcgttatggacagcatccaaacattatcactctaaaggatgtatatgatgatggaaagtatgtgtatgtagtaacagaacttatgaaaggaggtgaattgctggataaaattcttagacaaaaatttttctctgaacgagaggccagtgctgtcctgttcactataactaaaaccgttgaatatcttcacgcacaaggggtggttcatagagacttgaaacctagcaacattctttatgtggatgaatctggtaatccggaatctattcgaatttgtgattttggctttgcaaaacagctgagagcggaaaatggtcttctcatgactccttgttacactgcaaattttgttgcaccagaggttttaaaaagacaaggctatgatgctgcttgtgatatatggagtcttggtgtcctactctatacaatgcttaccggttacactccatttgcaaatggtcctgatgatacaccagaggaaatattggcacgaataggtagcggaaaattctcactcagtggtggttactggaattctgtttcagacacagcaaaggacctggtgtcaaagatgcttcatgtagaccctcatcagagactgactgctgctcttgtgctcagacatccttggatcgtccactgggaccaactgccacaataccaactaaacagacaggatgcaccacatctagtaaagggtgccatggcagctacatattctgctttgaaccgtaatcagtcaccagttttggaaccagtaggccgctctactcttgctcagcggagaggtattaaaaaaatcacctcaacagccctgtgaagtgacctcagtgagatatttggtaccatggtgtaagctgatagcacaagttctggcgacaggtagcacgtatctgagagacacctgcaagcacacactgtcccagctggtacccataatgctgctgttcctgctgctgctcctgctttcctctcttctcgctttaaatgattgttagcaagttagattttcctggagcttcggaagaaatgaaaatggaaacatgatgaagatatagtcactgaatcaatgag

SEQ ID NO: 833 - DNA, 7918 bp, Homo sapiens
aggcgcgcggctttcgggcggtcggcgtcggcgtcgagccctctctggggccgccgccgctgctgctgctgctgccgctgccgctgccgctgccgccgccgccgccgccgccgccgctgccgtggggctcgggcggcgacggagcggggccggccgtggggcgggcggggagggaggaggcggtgaaggcggcgggccgggggggaagatgccgctggcgcagctggcggacccgtggcagaagatggctgtggagagcccgtccgacagcgctgagaatggacagcaaattatggatgaacctatgggagaggaggagattaacccacaaactgaagaagtcagtatcaaagaaattgcaatcacacatcatgtaaaggaaggacatgaaaaggcagatccttcccagtttgaacttttaaaagtattagggcagggatcatttggaaaggttttcttagttaaaaaaatctcaggctctgatgctaggcagctttatgccatgaaggtattgaagaaggccacactgaaagttcgagaccgagttcggacaaaaatggaacgtgatatcttggtagaggttaatcatccttttattgtcaagttgcattatgcttttcaaactgaagggaagttgtatcttattttggattttctcaggggaggagatttgtttacacgcttatccaaagaggtgatgttcacagaagaagatgtcaaattctacttggctgaacttgcacttgctttagaccatctacatagcctgggaataatttatagagacttaaaaccagaaaatatacttcttgatgaagaaggtcacatcaagttaacagatttcggcctaagtaaagagtctattgaccatgaaaagaaggcatattctttttgtggaactgtggagtatatggctccagaagtagttaatcgtcgaggtcatactcagagtgctgactggtggtcttttggtgtgttaatgtttgaaatgcttactggtacactccctttccaaggaaaagatcgaaaagaaacaatgactatgattcttaaagccaaacttggaatgccacagtttttgagtcctgaagcgcagagtcttttacgaatgcttttcaagcgaaatcctgcaaacagattaggtgcaggaccagatggagttgaagaaattaaaagacattcatttttctcaacgatagactggaataaactgtatagaagagaaattcatccgccatttaaacctgcaacgggcaggcctgaagatacattctattttgatcctgagtttactgcaaaaactcccaaagattcacctggcattccacctagtgctaatgcacatcagctttttcgggggtttagttttgttgctattacctcagatgatgaaagccaagctatgcagacagttggtgtacattcaattgttcagcagttacacaggaacagtattcagtttactgatggatatgaagtaaaagaagatattggagttggctcctactctgtttgcaagagatgtatacataaagctacaaacatggagtttgcagtgaagattattgataaaagcaagagagacccaacagaagaaattgaaattcttcttcgttatggacagcatccaaacattatcactctaaaggatgtatatgatgatggaaagtatgtgtatgtagtaacagaacttatgaaaggaggtgaattgctggataaaattcttagacaaaaatttttctctgaacgagaggccagtgctgtcctgttcactataactaaaaccgttgaatatcttcacgcacaaggggtggttcatagagacttgaaacctagcaacattctttatgtggatgaatctggtaatccggaatctattcgaatttgtgattttggctttgcaaaacagctgagagcggaaaatggtcttctcatgactccttgttacactgcaaattttgttgcaccagaggttttaaaaagacaaggctatgatgctgcttgtgatatatggagtcttggtgtcctactctatacaatgcttaccggttacactccatttgcaaatggtcctgatgatacaccagaggaaatattggcacgaataggtagcggaaaattctcactcagtggtggttactggaattctgtttcagacacagcaaaggacctggtgtcaaagatgcttcatgtagaccctcatcagagactgactgctgctcttgtgctcagacatccttggatcgtccactgggaccaactgccacaataccaactaaacagacaggatgcaccacatctagtaaagggtgccatggcagctacatattctgctttgaaccgtaatcagtcaccagttttggaaccagtaggccgctctactcttgctcagcggagaggtattaaaaaaatcacctcaacagccctgtgaagtgacctcagtgagatatttggtaccatggtgtaagctgatagcacaagttctggcgacaggtagcacgtatctgagagacacctgcaagcacacactgtcccagctggtacccataatgctgctgttcctgctgctgctcctgctttcctctcttctcgctttaaatgattgttagcaagttagattttcctggagcttcggaagaaatgaaaatggaaacatgatgaagatatagtcactgaatcaatgagaaaaataatgaacatatgaataccacctaaaaatacactgaataaagtacaccatatagcattatttttataggaaatatttcatgtcccttaaatattctttgttagttatagggatggacagtttatgttaagcacttagcttaaacaatccgtttatattagcactgtatcccttgtgccatccaacattttgtatgtttttgtaaacagttcatatacagtacatttctgtactgctttctttaatgtatacatgccttgtttaacttggaatctattattattaatcaattgactattaaatctggttaaatagttcacctggattaacagtattgttggacagtcctaaaaatggccagattgtggaacagctgttgaatgtaatacttccaaaatgtacatatctttccccacgtctgtttcactggttcgttcatttgtttgtttcttaaagtcaggtgctctgtcagactaacctagagagctgttatggtagagaaagttatcatatgtgtgtggcatgaaatcaagaatacacctatgaagttagtccatatactttgcaactccttagagtacttttttccttaattaaggaagtagtccttgcacttctaatcttacatagcatccatacttagaatttggcatatcatctgggattttgccaatatacgtcaaagccctttaagagtcatggtaaggagatgggtgaaggaaaatttagcaacaggtaattgaagtcctattggatatttcatgtttaaatagatattctatattaaacactaatttaaatgtaataaaggccaaaggcctctgtatgaaattggatttaaactttcttattttagggaataaaacattattgatcaaacagtatctgttctaacctaaaattataggtagggcaggctaagtgaacagcattgagtattttctgaatccctcatgataatttatagccacatactgcttcctttgacttcaggaatgatcagttttcataatggccactgggcctgcttagattgcagtattcattatctgcatctaatttggtagtttccacaatcgtatttgatgaaagaaacttcagtccccattattacctgtgtctttgccaagctgcctagcatacatcagtatgtaatgtaaaagacatatgagcaagaaaaaagtgatttaacttacctcatcaagaatgtgcccctacaggccgggcgcagtggctcacgcctgtaatcccagcattttgggaggccgaggcaggtggatcacctgaggtcaggagtttgagaccagcctggccaacatggtgaaaccccgtctctactaaaaaatacaaaaattagctgggcatggtggcgtgcacctgtaatcctagctactcaggaggctgaggcaggagaatcgcttgaacctgggaggtggtggttgcagtgagccaagatcacaccattgcactccagcctgggtgacagagtgagactctgtctcaagaaggaaaaaaaaaaaaaagaatgtactcatacagatttttgttagtcatcatgtaataagccatttatatcagaaaccttttttcctgccacagaagctttaaattttcccctaagagtacaaagccaagagagtgtggtttatctaaatgtcctgaaatccacttgtcattccttaatttctcctctatgcaattaaagagaaaggggaaatctataacatttcttttgcccaagtgacacaaaaatgattactgcatagaaatcaaatgtaagtttagcttctaaatgaaataatatataggagggatatcagaatgtctagatagagaaagtattttcaaattcttgaatatatggatgctattaaaagctgctttccattgcctggaaagagagcttttttccctcctctattcagtgtttcaaactttggtcatctcaaattattgtcacttttaaaatgttaatgtcattctgagcagaaatagatatattttcagatttttttacactgatgctactccgtaattgcttaggagtattgtccatcatagtattttagaactagaagtaaacacataaatccttataaattacccaatccaactttctcatattgcatgtagagaacctgagacacatatcaaagtctagaatccttaacttctccccattttgtttttttccgcctcatcacaccatgctgcctttccctcatatgatcaccaaccagtagctgagttcaaaaactacatatttcttgggcagtcctctactggtatgtgatgccaacttttatttctttcgaagataattgccttctttgcctagccaagcagccaattttattggagaaaagcaagttatatgttcacaaaatggaaggctttctacctaaatttatttcatctgtggtcctcttattctcttccattgcttttgacatacagtggaaaaacttggccaacgatgtgctctaaatatagtgcttgtgttgggttaacttttccattaatttctcaacatcaattattcaggcccctacagttgtggtattgaggcccctaaaggcttctgcctttcaccaattagtgctgccagttactgaggcttctcccaaaaggtatcagtccagtcttaaagatatttcattgtgaaagaagaaactaaactatcaggcctcttttacaaaatgagagattgaatttaagcttgtcaagcacgtactggaaggtatgaattacactaccatgtgttttgtatcttccctttcaagtgatgatgttaaatgaaggtaagtttttcatccttttttaatttttgttttttataaatcatttcagctttttctggtttatagaggtgtcttatttctaatgcaacagacccccaactttaacagatttgatatggatgcatttattcacaagcaaccccaaaagtccaaaaatgtaataattttgacaaggcccaaagttgagatgctatgaagcttgtgtgtgtgaaaagtcagttatgattgtctggagagaagctgtggtgtgtatgctgtagagtttccacatttcacatgcagtgtactccaaaaagcgggtttgggtcaaccatttcccatctctttttaagaagtgactgctgttggggccaggggacatcatgggaggtggggctgtccagttagctgtgccctgcaccttcagcccaggaaagatttgaacagagcaaaggcttcaagagagggcagaatgtattcggcagaaaagggactcaggtaagcccagcctgggatgagagcagaaaagcattcaagatttgcaggccttgctatggatgcgcttaatcaccatggaggccagcaatacccatctcagcatggctttgatattctctacttcctggcctttaaaaatgacctataatttttcagtttgctttactatattttataaagaaaattctatcttatggttgattgagcattgagacttatgaaggcattaggatagatagctcaggaatgtaaaggttcagaaaaggtctgttttctcagattaacaaatatgatggattccatggctgaccttggtgcttaaaccaggaggtttcaatctagtcctagagttgtgtccctctgaaaggcccaatgccatgtaactaactttaaactggatatatactttgagccttacttaattcacagataagttgacttaactcagtatttttatttcaattaatgaaaacagtcctcttttcaaccccaggttgcttacattttgctggtctccccaagtgaccattggtggagaccaattaatgaaggaatgaaattcactttattgggactgtggtattcaacagagccacacttaaccactttttccaatgaagaatctccagaatgataatgcccaaatatggatggccaagaagaatttgtatctacggtgtgctttatgtgtttttgacactgctgtattctgtgtgatcaagtgatttgcagctggttccaatgtgactgagtgttctcaaagatttctagtaactaagtcaacttaattttcttaagcctggtattactatcagcctcacatttaccactttgattctagttttttaactgttcataacagggcataccgagggttgggatgagagcctacttcctacctcttaaggcactttcctcattattttgccatataatcttgaactgcatgataagctgtttaaatgtccatgacttctcccagagcaactagcaaagtatatgacattttgaatagagattagtggaaaggaaaatgtagagatttaagttcagaggtacaaacctcaataaaacctccttagagcacataccatgagtagagtatatgtaaacgtatatgagaagagagtcgctataatagtcctctctaagtagattagttcattgtctaatggaagtgaacatctttactcctgttatcaccatagtactgaatgaactgtataatgagtttttcaaacaagtatttaaaatagaactttcacgtacaaagcaagggcataaagattttggtttgtgtttctgtaagtgtagtttaccatctaaagctttggtttttaattttaaaaaaagcttcaaggtattgccattccttagcatccttattgattatgggtgatgagtttttaactcttaaaatcatatacgtgtattagtttatcttaactgttgccctaagcaaaagggaaggtatacacctaagggatgtacttattttgcatttttggtcatgggtgggaatggggtgggtgcctacttaaatagtttttaaaaaagaaaaaaatcacaaatatttttctactgttatatatgatcttcctttatactagtttctctctagtaaggcatgccagaagcccaagataccatatcatgaattcttacatattgtaccttttgttggtggttaaatcgcatcagatgcttggcattgctgccataattataaaatgcttgtaaaggatcaaatatcactaaatactttaaattgttttacttaagagtctaatctgggaagttttcaaatcatactattaatgtgtaatctaagctcttcagatgtatccatgaataatcctggaacaatattgcttgtattcctgtcatagaacaggttttgtaatctttaaaagaaatgaaaatttatataataaagtttcaaatcaatgca

SEQ ID NO: 834 - DNA, 530 bp, Homo sapiens
gggggggaagatgccgctggcgcagctggcggacccgtggcagaagatggctgtggagagcccgtccgacagcgctgaggataaatgaggagctgattcttaatcctgtcacattgaatggacagcaaattatggatgaacctatgggagaggaggagattaacccacaaactgaagaagtcagtatcaaagaaattgcaatcacacatcatgtaaaggaaggacatgaaaaggcagatccttcccagtttgaacttttaaaagtattagggcagggatcatttggaaaggttttcttagttaaaaaaatctcaggctctgatgctaggcagctttatgccatgaaggtattgaagaaggccacactgaaagttcgagaccgagttcggacaaaaatggaacgtgatatcttggtagaggttaatcatccttttattgtcaagttgcattatgcttttcaaactgaagggaagttgtatcttattttggattttctcaggggaggagatttgtttacacgcttatccaaa

SEQ ID NO: 835 - DNA, 804 bp, Homo sapiens
aggaaattttctaattgccggaacagctggtaggagaaaactttgcaggggcttggccttccctttctaacttaagttttaccgtcagaaattcttttatcaccatcatggtttcgtagccatgtttaaatttttgtcttttcgtgttcgctctatacaggaagaagtcagtatcaaagaaattgcaatcacacatcatgtaaaggaaggacatgaaaaggcagatccttcccagtttgaacttttaaaagtattagggcagggatcatttggaaaggttttcttagttaaaaaaatctcaggctctgatgctaggcagctttatgccatgaaggtattgaagaaggccacactgaaagttcgagaccgagttcggacaaaaatggaacgtgatatcttggtagaggttaatcatccttttattgtcaagttgcattatgcttttcaaactgaagggaagttgtatcttattttggattttctcaggggaggagatttgtttacacgcttatccaaagaggtgatgttcacagaagaagatgtcaaattctacttggctgaacttgcacttgctttagaccatctacatagcctgggaataatttatagagacttaaaaccagaaaatatacttcttgatgaagaaggtcacatcaagttaacagatttcggcctaagtaaagagtctattgaccatgaaaagaaggcatattctttttgtggaactgtggagtatatggctccagaagtagttaatcgtcgaggtcatactcagagtgctgactggtggtcttttggtgtgtt

SEQ ID NO: 836 - DNA, 2425 bp, Homo sapiens
aggattatatctttatccttgaaatttaaaaacatttgccaggacatgtcttggtgttgatgatctctgttgaaccttctcagtctccagtctcaggataaatgaggagctgattcttaatcctgtcacattgaatggacagcaaattatggatgaacctatgggagaggaggagattaacccacaaactgaagaagtcagtatcaaagaaattgcaatcacacatcatgtaaaggaaggacatgaaaaggcagatccttcccagtttgaacttttaaaagtattagggcagggatcatttggaaaggttttcttagttaaaaaaatctcaggctctgatgctaggcagctttatgccatgaaggtattgaagaaggccacactgaaagttcgagaccgagttcggacaaaaatggaacgtgatatcttggtagaggttaatcatccttttattgtcaagttgcattatgcttttcaaactgaagggaagttgtatcttattttggattttctcaggggaggagatttgtttacacgcttatccaaagaggtgatgttcacagaagaagatgtcaaattctacttggctgaacttgcacttgctttagaccatctacatagcctgggaataatttatagagacttaaaaccagaaaatatacttcttgatgaagaaggtcacatcaagttaacagatttcggcctaagtaaagagtctattgaccatgaaaagaaggcatattctttttgtggaactgtggagtatatggctccagaagtagttaatcgtcgaggtcatactcagagtgctgactggtggtcttttggtgtgttaatgtttgaaatgcttactggtacactccctttccaaggaaaagatcgaaaagaaacaatgactatgattcttaaagccaaacttggaatgccacagtttttgagtcctgaagcgcagagtcttttacgaatgcttttcaagcgaaatcctgcaaacagattaggtgcaggaccagatggagttgaagaaattaaaagacattcatttttctcaacgatagactggaataaactgtatagaagagaaattcatccgccatttaaacctgcaacgggcaggcctgaagatacattctattttgatcctgagtttactgcaaaaactcccaaagattcacctggcattccacctagtgctaatgcacatcagctttttcgggggtttagttttgttgctattacctcagatgatgaaagccaagctatgcagacagttggtgtacattcaattgttcagttacacaggaacagtattcagtttactgatggatatgaagtaaaagaagatattggagttggctcctactctgtttgcaagagatgtatacataaagctacaaacatggagtttgcagtgaagattattgataaaagcaagagagacccaacagaagaaattgaaattcttcttcgttatggacagcatccaaacattatcactctaaaggatgtatatgatgatggaaagtatgtgtatgtagtaacagaacttatgaaaggaggtgaattgctggataaaattcttagacaaaaatttttctctgaacgagaggccagtgctgtcctgttcactataactaaaaccgttgaatatcttcacgcacaaggggtggttcatagagacttgaaacctagcaacattctttatgtggatgaatctggtaatccggaatctattcgaatttgtgattttggctttgcaaaacagctgagagcggaaaatggtcttctcatgactccttgttacactgcaaattttgttgcaccagaggttttaaaaagacaaggctatgatgctgcttgtgatatatggagtcttggtgtcctactctatacaatgcttaccggttacactccatttgcaaatggtcctgatgatacaccagaggaaatattggcacgaataggtagcggaaaattctcactcagtggtggttactggaattctgtttcagacacagcaaaggacctggtgtcaaagatgcttcatgtagaccctcatcagagactgactgctgctcttgtgctcagacatccttggatcgtccactgggaccaactgccacaataccaactaaacagacaggatgcaccacatctagtaaagggtgccatggcagctacatattctgctttgaaccgtaatcagtcaccagttttggaaccagtaggccgctctactcttgctcagcggagaggtattaaaaaaatcacctcaacagccctgtgaagtgacctcagtgagatatttggtaccatggtgtaagctgatagcacaagttctggcgacaggtagcacgtatctgagagacacctgcaagcacacactgtcccagctggtacccataatgctgctgttcctgctgctgct

SEQ ID NO: 837 - DNA, 3054 bp, Homo sapiens
cttggctcgggactgcgcccccggtactttgcccacctccctccccagctgggcggggaccactgttctccctcattcccaaggagcctccgacctccttggacccttggcggtgaaaggctcccagccttcgcccctcctgcctttcccatttctttcccccgcctcccgccgacgcccccagatctgttgggctcgcccttcctgaaagtaggcgaggcccagaagctgaggttggggcgcagaaggaggggggtgggaagagggaggagcggagcgcagcggccgggggcgtgtcttccactagcccagcccctgggtgcgcgcggcggtggtggcggcggccgagcctcgctttgagagacagtataatgagtatgatgaatatcactgtacataagtctttatgcacatctctgatatttccttaggataaatgaggagctgattcttaatcctgtcacattgaatggacagcaaattatggatgaacctatgggagaggaggagattaacccacaaactgaagaagtcagtatcaaagaaattgcaatcacacatcatgtaaaggaaggacatgaaaaggcagatccttcccagtttgaacttttaaaagtattagggcagggatcatttggaaaggttttcttagttaaaaaaatctcaggctctgatgctaggcagctttatgccatgaaggtattgaagaaggccacactgaaagttcgagaccgagttcggacaaaaatggaacgtgatatcttggtagaggttaatcatccttttattgtcaagttgcattatgcttttcaaactgaagggaagttgtatcttattttggattttctcaggggaggagatttgtttacacgcttatccaaagaggtgatgttcacagaagaagatgtcaaattctacttggctgaacttgcacttgctttagaccatctacatagcctgggaataatttatagagacttaaaaccagaaaatatacttcttgatgaagaaggtcacatcaagttaacagatttcggcctaagtaaagagtctattgaccatgaaaagaaggcatattctttttgtggaactgtggagtatatggctccagaagtagttaatcgtcgaggtcatactcagagtgctgactggtggtcttttggtgtgttaatgtttgaaatgcttactggtacactccctttccaaggaaaagatcgaaaagaaacaatgactatgattcttaaagccaaacttggaatgccacagtttttgagtcctgaagcgcagagtcttttacgaatgcttttcaagcgaaatcctgcaaacagattaggtgcaggaccagatggagttgaagaaattaaaagacattcatttttctcaacgatagactggaataaactgtatagaagagaaattcatccgccatttaaacctgcaacgggcaggcctgaagatacattctattttgatcctgagtttactgcaaaaactcccaaagattcacctggcattccacctagtgctaatgcacatcagctttttcgggggtttagttttgttgctattacctcagatgatgaaagccaagctatgcagacagttggtgtacattcaattgttcagcagttacacaggaacagtattcagtttactgatggatatgaagtaaaagaagatattggagttggctcctactctgtttgcaagagatgtatacataaagctacaaacatggagtttgcagtgaagattattgataaaagcaagagagacccaacagaagaaattgaaattcttcttcgttatggacagcatccaaacattatcactctaaaggatgtatatgatgatggaaagtatgtgtatgtagtaacagaacttatgaaaggaggtgaattgctggataaaattcttagacaaaaatttttctctgaacgagaggccagtgctgtcctgttcactataactaaaaccgttgaatatcttcacgcacaaggggtggttcatagagacttgaaacctagcaacattctttatgtggatgaatctggtaatccggaatctattcgaatttgtgattttggctttgcaaaacagctgagagcggaaaatggtcttctcatgactccttgttacactgcaaattttgttgcaccagaggttttaaaaagacaaggctatgatgctgcttgtgatatatggagtcttggtgtcctactctatacaatgcttaccggttacactccatttgcaaatggtcctgatgatacaccagaggaaatattggcacgaataggtagcggaaaattctcactcagtggtggttactggaattctgtttcagacacagcaaaggacctggtgtcaaagatgcttcatgtagaccctcatcagagactgactgctgctcttgtgctcagacatccttggatcgtccactgggaccaactgccacaataccaactaaacagacaggatgcaccacatctagtaaagggtgccatggcagctacatattctgctttgaaccgtaatcagtcaccagttttggaaccagtaggccgctctactcttgctcagcggagaggtattaaaaaaatcacctcaacagccctgtgaagtgacctcagtgagatatttggtaccatggtgtaagctgatagcacaagttctggcgacaggtagcacgtatctgagagacacctgcaagcacacactgtcccagctggtacccataatgctgctgttcctgctgctgctcctgctttcctctcttctcgctttaaatgattgttagcaagttagattttcctggagcttcggaagaaatgaaaatggaaacatgatgaagatatagtcactgaatcaatgagaaaaataatgaacatatgaataccacctaaaaatacactgaataaagtacaccatatagcattatttttataggaaatatttcatgtcccttaaatattctttgttagttatagggatggacagtttatgttaagcacttagcttaaacaatccgtttatattagcactgtatccctt

SEQ ID NO: 838 - DNA, 2371 bp, Homo sapiens
gccgccatgtaaccggcgccgcccggagcccgagccgcgcgggccccagcgacccgcccgccatgggggacgaggacgacgatgagagctgcgccgtggagctgcggatcacagaagccaacctgaccgggcacgaggagaaggtgagcgtggagaacttcgagctgctcaaggtgctgggcacgggagcctacggcaaggtgttcctggtgcggaaggcgggcgggcacgacgcggggaagctgtacgccatgaaggtgctgcgcaaggcggcgctggtgcagcgcgccaagacgcaagagcacacgcgcaccgagcgctcggtgctggagctggtgcgccaggcgcccttcctggtcacgctgcactacgctttccagacggatgccaagctgcacctcatcctggactatgtgagcggcggggagatgttcacccacctctaccagcgccagtacttcaaggaggctgaggtgcgcgtgtatgggggtgagatcgtgctggccctggaacacctgcacaagctcggcatcatttaccgagacctgaaactggagaatgtgctgctggactccgagggccacattgtcctcacggacttcgggctgagcaaggagttcctgacggaggagaaagagcggaccttctccttctgtggcaccatcgagtacatggcccccgaaatcatccgtagcaagacggggcatggcaaggctgtggactggtggagcctgggcatcttgctcttcgagctgctgacgggggcctcgcccttcaccctggagggcgagaggaacacgcaggctgaggtgtctcgacggatcctgaagtgctcccctcccttcccccctcggatcgggcccgtggcgcaggacctgctgcagcggctgctttgtaaggatcctaagaagcgattgggcgcggggccccagggggcacaagaagtccggaaccatcccttcttccagggcctcgattgggtggctctggctgccaggaagattccagccccattccggccccaaatccgctcagagctggatgtgggcaactttgcggaggaattcactcggctggagcctgtctactcaccccctggcagccccccacctggggacccccgaatctttcagggatactcctttgtggcaccctccattctctttgaccacaacaacgcggccgagatcatgtgcaaaatccgcgaggggcgcttctcccttgacggggaggcctggcagggtgtatccgaggaagccaaggagctggtccgagggctcctgaccgtggaccccgccaagcggctgaagctcgagggactgcggggcagctcgtggctgcaggacggcagcgcgcgctcctcgcccccgctccggacgcccgacgtgctcgagtcctctgggcccgcagtgcgctcgggtctcaacgccaccttcatggcattcaaccggggcaagcgggagggcttcttcctgaagagcgtggagaatgcacccctggccaagcggcggaagcagaagctgcggagcgccaccgcctcccgccggggctcccctgcaccagccaacccgggccgagcccccgtcgcctccaaaggggccccccgccgagccaacggccccctgcccccctcctaatccccaccactgtgacccccttccctcataggggctgtgacctgggagcccggctcactcccggaggcctctgcctgcggctgacctgatccccaagggactgtcctttcctctcctaccccaccccactcccagacagagcagaagtatttttataagcagagaattttttatgtcttaccagatagagttgcagggaagggggggcctgctggggagtggggtttggggggccctctcccaggacactgcctcttctgggcagaaggcccctccagggggactgctccaacaggaaagagcccctcccccacttctaagcactgagttaggagtgctaactcctaaactgggaccccctaccctgttctcccctgaggccccgttcctgggaggggcacccctcaactgtcactttatggactgtctgtgcaattacgtccaccaaagacccgtgttgggggtactgaaggagaggccctgggggaccctctgaagcatttctgcctcactttatgtcatctgcttctcccctgttggggctaaggaaggagataggtggctcctaaaagaggaggccatcttctcacccaccccttcctctttggcacagctactcctggctgggggtggggccttgggggtctgggctgggcatccatggtcactgcctcagcccagccaggctgtgcctttgactttaaaataaaagtccacccagtgctgtgtgtggc

SEQ ID NO: 839 - DNA, 3119 bp, Homo sapiens
ggagccgccatgtaaccggcgccgcccggagcccgagccgcgcgggccccagcgacccgcccgccatgggggacgaggacgacgatgagagctgcgccgtggagctgcggatcacagaagccaacctgaccgggcacgaggagaaggtgagcgtggagaacttcgagctgctcaaggtgctgggcacgggagcctacggcaaggtgttcctggtgcggaaggcgggcgggcacgacgcggggaagctgtacgccatgaaggtgctgcgcaaggcggcgctggtgcagcgcgccaagacgcaagagcacacgcgcaccgagcgctcggtgctggagctggtgcgccaggcgcccttcctggtcacgctgcactacgctttccagacggatgccaagctgcacctcatcctggactatgtgagcggcggggagatgttcacccacctctaccagcgccagtacttcaaggaggctgaggtgcgcgtgtatgggggtgagatcgtgctggccctggaacacctgcacaagctcggcatcatttaccgagacctgaaactggagaatgtgctgctggactccgagggccacattgtcctcacggacttcgggctgagcaaggagttcctgacggaggagaaagagcggaccttctccttctgtggcaccatcgagtacatggcccccgaaatcatccgtagcaagacggggcatggcaaggctgtggactggtggagcctgggcatcttgctcttcgagctgctgacgggggcctcgcccttcaccctggagggcgagaggaacacgcaggctgaggtgtctcgacggatcctgaagtgctcccctcccttcccccctcggatcgggcccgtggcgcaggacctgctgcagcggctgctttgtaaggatcctaagaagcgattgggcgcggggccccagggggcacaagaagtccggaaccatcccttcttccagggcctcgattgggtggctctggctgccaggaagattccagccccattccggccccaaatccgctcagagctggatgtgggcaactttgcggaggaattcactcggctggagcctgtctactcaccccctggcagccccccacctggggacccccgaatctttcagggatactcctttgtggcaccctccattctctttgaccacaacaacgcggtgatgaccgatgggctggaagcgcctggtgctggagaccggccaggtcgggcagcggtggccaggagcgctatgatgcaggactcgcccttcttccagcagtacgagctggacctgcgggagcctgcgctgggccagggcagcttttctgtgtgtcgccgctgccgccagcgccagagcggccaggagttcgcagtcaagatcctcagtcgcaggctggaggcgaacacgcagcgcgaagtggctgccctgcgcctgtgccagtcacaccccaacgtggtgaatctgcacgaggtgcatcacgaccagctgcacacgtacctggtcctggagctgctgcggggcggggagctgctggagcacatccgcaagaagcggcacttcagcgagtcggaagcaagccagatcctgcgcagcctcgtgtcggccgtgagcttcatgcacgaggaggcgggcgtggtgcaccgcgacctcaagccggagaacatcctgtacgccgacgacacgcccggggccccggtgaaaatcatcgacttcgggttcgcgcggttgcggccgcagagtcccggggtgcccatgcagacgccctgcttcacgctgcagtacgctgcccccgagctgctggcgcagcagggctacgacgagtcctgcgacctctggagcctgggcgtcattctgtacatgatgctgtcggggcaggtccccttccagggggcctctggccagggcgggcagagccaggcggccgagatcatgtgcaaaatccgcgaggggcgcttctcccttgacggggaggcctggcagggtgtatccgaggaagccaaggagctggtccgagggctcctgaccgtggaccccgccaagcggctgaagctcgagggactgcggggcagctcgtggctgcaggacggcagcgcgcgctcctcgcccccgctccggacgcccgacgtgctcgagtcctctgggcccgcagtgcgctcgggtctcaacgccaccttcatggcattcaaccggggcaagcgggagggcttcttcctgaagagcgtggagaatgcacccctggccaagcggcggaagcagaagctgcggagcgccaccgcctcccgccggggctcccctgcaccagccaacccgggccgagcccccgtcgcctccaaaggggccccccgccgagccaacggccccctgcccccctcctaatccccaccactgtgacccccttccctcataggggctgtgacctgggagcccggctcactcccggaggcctctgcctgcggctgacctgatccccaagggactgtcctttcctctcctaccccaccccactcccagacagagcagaagtatttttataagcagagaattttttatgtcttaccagatagagttgcagggaagggggggcctgctggggagtggggtttggggggccctctcccaggacactgcctcttctgggcagaaggcccctccagggggactgctccaacaggaaagagcccctcccccacttctaagcactgagttaggagtgctaactcctaaactgggaccccctaccctgttctcccctgaggccccgttcctgggaggggcacccctcaactgtcactttatggactgtctgtgcaattacgtccaccaaagacccgtgttgggggtactgaaggagaggccctgggggaccctctgaagcatttctgcctcactttatgtcatctgcttctcccctgttggggctaaggaaggagataggtggctcctaaaagaggaggccatcttctcacccaccccttcctctttggcacagctactcctggctgggggtggggccttgggggtctgggctgggcatccatggtcactgcctcagcccagccaggctgtgcctttgactttaaaataaaagtccacccagtgctgtgtgtggca

SEQ ID NO: 840 - DNA, 3121 bp, Homo sapiens
accaggaagcgcccgccccggccggagccgccatgtaaccggcgccgcccggagcccgagccgcgcgggccccagcgacccgcccgccatgggggacgaggacgacgatgagagctgcgccgtggagctgcggatcacagaagccaacctgaccgggcacgaggagaaggtgagcgtggagaacttcgagctgctcaaggtgctgggcacgggagcctacggcaaggtgttcctggtgcggaaggcgggcgggcacgacgcggggaagctgtacgccatgaaggtgctgcgcaaggcggcgctggtgcagcgcgccaagacgcaagagcacacgcgcaccgagcgctcggtgctggagctggtgcgccaggcgcccttcctggtcacgctgcactacgctttccagacggatgccaagctgcacctcatcctggactatgtgagcggcggggagatgttcacccacctctaccagcgccagtacttcaaggaggctgaggtgcgcgtgtatgggggtgagatcgtgctggccctggaacacctgcacaagctcggcatcatttaccgagacctgaaactggagaatgtgctgctggactccgagggccacattgtcctcacggacttcgggctgagcaaggagttcctgacggaggagaaagagcggaccttctccttctgtggcaccatcgagtacatggcccccgaaatcatccgtagcaagacggggcatggcaaggctgtggactggtggagcctgggcatcttgctcttcgagctgctgacgggggcctcgcccttcaccctggagggcgagaggaacacgcaggctgaggtgtctcgacggatcctgaagtgctcccctcccttcccccctcggatcgggcccgtggcgcaggacctgctgcagcggctgctttgtaaggatcctaagaagcgattgggcgcggggccccagggggcacaagaagtccggaaccatcccttcttccagggcctcgattgggtggctctggctgccaggaagattccagccccattccggccccaaatccgctcagagctggatgtgggcaactttgcggaggaattcactcggctggagcctgtctactcaccccctggcagccccccacctggggacccccgaatctttcagggatactcctttgtggcaccctccattctctttgaccacaacaacgcggtgatgaccgatgggctggaagcgcctggtgctggagaccggccaggtcgggcagcggtggccaggagcgctatgatgcagtacgagctggacctgcgggagcctgcgctgggccagggcagcttttctgtgtgtcgccgctgccgccagcgccagagcggccaggagttcgcagtcaagatcctcagtcgcaggctggaggcgaacacgcagcgcgaagtggctgccctgcgcctgtgccagtcacaccccaacgtggtgaatctgcacgaggtgcatcacgaccagctgcacacgtacctggtcctggagctgctgcggggcggggagctgctggagcacatccgcaagaagcggcacttcagcgagtcggaagcaagccagatcctgcgcagcctcgtgtcggccgtgagcttcatgcacgaggaggcgggcgtggtgcaccgcgacctcaagccggagaacatcctgtacgccgacgacacgcccggggccccggtgaaaatcatcgacttcgggttcgcgcggttgcggccgcagagtcccggggtgcccatgcagacgccctgcttcacgctgcagtacgctgcccccgagctgctggcgcagcagggctacgacgagtcctgcgacctctggagcctgggcgtcattctgtacatgatgctgtcggggcaggtccccttccagggggcctctggccagggcgggcagagccaggcggccgagatcatgtgcaaaatccgcgaggggcgcttctcccttgacggggaggcctggcagggtgtatccgaggaagccaaggagctggtccgagggctcctgaccgtggaccccgccaagcggctgaagctcgagggactgcggggcagctcgtggctgcaggacggcagcgcgcgctcctcgcccccgctccggacgcccgacgtgctcgagtcctctgggcccgcagtgcgctcgggtctcaacgccaccttcatggcattcaaccggggcaagcgggagggcttcttcctgaagagcgtggagaatgcacccctggccaagcggcggaagcagaagctgcggagcgccaccgcctcccgccggggctcccctgcaccagccaacccgggccgagcccccgtcgcctccaaaggggccccccgccgagccaacggccccctgcccccctcctaatccccaccactgtgacccccttccctcataggggctgtgacctgggagcccggctcactcccggaggcctctgcctgcggctgacctgatccccaagggactgtcctttcctctcctaccccaccccactcccagacagagcagaagtatttttataagcagagaattttttatgtcttaccagatagagttgcagggaagggggggcctgctggggagtggggtttggggggccctctcccaggacactgcctcttctgggcagaaggcccctccagggggactgctccaacaggaaagagcccctcccccacttctaagcactgagttaggagtgctaactcctaaactgggaccccctaccctgttctcccctgaggccccgttcctgggaggggcacccctcaactgtcactttatggactgtctgtgcaattacgtccaccaaagacccgtgttgggggtactgaaggagaggccctgggggaccctctgaagcatttctgcctcactttatgtcatctgcttctcccctgttggggctaaggaaggagataggtggctcctaaaagaggaggccatcttctcacccaccccttcctctttggcacagctactcctggctgggggtggggccttgggggtctgggctgggcatccatggtcactgcctcagcccagccaggctgtgcctttgactttaaaataaaagtccacccagtgctgtgtgtggca

SEQ ID NO: 841 - DNA, 2114 bp, Homo sapiens
acagaagccaacctgaccgggcacgaggagaaggtgagcgtggagaacttcgagctgctcaaggtgctgggcacgggagcctacggcaaggtgttcctggtgcggaaggcgggcgggcacgacgcggggaagctgtacgccatgaaggtgctgcgcaaggcggcgctggtgcagcgcgccaagacgcaagagcacacgcgcaccgagcgctcggtgctggagctggtgcgccaggcgcccttcctggtcacgctgcactacgctttccagacggatgccaagctgcacctcatcctggactatgtgagcggcggggagatgttcacccacctctaccagcgccagtacttcaaggaggctgaggtgcgcgtgtatgggggtgagatcgtgctggccctggaacacctgcacaagctcggcatcatttaccgagacctgaaactggagaatgtgctgctggactccgagggccacattgtcctcacggacttcgggctgagcaaggagttcctgacggaggagaaagagcggaccttctccttctgtggcaccatcgagtacatggcccccgaaatcatccgtagcaagacggggcatggcaaggctgtggactggtggagcctgggcatcttgctcttcgagctgctgacgggggcctcgcccttcaccctggagggcgagaggaacacgcaggctgaggtgtctcgacggatcctgaagtgctcccctcccttcccccctcggatcgggcccgtggcgcaggacctgctgcagcggctgctttgtaaggatcctaagaagcgattgggcgcggggccccagggggcacaagaagtccggaaccatcccttcttccagggcctcgattgggtggctctggctgccaggaagattccagccccattccggccccaaatccgctcagagctggatgtgggcaactttgcggaggaattcactcggctggagcctgtctactcaccccctggcagccccccacctggggacccccgaatctttcagggatactcctttgtggcaccctccattctctttgaccacaacaacgcggtgatgaccgatgggctggaagcgcctggtgctggagaccggccaggtcgggcagcggtggccaggagcgctatgatgcagcagtacgagctggacctgcgggagcctgcgctgggccagggcagcttttctgtgtgtcgccgctgccgccagcgccagagcggccaggagttcgcagtcaagatcctcagtcgcaggctggaggcgaacacgcagcgcgaagtggctgccctgcgcctgtgccagtcacaccccaacgtggtgaatctgcacgaggtgcatcacgaccagctgcacacgtacctggtcctggagctgctgcggggcggggagctgctggagcacatccgcaagaagcggcacttcagcgagtcggaagcaagccagatcctgcgcagcctcgtgtcggccgtgagcttcatgcacgaggaggcgggcgtggtgcaccgcgacctcaagccggagaacatcctgtacgccgacgacacgcccggggccccggtgaaaatcatcgacttcgggttcgcgcggttgcggccgcagagtcccggggtgcccatgcagacgccctgcttcacgctgcagtacgctgcccccgagctgctggcgcagcagggctacgacgagtcctgcgacctctggagcctgggcgtcattctgtacatgatgctgtcggggcaggtccccttccagggggcctctggccagggcgggcagagccaggcggccgagatcatgtgcaaaatccgcgaggggcgcttctcccttgacggggaggcctggcagggtgtatccgaggaagccaaggagctggtccgagggctcctgaccgtggaccccgccaagcggctgaagctcgagggactgcggggcagctcgtggctgcaggacggcagcgcgcgctcctcgcccccgctccggacgcccgacgtgctcgagtcctctgggcccgcagtgcgctcgggtctcaacgccaccttcatggcattcaaccggggcaagcgggagggcttcttcctgaagagcgtggagaatgcacccct

SEQ ID NO: 842 - DNA, 4202 bp, Homo sapiens
ggcgaggagcgagccgtgcggccagagcgggaaagagactcgtctttgcgtccgagttctggagccgccgcaccccgactcctggggccgcggcagcggctgcgaggggacgggcgtccgctgtctcctgggttcccctcgtagcgacccgcgggatcggaaaaaaaggagaagatggaggaggagggtggcagcagcggcggcgccgcggggaccagcgcggacggcggcgacggaggagagcagctcctcactgtcaagcacgagctgcggactgctaatttgacaggacatgctgagaaggtgggaatagaaaattttgagctcctgaaggtcctaggaactggagcttatggaaaagtatttctagttcgtaaaataagtggccatgatactggaaagctgtatgccatgaaagttttgaaaaaggcaacaatcgttcaaaaggccaaaaccacagagcatacaaggacagaacgacaagtcctggaacacattaggcagtcgccatttttggtaacattacattatgctttccagacagaaaccaaacttcatctcattttagattatataaatggtggtgaactttttactcatctttctcaaagagagcgtttcacagagcatgaggtgcagatttatgttggagagattgtgcttgccctcgaacatctccacaagttggggattatatatcgtgatattaagcttgagaatattctacttgattctaatggccatgtggtgctgacagattttggtctgagtaaggagtttgtggctgatgaaactgaaagagcatattccttttgtggaactattgaatacatggcaccagatattgtcagagggggagattcaggacatgacaaggcagttgactggtggagtttgggtgttctaatgtatgaattactaactggagcatctcctttcactgttgatggagaaaaaaattcccaagctgagatatctaggagaatattaaaaagtgagcctccatatccccaagaaatgagtgctttagcgaaagacctaattcagcgtcttttgatgaaagatcccaagaagagattgggatgtggtccacgtgatgcagatgaaatcaaagaacatctcttctttcagaaaataaattgggatgatttagccgccaaaaaagtgcctgcaccatttaagccagtcattcgagatgaattagatgtgagtaactttgcagaagagttcacagaaatggatcccacttattctcccgcagccctgccccagagttctgagaagctgtttcagggctattcctttgttgctccttccatcctattcaagcgtaatgcagctgtcatagaccctcttcagtttcacatgggagttgaacgtcctggagtgacaaatgttgccaggagtgcaatgatgaaggactctccattctatcaacactatgacctagatttgaaggacaaacccctgggagaaggtagtttttcaatttgtcgaaagtgtgtgcataaaaaaagtaaccaagcttttgcagtcaaaataatcagcaaaaggatggaagccaatactcaaaaggaaataacagctctgaaactctgtgaaggacaccccaatattgtgaagttgcatgaagtttttcatgatcagcttcacacgtttctagtgatggaacttctgaatggaggagaactgtttgagcgcattaagaaaaagaagcacttcagtgagacggaagccagctacatcatgaggaagcttgtttcagctgtaagccacatgcatgatgttggagtggtgcacagggatctgaaacctgagaatttattgttcaccgatgaaaatgacaatttggaaattaaaataattgattttggatttgcacggctaaagccaccggataatcagcccctgaagactccatgcttcacccttcattatgccgccccagagctcttgaatcagaacggctacgatgagtcctgtgacctgtggagcttgggcgtcattttgtacacaatgttgtcaggacaggttcccttccaatctcatgaccgaagtttgacgtgtaccagcgcggtggaaatcatgaagaaaattaaaaagggagatttctcctttgaaggagaagcctggaagaatgtatcccaagaggctaaagatttgatccaaggacttctcacagtagatccaaacaaaaggcttaaaatgtctggcttgaggtacaatgaatggctacaagatggaagtcagctgtcctccaatcctctgatgactccggatattctaggatcttccggagctgccgtgcatacctgtgtgaaagcaaccttccacgcctttaacaaatacaagagagaggggttttgccttcagaatgttgataaggcccctttggctaagagaagaaaaatgaaaaagactagcaccagtaccgagacgcgcagcagttccagtgagagttcccattcttcttcctctcattctcacggtaaaactacacccaccaagacactgcagcccagcaatcctgccgacagcaataacccggagaccctcttccagttctcggactcagtagcttaggcatggtaggagtgtatcagtgatccattgcacctttattccctcagcatatgcctgaggcgatcttttatgcttttaaaaatgtttcccgttggtctcattggaatctgcctcctaatgatttttttcaggaaaacctgtttggttatcctcattcaaaagcactggacagagaatgttactgtgaatagagcacatattactctttttagcaacctagcatgatgccaacaagactattcttgaaagagcaaaggttcctgtaaatttaattagggctagatttgagctgcttgtaagtcacaggttttccagatgtctgccaacaagaaatgactcatactgtgatgataccttttgctttgccttgtggacaatgtgggtttttgaaatttgcacccttcaaacaatgatttatcagagaaaggggtctgttttcaaaaaagattctgtaatgaattttatgtgtggcatatacttatttcttgagagaagattttaacttattgtttttattttatggttacatatgatgataacctgctattattaaactttttctaaaaagtgaaaaaaaaaaaaaaagatataagaactcaaggtcccatactctgtattcgggatccatctgagatgcatgctaagctatgtgtatgtttttaattttgcactgctctttcctggcaatttgttttaatggttattgcagaatattaaggtacatgtctctctgttttaagtaatattgcactttataaaaaagtatgaataaagcaaactattttataaagtgcactgtttaaagcatttgcactgtatttttgccatttattttcattttctactttaaatttgtcctcacattcctcttctactttgtatgcaacaagtagaatggggcatgttgtgtcatgtagtcagccacttatgcaccaatgtgaggaaaacctaaagggaaattaaactaaacactgtgcttcatatttgtacactgtgttgtactacagtgaggaatttcctcctgtagtcatatattatgtacataatattttagaatcatacctatgacttgtttggaaatttttctgttaaattttaaatccagaaagcatattttataaacttatgcagagcacttttattgctcaaaagttctgaattcatacagaaaacaagtactatgtgatgaaaacatttcattaaaagattgctgcatttaaaaatacaattaattcgttccctatgcaaaaaaaaaaaaaaaaaaaaaagaagtgatagggtttgtgtgttatattttcttttaaagccatcatgtgaaatgtcaggactgagaaaagtgatttttttgctttgtttacaggaatcatgcttaaagagataatgcccaacatgtttattttatagtttttgttaatgataaccttttgagcattagtttggaatttggacatgatatttatttattcctttcttgaggttatagcagcattaatttcaaccagttatgaatactaaaaatattgcactctatgtaatagtagtatatttattactaaatcaatgtatatattaatagcacaggcaaaaaatggcaaatattaaaatattttcaaaatatt

SEQ ID NO: 843 - DNA, 2249 bp, Homo sapiens
gcgagccgtgcggccagagcgggaaagagactcgtctttgcgtccgagttctggagccgccgcaccccgactcctggggccgcggcagcggctgcgaggggacgggcgtccgctgtctcctgggttcccctcgtagcgacccgcgggatcggaaaaaaaggagaagatggaggaggagggtggcagcagcggcggcgccgcggggaccagcgcggacggcggcgacggaggagagcagctcctcactgtcaagcacgagctgcggactgctaatttgacaggacatgctgagaaggtgggaatagaaaattttgagctcctgaaggtcctaggaactggagcttatggaaaagtatttctagttcgtaaaataagtggccatgatactggaaagctgtatgccatgaaagttttgaaaaaggcaacaatcgttcaaaaggccaaaaccacagagcatacaaggacagaacgacaagtcctggaacacattaggcagtcgccatttttggtaacattacattatgctttccagacagaaaccaaacttcatctcattttagattatataaatggtggtgaactttttactcatctttctcaaagagagcgtttcacagagcatgaggtgcagatttatgttggagagattgtgcttgccctcgaacatctccacaagttggggattatatatcgtgatattaagcttgagaatattctacttgattctaatggccatgtggtgctgacagattttggtctgagtaaggagtttgtggctgatgaaactgaaagagcatattccttttgtggaactattgaatacatggcaccagatattgtcagagggggagattcaggacatgacaaggcagttgactggtggagtttgggtgttctaatgtatgaattactaactggagcatctcctttcactgttgatggagaaaaaaattcccaagctgagatatctaggagaatattaaaaagtgagcctccatatccccaagaaatgagtgctttagcgaaagacctaattcagcgtcttttgatgaaagatcccaagaagagattgggatgtggtccacgtgatgcagatgaaatcaaagaacatctcttctttcagaaaataaattgggatgatttagccgccaaaaaagtgcctgcaccatttaagccagtcattcgagatgaattagatgtgagtaactttgcagaagagttcacagaaatggatcccacttattctcccgcagccctgccccagagttctgagaagctgtttcagggctattcctttgttgctccttccatcctattcaagcgtaatgcagctgtcatagaccctcttcagtttcacatgggagttgaacgtcctggagtgacaaatgttgccaggagtgcaatgatgaaggactctccattctatcaacactatgacctagatttgaaggacaaacccctgggagaaggtagtttttcaatttgtcgaaagtgtgtgcataaaaaaagtaaccaagcttttgcagtcaaaataatcagcaaaaggatggaagccaatactcaaaaggaaataacagctctgaaactctgtgaaggacaccccaatattgtgaagttgcatgaagtttttcatgatcagcttcacacgtttctagtgatggaacttctgaatggaggagaactgtttgagcgcattaagaaaaagaagcacttcagtgagacggaagccagctacatcatgaggaagcttgtttcagctgtaagccacatgcatgatgttggagtggtgcacagggatctgaaacctgaggtataaaatcactggatctcttacgtaattcagtctagcaccattattaaagatctcccaaacatgggggaagtttctggggaggtttccttatttttttacttttcaaggctgttaaatagataattgaaaatacgtttctttgatgttttttcttttatatttcagtctaaaataaatttgtctttgtttattttttgccagctgatcatcttgaggttatatttgtaagtgtgagaaccttttatggaaaaaatactttatgcaacagttgtggactaaaaatagcaatggaaatttttatagcagaaaataatatctcttacatataattttagagggttttttttccaaatgatgtattttgaaaacttattttttacatttgtaatcaaattggttagctcatgaataaaaatgtatataattctattctaaa

SEQ ID NO: 844 - DNA, 2993 bp, Homo sapiens
agttttccccagcccgggaatgagcggcgggcaccaggcatcggggccagcgcagccgccgaccgctgcccgtggcacgcacctccgaggatgtcgctgctcccccttcccgcacagctaatttgacaggacatgctgagaaggtgggaatagaaaattttgagctcctgaaggtcctaggaactggagcttatggaaaagtatttctagttcgtaaaataagtggccatgatactggaaagctgtatgccatgaaagttttgaaaaaggcaacaatcgttcaaaaggccaaaaccacagagcatacaaggacagaacgacaagtcctggaacacattaggcagtcgccatttttggtaacattacattatgctttccagacagaaaccaaacttcatctcattttagattatataaatggtggtgaactttttactcatctttctcaaagagagcgtttcacagagcatgaggtgcagatttatgttggagagattgtgcttgccctcgaacatctccacaagttggggattatatatcgtgatattaagcttgagaatattctacttgattctaatggccatgtggtgctgacagattttggtctgagtaaggagtttgtggctgatgaaactgaaagagcatattccttttgtggaactattgaatacatggcaccagatattgtcagagggggagattcaggacatgacaaggcagttgactggtggagtttgggtgttctaatgtatgaattactaactggagcatctcctttcactgttgatggagaaaaaaattcccaagctgagatatctaggagaatattaaaaagtgagcctccatatccccaagaaatgagtgctttagcgaaagacctaattcagcgtcttttgatgaaagatcccaagaagagattgggatgtggtccacgtgatgcagatgaaatcaaagaacatctcttctttcagaaaataaattgggatgatttagccgccaaaaaagtgcctgcaccatttaagccagtcattcgagatgaattagatgtgagtaactttgcagaagagttcacagaaatggatcccacttattctcccgcagccctgccccagagttctgagaagctgtttcagggctattcctttgttgctccttccatcctattcaagcgtaatgcagctgtcatagaccctcttcagtttcacatgggagttgaacgtcctggagtgacaaatgttgccaggagtgcaatgatgaaggactctccattctatcaacactatgacctagatttgaaggacaaacccctgggagaaggtagtttttcaatttgtcgaaagtgtgtgcataaaaaaagtaaccaagcttttgcagtcaaaataatcagcaaaaggatggaagccaatactcaaaaggaaataacagctctgaaactctgtgaaggacaccccaatattgtgaagttgcatgaagtttttcatgatcagcttcacacgtttctagtgatggaacttctgaatggaggagaactgtttgagcgcattaagaaaaagaagcacttcagtgagacggaagccagctacatcatgaggaagcttgtttcagctgtaagccacatgcatgatgttggagtggtgcacagggatctgaaacctgagaatttattgttcaccgatgaaaatgacaatttggaaattaaaataattgattttggatttgcacggctaaagccaccggataatcagcccctgaagactccatgcttcacccttcattatgccgccccagagctcttgaatcagaacggctacgatgagtcctgtgacctgtggagcttgggcgtcattttgtacacaatgttgtcaggacaggttcccttccaatctcatgaccgaagtttgacgtgtaccagcgcggtggaaatcatgaagaaaattaaaaagggagatttctcctttgaaggagaagcctggaagaatgtatcccaagaggctaaagatttgatccaaggacttctcacagtagatccaaacaaaaggcttaaaatgtctggcttgaggtacaatgaatggctacaagatggaagtcagctgtcctccaatcctctgatgactccggatattctaggatcttccggagctgccgtgcatacctgtgtgaaagcaaccttccacgcctttaacaaatacaagagagaggggttttgccttcagaatgttgataaggcccctttggctaagagaagaaaaatgaaaaagactagcaccagtaccgagacgcgcagcagttccagtgagagttcccattcttcttcctctcattctcacggtaaaactacacccaccaagacactgcagcccagcaatcctgccgacagcaataacccggagaccctcttccagttctcggactcagtagcttaggcatggtaggagtgtatcagtgatccattgcacctttattccctcagcatatgcctgaggcgatcttttatgcttttaaaaatgtttcccgttggtctcattggaatctgcctcctaatgatttttttcaggaaaacctgtttggttatcctcattcaaaagcactggacagagaatgttactgtgaatagagcacatattactctttttagcaacctagcatgatgccaacaagactattcttgaaagagcaaaggttcctgtaaatttaattagggctagatttgagctgcttgtaagtcacaggttttccagatgtctgccaacaagaaatgactcatactgtgatgataccttttgctttgccttgtggacaatgtgggtttttgaaatttgcacccttcaaacaatgatttatcagagaaaggggtctgttttcaaaaaagattctgtaatgaattttatgtgtggcatatacttatttcttgagagaagattttaacttattgtttttattttatggttacatatgatgataacctgctattattaaactttttctaaaaagtg

SEQ ID NO: 845 - DNA, 2547 bp, Homo sapiens
aaggggagatgctaccattcgctcctcaggacgagccctgggaccgagaaatggaagtgttcagcggcggcggcgcgagcagcggcgaggtaaatggtcttaaaatggttgatgagccaatggaagagggagaagcagattcttgtcatgatgaaggagttgttaaagaaatccctattactcatcatgttaaggaaggctatgagaaagcagatcctgcacagtttgagttgctcaaggttcttggtcaggggtcatttggaaaggtttttcttgttagaaagaagaccggtcctgatgctgggcagctctatgcaatgaaggtgttaaaaaaagcctctttaaaagttcgagacagagttcggacaaagatggagagggatatactggtggaagtaaatcatccatttattgtcaaattgcactatgcctttcagactgaagggaaactgtacttaatactggattttctcaggggaggagatgttttcacaagattatccaaagaggttctgtttacagaggaagatgtgaaattctacctcgcagaactggcccttgctttggatcatctgcaccaattaggaattgtttatagagacctgaagccagaaaacattttgcttgatgaaataggacatatcaaattaacagattttggactcagcaaggagtcagtagatcaagaaaagaaggcttactcattttgtggtacagtagagtatatggctcctgaagtagtaaataggagaggccattcccagagtgctgattggtggtcatatggtgttcttatgtttgaaatgcttactggtactctgccatttcaaggtaaagacagaaatgagaccatgaatatgatattaaaagcaaaacttggaatgcctcaatttcttagtgctgaagcacaaagtcttctaaggatgttattcaaaaggaatccagcaaatagattgggatcagaaggagttgaagaaatcaaaagacatctgttttttgcaaatattgactgggataaattatataaaagagaagttcaacctcctttcaaacctgcttctggaaaaccagatgatactttttgttttgatcctgaatttactgcaaaaacacctaaagattctcccggtttgccagccagtgcaaatgctcatcagctcttcaaaggattcagctttgttgcaacttctattgcagaagaatataaaatcactcctatcacaagtgcaaatgtattaccaattgttcagataaatggaaatgctgcacaatttggtgaagtatatgaattgaaggaggatattggtgttggctcctactctgtttgcaagcgatgcatacatgcaactaccaacatggaatttgcagtgaagatcattgacaaaagtaagcgagacccttcagaagagattgaaatattgatgcgctatggacaacatcccaacattattactttgaaggatgtctttgatgatggtagatatgtttaccttgttacggatttaatgaaaggaggagagttacttgaccgtattctcaaacaaaaatgtttctcggaacgggaggctagtgatatactatatgtaataagtaagacagttgactatcttcattgtcaaggagttgttcatcgtgatcttaaacctagtaatattttatacatggatgaatcagccagtgcagattcaatcaggatatgtgattttgggtttgcaaaacaacttcgaggagaaaatggacttctcttaactccatgctacactgcaaactttgttgcacctgaggttcttatgcaacagggatatgatgctgcttgtgatatctggagtttaggagtccttttttacacaatgttggctggctacactccatttgctaatggccccaatgatactcctgaagagatactgctgcgtataggcaatggaaaattctctttgagtggtggaaactgggacaatatttcagacggagcaaaggatttgctttcccatatgcttcatatggacccacatcagcggtatactgctgaacaaatattaaagcactcatggataactcacagagaccagttgccaaatgatcagccaaagagaaatgatgtgtcacatgttgttaagggagcaatggttgcaacatactctgccctgactcacaagacctttcaaccagtcctagagcctgtagctgcttcaagcttagcccagcgacggagcatgaaaaagcgaacatcaactggcctgtaagatttgtggtgttcctaggccaaactggatgaagatgaaattaaatgtgtggcttttttcctattcttatcaaaggcatcgttgtctgctaaattacttgaatattaagtaatattaaatccccatttttaggggaagtgagatttaaaaaaccattcacaggtccacaatattcatactatgtgtttgcagtagtgttcaagtgtttatttaagcatataattggtgtccaccaggtcctcacaacttctctgcacacaagcttctaaaattcctttcaaataaagttactttaatattt

SEQ ID NO: 846 - DNA, 2515 bp, Homo sapiens
cctgtttgagtgctcctgaaggggagatgctaccattcgctcctcaggacgagccctgggaccgagaaatggaagtgttcagcggcggcggcgcgagcagcggcgagaaagttggatccttttctgataacttaatcgactgcgtactactccagtagaggccaccatacacctcctaaaaatagttggtgaaattgattcacagtaggatattttgagtatgttttaggtattgtagagatttaacaatgggtctctctacctcagcaatttggaaaaatactcgagtggaaattgttaatccctatgaagtaaaacgaaaggtgaaggtaaatggtcttaaaatggttgatgagccaatggaagagggagaagcagattcttgtcatgatgaaggagttgttaaagaaatccctattactcatcatgttaaggaaggctatgagaaagcagatcctgcacagtttgagttgctcaaggttcttggtcaggggtcatttggaaaggtttttcttgttagaaagaagaccggtcctgatgctgggcagctctatgcaatgaaggtgttaaaaaaagcctctttaaaagttcgagacagagttcggacaaagatggagagggatatactggtggaagtaaatcatccatttattgtcaaattgcactatgcctttcagactgaagggaaactgtacttaatactggattttctcaggggaggagatgttttcacaagattatccaaagaggttctgtttacagaggaagatgtgaaattctacctcgcagaactggcccttgctttggatcatctgcaccaattaggaattgtttatagagacctgaagccagaaaacattttgcttgatgaaataggacatatcaaattaacagattttggactcagcaaggagtcagtagatcaagaaaagaaggcttactcattttgtggtacagtagagtatatggctcctgaagtagtaaataggagaggccattcccagagtgctgattggtggtcatatggtgttcttatgtttgaaatgcttactggtactctgccatttcaaggtaaagacagaaatgagaccatgaatatgatattaaaagcaaaacttggaatgcctcaatttcttagtgctgaagcacaaagtcttctaaggatgttattcaaaaggaatccagcaaatagattgggatcagaaggagttgaagaaatcaaaagacatctgttttttgcaaatattgactgggataaattatataaaagagaagttcaacctcctttcaaacctgcttctggaaaaccagatgatactttttgttttgatcctgaatttactgcaaaaacacctaaagattctcccggtttgccagccagtgcaaatgctcatcagctcttcaaaggattcagctttgttgcaacttctattgcagaagaatataaaatcactcctatcacaagtgcaaatgtattaccaattgttcagataaatggaaatgctgcacaatttggtgaagtatatgaattgaaggaggatattggtgttggctcctactctgtttgcaagcgatgcatacatgcaactaccaacatggaatttgcagtgaagatcattgacaaaagtaagcgagacccttcagaagagattgaaatattgatgcgctatggacaacatcccaacattattactttgaaggatgtctttgatgatggtagatatgtttaccttgttacggatttaatgaaaggaggagagttacttgaccgtattctcaaacaaaaatgtttctcggaacgggaggctagtgatatactatatgtaataagtaagacagttgactatcttcattgtcaaggagttgttcatcgtgatcttaaacctagtaatattttatacatggatgaatcagccagtgcagattcaatcaggatatgtgattttgggtttgcaaaacaacttcgaggagaaaatggacttctcttaactccatgctacactgcaaactttgttgcacctgaggttcttatgcaacagggatatgatgctgcttgtgatatctggagtttaggagtccttttttacacaatgttggctggctacactccatttgctaatggccccaatgatactcctgaagagatactgctgcgtataggcaatggaaaattctctttgagtggtggaaactgggacaatatttcagacggagcaaaggatttgctttcccatatgcttcatatggacccacatcagcggtatactgctgaacaaatattaaagcactcatggataactcacagagaccagttgccaaatgatcagccaaagagaaatgatgtgtcacatgttgttaagggagcaatggttgcaacatactctgccctgactcacaagacctttcaaccagtcctagagcctgtagctgcttcaagcttagcccagcgacggagcatgaaaaagcgaacatcaactggcctgtaagatttgtggtgttcctaggccaaactgga

SEQ ID NO: 847 - DNA, 3016 bp, Homo sapiens
gaggggtcctcactcgctgaccacactgacctcaggaccaagggaacaaaacacagcaggggcaatccatccggtccacggagaagtgctaaaccccaaagggtaaatgagattcccacaggaggagcagggaggagacaacaggcagggtggagggaacagcatgaggaacagcatttgagcccagcgtgtgtggcctccatgtgctgaatgcgtactggataccaagcttgctctacggaggccctgtgaaggtggctgtggatcacagatatcctcagctctctccagagctcaacacagtaccagatgctccagaaatgtttgctgaactgaatttgactggaaaggaaaacagagccccaggcctgcgcggtggctcacgtctataatcccagcactgtgggaggccgaggcagacggatcacttgaggtcaggagttcaagaccagcctggccaacatggtcccagctgcagggcagccatgagcctggtggcctgtgagtgcctgcccagccccggcctggagcctgagccttgctcacgagcacggtcccaagctcacgtgtacctggagcagattcgcaacagggtggctctgggagtgcctgacatgacaaaacgtgactatctggtggatgcggccacgcagatccggctggccctggagcgcgatgttagtgaggactatgaggcggccttcaaccactatcagaatggcgtggacgtgctgctccgtggcatacacgttgaccccaacaaggagcgacgtgaggctgtgaagctgaaaattaccaaatacctgcggcgggcagaggagatcttcaactgccacctgcagcggccgctgagcagtggagccagccccagcgcggtgcagctggtccaggacccggcaaccggagggacctttgtggtgaagagcctacccaggtgccacatggtgagcagggagcggctgaccatcatcccacacggagtcccctacatgacgaagctgctcaggtactttgtgagcgaggactccatcttcctgcacctggagcatgtgcaaggaggcactctctggtcccacctgctctcccaggcgcactcccgacattctgggctcagctctggctctacccaggagaggatgaaggctcagctcaacccccacctcaacctcctgaccccagcgaggcttccctcaggccatgcccctggccaggacagaatcgccctggagcctcctaggacttctccgaaccttctcctagctggggaggccccatccaccagaccccagagggaggctgaaggtgaacccacagccaggaccagcacctctggctcctcggaccttccaaaggccccaggtggccacctgcaccttcaagctaggagggctggccagaactcagacgctgggccccctcgggggctcacttgggttcctgagggggccggcccggtgctagggggctgtggccgaggcatggatcagagctgcctgtcagcagatggggccggccggggctgtggcagggccacctggagtgtgagagaggagcaggtgaagcagtgggcggcagagatgctggtagcgctggaggcgctgcacgagcagggggtgctgtgccgggacctccaccccgggaacctgctcctggaccaggcaggtcacatccggctcacatattttggccagtggtcagaggtggagccccagtgctgcggggaggccgtggacaatctctacagcgccccagaggtgggtgggatttccgagctgacggaagcctgtgactggtggagctttgggtctctactgtatgaactgctgacgggaatggcactgtcccagagccacccttcaggaatccaggcccacacccagctccagctgcccgagtggctcagtcgcccagcggcctctctgctgactgagctgctgcagttcgagcctacccggcgcctgggcatgggagaaggtggtgtcagcaaactcaagtcccatccctttttcagtaccatccaatggagcaagctggtggggacatctctggagactcatctcaggacactgatccactggctcagtggacccaaaccagactgtcctggctagtcctcttagtcacacagcgagtaggcctcttccaccagaagctgttcgtgcagctggggaggcccagaagcagggatgccatctgttgtgcagggagggatgaggtaggggacaggatgacccccacccccacccccccacccccgattcctgaccatgccccctatcttgtgatttcagacttgggagagcaaaagggaggggaagaaaataagagtaatggggggaggaaggaatgcatgggtctgccccttagagcaagtctgaaaccagaatcaagagtcctcctccccagtgggcctgtgtgggggaagaggggcagcctgccccaggggtgcaagaggacagcaattcagcttccaggccaaagcagtttagacaaggtgtgcccatcaggactccctctcaggccctggctgtttaccatgtcactgcctactgtgacttcatgcccttttgggataagaaaccacaaaacgcatggaacaactatccatggctcttagccagaaatgtcttgcctctggtctctgaaaagctggggtgagtggttacctcaaagacaattgcctccagtttgggggctcctctcagggttcaccctgtcaccggggcgtgggaccgacctgggaaatttccactagagttttgccctcagctcctccctgccagcatcccagtcaccaccaggtggcgcttctgacacggtccacgtgcctggctctgaaggcccaactgtcagaccagacccctcactcatggtggggagacttgacttcctcgggctcttcaggagactgagacagagaagacaagtgaaagcgcagcctgtacatgactctctgtggtccacgtcctgcctctccctggggtttacacggccccaataaagcctgctctggcct

SEQ ID NO: 848 - DNA, 1931 bp, Homo sapiens
tctacggaggccctgtgaaggtggctgtggatcacagatatcctcagctctctccagagctcaacacagtaccagatgctccagaaatgtttgctgaactgaatttgactggaaaggaaaacagagccccaggcctgcgcggtggctcacgtctataatcccagcactgtgggaggccgaggcagacggatcacttgaggtcaggagttcaagaccagcctggccaacatggtcccagctgcagggcagccatgagcctggtggcctgtgagtgcctgcccagccccggcctggagcctgagccttgctcacgagcacggtcccaagctcacgtgtacctggagcagattcgcaacagggtggctctgggagtgcctgacatgacaaaacgtgactatctggtggatgcggccacgcagatccggctggccctggagcgcgatgttagtgaggactatgaggcggccttcaaccactatcagaatggcgtggacgtgctgctccgtggcatacacgttgaccccaacaaggagcgacgtgaggctgtgaagctgaaaattaccaaatacctgcggcgggcagaggagatcttcaactgccacctgcagcggccgctgagcagtggagccagccccagcgcgggtttcagcagcctgaggctccggcccattcgcacgctgagctctgccgtggagcagctgaggggctgcagggtggtcggggtcatcgagaaggtgcagctggtccaggacccggcaaccggagggacctttgtggtgaagagcctacccaggtgccacatggtgagcagggagcggctgaccatcatcccacacggagtcccctacatgacgaagctgctcaggtactttgtgagcgaggactccatcttcctgcacctggagcatgtgcaaggaggcactctctggtcccacctgctctcccaggcgcactcccgacattctgggctcagctctggctctacccaggagaggatgaaggctcagctcaacccccacctcaacctcctgaccccagcgaggcttccctcaggccatgcccctggccaggacagaatcgccctggagcctcctaggacttctccgaaccttctcctagctggggaggccccatccaccagaccccagagggaggctgaaggtgaacccacagccaggaccagcacctctggctcctcggaccttccaaaggccccaggtggccacctgcaccttcaagctaggagggctggccagaactcagacgctgggccccctcgggggctcacttgggttcctgagggggccggcccggtgctagggggctgtggccgaggcatggatcagagctgcctgtcagcagatggggccggccggggctgtggcagggccacctggagtgtgagagaggagcaggtgaagcagtgggcggcagagatgctggtagcgctggaggcgctgcacgagcagggggtgctgtgccgggacctccaccccgggaacctgctcctggaccaggcaggtcacatccggctcacatattttggccagtggtcagaggtggagccccagtgctgcggggaggccgtggacaatctctacagcgccccagaggtgggtgggatttccgagctgacggaagcctgtgactggtggagctttgggtctctactgtatgaactgctgacgggaatggcactgtcccagagccacccttcaggaatccaggcccacacccagctccagctgcccgagtggctcagtcgcccagcggcctctctgctgactgagctgctgcagttcgagcctacccggcgcctgggcatgggagaaggtggtgtcagcaaactcaagtcccatccctttttcagtaccatccaatggagcaagctggtggggtaagagggcagagcgggtgacggaagcagctgg

SEQ ID NO: 849 - DNA, 3309 bp, Homo sapiens
gctgcaccggctggccccgcacgctggatgccggaaagcagcggcccgcggcgcgctctggcgtgaagggccggtacgtgagggggaggcctggcccgcggacccggctcccagctcgggcagttcttacagcccagctctgtgctctgctctctgctggctccaggaggggtcctcactcgctgaccacactgacctcaggaccaagggaacaaaacacagcaggggcaatccatccggtccacggagaagtgctaaaccccaaagggtcccagctgcagggcagccatgagcctggtggcctgtgagtgcctgcccagccccggcctggagcctgagccttgctcacgagcacggtcccaagctcacgtgtacctggagcagattcgcaacagggtggctctgggagtgcctgacatgacaaaacgtgactatctggtggatgcggccacgcagatccggctggccctggagcgcgatgttagtgaggactatgaggcggccttcaaccactatcagaatggcgtggacgtgctgctccgtggcatacacgttgaccccaacaaggagcgacgtgaggctgtgaagctgaaaattaccaaatacctgcggcgggcagaggagatcttcaactgccacctgcagcggccgctgagcagtggagccagccccagcgcgggtttcagcagcctgaggctccggcccattcgcacgctgagctctgccgtggagcagctgaggggctgcagggtggtcggggtcatcgagaaggtgcagctggtccaggacccggcaaccggagggacctttgtggtgaagagcctacccaggtgccacatggtgagcagggagcggctgaccatcatcccacacggagtcccctacatgacgaagctgctcaggtactttgtgagcgaggactccatcttcctgcacctggagcatgtgcaaggaggcactctctggtcccacctgctctcccaggcgcactcccgacattctgggctcagctctggctctacccaggagaggatgaaggctcagctcaacccccacctcaacctcctgaccccagcgaggcttccctcaggccatgcccctggccaggacagaatcgccctggagcctcctaggacttctccgaaccttctcctagctggggaggccccatccaccagaccccagagggaggctgaaggtgaacccacagccaggaccagcacctctggctcctcggaccttccaaaggccccaggtggccacctgcaccttcaagctaggagggctggccagaactcagacgctgggccccctcgggggctcacttgggttcctgagggggccggcccggtgctagggggctgtggccgaggcatggatcagagctgcctgtcagcagatggggccggccggggctgtggcagggccacctggagtgtgagagaggagcaggtgaagcagtgggcggcagagatgctggtagcgctggaggcgctgcacgagcagggggtgctgtgccgggacctccaccccgggaacctgctcctggaccaggcaggtcacatccggctcacatattttggccagtggtcagaggtggagccccagtgctgcggggaggccgtggacaatctctacagcgccccagaggtgggtgggatttccgagctgacggaagcctgtgactggtggagctttgggtctctactgtatgaactgctgacgggaatggcactgtcccagagccacccttcaggaatccaggcccacacccagctccagctgcccgagtggctcagtcgcccagcggcctctctgctgactgagctgctgcagttcgagcctacccggcgcctgggcatgggagaaggtggtgtcagcaaactcaagtcccatccctttttcagtaccatccaatggagcaagctggtggggtaagagggcagagcgggtgacggaagcagctggcctggtctggatcgcctctcctccttgcctgacacccaacccagggctggccctctatcagcgggctttgggcgaggaatggagggcactgtctgtcctgctgggctcccactggggcctcagaattatggccaccacccaggaagggccagctcctggaaaagctggaggtgggggcagtcaaggcttgccctgctaagcagcttgaaccatctacccatcagtcaacagacccgttgagcatgtggactcaccatgttaaaggttgccttctgtggcactggcgctgagctgttgaccacctgctgcaccctactgtgaggttctgtgactcactcactgccatgttgtgccccactcaggacatctctggagactcatctcaggacactgatccactggctcagtggacccaaaccagactgtcctggctagtcctcttagtcacacagcgagtaggcctcttccaccagaagctgttcgtgcagctggggaggcccagaagcagggatgccatctgttgtgcagggagggatgaggtaggggacaggatgacccccacccccacccccccacccccgattcctgaccatgccccctatcttgtgatttcagacttgggagagcaaaagggaggggaagaaaataagagtaatggggggaggaaggaatgcatgggtctgccccttagagcaagtctgaaaccagaatcaagagtcctcctccccagtgggcctgtgtgggggaagaggggcagcctgccccaggggtgcaagaggacagcaattcagcttccaggccaaagcagtttagacaaggtgtgcccatcaggactccctctcaggccctggctgtttaccatgtcactgcctactgtgacttcatgcccttttgggataagaaaccacaaaacgcatggaacaactatccatggctcttagccagaaatgtcttgcctctggtctctgaaaagctggggtgagtggttacctcaaagacaattgcctccagtttgggggctcctctcagggttcaccctgtcaccggggcgtgggaccgacctgggaaatttccactagagttttgccctcagctcctccctgccagcatcccagtcaccaccaggtggcgcttctgacacggtccacgtgcctggctctgaaggcccaactgtcagaccagacccctcactcatggtggggagacttgacttcctcgggctcttcaggagactgagacagagaagacaagtgaaagcgcagcctgtacatgactctctgtggtccacgtcctgcctctccctggggtttacacggccccaataaagcctgctctggccta

SEQ ID NO: 850 - DNA, 583 bp, Homo sapiens
cgcgctctggcgtgaagggccggtacgtgagggggaggcctggcccgcggacccggctcccagctcgggcaggaggggtcctcactcgctgaccacactgacctcaggaccaagggaacaaaacacagcaggggcaatccatccggtccacggagaagtgctaaaccccaaagggtaaatgagattcccacaggaggagcagggaggagacaacaggcagggtggagggaacagcatgaggaacagcatttgagcccagcgtgtgtggcctccatgtgctgaatgcgtactggataccaagcttgctctacggaggccctgtgaaggtggctgtggatcacagatatcctcagctctctccagagctcaacacagtaccagatgctccagaaatgtttgctgaactgaatttgactggaaaggaaaacagagccccaggcctgcgcggtggctcacgtctataatcccagcactgtgggaggccgaggcagacggatcacttgaggtcaggagttcaagaccagcctggccaacatggtcccagctgcagggcagccatgagcctggtggcctgtgagtgcct

SEQ ID NO: 851 - DNA, 2425 bp, Homo sapiens
cttgcggctttaaggccggcaggagccgagccgggcggtgattggtggtttattctaaggctcaagtatgagctcatccgcagccaatggccgcgctgcaccggctggccccgcacgctggatgccggaaagcagcggcccgcggcgcgctctggcgtgaagggccggtacgtgagggggaggcctggcccgcggacccggctcccagctcgggcagttcttacagcccagctctgtgctctgctctctgctggctccaggaggggtcctcactcgctgaccacactgacctcaggaccaagggaacaaaacacagcaggggcaatccatccggtccacggagaagtgctaaaccccaaagggtaaatgagattcccacaggaggagcagggaggagacaacaggcagggtggagggaacagcatgaggaacagcatttgagcccagcgtgtgtggcctccatgtgctgaatgcgtactggataccaagcttgctctacggaggccctgtgaaggtggctgtggatcacagatatcctcagctctctccagagctcaacacagtaccagatgctccagaaatgtttgctgaactgaatttgactggaaaggaaaacagagccccaggcctgcgcggtggctcacgtctataatcccagcactgtgggaggccgaggcagacggatcacttgaggtcaggagttcaagaccagcctggccaacatggtcccagctgcagggcagccatgagcctggtggcctgtgagtgcctgcccagccccggcctggagcctgagccttgctcacgagcacggtcccaagctcacgtgtacctggagcagattcgcaacagggtggctctgggagtgcctgacatgacaaaacgtgactatctggtggatgcggccacgcagatccggctggccctggagcgcgatgttagtgaggactatgaggcggccttcaaccactatcagaatggcgtggacgtgctgctccgtggcatacacgttgaccccaacaaggagcgacgtgaggctgtgaagctgaaaattaccaaatacctgcggcgggcagaggagatcttcaactgccacctgcagcggccgctgagcagtggagccagccccagcgcgggtttcagcagcctgaggctccggcccattcgcacgctgagctctgccgtggagcagctgaggggctgcagggtggtcggggtcatcgagaaggtgcagctggtccaggacccggcaaccggagggacctttgtggtgaagagcctacccaggtgccacatggtgagcagggagcggctgaccatcatcccacacggagtcccctacatgacgaagctgctcaggtactttgtgagcgaggactccatcttcctgcacctggagcatgtgcaaggaggcactctctggtcccacctgctctcccaggcgcactcccgacattctgggctcagctctggctctacccaggagaggatgaaggctcagctcaacccccacctcaacctcctgaccccagcgaggcttccctcaggccatgcccctggccaggacagaatcgccctggagcctcctaggacttctccgaaccttctcctagctggggaggccccatccaccagaccccagagggaggctgaaggtgaacccacagccaggaccagcacctctggctcctcggaccttccaaaggccccaggtggccacctgcaccttcaagctaggagggctggccagaactcagacgctgggccccctcgggggctcacttgggttcctgagggggccggcccggtgctagggggctgtggccgaggcatggatcagagctgcctgtcagcagatggggccggccggggctgtggcagggccacctggagtgtgagagaggagcaggtgaagcagtgggcggcagagatgctggtagcgctggaggcgctgcacgagcagggggtgctgtgccgggacctccaccccgggaacctgctcctggaccaggcaggtcacatccggctcacatattttggccagtggtcagaggtggagccccagtgctgcggggaggccgtggacaatctctacagcgccccagaggtgggtgggatttccgagctgacggaagcctgtgactggtggagctttgggtctctactgtatgaactgctgacgggaatggcactgtcccagagccacccttcaggaatccaggcccacacccagctccagctgcccgagtggctcagtcgcccagcggcctctctgctgactgagctgctgcagttcgagcctacccggcgcctgggcatgggagaaggtggtgtcagcaaactcaagtcccatccctttttcagtaccatccaatggagcaagctggtggggtaagagggcagagcgggtgacggaagcagctgg

SEQ ID NO: 852 - DNA, 4465 bp, Homo sapiens
ctcaaagttcgcaggaggcgagagatgctgccgcagcaagtcggcttcgtgtgcgcggtgctggccctggtgtgctgtgcgtccggcctcttcggcagcttggggcacaaaacagcttctgctagcaaacgtgtcctgccagacacgtggagaaatagaaagttgatggccccagtgaatgggacacagacagccaagaactgcacagatcctgcgattcacgagttccccacagatctgttctccaataaggagcgacagcacggagccgtcctgctgcacatccttggtgctctgtatatgttctatgccttggccatagtgtgcgatgacttctttgttccgtctctagagaagatctgtgagagactccatctgagcgaagatgtggctggagccaccttcatggctgcaggaagctcaacgccagagctgtttgcgtctgttattggggtgttcatcacccatggggacgtcggggtgggcaccatcgtgggctctgctgtgttcaacatcctgtgcataattggagtgtgcggactgtttgctggccaggtggtccgtctgacgtggtgggccgtgtgccgagactccgtgtactacaccatctctgtcatcgtgctcatcgtgttcatatatgatgaacaaattgtgtggtgggaaggcctggtgctcatcatcttgtatgtgttttatattctgatcatgaagtacaatgtgaagatgcaagcctttttcacagtcaaacaaaagagcattgcaaacggtaacccggtcaacagtgagctggaggctggtaatgatttctatgacggtagctatgatgacccttccgtgccattgctggggcaagtgaaggagaagccacagtatggcaagaaccccgtggtgatggtggacgagattatgagctccagccctcccaagttcaccttccctgaagcaggcttacgaatcatgatcaccaataagtttggacccaggacccgactacggatggccagcaggatcatcattaatgagcggcagagactgatcaactcggccaatggtgtgagcagtaagccgcttcaaaacgggaggcacgagaacattgagaacgggaatgttcctgtggaaaaccccgaagaccctcagcagaatcaggagcagcagccgccgccacagccaccaccgccagagccagagccggtggaggctgacttcctgtcccccttctccgtgccggaggccagaggggacaaggtcaagtgggtgttcacctggcccctcatcttcctcctgtgcgtcaccattcccaactgcagcaagccccgctgggagaagttcttcatggtcaccttcatcaccgccacgctgtggatcgctgtgttctcctacatcatggtgtggctggtgactattatcggatacacacttgggatcccggatgtcatcatgggcattactttcctggcagcagggacaagtgttccagactgcatggccagcctaattgtggcgagacaaggccttggggacatggcagtctccaacaccataggaagcaacgtgtttgacatcctggtaggacttggtgtaccgtggggcctgcagaccatggttgttaattatggatcaacagtgaagatcaacagccgggggctggtctattccgtggtcctgttgctgggctctgtcgctctcaccgtcctcggcatccacctaaacaagtggcgactggaccggaagctgggtgtctacgtgctggttctctacgccatcttcttgtgcttctccataatgatagagtttaacgtctttaccttcgtcaacttgccgatgtgccgggaagacgattagcgctgagtcgcggcccctgggagctgatctggacaccctgtgacactggcgttctcctctcccctccttcccccaccacaggtctctcctgcataggcagccactgtccgttctttcacacactggaaggaagagccatcgtggtctttgtctggccacaggccaggctgctgggcatcctcctcctccttggagttccgcccctgcaaggctggatttgggggccattatctgagcagcttcaaagacccctgagctgccaaccacggagatgtgccaagcatctcatctctcctgcacactttagtcagaaggacttctgcatgcagtttgtctttctgttctgcaggcagcttcagaattgaggtcatttgtgagcacaagatctcatagggcaggtgcaaaataggaatgttgttctcaagtgtcacctccagcccagaggtggttccttaggcagcatgtgctcctgggagcctctgacttttgctggaagcagccacagtttggaaggggcaagacctcaacctgttggggtttagggcccatgatggcagacattctaccccttttcctggaaaaactggaagaatgaaaataatttttttctgtggaagagagaaaatgagtgaatattcttctcacttttattgatgcattcagagaataagcaatgaaatattaaaaaatgaaacatcatataggtcatcatacttgaaaattatcattccatatgaaaggatcatgatacacaccaaaaaagtaatgatcgtaaagacacaaatcctctgtatgccatcttgcattggcactgaggtgtttggtttggaatagggaaaaaggtaagagactaacgtggaaaggtgctaactcagagactggagattatagtttacagctgtactttccagatcttctatgtgacacaatgcactgtccttgtgggtttgtcatttattggttaatgctctagtttcaaaaccaccctgttgaaagttccagttatttatatgcccaacaaatttcatagcctgctgaactgaactgagtgtgtcagaagtgctggttaatgacgagaagagattgcctgaaaaacaacaaactgctttctggttagctgaaggcaagtgtgaaaatcagaatttagaatatttagagctaagcttctggaaccacgtagtttctacacgtggcaggccaagaatgggaggctgactcaaaactagatagaaaaatataaaataatcttcgaccacttgatagctctcaaatatatatttaaaagatttatgaatacaaaccatttatggtttatgatttctaaaaagaaagcacaattaattttatagagaggttttttatttttttaatatttctattgcaaaagtctatccgatttgatgcactttgaatattgagatattttgcacggatgaatgtatgggaactacccatgatgatgtaagaggaaagaacatttttttgtgattcaccagacatcactttaaacttggtgatgagtttaaatccagtagctaatcccttcctgagactcaaagatcgtgacgctggttggaatttctgactgtgccctttagggcctcctgagtttcaaaaggaggaagtgttcgtgcttgtgtccctgaagttccctgttgcatgagcctgcgacaggacctcacccccaccaccaggcttctatttgggattcacatcagtattagtatcgtagctacaccaagttcaggcttctctttttgtttttttacctagaaattgggctcagtggtcttcaacttgaggacgagggtgattttcctaagaaatcagcaaagagggaaggcagggcccctgtagattcaccagtataaacttcagctgcagggattccagagccctcgggaccactctgtcaccttaatagccaagttctcctggttcctccgatcttacaggctcatccaggttccaaagtgcttctgtctctgttttgattctccaaactgctctgtgatgtatgtagggattattctccccacttaacagaaagtagtgtcttggagaggtcaagggtctctagttcaatggccagtcatagcagaagggaggccaagcaccagtccatcacccctcccaggccagcctctgtaagttggccacacttggggagtgagtgtgggtatgactttaccctcctggttggttcttactgtttgagtcaaaacctcatcaatatatcattgactcctgggttcctcaggtcatttcctaatatctgtccctatccaatgcctctattttatcttgaaaaaaggaccaaaaattatttttagctatggcaaggcacaggccacatggcccctgatggcgtccctgctggttttcaattctctgaagccttgtgtagctttcagagcacacgtatcctaattaccctcctcttcctcagcagaacccatttgagattctaaatgaatactcttagtctctaaagttgcagttagaaactaaaataatgttttttaatatgtaatatgctcctcttggctaattttcttttgactttaatgtgccaatgtaacttcctttaaaggatctatgcatttattaaatctggaaaact

SEQ ID NO: 853 - DNA, 1359 bp, Homo sapiens
ctcaaagttcgcaggaggcgagagatgctgccgcagcaagtcggcttcgtgtgcgcggtgctggccctggtgtgctgtgcgtccggcctcttcggcagcttggggcacaaaacagcttctgctagcaaacgtgtcctgccagacacgtggagaaatagaaagttgatggccccagtgaatgggacacagacagccaagaactgcacagatcctgcgattcacgagttccccacagatctgttctccaataaggagcgacagcacggagccgtcctgctgcacatccttggtgctctgtatatgttctatgccttggccatagtgtgcgatgacttctttgttccgtctctagagaagatctgtgagagactccatctgagcgaagatgtggctggagccaccttcatggctgcaggaagctcaacgccagagctgtttgcgtctgttattggggtgttcatcacccatggggacgtcggggtgggcaccatctctgtttcttttgccttacagttcatatatgatgaacaaattgtgtggtgggaaggcctggtgctcatcatcttgtatgtgttttatattctgatcatgaagtacaatgtgaagatgcaagcctttttcacagtcaaacaaaagagcattgcaaacggtaacccggtcaacagtgagctggaggctggtaatgatttctatgacggtagctatgatgacccttccgtgccattgctggggcaagtgaaggagaagccacagtatggcaagaaccccgtggtgatggtggacgagattatgagctccagccctcccaagttcaccttccctgaagcaggcttacgaatcatgatcaccaataagtttggacccaggacccgactacggatggccagcaggatcatcattaatgagcggcagagactgatcaactcggccaatggtgtgagcagtaagccgcttcaaaacgggaggcacgagaacattgagaacgggaatgttcctgtggaaaaccccgaagaccctcagcagaatcaggagcagcagccgccgccacagccaccaccgccagagccagagccggtggaggctgacttcctgtcccccttctccgtgccggaggccagaggggacaaggtcaagtgggtgttcacctggcccctcatcttcctcctgtgcgtcaccattcccaactgcagcaagccccgctgggagaagttcttcatggtcaccttcatcaccgccacgctgtggatcgctgtgttctcctacatcatggtgtggctggagcaaagagaggggaagcagttccagcatggctgcagttctgttgattgtgaaactcactctcagccccttacaccctag

SEQ ID NO: 854 - DNA, 4408 bp, Homo sapiens
ctcaaagttcgcaggaggcgagagatgctgccgcagcaagtcggcttcgtgtgcgcggtgctggccctggtgtgctgtgcgtccggcctcttcggcagcttggggcacaaaacagcttctgctagcaaacgtgtcctgccagacacgtggagaaatagaaagttgatggccccagtgaatgggacacagacagccaagaactgcacagatcctgcgattcacgagttccccacagatctgttctccaataaggagcgacagcacggagccgtcctgctgcacatccttggtgctctgtatatgttctatgccttggccatagtgtgcgatgacttctttgttccgtctctagagaagatctgtgagagactccatctgagcgaagatgtggctggagccaccttcatggctgcaggaagctcaacgccagagctgtttgcgtctgttattggggtgttcatcacccatggggacgtcggggtgggcaccatcgtgggctctgctgtgttcaacatcctgtgcataattggagtgtgcggactgtttgctggccaggtggtccgtctgacgtggtgggccgtgtgccgagactccgtgtactacaccatctctgtcatcgtgctcatcgtgttcatatatgatgaacaaattgtgtggtgggaaggcctggtgctcatcatcttgtatgtgttttatattctgatcatgaagtacaatgtgaagatgcaagcctttttcacagtcaaacaaaagagcattgcaaacggtaacccggtcaacagtgagctggaggctgtgaaggagaagccacagtatggcaagaaccccgtggtgatggtggacgagattatgagctccagccctcccaagttcaccttccctgaagcaggcttacgaatcatgatcaccaataagtttggacccaggacccgactacggatggccagcaggatcatcattaatgagcggcagagactgatcaactcggccaatggtgtgagcagtaagccgcttcaaaacgggaggcacgagaacattgagaacgggaatgttcctgtggaaaaccccgaagaccctcagcagaatcaggagcagcagccgccgccacagccaccaccgccagagccagagccggtggaggctgacttcctgtcccccttctccgtgccggaggccagaggggacaaggtcaagtgggtgttcacctggcccctcatcttcctcctgtgcgtcaccattcccaactgcagcaagccccgctgggagaagttcttcatggtcaccttcatcaccgccacgctgtggatcgctgtgttctcctacatcatggtgtggctggtgactattatcggatacacacttgggatcccggatgtcatcatgggcattactttcctggcagcagggacaagtgttccagactgcatggccagcctaattgtggcgagacaaggccttggggacatggcagtctccaacaccataggaagcaacgtgtttgacatcctggtaggacttggtgtaccgtggggcctgcagaccatggttgttaattatggatcaacagtgaagatcaacagccgggggctggtctattccgtggtcctgttgctgggctctgtcgctctcaccgtcctcggcatccacctaaacaagtggcgactggaccggaagctgggtgtctacgtgctggttctctacgccatcttcttgtgcttctccataatgatagagtttaacgtctttaccttcgtcaacttgccgatgtgccgggaagacgattagcgctgagtcgcggcccctgggagctgatctggacaccctgtgacactggcgttctcctctcccctccttcccccaccacaggtctctcctgcataggcagccactgtccgttctttcacacactggaaggaagagccatcgtggtctttgtctggccacaggccaggctgctgggcatcctcctcctccttggagttccgcccctgcaaggctggatttgggggccattatctgagcagcttcaaagacccctgagctgccaaccacggagatgtgccaagcatctcatctctcctgcacactttagtcagaaggacttctgcatgcagtttgtctttctgttctgcaggcagcttcagaattgaggtcatttgtgagcacaagatctcatagggcaggtgcaaaataggaatgttgttctcaagtgtcacctccagcccagaggtggttccttaggcagcatgtgctcctgggagcctctgacttttgctggaagcagccacagtttggaaggggcaagacctcaacctgttggggtttagggcccatgatggcagacattctaccccttttcctggaaaaactggaagaatgaaaataatttttttctgtggaagagagaaaatgagtgaatattcttctcacttttattgatgcattcagagaataagcaatgaaatattaaaaaatgaaacatcatataggtcatcatacttgaaaattatcattccatatgaaaggatcatgatacacaccaaaaaagtaatgatcgtaaagacacaaatcctctgtatgccatcttgcattggcactgaggtgtttggtttggaatagggaaaaaggtaagagactaacgtggaaaggtgctaactcagagactggagattatagtttacagctgtactttccagatcttctatgtgacacaatgcactgtccttgtgggtttgtcatttattggttaatgctctagtttcaaaaccaccctgttgaaagttccagttatttatatgcccaacaaatttcatagcctgctgaactgaactgagtgtgtcagaagtgctggttaatgacgagaagagattgcctgaaaaacaacaaactgctttctggttagctgaaggcaagtgtgaaaatcagaatttagaatatttagagctaagcttctggaaccacgtagtttctacacgtggcaggccaagaatgggaggctgactcaaaactagatagaaaaatataaaataatcttcgaccacttgatagctctcaaatatatatttaaaagatttatgaatacaaaccatttatggtttatgatttctaaaaagaaagcacaattaattttatagagaggttttttatttttttaatatttctattgcaaaagtctatccgatttgatgcactttgaatattgagatattttgcacggatgaatgtatgggaactacccatgatgatgtaagaggaaagaacatttttttgtgattcaccagacatcactttaaacttggtgatgagtttaaatccagtagctaatcccttcctgagactcaaagatcgtgacgctggttggaatttctgactgtgccctttagggcctcctgagtttcaaaaggaggaagtgttcgtgcttgtgtccctgaagttccctgttgcatgagcctgcgacaggacctcacccccaccaccaggcttctatttgggattcacatcagtattagtatcgtagctacaccaagttcaggcttctctttttgtttttttacctagaaattgggctcagtggtcttcaacttgaggacgagggtgattttcctaagaaatcagcaaagagggaaggcagggcccctgtagattcaccagtataaacttcagctgcagggattccagagccctcgggaccactctgtcaccttaatagccaagttctcctggttcctccgatcttacaggctcatccaggttccaaagtgcttctgtctctgttttgattctccaaactgctctgtgatgtatgtagggattattctccccacttaacagaaagtagtgtcttggagaggtcaagggtctctagttcaatggccagtcatagcagaagggaggccaagcaccagtccatcacccctcccaggccagcctctgtaagttggccacacttggggagtgagtgtgggtatgactttaccctcctggttggttcttactgtttgagtcaaaacctcatcaatatatcattgactcctgggttcctcaggtcatttcctaatatctgtccctatccaatgcctctattttatcttgaaaaaaggaccaaaaattatttttagctatggcaaggcacaggccacatggcccctgatggcgtccctgctggttttcaattctctgaagccttgtgtagctttcagagcacacgtatcctaattaccctcctcttcctcagcagaacccatttgagattctaaatgaatactcttagtctctaaagttgcagttagaaactaaaataatgttttttaatatgtaatatgctcctcttggctaattttcttttgactttaatgtgccaatgtaacttcctttaaaggatctatgcatttattaaatctggaaaact

SEQ ID NO: 855 - DNA, 4417 bp, Homo sapiens
gggcccgcagatctctctggttcccctctctgccccgtctccagcttttttgcagggcacaaaacagcttctgctagcaaacgtgtcctgccagacacgtggagaaatagaaagttgatggccccagtgaatgggacacagacagccaagaactgcacagatcctgcgattcacgagttccccacagatctgttctccaataaggagcgacagcacggagccgtcctgctgcacatccttggtgctctgtatatgttctatgccttggccatagtgtgcgatgacttctttgttccgtctctagagaagatctgtgagagactccatctgagcgaagatgtggctggagccaccttcatggctgcaggaagctcaacgccagagctgtttgcgtctgttattggggtgttcatcacccatggggacgtcggggtgggcaccatcgtgggctctgctgtgttcaacatcctgtgcataattggagtgtgcggactgtttgctggccaggtggtccgtctgacgtggtgggccgtgtgccgagactccgtgtactacaccatctctgtcatcgtgctcatcgtgttcatatatgatgaacaaattgtgtggtgggaaggcctggtgctcatcatcttgtatgtgttttatattctgatcatgaagtacaatgtgaagatgcaagcctttttcacagtcaaacaaaagagcattgcaaacggtaacccggtcaacagtgagctggaggctggtaatgatttctatgacggtagctatgatgacccttccgtgccattgctggggcaagtgaaggagaagccacagtatggcaagaaccccgtggtgatggtggacgagattatgagctccagccctcccaagttcaccttccctgaagcaggcttacgaatcatgatcaccaataagtttggacccaggacccgactacggatggccagcaggatcatcattaatgagcggcagagactgatcaactcggccaatggtgtgagcagtaagccgcttcaaaacgggaggcacgagaacattgagaacgggaatgttcctgtggaaaaccccgaagaccctcagcagaatcaggagcagcagccgccgccacagccaccaccgccagagccagagccggtggaggctgacttcctgtcccccttctccgtgccggaggccagaggggacaaggtcaagtgggtgttcacctggcccctcatcttcctcctgtgcgtcaccattcccaactgcagcaagccccgctgggagaagttcttcatggtcaccttcatcaccgccacgctgtggatcgctgtgttctcctacatcatggtgtggctggtgactattatcggatacacacttgggatcccggatgtcatcatgggcattactttcctggcagcagggacaagtgttccagactgcatggccagcctaattgtggcgagacaaggccttggggacatggcagtctccaacaccataggaagcaacgtgtttgacatcctggtaggacttggtgtaccgtggggcctgcagaccatggttgttaattatggatcaacagtgaagatcaacagccgggggctggtctattccgtggtcctgttgctgggctctgtcgctctcaccgtcctcggcatccacctaaacaagtggcgactggaccggaagctgggtgtctacgtgctggttctctacgccatcttcttgtgcttctccataatgatagagtttaacgtctttaccttcgtcaacttgccgatgtgccgggaagacgattagcgctgagtcgcggcccctgggagctgatctggacaccctgtgacactggcgttctcctctcccctccttcccccaccacaggtctctcctgcataggcagccactgtccgttctttcacacactggaaggaagagccatcgtggtctttgtctggccacaggccaggctgctgggcatcctcctcctccttggagttccgcccctgcaaggctggatttgggggccattatctgagcagcttcaaagacccctgagctgccaaccacggagatgtgccaagcatctcatctctcctgcacactttagtcagaaggacttctgcatgcagtttgtctttctgttctgcaggcagcttcagaattgaggtcatttgtgagcacaagatctcatagggcaggtgcaaaataggaatgttgttctcaagtgtcacctccagcccagaggtggttccttaggcagcatgtgctcctgggagcctctgacttttgctggaagcagccacagtttggaaggggcaagacctcaacctgttggggtttagggcccatgatggcagacattctaccccttttcctggaaaaactggaagaatgaaaataatttttttctgtggaagagagaaaatgagtgaatattcttctcacttttattgatgcattcagagaataagcaatgaaatattaaaaaatgaaacatcatataggtcatcatacttgaaaattatcattccatatgaaaggatcatgatacacaccaaaaaagtaatgatcgtaaagacacaaatcctctgtatgccatcttgcattggcactgaggtgtttggtttggaatagggaaaaaggtaagagactaacgtggaaaggtgctaactcagagactggagattatagtttacagctgtactttccagatcttctatgtgacacaatgcactgtccttgtgggtttgtcatttattggttaatgctctagtttcaaaaccaccctgttgaaagttccagttatttatatgcccaacaaatttcatagcctgctgaactgaactgagtgtgtcagaagtgctggttaatgacgagaagagattgcctgaaaaacaacaaactgctttctggttagctgaaggcaagtgtgaaaatcagaatttagaatatttagagctaagcttctggaaccacgtagtttctacacgtggcaggccaagaatgggaggctgactcaaaactagatagaaaaatataaaataatcttcgaccacttgatagctctcaaatatatatttaaaagatttatgaatacaaaccatttatggtttatgatttctaaaaagaaagcacaattaattttatagagaggttttttatttttttaatatttctattgcaaaagtctatccgatttgatgcactttgaatattgagatattttgcacggatgaatgtatgggaactacccatgatgatgtaagaggaaagaacatttttttgtgattcaccagacatcactttaaacttggtgatgagtttaaatccagtagctaatcccttcctgagactcaaagatcgtgacgctggttggaatttctgactgtgccctttagggcctcctgagtttcaaaaggaggaagtgttcgtgcttgtgtccctgaagttccctgttgcatgagcctgcgacaggacctcacccccaccaccaggcttctatttgggattcacatcagtattagtatcgtagctacaccaagttcaggcttctctttttgtttttttacctagaaattgggctcagtggtcttcaacttgaggacgagggtgattttcctaagaaatcagcaaagagggaaggcagggcccctgtagattcaccagtataaacttcagctgcagggattccagagccctcgggaccactctgtcaccttaatagccaagttctcctggttcctccgatcttacaggctcatccaggttccaaagtgcttctgtctctgttttgattctccaaactgctctgtgatgtatgtagggattattctccccacttaacagaaagtagtgtcttggagaggtcaagggtctctagttcaatggccagtcatagcagaagggaggccaagcaccagtccatcacccctcccaggccagcctctgtaagttggccacacttggggagtgagtgtgggtatgactttaccctcctggttggttcttactgtttgagtcaaaacctcatcaatatatcattgactcctgggttcctcaggtcatttcctaatatctgtccctatccaatgcctctattttatcttgaaaaaaggaccaaaaattatttttagctatggcaaggcacaggccacatggcccctgatggcgtccctgctggttttcaattctctgaagccttgtgtagctttcagagcacacgtatcctaattaccctcctcttcctcagcagaacccatttgagattctaaatgaatactcttagtctctaaagttgcagttagaaactaaaataatgttttttaatatgtaatatgctcctcttggctaattttcttttgactttaatgtgccaatgtaacttcctttaaaggatctatgcatttattaaatctggaaaact

SEQ ID NO: 856 - DNA, 4531 bp, Homo sapiens
agagagaaagttcccggggagagctcgcccctgggagggccgacgtcgagcctgctcgccgcgagggtctcagagacggcacccaggcgctccgggatggcgctccgcgggaccctccggccgctcaaagttcgcaggaggcgagagatgctgccgcagcaagtcggcttcgtgtgcgcggtgctggccctggtgtgctgtgcgtccggcctcttcggcagcttggggcacaaaacagcttctgctagcaaacgtgtcctgccagacacgtggagaaatagaaagttgatggccccagtgaatgggacacagacagccaagaactgcacagatcctgcgattcacgagttccccacagatctgttctccaataaggagcgacagcacggagccgtcctgctgcacatccttggtgctctgtatatgttctatgccttggccatagtgtgcgatgacttctttgttccgtctctagagaagatctgtgagagactccatctgagcgaagatgtggctggagccaccttcatggctgcaggaagctcaacgccagagctgtttgcgtctgttattggggtgttcatcacccatggggacgtcggggtgggcaccatcgtgggctctgctgtgttcaacatcctgtgcataattggagtgtgcggactgtttgctggccaggtggtccgtctgacgtggtgggccgtgtgccgagactccgtgtactacaccatctctgtcatcgtgctcatcgtgttcatatatgatgaacaaattgtgtggtgggaaggcctggtgctcatcatcttgtatgtgttttatattctgatcatgaagtacaatgtgaagatgcaagcctttttcacagtcaaacaaaagagcattgcaaacggtaacccggtcaacagtgagctggaggctgtgaaggagaagccacagtatggcaagaaccccgtggtgatggtggacgagattatgagctccagccctcccaagttcaccttccctgaagcaggcttacgaatcatgatcaccaataagtttggacccaggacccgactacggatggccagcaggatcatcattaatgagcggcagagactgatcaactcggccaatggtgtgagcagtaagccgcttcaaaacgggaggcacgagaacattgagaacgggaatgttcctgtggaaaaccccgaagaccctcagcagaatcaggagcagcagccgccgccacagccaccaccgccagagccagagccggtggaggctgacttcctgtcccccttctccgtgccggaggccagaggggacaaggtcaagtgggtgttcacctggcccctcatcttcctcctgtgcgtcaccattcccaactgcagcaagccccgctgggagaagttcttcatggtcaccttcatcaccgccacgctgtggatcgctgtgttctcctacatcatggtgtggctggtgactattatcggatacacacttgggatcccggatgtcatcatgggcattactttcctggcagcagggacaagtgttccagactgcatggccagcctaattgtggcgagacaaggccttggggacatggcagtctccaacaccataggaagcaacgtgtttgacatcctggtaggacttggtgtaccgtggggcctgcagaccatggttgttaattatggatcaacagtgaagatcaacagccgggggctggtctattccgtggtcctgttgctgggctctgtcgctctcaccgtcctcggcatccacctaaacaagtggcgactggaccggaagctgggtgtctacgtgctggttctctacgccatcttcttgtgcttctccataatgatagagtttaacgtctttaccttcgtcaacttgccgatgtgccgggaagacgattagcgctgagtcgcggcccctgggagctgatctggacaccctgtgacactggcgttctcctctcccctccttcccccaccacaggtctctcctgcataggcagccactgtccgttctttcacacactggaaggaagagccatcgtggtctttgtctggccacaggccaggctgctgggcatcctcctcctccttggagttccgcccctgcaaggctggatttgggggccattatctgagcagcttcaaagacccctgagctgccaaccacggagatgtgccaagcatctcatctctcctgcacactttagtcagaaggacttctgcatgcagtttgtctttctgttctgcaggcagcttcagaattgaggtcatttgtgagcacaagatctcatagggcaggtgcaaaataggaatgttgttctcaagtgtcacctccagcccagaggtggttccttaggcagcatgtgctcctgggagcctctgacttttgctggaagcagccacagtttggaaggggcaagacctcaacctgttggggtttagggcccatgatggcagacattctaccccttttcctggaaaaactggaagaatgaaaataatttttttctgtggaagagagaaaatgagtgaatattcttctcacttttattgatgcattcagagaataagcaatgaaatattaaaaaatgaaacatcatataggtcatcatacttgaaaattatcattccatatgaaaggatcatgatacacaccaaaaaagtaatgatcgtaaagacacaaatcctctgtatgccatcttgcattggcactgaggtgtttggtttggaatagggaaaaaggtaagagactaacgtggaaaggtgctaactcagagactggagattatagtttacagctgtactttccagatcttctatgtgacacaatgcactgtccttgtgggtttgtcatttattggttaatgctctagtttcaaaaccaccctgttgaaagttccagttatttatatgcccaacaaatttcatagcctgctgaactgaactgagtgtgtcagaagtgctggttaatgacgagaagagattgcctgaaaaacaacaaactgctttctggttagctgaaggcaagtgtgaaaatcagaatttagaatatttagagctaagcttctggaaccacgtagtttctacacgtggcaggccaagaatgggaggctgactcaaaactagatagaaaaatataaaataatcttcgaccacttgatagctctcaaatatatatttaaaagatttatgaatacaaaccatttatggtttatgatttctaaaaagaaagcacaattaattttatagagaggttttttatttttttaatatttctattgcaaaagtctatccgatttgatgcactttgaatattgagatattttgcacggatgaatgtatgggaactacccatgatgatgtaagaggaaagaacatttttttgtgattcaccagacatcactttaaacttggtgatgagtttaaatccagtagctaatcccttcctgagactcaaagatcgtgacgctggttggaatttctgactgtgccctttagggcctcctgagtttcaaaaggaggaagtgttcgtgcttgtgtccctgaagttccctgttgcatgagcctgcgacaggacctcacccccaccaccaggcttctatttgggattcacatcagtattagtatcgtagctacaccaagttcaggcttctctttttgtttttttacctagaaattgggctcagtggtcttcaacttgaggacgagggtgattttcctaagaaatcagcaaagagggaaggcagggcccctgtagattcaccagtataaacttcagctgcagggattccagagccctcgggaccactctgtcaccttaatagccaagttctcctggttcctccgatcttacaggctcatccaggttccaaagtgcttctgtctctgttttgattctccaaactgctctgtgatgtatgtagggattattctccccacttaacagaaagtagtgtcttggagaggtcaagggtctctagttcaatggccagtcatagcagaagggaggccaagcaccagtccatcacccctcccaggccagcctctgtaagttggccacacttggggagtgagtgtgggtatgactttaccctcctggttggttcttactgtttgagtcaaaacctcatcaatatatcattgactcctgggttcctcaggtcatttcctaatatctgtccctatccaatgcctctattttatcttgaaaaaaggaccaaaaattatttttagctatggcaaggcacaggccacatggcccctgatggcgtccctgctggttttcaattctctgaagccttgtgtagctttcagagcacacgtatcctaattaccctcctcttcctcagcagaacccatttgagattctaaatgaatactcttagtctctaaagttgcagttagaaactaaaataatgttttttaatatgtaatatgctcctcttggctaattttcttttgactttaatgtgccaatgtaacttcctttaaaggatctatgcatttattaaatctggaaaact

SEQ ID NO: 857 - DNA, 4718 bp, Homo sapiens
gcacgcggcgcgcgggactctgagctccggccgcgtcgcgcgtccccaccttcccaaggggctcccccgccgacctcgccctcgggccatgaggctttggcccggagctcctcgcctctgagtcgcgcaccgcctgctccagccccagcgccgctcggccactgattgcactctggccgctgaagctccccatcctctcccagagacggcacccaggcgctccgggatggcgctccgcgggaccctccggccgctcaaagttcgcaggaggcgagagatgctgccgcagcaagtcggcttcgtgtgcgcggtgctggccctggtgtgctgtgcgtccggcctcttcggcagcttggggcacaaaacagcttctgctagcaaacgtgtcctgccagacacgtggagaaatagaaagttgatggccccagtgaatgggacacagacagccaagaactgcacagatcctgcgattcacgagttccccacagatctgttctccaataaggagcgacagcacggagccgtcctgctgcacatccttggtgctctgtatatgttctatgccttggccatagtgtgcgatgacttctttgttccgtctctagagaagatctgtgagagactccatctgagcgaagatgtggctggagccaccttcatggctgcaggaagctcaacgccagagctgtttgcgtctgttattggggtgttcatcacccatggggacgtcggggtgggcaccatcgtgggctctgctgtgttcaacatcctgtgcataattggagtgtgcggactgtttgctggccaggtggtccgtctgacgtggtgggccgtgtgccgagactccgtgtactacaccatctctgtcatcgtgctcatcgtgttcatatatgatgaacaaattgtgtggtgggaaggcctggtgctcatcatcttgtatgtgttttatattctgatcatgaagtacaatgtgaagatgcaagcctttttcacagtcaaacaaaagagcattgcaaacggtaacccggtcaacagtgagctggaggctggtaatgatttctatgacggtagctatgatgacccttccgtgccattgctggggcaagtgaaggagaagccacagtatggcaagaaccccgtggtgatggtggacgagattatgagctccagccctcccaagttcaccttccctgaagcaggcttacgaatcatgatcaccaataagtttggacccaggacccgactacggatggccagcaggatcatcattaatgagcggcagagactgatcaactcggccaatggtgtgagcagtaagccgcttcaaaacgggaggcacgagaacattgagaacgggaatgttcctgtggaaaaccccgaagaccctcagcagaatcaggagcagcagccgccgccacagccaccaccgccagagccagagccggtggaggctgacttcctgtcccccttctccgtgccggaggccagaggggacaaggtcaagtgggtgttcacctggcccctcatcttcctcctgtgcgtcaccattcccaactgcagcaagccccgctgggagaagttcttcatggtcaccttcatcaccgccacgctgtggatcgctgtgttctcctacatcatggtgtggctggtgactattatcggatacacacttgggatcccggatgtcatcatgggcattactttcctggcagcagggacaagtgttccagactgcatggccagcctaattgtggcgagacaaggccttggggacatggcagtctccaacaccataggaagcaacgtgtttgacatcctggtaggacttggtgtaccgtggggcctgcagaccatggttgttaattatggatcaacagtgaagatcaacagccgggggctggtctattccgtggtcctgttgctgggctctgtcgctctcaccgtcctcggcatccacctaaacaagtggcgactggaccggaagctgggtgtctacgtgctggttctctacgccatcttcttgtgcttctccataatgatagagtttaacgtctttaccttcgtcaacttgccgatgtgccgggaagacgattagcgctgagtcgcggcccctgggagctgatctggacaccctgtgacactggcgttctcctctcccctccttcccccaccacaggtctctcctgcataggcagccactgtccgttctttcacacactggaaggaagagccatcgtggtctttgtctggccacaggccaggctgctgggcatcctcctcctccttggagttccgcccctgcaaggctggatttgggggccattatctgagcagcttcaaagacccctgagctgccaaccacggagatgtgccaagcatctcatctctcctgcacactttagtcagaaggacttctgcatgcagtttgtctttctgttctgcaggcagcttcagaattgaggtcatttgtgagcacaagatctcatagggcaggtgcaaaataggaatgttgttctcaagtgtcacctccagcccagaggtggttccttaggcagcatgtgctcctgggagcctctgacttttgctggaagcagccacagtttggaaggggcaagacctcaacctgttggggtttagggcccatgatggcagacattctaccccttttcctggaaaaactggaagaatgaaaataatttttttctgtggaagagagaaaatgagtgaatattcttctcacttttattgatgcattcagagaataagcaatgaaatattaaaaaatgaaacatcatataggtcatcatacttgaaaattatcattccatatgaaaggatcatgatacacaccaaaaaagtaatgatcgtaaagacacaaatcctctgtatgccatcttgcattggcactgaggtgtttggtttggaatagggaaaaaggtaagagactaacgtggaaaggtgctaactcagagactggagattatagtttacagctgtactttccagatcttctatgtgacacaatgcactgtccttgtgggtttgtcatttattggttaatgctctagtttcaaaaccaccctgttgaaagttccagttatttatatgcccaacaaatttcatagcctgctgaactgaactgagtgtgtcagaagtgctggttaatgacgagaagagattgcctgaaaaacaacaaactgctttctggttagctgaaggcaagtgtgaaaatcagaatttagaatatttagagctaagcttctggaaccacgtagtttctacacgtggcaggccaagaatgggaggctgactcaaaactagatagaaaaatataaaataatcttcgaccacttgatagctctcaaatatatatttaaaagatttatgaatacaaaccatttatggtttatgatttctaaaaagaaagcacaattaattttatagagaggttttttatttttttaatatttctattgcaaaagtctatccgatttgatgcactttgaatattgagatattttgcacggatgaatgtatgggaactacccatgatgatgtaagaggaaagaacatttttttgtgattcaccagacatcactttaaacttggtgatgagtttaaatccagtagctaatcccttcctgagactcaaagatcgtgacgctggttggaatttctgactgtgccctttagggcctcctgagtttcaaaaggaggaagtgttcgtgcttgtgtccctgaagttccctgttgcatgagcctgcgacaggacctcacccccaccaccaggcttctatttgggattcacatcagtattagtatcgtagctacaccaagttcaggcttctctttttgtttttttacctagaaattgggctcagtggtcttcaacttgaggacgagggtgattttcctaagaaatcagcaaagagggaaggcagggcccctgtagattcaccagtataaacttcagctgcagggattccagagccctcgggaccactctgtcaccttaatagccaagttctcctggttcctccgatcttacaggctcatccaggttccaaagtgcttctgtctctgttttgattctccaaactgctctgtgatgtatgtagggattattctccccacttaacagaaagtagtgtcttggagaggtcaagggtctctagttcaatggccagtcatagcagaagggaggccaagcaccagtccatcacccctcccaggccagcctctgtaagttggccacacttggggagtgagtgtgggtatgactttaccctcctggttggttcttactgtttgagtcaaaacctcatcaatatatcattgactcctgggttcctcaggtcatttcctaatatctgtccctatccaatgcctctattttatcttgaaaaaaggaccaaaaattatttttagctatggcaaggcacaggccacatggcccctgatggcgtccctgctggttttcaattctctgaagccttgtgtagctttcagagcacacgtatcctaattaccctcctcttcctcagcagaacccatttgagattctaaatgaatactcttagtctctaaagttgcagttagaaactaaaataatgttttttaatatgtaatatgctcctcttggctaattttcttttgactttaatgtgccaatgtaacttcctttaaaggatctatgcatttattaaatctggaaaact

SEQ ID NO: 858 - DNA, 1897 bp, Homo sapiens
cctcacatgatccagtttaatcctcctcttctcccttcctgaagctgcacgctgcagtaagagcacagcagaaatgcagacaaaagggggccaaacatgggcgagaagggctctgttgctcggcatcctgtgggccactgcacatctgcctctctcagggacctccctgccccaacgtctcccaagggccacaggaaatagcacccaatgtgttatttctccatcatcggagtttcccgaagggtttttcacgagacaggagcgcagagatggaggcatcataatctatttcctaattatcgtttacatgttcatggccatatctattgtctgtgatgaatacttcctaccctccctggaaatcatcagtgaatcccttggattgtctcaggatgttgcaggcacaactttcatggcagcgggcagttcagctcctgaattagttactgctttcctaggtgtatttatcacaaagggagatattggcattagcaccatccttggatctgcaatttataatctccttggcatctgtgctgcctgtggtttgctatctaatacggtctcaacactatcatgttggcccctattcagagactgtgcagcgtacacaattagtgcagcagcagttcttggtataatatatgacaaccaagtttactggtatgaaggggctttactgcttttgatatatggattgtatgttttggtgctgtgttttgacattaaaattaaccaatatattataaagaaatgcagtccttgctgcgcctgtcttgccaaagctatggagagaagtgaacaacagccactgatgggctgggaagatgaaggtcaaccattcattcgtcggcaatcaagaactgatagtggaatattttatgaagattctggctactctcagctctctataagtttacatggccttagtcaggtttctgaagatccaccaagtgttttcaacatgcctgaagcagacttaaaaagaattttttgggtattatcccttcctattattacattactttttctaaccacaccagattgtagaaaaaagttttggaaaaactactttgtgataacctttttcatgtctgcaatatggatatccgcatttacatatatcctggtttggatggtcacaataactggggaaacactagaaattcccgatacagtaatgggccttactttattagcagcaggaacaagcataccagacacaattgcaagtgtgttggttgcaagaaaagggaaaggagatatggctatgtctaacatcgtgggatccaatgtgtttgatatgttgtgccttggtattccatggtttattaaaactgcatttataaatggatcagctcctgcagaagtaaacagcagaggactaacttacataaccatctctctcaacatttcaattatttttctttttttagcagttcacttcaatggctggaaactagacagaaagttgggaatagtctgcctattatcatacttggggcttgctacattatcagttctatatgaacttggaattattggaaataataaaataaggggctgtggaggttgatattattaatagtgttatgcagaaaatatgaatggcagggaggggcagagagaaaaatccatttcttcatttaaatcaaattttaaaaatcttgaaccttagaatctaaaacttacagtaatttaaaaccaaccaaaatcacatcctaatttttctgagccctttcttttcatgaaaaattacatattataaaacagaagtttggggggaaaaaatctatgttttaccatacaataagttgacaaaaactggagaaactagaacaaacaaatccaactatgtagtactgaaaacaacaagaaaatggcttatttcattaaa

SEQ ID NO: 859 - DNA, 1388 bp, Homo sapiens
tgcagtaagagcacagcagaaatgcagacaaaagggggccaaacatgggcgagaagggctctgttgctcggcatcctgtgggccactgcacatctgcctctctcagggacctccctgccccaacgtctcccaagggccacagcccttggattgtctcaggatgttgcaggcacaactttcatggcagcgggcagttcagctcctgaattagttactgctttcctaggtgtatttatcacaaagggagatattggcattagcaccatccttggatctgcaatttataatctccttggcatctgtgctgcctgtggtttgctatctaatacggtctcaacactatcatgttggcccctattcagagactgtgcagcgtacacaattagtgcagcagcagttcttggtataatatatgacaaccaagtttactggtatgaaggggctttactgcttttgatatatggattgtatgttttggtgctgtgttttgacattaaaattaaccaatatattataaagaaatgcagtccttgctgcgcctgtcttgccaaagctatggagagaagtgaacaacagccactgatgggctgggaagatgaaggtcaaccattcattcgtcggcaatcaagaactgatagtggaatattttatgaagattctggctactctcagctctctataagtttacatggccttagtcaggtttctgaagatccaccaagtgttttcaacatgcctgaagcagacttaaaaagaattttttgggtattatcccttcctattattacattactttttctaaccacaccagattgtagaaaaaagttttggaaaaactactttgtgataacctttttcatgtctgcaatatggatatccgcatttacatatatcctggtttggatggtcacaataactggggaaacactagaaattcccgatacagtaatgggccttactttattagcagcaggaacaagcataccagacacaattgcaagtgtgttggttgcaagaaaagggaaaggagatatggctatgtctaacatcgtgggatccaatgtgtttgatatgttgtgccttggtattccatggtttattaaaactgcatttataaatggatcagctcctgcagaagtaaacagcagaggactaacttacataaccatctctctcaacatttcaattatttttctttttttagcagttcacttcaatggctggaaactagacagaaagttgggaatagtctgcctattatcatacttggggcttgctacattatcagttctatatgaacttggaattattggaaataataaaataaggggctgtggaggttgatattattaatagtgttatgcagaaaatatgaatggcagggaggg

SEQ ID NO: 860 - DNA, 991 bp, Homo sapiens
gcgctttcttaaggcccgcgggcggcgcaggagcggcactcgtggctgtggtggcttcggcagcggcttcagcagatcggcggcatcagcggtagcaccagcactagcagcatgttgagccgggcagtgtgcggcaccagcaggcagctggctccggttttggggtatctgggctccaggcagaagcacagcctccccgacctgccctacgactacggcgccctggaacctcacatcaacgcgcagatcatgcagctgcaccacagcaagcaccacgcggcctacgtgaacaacctgaacgtcaccgaggagaagtaccaggaggcgttggccaagggggagttgctggaagccatcaaacgtgactttggttcctttgacaagtttaaggagaagctgacggctgcatctgttggtgtccaaggctcaggttggggttggcttggtttcaataaggaacggggacacttacaaattgctgcttgtccaaatcaggatccactgcaaggaacaacaggccttattccactgctggggattgatgtgtgggagcacgcttactaccttcagtataaaaatgtcaggcctgattatctaaaagctatttggaatgtaatcaactgggagaatgtaactgaaagatacatggcttgcaaaaagtaaaccacgatcgttatgctgagtatgttaagctctttatgactgtttttgtagtggtatagagtactgcagaatacagtaagctgctctattgtagcatttcttgatgttgcttagtcacttatttcataaacaacttaatgttctgaataatttcttactaaacattttgttattgggcaagtgattgaaaatagtaaatgctttgtgtgattgaatctgattggacattttcttcagagagctaaattacaattgtcatttataaaaccatcaaaaatattccatccatatactttggggacttgtagggatgcctttctagtcctat

SEQ ID NO: 861 - DNA, 815 bp, Homo sapiens
gtggcttcggcagcggcttcagcagatcggcggcatcagcggtagcaccagcactagcagcatgttgagccgggcagtgtgcggcaccagcaggcagctggctccggttttggggtatctgggctccaggcagaagcacagcctccccgacctgccctacgactacggcgccctggaacctcacatcaacgcgcagatcatgcagctgcaccacagcaagcaccacgcggcctacgtgaacaacctgaacgtcaccgaggagaagtaccaggaggcgttggccaagggggagttgctggaagccatcaaacgtgactttggttcctttgacaagtttaaggagaagctgacggctgcatctgttggtgtccaaggctcaggttggggttggcttggtttcaataaggaacggggacacttacaaattgctgcttgtccaaatcaggatccactgcaaggaacaacaggccttattccactgctggggattgatgtgtgggagcacgcttactaccttcagtataaaaatgtcaggcctgattatctaaaagctatttggaatgtaatcaactgggagaatgtaactgaaagatacatggcttgcaaaaagtaaaccacgatcgttatgctgatcataccctaatgatcccagcaagataatgtcctgtcttctaagatgtgcatcaagcctggtacatactgaaaaccctataaggtcctggataatttttgtttgattattcattgaagaaacatttattttccaattgtgtgaagtttttgactgttaataaaagaatctgtcaaccatcaaa

SEQ ID NO: 862 - DNA, 990 bp, Homo sapiens
gctgtggtggcttcggcagcggcttcagcagatcggcggcatcagcggtagcaccagcactagcagcatgttgagccgggcagtgtgcggcaccagcaggcagctggctccggttttggggtatctgggctccaggcagaagcacagcctccccgacctgccctacgactacggcgccctggaacctcacatcaacgcgcagatcatgcagctgcaccacagcaagcaccacgcggcctacgtgaacaacctgaacgtcaccgaggagaagtaccaggaggcgttggccaagggagatgttacagcccagatagctcttcagcctgcactgaagttcaatggtggtggtcatatcaatcatagcattttctggacaaacctcagccctaacggtggtggagaacccaaaggggagttgctggaagccatcaaacgtgactttggttcctttgacaagtttaaggagaagctgacggctgcatctgttggtgtccaaggctcaggttggggttggcttggtttcaataaggaacggggacacttacaaattgctgcttgtccaaatcaggatccactgcaaggaacaacaggccttattccactgctggggattgatgtgtgggagcacgcttactaccttcagtataaaaatgtcaggcctgattatctaaaagctatttggaatgtaatcaactgggagaatgtaactgaaagatacatggcttgcaaaaagtaaaccacgatcgttatgctgatcataccctaatgatcccagcaagataatgtcctgtcttctaagatgtgcatcaagcctggtacatactgaaaaccctataaggtcctggataatttttgtttgattattcattgaagaaacatttattttccaattgtgtgaagtttttgactgttaataaaagaatctgtcaaccatcaaagaggtctgcattatgcttgcatgtcaaaaactttaaaaatcctataatcttc

SEQ ID NO: 863 - DNA, 4259 bp, Homo sapiens
cggggcggcggtgcccttgcggcgcagctggggtcgcggccctgctccccgcgctttcttaaggcccgcgggcggcgcaggagcggcactcgtggctgtggtggcttcggcagcggcttcagcagatcggcggcatcagcggtagcaccagcactagcagcatgttgagccgggcagtgtgcggcaccagcaggcagctggctccggttttggggtatctgggctccaggcagaagcacagcctccccgacctgccctacgactacggcgccctggaacctcacatcaacgcgcagatcatgcagctgcaccacagcaagcaccacgcggcctacgtgaacaacctgaacgtcaccgaggagaagtaccaggaggcgttggccaagggagatgttacagcccagatagctcttcagcctgcactgaagttcaatggtggtggtcatatcaatcatagcattttctggacaaacctcagccctaacggtggtggagaacccaaaggggagttgctggaagccatcaaacgtgactttggttcctttgacaagtttaaggagaagctgacggctgcatctgttggtgtccaaggctcaggttggggttggcttggtttcaataaggaacggggacacttacaaattgctgcttgtccaaatcaggatccactgcaaggaacaacaggccttattccactgctggggattgatgtgtgggagcacgcttactaccttcagtataaaaatgtcaggcctgattatctaaaagctatttggaatgtaatcaactgggagaatgtaactgaaagatacatggcttgcaaaaagtaaaccacgatcgttatgctgagtatgttaagctctttatgactgtttttgtagtggtatagagtactgcagaatacagtaagctgctctattgtagcatttcttgatgttgcttagtcacttatttcataaacaacttaatgttctgaataatttcttactaaacattttgttattgggcaagtgattgaaaatagtaaatgctttgtgtgattgaatctgattggacattttcttcagagagctaaattacaattgtcatttataaaaccatcaaaaatattccatccatatactttggggacttgtagggatgcctttctagtcctattctattgcagttatagaaaatctagtcttttgccccagttacttaaaaataaaatattaacactttcccaagggaaacactcggctttctatagaaaattgcactttttgtcgagtaatcctctgcagtgatacttctggtagatgtcacccagtggtttttgttaggtcaaatgttcctgtatagtttttgcaaatagagctgtatactgtttaaatgtagcaggtgaactgaactggggtttgctcacctgcacagtaaaggcaaacttcaacagcaaaactgcaaaaaggtggtttttgcagtaggagaaaggaggatgtttatttgcagggcgccaagcaaggagaattgggcagctcatgcttgagacccaatctccatgatgacctacaagctagagtatttaaaggcagtggtaaatttcaggaaagcagaagttaaaggcaaaattgtaaatcagtcgagatcgggtgccttcagggtggtatggctgtataccaaaattgtaaatcactacatgaagcttatatattggtttggcctgaaaggtgaagtggggtaggcagggggcgggcttacaggttatggtggattcaaagactccctgatttgtgattggttaaggaagcaaagctttgtctaaaaacttggggtccgcagaaaggaacattaaggtctggccaggcccctcaggaagaaactgagagcaaagaatggaggtcagagtttagtccctggtgttcccccttatctgacgtctgtgtgaatccatttggtgggggtctgggtttctgaaaagtagctcaggggcacgtgttaaggatgtctctaggtgactctaacttccctggctattgtttgaaactgttatgaccttcttgcttatcagcttgctggtttccttctcggggcgagctgggtgcctggagttttcggtgaaggaaactcaagattctcctttatttctgtgcttgtgggaatccccctggcacaccccaaagaggggtccctgctccgtctcacagggatctttttgtatatttggcttagcatcatacatttgccatgttgtttcatcatctgcctaatttactgtttttgaatatttcatttgtttctaattgttactacagataatgctggggtgagcaactctgtgtacataggtttatctcctattggaatattttctttatataggcgttttttttttttctttttttttggagacagagtcttgctctgttgcccaggctggagtgcagtggcgcgaccggagctcactgcaacctccacttcccgggttcaagtgattgtcccacctcagcctcctgaatagctgggattacaggtgcatgctaccatgcctggctactttttgtatttttagcagagacagggtttcaccatgttggccagggtggtctcgaactcctgacctcaagtgatccgtctggctcagcctcccaaagtgctgggattacaggtgtgagccactgcacctggcctatataggcttttttcttaaacctatttagtaatgttttcccaagtttattttttatttttaattttttccccaagtttatttttctatttttttttcatggaaaaatggggtaacttagcagtttcaatattgaagactgaagtttaaaaaaaatttaaattcaaggtacttttaaaattcagttagaaaagtaggctttaaaaattattagagacaagagtaccaaagcggtgtgtgtatgtgtgtgtgtgtatgcatgcttgtggattggaaaaactttggagactgattacttttcattatatatgtgtcacagtgaaacagcttttatgtgtcatgtaagattactgcttgcctctctaaggaaggtcgtgactgtttaaatagacgggcaaggtggaaccttttgaaagatgagcttttgaatataagttgtctgctagatcatggtttgtattgaactaacaaggtttgcagatctgctgacttatataaagctttttgattcctactaagctttaagatttaaaaaatgttcaatgttgaaatttctgtggggctctatttttgctttggctttctggtgagagagtgaggaagcattctttccttcactaagtttgtctttcttgtcttctggatagattgattttaagagactaagggaatttacaaactaaagattttagtcatctggtggaaaaggagactttaagattgtttagggctgggcggggtgactcacatctgtaatcccagcactttgggaggccaaggcaggcagaacacttgaaggagttcaagaccagcgtggccaacgtggtgaaaccctgtctctactaaaaatacaaaaattgtttagctctgtttttcataatagaaatagaaaaggtaaaattgcttttcttctgaaaagaacaagtattgttcatccaagaagggtttttgtgactgaatcagcagtgcctgccctagtcatagctgtgcttcaaaaacctcagcatgattagtgttggagcaaaacaaggaagcaaagcaaatactgtttttgaaattctatctgttgcttgaactattttgtaataattaaactttgatgttgagaaatcacaactttattgtacacttcattgcaacttgaaattcatggtcttaaagtgagatttgaatttctattgagcgcctttaaaaaagtaataccaaaccataaagttaaaatctatgtatattgagtcatatctaaaaccacgtataaacataaattgtatttcctgttttaattccaggggaagtactgtttgggaaagctattattaggtaaatgttttacaaattactgtttctcactttcagtcataccctaatgatcccagcaagataatgtcctgtcttctaagatgtgcatcaagcctggtacatactgaaaaccctataaggtcctggataatttttgtttgattattcattgaagaaacatttattttccaattgtgtgaagtttttgactgttaataaaagaatctgtcaaccatcaaagaggtctgcattatgcttgcatgtcaaaaactttaaaaatcctataatcttc

SEQ ID NO: 864 - DNA, 2558 bp, Homo sapiens
aaagccgggctcagaccacctagcagttccgcccctgccgcaggcattaccgatggcgcctcccggagccggccaatcaggggccccggaggagaacacctccctacgccaaccaatgggagaggcaggccacgcgatggctctaccccgggagccaatccaagcacgagggacggagtgcgcacatcgggagaggagagggtggggctgtagcaccaggtcagggaacgcgggagccgcagggttccagggatcccgcggctcctcgcggcttggcctgaccggcttcctccacatacgcccctctcctacacaagtccggccctcggcgctcctgccgaagcagcaggcgcctcggactctgcgcggctcccgccggccactcacctatgatggtccgcgccgccgagacgatgaccacaggatctgagcctgcattcatcttgcttctcctgccgccgtctgccctgcgctgcctgcaagctaggcaaagctcctcctcgcagcccacaggcctgccgcgggcgggacctgaggtagccccgcccctcgccctccacctccccgcgcaccacctccccgcgcatcccactgtgcgcaggcgcaaggccggagcaggggcgggcggaggcgcgcggggcgcggggcgcggggcgcggggcggaagtgaggccggggcgcggggcgcggggcggaagtgaggccggggtctgggcttgcgggcagaaccgcggacctcggacgcatttacagagcgcctgaaaccccagtgtttctggacaccccaatgttggagttccccgacttgacgtcttgggcttttttttaaaaaatcttagggtttctcgaaacagtaaagactggggggtgacaaagacttatctctcgttcagctcaggactggaatcccacgggcgagaatctcgagtgcgagcccggcccgcggcgggtctcagcacagctctgatgggtccttttgctctcggcggcttcgggaggtcctatgcgtttctcctggcgccagtcattcgctcgcgtgaggggcttgctaggagcgtctcggtgcgagccccctgccttctaagatcaactctggctgtgaacgggtgaggacgccgggagcgtcttagcgtcacaaaagttcctttggttgacgtttggacagtgaaaggagcatgtaacaagtggggtcagttttgtttaaaaccctttctgacttcccagcctcttactgggcaaagttcataatttttctgagctttctagggtttccaggcaagcttatgaggggccaccgttacagcaacttgttgggaacacctggatagtggaacaagaaagctttgtcacaaagtcatgaaggggaaaactgttgacggacctggagaatcttcctgaagaactttaaagttgattgaaagaatcattaaatcctggaaacctacattaagactttgcagagatatgcggatgggtcagataaatcagagaagaaacatttctcaagtgtctacatgttctagaaggggaatttttcggaggtggccacttcttcggaatagtccgacgccatcaggcctctgaagcaaggggaaggggaaaagaaaaaagctgaaacacaaggttcatctgtagagacagcgtttcactatgttggccaggctggtctccaactcctgacattggcttatgttctttttaaaaagtttgatgcaccagcaggcagctggctccggttttggggtatctgggctccaggcagaagcacagcctccccgacctgccctacgactacggcgccctggaacctcacatcaacgcgcagatcatgcagctgcaccacagcaagcaccacgcggcctacgtgaacaacctgaacgtcaccgaggagaagtaccaggaggcgttggccaagggagatgttacagcccagatagctcttcagcctgcactgaagttcaatggtggtggtcatatcaatcatagcattttctggacaaacctcagccctaacggtggtggagaacccaaaggggagttgctggaagccatcaaacgtgactttggttcctttgacaagtttaaggagaagctgacggctgcatctgttggtgtccaaggctcaggttggggttggcttggtttcaataaggaacggggacacttacaaattgctgcttgtccaaatcaggatccactgcaaggaacaacaggccttattccactgctggggattgatgtgtgggagcacgcttactaccttcagtataaaaatgtcaggcctgattatctaaaagctatttggaatgtaatcaactgggagaatgtaactgaaagatacatggcttgcaaaaagtaaaccacgatcgttatgctgatcataccctaatgatcccagcaagataatgtcctgtcttctaagatgtgcatcaagcctggtacatactgaaaaccctataaggtcctggataatttttgtttgattattcattgaagaaacatttattttccaattgtgtgaagtttttgactgttaataaaagaatctgtcaaccatc

SEQ ID NO: 865 - DNA, 1526 bp, Homo sapiens
ggggaggtctggcctgcttttcctccctgaactggcccaatgactggctccctcacgctgaccactcctctgggctggcctcctgcactcgcgctaacagcccaggctccagggacagcctgcgttcctgggctggctgggtgcagctctcttttcaggagagaaagctctcttggaggagctggaaaggtgcccgactccagccatgctggcgctactgtgttcctgcctgctcctggcagccggtgcctcggacgcctggacgggcgaggactcggcggagcccaactctgactcggcggagtggatccgagacatgtacgccaaggtcacggagatctggcaggaggtcatgcagcggcgggacgacgacggcgcgctccacgccgcctgccaggtgcagccgtcggccacgctggacgccgcgcagccccgggtgaccggcgtcgtcctcttccggcagcttgcgccccgcgccaagctcgacgccttcttcgccctggagggcttcccgaccgagccgaacagctccagccgcgccatccacgtgcaccagttcggggacctgagccagggctgcgagtccaccgggccccactacaacccgctggccgtgccgcacccgcagcacccgggcgacttcggcaacttcgcggtccgcgacggcagcctctggaggtaccgcgccggcctggccgcctcgctcgcgggcccgcactccatcgtgggccgggccgtggtcgtccacgctggcgaggacgacctgggccgcggcggcaaccaggccagcgtggagaacgggaacgcgggccggcggctggcctgctgcgtggtgggcgtgtgcgggcccgggctctgggagcgccaggcgcgggagcactcagagcgcaagaagcggcggcgcgagagcgagtgcaaggccgcctgagcgcggcccccacccggcggcggccagggacccccgaggcccccctctgcctttgagcttctcctctgctccaacagacaccctccactctgaggtctcaccttcgcctttgctgaagtctccccgcagccctctccacccagaggtctccctataccgagacccaccatccttccatcctgaggaccgccccaaccctcggagccccccactcagtaggtctgaaggcctccatttgtaccgaaacaccccgctcacgctgacagcctcctaggctccctgaggtacctttccacccagaccctccttccccaccccataagccctgagactcccgcctttgacctgacgatcttcccccttcccgccttcaggttcctcctaggcgctcagaggccgctctggggggttgcctcgagtccccccacccctccccacccaccaccgctcccgcgggaagccagcccgtgcaacggaagccaggccaactgccccgcgtcttcagctgtttcgcatccaccgccaccccactgagagctgctcctttgggggaatgtttggcaacctttgtgttacagattaaaaattcagcaattca

SEQ ID NO: 866 - DNA, 1239 bp, Homo sapiens
gggtccagatgttatgggcatcgacgagttaccgtctcggaaactctcaatcacgcaagcgaaaggagaggaggcggctaattaaatattgagcagaaagtcgcgtggggagaatgtcacgtgggtctggaggctcaaggaggctgggataaataccgcaaggcactgagcaggcgaaagagcgcgctcggacctccttcccggcggcagctaccgagagtgcggagcgaccagcgtgcgctcggaggaaccagagaaactcagcaccccgcgggactgtccgtcgcaaaatccaacatgaaaatcctcgtggccttggcagtcttttttcttgtctccactcagctgtttgcagaagaaataggagccaatgatgatctgaattactggtccgactggtacgacagcgaccagatcaaggaggaactgccggagccctttgagcatcttctgcagagaatcgcccggagacccaagcctcagcagttctttggattaatgggcaaacgggatgctgattcctcaattgaaaaacaagtggccctgttaaaggctctttatggacatggccagatctctcacaaaagacataaaacagattcctttgttggactaatgggcaaaagagctttaaattctgtggcttatgaaaggagtgcaatgcagaattatgaaagaagacgttaataaactacctaacattatttattcagcttcatttgtgtcaatgggcaatgacaggtaaattaagacatgcactatgaggaataattatttatttaataacaattgtttggggttgaaaattcaaaaagtgtttatttttcatattgtgccaatatgtattgtaaacatgtgttttaattccaatatgatgactcccttaaaatagaaataagtggttatttctcaacaaagcacagtgttaaatgaaattgtaaaacctgtcaatgatacagtccctaaagaaaaaaaatcattgctttgaagcagttgtgtcagctactgcggaaaaggaaggaaactcctgacagtcttgtgcttttcctatttgttttcatggtgaaaatgtactgagattttggtattacactgtatttgtatctctgaagcatgtttcatgttttgtgactatatagagatgtttttaaaagtttcaatgtgattctaatgtcttcatttcattgtatgatgtgttgtgatagctaacattttaaataaaagaaaaaatatcttgaa

SEQ ID NO: 867 - DNA, 1011 bp, Homo sapiens
aaagagcgcgctcggacctccttcccggcggcagctaccgagagtgcggagcgaccagcgtgcgctcggaggaaccagagaaactcagcaccccgcgggactgtccgtcgcaaaatccaacatgaaaatcctcgtggccttggcagtcttttttcttgtctccactcagctgtttgcagaagaaataggagccaatgatgatctgaattactggtccgactggtacgacagcgaccagatcaaggaggaactgccggagccctttgagcatcttctgcagagaatcgcccggagacccaagcctcagcagttctttggattaatgggcaaacgggatgctggacatggccagatctctcacaaaagacataaaacagattcctttgttggactaatgggcaaaagagctttaaattctgtggcttatgaaaggagtgcaatgcagaattatgaaagaagacgttaataaactacctaacattatttattcagcttcatttgtgtcaatgggcaatgacaggtaaattaagacatgcactatgaggaataattatttatttaataacaattgtttggggttgaaaattcaaaaagtgtttatttttcatattgtgccaatatgtattgtaaacatgtgttttaattccaatatgatgactcccttaaaatagaaataagtggttatttctcaacaaagcacagtgttaaatgaaattgtaaaacctgtcaatgatacagtccctaaagaaaaaaaatcattgctttgaagcagttgtgtcagctactgcggaaaaggaaggaaactcctgacagtcttgtgcttttcctatttgttttcatggtgaaaatgtactgagattttggtattacactgtatttgtatctctgaagcatgtttcatgttttgtgactatatagagatgtttttaaaagtttcaatgtgattctaatgtcttcatttcattgtatgatgtgttgtgatagctaacattttaaataaaagaaaaaata

SEQ ID NO: 868 - DNA, 975 bp, Homo sapiens
aaagagcgcgctcggacctccttcccggcggcagctaccgagagtgcggagcgaccagcgtgcgctcggaggaaccagagaaactcagcaccccgcgggactgtccgtcgcaaaatccaacatgaaaatcctcgtggccttggcagtcttttttcttgtctccactcagctgtttgcagaagaaataggagccaatgatgatctgaattactggtccgactggtacgacagcgaccagatcaaggaggaactgccggagccctttgagcatcttctgcagagaatcgcccggagacccaagcctcagcagttctttggattaatgggcaaacgggatgctgattcctcaattgaaaaacaagtggccctgttaaaggctctttatggacatggccagatctctcacaaaatggcttatgaaaggagtgcaatgcagaattatgaaagaagacgttaataaactacctaacattatttattcagcttcatttgtgtcaatgggcaatgacaggtaaattaagacatgcactatgaggaataattatttatttaataacaattgtttggggttgaaaattcaaaaagtgtttatttttcatattgtgccaatatgtattgtaaacatgtgttttaattccaatatgatgactcccttaaaatagaaataagtggttatttctcaacaaagcacagtgttaaatgaaattgtaaaacctgtcaatgatacagtccctaaagaaaaaaaatcattgctttgaagcagttgtgtcagctactgcggaaaaggaaggaaactcctgacagtcttgtgcttttcctatttgttttcatggtgaaaatgtactgagattttggtattacactgtatttgtatctctgaagcatgtttcatgttttgtgactatatagagatgtttttaaaagtttcaatgtgattctaatgtcttcatttcattgtatgatgtgttgtgatag

SEQ ID NO: 869 - DNA, 578 bp, Homo sapiens
ggtataaaatgaaccaagagcttttagtttgggtcaccacagcatctgctcaccaatgcaaagtaagcatgactgctctctttctgatgtccatgctttttggccttacatgtgggcaagcgatgtctttttgtattccaactgagtatacaatgcacatcgaaaggagagagtgtgcttattgcctaaccatcaacaccaccatctgtgctggatattgtatgacacgggatatcaatggcaaactgtttcttcccaaatatgctctgtcccaggatgtttgcacatatagagacttcatctacaggactgtagaaataccaggatgcccactccatgttgctccctatttttcctatcctgttgctttaagctgtaagtgtggcaagtgcaatactgactatagtgactgcatacatgaagccatcaagacaaactactgtaccaaacctcagaagtcttatctggtaggattttctgtctaatagtgatataatttgcaatttggttaaatgtgcttgcctgaaataaagctaataaaaatattatgtttcacattatcttctgttcattttgag

SEQ ID NO: 870 - DNA, 474 bp, Homo sapiens
atgactgctctctttctgatgtccatgctttttggccttacatgtgggcaagcgatgtctttttgtattccaactgagtatacaatgcacatcgaaaggagagagtgtgcttattgcctaaccatcaacaccaccatctgtgctggatattgtatgacacgggatatcaatggcaaactgtttcttcccaaatatgctctgtcccaggatgtttgcacatatagagacttcatctacaggactgtagaaataccaggatgcccactccatgttgctccctatttttcctatcctgttgctttaagctgtaagtgtggcaagtgcaatactgactatagtgactgcatacatgaagccatcaagacaaactactgtaccaaacctcagaagtcttatctggtaggattttctgtctaatagtgatataatttgcaatttggttaaatgtgcttgcctgaaataaagctaataaaa

SEQ ID NO: 871 - DNA, 5268 bp, Homo sapiens
gccgagacctcagttcccggcggctcttgcggggcacaggtgagccctggctgcgcgcgcggcccctcctccccggcgcctcccagatgggggctccggaggtggcgcccaggctctgagctaccctaggtctgcagactagcgggcattggccagagacatggcccagccactggccttcatcctcgatgtccctgagaccccaggggaccagggccagggccccagcccctatgatgaaagcgaagtgcacgactccttccagcagctcatccaggagcagagccagtgcacggcccaggaggggctggagctgcagcagagagagcgggaggtgacaggaagtagccagcagacactctggcggcccgagggcacccagagcacggccacactccgcatcctggccagcatgcccagccgcaccattggccgcagccgaggtgccatcatctcccagtactacaaccgcacggtgcagcttcggtgcaggagcagccggcccctgctcgggaactttgtccgctccgcctggcccagcctccgcctgtacgacctggagctggaccccacggccctggaggaggaggagaagcagagcctcctggtgaaggagctccagagcctggcagtggcacagcgggaccacatgcttcgcgggatgcccttaagcctggctgagaaacgcagcctgcgagagaagagcaggaccccgagggggaagtggaggggccagccgggcagcggcggggtctgctcctgctgtggccggctcagatatgcctgcgtgctggccttgcacagcctgggcctggcgctgctctccgccctgcaggccctgatgccgtggcgctacgccctgaagcgcatcgggggccagttcggctccagcgtgctctcctacttcctctttctcaagaccctgctggctttcaatgccctcctgctgctgctgctggtggccttcatcatgggccctcaggtcgccttcccacccgccctgccgggccctgcccccgtctgcacaggcctggagctcctcacaggcgcgggttgcttcacccacaccgtcatgtactacggccactacagtaacgccacgctgaaccagccgtgtggcagccccctggatggcagccagtgcacacccagggtgggtggcctgccctacaacatgcccctggcctacctctccactgtgggcgtgagcttctttatcacctgcatcaccctggtgtacagcatggctcactctttcggggagagctaccgggtgggcagcacctctggcatccacgccatcaccgtcttctgctcctgggactacaaggtgacgcagaagcgggcctcccgcctccagcaggacaatattcgcacccggctgaaggagctgctggccgagtggcagctgcggcacagccccaggagcgtgtgcgggaggctgcggcaggcggctgtgctggggcttgtgtggctgctgtgtctggggaccgcgctgggctgcgccgtggccgtccacgtcttctcggagttcatgatccagagtccagaggctgctggccaggaggctgtgctgctggtcctgcccctggtggttggcctcctcaacctgggggccccctacctgtgccgtgtcctggccgccctggagccgcatgactccccggtactggaggtgtacgtggccatctgcaggaacctcatcctcaagctggccatcctggggacactgtgctaccactggctgggccgcagggtgggcgtcctgcagggccagtgctgggaggattttgtgggccaggagctgtaccggttcctggtgatggacttcgtcctcatgttgctggacacgctttttggggaactggtgtggaggattatctccgagaagaagctgaagaggaggcggaagccggagtttgacattgcccggaatgtcctggagctgatttatgggcagactctgacctggctgggggtgctcttctcgcccctcctccccgccgtgcagatcatcaagctgctgctcgtcttctatgtcaagaagaccagccttctggccaactgccaggcgccgcgccggccctggctggcctcacacatgagcaccgtcttcctcacgctgctctgcttccccgccttcctgggcgccgctgtcttcctctgctacgccgtctggcaggtgaagccctcgagcacctgcggccccttccggaccctggacaccatgtacgaggccggcagggtgtgggtgcgccacctggaggcggcaggccccagggtctcctggctgccctgggtgcaccggtacctgatggaaaacaccttctttgtcttcctggtgtcagccctgctgctggccgtgatctacctcaacatccaggtggtgcggggccagcgcaaggtcatctgcctgctcaaggagcagatcagcaatgagggtgaggacaaaatcttcttaatcaacaagcttcactccatctacgagaggaaggagagggaggagaggagcagggttgggacaaccgaggaggctgcggcaccccctgccctgctcacagatgaacaggatgcctagggggacggcgatgggcctcacgggcccgcccagcaccctgagaccacactgttgcctcccagtgaccctgctgggacaccaggacaaggaagacagtttcgcctctcgaaagccgcagctgcgcctaggctggagctggaagggtgggtgaatccggcttgggcatccccaatgaactctgccctgcctgggactctatttattctgattaaaggggttttgcaaatgggcttgtcccttggggctctgtgtctgtgaccacacccggggcctgcttcccgctgccctggggccacctccaggcgcaggtctgggtcctgggaacctcagctggagtgggggcgccctctgctggccaagccccagatggcaggggctggaccgcgccagggcttgattcgcttgctgcctttgaccagcctgaactcgcgcccaggaggggcttacacctgcacaagtgagccgagcaggcacggattgtgaccagagcgatgcgtcaaccattgggtgatgctgtagcatctactggagcaggagacaaatttagagagggacttggaggggagacatatcagttgcaaatgagttgtggggacagttgcctcccaggcataggtaaccagcacctgtgcttggaggcgaacagggcttggtgaggtggggctggccccctgcttctggctgccagcagctggctggggggtggtgatcctgggtctgactgggctgagtttgaggagcccgtgggataccgaaaaccgtaggctgtggggggtgggcacagggattcggggaccagcccgtcatgaccccgtgctccaggtctgcagggaccagcccatgacagcccagggctccaggtctgcggggaccagcccatcacagcccagggctccaggcctgcggggaccagcccgtcagcctcagttctccaggcctgcggggaccagcccgtcatgaccccagtgctccaggtctgtggggaccagcccgtcagcctgtgctccaggcctgcaggaaccagcccgtcagcctcagtgctccaggcctgcggggaccagcccgtcagcctgtgctccaggcctgcggggaccagcccgtcatgaccccagtgctccaggtctgtggggaccagcccgtcagcctgtgctccaggcctgcgggaaccagcccgtcatgaccccagtgctccaggcctgcggggaccagcccgtcatgaccccagtgctccaggtctgtggggaccagcccgtcacggcgcagggttccaggcttgtggggaccagcctgtcacagcccagggctccaggcctgcaggagctgcgcttgggattgggggaatgaacccaggtggggaaatggtcaaagagcgatgggcccagaaaagggtcagacccagatggagatgccactggctgctagcagacccccacgctgggtctagcccacccaatcccatggggatgctcctgtgctctgcagacatctgggtgctgccacaggggcccgacagagttggcatctgggtggatctgagccaagtggtgcttctgggcctcagcaagtagctggtgctgattctgggcagccaactgtggcagcatcttcaggtgcgagtgctgctgggtgaagctgcgtgggcagtccagaaagtgacgtgacagtccacagggaccgacgtagggtttccagcccctatctgtgcagatgctgtcctccaaaccatcacggtccctctctggctggggacgtgcgcctgccactgctggcttgccagcatgatcattggttgtgacctgttgagcccatcttgccagcctcacaaaggacagtactagctgcttatgacaggaaagtggaagaacttggcctggatatttctggagaattaccgtgtgtgctagtcagtctttcgtgtcaaccaggccaggctgtggggcccagtgatctcatcgagaggggccgaggtgttgctgtgatcgtgtgctgctggaatgtggtgaacacctacagtcgatttcacctaaagatcatccttgagaatgtgggtgggcctcatcctatcagctgaaagctttaagagcaaaacccgaggtgtcccagagagggaattctgccttgagacggcggcttcccactcccactggatgtccagcccgcggccccacggctgggtgagcccgtcctctcctcgtttctgtctccggacccaccgtgtggccccagaccctccagtgaggacctcccgtatttcttcagagcagcccttgcgtgctggaggcctgggcttcagtgtgtccctgggtgccctggggcatgttctgtgacctcccagctcctcgcctcatggggccgctgtatcaagtgacacagtttgtgtgctgcgtaccatgcctggcacccatttgaggtgttgcaaggaggccatgtttgctcgatgagagcagcctaagatctacaaactgttgttcgagtggatgggaacttgatgctattttcaggctgaatgacaagactccgcgatgcttctcggcctgggctgcacaacggaatctaccagggaggttttaaaaacactggtacttgctggaggtggtggcgcctgtctgtaattgcagctgctccagaggctgaggcggaggattgcttgagcccaagagtttcggtttatttgctttttcagagtcttg

SEQ ID NO: 872 - DNA, 1246 bp, Homo sapiens
caccaccctgcctggcttggcaggagtcgtctgagaaggggactcctccagggacttggtccctaggtccccagatggggagactgaggccgtggctgtgtgtccctctgagagttggagcggggctgggcccgaattcgaccgcagcaggattctctctcatttctgagccccggaggtggcagagcggcagacccgggcaagtgaaccctagggctgcaggagcccaggccccgacgccggcgcagaggggacggaagggcccgcccccagcccagcgtgcacagaggccatagccaaggccttaaggctcatccaaccggggactcatatcccccccaccggcagcccggcgccccagcctctacccgtgcccgccgagatgctgctgccgcggtcggtgtcatcggagcgggcccctggggtgccggagccggaggagctgtgggaggcagagatggagcggctgcgcggctctgggacgcccgtgcgcgggctgccctatgccatgatggacaagcgcctcatctggcagctgcgggagcccgcgggggtgcagaccttgcgctggcagcggtggcagcgccggcggcagacggtggaaaggcgcctgcgggaggcagcgcagcggctggcccggggccttgggctctgggagggggcgctctacgagatcgggggcctcttcggcacaggaattcggtcctacttcaccttcctccgcttcctgctgctactcaacctgctgagcctgctgctcaccgcaagcttcgtgctgctgcccctggtctggctccgcccccctgacccaggccccaccctgaacttgaccctccagtgccctggtagccgccagtccccgcctggcgttttgaggttccacaatcaactttggcatgttttgactggcagggccttcaccaacacctatctcttctacggtgcgtaccgagtggggccggagagcagctccgtgtacagcatccgcctggcctacctcctcagcccgctggcctgcctgctcctctgcttctgtgggactctgcggcgactactcagcaccctggcaagtggtcccggagctggtggcccttgggctcccgcccattggccagcgtgccctccactacctgggctcccacgccttcagcttccccctcctcatcatgctcaggttctcagggcagccggggccatgggaggggacacctggagggggaggtccttccttccatgggggtggtga

SEQ ID NO: 873 - DNA, 4419 bp, Homo sapiens
caccaccctgcctggcttggcaggagtcgtctgagaaggggactcctccagggacttggtccctaggtccccagatggggagactgaggccgtggctgtgtgtccctctgagagttggagcggggctgggcccgaattcgaccgcagcaggattctctctcatttctgagccccggaggtggcagagcggcagacccgggcaagtgaaccctagggctgcaggagcccaggccccgacgccggcgcagaggggacggaagggcccgcccccagcccagcgtgcacagaggccatagccaaggccttaaggctcatccaaccggggactcatatcccccccaccggcagcccggcgccccagcctctacccgtgcccgccgagatgctgctgccgcggtcggtgtcatcggagcgggcccctggggtgccggagccggaggagctgtgggaggcagagatggagcggctgcgcggctctgggacgcccgtgcgcgggctgccctatgccatgatggacaagcgcctcatctggcagctgcgggagcccgcgggggtgcagaccttgcgctggcagcggtggcagcgccggcggcagacggtggaaaggcgcctgcgggaggcagcgcagcggctggcccggggccttgggctctgggagggggcgctctacgagatcgggggcctcttcggcacaggaattcggtcctacttcaccttcctccgcttcctgctgctactcaacctgctgagcctgctgctcaccgcaagcttcgtgctgctgcccctggtctggctccgcccccctgacccaggccccaccctgaacttgaccctccagtgccctggtagccgccagtccccgcctggcgttttgaggttccacaatcaactttggcatgttttgactggcagggccttcaccaacacctatctcttctacggtgcgtaccgagtggggccggagagcagctccgtgtacagcatccgcctggcctacctcctcagcccgctggcctgcctgctcctctgcttctgtgggactctgcggcggatggtgaaggggctgccgcagaagactctgctgggtcagggctatcaggcgcctctcagcgccaaggtcttctcctcatgggacttctgcatccgggtgcaggaagcagccaccatcaagaagcatgagatcagcaacgagttcaaggtggagctggaggagggccgtcgcttccagctgatgcagcagcagacccgggcccagacggcctgccgcctgctctcctacctgcgggtcaacgtactcaacgggctcctggtggttggggccatcagcgccatcttctgggctaccaagtactcacaggacaacaaggaggagtccctgtttctgctgctccagtacctgccccctggggtcatcgccctggtcaacttcctgggtcccctgctgttcacatttctggtccagctggagaactaccctcccaacacggaggtcaacctcactctgatctggtgcgtggtgctgaagctggccagcttggggatgttctccgtctccctgggtcagaccatactgtgcattggcagagacaagagcagctgtgagtcctacggctacaacgtttgtgactatcagtgctgggagaactccgtgggggaggagctgtacaagctgagtatcttcaacttcctcctcaccgtggccttcgccttcctggtcaccctgcctcggaggctgctggtggaccggttctcaggccggttctgggcctggctggaacgggaggagttcctggtccccaagaatgtgctggacatcgtggcggggcagacggtcacctggatgggcctcttctactgccccctgctgcccctgctgaatagcgtcttcctcttcctcaccttctacatcaagaagtacaccctcctgaagaactccagggcatcttcgcggcccttccgtgcctccagctccaccttcttcttccagctagtgctcctcctgggcctgcttctggctgcagtgcccctgggctatgtggtcagcagcatccactcctcctgggactgcggcctcttcaccaactactcagcaccctggcaagtggtcccggagctggtggcccttgggctcccgcccattggccagcgtgccctccactacctgggctcccacgccttcagcttccccctcctcatcatgctcagccttgtcctgacggtgtgcgtctcccagacccaggccaatgccagggccatccacaggctccggaagcagctggtgtggcaggttcaggagaagtggcacctggtggaggacctgtcgcgactgctgccggagccaggcccgagcgactctccgggccccaagtaccctgcctcccaagcttcgcgcccgcagtccttctgccccggatgcccatgccctggctccccgggccaccaggccccgcggccgggcccctccgtcgtggatgccgcgggactgcgttccccttgccctggacagcacggtgccccggcctccgcccgcagattccgcttccccagcggcgcggagctgtaacccctacccctgcctccccgaagcctccctggggccccttcaggcctccttactccatcttccagacccctggcgaccaccgcccctctcagtggctccagggcctccctcagaggtccccaaagatggacacacaaccccagcggcagcaggaaaaacatatgggaattttctttctatattttaatctcatccctttaaaatgtctattttttattgtgttttttataatatacataatctattagtatagtatctcttgaatgcgattttttctagaatgtgttctgctgatttgttttagagccatgagtgcaatttatacacatacatctattgggaatgctcagaagttgtttactgatggaagtgccttcagaagagtccgggaaccacttcctaaggaaggaaagagctggccacagttagagcaagcctgcctggggccctgctctgtgttccagctgcaaactgcctgcatcatcccttcctgttactcttccttcacctgagacagtcgaggccacagcgtcagccagggccagagctgggatttgaacccaggcactcgggctccagagccacactgccccagtgtggggcttagtggcggctcctggccctgactgaggggctgactgaagcctggtgagagcgtgctgggtcagcctctccctggcgggaatcctctccgtccagtcttctaacctagcagcctcacgtccacagagctgccttgtgaaactcagcagagccctggcttcctgcagagccgtgttctcccagcctgcttcatggctccctggttgagccaagcttgcggatccgtggggtgaaggtacccgcaccgcctgggccttagtggtatgtacgggcctgcatcgtgagcagcgggcgggggcccaggcaggtgaggcagctggccacaagggcagggcccggcccccctcccaaggctgtgtctgatattcttgagcctgttcgagtttccttttccaagcctcctgttctcccacccccacccctgccatgctgcagtgactaaatctgtggttctcatccttggagaacacctgagtagctgctacaagctggccacagcccagcgactctgatgtggttgggctgggtgtggccagcagccagggcatcgggacttttcgaagctcccaggtgactcaccggcagctggggatgagaactgtcaggagggaaggtcagaagtcccaggatgcacttgaaaagcctctagctccaccagtgaccagctcctggctggactcctggtctggactcagcatcagggaggctctggcctctcgccctcagggctgggggcttcttcacatggtcatcaaagacttggccagttccgcctctcccacggccgtccttgtctcacccagcatcacgacgcatcagttcaccaacaaacacgattcagtgctgctagtgctgggtcctgttctgggggctggtgatgaggccaagagggaaagagggagctctgtgttccatcgagggggcgacaagcctggaccagatgaaagtgactcatgttgttaattagcggcttagggccaaaggtggcccctggaccagtggcctcagcatcacctgggaaaaggttagaaatgaacattcccaggccccacctcagcctcctgaatcagagcatccctttggcaaaccatactgagaaacaaccacgtgcatcaccaagcgctgtgaagaaggcaagctttgagaccttgaaggaatcatcaaactctgggcctcggtgtgctcacccagggcgagacaaagacgccatgctcctccaagtggcctccaagattaaatgagcaatgactttt

SEQ ID NO: 874 - DNA, 1676 bp, Homo sapiens
cagacgctccctcagcaaggacagcagaggaccagctaagagggagagaagcaactacagaccccccctgaaaacaaccctcagacgccacatcccctgacaagctgccaggcaggttctcttcctctcacatactgacccacggctccaccctctctcccctggaaaggacaccatgagcactgaaagcatgatccgggacgtggagctggccgaggaggcgctccccaagaagacaggggggccccagggctccaggcggtgcttgttcctcagcctcttctccttcctgatcgtggcaggcgccaccacgctcttctgcctgctgcactttggagtgatcggcccccagagggaagagttccccagggacctctctctaatcagccctctggcccaggcagtcagatcatcttctcgaaccccgagtgacaagcctgtagcccatgttgtagcaaaccctcaagctgaggggcagctccagtggctgaaccgccgggccaatgccctcctggccaatggcgtggagctgagagataaccagctggtggtgccatcagagggcctgtacctcatctactcccaggtcctcttcaagggccaaggctgcccctccacccatgtgctcctcacccacaccatcagccgcatcgccgtctcctaccagaccaaggtcaacctcctctctgccatcaagagcccctgccagagggagaccccagagggggctgaggccaagccctggtatgagcccatctatctgggaggggtcttccagctggagaagggtgaccgactcagcgctgagatcaatcggcccgactatctcgactttgccgagtctgggcaggtctactttgggatcattgccctgtgaggaggacgaacatccaaccttcccaaacgcctcccctgccccaatccctttattaccccctccttcagacaccctcaacctcttctggctcaaaaagagaattgggggcttagggtcggaacccaagcttagaactttaagcaacaagaccaccacttcgaaacctgggattcaggaatgtgtggcctgcacagtgaagtgctggcaaccactaagaattcaaactggggcctccagaactcactggggcctacagctttgatccctgacatctggaatctggagaccagggagcctttggttctggccagaatgctgcaggacttgagaagacctcacctagaaattgacacaagtggaccttaggccttcctctctccagatgtttccagacttccttgagacacggagcccagccctccccatggagccagctccctctatttatgtttgcacttgtgattatttattatttatttattatttatttatttacagatgaatgtatttatttgggagaccggggtatcctgggggacccaatgtaggagctgccttggctcagacatgttttccgtgaaaacggagctgaacaataggctgttcccatgtagccccctggcctctgtgccttcttttgattatgttttttaaaatatttatctgattaagttgtctaaacaatgctgatttggtgaccaactgtcactcattgctgagcctctgctccccaggggagttgtgtctgtaatcgccctactattcagtggcgagaaataaagtttgcttagaaaagaaa

SEQ ID NO: 875 - DNA, 1676 bp, Homo sapiens; identical to SEQ ID NO: 874

SEQ ID NO: 876 - DNA, 1676 bp, Homo sapiens; identical to SEQ ID NO: 874

SEQ ID NO: 877 - DNA, 1676 bp, Homo sapiens; identical to SEQ ID NO: 874

SEQ ID NO: 878 - DNA, 1676 bp, Homo sapiens; identical to SEQ ID NO: 874

SEQ ID NO: 879 - DNA, 1676 bp, Homo sapiens; identical to SEQ ID NO: 874

SEQ ID NO: 880 - DNA, 1676 bp, Homo sapiens; identical to SEQ ID NO: 874

SEQ ID NO: 881 - DNA, 2668 bp, Homo sapiens
acagttctgacgtgagaggacaagaaacacaagcaaatataaaacattcaattctaagagaagttcatcagagacatccttcaggattgtgagctggattttcctctacgtgcttcagtcttctctacacaaagagctgcaaaccaggtctttgttttgcactcttatttcaagcagaatgagtgctcctaaactcctctctctgggctgtatcttcttccccttgctactttttcagcaggcccgggctcaattcccaagacagtgtgccactgttgaggctttgagaagtggtatgtgttgcccagacctgtcccctgtgtctgggcctgggacagaccgctgtggctcatcatcagggaggggcagatgtgaggcagtgactgcagactcccggccccacagccctcagtatccccatgatggcagagatgatcgggaggtctggcccttgcgcttcttcaataggacatgtcactgcaacggcaatttctcaggacacaactgtgggacgtgccgtcctggctggagaggagctgcctgtgaccagagggttctcatagtcaggagaaatcttctggacttaagtaaagaagaaaagaaccactttgtccgggccctggatatggcaaagcgcacaactcaccctttatttgtcattgccaccaggagatcagaagaaatactggggccagatggcaacacgccacaatttgagaacatttccatttataactactttgtttggacacactattactcagtcaaaaagactttccttggggtaggacaggaaagctttggtgaagtggatttctctcatgagggaccagcttttctcacatggcacaggtaccacctcctgcgtctggagaaagacatgcaggcaccgaggatgggccaattaggagaaatccagctggaaatgtggccagaccaatggtgcaacgtcttcctgaaccacaggatgtcgctcagtgcttggaagttggtttatttgacacgcctcctttttattccaactctacaaacagtttccgaaacacagtggaaggcaatgaccccacgggaaagtatgaccctgctgttcgaagtcttcacaatttggctcatctattcctgaatggaacagggggacaaacccatttgtctccaaatgatcctatttttgtcctcctgcacaccttcacagatgcagtctttgatgaatggctgaggagatacaatgctgatatatccacatttccattggaaaatgcccctattggacataatagacaatacaacatggtgccattctggcccccagtcaccaacacagaaatgtttgttactgctccagacaacctgggatacacttatgaaattcaatggccaagtcgggagtttagtgtacctgagataattgccatagcagtagttggcgctttgttactggttgcactcatttttgggactgcttcttatctgattcgtgccagacgcagtatggatgaagctaaccagcctctcctcactgatcagtatcaatgctatgctgaagaatatgaaaaactccagaatcctaatcagtctgtggtctaacaaatgccctactctcttatgcattagtatcacaaaaccacctggttgaatataatagattgagttattaactgtattttctttcactttattaccttctttctaatacaagcatatgttagcattaaagttctaggcatacttttcaaagctgggaagaccctttcagaatcttttcaatgggttttaattttcagttctatttaaaatggtgaatgacactaaactccatgatatttaaggatagtgtgaagatctttggcatgatttaaaggttgagtatgtgaagatataagtaagtgaactaccatgctttgtttacgtgtaaaggaaaataatgtttgatagtaaatgtccacttaaaatacatgaatgggcatttctaaaatgttaaaacataaacacatttccattcatggatatttgtcaacagatttaaagaaaaccacagttattaattaaagaaaattaattatgtgtagttataaaccaatgaaattttgattaaccttttcaaattaatgttccagtttgaagaccaatcaaatatattatttagtcaacatatactatttagtctcaggttcaaggctacaacaaaaatcaccatctttgtcaaactttggagagggaaaatcttcactttcttaagcaacaatggatattgcctgtgtttgccactgtgtttccctgcctctcaattcgctgaaaaaggaactacctatccttacatttcacctactaatgtctcttctaacatcttagaggtccatggagaaggcatatggagaacatgttttatactgctctataaatagtattccaatcactgtgcttaatttaaatagcattatcttatcatttatcagccttttatgtattttccaagtaaaatattaacatattatttcattggtcttcttttttatctggttctatatgaatgctattttttcccttctcttctaacatgaaatatattttctctttttgatcttgtgctatgaaacaatcttccaaagaactgtataaggtggtcataagtgaatattttaattaaaattggtaaaaataaataataaca

SEQ ID NO: 882 - DNA, 2835 bp, Homo sapiens
aattctaagagaagttcatcagagacatccttcaggattgtgagctggattttcctctacgtgcttcagtcttctctacacaaagagctgcaaaccaggtctttgttttgcactcttatttcaagcagaatgagtgctcctaaactcctctctctgggctgtatcttcttccccttgctactttttcagcaggcccgggctcaattcccaagacagtgtgccactgttgaggctttgagaagtggtatgtgttgcccagacctgtcccctgtgtctgggcctgggacagaccgctgtggctcatcatcagggaggggcagatgtgaggcagtgactgcagactcccggccccacagccctcagtatccccatgatggcagagatgatcgggaggtctggcccttgcgcttcttcaataggacatgtcactgcaacggcaatttctcaggacacaactgtgggacgtgccgtcctggctggagaggagctgcctgtgaccagagggttctcatagtcaggagaaatcttctggacttaagtaaagaagaaaagaaccactttgtccgggccctggatatggcaaagcgcacaactcaccctttatttgtcattgccaccaggagatcagaagaaatactggggccagatggcaacacgccacaatttgagaacatttccatttataactactttgtttggacacactattactcagtcaaaaagactttccttggggtaggacaggaaagctttggtgaagtggatttctctcatgagggaccagcttttctcacatggcacaggtaccacctcctgcgtctggagaaagacatgcaggaaatgttgcaagagccttctttctcccttccttactggaattttgcaacggggaaaaatgtctgtgatatctgcacggatgacttgatgggatccagaagcaactttgattccactctaataagcccaaactctgtcttttctcaatggcgagtggtctgtgactccttggaagattatgataccctgggaacactttgtaacagcaccgaggatgggccaattaggagaaatccagctggaaatgtggccagaccaatggtgcaacgtcttcctgaaccacaggatgtcgctcagtgcttggaagttggtttatttgacacgcctcctttttattccaactctacaaacagtttccgaaacacagtggaaggttacagtgaccccacgggaaagtatgaccctgctgttcgaagtcttcacaatttggctcatctattcctgaatggaacagggggacaaacccatttgtctccaaatgatcctatttttgtcctcctgcacaccttcacagatgcagtctttgatgaatggctgaggagatacaatgctgatatatccacatttccattggaaaatgcccctattggacataatagacaatacaacatggtgccattctggcccccagtcaccaacacagaaatgtttgttactgctccagacaacctgggatacacttatgaaattcaatggccaagtcgggagtttagtgtacctgagataattgccatagcagtagttggcgctttgttactggttgcactcatttttgggactgcttcttatctgattcgtgccagacgcagtatggatgaagctaaccagcctctcctcactgatcagtatcaatgctatgctgaagaatatgaaaaactccagaatcctaatcagtctgtggtctaacaaatgccctactctcttatgcattagtatcacaaaaccacctggttgaatataatagattgagttattaactgtattttctttcactttattaccttctttctaatacaagcatatgttagcattaaagttctaggcatacttttcaaagctgggaagaccctttcagaatcttttcaatgggttttaattttcagttctatttaaaatggtgaatgacactaaactccatgatatttaaggatagtgtgaagatctttggcatgatttaaaggttgagtatgtgaagatataagtaagtgaactaccatgctttgtttacgtgtaaaggaaaataatgtttgatagtaaatgtccacttaaaatacatgaatgggcatttctaaaatgttaaaacataaacacatttccattcatggatatttgtcaacagatttaaagaaaaccacagttattaattaaagaaaattaattatgtgtagttataaaccaatgaaattttgattaaccttttcaaattaatgttccagtttgaagaccaatcaaatatattatttagtcaacatatactatttagtctcaggttcaaggctacaacaaaaatcaccatctttgtcaaactttggagagggaaaatcttcactttcttaagcaacaatggatattgcctgtgtttgccactgtgtttccctgcctctcaattcgctgaaaaaggaactacctatccttacatttcacctactaatgtctcttctaacatcttagaggtccatggagaaggcatatggagaacatgttttatactgctctataaatagtattccaatcactgtgcttaatttaaatagcattatcttatcatttatcagccttttatgtattttccaagtaaaatattaacatattatttcattggtcttcttttttatctggttctatatgaatgctattttttcccttctcttctaacatgaaatatattttctctttttgatcttgtgctatgaaacaatcttccaaagaactgtataaggtggtcataagtgaatattttaattaaaattggtaaaaataaataataacagtaataat

SEQ ID NO: 883 - DNA, 549 bp, Homo sapiens
ataaaagttatctcactaaatacttgagactcaaagtgatatacttcacttttccatacagcctgcagacaaaacccatcatatagctctgcctagctacaaggggatggcaaaatataatcccatatatctgaaaggagagaagaaccagatatggctggattttcctctacgtgcttcagtcttctctacacaaagagctgcaaaccaggtctttgttttgcactcttatttcaagcagaatgagtgctcctaaactcctctctctgggctgtatcttcttccccttgctactttttcagcaggcccgggctcaattcccaagacagtgtgccactgttgaggctttgagaagtggtatgtgttgcccagacctgtcccctgtgtctgggcctgggacagaccgctgtggctcatcatcagggaggggcagatgtgaggcagtgactgcagactcccggccccacagccctcagtatccccatgatggcagagatgatcgggaggtctggcccttgcgcttcttcaataggacatgtcactgcaacg

SEQ ID NO: 884 - protein, 375 aa, Homo sapiens
MEEEIAALVIDNGSGMCKAGFAGDDAPRAVFPSIVGRPRHQGVMVGMGQKDSYVGDEAQSKRGILTLKYPIEHGIVTNWDDMEKIWHHTFYNELRVAPEEHPVLLTEAPLNPKANREKMTQIMFETFNTPAMYVAIQAVLSLYASGRTTGIVMDSGDGVTHTVPIYEGYALPHAILRLDLAGRDLTDYLMKILTERGYSFTTTAEREIVRDIKEKLCYVALDFEQEMATAASSSSLEKSYELPDGQVITIGNERFRCPEALFQPSFLGMESCGIHETTFNSIMKCDVDIRKDLYANTVLSGGTTMYPGIADRMQKEITALAPSTMKIKIIAPPERKYSVWIGGSILASLSTFQQMWISKQEYDESGPSIVHRKCF

SEQ ID NO: 885 - protein, 377 aa, Homo sapiens
MCEEEDSTALVCDNGSGLCKAGFAGDDAPRAVFPSIVGRPRHQGVMVGMGQKDSYVGDEAQSKRGILTLKYPIEHGIITNWDDMEKIWHHSFYNELRVAPEEHPTLLTEAPLNPKANREKMTQIMFETFNVPAMYVAIQAVLSLYASGRTTGIVLDSGDGVTHNVPIYEGYALPHAIMRLDLAGRDLTDYLMKILTERGYSFVTTAEREIVRDIKEKLCYVALDFENEMATAASSSSLEKSYELPDGQVITIGNERFRCPETLFQPSFIGMESAGIHETTYNSIMKCDIDIRKDLYANNVLSGGTTMYPGIADRMQKEITALAPSTMKIKIIAPPERKYSVWIGGSILASLSTFQQMWISKQEYDEAGPSIVHRKCF

SEQ ID NO: 886 - protein, 151 aa, Homo sapiens
MCEEEDSTALVCDNGSGLCKAGFAGDDAPRAVFPSIVGRPRHQGVMVGMGQKDSYVGDEAQSKRGILTLKYPIEHGIITNWDDMEKIWHHSFYNELRVAPEEHPTLLTEAPLNPKANREKMTQIMFETFNVPAMYVAIQAVLSLYASGRTT

SEQ ID NO: 887 - protein, 151 aa, Homo sapiens; identical to SEQ ID NO: 886

SEQ ID NO: 888 - protein, 377 aa, Homo sapiens; identical to SEQ ID NO: 885

SEQ ID NO: 889 - protein, 332 aa, Homo sapiens
MVGMGQKDSYVGDEAQSKRGILTLKYPIEHGIITNWDDMEKIWHHSFYNELRVAPEEHPTLLTEAPLNPKANREKMTQIMFETFNVPAMYVAIQAVLSLYASGRTTGIVLDSGDGVTHNVPIYEGYALPHAIMRLDLAGRDLTDYLMKILTERGYSFVTTAEREIVRDIKEKLCYVALDFENEMATAASSSSLEKSYELPDGQVITIGNERFRCPETLFQPSFIGMESAGIHETTYNSIMKCDIDIRKDLYANNVLSGGTTMYPGIADRMQKEITALAPSTMKIKIIAPPERKYSVWIGGSILASLSTFQQMWISKQEYDEAGPSIVHRKCF

SEQ ID NO: 890 - protein, 377 aa, Homo sapiens
MCDDEETTALVCDNGSGLVKAGFAGDDAPRAVFPSIVGRPRHQGVMVGMGQKDSYVGDEAQSKRGILTLKYPIEHGIITNWDDMEKIWHHTFYNELRVAPEEHPTLLTEAPLNPKANREKMTQIMFETFNVPAMYVAIQAVLSLYASGRTTGIVLDSGDGVTHNVPIYEGYALPHAIMRLDLAGRDLTDYLMKILTERGYSFVTTAEREIVRDIKEKLCYVALDFENEMATAASSSSLEKSYELPDGQVITIGNERFRCPETLFQPSFIGMESAGIHETTYNSIMKCDIDIRKDLYANNVLSGGTTMYPGIADRMQKEITALAPSTMKIKIIAPPERKYSVWIGGSILASLSTFQQMWISKQEYDEAGPSIVHRKCF

SEQ ID NO: 891 - protein, 342 aa, Homo sapiens
MCDDEETTALVCDNGSGLVKAGFAGDDAPRAVFPSIVGRPRHQGVMVGMGQKDSYVGDEAQSKRGILTLKYPIEHGIITKANREKMTQIMFETFNVPAMYVAIQAVLSLYASGRTTGIVLDSGDGVTHNVPIYEGYALPHAIMRLDLAGRDLTDYLMKILTERGYSFVTTAEREIVRDIKEKLCYVALDFENEMATAASSSSLEKSYELPDGQVITIGNERFRCPETLFQPSFIGMESAGIHETTYNSIMKCDIDIRKDLYANNVLSGGTTMYPGIADRMQKEITALAPSTMKIKIIAPPERKYSVWIGGSILASLSTFQQMWISKQEYDEAGPSIVHRKCF

SEQ ID NO: 892 - protein, 294 aa, Homo sapiens
MEKIWHHTFYNELRVAPEEHPVLLTEAPLNPKANREKMTQIMFETFNTPAMYVAIQAVLSLYASGRTTGIVMDSGDGVTHTVPIYEGYALPHAILRLDLAGRDLTDYLMKILTERGYSFTTTAEREIVRDIKEKLCYVALDFEQEMATAASSSSLEKSYELPDGQVITIGNERFRCPEALFQPSFLGMESCGIHETTFNSIMKCDVDIRKDLYANTVLSGGTTMYPGIADRMQKEITALAPSTMKIKIIAPPERKYSVWIGGSILASLSTFQQMWISKQEYDESGPSIVHRKCF

SEQ ID NO: 893 - protein, 375 aa, Homo sapiens
MDDDIAALVVDNGSGMCKAGFAGDDAPRAVFPSIVGRPRHQGVMVGMGQKDSYVGDEAQSKRGILTLKYPIEHGIVTNWDDMEKIWHHTFYNELRVAPEEHPVLLTEAPLNPKANREKMTQIMFETFNTPAMYVAIQAVLSLYASGRTTGIVMDSGDGVTHTVPIYEGYALPHAILRLDLAGRDLTDYLMKILTERGYSFTTTAEREIVRDIKEKLCYVALDFEQEMATAASSSSLEKSYELPDGQVITIGNERFRCPEALFQPSFLGMESCGIHETTFNSIMKCDVDIRKDLYANTVLSGGTTMYPGIADRMQKEITALAPSTMKIKIIAPPERKYSVWIGGSILASLSTFQQMWISKQEYDESGPSIVHRKCF

SEQ ID NO: 894 - protein, 347 aa, Homo sapiens
MDDDIAALVVDNGSGMCKAGFAGDDAPRAVFPSIVGRPRHQGVMVGIVTNWDDMEKIWHHTFYNELRVAPEEHPVLLTEAPLNPKANREKMTQIMFETFNTPAMYVAIQAVLSLYASGRTTGIVMDSGDGVTHTVPIYEGYALPHAILRLDLAGRDLTDYLMKILTERGYSFTTTAEREIVRDIKEKLCYVALDFEQEMATAASSSSLEKSYELPDGQVITIGNERFRCPEALFQPSFLGMESCGIHETTFNSIMKCDVDIRKDLYANTVLSGGTTMYPGIADRMQKEITALAPSTMKIKIIAPPERKYSVWIGGSILASLSTFQQMWISKQEYDESGPSIVHRKCF

SEQ ID NO: 895 - protein, 80 aa, Homo sapiens
MDDDIAALVVDNGSGMCKAGFAGDDAPRAVFPSIVGRPRHQGVMVGMGQKDSYVGDEAQSKRGILTLKYPIEHGIVTNWD

SEQ ID NO: 896 - protein, 99 aa, Homo sapiens
MLTMDDDIAALVVDNGSGMCKAGFAGDDAPRAVFPSIVGRPRHQGVMVGMGQKDSYVGDEAQSKRGILTLKYPIEHGIVTNWDDMEKIWHHTFYNELRV

SEQ ID NO: 897 - protein, 164 aa, Homo sapiens
MDDDIAALVVDNGSGMCKAGFAGDDAPRAVFPSIVGRPRHQGVMVGMGQKDSYVGDEAQSKRGILTLKYPIEHGIVTNWDDMEKIWHHTFYNELRVAPEEHPVLLTEAPLNPKANREKMTQIMFETFNTPAMYVAIQAVLSLYASGRTTGIVMDSGDGVTHTVP

SEQ ID NO: 898 - protein, 103 aa, Homo sapiens
MDDDIAALVVDNGSGMCKAGFAGDDAPRAVFPSIVGRPRHQGVMVGMGQKDSYVGDEAQSKRGILTLKYPIEHGIVTNWDDMEKIWHHTFYNELRVAPEEHPV

SEQ ID NO: 899 - protein, 351 aa, Homo sapiens
MDDDIAALVVDNGSGMCKAGFAGDDAPRAVFPSIVGRPRHQGVMVGMGQKDSYVGDEAQSKRGILTLKYPIEHGIVTNWDDMEKIWHHTFYNELRVAPEEHPVLLTEAPLNPKANREKMTQIMFETFNTPAMYVAIQAVLSLYASGRTTAILRLDLAGRDLTDYLMKILTERGYSFTTTAEREIVRDIKEKLCYVALDFEQEMATAASSSSLEKSYELPDGQVITIGNERFRCPEALFQPSFLGMESCGIHETTFNSIMKCDVDIRKDLYANTVLSGGTTMYPGIADRMQKEITALAPSTMKIKIIAPPERKYSVWIGGSILASLSTFQQMWISKQEYDESGPSIVHRKCF

SEQ ID NO: 900 - protein, 376 aa, Homo sapiens
MTDNELSALVVDNGSGMCKAGFGGDDAPRAVFPSMIGRPRHQGVMVGMGQKDCYVGDEAQSKRGVLTLKYPIEHGVVTNWDDMEKIWYHTFYNELRVAPDEHPILLTEAPLNPKINREKMTQIMFEAFNTPAMYVAIQAVLSLYASGRTTGIVMDSGDGVTHIVPIYEGYALPHAILRLDLAGRDLTDYLMKILTERGYNFTTTAEREIVRDVKEKLCYVALDFEQEMVRAAASSSPERSYELPDGQVITIGNERFRCPEAIFQPSFLGIESSGIHETTFNSIMKCDVDIRKDLYANTVLSGGSTMYPGIADRMQKEIITLAPSTMKIKIIAPPERKYSVWIGGSILASLSTFQQMWISKQEYDEAGPPIVHRKCF

SEQ ID NO: 901 - protein, 375 aa, Homo sapiens; identical to SEQ ID NO: 884

SEQ ID NO: 902 - protein, 333 aa, Homo sapiens
MEEEIAALVIDNGSGMCKAGFAGDDAPRAVFPSIVGRPRHQGVMVGMGQKDSYVGDEAQSKRGILTLKYPIEHGIVTNWDDMEKIWHHTFYNELRVAPEEHPVLLTEAPLNPKANREKMTQIMFETYALPHAILRLDLAGRDLTDYLMKILTERGYSFTTTAEREIVRDIKEKLCYVALDFEQEMATAASSSSLEKSYELPDGQVITIGNERFRCPEALFQPSFLGMESCGIHETTFNSIMKCDVDIRKDLYANTVLSGGTTMYPGIADRMQKEITALAPSTMKIKIIAPPERKYSVWIGGSILASLSTFQQMWISKQEYDESGPSIVHRKCF

SEQ ID NO: 903 - protein, 376 aa, Homo sapiens
MCEEETTALVCDNGSGLCKAGFAGDDAPRAVFPSIVGRPRHQGVMVGMGQKDSYVGDEAQSKRGILTLKYPIEHGIITNWDDMEKIWHHSFYNELRVAPEEHPTLLTEAPLNPKANREKMTQIMFETFNVPAMYVAIQAVLSLYASGRTTGIVLDSGDGVTHNVPIYEGYALPHAIMRLDLAGRDLTDYLMKILTERGYSFVTTAEREIVRDIKEKLCYVALDFENEMATAASSSSLEKSYELPDGQVITIGNERFRCPETLFQPSFIGMESAGIHETTYNSIMKCDIDIRKDLYANNVLSGGTTMYPGIADRMQKEITALAPSTMKIKIIAPPERKYSVWIGGSILASLSTFQQMWISKPEYDEAGPSIVHRKCF

SEQ ID NO: 904 - protein, 376 aa, Homo sapiens; identical to SEQ ID NO: 903

SEQ ID NO: 905 - protein, 387 aa, Homo sapiens
MVVERDDGSTLMEIDGDKGKQGGPTYYIDTNALRVPRENMEAISPLKNGMVEDWDSFQAILDHTYKMHVKSEASLHPVLMSEAPWNTRAKREKLTELMFEHYNIPAFFLCKTAVLTAFANGRSTGLILDSGATHTTAIPVHDGYVLQQGIVKSPLAGDFITMQCRELFQEMNIELVPPYMIASKEAVREGSPANWKRKEKLPQVTRSWHNYMCNCVIQDFQASVLQVSDSTYDEQVAAQMPTVHYEFPNGYNCDFGAERLKIPEGLFDPSNVKGLSGNTMLGVSHVVTTSVGMCDIDIRPGLYGSVIVAGGNTLIQSFTDRLNRELSQKTPPSMRLKLIANNTTVERRFSSWIGGSILASLGTFQQMWISKQEYEEGGKQCVERKCP

SEQ ID NO: 906 - protein, 429 aa, Homo sapiens
MSGGVYGGDEVGALVFDIGSYTVRAGYAGEDCPKVDFPTAIGMVVERDDGSTLMEIDGDKGKQGGPTYYIDTNALRVPRENMEAISPLKNGMVEDWDSFQAILDHTYKMHVKSEASLHPVLMSEAPWNTRAKREKLTELMFEHYNIPAFFLCKTAVLTAFANGRSTGLILDSGATHTTAIPVHDGYVLQQGIVKSPLAGDFITMQCRELFQEMNIELVPPYMIASKEAVREGSPANWKRKEKLPQVTRSWHNYMCNCVIQDFQASVLQVSDSTYDEQVAAQMPTVHYEFPNGYNCDFGAERLKIPEGLFDPSNVKGLSGNTMLGVSHVVTTSVGMCDIDIRPGLYGSVIVAGGNTLIQSFTDRLNRELSQKTPPSMRLKLIANNTTVERRFSSWIGGSILASLGTFQQMWISKQEYEEGGKQCVERKCP

SEQ ID NO: 907 - protein, 387 aa, Homo sapiens; identical to SEQ ID NO: 905

SEQ ID NO: 908 - protein, 50 aa, Homo sapiens
MVVERDDGSTLMEIDGDKGKQGGPTYYIDTNALRVPRENMEAISPLKNGM

SEQ ID NO: 909 - protein, 426 aa, Homo sapiens
MSGGVYGGDEVGALVFDIGSFSVRAGYAGEDCPKADFPTTVGLLAAEEGGGLELEGDKEKKGKIFHIDTNALHVPRDGAEVMSPLKNGMIEDWECFRAILDHTYSKHVKSEPNLHPVLMSEAPWNTRAKREKLTELMFEQYNIPAFFLCKTAVLTAFANGRSTGLVLDSGATHTTAIPVHDGYVLQQGIVKSPLAGDFISMQCRELFQEMAIDIIPPYMIAAKEPVREGAPPNWKKKEKLPQVSKSWHNYMCNEVIQDFQASVLQVSDSPYDEQVAAQMPTVHYEMPNGYNTDYGAERLRIPEGLFDPSNVKGLSGNTMLGVGHVVTTSIGMCDIDIRPGLYGSVIVTGGNTLLQGFTDRLNRELSQKTPPSMRLKLIASNSTMERKFSPWIGGSILASLGTFQQMWISKQEYEEGGKQCVERKCP

SEQ ID NO: 910 - protein, 435 aa, Homo sapiens
MWAPPAAIMGDGPTKKVGNQAPLQTQALQTASLRDGPAKRAVWVRHTSSEPQEPTESKAAKERPKQEVTKAVVVDLGTGYCKCGFAGLPRPTHKISTTVGKPYMETAKTGDNRKETFVGQELNNTNVHLKLVNPLRHGIIVDWDTVQDIWEYLFRQEMKIAPEEHAVLVSDPPLSPHTNREKYAEMLFEAFNTPAMHIAYQSRLSMYSYGRTSGLVVEVGHGVSYVVPIYEGYPLPSITGRLDYAGSDLTAYLLGLLNSAGNEFTQDQMGIVEDIKKKCCFVALDPIEEKKVPLSEHTIRYVLPDGKEIQLCQERFLCSEMFFKPSLIKSMQLGLHTQTVSCLNKCDIALKRDLMGNILLCGGSTMLSGFPNRLQKELSSMCPNDTPQVNVLPERDSAVWTGGSILASLQGFQPLWVHRFEYEEHGPFFLYRRCF

SEQ ID NO: 911 - protein, 415 aa, Homo sapiens
MATRNSPMPLGTAQGDPGEAGTRPGPDASLRDTGAATQLKMKPRKVHKIKAVIIDLGSQYCKCGYAGEPRPTYFISSTVGKRCPEAADAGDTRKWTLVGHELLNTEAPLKLVNPLKHGIVVDWDCVQDIWEYIFRTAMKILPEEHAVLVSDPPLSPSSNREKYAELMFETFGIPAMHVTSQSLLSIYSYGKTSGLVVESGHGVSHVVPISEGDVLPGLTSRADYAGGDLTNYLMQLLNEAGHAFTDDHLHIIEHIKKKCCYAAFLPEEELGLVPEELRVDYELPDGKLITIGQERFRCSEMLFQPSLAGSTQPGLPELTAACLGRCQDTGFKEEMAANVLLCGGCTMLDGFPERFQRELSLLCPGDSPAVAAAPERKTSVWTGGSILASLQAFQQLWVSKEEFEERGSVAIYSKC

SEQ ID NO: 912 - protein, 366 aa, Homo sapiens
MAARTVIIDHGSGFLKAGTAGWNEPQMVFPNIVNYLPCKENPGPSYARRRVSLGIDICHPDTFSYPIERGRILNWEGVQYLWSFVLENHRREQEVPPVIITETPLREPADRKKMLEILFELLHVPSVLLADQLQMSLYASGLLTGVVVDSGYGLTRVQPFHQGRPLPASGKTLEFAGQDLSAYLLKSLFKEDCDRRCLFQLETVAVTQMNKCYVPQNLGEALDFRERQQSALDESNTYQLPDGSRVELTPMQRVAPEMFFSPQVFEQPGPSIPRAIVESVESCEISLRPLLVSHVMACGGNTLYPGFTKRLFRELMGDHVSSTKATVWEGSNRNFSVWLGASVVAHLSTYQSEWMSREEYGEHMRM

SEQ ID NO: 913 - protein, 416 aa, Homo sapiens
MDASRPKSSESQSSLEAPRPGPNPSPNVVNKPLQRDFPGMVADRLPPKTGVVVIDMGTGTCKVGFAGQASPTYTVATILGCQPKKPATSGQSGLQTFIGEAARVLPELTLVQPLRSGIVVDWDAAELIWRHLLEHDLRVATHDHPLLFSDPPFSPATNREKLVEVAFESLRSPAMYVASQSVLSVYAHGRVSGLVVDTGHGVTYTVPVFQGYNLLHATERLDLAGNHLTAFLAEMLLQAGLPLGQQDLDLVENIKHHYCYVASDFQKEQARPEQEYKRTLKLPDGRTVTLGKELFQCPELLFNPPEVPGLSPVGLSTMAKQSLRKLSLEMRADLAQNVLLCGGSSLFTGFEGRFRAELLRALPAETHVVVAAQPTRNFSVWIGGSILASLRAFQSCWVLREQYEEQGPYIVYRKCY

SEQ ID NO: 914 - protein, 920 aa, Homo sapiens
MEVQLGLGRVYPRPPSKTYRGAFQNLFQSVREVIQNPGPRHPEAASAAPPGASLLLLQQQQQQQQQQQQQQQQQQQQQQQETSPRQQQQQQGEDGSPQAHRRGPTGYLVLDEEQQPSQPQSALECHPERGCVPEPGAAVAASKGLPQQLPAPPDEDDSAAPSTLSLLGPTFPGLSSCSADLKDILSEASTMQLLQQQQQEAVSEGSSSGRAREASGAPTSSKDNYLGGTSTISDNAKELCKAVSVSMGLGVEALEHLSPGEQLRGDCMYAPLLGVPPAVRPTPCAPLAECKGSLLDDSAGKSTEDTAEYSPFKGGYTKGLEGESLGCSGSAAAGSSGTLELPSTLSLYKSGALDEAAAYQSRDYYNFPLALAGPPPPPPPPHPHARIKLENPLDYGSAWAAAAAQCRYGDLASLHGAGAAGPGSGSPSAAASSSWHTLFTAEEGQLYGPCGGGGGGGGGGGGGGGGGGGGGGGEAGAVAPYGYTRPPQGLAGQESDFTAPDVWYPGGMVSRVPYPSPTCVKSEMGPWMDSYSGPYGDMRLETARDHVLPIDYYFPPQKTCLICGDEASGCHYGALTCGSCKVFFKRAAEGKQKYLCASRNDCTIDKFRRKNCPSCRLRKCYEAGMTLGARKLKKLGNLKLQEEGEASSTTSPTEETTQKLTVSHIEGYECQPIFLNVLEAIEPGVVCAGHDNNQPDSFAALLSSLNELGERQLVHVVKWAKALPGFRNLHVDDQMAVIQYSWMGLMVFAMGWRSFTNVNSRMLYFAPDLVFNEYRMHKSRMYSQCVRMRHLSQEFGWLQITPQEFLCMKALLLFSIIPVDGLKNQKFFDELRMNYIKELDRIIACKRKNPTSCSRRFYQLTKLLDSVQPIARELHQFTFDLLIKSHMVSVDFPEMMAEIISVQVPKILSGKVKPIYFHTQ

SEQ ID NO: 915 - protein, 388 aa, Homo sapiens
MILWLHSLETARDHVLPIDYYFPPQKTCLICGDEASGCHYGALTCGSCKVFFKRAAEGKQKYLCASRNDCTIDKFRRKNCPSCRLRKCYEAGMTLGARKLKKLGNLKLQEEGEASSTTSPTEETTQKLTVSHIEGYECQPIFLNVLEAIEPGVVCAGHDNNQPDSFAALLSSLNELGERQLVHVVKWAKALPGFRNLHVDDQMAVIQYSWMGLMVFAMGWRSFTNVNSRMLYFAPDLVFNEYRMHKSRMYSQCVRMRHLSQEFGWLQITPQEFLCMKALLLFSIIPVDGLKNQKFFDELRMNYIKELDRIIACKRKNPTSCSRRFYQLTKLLDSVQPIARELHQFTFDLLIKSHMVSVDFPEMMAEIISVQVPKILSGKVKPIYFHTQ

SEQ ID NO: 916 - protein, 734 aa, Homo sapiens
MEVQLGLGRVYPRPPSKTYRGAFQNLFQSVREVIQNPGPRHPEAASAAPPGASLLLLQQQQQQQQQQQQQQQQQQQQQQQETSPRQQQQQQGEDGSPQAHRRGPTGYLVLDEEQQPSQPQSALECHPERGCVPEPGAAVAASKGLPQQLPAPPDEDDSAAPSTLSLLGPTFPGLSSCSADLKDILSEASTMQLLQQQQQEAVSEGSSSGRAREASGAPTSSKDNYLGGTSTISDNAKELCKAVSVSMGLGVEALEHLSPGEQLRGDCMYAPLLGVPPAVRPTPCAPLAECKGSLLDDSAGKSTEDTAEYSPFKGGYTKGLEGESLGCSGSAAAGSSGTLELPSTLSLYKSGALDEAAAYQSRDYYNFPLALAGPPPPPPPPHPHARIKLENPLDYGSAWAAAAAQCRYGDLASLHGAGAAGPGSGSPSAAASSSWHTLFTAEEGQLYGPCGGGGGGGGGGGGGGGGGGGGGGGEAGAVAPYGYTRPPQGLAGQESDFTAPDVWYPGGMVSRVPYPSPTCVKSEMGPWMDSYSGPYGDMRLETARDHVLPIDYYFPPQKTCLICGDEASGCHYGALTCGSCKVFFKRAAEGKQKYLCASRNDCTIDKFRRKNCPSCRLRKCYEAGMTLGARKLKKLGNLKLQEEGEASSTTSPTEETTQKLTVSHIEGYECQPIFLNVLEAIEPGVVCAGHDNNQPDSFAALLSSLNELGERQLVHVVKWAKALPDCERAASVHF

SEQ ID NO: 917 - protein, 531 aa, Homo sapiens
MEVQLGLGRVYPRPPSKTYRGAFQNLFQSVREVIQNPGPRHPEAASAAPPGASLLLLQQQQQQQQQQQQQQQETSPRQQQQQQGEDGSPQAHRRGPTGYLVLDEEQQPSQPQSALECHPERGCVPEPGAAVAASKGLPQQLPAPPDEDDSAAPSTLSLLGPTFPGLSSCSADLKDILSEASTMQLLQQQQQEAVSEGSSSGRAREASGAPTSSKDNYLGGTSTISDNAKELCKAVSVSMGLGVEALEHLSPGEQLRGDCMYAPLLGVPPAVRPTPCAPLAECKGSLLDDSAGKSTEDTAEYSPFKGGYTKGLEGESLGCSGSAAAGSSGTLELPSTLSLYKSGALDEAAAYQSRDYYNFPLALAGPPPPPPPPHPHARIKLENPLDYGSAWAAAAAQCRYGDLASLHGAGAAGPGSGSPSAAASSSWHTLFTAEEGQLYGPCGGGGGGGGGGGGGGGGGGGGGGGEAGAVAPYGYTRPPQGLAGQESDFTAPDVWYPGGMVSRVPYPSPTCVKSEMGPWMDSYSGPYGDMR

SEQ ID NO: 918 - protein, 738 aa, Homo sapiens
MQLLQQQQQEAVSEGSSSGRAREASGAPTSSKDNYLGGTSTISDNAKELCKAVSVSMGLGVEALEHLSPGEQLRGDCMYAPLLGVPPAVRPTPCAPLAECKGSLLDDSAGKSTEDTAEYSPFKGGYTKGLEGESLGCSGSAAAGSSGTLELPSTLSLYKSGALDEAAAYQSRDYYNFPLALAGPPPPPPPPHPHARIKLENPLDYGSAWAAAAAQCRYGDLASLHGAGAAGPGSGSPSAAASSSWHTLFTAEEGQLYGPCGGGGGGGGGGGGGGGGGGGGGGGEAGAVAPYGYTRPPQGLAGQESDFTAPDVWYPGGMVSRVPYPSPTCVKSEMGPWMDSYSGPYGDMRLETARDHVLPIDYYFPPQKTCLICGDEASGCHYGALTCGSCKVFFKRAAEGKQKYLCASRNDCTIDKFRRKNCPSCRLRKCYEAGMTLGARKLKKLGNLKLQEEGEASSTTSPTEETTQKLTVSHIEGYECQPIFLNVLEAIEPGVVCAGHDNNQPDSFAALLSSLNELGERQLVHVVKWAKALPGFRNLHVDDQMAVIQYSWMGLMVFAMGWRSFTNVNSRMLYFAPDLVFNEYRMHKSRMYSQCVRMRHLSQEFGWLQITPQEFLCMKALLLFSITFCLHPTSVPVDGLKNQKFFDELRMNYIKELDRIIACKRKNPTSCSRRFYQLTKLLDSVQPIARELHQFTFDLLIKSHMVSVDFPEMMAEIISVQVPKILSGKVKPIYFHTQ

SEQ ID NO: 919 - protein, 1429 aa, Homo sapiens
MVAAAAATEARLRRRTAATAALAGRSGGPHWDWDVTRAGRPGLGAGLRLPRLLSPPLRPRLLLLLLLLSPPLLLLLLPCEAEAAAAAAAVSGSAAAEAKECDRPCVNGGRCNPGTGQCVCPAGWVGEQCQHCGGRFRLTGSSGFVTDGPGNYKYKTKCTWLIEGQPNRIMRLRFNHFATECSWDHLYVYDGDSIYAPLVAAFSGLIVPERDGNETVPEVVATSGYALLHFFSDAAYNLTGFNITYSFDMCPNNCSGRGECKISNSSDTVECECSENWKGEACDIPHCTDNCGFPHRGICNSSDVRGCSCFSDWQGPGCSVPVPANQSFWTREEYSNLKLPRASHKAVVNGNIMWVVGGYMFNHSDYNMVLAYDLASREWLPLNRSVNNVVVRYGHSLALYKDKIYMYGGKIDSTGNVTNELRVFHIHNESWVLLTPKAKEQYAVVGHSAHIVTLKNGRVVMLVIFGHCPLYGYISNVQEYDLDKNTWSILHTQGALVQGGYGHSSVYDHRTRALYVHGGYKAFSANKYRLADDLYRYDVDTQMWTILKDSRFFRYLHTAVIVSGTMLVFGGNTHNDTSMSHGAKCFSSDFMAYDIACDRWSVLPRPDLHHDVNRFGHSAVLHNSTMYVFGGFNSLLLSDILVFTSEQCDAHRSEAACLAAGPGIRCVWNTGSSQCISWALATDEQEEKLKSECFSKRTLDHDRCDQHTDCYSCTANTNDCHWCNDHCVPRNHSCSEGQISIFRYENCPKDNPMYYCNKKTSCRSCALDQNCQWEPRNQECIALPENICGIGWHLVGNSCLKITTAKENYDNAKLFCRNHNALLASLTTQKKVEFVLKQLRIMQSSQSMSKLTLTPWVGLRKINVSYWCWEDMSPFTNSLLQWMPSEPSDAGFCGILSEPSTRGLKAATCINPLNGSVCERPANHSAKQCRTPCALRTACGDCTSGSSECMWCSNMKQCVDSNAYVASFPFGQCMEWYTMSTCPPENCSGYCTCSHCLEQPGCGWCTDPSNTGKGKCIEGSYKGPVKMPSQAPTGNFYPQPLLNSSMCLEDSRYNWSFIHCPACQCNGHSKCINQSICEKCENLTTGKHCETCISGFYGDPTNGGKCQPCKCNGHASLCNTNTGKCFCTTKGVKGDECQLCEVENRYQGNPLRGTCYYTLLIDYQFTFSLSQEDDRYYTAINFVATPDEQNRDLDMFINASKNFNLNITWAASFSAGTQAGEEMPVVSKTNIKEYKDSFSNEKFDFRNHPNITFFVYVSNFTWPIKIQIAFSQHSNFMDLVQFFVTFFSCFLSLLLVAAVVWKIKQSCWASRRREQLLREMQQMASRPFASVNVALETDEEPPDLIGGSIKTVPKPIALEPCFGNKAAVLSVFVRLPRGLGGIPPPGQSGLAVASALVDISQQMPIVYKEKSGAVRNRKQQPPAQPGTCI

SEQ ID NO: 920 - protein, 1193 aa, Homo sapiens
MVAAAAATEARLRRRTAATAALAGRSGGPHCVNGGRCNPGTGQCVCPAGWVGEQCQHCGGRFRLTGSSGFVTDGPGNYKYKTKCTWLIEGQPNRIMRLRFNHFATECSWDHLYVYDGDSIYAPLVAAFSGLIVPERDGNETVPEVVATSGYALLHFFSDAAYNLTGFNITYSFDMCPNNCSGRGECKISNSSDTVECECSENWKGEACDIPHCTDNCGFPHRGICNSSDVRGCSCFSDWQGPGCSVPVPANQSFWTREEYSNLKLPRASHKAVVNGNIMWVVGGYMFNHSDYNMVLAYDLASREWLPLNRSVNNVVVRYGHSLALYKDKIYMYGGKIDSTGNVTNELRVFHIHNESWVLLTPKAKEQYAVVGHSAHIVTLKNGRVVMLVIFGHCPLYGYISNVQEYDLDKNTWSILHTQGALVQGGYGHSSVYDHRTRALYVHGGYKAFSANKYRLADDLYRYDVDTQMWTILKDSRFFRYLHTAVIVSGTMLVFGGNTHNDTSMSHGAKCFSSDFMAYDIACDRWSVLPRPDLHHDVNRFGHSAVLHNSTMYVFGGFNSLLLSDILVFTSEQCDAHRSEAACLAAGPGIRCVWNTGSSQCISWALATDEQEEKLKSECFSKRTLDHDRCDQHTDCYSCTANTNDCHWCNDHCVPRNHSCSEGQISIFRYENCPKDNPMYYCNKKTSCRSCALDQNCQWEPRNQECIALPENICGIGWHLVGNSCLKITTAKENYDNAKLFCRNHNALLASLTTQKKVEFVLKQLRIMQSSQSMSKLTLTPWVGLRKINVSYWCWEDMSPFTNSLLQWMPSEPSDAGFCGILSEPSTRGLKAATCINPLNGSVCERPANHSAKQCRTPCALRTACGDCTSGSSECMWCSNMKQCVDSNAYVASFPFGQCMEWYTMSTCPPENCSGYCTCSHCLEQPGCGWCTDPSNTGKGKCIEGSYKGPVKMPSQAPTGNFYPQPLLNSSMCLEDSRYNWSFIHCPACQCNGHSKCINQSICEKCENLTTGKHCETCISGFYGDPTNGGKCQPCKCNGHASLCNTNTGKCFCTTKGVKGDECQLCEVENRYQGNPLRGTCYYTLLIDYQFTFSLSQEDDRYYTAINFVATPDEQNRDLDMFINASKNFNLNITWAASFSAGTQAGEEMPVVSKTNIKEYKDSFSNEKFDFRNHPNITFFVYVSNFTWPIKIQ

SEQ ID NO: 921 - protein, 1272 aa, Homo sapiens
MVAAAAATEARLRRRTAATAALAGRSGGPHWDWDVTRAGRPGLGAGLRLPRLLSPPLRPRLLLLLLLLSPPLLLLLLPCEAEAAAAAAAVSGSAAAEAKECDRPCVNGGRCNPGTGQCVCPAGWVGEQCQHCGGRFRLTGSSGFVTDGPGNYKYKTKCTWLIEGQPNRIMRLRFNHFATECSWDHLYVYDGDSIYAPLVAAFSGLIVPERDGNETVPEVVATSGYALLHFFSDAAYNLTGFNITYSFDMCPNNCSGRGECKISNSSDTVECECSENWKGEACDIPHCTDNCGFPHRGICNSSDVRGCSCFSDWQGPGCSVPVPANQSFWTREEYSNLKLPRASHKAVVNGNIMWVVGGYMFNHSDYNMVLAYDLASREWLPLNRSVNNVVVRYGHSLALYKDKIYMYGGKIDSTGNVTNELRVFHIHNESWVLLTPKAKEQYAVVGHSAHIVTLKNGRVVMLVIFGHCPLYGYISNVQEYDLDKNTWSILHTQGALVQGGYGHSSVYDHRTRALYVHGGYKAFSANKYRLADDLYRYDVDTQMWTILKDSRFFRYLHTAVIVSGTMLVFGGNTHNDTSMSHGAKCFSSDFMAYDIACDRWSVLPRPDLHHDVNRFGHSAVLHNSTMYVFGGFNSLLLSDILVFTSEQCDAHRSEAACLAAGPGIRCVWNTGSSQCISWALATDEQEEKLKSECFSKRTLDHDRCDQHTDCYSCTANTNDCHWCNDHCVPRNHSCSEGQISIFRYENCPKDNPMYYCNKKTSCRSCALDQNCQWEPRNQECIALPENICGIGWHLVGNSCLKITTAKENYDNAKLFCRNHNALLASLTTQKKVEFVLKQLRIMQSSQSMSKLTLTPWVGLRKINVSYWCWEDMSPFTNSLLQWMPSEPSDAGFCGILSEPSTRGLKAATCINPLNGSVCERPANHSAKQCRTPCALRTACGDCTSGSSECMWCSNMKQCVDSNAYVASFPFGQCMEWYTMSTCPPENCSGYCTCSHCLEQPGCGWCTDPSNTGKGKCIEGSYKGPVKMPSQAPTGNFYPQPLLNSSMCLEDSRYNWSFIHCPACQCNGHSKCINQSICEKCENLTTGKHCETCISGFYGDPTNGGKCQPCKCNGHASLCNTNTGKCFCTTKGVKGDECQLCEVENRYQGNPLRGTCYYTLLIDYQFTFSLSQEDDRYYTAINFVATPDEQNRDLDMFINASKNFNLNITWAASFSAGTQAGEEMPVVSKTNIKEYKDSFSNEKFDFRNHPNITFFVYVSNFTWPIKIQVQTEQ

SEQ ID NO: 922 - protein, 255 aa, Homo sapiens
MFHQVRRVMTILFLTMVISYFGCMKAAPMKEANIRGQGGLAYPGVRTHGTLESVNGPKAGSRGLTSLADTFEHVIEELLDEDQKVRPNEENNKDADLYTSRVMLSSQVPLEPPLLFLLEEYKNYLDAANMSMRVRRHSDPARRGELSVCDSISEWVTAADKKTAVDMSGGTVTVLEKVPVSKGQLKQYFYETKCNPMGYTKEGCRGIDKRHWNSQCRTTQSYVRALTMDSKKRIGWRFIRIDTSCVCTLTIKRGR

SEQ ID NO: 923 - protein, 247 aa, Homo sapiens
MTILFLTMVISYFGCMKAAPMKEANIRGQGGLAYPGVRTHGTLESVNGPKAGSRGLTSLADTFEHVIEELLDEDQKVRPNEENNKDADLYTSRVMLSSQVPLEPPLLFLLEEYKNYLDAANMSMRVRRHSDPARRGELSVCDSISEWVTAADKKTAVDMSGGTVTVLEKVPVSKGQLKQYFYETKCNPMGYTKEGCRGIDKRHWNSQCRTTQSYVRALTMDSKKRIGWRFIRIDTSCVCTLTIKRGR

SEQ ID NO: 924 - protein, 247 aa, Homo sapiens; identical to SEQ ID NO: 923

SEQ ID NO: 925 - protein, 247 aa, Homo sapiens; identical to SEQ ID NO: 923

SEQ ID NO: 926 - protein, 247 aa, Homo sapiens; identical to SEQ ID NO: 923

SEQ ID NO: 927 - protein, 247 aa, Homo sapiens; identical to SEQ ID NO: 923

SEQ ID NO: 928 - protein, 262 aa, Homo sapiens
MQSREEEWFHQVRRVMTILFLTMVISYFGCMKAAPMKEANIRGQGGLAYPGVRTHGTLESVNGPKAGSRGLTSLADTFEHVIEELLDEDQKVRPNEENNKDADLYTSRVMLSSQVPLEPPLLFLLEEYKNYLDAANMSMRVRRHSDPARRGELSVCDSISEWVTAADKKTAVDMSGGTVTVLEKVPVSKGQLKQYFYETKCNPMGYTKEGCRGIDKRHWNSQCRTTQSYVRALTMDSKKRIGWRFIRIDTSCVCTLTIKRGR

SEQ ID NO: 929 - protein, 247 aa, Homo sapiens; identical to SEQ ID NO: 923

SEQ ID NO: 930 - protein, 247 aa, Homo sapiens; identical to SEQ ID NO: 923

SEQ ID NO: 931 - protein, 329 aa, Homo sapiens
MCGATSFLHECTRLILVTTQNAEFLQKGLQVHTCFGVYPHASVWHDCASQKKGCAVYLHVSVEFNKLIPENGFIKFHQVRRVMTILFLTMVISYFGCMKAAPMKEANIRGQGGLAYPGVRTHGTLESVNGPKAGSRGLTSLADTFEHVIEELLDEDQKVRPNEENNKDADLYTSRVMLSSQVPLEPPLLFLLEEYKNYLDAANMSMRVRRHSDPARRGELSVCDSISEWVTAADKKTAVDMSGGTVTVLEKVPVSKGQLKQYFYETKCNPMGYTKEGCRGIDKRHWNSQCRTTQSYVRALTMDSKKRIGWRFIRIDTSCVCTLTIKRGR

SEQ ID NO: 932 - protein, 247 aa, Homo sapiens; identical to SEQ ID NO: 923

SEQ ID NO: 933 - protein, 247 aa, Homo sapiens; identical to SEQ ID NO: 923

SEQ ID NO: 934 - protein, 247 aa, Homo sapiens; identical to SEQ ID NO: 923

SEQ ID NO: 935 - protein, 247 aa, Homo sapiens; identical to SEQ ID NO: 923

SEQ ID NO: 936 - protein, 247 aa, Homo sapiens; identical to SEQ ID NO: 923

SEQ ID NO: 937 - protein, 247 aa, Homo sapiens; identical to SEQ ID NO: 923

SEQ ID NO: 938 - protein, 247 aa, Homo sapiens; identical to SEQ ID NO: 923

SEQ ID NO: 939 - protein, 77 aa, Homo sapiens
MCGATSFLHECTRLILVTTQNAEFLQKGLQVHTCFGVYPHASVWHDCASQKKGCAVYLHVSVEFNKLIPENGFIKGW

SEQ ID NO: 940 - protein, 297 aa, Homo sapiens
MSSAHFNRGPAYGLSAEVKNKLAQKYDHQREQELREWIEGVTGRRIGNNFMDGLKDGIILCEFINKLQPGSVKKINESTQNWHQLENIGNFIKAITKYGVKPHDIFEANDLFENTNHTQVQSTLLALASMAKTKGNKVNVGVKYAEKQERKFEPGKLREGRNIIGLQMGTNKFASQQGMTAYGTRRHLYDPKLGTDQPLDQATISLQMGTNKGASQAGMTAPGTKRQIFEPGLGMEHCDTLNVSLQMGSNKGASQRGMTVYGLPRQVYDPKYCLTPEYPELGEPAHNHHAHNYYNSA

SEQ ID NO: 941 - protein, 247 aa, Homo sapiens
MDGLKDGIILCEFINKLQPGSVKKINESTQNWHQLENIGNFIKAITKYGVKPHDIFEANDLFENTNHTQVQSTLLALASMAKTKGNKVNVGVKYAEKQERKFEPGKLREGRNIIGLQMGTNKFASQQGMTAYGTRRHLYDPKLGTDQPLDQATISLQMGTNKGASQAGMTAPGTKRQIFEPGLGMEHCDTLNVSLQMGSNKGASQRGMTVYGLPRQVYDPKYCLTPEYPELGEPAHNHHAHNYYNSA

SEQ ID NO: 942 - protein, 277 aa, Homo sapiens
MLAQKYDHQREQELREWIEGVTGRRIGNNFMDGLKDGIILCEFINKLQPGSVKKINESTQNWHQLENIGNFIKAITKYGVKPHDIFEANDLFENTNHTQVQSTLLALASMAKTKGNKVNVGVKYAEKQERKFEPGKLREGRNIIGLQMGTNKFASQQGMTAYGTRRHLYDPKLGTDQPLDQATISLQMGTNKGASQAGMTAPGTKRQIFEPGLGMEHCDTLNVSLQMGSNKGASQRGMTVYGLPRQVYDPKYCLTPEYPELGEPAHNHHAHNYYNSA

SEQ ID NO: 943 - protein, 309 aa, Homo sapiens
MSSTQFNKGPSYGLSAEVKNRLLSKYDPQKEAELRTWIEGLTGLSIGPDFQKGLKDGTILCTLMNKLQPGSVPKINRSMQNWHQLENLSNFIKAMVSYGMNPVDLFEANDLFESGNMTQVQVSLLALAGKAKTKGLQSGVDIGVKYSEKQERNFDDATMKAGQCVIGLQMGTNKCASQSGMTAYGTRRHLYDPKNHILPPMDHSTISLQMGTNKCASQVGMTAPGTRRHIYDTKLGTDKCDNSSMSLQMGYTQGANQSGQVFGLGRQIYDPKYCPQGTVADGAPSGTGDCPDPGEVPEYPPYYQEEAGY

SEQ ID NO: 944 - protein, 270 aa, Homo sapiens
MSSTQFNKGPSYGLSAEVKNRLLSKYDPQKEAELRTWIEGLTGLSIGPDFQKGLKDGTILCTLMNKLQPGSVPKINRSMQNWHQLENLSNFIKAMVSYGMNPVDLFEANDLFESGNMTQVQVSLLALAGKMGTNKCASQSGMTAYGTRRHLYDPKNHILPPMDHSTISLQMGTNKCASQVGMTAPGTRRHIYDTKLGTDKCDNSSMSLQMGYTQGANQSGQVFGLGRQIYDPKYCPQGTVADGAPSGTGDCPDPGEVPEYPPYYQEEAGY

SEQ ID NO: 945 - protein, 288 aa, Homo sapiens
MSSTQFNKGPSYGLSAEVKNRLLSKYDPQKKGLKDGTILCTLMNKLQPGSVPKINRSMQNWHQLENLSNFIKAMVSYGMNPVDLFEANDLFESGNMTQVQVSLLALAGKAKTKGLQSGVDIGVKYSEKQERNFDDATMKAGQCVIGLQMGTNKCASQSGMTAYGTRRHLYDPKNHILPPMDHSTISLQMGTNKCASQVGMTAPGTRRHIYDTKLGTDKCDNSSMSLQMGYTQGANQSGQVFGLGRQIYDPKYCPQGTVADGAPSGTGDCPDPGEVPEYPPYYQEEAGY

SEQ ID NO: 946 - protein, 329 aa, Homo sapiens
MTHFNKGPSYGLSAEVKNKIASKYDHQAEEDLRNWIEEVTGMSIGPNFQLGLKDGIILCELINKLQPGSVKKVNESSLNWPQLENIGNFIKAIQAYGMKPHDIFEANDLFENGNMTQVQTTLVALAGLAKTKGFHTTIDIGVKYAEKQTRRFDEGKLKAGQSVIGLQMGTNKCASQAGMTAYGTRRHLYDPKMQTDKPFDQTTISLQMGTNKGASQAGMLAPGTRRDIYDQKLTLQPVDNSTISLQMGTNKVASQKGMSVYGLGRQVYDPKYCAAPTEPVIHNGSQGTGTNGSEISDSDYQAEYPDEYHGEYQDDYPRDYQYSDQGIDY

SEQ ID NO: 947 - protein, 283 aa, Homo sapiens
MTHFNKGPSYGLSAEVKNKIASKYDHQAEEDLRNWIEEVTGMSIGPNFQLGLKDGIILCELINKLQPGSVKKVNESSLNWPQAKTKGFHTTIDIGVKYAEKQTRRFDEGKLKAGQSVIGLQMGTNKCASQAGMTAYGTRRHLYDPKMQTDKPFDQTTISLQMGTNKGASQAGMLAPGTRRDIYDQKLTLQPVDNSTISLQMGTNKVASQKGMSVYGLGRQVYDPKYCAAPTEPVIHNGSQGTGTNGSEISDSDYQAEYPDEYHGEYQDDYPRDYQYSDQGIDY

SEQ ID NO: 948 - protein, 185 aa, Homo sapiens
MSIGPNFQLGLKDGIILCELINKLQPGSVKKVNESSLNWPQLENIGNFIKAIQAYGMKPHDIFEANDLFENGNMTQVQTTLVALAGLAKTKGFHTTIDIGVKYAEKQTRRFDEGKLKAGQSVIGLQMGTNKCASQAGMTAYGTRRHLYDPKMQTDKPFDQTTISLQMGTNKGASQAGMLAPGTRR

SEQ ID NO: 949 - protein, 329 aa, Homo sapiens; identical to SEQ ID NO: 946

SEQ ID NO: 950 - protein, 288 aa, Homo sapiens
MSIGPNFQLGLKDGIILCELINKLQPGSVKKVNESSLNWPQLENIGNFIKAIQAYGMKPHDIFEANDLFENGNMTQVQTTLVALAGLAKTKGFHTTIDIGVKYAEKQTRRFDEGKLKAGQSVIGLQMGTNKCASQAGMTAYGTRRHLYDPKMQTDKPFDQTTISLQMGTNKGASQAGMLAPGTRRDIYDQKLTLQPVDNSTISLQMGTNKVASQKGMSVYGLGRQVYDPKYCAAPTEPVIHNGSQGTGTNGSEISDSDYQAEYPDEYHGEYQDDYPRDYQYSDQGIDY

SEQ ID NO: 951 - protein, 740 aa, Homo sapiens
MGELCRRDSALTALDEETLWEMMESHRHRIVRCICPSRLTPYLRQAKVLCQLDEEEVLHSPRLTNSAMRAGHLLDLLKTRGKNGAIAFLESLKFHNPDVYTLVTGLQPDVDFSNFSGLMETSKLTECLAGAIGSLQEELNQEKGQKEVLLRRCQQLQEHLGLAETRAEGLHQLEADHSRMKREVSAHFHEVLRLKDEMLSLSLHYSNALQEKELAASRCRSLQEELYLLKQELQRANMVSSCELELQEQSLRTASDQESGDEELNRLKEENEKLRSLTFSLAEKDILEQSLDEARGSRQELVERIHSLRERAVAAERQREQYWEEKEQTLLQFQKSKMACQLYREKVNALQAQVCELQKERDQAYSARDSAQREISQSLVEKDSLRRQVFELTDQVCELRTQLRQLQAEPPGVLKQEARTREPCPREKQRLVRMHAICPRDDSDCSLVSSTESQLLSDLSATSSRELVDSFRSSSPAPPSQQSLYKRVAEDFGEEPWSFSSCLEIPEGDPGALPGAKAGDPHLDYELLDTADLPQLESSLQPVSPGRLDVSESGVLMRRRPARRILSQVTMLAFQGDALLEQISVIGGNLTGIFIHRVTPGSAADQMALRPGTQIVMVDYEASEPLFKAVLEDTTLEEAVGLLRRVDGFCCLSVKVNTDGYKRLLQDLEAKVATSGDSFYIRVNLAMEGRAKGELQVHCNEVLHVTDTMFQGCGCWHAHRVNSYTMKDTAAHGTIPNYSR

SEQ ID NO: 952 - protein, 1004 aa, Homo sapiens
MGELCRRDSALTALDEETLWEMMESHRHRIVRCICPSRLTPYLRQAKVLCQLDEEEVLHSPRLTNSAMRAGHLLDLLKTRGKNGAIAFLESLKFHNPDVYTLVTGLQPDVDFSNFSGLMETSKLTECLAGAIGSLQEELNQEKGQKEVLLRRCQQLQEHLGLAETRAEGLHQLEADHSRMKREVSAHFHEVLRLKDEMLSLSLHYSNALQEKELAASRCRSLQEELYLLKQELQRANMVSSCELELQEQSLRTASDQESGDEELNRLKEENEKLRSLTFSLAEKDILEQSLDEARGSRQELVERIHSLRERAVAAERQREQYWEEKEQTLLQFQKSKMACQLYREKVNALQAQVCELQKERDQAYSARDSAQREISQSLVEKDSLRRQVFELTDQVCELRTQLRQLQAEPPGVLKQEARTREPCPREKQRLVRMHAICPRDDSDCSLVSSTESQLLSDLSATSSRELVDSFRSSSPAPPSQQSLYKRVAEDFGEEPWSFSSCLEIPEGDPGALPGAKAGDPHLDYELLDTADLPQLESSLQPVSPGRLDVSESGVLMRRRPARRILSQVTMLAFQGDALLEQISVIGGNLTGIFIHRVTPGSAADQMALRPGTQIVMVDYEASEPLFKAVLEDTTLEEAVGLLRRVDGFCCLSVKVNTDGYKRLLQDLEAKVATSGDSFYIRVNLAMEGRAKGELQVHCNEVLHVTDTMFQGCGCWHAHRVNSYTMKDTAAHGTIPNYSRAQQQLIALIQDMTQQCTVTRKPSSGGPQKLVRIVSMDKAKASPLRLSFDRGQLDPSRMEGSSTCFWAESCLTLVPYTLVRPHRPARPRPVLLVPRAVGKILSEKLCLLQGFKKCLAEYLSQEEYEAWSQRGDIIQEGEVSGGRCWVTRHAVESLMEKNTHALLDVQLDSVCTLHRMDIFPIVIHVSVNEKMAKKLKKGLQRLGTSEEQLLEAARQEEGDLDRAPCLYSSLAPDGWSDLDGLLSCVRQAIADEQKKVVWTEQSPR

SEQ ID NO: 953 - protein, 434 aa, Homo sapiens
MVSSCELELQEQSLRTASDQESGDEELNRLKEENEKLRSLTFSLAEKDILEQSLDEARGSRQELVERIHSLRERAVAAERQREQYWEEKEQTLLQFQKSKMACQLYREKVNALQAQVCELQKERDQAYSARDSAQREISQSLVEKDSLRRQVFELTDQVCELRTQLRQLQAEPPGVLKQEARTREPCPREKQRLVRMHAICPRDDSDCSLVSSTESQLLSDLSATSSRELVDSFRSSSPAPPSQQSLYKRVAEDFGEEPWSFSSCLEIPEGDPGALPGAKAGDPHLDYELLDTADLPQLESSLQPVSPGRLDVSESGVLMRRRPARRILSQVTMLAFQGDALLEQISVIGGNLTGIFIHRVTPGSAADQMALRPGTQIVMVSRARPLLSPGLLMGTVAAGGVTQADFTSPRRCRSTLGWASALSWADVKRSAHL

SEQ ID NO: 954 - protein, 1004 aa, Homo sapiens; identical to SEQ ID NO: 952

SEQ ID NO: 955 - protein, 441 aa, Homo sapiens
MVSSCELELQEQSLRTASDQESGDEELNRLKEENEKLRSLTFSLAEKDILEQSLDEARGSRQELVERIHSLRERAVAAERQREQYWEEKEQTLLQFQKSKMACQLYREKVNALQAQVCELQKERDQAYSARDSAQREISQSLVEKDSLRRQVFELTDQVCELRTQLRQLQAEPPGVLKQEARTREPCPREKQRLVRMHAICPRDDSDCSLVSSTESQLLSDLSATSSRELVDSFRSSSPAPPSQQSLYKRVAEDFGEEPWSFSSCLEIPEGDPGALPGAKAGDPHLDYELLDTADLPQLESSLQPVSPGRLDVSESGVLMRRRPARRILSQVTMLAFQGDALLEQISVIGGNLTGIFIHRVTPGSAADQMALRPGTQIVMVIRGYSRTWRPKWRPRGTHSTSGSTWPWRAGPKGSCRCIATRSCTSPTPCSRAAAAGMPTA

SEQ ID NO: 956 - protein, 782 aa, Homo sapiens
MFPPSGSTGLIPPSHFQARPLSTLPRMAPTWLSDIPLVQPPGHQDVSERRLDTQRPQVTMWERDVSSDRQEPGRRGRSWGLEGSQALSQQAEVIVRQLQELRRLEEEVRLLRETSLQQKMRLEAQAMELEALARAEKAGRAEAEGLRAALAGAEVVRKNLEEGSQRELEEVQRLHQEQLSSLTQAHEEALSSLTSKAEGLEKSLSSLETRRAGEAKELAEAQREAELLRKQLSKTQEDLEAQVTLVENLRKYVGEQVPSEVHSQTWELERQKLLETMQHLQEDRDSLHATAELLQVRVQSLTHILALQEEELTRKVQPSDSLEPEFTRKCQSLLNRWREKVFALMVQLKAQELEHSDSVKQLKGQVASLQEKVTSQSQEQAILQRSLQDKAAEVEVERMGAKGLQLELSRAQEARRRWQQQTASAEEQLRLVVNAVSSSQIWLETTMAKVEGAAAQLPSLNNRLSYAVRKVHTIRGLIARKLALAQLRQESCPLPPPVTDVSLELQQLREERNRLDAELQLSARLIQQEVGRAREQGEAERQQLSKVAQQLEQELQQTQESLASLGLQLEVARQGQQESTEEAASLRQELTQQQELYGQALQEKVAEVETRLREQLSDTERRLNEARREHAKAVVSLRQIQRRAAQEKERSQELRRLQEEARKEEGQRLARRLQELERDKNLMLATLQQEGLLSRYKQQRLLTVLPSLLDKKKSVVSSPRPPECSASAPVAAAVPTRESIKGSLSVLLDDLQDLSEAISKEEAVCQGDNLDRCSSSNPQMSS

SEQ ID NO: 957 - protein, 782 aa, Homo sapiens
MFPPSGSTGLIPPSHFQARPLSTLPRMAPTWLSDIPLVQPPGHQDVSERRLDTQRPQVTMWERDVSSDRQEPGRRGRSWGLEGSQALSQQAEVIVRQLQELRWLEEEVWLLRETSLQQKMRLEAQAMELEALARAEKAGRAEAEGLRAALAGAEVVRKNLEEGRQRELEEVQRLHQEQLSSLTQAHEEALSSLTSKAEGLEKSLSSLETRRAGEAKELAEAQREAELLRKQLSKTQEDLEAQVTLVENLRKYVGEQVPSEVHSQTWELERQKLLETMQHLQEDRDSLHATAELLQVRVQSLTHILALQEEELTRKVQPSDSLEPEFTRKCQSLLNRWREKVFALMVQLKAQELEHSDSVKQLKGQVASLQEKVTSQSQEQAILQRSLQDKAAEVEVERMGAKGLQLELSRAQEARRWWQQQTASAEEQLRLVVNAVSSSQIWLETTMAKVEGAAAQLPSLNNRLSYAVRKVHTIRGLIARKLALAQLRQESCPLPPPVTDVSLELQQLREERNRLDAELQLSARLIQQEVGRAREQGEAERQQLSKVAQQLEQELQQTQESLASLGLQLEVARQCQQESTEEAASLRQELTQQQELYGQALQEKVAEVETRLREQLSDTERRLNEARREHAKAVVSLRQIQRRAAQEKERSQELRRLQEEARKEEGQRLARRLQELERDKNLMLATLQQEGLLSRYKQQRLLTVLPSLLDKKKSVVSSPRPPECSASAPVAAAVPTRESIKGSLSVLLDDLQDLSEAISKEEAVCQGDNLDRCSSCNPQMSS

SEQ ID NO: 958 - protein, 782 aa, Homo sapiens; identical to SEQ ID NO: 956

SEQ ID NO: 959 - protein, 729 aa, Homo sapiens
MFPPSGSTGLIPPSHFQARPLSTLPRMAPTWLSDIPLVQPPGHQDVSERRLDTQRPQVTMWERDVSSDRQEPGRRGRSWGLEGSQALSQQAEVIVRQLQELRRLEEEVRLLRETSLQQKMRLEAQAMELEALARAEKAGRAEAEGLRAALAGAEVVRKNLEEGSQRELEEVQRLHQEQLSSLTQAHEEALSSLTSKAEGLEKSLSSLETRRAGEAKELAEAQREAELLRKQLSKTQEDLEAQVTLVENLRKYVGEQVPSEVHSQTWELERQKLLETMQHLQEDRDSLHATAELLQVRVQSLTHILALQEEELTRKVQPSDSLEPEFTRKCQSLLNRWREKVFALMVQLKAQELEHSDSVKQLKGQVASLQEKVTSQSQEQAILQRSLQDKAAEVEVERMGAKGLQLELSRAQEARRRWQQQTASAEEQLRLVVNAVSSCPLPPPVTDVSLELQQLREERNRLDAELQLSARLIQQEVGRAREQGEAERQQLSKVAQQLEQELQQTQESLASLGLQLEVARQGQQESTEEAASLRQELTQQQELYGQALQEKVAEVETRLREQLSDTERRLNEARREHAKAVVSLRQIQRRAAQEKERSQELRRLQEEARKEEGQRLARRLQELERDKNLMLATLQQEGLLSRYKQQRLLTVLPSLLDKKKSVVSSPRPPECSASAPVAAAVPTRESIKGSLSVLLDDLQDLSEAISKEEAVCQGDNLDRCSSSNPQMSS

SEQ ID NO: 960 - protein, 871 aa, Homo sapiens
MWPHSAGARPWASTLTGKDPRVMACWCLDGLPSGLAEPWRELWRWRSRPLHCVPPFSPLARSSRDHRNLRRRGNIDGWRQNLEPSNNVEMFPPSGSTGLIPPSHFQARPLSTLPRMAPTWLSDIPLVQPPGHQDVSERRLDTQRPQVTMWERDVSSDRQEPGRRGRSWGLEGSQALSQQAEVIVRQLQELRRLEEEVRLLRETSLQQKMRLEAQAMELEALARAEKAGRAEAEGLRAALAGAEVVRKNLEEGSQRELEEVQRLHQEQLSSLTQAHEEALSSLTSKAEGLEKSLSSLETRRAGEAKELAEAQREAELLRKQLSKTQEDLEAQVTLVENLRKYVGEQVPSEVHSQTWELERQKLLETMQHLQEDRDSLHATAELLQVRVQSLTHILALQEEELTRKVQPSDSLEPEFTRKCQSLLNRWREKVFALMVQLKAQELEHSDSVKQLKGQVASLQEKVTSQSQEQAILQRSLQDKAAEVEVERMGAKGLQLELSRAQEARRRWQQQTASAEEQLRLVVNAVSSSQIWLETTMAKVEGAAAQLPSLNNRLSYAVRKVHTIRGLIARKLALAQLRQESCPLPPPVTDVSLELQQLREERNRLDAELQLSARLIQQEVGRAREQGEAERQQLSKVAQQLEQELQQTQESLASLGLQLEVARQGQQESTEEAASLRQELTQQQELYGQALQEKVAEVETRLREQLSDTERRLNEARREHAKAVVSLRQIQRRAAQEKERSQELRRLQEEARKEEGQRLARRLQELERDKNLMLATLQQEGLLSRYKQQRLLTVLPSLLDKKKSVVSSPRPPECSASAPVAAAVPTRESIKGSLSVLLDDLQDLSEAISKEEAVCQGDNLDRCSSSNPQMSS

SEQ ID NO: 961 - protein, 729 aa, Homo sapiens
MFPPSGSTGLIPPSHFQARPLSTLPRMAPTWLSDIPLVQPPGHQDVSERRLDTQRPQVTMWERDVSSDRQEPGRRGRSWGLEGSQALSQQAEVIVRQLQELRWLEEEVWLLRETSLQQKMRLEAQAMELEALARAEKAGRAEAEGLRAALAGAEVVRKNLEEGRQRELEEVQRLHQEQLSSLTQAHEEALSSLTSKAEGLEKSLSSLETRRAGEAKELAEAQREAELLRKQLSKTQEDLEAQVTLVENLRKYVGEQVPSEVHSQTWELERQKLLETMQHLQEDRDSLHATAELLQVRVQSLTHILALQEEELTRKVQPSDSLEPEFTRKCQSLLNRWREKVFALMVQLKAQELEHSDSVKQLKGQVASLQEKVTSQSQEQAILQRSLQDKAAEVEVERMGAKGLQLELSRAQEARRWWQQQTASAEEQLRLVVNAVSSCPLPPPVTDVSLELQQLREERNRLDAELQLSARLIQQEVGRAREQGEAERQQLSKVAQQLEQELQQTQESLASLGLQLEVARQCQQESTEEAASLRQELTQQQELYGQALQEKVAEVETRLREQLSDTERRLNEARREHAKAVVSLRQIQRRAAQEKERSQELRRLQEEARKEEGQRLARRLQELERDKNLMLATLQQEGLLSRYKQQRLLTVLPSLLDKKKSVVSSPRPPECSASAPVAAAVPTRESIKGSLSVLLDDLQDLSEAISKEEAVCQGDNLDRCSSCNPQMSS

SEQ ID NO: 962 - protein, 782 aa, Homo sapiens; identical to SEQ ID NO: 957

SEQ ID NO: 963 - protein, 729 aa, Homo sapiens; identical to SEQ ID NO: 959

SEQ ID NO: 964 - protein, 871 aa, Homo sapiens; identical to SEQ ID NO: 960

SEQ ID NO: 965 - protein, 171 aa, Homo sapiens
MFPPSGQWDQTRGVVVVSAWETDHLCFCNSSGSTGLIPPSHFQARPLSTLPRMAPTWLSDIPLVQPPGHQDVSERRLDTQRPQVTMWERDVSSDRQEPGRRGRSWGLEGSQALSQQAEVIVRQLQELRRLEEEVRLLRETSLQQKMRLEAQAMELEALARAEKAGRAEAEG

SEQ ID NO: 966 - protein, 171 aa, Homo sapiens; identical to SEQ ID NO: 965

SEQ ID NO: 967 - protein, 729 aa, Homo sapiens; identical to SEQ ID NO: 961

SEQ ID NO: 968 - protein, 782 aa, Homo sapiens; identical to SEQ ID NO: 957

SEQ ID NO: 969 - protein, 782 aa, Homo sapiens
MFPPSGSTGLIPPSHFQARPLSTLPRMAPTWLSDIPLVQPPGHQDVSERRLDTQRPQVTMWERDVSSDRQEPGRRGRSWGLEGSQALSQQAEVIVRQLQELRRLEEEVRLLRETSLQQKMRLEAQAMELEALARAEKAGRAEAEGLRAALAGAEVVRKNLEEGRQRELEEVQRLHQEQLSSLTQAHEEALSSLTSKAEGLEKSLSSLETRRAGEAKELAEAQREAELLRKQLSKTQEDLEAQVTLVENLRKYVGEQVPSEVHSQTWELERQKLLDTMQHLQEDRDSLHATAELLQVRVQSLTHILALQEEELTRKVQPSDSLEPEFTRKCQSLLNRWREKVFALMVQLKAQELEHSDSVKQLKGQVASLQEKVTSQSQEQAILQRSLQDKAAEVEVERMGAKGLQLELSRAQEARRRWQQQTASAEEQLRLVVNAVSSSQIWLETTMAKVEGAAAQLPSLNNRLSYAVRKVHTIRGLIARKLALAQLRQESCPLPPPVTDVSLELQQLREERNRLDAELQLSARLIQQEVGRAREQGEAERQQLSKVAQQLEQELQQTQESLASLGLQLEVARQGQQESTEEAASLRQELTQQQELYGQALQEKVAEVETRLREQLSDTERRLNEARREHAKAVVSLRQIQRRAAQEKERSQELRRLQEEARKEEGQRLARRLQELERDKNLMLATLQQEGLLSRYKQQRLLTVLPSLLDKKKSVVSSPRPPECSASAPVAAAVPTRESIKGSLSVLLDDLQDLSEAISKEEAVCQGDNLDRCSSSNPQMSS

SEQ ID NO: 970 - protein, 127 aa, Homo sapiens
MFPPSGQWDQTRGVVVVSAWETDHLCFCNSSGSTGLIPPSHFQARPLSTLPRMAPTWLSDIPLVQPPGHQDVSERRLDTQRPQVTMWERDVSSDRQEPGRRGRSWGLEGSQALSQQAEVIVRQLQEL

SEQ ID NO: 971 - protein, 127 aa, Homo sapiens; identical to SEQ ID NO: 970

SEQ ID NO: 972 - protein, 171 aa, Homo sapiens
MFPPSGQWDQTRGVVVVSAWETDHLCFCNSSGSTGLIPPSHFQARPLSTLPRMAPTWLSDIPLVQPPGHQDVSERRLDTQRPQVTMWERDVSSDRQEPGRRGRSWGLEGSQALSQQAEVIVRQLQELRWLEEEVWLLRETSLQQKMRLEAQAMELEALARAEKAGRAEAEG

SEQ ID NO: 973 - protein, 256 aa, Homo sapiens
  MOD_RES (1)..(1): Any amino acid
XRLDAELQLSARLIQQEVGRAREQGEAERQQLSKVAQQLEQELQQTQESLASLGLQLEVARQGQQESTEEAASLRQELTQQQELYGQALQEKVAEVETRLREQLSDTERRLNEARREHAKAVVSLRQIQRRAAQEKERSQELRRLQEEARKEEGQRLARRLQELERDKNLMLQRLLTVLPSLLDKKKSVVSSPRPPECSASAPVAAAVPTRESIKGSLSVLLDDLQDLSEAISKEEAVCQGDNLDRCSSSNPQMSS

SEQ ID NO: 974 - protein, 782 aa, Homo sapiens; identical to SEQ ID NO: 969

SEQ ID NO: 975 - protein, 256 aa, Homo sapiens; identical to SEQ ID NO: 973
  MOD_RES (1)..(1): Any amino acid

SEQ ID NO: 976 - protein, 256 aa, Homo sapiens
  MOD_RES (1)..(1): Any amino acid
XRLDAELQLSARLIQQEVGRAREQGEAERQQLSKVAQQLEQELQQTQESLASLGLQLEVARQCQQESTEEAASLRQELTQQQELYGQALQEKVAEVETRLREQLSDTERRLNEARREHAKAVVSLRQIQRRAAQEKERSQELRRLQEEARKEEGQRLARRLQELERDKNLMLQRLLTVLPSLLDKKKSVVSSPRPPECSASAPVAAAVPTRESIKGSLSVLLDDLQDLSEAISKEEAVCQGDNLDRCSSCNPQMSS

SEQ ID NO: 977 - protein, 171 aa, Homo sapiens; identical to SEQ ID NO: 965

SEQ ID NO: 978 - protein, 153 aa, Homo sapiens
MFPPSGSTGLIPPSHFQARPLSTLPRMAPTWLSDIPLVQPPGHQDVSERRLDTQRPQVTMWERDVSSDRQEPGRRGRSWGLEGSQALSQQAEVIVRQLQELRRLEEEVRLLRETSLQQKMRLEAQAMELEALARAEKAGRAEAEGLRAALAGA

SEQ ID NO: 979 - protein, 153 aa, Homo sapiens; identical to SEQ ID NO: 978

SEQ ID NO: 980 - protein, 782 aa, Homo sapiens; identical to SEQ ID NO: 957

SEQ ID NO: 981 - protein, 216 aa, Homo sapiens
MWPHSAGARPWASTLTGKDPRVMACWCLDGLPSGLAEPWRELWRWRSRPLHCVPPFSPLARSSRDHRNLRRRVEALPRILKGNIDGWRQNLEPSNNVEMFPPSGSTGLIPPSHFQARPLSTLPRMAPTWLSDIPLVQPPGHQDVSERRLDTQRPQVTMWERDVSSDRQEPGRRGRSWGLEGSQALSQQAEVIVRQLQELRRLEEEVRLLRETSLQQ

SEQ ID NO: 982 - protein, 118 aa, Homo sapiens
MFPPSGSTGLIPPSHFQARPLSTLPRMAPTWLSDIPLVQPPGHQDVSERRLDTQRPQVTMWERDVSSDRQEPGRRGRSWGLEGSQALSQQAEVIVRQLQELRRLEEEVRLLRETSLQQ

SEQ ID NO: 983 - protein, 127 aa, Homo sapiens; identical to SEQ ID NO: 970

SEQ ID NO: 984 - protein, 729 aa, Homo sapiens
MFPPSGSTGLIPPSHFQARPLSTLPRMAPTWLSDIPLVQPPGHQDVSERRLDTQRPQVTMWERDVSSDRQEPGRRGRSWGLEGSQALSQQAEVIVRQLQELRRLEEEVRLLRETSLQQKMRLEAQAMELEALARAEKAGRAEAEGLRAALAGAEVVRKNLEEGRQRELEEVQRLHQEQLSSLTQAHEEALSSLTSKAEGLEKSLSSLETRRAGEAKELAEAQREAELLRKQLSKTQEDLEAQVTLVENLRKYVGEQVPSEVHSQTWELERQKLLDTMQHLQEDRDSLHATAELLQVRVQSLTHILALQEEELTRKVQPSDSLEPEFTRKCQSLLNRWREKVFALMVQLKAQELEHSDSVKQLKGQVASLQEKVTSQSQEQAILQRSLQDKAAEVEVERMGAKGLQLELSRAQEARRRWQQQTASAEEQLRLVVNAVSSCPLPPPVTDVSLELQQLREERNRLDAELQLSARLIQQEVGRAREQGEAERQQLSKVAQQLEQELQQTQESLASLGLQLEVARQGQQESTEEAASLRQELTQQQELYGQALQEKVAEVETRLREQLSDTERRLNEARREHAKAVVSLRQIQRRAAQEKERSQELRRLQEEARKEEGQRLARRLQELERDKNLMLATLQQEGLLSRYKQQRLLTVLPSLLDKKKSVVSSPRPPECSASAPVAAAVPTRESIKGSLSVLLDDLQDLSEAISKEEAVCQGDNLDRCSSSNPQMSS

SEQ ID NO: 985 - protein, 316 aa, Homo sapiens
MFPPSGHQDVSERRLDTQRPQVTMWERDVSSDRQEPGRRGRSWGLEGSQALSQQAEVIVRQLQELRRLEEEVRLLRETSLQQKMRLEAQAMELEALARAEKAGRAEAEGLRAALAGAEVVRKNLEEGSQRELEEVQRLHQEQLSSLTQAHEEALSSLTSKAEGLEKSLSSLETRRAGEAKELAEAQREAELLRKQLSKTQEDLEAQVTLVENLRKYVGEQVPSEVHSQTWELERQKLLETMQHLQEDRDSLHATAELLQVRVQSLTHILALQEEELTRKVQPSDSLEPEFTRKCQSLLNRWREKVFALMVQLKAQE

SEQ ID NO: 986 - protein, 256 aa, Homo sapiens; identical to SEQ ID NO: 973
  MOD_RES (1)..(1): Any amino acid

SEQ ID NO: 987 - protein, 118 aa, Homo sapiens; identical to SEQ ID NO: 982

SEQ ID NO: 988 - protein, 782 aa, Homo sapiens; identical to SEQ ID NO: 969

SEQ ID NO: 989 - protein, 127 aa, Homo sapiens; identical to SEQ ID NO: 970

SEQ ID NO: 990 - protein, 153 aa, Homo sapiens
MFPPSGSTGLIPPSHFQARPLSTLPRMAPTWLSDIPLVQPPGHQDVSERRLDTQRPQVTMWERDVSSDRQEPGRRGRSWGLEGSQALSQQAEVIVRQLQELRWLEEEVWLLRETSLQQKMRLEAQAMELEALARAEKAGRAEAEGLRAALAGA

SEQ ID NO: 991 - protein, 127 aa, Homo sapiens; identical to SEQ ID NO: 970

SEQ ID NO: 992 - protein, 188 aa, Homo sapiens
MFPPSGSTGLIPPSHFQARPLSTLPRMAPTWLSDIPLVQPPGHQDVSERRLDTQRPQVTMWERDVSSDRQEPGRRGRSWGLEGSQALSQQAEVIVRQLQELRRLEEEVRLLRETSLQQKMRLEAQAMELEALARAEKAGRAEAEGLRAALAGAEVVRKNLEEGRQRELEEVQRLHQEQLSSLTQAHEE

SEQ ID NO: 993 - protein, 188 aa, Homo sapiens
MFPPSGSTGLIPPSHFQARPLSTLPRMAPTWLSDIPLVQPPGHQDVSERRLDTQRPQVTMWERDVSSDRQEPGRRGRSWGLEGSQALSQQAEVIVRQLQELRWLEEEVWLLRETSLQQKMRLEAQAMELEALARAEKAGRAEAEGLRAALAGAEVVRKNLEEGRQRELEEVQRLHQEQLSSLTQAHEE

SEQ ID NO: 994 - protein, 316 aa, Homo sapiens
MFPPSGHQDVSERRLDTQRPQVTMWERDVSSDRQEPGRRGRSWGLEGSQALSQQAEVIVRQLQELRRLEEEVRLLRETSLQQKMRLEAQAMELEALARAEKAGRAEAEGLRAALAGAEVVRKNLEEGRQRELEEVQRLHQEQLSSLTQAHEEALSSLTSKAEGLEKSLSSLETRRAGEAKELAEAQREAELLRKQLSKTQEDLEAQVTLVENLRKYVGEQVPSEVHSQTWELERQKLLDTMQHLQEDRDSLHATAELLQVRVQSLTHILALQEEELTRKVQPSDSLEPEFTRKCQSLLNRWREKVFALMVQLKAQE

SEQ ID NO: 995 - protein, 188 aa, Homo sapiens
MFPPSGSTGLIPPSHFQARPLSTLPRMAPTWLSDIPLVQPPGHQDVSERRLDTQRPQVTMWERDVSSDRQEPGRRGRSWGLEGSQALSQQAEVIVRQLQELRRLEEEVRLLRETSLQQKMRLEAQAMELEALARAEKAGRAEAEGLRAALAGAEVVRKNLEEGSQRELEEVQRLHQEQLSSLTQAHEE

SEQ ID NO: 996 - protein, 768 aa, Homo sapiens
MFPPSGSTGLIPPSHFQARPLSTLPRMAPTWLSDIPLVQPPGHQDVSERRLDTQRPQVTMWERDVSSDRQEPGRRGRSWGLEGSQALSQQAEVIVRQLQELRRLEEEVRLLRETSLQQKMRLEAQAMELEALARAEKAGRAEAEGLRAALAGAEVVRKNLEEGSQRELEEVQRLHQEQLSSLTQAHEEALSSLTSKAEGLEKSLSSLETRRAGEAKELAEAQREAELLRKQLSKTQEDLEAQVTLVENLRKYVGEQVPSEVHSQTWELERQKLLETMQHLQEDRDSLHATAELLQVRVQSLTHILALQEEELTRKVQPSDSLEPEFTRKCQSLLNRWREKVFALMVQLKAQELEHSDSVKQLKGQVASLQEKVTSQSQEQAILQRSLQDKAAEVEVERMGAKGLQLELSRAQEARRRWQQQTASAEEQLRLVVNAVSSSQIWLETTMAKVEGAAAQLPSLNNRLSYAVRKVHTIRGLIARKLALAQLRQESCPLPPPVTDVSLELQQLREERNRLDAELQLSARLIQQEVGRAREQGEAERQQLSKVAQQLEQELQQTQESLASLGLQLEVARQGQQESTEEAASLRQELTQQQELYGQALQEKVAEVETRLREQLSDTERRLNEARREHAKAVVSLRQIQRRAAQEKERSQELRRLQEEARKEEGQRLARRLQELERDKNLMLQRLLTVLPSLLDKKKSVVSSPRPPECSASAPVAAAVPTRESIKGSLSVLLDDLQDLSEAISKEEAVCQGDNLDRCSSSNPQMSS

SEQ ID NO: 997 - protein, 316 aa, Homo sapiens
MFPPSGHQDVSERRLDTQRPQVTMWERDVSSDRQEPGRRGRSWGLEGSQALSQQAEVIVRQLQELRWLEEEVWLLRETSLQQKMRLEAQAMELEALARAEKAGRAEAEGLRAALAGAEVVRKNLEEGRQRELEEVQRLHQEQLSSLTQAHEEALSSLTSKAEGLEKSLSSLETRRAGEAKELAEAQREAELLRKQLSKTQEDLEAQVTLVENLRKYVGEQVPSEVHSQTWELERQKLLETMQHLQEDRDSLHATAELLQVRVQSLTHILALQEEELTRKVQPSDSLEPEFTRKCQSLLNRWREKVFALMVQLKAQE

SEQ ID NO: 998 - protein, 118 aa, Homo sapiens
MFPPSGSTGLIPPSHFQARPLSTLPRMAPTWLSDIPLVQPPGHQDVSERRLDTQRPQVTMWERDVSSDRQEPGRRGRSWGLEGSQALSQQAEVIVRQLQELRWLEEEVWLLRETSLQQ

SEQ ID NO: 999 - protein, 782 aa, Homo sapiens; identical to SEQ ID NO: 969

SEQ ID NO: 1000 - protein, 188 aa, Homo sapiens; identical to SEQ ID NO: 992

SEQ ID NO: 1001 - protein, 191 aa, Homo sapiens
MFPPSGHQDVSERRLDTQRPQVTMWERDVSSDRQEPGRRGRSWGLEGSQALSQQAEVIVRQLQELRRLEEEVRLLRETSLQQKMRLEAQAMELEALARAEKAGRAEAEGLRAALAGAEVVRKNLEEGSQRELEEVQRLHQEQLSSLTQAHEEALSSLTSKAEGLEKSLSSLETRRAGEAKELAEAQREAEL

SEQ ID NO: 1002 - protein, 188 aa, Homo sapiens; identical to SEQ ID NO: 995

SEQ ID NO: 1003 - protein, 316 aa, Homo sapiens; identical to SEQ ID NO: 997

SEQ ID NO: 1004 - protein, 171 aa, Homo sapiens; identical to SEQ ID NO: 972

SEQ ID NO: 1005 - protein, 118 aa, Homo sapiens; identical to SEQ ID NO: 998

SEQ ID NO: 1006 - protein, 256 aa, Homo sapiens; identical to SEQ ID NO: 976
  MOD_RES (1)..(1): Any amino acid

SEQ ID NO: 1007 - protein, 835 aa, Homo sapiens
MWPHSAGARPWASTLTGKDPRVMACWCLDGLPSGLAEPWRELWRWRSRPLHCVPPFSPLARSSRDHRNLRRRGNIDGWRQNLEPSNNVEMFPPSGHQDVSERRLDTQRPQVTMWERDVSSDRQEPGRRGRSWGLEGSQALSQQAEVIVRQLQELRRLEEEVRLLRETSLQQKMRLEAQAMELEALARAEKAGRAEAEGLRAALAGAEVVRKNLEEGSQRELEEVQRLHQEQLSSLTQAHEEALSSLTSKAEGLEKSLSSLETRRAGEAKELAEAQREAELLRKQLSKTQEDLEAQVTLVENLRKYVGEQVPSEVHSQTWELERQKLLETMQHLQEDRDSLHATAELLQVRVQSLTHILALQEEELTRKVQPSDSLEPEFTRKCQSLLNRWREKVFALMVQLKAQELEHSDSVKQLKGQVASLQEKVTSQSQEQAILQRSLQDKAAEVEVERMGAKGLQLELSRAQEARRRWQQQTASAEEQLRLVVNAVSSSQIWLETTMAKVEGAAAQLPSLNNRLSYAVRKVHTIRGLIARKLALAQLRQESCPLPPPVTDVSLELQQLREERNRLDAELQLSARLIQQEVGRAREQGEAERQQLSKVAQQLEQELQQTQESLASLGLQLEVARQGQQESTEEAASLRQELTQQQELYGQALQEKVAEVETRLREQLSDTERRLNEARREHAKAVVSLRQIQRRAAQEKERSQELRRLQEEARKEEGQRLARRLQELERDKNLMLATLQQEGLLSRYKQQRLLTVLPSLLDKKKSVVSSPRPPECSASAPVAAAVPTRESIKGSLSVLLDDLQDLSEAISKEEAVCQGDNLDRCSSSNPQMSS

SEQ ID NO: 1008 - protein, 729 aa, Homo sapiens; identical to SEQ ID NO: 984

SEQ ID NO: 1009 - protein, 127 aa, Homo sapiens; identical to SEQ ID NO: 970

SEQ ID NO: 1010 - protein, 153 aa, Homo sapiens; identical to SEQ ID NO: 978

SEQ ID NO: 1011 - protein, 188 aa, Homo sapiens; identical to SEQ ID NO: 993

SEQ ID NO: 1012 - protein, 153 aa, Homo sapiens; identical to SEQ ID NO: 978

SEQ ID NO: 1013 - protein, 153 aa, Homo sapiens; identical to SEQ ID NO: 990

SEQ ID NO: 1014 - protein, 316 aa, Homo sapiens; identical to SEQ ID NO: 994

SEQ ID NO: 1015 - protein, 216 aa, Homo sapiens; identical to SEQ ID NO: 981

SEQ ID NO: 1016 - protein, 171 aa, Homo sapiens; identical to SEQ ID NO: 965

SEQ ID NO: 1017 - protein, 118 aa, Homo sapiens; identical to SEQ ID NO: 982

SEQ ID NO: 1018 - protein, 140 aa, Homo sapiens
MFPPSGSTGLIPPSHFQARPLSTLPRMAPTWLSDIPLVQPPGHQDVSERRLDTQRPQVTMWERDVSSDRQEPGRRGRSWGLEGSQALSQQAEVIVRQLQELRRLEEEVRLLRETSLQQKMRLEAQAMELEALARAEKAGR

SEQ ID NO: 1019 - protein, 36 aa, Homo sapiens
MFPPSGSTGLIPPSHFQARPLSTLPRMAPTWLSDIP

SEQ ID NO: 1020 - protein, 96 aa, Homo sapiens
MFPPSGSTGLIPPSHFQARPLSTLPRMAPTWLSDIPLVQPPGHQDVSERRLDTQRPQVTMWERDVSSDRQEPGRRGRSWGLEGSQALSQQAEVIVR

SEQ ID NO: 1021 - protein, 158 aa, Homo sapiens
MFPPSGSTGLIPPSHFQARPLSTLPRMAPTWLSDIPLVQPPGHQDVSERRLDTQRPQVTMWERDVSSDRQEPGRRGRSWGLEGSQALSQQAEVIVRQLQELRRLEEEVRLLRETSLQQKMRLEAQAMELEALARAEKAGRAEAEGLRAALAGAEVVRK

SEQ ID NO: 1022 - protein, 116 aa, Homo sapiens
MFPPSGSTGLIPPSHFQARPLSTLPRMAPTWLSDIPLVQPPGHQDVSERRLDTQRPQVTMWERDVSSDRQEPGRRGRSWGLEGSQALSQQAEVIVRQLQELRRLEEEVRLLRETSL

SEQ ID NO: 1023 - protein, 41 aa, Homo sapiens
MFPPSGSTGLIPPSHFQARPLSTLPRMAPTWLSDIPLVQPP

SEQ ID NO: 1024 - protein, 159 aa, Homo sapiens
MFPPSGHQDVSERRLDTQRPQVTMWERDVSSDRQEPGRRGRSWGLEGSQALSQQAEVIVRQLQELRRLEEEVRLLRETSLQQKMRLEAQAMELEALARAEKAGRAEAEGLRAALAGAEVVRKNLEEGSQRELEEVQRLHQEQLSSLTQAHEEALSSLTS

SEQ ID NO: 1025 - protein, 140 aa, Homo sapiens
MAPTWLSDIPLVQPPGHQDVSERRLDTQRPQVTMWERDVSSDRQEPGRRGRSWGLEGSQALSQQAEVIVRQLQELRRLEEEVRLLRETSLQQKMRLEAQAMELEALARAEKAGRAEAEGLRAALAGAEVVRKNLEEGSQR

SEQ ID NO: 1026 - protein, 159 aa, Homo sapiens
MFPPSGSTGLIPPSHFQARPLSTLPRMAPTWLSDIPLVQPPGHQDVSERRLDTQRPQVTMWERDVSSDRQEPGRRGRSWGLEGSQALSQQAEVIVRQLQELRRLEEEVRLLRETSLQQKMRLEAQAMELEALARAEKAGRAEAEGLRAALAGAEVVRKN

SEQ ID NO: 1027 - protein, 1237 aa, Homo sapiens
MRKHRHLPLVAVFCLFLSGFPTTHAQQQQAAQDSADIIFLIDGSNNTGSVNFAVILDFLVNLLEKLPIGTQQIRVGVVQFSDEPRTMFSLDTYSTKAQVLGAVKALGFAGGELANIGLALDFVVENHFTRAGGSRVEEGVPQVLVLISAGPSSDEIRYGVVALKQASVFSFGLGAQAASRAELQHIATDDNLVFTVPEFRSFGDLQEKLLPYIVGVAQRHIVLKPPTIVTQVIEVNKRDIVFLVDGSSALGLANFNAIRDFIAKVIQRLEIGQDLIQVAVAQYADTVRPEFYFNTHPTKREVITAVRKMKPLDGSALYTGSALDFVRNNLFTSSAGYRAAEGIPKLLVLITGGKSLDEISQPAQELKRSSIMAFAIGNKGADQAELEEIAFDSSLVFIPAEFRAAPLQGMLPGLLAPLRTLSGTPEVHSNKRDIIFLLDGSANVGKTNFPYVRDFVMNLVNSLDIGNDNIRVGLVQFSDTPVTEFSLNTYQTKSDILGHLRQLQLQGGSGLNTGSALSYVYANHFTEAGGSRIREHVPQLLLLLTAGQSEDSYLQAANALTRAGILTFCVGASQANKAELEQIAFNPSLVYLMDDFSSLPALPQQLIQPLTTYVSGGVEEVPLAQPESKRDILFLFDGSANLVGQFPVVRDFLYKIIDELNVKPEGTRIAVAQYSDDVKVESRFDEHQSKPEILNLVKRMKIKTGKALNLGYALDYAQRYIFVKSAGSRIEDGVLQFLVLLVAGRSSDRVDGPASNLKQSGVVPFIFQAKNADPAELEQIVLSPAFILAAESLPKIGDLHPQIVNLLKSVHNGAPAPVSGEKDVVFLLDGSEGVRSGFPLLKEFVQRVVESLDVGQDRVRVAVVQYSDRTRPEFYLNSYMNKQDVVNAVRQLTLLGGPTPNTGAALEFVLRNILVSSAGSRITEGVPQLLIVLTADRSGDDVRNPSVVVKRGGAVPIGIGIGNADITEMQTISFIPDFAVAIPTFRQLGTVQQVISERVTQLTREELSRLQPVLQPLPSPGVGGKRDVVFLIDGSQSAGPEFQYVRTLIERLVDYLDVGFDTTRVAVIQFSDDPKVEFLLNAHSSKDEVQNAVQRLRPKGGRQINVGNALEYVSRNIFKRPLGSRIEEGVPQFLVLISSGKSDDEVDDPAVELKQFGVAPFTIARNADQEELVKISLSPEYVFSVSTFRELPSLEQKLLTPITTLTSEQIQKLLASTRYPPPGEMGASEVLLGAFSI

SEQ ID NO: 1028 - protein, 2570 aa, Homo sapiens
MRKHRHLPLVAVFCLFLSGFPTTHAQQQQAVIEVNKRDIVFLVDGSSALGLANFNAIRDFIAKVIQRLEIGQDLIQVAVAQYADTVRPEFYFNTHPTKREVITAVRKMKPLDGSALYTGSALDFVRNNLFTSSAGYRAAEGIPKLLVLITGGKSLDEISQPAQELKRSSIMAFAIGNKGADQAELEEIAFDSSLVFIPAEFRAAPLQGMLPGLLAPLRTLSGTPEESKRDILFLFDGSANLVGQFPVVRDFLYKIIDELNVKPEGTRIAVAQYSDDVKVESRFDEHQSKPEILNLVKRMKIKTGKALNLGYALDYAQRYIFVKSAGSRIEDGVLQFLVLLVAGRSSDRVDGPASNLKQSGVVPFIFQAKNADPAELEQIVLSPAFILAAESLPKIGDLHPQIVNLLKSVHNGAPAPVSGEKDVVFLLDGSEGVRSGFPLLKEFVQRVVESLDVGQDRVRVAVVQYSDRTRPEFYLNSYMNKQDVVNAVRQLTLLGGPTPNTGAALEFVLRNILVSSAGSRITEGVPQLLIVLTADRSGDDVRNPSVVVKRGGAVPIGIGIGNADITEMQTISFIPDFAVAIPTFRQLGTVQQVISERVTQLTREELSRLQPVLQPLPSPGVGGKRDVVFLIDGSQSAGPEFQYVRTLIERLVDYLDVGFDTTRVAVIQFSDDPKVEFLLNAHSSKDEVQNAVQRLRPKGGRQINVGNALEYVSRNIFKRPLGSRIEEGVPQFLVLISSGKSDDEVDDPAVELKQFGVAPFTIARNADQEELVKISLSPEYVFSVSTFRELPSLEQKLLTPITTLTSEQIQKLLASTRYPPPAVESDAADIVFLIDSSEGVRPDGFAHIRDFVSRIVRRLNIGPSKVRVGVVQFSNDVFPEFYLKTYRSQAPVLDAIRRLRLRGGSPLNTGKALEFVARNLFVKSAGSRIEDGVPQHLVLVLGGKSQDDVSRFAQVIRSSGIVSLGVGDRNIDRTELQTITNDPRLVFTVREFRELPNIEERIMNSFGPSAATPAPPGVDTPPPSRPEKKKADIVFLLDGSINFRRDSFQEVLRFVSEIVDTVYEDGDSIQVGLVQYNSDPTDEFFLKDFSTKRQIIDAINKVVYKGGRHANTKVGLEHLRVNHFVPEAGSRLDQRVPQIAFVITGGKSVEDAQDVSLALTQRGVKVFAVGVRNIDSEEVGKIASNSATAFRVGNVQELSELSEQVLETLHDAMHETLCPGVTDAAKACNLDVILGFDGSRDQNVFVAQKGFESKVDAILNRISQMHRVSCSGGRSPTVRVSVVANTPSGPVEAFDFDEYQPEMLEKFRNMRSQHPYVLTEDTLKVYLNKFRQSSPDSVKVVIHFTDGADGDLADLHRASENLRQEGVRALILVGLERVVNLERLMHLEFGRGFMYDRPLRLNLLDLDYELAEQLDNIAEKACCGVPCKCSGQRGDRGPIGSIGPKGIPGEDGYRGYPGDEGGPGERGPPGVNGTQGFQGCPGQRGVKGSRGFPGEKGEVGEIGLDGLDGEDGDKGLPGSSGEKGNPGRRGDKGPRGEKGERGDVGIRGDPGNPGQDSQERGPKGETGDLGPMGVPGRDGVPGGPGETGKNGGFGRRGPPGAKGNKGGPGQPGFEGEQGTRGAQGPAGPAGPPGLIGEQGISGPRGSGGAAGAPGERGRTGPLGRKGEPGEPGPKGGIGNRGPRGETGDDGRDGVGSEGRRGKKGERGFPGYPGPKGNPGEPGLNGTTGPKGIRGRRGNSGPPGIVGQKGDPGYPGPAGPKGNRGDSIDQCALIQSIKDKCPCCYGPLECPVFPTELAFALDTSEGVNQDTFGRMRDVVLSIVNDLTIAESNCPRGARVAVVTYNNEVTTEIRFADSKRKSVLLDKIKNLQVALTSKQQSLETAMSFVARNTFKRVRNGFLMRKVAVFFSNTPTRASPQLREAVLKLSDAGITPLFLTRQEDRQLINALQINNTAVGHALVLPAGRDLTDFLENVLTCHVCLDICNIDPSCGFGSWRPSFRDRRAAGSDVDIDMAFILDSAETTTLFQFNEMKKYIAYLVRQLDMSPDPKASQHFARVAVVQHAPSESVDNASMPPVKVEFSLTDYGSKEKLVDFLSRGMTQLQGTRALGSAIEYTIENVFESAPNPRDLKIVVLMLTGEVPEQQLEEAQRVILQAKCKGYFFVVLGIGRKVNIKEVYTFASEPNDVFFKLVDKSTELNEEPLMRFGRLLPSFVSSENAFYLSPDIRKQCDWFQGDQPTKNLVKFGHKQVNVPNNVTSSPTSNPVTTTKPVTTTKPVTTTTKPVTTTTKPVTIINQPSVKPAAAKPAPAKPVAAKPVATKMATVRPPVAVKPATAAKPVAAKPAAVRPPAAAAAKPVATKPEVPRPQAAKPAATKPATTKPMVKMSREVQVFEITENSAKLHWERAEPPGPYFYDLTVTSAHDQSLVLKQNLTVTDRVIGGLLAGQTYHVAVVCYLRSQVRATYHGSFSTKKSQPPPPQPARSASSSTINLMVSTEPLALTETDICKLPKDEGTCRDFILKWYYDPNTKSCARFWYGGCGGNENKFGSQKECEKVCAPVLAKPGVISVMGT

SEQ ID NO: 1029 - protein, 645 aa, Homo sapiens
MLLKKHAGKGGGREPRSEDPTPAEQHCARTMPPCAVLAALLSVVAVVSCLYLGVKTNDLQARIAALESAKGAPSIHLLPDTLDHLKTMVQEKVERLLAQKSYEHMAKIRIAREAPSECNCPAGPPGKRGKRGRRGESGPPGQPGPQGPPGPKGDKGEQGDQGPRGLPGFPTVAALHSNQILTVKGDQGQAGPPGPPGPPGPRGPPGDTGKDGPRGMPGVPGEPGKPGEQGLMGPLGPPGQKGSIGAPGIPGMNGQKGEPGLPGAVGQNGIPGPKGEPGEQGEKGDAGENGPKGDTGEKGDPGSSAAGIKGEPGESGRPGQKGEPGLPGLPGLPGIKGEPGFIGPQGEPGLPGLPGTKGERGEAGPPGRGERGEPGAPGPKGDRGEKGDSGAQGPRGPPGQKGDQGATEIIDYNGNLHEALQGPPGPPGPQGLQGPKGEQGSPGIPGMDGEQGLKGSKGDMGDPGMTGEKGGIGLPGLPGANGMKGEKGDSGMPGPQGPSIIGPPGPPGPHGPPGPMGPHGLPGPKGEPGLNGVKGLKGEPGQKGDRGPLGLPGASGLDGKPGSRGTDGPMGPHGPAGPKGERGEKGAMGEPGPRGPYGLPGFPGPRGEKGDLGEKGEKVTSPSQHVPCLILLLLSALLFSLCDSI

SEQ ID NO: 1030 - protein, 1464 aa, Homo sapiens
MFSFVDLRLLLLLAATALLTHGQEEGQVEGQDEDIPPITCVQNGLRYHDRDVWKPEPCRICVCDNGKVLCDDVICDETKNCPGAEVPEGECCPVCPDGSESPTDQETTGVEGPKGDTGPRGPRGPAGPPGRDGIPGQPGLPGPPGPPGPPGPPGLGGNFAPQLSYGYDEKSTGGISVPGPMGPSGPRGLPGPPGAPGPQGFQGPPGEPGEPGASGPMGPRGPPGPPGKNGDDGEAGKPGRPGERGPPGPQGARGLPGTAGLPGMKGHRGFSGLDGAKGDAGPAGPKGEPGSPGENGAPGQMGPRGLPGERGRPGAPGPAGARGNDGATGAAGPPGPTGPAGPPGFPGAVGAKGEAGPQGPRGSEGPQGVRGEPGPPGPAGAAGPAGNPGADGQPGAKGANGAPGIAGAPGFPGARGPSGPQGPGGPPGPKGNSGEPGAPGSKGDTGAKGEPGPVGVQGPPGPAGEEGKRGARGEPGPTGLPGPPGERGGPGSRGFPGADGVAGPKGPAGERGSPGPAGPKGSPGEAGRPGEAGLPGAKGLTGSPGSPGPDGKTGPPGPAGQDGRPGPPGPPGARGQAGVMGFPGPKGAAGEPGKAGERGVPGPPGAVGPAGKDGEAGAQGPPGPAGPAGERGEQGPAGSPGFQGLPGPAGPPGEAGKPGEQGVPGDLGAPGPSGARGERGFPGERGVQGPPGPAGPRGANGAPGNDGAKGDAGAPGAPGSQGAPGLQGMPGERGAAGLPGPKGDRGDAGPKGADGSPGKDGVRGLTGPIGPPGPAGAPGDKGESGPSGPAGPTGARGAPGDRGEPGPPGPAGFAGPPGADGQPGAKGEPGDAGAKGDAGPPGPAGPAGPPGPIGNVGAPGAKGARGSAGPPGATGFPGAAGRVGPPGPSGNAGPPGPPGPAGKEGGKGPRGETGPAGRPGEVGPPGPPGPAGEKGSPGADGPAGAPGTPGPQGIAGQRGVVGLPGQRGERGFPGLPGPSGEPGKQGPSGASGERGPPGPMGPPGLAGPPGESGREGAPGAEGSPGRDGSPGAKGDRGETGPAGPPGAPGAPGAPGPVGPAGKSGDRGETGPAGPTGPVGPVGARGPAGPQGPRGDKGETGEQGDRGIKGHRGFSGLQGPPGPPGSPGEQGPSGASGPAGPRGPPGSAGAPGKDGLNGLPGPIGPPGPRGRTGDAGPVGPPGPPGPPGPPGPPSAGFDFSFLPQPPQEKAHDGGRYYRADDANVVRDRDLEVDTTLKSLSQQIENIRSPEGSRKNPARTCRDLKMCHSDWKSGEYWIDPNQGCNLDAIKVFCNMETGETCVYPTQPSVAQKNWYISKNPKDKRHVWFGESMTDGFQFEYGGQGSDPADVAIQLTFLRLMSTEASQNITYHCKNSVAYMDQQTGNLKKALLLQGSNEIEIRAEGNSRFTYSVTVDGCTSHTGAWGKTVIEYKTTKTSRLPIIDVAPLDVGAPDQEFGFDVGPVCFL

SEQ ID NO: 1031 - protein, 1418 aa, Homo sapiens
MIRLGAPQTLVLLTLLVAAVLRCQGQDVRQPGPKGQKGEPGDIKDIVGPKGPPGPQGPAGEQGPRGDRGDKGEKGAPGPRGRDGEPGTPGNPGPPGPPGPPGPPGLGGNFAAQMAGGFDEKAGGAQLGVMQGPMGPMGPRGPPGPAGAPGPQGFQGNPGEPGEPGVSGPMGPRGPPGPPGKPGDDGEAGKPGKAGERGPPGPQGARGFPGTPGLPGVKGHRGYPGLDGAKGEAGAPGVKGESGSPGENGSPGPMGPRGLPGERGRTGPAGAAGARGNDGQPGPAGPPGPVGPAGGPGFPGAPGAKGEAGPTGARGPEGAQGPRGEPGTPGSPGPAGASGNPGTDGIPGAKGSAGAPGIAGAPGFPGPRGPPGPQGATGPLGPKGQTGEPGIAGFKGEQGPKGEPGPAGPQGAPGPAGEEGKRGARGEPGGVGPIGPPGERGAPGNRGFPGQDGLAGPKGAPGERGPSGLAGPKGANGDPGRPGEPGLPGARGLTGRPGDAGPQGKVGPSGAPGEDGRPGPPGPQGARGQPGVMGFPGPKGANGEPGKAGEKGLPGAPGLRGLPGKDGETGAAGPPGPAGPAGERGEQGAPGPSGFQGLPGPPGPPGEGGKPGDQGVPGEAGAPGLVGPRGERGFPGERGSPGAQGLQGPRGLPGTPGTDGPKGASGPAGPPGAQGPPGLQGMPGERGAAGIAGPKGDRGDVGEKGPEGAPGKDGGRGLTGPIGPPGPAGANGEKGEVGPPGPAGSAGARGAPGERGETGPPGPAGFAGPPGADGQPGAKGEQGEAGQKGDAGAPGPQGPSGAPGPQGPTGVTGPKGARGAQGPPGATGFPGAAGRVGPPGSNGNPGPPGPPGPSGKDGPKGARGDSGPPGRAGEPGLQGPAGPPGEKGEPGDDGPSGAEGPPGPQGLAGQRGIVGLPGQRGERGFPGLPGPSGEPGKQGAPGASGDRGPPGPVGPPGLTGPAGEPGREGSPGADGPPGRDGAAGVKGDRGETGAVGAPGAPGPPGSPGPAGPTGKQGDRGEAGAQGPMGPSGPAGARGIQGPQGPRGDKGEAGEPGERGLKGHRGFTGLQGLPGPPGPSGDQGASGPAGPSGPRGPPGPVGPSGKDGANGIPGPIGPPGPRGRSGETGPAGPPGNPGPPGPPGPPGPGIDMSAFAGLGPREKGPDPLQYMRADQAAGGLRQHDAEVDATLKSLNNQIESIRSPEGSRKNPARTCRDLKLCHPEWKSGDYWIDPNQGCTLDAMKVFCNMETGETCVYPNPANVPKKNWWSSKSKEKKHIWFGETINGGFHFSYGDDNLAPNTANVQMTFLRLLSTEGSQNITYHCKNSIAYLDEAAGNLKKALLIQGSNDVEIRAEGNSRFTYTALKDGCTKHTGKWGKTVIEYRSQKTSRLPIIDIAPMDIGGPEQEFGVDIGPVCFL

SEQ ID NO: 1032 - protein, 1487 aa, Homo sapiens
MIRLGAPQTLVLLTLLVAAVLRCQGQDVQEAGSCVQDGQRYNDKDVWKPEPCRICVCDTGTVLCDDIICEDVKDCLSPEIPFGECCPICPTDLATASGQPGPKGQKGEPGDIKDIVGPKGPPGPQGPAGEQGPRGDRGDKGEKGAPGPRGRDGEPGTPGNPGPPGPPGPPGPPGLGGNFAAQMAGGFDEKAGGAQLGVMQGPMGPMGPRGPPGPAGAPGPQGFQGNPGEPGEPGVSGPMGPRGPPGPPGKPGDDGEAGKPGKAGERGPPGPQGARGFPGTPGLPGVKGHRGYPGLDGAKGEAGAPGVKGESGSPGENGSPGPMGPRGLPGERGRTGPAGAAGARGNDGQPGPAGPPGPVGPAGGPGFPGAPGAKGEAGPTGARGPEGAQGPRGEPGTPGSPGPAGASGNPGTDGIPGAKGSAGAPGIAGAPGFPGPRGPPGPQGATGPLGPKGQTGEPGIAGFKGEQGPKGEPGPAGPQGAPGPAGEEGKRGARGEPGGVGPIGPPGERGAPGNRGFPGQDGLAGPKGAPGERGPSGLAGPKGANGDPGRPGEPGLPGARGLTGRPGDAGPQGKVGPSGAPGEDGRPGPPGPQGARGQPGVMGFPGPKGANGEPGKAGEKGLPGAPGLRGLPGKDGETGAAGPPGPAGPAGERGEQGAPGPSGFQGLPGPPGPPGEGGKPGDQGVPGEAGAPGLVGPRGERGFPGERGSPGAQGLQGPRGLPGTPGTDGPKGASGPAGPPGAQGPPGLQGMPGERGAAGIAGPKGDRGDVGEKGPEGAPGKDGGRGLTGPIGPPGPAGANGEKGEVGPPGPAGSAGARGAPGERGETGPPGPAGFAGPPGADGQPGAKGEQGEAGQKGDAGAPGPQGPSGAPGPQGPTGVTGPKGARGAQGPPGATGFPGAAGRVGPPGSNGNPGPPGPPGPSGKDGPKGARGDSGPPGRAGEPGLQGPAGPPGEKGEPGDDGPSGAEGPPGPQGLAGQRGIVGLPGQRGERGFPGLPGPSGEPGKQGAPGASGDRGPPGPVGPPGLTGPAGEPGREGSPGADGPPGRDGAAGVKGDRGETGAVGAPGAPGPPGSPGPAGPTGKQGDRGEAGAQGPMGPSGPAGARGIQGPQGPRGDKGEAGEPGERGLKGHRGFTGLQGLPGPPGPSGDQGASGPAGPSGPRGPPGPVGPSGKDGANGIPGPIGPPGPRGRSGETGPAGPPGNPGPPGPPGPPGPGIDMSAFAGLGPREKGPDPLQYMRADQAAGGLRQHDAEVDATLKSLNNQIESIRSPEGSRKNPARTCRDLKLCHPEWKSGDYWIDPNQGCTLDAMKVFCNMETGETCVYPNPANVPKKNWWSSKSKEKKHIWFGETINGGFHFSYGDDNLAPNTANVQMTFLRLLSTEGSQNITYHCKNSIAYLDEAAGNLKKALLIQGSNDVEIRAEGNSRFTYTALKDGCTKHTGKWGKTVIEYRSQKTSRLPIIDIAPMDIGGPEQEFGVDIGPVCFL

SEQ ID NO: 1033 - protein, 1418 aa, Homo sapiens
MIRLGAPQTLVLLTLLVAAVLRCQGQDVRKPAPALEPAAPGSLSQIVGPKGPPGPQGPAGEQGPRGDRGDKGEKGAPGPRGRDGEPGTPGNPGPPGPPGPPGPPGLGGNFAAQMAGGFDEKAGGAQLGVMQGPMGPMGPRGPPGPAGAPGPQGFQGNPGEPGEPGVSGPMGPRGPPGPPGKPGDDGEAGKPGKAGERGPPGPQGARGFPGTPGLPGVKGHRGYPGLDGAKGEAGAPGVKGESGSPGENGSPGPMGPRGLPGERGRTGPAGAAGARGNDGQPGPAGPPGPVGPAGGPGFPGAPGAKGEAGPTGARGPEGAQGPRGEPGTPGSPGPAGASGNPGTDGIPGAKGSAGAPGIAGAPGFPGPRGPPGPQGATGPLGPKGQTGEPGIAGFKGEQGPKGEPGPAGPQGAPGPAGEEGKRGARGEPGGVGPIGPPGERGAPGNRGFPGQDGLAGPKGAPGERGPSGLAGPKGANGDPGRPGEPGLPGARGLTGRPGDAGPQGKVGPSGAPGEDGRPGPPGPQGARGQPGVMGFPGPKGANGEPGKAGEKGLPGAPGLRGLPGKDGETGAAGPPGPAGPAGERGEQGAPGPSGFQGLPGPPGPPGEGGKPGDQGVPGEAGAPGLVGPRGERGFPGERGSPGAQGLQGPRGLPGTPGTDGPKGASGPAGPPGAQGPPGLQGMPGERGAAGIAGPKGDRGDVGEKGPEGAPGKDGGRGLTGPIGPPGPAGANGEKGEVGPPGPAGSAGARGAPGERGETGPPGPAGFAGPPGADGQPGAKGEQGEAGQKGDAGAPGPQGPSGAPGPQGPTGVTGPKGARGAQGPPGATGFPGAAGRVGPPGSNGNPGPPGPPGPSGKDGPKGARGDSGPPGRAGEPGLQGPAGPPGEKGEPGDDGPSGAEGPPGPQGLAGQRGIVGLPGQRGERGFPGLPGPSGEPGKQGAPGASGDRGPPGPVGPPGLTGPAGEPGREGSPGADGPPGRDGAAGVKGDRGETGAVGAPGAPGPPGSPGPAGPTGKQGDRGEAGAQGPMGPSGPAGARGIQGPQGPRGDKGEAGEPGERGLKGHRGFTGLQGLPGPPGPSGDQGASGPAGPSGPRGPPGPVGPSGKDGANGIPGPIGPPGPRGRSGETGPAGPPGNPGPPGPPGPPGPGIDMSAFAGLGPREKGPDPLQYMRADQAAGGLRQHDAEVDATLKSLNNQIESIRSPEGSRKNPARTCRDLKLCHPEWKSGDYWIDPNQGCTLDAMKVFCNMETGETCVYPNPANVPKKNWWSSKSKEKKHIWFGETINGGFHFSYGDDNLAPNTANVQMTFLRLLSTEGSQNITYHCKNSIAYLDEAAGNLKKALLIQGSNDVEIRAEGNSRFTYTALKDGCTKHTGKWGKTVIEYRSQKTSRLPIIDIAPMDIGGPEQEFGVDIGPVCFL

SEQ ID NO: 1034 - protein, 1312 aa, Homo sapiens
MGPRLSVWLLLLPAALLLHEEHSRAAAKGGCAGSGCGKCDCHGVKGQKGERGLPGLQGVIGFPGMQGPEGPQGPPGQKGDTGEPGLPGTKGTRGPPGASGYPGNPGLPGIPGQDGPPGPPGIPGCNGTKGERGPLGPPGLPGFAGNPGDPGEILGHVPGMLLKGERGFPGIPGTPGPPGLPGLQGPVGPPGFTGPPVSFGGCLSEFGHGGISFPLTKRRQGDQGVSGPPGVPGQAQVQEKGDFATKGEKGQKGEPGFQGMPGVGEKGEPGKPGPRGKPGKDGDKGEKGSPGFPGEPGYPGLIGRQGPQVNAGTIAYPLPPCPVIGTGPLGEKGERGYPGTPGPRGEPGPKGSFLAFFPPPPTPPPFAGLPVPGQAGAPGFPGERGEKGDRGFPGTSLPGPSGRDGLPGPPGSPGPPGQPGYTNGIVECQPGPPGDQGPPGIPGQPGFIGEIGEKGQKGESCLICDIDGYRGPPGPQGPPGEIGFPGQPGAKGLPGITGQSGLPGLPGQQGAPGIPGFPGSKGEMGVMGTPGQPGSPGPVGAPGLPGEKGDHGFPGSSGPRGDPGLKGDKGDVGLPGKPGSMDKVDMGSMKGQKGDQGEKGQIGPIGEKGSRGDPGTPGVPGKDGQAGQPGQPGPKGDPGISGTPGAPGLPGPKGSVGGMGLPGTPGEKGVPGIPGPQGSPGLPGDKGAKGEKGQAGPPGIGIPGLRGEKGDQGIAGFPGSPGEKGEKGSIGIPGMPGSPGLKGSPGSVGYPGSPGLPGEKGDKGLPGLDGIPGVKGEAGLPGTPGPTGPAGQKGEPGSDGIPGSAGEKGEPGLPGRGFPGFPGAKGDKGSKGEVGFPGLAGSPGIPGSKGEQGFMGPPGPQGQPGLPGSPGHATEGPKGDRGPQGQPGLPGLPGPMGPPGLPGIDGVKGDKGNPGWPGAPGVPGPKGDPGFQGMPGIGGSPGITGSKGDMGPPGVPGFQGPKGLPGLQGIKGDQGDQGVPGAKGLPGPPGPPGPYDIIKGEPGLPGPEGPPGLKGLQGLPGPKGQQGVTGLVGIPGPPGIPGFDGAPGQKGEMGPAGPTGPRGFPGPPGPDGLPGSMGPPGTPSVDHGFLVTRHSQTIDDPQCPSGTKILYHGYSLLYVQGNERAHGQDLGTAGSCLRKFSTMPFLFCNINNVCNFASRNDYSYWLSTPEPMPMSMAPITGENIRPFISRCAVCEAPAMVMAVHSQTIQIPPCPSGWSSLWIGYSFVMHTSAGAEGSGQALASPGSCLEEFRSAPFIECHGRGTCNYYANAYSFWLATIERSEMFKKPTPSTLKAGELRTHVSRCQVCMRRT

SEQ ID NO: 1035 - protein, 1669 aa, Homo sapiens
MGPRLSVWLLLLPAALLLHEEHSRAAAKGGCAGSGCGKCDCHGVKGQKGERGLPGLQGVIGFPGMQGPEGPQGPPGQKGDTGEPGLPGTKGTRGPPGASGYPGNPGLPGIPGQDGPPGPPGIPGCNGTKGERGPLGPPGLPGFAGNPGPPGLPGMKGDPGEILGHVPGMLLKGERGFPGIPGTPGPPGLPGLQGPVGPPGFTGPPGPPGPPGPPGEKGQMGLSFQGPKGDKGDQGVSGPPGVPGQAQVQEKGDFATKGEKGQKGEPGFQGMPGVGEKGEPGKPGPRGKPGKDGDKGEKGSPGFPGEPGYPGLIGRQGPQGEKGEAGPPGPPGIVIGTGPLGEKGERGYPGTPGPRGEPGPKGFPGLPGQPGPPGLPVPGQAGAPGFPGERGEKGDRGFPGTSLPGPSGRDGLPGPPGSPGPPGQPGYTNGIVECQPGPPGDQGPPGIPGQPGFIGEIGEKGQKGESCLICDIDGYRGPPGPQGPPGEIGFPGQPGAKGDRGLPGRDGVAGVPGPQGTPGLIGQPGAKGEPGEFYFDLRLKGDKGDPGFPGQPGMTGRAGSPGRDGHPGLPGPKGSPGSVGLKGERGPPGGVGFPGSRGDTGPPGPPGYGPAGPIGDKGQAGFPGGPGSPGLPGPKGEPGKIVPLPGPPGAEGLPGSPGFPGPQGDRGFPGTPGRPGLPGEKGAVGQPGIGFPGPPGPKGVDGLPGDMGPPGTPGRPGFNGLPGNPGVQGQKGEPGVGLPGLKGLPGLPGIPGTPGEKGSIGVPGVPGEHGAIGPPGLQGIRGEPGPPGLPGSVGSPGVPGIGPPGARGPPGGQGPPGLSGPPGIKGEKGFPGFPGLDMPGPKGDKGAQGLPGITGQSGLPGLPGQQGAPGIPGFPGSKGEMGVMGTPGQPGSPGPVGAPGLPGEKGDHGFPGSSGPRGDPGLKGDKGDVGLPGKPGSMDKVDMGSMKGQKGDQGEKGQIGPIGEKGSRGDPGTPGVPGKDGQAGQPGQPGPKGDPGISGTPGAPGLPGPKGSVGGMGLPGTPGEKGVPGIPGPQGSPGLPGDKGAKGEKGQAGPPGIGIPGLRGEKGDQGIAGFPGSPGEKGEKGSIGIPGMPGSPGLKGSPGSVGYPGSPGLPGEKGDKGLPGLDGIPGVKGEAGLPGTPGPTGPAGQKGEPGSDGIPGSAGEKGEPGLPGRGFPGFPGAKGDKGSKGEVGFPGLAGSPGIPGSKGEQGFMGPPGPQGQPGLPGSPGHATEGPKGDRGPQGQPGLPGLPGPMGPPGLPGIDGVKGDKGNPGWPGAPGVPGPKGDPGFQGMPGIGGSPGITGSKGDMGPPGVPGFQGPKGLPGLQGIKGDQGDQGVPGAKGLPGPPGPPGPYDIIKGEPGLPGPEGPPGLKGLQGLPGPKGQQGVTGLVGIPGPPGIPGFDGAPGQKGEMGPAGPTGPRGFPGPPGPDGLPGSMGPPGTPSVDHGFLVTRHSQTIDDPQCPSGTKILYHGYSLLYVQGNERAHGQDLGTAGSCLRKFSTMPFLFCNINNVCNFASRNDYSYWLSTPEPMPMSMAPITGENIRPFISRCAVCEAPAMVMAVHSQTIQIPPCPSGWSSLWIGYSFVMHTSAGAEGSGQALASPGSCLEEFRSAPFIECHGRGTCNYYANAYSFWLATIERSEMFKKPTPSTLKAGELRTHVSRCQVCMRRT

SEQ ID NO: 1036 - protein, 1318 aa, Homo sapiens
MGPRLSVWLLLLPAALLLHEEHSRAAAKGGCAGSGCGKCDCHGVKGQKGERGLPGLQGVIGFPGMQGPEGPQGPPGQKGDTGEPGLPGTKGTRGPPGASGYPGNPGLPGIPGQDGPPGPPGIPGCNGTKGERGPLGPPGLPGFAGNPGPPGLPGMKGDPGEILGHVPGMLLKGERGFPGIPGTPGPPGLPGLQGPVGPPGFTGPPGPPGPPGPPGEKGQMGLSFQGPKGDKGDQGVSGPPGVPGQAQVQEKGDFATKGEKGQKGEPGFQGMPGVGEKGEPGKPGPRGKPGKDGDKGEKGSPGFPGEPGYPGLIGRQGPQGEKGEAGPPGPPGIVIGTGPLGEKGERGYPGTPGPRGEPGPKGFPGLPGQPGPPGLPVPGQAGAPGFPGERGEKGDRGFPGTSLPGPSGRDGLPGPPGSPGPPGQPGYTNGIVECQPGPPGDQGPPGIPGQPGFIGEIGEKGQKGESCLICDIDGYRGPPGPQGPPGEIGFPGQPGAKGLPGITGQSGLPGLPGQQGAPGIPGFPGSKGEMGVMGTPGQPGSPGPVGAPGLPGEKGDHGFPGSSGPRGDPGLKGDKGDVGLPGKPGSMDKVDMGSMKGQKGDQGEKGQIGPIGEKGSRGDPGTPGVPGKDGQAGQPGQPGPKGDPGISGTPGAPGLPGPKGSVGGMGLPGTPGEKGVPGIPGPQGSPGLPGDKGAKGEKGQAGPPGIGIPGLRGEKGDQGIAGFPGSPGEKGEKGSIGIPGMPGSPGLKGSPGSVGYPGSPGLPGEKGDKGLPGLDGIPGVKGEAGLPGTPGPTGPAGQKGEPGSDGIPGSAGEKGEPGLPGRGFPGFPGAKGDKGSKGEVGFPGLAGSPGIPGSKGEQGFMGPPGPQGQPGLPGSPGHATEGPKGDRGPQGQPGLPGLPGPMGPPGLPGIDGVKGDKGNPGWPGAPGVPGPKGDPGFQGMPGIGGSPGITGSKGDMGPPGVPGFQGPKGLPGLQGIKGDQGDQGVPGAKGLPGPPGPPGPYDIIKGEPGLPGPEGPPGLKGLQGLPGPKGQQGVTGLVGIPGPPGIPGFDGAPGQKGEMGPAGPTGPRGFPGPPGPDGLPGSMGPPGTPSVDHGFLVTRHSQTIDDPQCPSGTKILYHGYSLLYVQGNERAHGQDLGTAGSCLRKFSTMPFLFCNINNVCNFASRNDYSYWLSTPEPMPMSMAPITGENIRPFISRCAVCEAPAMVMAVHSQTIQIPPCPSGWSSLWIGYSFVMHTSAGAEGSGQALASPGSCLEEFRSAPFIECHGRGTCNYYANAYSFWLATIERSEMFKKPTPSTLKAGELRTHVSRCQVCMRRT

SEQ ID NO: 1037 - protein, 519 aa, Homo sapiens
MGPRLSVWLLLLPAALLLHEEHSRAAAKGGCAGSGCGKCDCHGVKGQKGERGLPGLQGVIGFPGMQGPEGPQGPPGQKGDTGEPGLPGTKGTRGPPGASGYPGNPGLPGIPGQDGPPGPPGIPGCNGTKGERGPLGPPGLPGFAGNPGPPGLPGMKGDPGEILGHVPGMLLKGERGFPGIPGTPGPPGLPGLQGPVGPPGFTGPPGPPGPPGPPGEKGQMGLSFQGPKGDKGDQGVSGPPGVPGQAQVQEKGDFATKGEKGQKGEPGFQGMPGVGEKGEPGKPGPRGKPGKDGDKGEKGSPGFPGEPGYPGLIGRQGPQGEKGEAGPPGPPGIVIGTGPLGEKGERGYPGTPGPRGEPGPKGFPGLPGQPGPPGLPVPGQAGAPGFPGERGEKGDRGFPGTSLPGPSGRDGLPGPPGSPGPPGQPGYTNGIVECQPGPPGDQGPPGIPGQPGFIGEIGEKGQKGESCLICDIDGYRGPPGPQGPPGEIGFPGQPGAKGDRGLPGRDGVAGVPLLFQIHK

SEQ ID NO: 1038 - protein, 598 aa, Homo sapiens
MSDNQSWNSSGSEEDPETESGPPVERCGVLSKWTNYIHGWQDRWVVLKNNALSYYKSEDETEYGCRGSICLSKAVITPHDFDECRFDISVNDSVWYLRAQDPDHRQQWIDAIEQHKTESGYGSESSLRRHGSMVSLVSGASGYSATSTSSFKKGHSLREKLAEMETFRDILCRQVDTLQKYFDACADAVSKDELQRDKVVEDDEDDFPTTRSDGDFLHSTNGNKEKLFPHVTPKGINGIDFKGEAITFKATTAGILATLSHCIELMVKREDSWQKRLDKETEKKRRTEEAYKNAMTELKKKSHFGGPDYEEGPNSLINEEEFFDAVEAALDRQDKIEEQSQSEKVRLHWPTSLPSGDAFSSVGTHRFVQKVEEMVQNHMTYSLQDVGGDANWQLVVEEGEMKVYRREVEENGIVLDPLKATHAVKGVTGHEVCNYFWNVDVRNDWETTIENFHVVETLADNAIIIYQTHKRVWPASQRDVLYLSVIRKIPALTENDPETWIVCNFSVDHDSAPLNNRCVRAKINVAMICQTLVSPPEGNQEISRDNILCKITYVANVNPGGWAPASVLRAVAKREYPKFLKRFTSYVQEKTAGKPILF

SEQ ID NO: 1039 - protein, 229 aa, Homo sapiens
KVEEMVQNHMTYSLQDVGGDANWQLVVEEGEMKVYRREVEENGIVLDPLKATHAVKGVTGHEVCNYFWNVDVRNDWETTIENFHVVETLADNAIIIYQTHKRVWPASQRDVLYLSVIRKIPALTENDPETWIVCNFSVDHDSAPLNNRCVRAKINVAMICQTLVSPPEGNQEISRDNILCKITYVANVNPGGWAPASVLRAVAKREYPKFLKRFTSYVQEKTAGKPILF

SEQ ID NO: 1040 - protein, 752 aa, Homo sapiens
MQHSCIPTPPSPFSAPPAFLPVVTRESRRGLSSGGSAGRNAGVTATAAAADGWKGRLPSPLVLLPRSARCQARRRRGGRTSSLLLLPPTPERALFASPSPDPSPRGLGASSGAAEGAGAGLLLGCRASMSDNQSWNSSGSEEDPETESGPPVERCGVLSKWTNYIHGWQDRWVVLKNNALSYYKSEDETEYGCRGSICLSKAVITPHDFDECRFDISVNDSVWYLRAQDPDHRQQWIDAIEQHKTESGYGSESSLRRHGSMVSLVSGASGYSATSTSSFKKGHSLREKLAEMETFRDILCRQVDTLQKYFDACADAVSKDELQRDKVVEDDEDDFPTTRSDGDFLHSTNGNKEKLFPHVTPKGINGIDFKGEAITFKATTAGILATLSHCIELMVKREDSWQKRLDKETEKKRRTEEAYKNAMTELKKKSHFGGPDYEEGPNSLINEEEFFDAVEAALDRQDKIEEQSQSEKVRLHWPTSLPSGDAFSSVGTHRFVQKPYSRSSSMSSIDLVSASDDVHRFSSQVEEMVQNHMTYSLQDVGGDANWQLVVEEGEMKVYRREVEENGIVLDPLKATHAVKGVTGHEVCNYFWNVDVRNDWETTIENFHVVETLADNAIIIYQTHKRVWPASQRDVLYLSVIRKIPALTENDPETWIVCNFSVDHDSAPLNNRCVRAKINVAMICQTLVSPPEGNQEISRDNILCKITYVANVNPGGWAPASVLRAVAKREYPKFLKRFTSYVQEKTAGKPILF

SEQ ID NO: 1041 - protein, 624 aa, Homo sapiens
MSDNQSWNSSGSEEDPETESGPPVERCGVLSKWTNYIHGWQDRWVVLKNNALSYYKSEDETEYGCRGSICLSKAVITPHDFDECRFDISVNDSVWYLRAQDPDHRQQWIDAIEQHKTESGYGSESSLRRHGSMVSLVSGASGYSATSTSSFKKGHSLREKLAEMETFRDILCRQVDTLQKYFDACADAVSKDELQRDKVVEDDEDDFPTTRSDGDFLHSTNGNKEKLFPHVTPKGINGIDFKGEAITFKATTAGILATLSHCIELMVKREDSWQKRLDKETEKKRRTEEAYKNAMTELKKKSHFGGPDYEEGPNSLINEEEFFDAVEAALDRQDKIEEQSQSEKVRLHWPTSLPSGDAFSSVGTHRFVQKPYSRSSSMSSIDLVSASDDVHRFSSQVEEMVQNHMTYSLQDVGGDANWQLVVEEGEMKVYRREVEENGIVLDPLKATHAVKGVTGHEVCNYFWNVDVRNDWETTIENFHVVETLADNAIIIYQTHKRVWPASQRDVLYLSVIRKIPALTENDPETWIVCNFSVDHDSAPLNNRCVRAKINVAMICQTLVSPPEGNQEISRDNILCKITYVANVNPGGWAPASVLRAVAKREYPKFLKRFTSYVQEKTAGKPILF

SEQ ID NO: 1042 - protein, 126 aa, Homo sapiens
  MOD_RES (1)..(1): Any amino acid
XPASQRDVLYLSVIRKIPALTENDPETWIVCNFSVDHDSAPLNNRCVRAKINVAMICQTLVSPPEGNQEISRDNILCKITYVANVNPGGWAPASVLRAVAKREYPKFLKRFTSYVQEKTAGKPILF

SEQ ID NO: 1043 - protein, 1687 aa, Homo sapiens [sequence omitted]

SEQ ID NO: 1044 - protein, 1690 aa, Homo sapiens
MWSLHIVLMRCSFRLTKSLATGPWSLILILFSVQYVYGSGKKYIGPCGGRDCSVCHCVPEKGSRGPPGPPGPQGPIGPLGAPGPIGLSGEKGMRGDRGPPGAAGDKGDKGPTGVPGFPGLDGIPGHPGPPGPRGKPGMSGHNGSRGDPGFPGGRGALGPGGPLGHPGEKGEKGNSVFILGAVKGIQGDRGDPGLPGLPGSWGAGGPAGPTGYPGEPGLVGPPGQPGRPGLKGNPGVGVKGQMGDPGEVGQQGSPGPTLLVEPPDFCLYKGEKGIKGIPGMVGLPGPPGRKGESGIGAKGEKGIPGFPGPRGDPGSYGSPGFPGLKGELGLVGDPGLFGLIGPKGDPGNRGHPGPPGVLVTPPLPLKGPPGDPGFPGRYGETGDVGPPGPPGLLGRPGEACAGMIGPPGPQGFPGLPGLPGEAGIPGRPDSAPGKPGKPGSPGLPGAPGLQGLPGSSVIYCSVGNPGPQGIKGKVGPPGGRGPKGEKGNEGLCACEPGPMGPPGPPGLPGRQGSKGDLGLPGWLGTKGDPGPPGAEGPPGLPGKHGASGPPGNKGAKGDMVVSRVKGHKGERGPDGPPGFPGQPGSHGRDGHAGEKGDPGPPGDHEDATPGGKGFPGPLGPPGKAGPVGPPGLGFPGPPGERGHPGVPGHPGVRGPDGLKGQKGDTISCNVTYPGRHGPPGFDGPPGPKGFPGPQGAPGLSGSDGHKGRPGTPGTAEIPGPPGFRGDMGDPGFGGEKGSSPVGPPGPPGSPGVNGQKGIPGDPAFGHLGPPGKRGLSGVPGIKGPRGDPGCPGAEGPAGIPGFLGLKGPKGREGHAGFPGVPGPPGHSCERGAPGIPGQPGLPGYPGSPGAPGGKGQPGDVGPPGPAGMKGLPGLPGRPGAHGPPGLPGIPGPFGDDGLPGPPGPKGPRGLPGFPGFPGERGKPGAEGCPGAKGEPGEKGMSGLPGDRGLRGAKGAIGPPGDEGEMAIISQKGTPGEPGPPGDDGFPGERGDKGTPGMQGRRGEPGRYGPPGFHRGEPGEKGQPGPPGPPGPPGSTGLRGFIGFPGLPGDQGEPGSPGPPGFSGIDGARGPKGNKGDPASHFGPPGPKGEPGSPGCPGHFGASGEQGLPGIQGPRGSPGRPGPPGSSGPPGCPGDHGMPGLRGQPGEMGDPGPRGLQGDPGIPGPPGIKGPSGSPGLNGLHGLKGQKGTKGASGLHDVGPPGPVGIPGLKGERGDPGSPGISPPGPRGKKGPPGPPGSSGPPGPAGATGRAPKDIPDPGPPGDQGPPGPDGPRGAPGPPGLPGSVDLLRGEPGDCGLPGPPGPPGPPGPPGYKGFPGCDGKDGQKGPVGFPGPQGPHGFPGPPGEKGLPGPPGRKGPTGLPGPRGEPGPPADVDDCPRIPGLPGAPGMRGPEGAMGLPGMRGPSGPGCKGEPGLDGRRGVDGVPGSPGPPGRKGDTGEDGYPGGPGPPGPIGDPGPKGFGPGYLGGFLLVLHSQTDQEPTCPLGMPRLWTGYSLLYLEGQEKAHNQDLGLAGSCLPVFSTLPFAYCNIHQVCHYAQRNDRSYWLASAAPLPMMPLSEEAIRPYVSRCAVCEAPAQAVAVHSQDQSIPPCPQTWRSLWIGYSFLMHTGAGDQGGGQALMSPGSCLEDFRAAPFLECQGRQGTCHFFANKYSFWLTTVKADLQFSSAPAPDTLKESQAQRQKISRCQVCVKYS

SEQ ID NO: 1045 - protein, 1691 aa, Homo sapiens
MKLRGVSLAAGLFLLALSLWGQPAEAAACYGCSPGSKCDCSGIKGEKGERGFPGLEGHPGLPGFPGPEGPPGPRGQKGDDGIPGPPGPKGIRGPPGLPGFPGTPGLPGMPGHDGAPGPQGIPGCNGTKGERGFPGSPGFPGLQGPPGPPGIPGMKGEPGSIIMSSLPGPKGNPGYPGPPGIQGLPGPTGIPGPIGPPGPPGLMGPPGPPGLPGPKGNMGLNFQGPKGEKGEQGLQGPPGPPGQISEQKRPIDVEFQKGDQGLPGDRGPPGPPGIRGPPGPPGGEKGEKGEQGEPGKRGKPGKDGENGQPGIPGLPGDPGYPGEPGRDGEKGQKGDTGPPGPPGLVIPRPGTGITIGEKGNIGLPGLPGEKGERGFPGIQGPPGLPGPPGAAVMGPPGPPGFPGERGQKGDEGPPGISIPGPPGLDGQPGAPGLPGPPGPAGPHIPPSDEICEPGPPGPPGSPGDKGLQGEQGVKGDKGDTCFNCIGTGISGPPGQPGLPGLPGPPGSLGFPGQKGEKGQAGATGPKGLPGIPGAPGAPGFPGSKGEPGDILTFPGMKGDKGELGSPGAPGLPGLPGTPGQDGLPGLPGPKGEPGGITFKGERGPPGNPGLPGLPGNIGPMGPPGFGPPGPVGEKGIQGVAGNPGQPGIPGPKGDPGQTITQPGKPGLPGNPGRDGDVGLPGDPGLPGQPGLPGIPGSKGEPGIPGIGLPGPPGPKGFPGIPGPPGAPGTPGRIGLEGPPGPPGFPGPKGEPGFALPGPPGPPGLPGFKGALGPKGDRGFPGPPGPPGRTGLDGLPGPKGDVGPNGQPGPMGPPGLPGIGVQGPPGPPGIPGPIGQPGLHGIPGEKGDPGPPGLDVPGPPGERGSPGIPGAPGPIGPPGSPGLPGKAGASGFPGTKGEMGMMGPPGPPGPLGIPGRSGVPGLKGDDGLQGQPGLPGPTGEKGSKGEPGLPGPPGPMDPNLLGSKGEKGEPGLPGIPGVSGPKGYQGLPGDPGQPGLSGQPGLPGPPGPKGNPGLPGQPGLIGPPGLKGTIGDMGFPGPQGVEGPPGPSGVPGQPGSPGLPGQKGDKGDPGISSIGLPGLPGPKGEPGLPGYPGNPGIKGSVGDPGLPGLPGTPGAKGQPGLPGFPGTPGPPGPKGISGPPGNPGLPGEPGPVGGGGHPGQPGPPGEKGKPGQDGIPGPAGQKGEPGQPGFGNPGPPGLPGLSGQKGDGGLPGIPGNPGLPGPKGEPGFHGFPGVQGPPGPPGSPGPALEGPKGNPGPQGPPGRPGPTGFQGLPGPEGPPGLPGNGGIKGEKGNPGQPGLPGLPGLKGDQGPPGLQGNPGRPGLNGMKGDPGLPGVPGFPGMKGPSGVPGSAGPEGEPGLIGPPGPPGLPGPSGQSIIIKGDAGPPGIPGQPGLKGLPGPQGPQGLPGPTGPPGDPGRNGLPGFDGAGGRKGDPGLPGQPGTRGLDGPPGPDGLQGPPGPPGTSSVAHGFLITRHSQTTDAPQCPQGTLQVYEGFSLLYVQGNKRAHGQDLGTAGSCLRRFSTMPFMFCNINNVCNFASRNDYSYWLSTPEPMPMSMQPLKGQSIQPFISRCAVCEAPAVVIAVHSQTIQIPHCPQGWDSLWIGYSFMMHTSAGAEGSGQALASPGSCLEEFRSAPFIECHGRGTCNYYANSYSFWLATVDVSDMFSKPQSETLKAGDLRTRISRCQVCMKRT

SEQ ID NO: 1046 - protein, 1685 aa, Homo sapiens
MKLRGVSLAAGLFLLALSLWGQPAEAAACYGCSPGSKCDCSGIKGEKGERGFPGLEGHPGLPGFPGPEGPPGPRGQKGDDGIPGPPGPKGIRGPPGLPGFPGTPGLPGMPGHDGAPGPQGIPGCNGTKGERGFPGSPGFPGLQGPPGPPGIPGMKGEPGSIIMSSLPGPKGNPGYPGPPGIQGLPGPTGIPGPIGPPGPPGLMGPPGPPGLPGPKGNMGLNFQGPKGEKGEQGLQGPPGPPGQISEQKRPIDVEFQKGDQGLPGDRGPPGPPGIRGPPGPPGGEKGEKGEQGEPGKRGKPGKDGENGQPGIPGLPGDPGYPGEPGRDGEKGQKGDTGPPGPPGLVIPRPGTGITIGEKGNIGLPGLPGEKGERGFPGIQGPPGLPGPPGAAVMGPPGPPGFPGERGQKGDEGPPGISIPGPPGLDGQPGAPGLPGPPGPAGPHIPPSDEICEPGPPGPPGSPGDKGLQGEQGVKGDKGDTCFNCIGTGISGPPGQPGLPGLPGPPGSLGFPGQKGEKGQAGATGPKGLPGIPGAPGAPGFPGSKGEPGDILTFPGMKGDKGELGSPGAPGLPGLPGTPGQDGLPGLPGPKGEPGGITFKGERGPPGNPGLPGLPGNIGPMGPPGFGPPGPVGEKGIQGVAGNPGQPGIPGPKGDPGQTITQPGKPGLPGNPGRDGDVGLPGDPGLPGQPGLPGIPGSKGEPGIPGIGLPGPPGPKGFPGIPGPPGAPGTPGRIGLEGPPGPPGFPGPKGEPGFALPGPPGPPGLPGFKGALGPKGDRGFPGPPGPPGRTGLDGLPGPKGDVGPNGQPGPMGPPGLPGIGVQGPPGPPGIPGPIGQPGLHGIPGEKGDPGPPGLDVPGPPGERGSPGIPGAPGPIGPPGSPGLPGKAGASGFPGTKGEMGMMGPPGPPGPLGIPGRSGVPGLKGDDGLQGQPGLPGPTGEKGSKGEPGLPGPPGPMDPNLLGSKGEKGEPGLPGIPGVSGPKGYQGLPGDPGQPGLSGQPGLPGPPGPKGNPGLPGQPGLIGPPGLKGTIGDMGFPGPQGVEGPPGPSGVPGQPGSPGLPGQKGDKGDPGISSIGLPGLPGPKGEPGLPGYPGNPGIKGSVGDPGLPGLPGTPGAKGQPGLPGFPGTPGPPGPKGISGPPGNPGLPGEPGPVGGGGHPGQPGPPGEKGKPGQDGIPGPAGQKGEPGQPGFGNPGPPGLPGLSGQKGDGGLPGIPGNPGLPGPKGEPGFHGFPGVQGPPGPPGSPGPALEGPKGNPGPQGPPGRPGLPGPEGPPGLPGNGGIKGEKGNPGQPGLPGLPGLKGDQGPPGLQGNPGRPGLNGMKGDPGLPGVPGFPGMKGPSGVPGSAGPEGEPGLIGPPGPPGLPGPSGQSIIIKGDAGPPGIPGQPGLKGLPGPQGPQGLPGPTGPPGDPGRNGLPGFDGAGGRKGDPGLPGQPGTRGLDGPPGPDGLQGPPGPPGTSSVAHGFLITRHSQTTDAPQCPQGTLQVYEGFSLLYVQGNKRAHGQDLGTAGSCLRRFSTMPFMFCNINNVCNFASRNDYSYWLSTPEPMPMSMQPLKGQSIQPFISRCAVCEAPAVVIAVHSQTIQIPHCPQGWDSLWIGYSFMMHTSAGAEGSGQALASPGSCLEEFRSAPFIECHGRGTCNYYANSYSFWLATVDVSDMFSKPQSETLKAGDLRTRISRCQVCMKRT

SEQ ID NO: 1047 - protein, 1691 aa, Homo sapiens
MKLRGVSLAAGLFLLALSLWGQPAEAAACYGCSPGSKCDCSGIKGEKGERGFPGLEGHPGLPGFPGPEGPPGPRGQKGDDGIPGPPGPKGIRGPPGLPGFPGTPGLPGMPGHDGAPGPQGIPGCNGTKGERGFPGSPGFPGLQGPPGPPGIPGMKGEPGSIIMSSLPGPKGNPGYPGPPGIQGLPGPTGIPGPIGPPGPPGLMGPPGPPGLPGPKGNMGLNFQGPKGEKGEQGLQGPPGPPGQISEQKRPIDVEFQKGDQGLPGDRGPPGPPGIRGPPGPPGGEKGEKGEQGEPGKRGKPGKDGENGQPGIPGLPGDPGYPGEPGRDGEKGQKGDTGPPGPPGLVIPRPGTGITIGEKGNIGLPGLPGEKGERGFPGIQGPPGLPGPPGAAVMGPPGPPGFPGERGQKGDEGPPGISIPGPPGLDGQPGAPGLPGPPGPAGPHIPPSDEICEPGPPGPPGSPGDKGLQGEQGVKGDKGDTCFNCIGTGISGPPGQPGLPGLPGPPGSLGFPGQKGEKGQAGATGPKGLPGIPGAPGAPGFPGSKGEPGDILTFPGMKGDKGELGSPGAPGLPGLPGTPGQDGLPGLPGPKGEPGGITFKGERGPPGNPGLPGLPGNIGPMGPPGFGPPGPVGEKGIQGVAGNPGQPGIPGPKGDPGQTITQPGKPGLPGNPGRDGDVGLPGDPGLPGQPGLPGIPGSKGEPGIPGIGLPGPPGPKGFPGIPGPPGAPGTPGRIGLEGPPGPPGFPGPKGEPGFALPGPPGPPGLPGFKGALGPKGDRGFPGPPGPPGRTGLDGLPGPKGDVGPNGQPGPMGPPGLPGIGVQGPPGPPGIPGPIGQPGLHGIPGEKGDPGPPGLDVPGPPGERGSPGIPGAPGPIGPPGSPGLPGKAGASGFPGTKGEMGMMGPPGPPGPLGIPGRSGVPGLKGDDGLQGQPGLPGPTGEKGSKGEPGLPGPPGPMDPNLLGSKGEKGEPGLPGIPGVSGPKGYQGLPGDPGQPGLSGQPGLPGPPGPKGNPGLPGQPGLIGPPGLKGTIGDMGFPGPQGVEGPPGPSGVPGQPGSPGLPGQKGDKGDPGISSIGLPGLPGPKGEPGLPGYPGNPGIKGSVGDPGLPGLPGTPGAKGQPGLPGFPGTPGPPGPKGISGPPGNPGLPGEPGPVGGGGHPGQPGPPGEKGKPGQDGIPGPAGQKGEPGQPGFGNPGPPGLPGLSGQKGDGGLPGIPGNPGLPGPKGEPGFHGFPGVQGPPGPPGSPGPALEGPKGNPGPQGPPGRPGPTGFQSLPGPEGPPGLPGNGGIKGEKGNPGQPGLPGLPGLKGDQGPPGLQGNPGRPGLNGMKGDPGLPGVPGFPGMKGPSGVPGSAGPEGEPGLIGPPGPPGLPGPSGQSIIIKGDAGPPGIPGQPGLKGLPGPQGPQGLPGPTGPPGDPGRNGLPGFDGAGGRKGDPGLPGQPGTRGLDGPPGPDGLQGPPGPPGTSSVAHGFLITRHSQTTDAPQCPQGTLQVYEGFSLLYVQGNKRAHGQDLGTAGSCLRRFSTMPFMFCNINNVCNFASRNDYSYWLSTPEPMPMSMQPLKGQSIQPFISRCAVCEAPAVVIAVHSQTIQIPHCPQGWDSLWIGYSFMMHTSAGAEGSGQALASPGSCLEEFRSAPFIECHGRGTCNYYANSYSFWLATVDVSDMFSKPQSETLKAGDLRTRISRCQVCMKRT

SEQ ID NO: 1048 - protein, 1690 aa, Homo sapiens
MHPGLWLLLVTLCLTEELAAAGEKSYGKPCGGQDCSGSCQCFPEKGARGRPGPIGIQGPTGPQGFTGSTGLSGLKGERGFPGLLGPYGPKGDKGPMGVPGFLGINGIPGHPGQPGPRGPPGLDGCNGTQGAVGFPGPDGYPGLLGPPGLPGQKGSKGDPVLAPGSFKGMKGDPGLPGLDGITGPQGAPGFPGAVGPAGPPGLQGPPGPPGPLGPDGNMGLGFQGEKGVKGDVGLPGPAGPPPSTGELEFMGFPKGKKGSKGEPGPKGFPGISGPPGFPGLGTTGEKGEKGEKGIPGLPGPRGPMGSEGVQGPPGQQGKKGTLGFPGLNGFQGIEGQKGDIGLPGPDVFIDIDGAVISGNPGDPGVPGLPGLKGDEGIQGLRGPSGVPGLPALSGVPGALGPQGFPGLKGDQGNPGRTTIGAAGLPGRDGLPGPPGPPGPPSPEFETETLHNKESGFPGLRGEQGPKGNLGLKGIKGDSGFCACDGGVPNTGPPGEPGPPGPWGLIGLPGLKGARGDRGSGGAQGPAGAPGLVGPLGPSGPKGKKGEPILSTIQGMPGDRGDSGSQGFRGVIGEPGKDGVPGLPGLPGLPGDGGQGFPGEKGLPGLPGEKGHPGPPGLPGNGLPGLPGPRGLPGDKGKDGLPGQQGLPGSKGITLPCIIPGSYGPSGFPGTPGFPGPKGSRGLPGTPGQPGSSGSKGEPGSPGLVHLPELPGFPGPRGEKGLPGFPGLPGKDGLPGMIGSPGLPGSKGATGDIFGAENGAPGEQGLQGLTGHKGFLGDSGLPGLKGVHGKPGLLGPKGERGSPGTPGQVGQPGTPGSSGPYGIKGKSGLPGAPGFPGISGHPGKKGTRGKKGPPGSIVKKGLPGLKGLPGNPGLVGLKGSPGSPGVAGLPALSGPKGEKGSVGFVGFPGIPGLPGIPGTRGLKGIPGSTGKMGPSGRAGTPGEKGDRGNPGPVGIPSPRRPMSNLWLKGDKGSQGSAGSNGFPGPRGDKGEAGRPGPPGLPGAPGLPGIIKGVSGKPGPPGFMGIRGLPGLKGSSGITGFPGMPGESGSQGIRGSPGLPGASGLPGLKGDNGQTVEISGSPGPKGQPGESGFKGTKGRDGLIGNIGFPGNKGEDGKVGVSGDVGLPGAPGFPGVAGMRGEPGLPGSSGHQGAIGPLGSPGLIGPKGFPGFPGLHGLNGLPGTKGTHGTPGPSITGVPGPAGLPGPKGEKGYPGIGIGAPGKPGLRGQKGDRGFPGLQGPAGLPGAPGISLPSLIAGQPGDPGRPGLDGERGRPGPAGPPGPPGPSSNQGDTGDPGFPGIPGPKGPKGDQGIPGFSGLPGELGLKGMRGEPGFMGTPGKVGPPGDPGFPGMKGKAGPRGSSGLQGDPGQTPTAEAVQVPPGPLGLPGIDGIPGLTGDPGAQGPVGLQGSKGLPGIPGKDGPSGLPGPPGALGDPGLPGLQGPPGFEGAPGQQGPFGMPGMPGQSMRVGYTLVKHSQSEQVPPCPIGMSQLWVGYSLLFVEGQEKAHNQDLGFAGSCLPRFSTMPFIYCNINEVCHYARRNDKSYWLSTTAPIPMMPVSQTQIPQYISRCSVCEAPSQAIAVHSQDITIPQCPLGWRSLWIGYSFLMHTAAGAEGGGQSLVSPGSCLEDFRATPFIECSGARGTCHYFANKYSFWLTTVEERQQFGELPVSETLKAGQLHTRVSRCQVCMKSL

SEQ ID NO: 1049 - protein, 1691 aa, Homo sapiens
MLINKLWLLLVTLCLTEELAAAGEKSYGKPCGGQDCSGSCQCFPEKGARGRPGPIGIQGPTGPQGFTGSTGLSGLKGERGFPGLLGPYGPKGDKGPMGVPGFLGINGIPGHPGQPGPRGPPGLDGCNGTQGAVGFPGPDGYPGLLGPPGLPGQKGSKGDPVLAPGSFKGMKGDPGLPGLDGITGPQGAPGFPGAVGPAGPPGLQGPPGPPGPLGPDGNMGLGFQGEKGVKGDVGLPGPAGPPPSTGELEFMGFPKGKKGSKGEPGPKGFPGISGPPGFPGLGTTGEKGEKGEKGIPGLPGPRGPMGSEGVQGPPGQQGKKGTLGFPGLNGFQGIEGQKGDIGLPGPDVFIDIDGAVISGNPGDPGVPGLPGLKGDEGIQGLRGPSGVPGLPALSGVPGALGPQGFPGLKGDQGNPGRTTIGAAGLPGRDGLPGPPGPPGPPSPEFETETLHNKESGFPGLRGEQGPKGNLGLKGIKGDSGFCACDGGVPNTGPPGEPGPPGPWGLIGLPGLKGARGDRGSGGAQGPAGAPGLVGPLGPSGPKGKKGEPILSTIQGMPGDRGDSGSQGFRGVIGEPGKDGVPGLPGLPGLPGDGGQGFPGEKGLPGLPGEKGHPGPPGLPGNGLPGLPGPRGLPGDKGKDGLPGQQGLPGSKGITLPCIIPGSYGPSGFPGTPGFPGPKGSRGLPGTPGQPGSSGSKGEPGSPGLVHLPELPGFPGPRGEKGLPGFPGLPGKDGLPGMIGSPGLPGSKGATGDIFGAENGAPGEQGLQGLTGHKGFLGDSGLPGLKGVHGKPGLLGPKGERGSPGTPGQVGQPGTPGSSGPYGIKGKSGLPGAPGFPGISGHPGKKGTRGKKGPPGSIVKKGLPGLKGLPGNPGLVGLKGSPGSPGVAGLPALSGPKGEKGSVGFVGFPGIPGLPGIPGTRGLKGIPGSTGKMGPSGRAGTPGEKGDRGNPGPVGIPSPRRPMSNLWLKGDKGSQGSAGSNGFPGPRGDKGEAGRPGPPGLPGAPGLPGIIKGVSGKPGPPGFMGIRGLPGLKGSSGITGFPGMPGESGSQGIRGSPGLPGASGLPGLKGDNGQTVEISGSPGPKGQPGESGFKGTKGRDGLIGNIGFPGNKGEDGKVGVSGDVGLPGAPGFPGVAGMRGEPGLPGSSGHQGAIGPLGSPGLIGPKGFPGFPGLHGLNGLPGTKGTHGTPGPSITGVPGPAGLPGPKGEKGYPGIGIGAPGKPGLRGQKGDRGFPGLQGPAGLPGAPGISLPSLIAGQPGDPGRPGLDGERGRPGPAGPPGPPGPSSNQGDTGDPGFPGIPGPKGPKGDQGIPGFSGLPGELGLKGMRGEPGFMGTPGKVGPPGDPGFPGMKGKAGPRGSSGLQGDPGQTPTAEAVQVPPGPLGLPGIDGIPGLTGDPGAQGPVGLQGSKGLPGIPGKDGPSGLPGPPGALGDPGLPGLQGPPGFEGAPGQQGPFGMPGMPGQSMRVGYTLVKHSQSEQVPPCPIGMSQLWVGYSLLFVEGQEKAHNQDLGFAGSCLPRFSTMPFIYCNINEVCHYARRNDKSYWLSTTAPIPMMPVSQTQIPQYISRCSVCEAPSQAIAVHSQDITIPQCPLGWRSLWIGYSFLMHTAAGAEGGGQSLVSPGSCLEDFRATPFIECSGARGTCHYFANKYSFWLTTVEERQQFGELPVSETLKAGQLHTRVSRCQVCMKSL

SEQ ID NO: 1050 - protein, 1691 aa, Homo sapiens
MHPGLWLLLVTLCLTEELAAAGEKSYGKPCGGQDCSGSCQCFPEKGARGRPGPIGIQGPTGPQGFTGSTGLSGLKGERGFPGLLGPYGPKGDKKFSIPVLLIYDSRPGHPGQPGPRGPPGLDGCNGTQGAVGFPGPDGYPGLLGPPGLPGQKGSKGDPVLAPGSFKGMKAFIPLFESIRGPQGAPGFPGAVGPAGPPGLQQGQPPFLEVLFPHWHEGEEAKVRDSLFGDVGLPGPAGPPPSTGELEFMGFPKGKKGSKGEPGPKGFPGISGPPGFPGLGTTGEKGEKGEKGIPGLPGPRTLLCSHTFHLVVTMFLSQGKKGTLGFPGLNGFQGIEGQKGDIGLPGPDVFIDIDGAVISGNPGDPGVPGLPGLKGDEGIQGLRGPSGVPGLPALSGVPGALGPQGFPGLKGDQGNPGRTTIGAAGLPGRDGLPGPPGPPGPPSPEFETETLHNKESGFPGLRGEQGPKGNLGLKGIKGDSGFCACDGGVPNTGPPGEPGPPGPWGLIGLPGLKGARGDRGSGGAQGPAGAPGLVGPLGPSGPKGKKGEPILSTIQGMPGDRGDSGSQGFRGVIGEPGKDGVPGLPGLPGLPGDGGQGFPGEKGLPGLPGEKGHPGPPGLPGNGLPGLPGPRGLPGDKGKDGLPGQQGLPGSKGITLPCIIPGSYGPSGFPGTPGFPGPKGSRGLPGTPGQPGSSGSKGEPGSPGLVHLPELPGFPGPRGEKGLPGFPGLPGKDGLPGMIGSPGLPGSKGATGDIFGAENGAPGEQGLQGLTGHKGFLGDSGLPGLKGVHGKPGLLGPKGERGSPGTPGQVGQPGTPGSSGPYGIKGKSGLPGAPGFPGISGHPGKKGTRGKKGPPGSIVKKGLPGLKGLPGNPGLVGLKGSPGSPGVAGLPALSGPKGEKGSVGFVGFPGIPGLPGIPGTRGLKGIPGSTGKMGPSGRAGTPGEKGDRGNPGPVGIPSPRRPMSNLWLKGDKGSQGSAGSNGFPGPRGDKGEAGRPGPPGLPGAPGLPGIIKGVSGKPGPPGFMGIRGLPGLKGSSGITGFPGMPGESGSQGIRGSPGLPGASGLPGLKGDNGQTVEISGSPGPKGQPGESGFKGTKGRDGLIGNIGFPGNKGEDGKVGVSGDVGLPGAPGFPGVAGMRGEPGLPGSSGHQGAIGPLGSPGLIGPKGFPGFPGLHGLNGLPGTKGTHGTPGPSITGVPGPAGLPGPKGEKGYPGIGIGAPGKPGLRGQKGDRGFPGLQGPAGLPGAPGISLPSLIAGQPGDPGRPGLDGERGRPGPAGPPGPPGPSSNQGDTGDPGFPGIPGPKGPKGDQGIPGFSGLPGELGLKGMRGEPGFMGTPGKVGPPGDPGFPGMKGKAGPRGSSGLQGDPGQTPTAEAVQVPPGPLGLPGIDGIPGLTGDPGAQGPVGLQGSKGLPGIPGKDGPSGLPGPPGALGDPGLPGLQGPPGFEGAPGQQGPFGMPGMPGQSMRVGYTLVKHSQSEQVPPCPIGMSQLWVGYSLLFVEGQEKAHNQDLGFAGSCLPRFSTMPFIYCNINEVCHYARRNDKSYWLSTTAPIPMMPVSQTQIPQYISRCSVCEAPSQAIAVHSQDITIPQCPLGWRSLWIGYSFLMHTAAGAEGGGQSLVSPGSCLEDFRATPFIECSGARGTCHYFANKYSFWLTTVEERQQFGELPVSETLKAGQLHTRVSRCQVCMKSL

SEQ ID NO: 1051 - protein, 260 aa, Homo sapiens
MLQDWKERAASVWCKWLDVNPNHHLVKAPQPDLPCPCPLSLLPGFAGSCLPRFSTMPFIYCNINEVCHYARRNDKSYWLSTTAPIPMMPVSQTQIPQYISRCSVCEAPSQAIAVHSQDITIPQCPLGWRSLWIGYSFLMHTAAGAEGGGQSLVSPGSCLEDFRATPFIECSGARGTCHYFANKYSFWLTTVEERQQFGELPVSETLKAGQLHTRVSRCQPGFTGPGIKEWKWKWHHSPSAPVIHQQNFCFLFPRHYVLLA

SEQ ID NO: 1052 - protein, 1633 aa, Homo sapiens
MHPGLWLLLVTLCLTEELAAAGEKSYGKPCGGQDCSGSCQCFPEKGARGRPGPIGIQGPTGPQGFTGSTGLSGLKGERGFPGLLGPYGPKGDKGPMGVPGFLGINGIPGHPGQPGPRGPPGLDGCNGTQGAVGFPGPDGYPGLLGPPGLPGQKGSKGDPVLAPGSFKGMKGDPGLPGLDGITGPQGAPGFPGAVGPAGPPGLQGPPGPPGPLGPDGNMGLGFQGEKGVKGDVGLPGPAGPPPSTGELEFMGFPKGKKGSKGEPGPKGFPGISGPPGFPGLGTTGEKGEKGEKGIPGLPGPRGPMGSEGVQGPPGQQGKKGTLGFPGLNGFQGIEGQKGDIGLPGPDVFIDIDGAVISGNPGDPGVPGLPGLKGDEGIQGLRGPSGVPGLPALSGVPGALGPQGFPGLKGDQGNPGRTTIGAAGLPGRDGLPGPPGPPGPPSPEFETETLHNKESGFPGLRGEQGPKGNLGLKGIKGDSGFCACDGGVPNTGPPGEPGPPGPWGLIGLPGLKGARGDRGSGGAQGPAGAPGLVGPLGPSGPKGKKGEPILSTIQGMPGDRGDSGSQGFRGVIGEPGKDGVPGLPGLPGLPGDGGQGFPGEKGLPGLPGEKGHPGPPGLPGNGLPGLPGPRGLPGDKGKDGLPGQQGLPGSKGITLPCIIPGSYGPSGFPGTPGFPGPKGSRGLPGTPGQPGSSGSKGEPGSPGLVHLPELPGFPGPRGEKGLPGFPGLPGKDGLPGMIGSPGLPGSKGATGDIFGAENGAPGEQGLQGLTGHKGFLGDSGLPGLKGVHGKPGLLGPKGERGSPGTPGQVGQPGTPGSSGPYGIKGKSGLPGAPGFPGISGHPGKKGTRGKKGPPGSIVKKGLPGLKGLPGNPGLVGLKGSPGSPGVAGLPALSGPKGEKGSVGFVGFPGIPGLPGIPGTRGLKGIPGSTGKMGPSGRAGTPGEKGDRGNPGPVGIPSPRRPMSNLWLKGDKGSQGSAGSNGFPGPRGDKGEAGRPGPPGLPGAPGLPGIIKGVSGKPGPPGFMGIRGLPGLKGSSGITGFPGMPGESGSQGIRGSPGLPGASGLPGLKGDNGQTVEISGSPGPKGQPGESGFKGTKGRDGLIGNIGFPGNKGEDGKVGVSGDVGLPGAPGFPGVAGMRGEPGLPGSSGHQGAIGPLGSPGLIGPKGPSITGVPGPAGLPGPKGEKGYPGIGIGAPGKPGLRGQKGDRGFPGLQGPAGLPGAPGISLPSLIAGQPGDPGRPGLDGERGRPGPAGPPGPPGPSSNQGDTGDPGFPGIPGPKGPKGDQGIPGFSGLPGELGLKGSSGLQGDPGQTPTAEAVQVPPGPLGLPGIDGIPGLTGDPGAQGPVGLQGSKGLPGIPGKDGPSGLPGPPGALGDPGLPGLQGPPGFEGAPGQQGPFGMPGMPGQSMRVGYTLVKHSQSEQVPPCPIGMSQLWVGYSLLFVEGQEKAHNQDLGFAGSCLPRFSTMPFIYCNINEVCHYARRNDKSYWLSTTAPIPMMPVSQTQIPQYISRCSVCEAPSQAIAVHSQDITIPQCPLGWRSLWIGYSFLMHTAAGAEGGGQSLVSPGSCLEDFRATPFIECSGARGTCHYFANKYSFWLTTVEERQQFGELPVSETLKAGQLHTRVSRCQVCMKSL

SEQ ID NO: 1053 - protein, 1666 aa, Homo sapiens
MHPGLWLLLVTLCLTEELAAAGEKSYGKPCGGQDCSGSCQCFPEKGARGRPGPIGIQGPTGPQGFTGSTGLSGLKGERGFPGLLGPYGPKGDKGPMGVPGFLGINGIPGHPGQPGPRGPPGLDGCNGTQGAVGFPGPDGYPGLLGPPGLPGQKGSKGDPVLAPGSFKGMKGDPGLPGLDGITGPQGAPGFPGAVGPAGPPGLQGPPGPPGPLGPDGNMGLGFQGEKGVKGDVGLPGPAGPPPSTGELEFMGFPKGKKGSKGEPGPKGFPGISGPPGFPGLGTTGEKGEKGEKGIPGLPGPRGPMGSEGVQGPPGQQGKKGTLGFPGLNGFQGIEGQKGDIGLPGPDVFIDIDGAVISGNPGDPGVPGLPGLKGDEGIQGLRGPSGVPGLPALSGVPGALGPQGFPGLKGDQGNPGRTTIGAAGLPGRDGLPGPPGPPGPPSPEFETETLHNKESGFPGLRGEQGPKGNLGLKGIKGDSGFCACDGGVPNTGPPGEPGPPGPWGLIGLPGLKGARGDRGSGGAQGPAGAPGLVGPLGPSGPKGKKGEPILSTIQGMPGDRGDSGSQGFRGVIGEPGKDGVPGLPGLPGLPGDGGQGFPGEKGLPGLPGEKGHPGPPGLPGNGLPGLPGPRGLPGDKGKDGLPGQQGLPGSKGITLPCIIPGSYGPSGFPGTPGFPGPKGSRGLPGTPGQPGSSGSKGEPGSPGLVHLPELPGFPGPRGEKGLPGFPGLPGKDGLPGMIGSPGLPGSKGATGDIFGAENGAPGEQGLQGLTGHKGFLGDSGLPGLKGVHGKPGLLGPKGERGSPGTPGQVGQPGTPGSSGPYGIKGKSGLPGAPGFPGISGHPGKKGTRGKKGPPGSIVKKGLPGLKGLPGNPGLVGLKGSPGSPGVAGLPALSGPKGEKGSVGFVGFPGIPGLPGIPGTRGLKGIPGSTGKMGPSGRAGTPGEKGDRGNPGPVGIPSPRRPMSNLWLKGDKGSQGSAGSNGFPGPRGDKGEAGRPGPPGLPGAPGLPGIIKGVSGKPGPPGFMGIRGLPGLKGSSGITGFPGMPGESGSQGIRGSPGLPGASGLPGLKGDNGQTVEISGSPGPKGQPGESGFKGTKGRDGLIGNIGFPGNKGEDGKVGVSGDVGLPGAPGFPGVAGMRGEPGLPGSSGHQGAIGPLGSPGLIGPKGPSITGVPGPAGLPGPKGEKGYPGIGIGAPGKPGLRGQKGDRGFPGLQGPAGLPGAPGISLPSLIAGQPGDPGRPGLDGERGRPGPAGPPGPPGPSSNQGDTGDPGFPGIPGPKGPKGDQGIPGFSGLPGELGLKGMRGEPGFMGTPGKVGPPGDPGFPGMKGKAGPRGSSGLQGDPGQTPTAEAVQVPPGPLGLPGIDGIPGLTGDPGAQGPVGLQGSKGLPGIPGKDGPSGLPGPPGALGDPGLPGLQGPPGFEGAPGQQGPFGMPGMPGQSMRVGYTLVKHSQSEQVPPCPIGMSQLWVGYSLLFVEGQEKAHNQDLGFAGSCLPRFSTMPFIYCNINEVCHYARRNDKSYWLSTTAPIPMMPVSQTQIPQYISRCSVCEAPSQAIAVHSQDITIPQCPLGWRSLWIGYSFLMHTAAGAEGGGQSLVSPGSCLEDFRATPFIECSGARGTCHYFANKYSFWLTTVEERQQFGELPVSETLKAGQLHTRVSRCQVCMKSL

SEQ ID NO: 1054 - protein, 678 aa, Homo sapiens
MAWTARDRGALGLLLLGLCLCAAQRGPPGEQGPPGPPGPPGVPGIDGIDGDRGPKGPPGPPGPAGEPGKPGAPGKPGTPGADGLTGPDGSPGSIGSKGQKGEPGVPGSRGFPGRGIPGPPGPPGTAGLPGELGRVGPVGDPGRRGPPGPPGPPGPRGTIGFHDGDPLCPNACPPGRSGYPGLPGMRGHKGAKGEIGEPGRQGHKGEEGDQGELGEVGAQGPPGAQGLRGITGIVGDKGEKGARGLDGEPGPQGLPGAPGDQGQRGPPGEAGPKGDRGAEGARGIPGLPGPKGDTGLPGVDGRDGIPGMPGTKGEPGKPGPPGDAGLQGLPGVPGIPGAKGVAGEKGSTGAPGKPGQMGNSGKPGQQGPPGEVGPRGPQGLPGSRGELGPVGSPGLPGKLGSLGSPGLPGLPGPPGLPGMKGDRGVVGEPGPKGEQGASGEEGEAGERGELGDIGLPGPKGSAGNPGEPGLRGPEGSRGLPGVEGPRGPPGPRGVQGEQGATGLPGVQGPPGRAPTDQHIKQVCMRVIQEHFAEMAASLKRPDSGATGLPGRPGPPGPPGPPGENGFPGQMGIRGLPGIKGPPGALGLRGPKGDLGEKGERGPPGRGPNGLPGAIGLPGDPGPASYGRNGRDGERGPPGVAGIPGVPGPPGPPGLPGFCEPASCTMQAGQRAFNKGPDP

SEQ ID NO: 1055 - protein, 921 aa, Homo sapiens
MKTCWKIPVFFFVCSFLEPWASAAVKRRPRFPVNSNSNGGNELCPKIRIGQDDLPGFDLISQFQVDKAASRRAIQRVVGSATLQVAYKLGNNVDFRIPTRNLYPSGLPEEYSFLTTFRMTGSTLKKNWNIWQIQDSSGKEQVGIKINGQTQSVVFSYKGLDGSLQTAAFSNLSSLFDSQWHKIMIGVERSSATLFVDCNRIESLPIKPRGPIDIDGFAVLGKLADNPQVSVPFELQWMLIHCDPLRPRRETCHELPARITPSQTTDERGPPGEQGPPGPPGPPGVPGIDGIDGDRGPKGPPGPPGPAGEPGKPGAPGKPGTPGADGLTGPDGSPGSIGSKGQKGEPGVPGSRGFPGRGIPGPPGPPGTAGLPGELGRVGPVGDPGRRGPPGPPGPPGPRGTIGFHDGDPLCPNACPPGRSGYPGLPGMRGHKGAKGEIGEPGRQGHKGEEGDQGELGEVGAQGPPGAQGLRGITGIVGDKGEKGARGLDGEPGPQGLPGAPGDQGQRGPPGEAGPKGDRGAEGARGIPGLPGPKGDTGLPGVDGRDGIPGMPGTKGEPGKPGPPGDAGLQGLPGVPGIPGAKGVAGEKGSTGAPGKPGQMGNSGKPGQQGPPGEVGPRGPQGLPGSRGELGPVGSPGLPGKLGSLGSPGLPGLPGPPGLPGMKGDRGVVGEPGPKGEQGASGEEGEAGERGELGDIGLPGPKGSAGNPGEPGLRGPEGSRGLPGVEGPRGPPGPRGVQGEQGATGLPGVQGPPGRAPTDQHIKQVCMRVIQEHFAEMAASLKRPDSGATGLPGRPGPPGPPGPPGENGFPGQMGIRGLPGIKGPPGALGLRGPKGDLGEKGERGPPGRGPNGLPGAIGLPGDPGPASYGRNGRDGERGPPGVAGIPGVPGPPGPPGLPGFCEPASCTMQAGQRAFNKGPDP

SEQ ID NO: 1056 - protein, 328 aa, Homo sapiens
MKTCWKIPVFFFVCSFLEPWASAAVKRRPRFPVNSNSNGGNELCPKIRIGQDDLPGFDLISQFQVDKAASRRAIQRVVGSATLQVAYKLGNNVDFRIPTRNLYPSGLPEEYSFLTTFRMTGSTLKKNWNIWQIQDSSGKEQVGIKINGQTQSVVFSYKGLDGSLQTAAFSNLSSLFDSQWHKIMIGVERSSATLFVDCNRIESLPIKPRGPIDIDGFAVLGKLADNPQVSVPFELQWMLIHCDPLRPRRETCHELPARITPSQTTDERGPPGEQGPPGPPGPPGVPGIDGIDGDRGPKGPPGPPGPAGEPGKPGAPGKPGTPGADTSP

SEQ ID NO: 1057 - protein, 678 aa, Homo sapiens
MAWTARDRGALGLLLLGLCLCAAQRGPPGEQGPPGPPGPPGVPGIDGIDGDRGPKGPPGPPGPAGEPGKPGAPGKPGTPGADGLTGPDGSPGSIGSKGQKGEPGVPGSRGFPGKILPLLQGPPGTAGLPGELGRVGPVGDPGRRGPPGPPGPPGPRGTIGFHDGDPLCPNACPPGRSGYPGLPGMRGHKGAKGEIGEPGRQGHKGEEGDQGELGEVGAQGPPGAQGLRGITGIVGDKGEKGARGLDGEPGPQGLPGAPGDQGQRGPPGEAGPKGDRGAEGARGIPGLPGPKGDTGLPGVDGRDGIPGMPGTKGEPGKPGPPGDAGLQGLPGVPGIPGAKGVAGEKGSTGAPGKPGQMGNSGKPGQQGPPGEVGPRGPQGLPGSRGELGPVGSPGLPGKLGSLGSPGLPGLPGPPGLPGMKGDRGVVGEPGPKGEQGASGEEGEAGERGELGDIGLPGPKGSAGNPGEPGLRGPEGSRGLPGVEGPRGPPGPRGVQGEQGATGLPGVQGPPGRAPTDQHIKQVCMRVIQEHFAEMAASLKRPDSGATGLPGRPGPPGPPGPPGENGFPGQMGIRGLPGIKGPPGALGLRGPKGDLGEKGERGPPGRGPNGLPGAIGLPGDPGPASYGRNGRDGERGPPGVAGIPGVPGPPGPPGLPGFCEPASCTMQAGQRAFNKGPDP

SEQ ID NO: 1058 - protein, 83 aa, Homo sapiens
MAAATASPRSLLVLLQVVVLALAQIRGPPGERGPPGPPGPPGVPGSDGIDGPPGPVGLPGEIGIRGPKGDPGPDGPSGPPGPP

SEQ ID NO: 1059 - protein, 689 aa, Homo sapiens
MAAATASPRSLLVLLQVVVLALAQIRGPPGERGPPGPPGPPGVPGSDGIDGDNGPPGKAGPPGPKGEPGKAGPDGPDGKPGIDGLTGAKGEPGPMGIPGVKGQPGLPGPPGLPGPGFAGPPGPPGPVGLPGEIGIRGPKGDPGPDGPSGPPGPPGKPGRPGTIQGLEGSADFLCPTNCPPGMKGPPGLQGVKGHAGKRGILGDPGHQGKPGPKGDVGASGEQGIPGPPGPQGIRGYPGMAGPKGETGPHGYKGMVGAIGATGPPGEEGPRGPPGRAGEKGDEGSPGIRGPQGITGPKGATGPPGINGKDGTPGTPGMKGSAGQAGQPGSPGHQGLAGVPGQPGTKGGPGDQGEPGPQGLPGFSGPPGKEGEPGPRGEIGPQGIMGQKGDQGERGPVGQPGPQGRQGPKGEQGPPGIPGPQGLPGVKGDKGSPGKTGPRGKVGDPGVAGLPGEKGEKGESGEPGPKGQQGVRGEPGYPGPSGDAGAPGVQGYPGPPGPRGLAGNRGVPGQPGRQGVEGRDATDQHIVDVALKMLQEQLAEVAVSAKREALGAVGMMGPPGPPGPPGYPGKQGPHGHPGPRGVPGIVGAVGQIGNTGPKGKRGEKGDPGEVGRGHPGMPGPPGIPGLPGRPGQAINGKDGDRGSPGAPGEAGRPGLPGPVGLPGFCEPAACLGASAYASARLTEPGSIKGP

SEQ ID NO: 1060 - protein, 684 aa, Homo sapiens
MAGPRACAPLLLLLLLGELLAAAGAQRVGLPGPPGPPGPPGKPGQDGIDGEAGPPGLPGPPGPKGAPGKPGKPGEAGLPGLPGVDGLTGRDGPPGPKGAPGERGSLGPPGPPGLGGKGLPGPPGEAGVSGPPGGIGLRGPPGPSGLPGLPGPPGPPGPPGHPGVLPEGATDLQCPSICPPGPPGPPGMPGFKGPTGYKGEQGEVGKDGEKGDPGPPGPAGLPGSVGLQGPRGLRGLPGPLGPPGDRGPIGFRGPPGIPGAPGKAGDRGERGPEGFRGPKGDLGRPGPKGTPGVAGPSGEPGMPGKDGQNGVPGLDGQKGEAGRNGAPGEKGPNGLPGLPGRAGSKGEKGERGRAGELGEAGPSGEPGVPGDAGMPGERGEAGHRGSAGALGPQGPPGAPGVRGFQGQKGSMGDPGLPGPQGLRGDVGDRGPGGAAGPKGDQGIAGSDGLPGDKGELGPSGLVGPKGESGSRGELGPKGTQGPNGTSGVQGVPGPPGPLGLQGVPGVPGITGKPGVPGKEASEQRIRELCGGMISEQIAQLAAHLRKPLAPGSIGRPGPAGPPGPPGPPGSIGHPGARGPPGYRGPTGELGDPGPRGNQGDRGDKGAAGAGLDGPEGDQGPQGPQGVPGTSKDGQDGAPGEPGPPGDPGLPGAIGAQGTPGICDTSACQGAVLGGVGEKSGSRSS

SEQ ID NO: 1061 - protein, 191 aa, Homo sapiens
MWWSSTQNAGTEGEAGPPGLPGPPGPKGAPGKPGKPGEAGLPGLPGVDGLTGRDGPPGPKGAPGERGSLGPPGPPGLGGKGLPGPPGEAGVSGPPGGIGLRGPPGPSGLPGLPGPPGPPGPPGHPGVLPEGATDLQCPSICPPGPPGPPGMPGFKGPTGYKGEQGEVGKDGEKGDPGPPGPAGLPGSVGLQ

SEQ ID NO: 1062 - protein, 191 aa, Homo sapiens; identical to SEQ ID NO: 1061

SEQ ID NO: 1063 - protein, 375 aa, Homo sapiens
MGPPGLPGLKGDSGPKGEKGHPGLIGLIGPPGEQGEKGDRGLPGPQGSSGPKGEQGITGPSGPIGPPGPPGLPGPPGPKGAKGSSGPTGPKGEAGHPGPPGPPGPPGEVIQPLPIQASRTRRNIDASQLLDDGNGENYVDYADGMEEIFGSLNSLKLEIEQMKRPLGTQQNPARTCKDLQLCHPDFPDGEYWVDPNQGCSRDSFKVYCNFTAGGSTCVFPDKKSEGSKMARWPKEQPSTWYSQYKRGSLLSYVDAEGNPVGVVQMTFLRLLSASAHQNVTYHCYQSVAWQDAATGSYDKALRFLGSNDEEMSYDNNPYIRALVDGCATKKGYQKTVLEIDTPKVEQVPIVDIMFNDFGEASQKFGFEVGPACFMG

SEQ ID NO: 1064 - protein, 1838 aa, Homo sapiens
MDVHTRWKARSALRPGAPLLPPLLLLLLWAPPPSRAAQPADLLKVLDFHNLPDGITKTTGFCATRRSSKGPDVAYRVTKDAQLSAPTKQLYPASAFPEDFSILTTVKAKKGSQAFLVSIYNEQGIQQIGLELGRSPVFLYEDHTGKPGPEDYPLFRGINLSDGKWHRIALSVHKKNVTLILDCKKKTTKFLDRSDHPMIDINGIIVFGTRILDEEVFEGDIQQLLFVSDHRAAYDYCEHYSPDCDTAVPDTPQSQDPNPDEYYTEGDGEGETYYYEYPYYEDPEDLGKEPTPSKKPVEAAKETTEVPEELTPTPTEAAPMPETSEGAGKEEDVGIGDYDYVPSEDYYTPSPYDDLTYGEGEENPDQPTDPGAGAEIPTSTADTSNSSNPAPPPGEGADDLEGEFTEETIRNLDENYYDPYYDPTSSPSEIGPGMPANQDTIYEGIGGPRGEKGQKGEPAIIEPGMLIEGPPGPEGPAGLPGPPGTMGPTGQVGDPGERGPPGRPGLPGADGLPGPPGTMLMLPFRFGGGGDAGSKGPMVSAQESQAQAILQQARLALRGPAGPMGLTGRPGPVGPPGSGGLKGEPGDVGPQGPRGVQGPPGPAGKPGRRGRAGSDGARGMPGQTGPKGDRGFDGLAGLPGEKGHRGDPGPSGPPGPPGDDGERGDDGEVGPRGLPGEPGPRGLLGPKGPPGPPGPPGVTGMDGQPGPKGNVGPQGEPGPPGQQGNPGAQGLPGPQGAIGPPGEKGPLGKPGLPGMPGADGPPGHPGKEGPPGEKGGQGPPGPQGPIGYPGPRGVKGADGIRGLKGTKGEKGEDGFPGFKGDMGIKGDRGEIGPPGPRGEDGPEGPKGRGGPNGDPGPLGPPGEKGKLGVPGLPGYPGRQGPKGSIGFPGFPGANGEKGGRGTPGKPGPRGQRGPTGPRGERGPRGITGKPGPKGNSGGDGPAGPPGERGPNGPQGPTGFPGPKGPPGPPGKDGLPGHPGQRGETGFQGKTGPPGPPGVVGPQGPTGETGPMGERGHPGPPGPPGEQGLPGLAGKEGTKGDPGPAGLPGKDGPPGLRGFPGDRGLPGPVGALGLKGNEGPPGPPGPAGSPGERGPAGAAGPIGIPGRPGPQGPPGPAGEKGAPGEKGPQGPAGRDGLQGPVGLPGPAGPVGPPGEDGDKGEIGEPGQKGSKGDKGEQGPPGPTGPQGPIGQPGPSGADGEPGPRGQQGLFGQKGDEGPRGFPGPPGPVGLQGLPGPPGEKGETGDVGQMGPPGPPGPRGPSGAPGADGPQGPPGGIGNPGAVGEKGEPGEAGEPGLPGEGGPPGPKGERGEKGESGPSGAAGPPGPKGPPGDDGPKGSPGPVGFPGDPGPPGEPGPAGQDGPPGDKGDDGEPGQTGSPGPTGEPGPSGPPGKRGPPGPAGPEGRQGEKGAKGEAGLEGPPGKTGPIGPQGAPGKPGPDGLRGIPGPVGEQGLPGSPGPDGPPGPMGPPGLPGLKGDSGPKGEKGHPGLIGLIGPPGEQGEKGDRGLPGPQGSSGPKGEQGITGPSGPIGPPGPPGLPGPPGPKGAKGSSGPTGPKGEAGHPGPPGPPGPPGEVIQPLPIQASRTRRNIDASQLLDDGNGENYVDYADGMEEIFGSLNSLKLEIEQMKRPLGTQQNPARTCKDLQLCHPDFPDGEYWVDPNQGCSRDSFKVYCNFTAGGSTCVFPDKKSEGARITSWPKENPGSWFSEFKRGKLLSYVDAEGNPVGVVQMTFLRLLSASAHQNVTYHCYQSVAWQDAATGSYDKALRFLGSNDEEMSYDNNPYIRALVDGCATKKGYQKTVLEIDTPKVEQVPIVDIMFNDFGEASQKFGFEVGPACFMG

SEQ ID NO: 1065 - protein, 210 aa, Homo sapiens
  MOD_RES (1)..(1): Any amino acid
XRTRRNIDASQLLDDGNGENYVDYADGMEEIFGSLNSLKLEIEQMKRPLGTQQNPARTCKDLQLCHPDFPDGEYWVDPNQGCSRDSFKVYCNFTAGGSTCVFPDKKSEGSKMARWPKEQPSTWYSQYKRGSLLSYVDAEGNPVGVVQMTFLRLLSASAHQNVTYHCYQSVAWQDAATGSYDKALRFLGSNDEEMSYDNNPYIRALVDGCA

SEQ ID NO: 1066 - protein, 1745 aa, Homo sapiens
MGNRRDLGQPRAGLCLLLAALQLLPGTQADPVDVLKALGVQGGQAGVPEGPGFCPQRTPEGDRAFRIGQASTLGIPTWELFPEGHFPENFSLLITLRGQPANQSVLLSIYDERGARQLGLALGPALGLLGDPFRPLPQQVNLTDGRWHRVAVSIDGEMVTLVADCEAQPPVLGHGPRFISIAGLTVLGTQDLGEKTFEGDIQELLISPDPQAAFQACERYLPDCDNLAPAATVAPQGEPETPRPRRKGKGKGRKKGRGRKGKGRKKNKEIWTSSPPPDSAENQTSTDIPKTETPAPNLPPTPTPLVVTSTVTTGLNATILERSLDPDSGTELGTLETKAAREDEEGDDSTMGPDFRAAEYPSRTQFQIFPGAGEKGAKGEPAVIEKGQQFEGPPGAPGPQGVVGPSGPPGPPGFPGDPGPPGPAGLPGIPGIDGIRGPPGTVIMMPFQFAGGSFKGPPVSFQQAQAQAVLQQTQLSMKGPPGPVGLTGRPGPVGLPGHPGLKGEEGAEGPQGPRGLQGPHGPPGRVGKMGRPGADGARGLPGDTGPKGDRGFDGLPGLPGEKGQRGDFGHVGQPGPPGEDGERGAEGPPGPTGQAGEPGPRGLLGPRGSPGPTGRPGVTGIDGAPGAKGNVGPPGEPGPPGQQGNHGSQGLPGPQGLIGTPGEKGPPGNPGIPGLPGSDGPLGHPGHEGPTGEKGAQGPPGSAGPPGYPGPRGVKGTSGNRGLQGEKGEKGEDGFPGFKGDVGLKGDQGKPGAPGPRGEDGPEGPKGQAGQAGEEGPPGSAGEKGKLGVPGLPGYPGRPGPKGSIGFPGPLGPIGEKGKSGKTGQPGLEGERGPPGSRGERGQPGATGQPGPKGDVGQDGAPGIPGEKGLPGLQGPPGFPGPKGPPGHQGKDGRPGHPGQRGELGFQGQTGPPGPAGVLGPQGKTGEVGPLGERGPPGPPGPPGEQGLPGLEGREGAKGELGPPGPLGKEGPAGLRGFPGPKGGPGDPGPTGLKGDKGPPGPVGANGSPGERGPLGPAGGIGLPGQSGSEGPVGPAGKKGSRGERGPPGPTGKDGIPGPLGPLGPPGAAGPSGEEGDKGDVGAPGHKGSKGDKGDAGPPGQPGIRGPAGHPGPPGADGAQGRRGPPGLFGQKGDDGVRGFVGVIGPPGLQGLPGPPGEKGEVGDVGSMGPHGAPGPRGPQGPTGSEGTPGLPGGVGQPGAVGEKGERGDAGDPGPPGAPGIPGPKGDIGEKGDSGPSGAAGPPGKKGPPGEDGAKGSVGPTGLPGDLGPPGDPGVSGIDGSPGEKGDPGDVGGPGPPGASGEPGAPGPPGKRGPSGHMGREGREGEKGAKGEPGPDGPPGRTGPMGARGPPGRVGPEGLRGIPGPVGEPGLLGAPGQMGPPGPLGPSGLPGLKGDTGPKGEKGHIGLIGLIGPPGEAGEKGDQGLPGVQGPPGPKGDPGPPGPIGSLGHPGPPGVAGPLGQKGSKGSPGSMGPRGDTGPAGPPGPPGAPAELHGLRRRRRFVPVPLPVVEGGLEEVLASLTSLSLELEQLRRPPGTAERPGLVCHELHRNHPHLPDGEYWIDPNQGCARDSFRVFCNFTAGGETCLYPDKKFEIVKLASWSKEKPGGWYSTFRRGKKFSYVDADGSPVNVVQLNFLKLLSATARQNFTYSCQNAAAWLDEATGDYSHSARFLGTNGEELSFNQTTAATVSVPQDGCRLRKGQTKTLFEFSSSRAGFLPLWDVAATDFGQTNQKFGFELGPVCFSS

SEQ ID NO: 1067 - protein, 3177 aa, Homo sapiens
MRKHRHLPLVAVFCLFLSGFPTTHAQQQQADVKNGAAADIIFLVDSSWTIGEEHFQLVREFLYDVVKSLAVGENDFHFALVQFNGNPHTEFLLNTYRTKQEVLSHISNMSYIGGTNQTGKGLEYIMQSHLTKAAGSRAGDGVPQVIVVLTDGHSKDGLALPSAELKSADVNVFAIGVEDADEGALKEIASEPLNMHMFNLENFTSLHDIVGNLVSCVHSSVSPERAGDTETLKDITAQDSADIIFLIDGSNNTGSVNFAVILDFLVNLLEKLPIGTQQIRVGVVQFSDEPRTMFSLDTYSTKAQVLGAVKALGFAGGELANIGLALDFVVENHFTRAGGSRVEEGVPQVLVLISAGPSSDEIRYGVVALKQASVFSFGLGAQAASRAELQHIATDDNLVFTVPEFRSFGDLQEKLLPYIVGVAQRHIVLKPPTIVTQVIEVNKRDIVFLVDGSSALGLANFNAIRDFIAKVIQRLEIGQDLIQVAVAQYADTVRPEFYFNTHPTKREVITAVRKMKPLDGSALYTGSALDFVRNNLFTSSAGYRAAEGIPKLLVLITGGKSLDEISQPAQELKRSSIMAFAIGNKGADQAELEEIAFDSSLVFIPAEFRAAPLQGMLPGLLAPLRTLSGTPEVHSNKRDIIFLLDGSANVGKTNFPYVRDFVMNLVNSLDIGNDNIRVGLVQFSDTPVTEFSLNTYQTKSDILGHLRQLQLQGGSGLNTGSALSYVYANHFTEAGGSRIREHVPQLLLLLTAGQSEDSYLQAANALTRAGILTFCVGASQANKAELEQIAFNPSLVYLMDDFSSLPALPQQLIQPLTTYVSGGVEEVPLAQPESKRDILFLFDGSANLVGQFPVVRDFLYKIIDELNVKPEGTRIAVAQYSDDVKVESRFDEHQSKPEILNLVKRMKIKTGKALNLGYALDYAQRYIFVKSAGSRIEDGVLQFLVLLVAGRSSDRVDGPASNLKQSGVVPFIFQAKNADPAELEQIVLSPAFILAAESLPKIGDLHPQIVNLLKSVHNGAPAPVSGEKDVVFLLDGSEGVRSGFPLLKEFVQRVVESLDVGQDRVRVAVVQYSDRTRPEFYLNSYMNKQDVVNAVRQLTLLGGPTPNTGAALEFVLRNILVSSAGSRITEGVPQLLIVLTADRSGDDVRNPSVVVKRGGAVPIGIGIGNADITEMQTISFIPDFAVAIPTFRQLGTVQQVISERVTQLTREELSRLQPVLQPLPSPGVGGKRDVVFLIDGSQSAGPEFQYVRTLIERLVDYLDVGFDTTRVAVIQFSDDPKVEFLLNAHSSKDEVQNAVQRLRPKGGRQINVGNALEYVSRNIFKRPLGSRIEEGVPQFLVLISSGKSDDEVDDPAVELKQFGVAPFTIARNADQEELVKISLSPEYVFSVSTFRELPSLEQKLLTPITTLTSEQIQKLLASTRYPPPAVESDAADIVFLIDSSEGVRPDGFAHIRDFVSRIVRRLNIGPSKVRVGVVQFSNDVFPEFYLKTYRSQAPVLDAIRRLRLRGGSPLNTGKALEFVARNLFVKSAGSRIEDGVPQHLVLVLGGKSQDDVSRFAQVIRSSGIVSLGVGDRNIDRTELQTITNDPRLVFTVREFRELPNIEERIMNSFGPSAATPAPPGVDTPPPSRPEKKKADIVFLLDGSINFRRDSFQEVLRFVSEIVDTVYEDGDSIQVGLVQYNSDPTDEFFLKDFSTKRQIIDAINKVVYKGGRHANTKVGLEHLRVNHFVPEAGSRLDQRVPQIAFVITGGKSVEDAQDVSLALTQRGVKVFAVGVRNIDSEEVGKIASNSATAFRVGNVQELSELSEQVLETLHDAMHETLCPGVTDAAKACNLDVILGFDGSRDQNVFVAQKGFESKVDAILNRISQMHRVSCSGGRSPTVRVSVVANTPSGPVEAFDFDEYQPEMLEKFRNMRSQHPYVLTEDTLKVYLNKFRQSSPDSVKVVIHFTDGADGDLADLHRASENLRQEGVRALILVGLERVVNLERLMHLEFGRGFMYDRPLRLNLLDLDYELAEQLDNIAEKACCGVPCKCSGQRGDRGPIGSIGPKGIPGEDGYRGYPGDEGGPGERGPPGVNGTQGFQGCPGQRGVKGSRGFPGEKGEVGEIGLDGLDGEDGDKGLPGSSGEKGNPGRRGDKGPRGEKGERGDVGIRGDPGNPGQDSQERGPKGETGDLGPMGVPGRDGVPGGPGETGKNGGFGRRGPPGAKGNKGGPGQPGFEGEQGTRGAQGPAGPAGPPGLIGEQGISGPRGSGGAAGAPGERGRTGPLGRKGEPGEPGPKGGIGNRGPRGETGDDGRDGVGSEGRRGKKGERGFPGYPGPKGNPGEPGLNGTTGPKGIRGRRGNSGPPGIVGQKGDPGYPGPAGPKGNRGDSIDQCALIQSIKDKCPCCYGPLECPVFPTELAFALDTSEGVNQDTFGRMRDVVLSIVNDLTIAESNCPRGARVAVVTYNNEVTTEIRFADSKRKSVLLDKIKNLQVALTSKQQSLETAMSFVARNTFKRVRNGFLMRKVAVFFSNTPTRASPQLREAVLKLSDAGITPLFLTRQEDRQLINALQINNTAVGHALVLPAGRDLTDFLENVLTCHVCLDICNIDPSCGFGSWRPSFRDRRAAGSDVDIDMAFILDSAETTTLFQFNEMKKYIAYLVRQLDMSPDPKASQHFARVAVVQHAPSESVDNASMPPVKVEFSLTDYGSKEKLVDFLSRGMTQLQGTRALGSAIEYTIENVFESAPNPRDLKIVVLMLTGEVPEQQLEEAQRVILQAKCKGYFFVVLGIGRKVNIKEVYTFASEPNDVFFKLVDKSTELNEEPLMRFGRLLPSFVSSENAFYLSPDIRKQCDWFQGDQPTKNLVKFGHKQVNVPNNVTSSPTSNPVTTTKPVTTTKPVTTTTKPVTTTTKPVTIINQPSVKPAAAKPAPAKPVAAKPVATKMATVRPPVAVKPATAAKPVAAKPAAVRPPAAAAAKPVATKPEVPRPQAAKPAATKPATTKPMVKMSREVQVFEITENSAKLHWERAEPPGPYFYDLTVTSAHDQSLVLKQNLTVTDRVIGGLLAGQTYHVAVVCYLRSQVRATYHGSFSTKKSQPPPPQPARSASSSTINLMVSTEPLALTETDICKLPKDEGTCRDFILKWYYDPNTKSCARFWYGGCGGNENKFGSQKECEKVCAPVLAKPGVISVMGT

SEQ ID NO: 1068 - protein, 2977 aa, Homo sapiens
MRKHRHLPLVAVFCLFLSGFPTTHAQQQQADVKNGAAADIIFLVDSSWTIGEEHFQLVREFLYDVVKSLAVGENDFHFALVQFNGNPHTEFLLNTYRTKQEVLSHISNMSYIGGTNQTGKGLEYIMQSHLTKAAGSRAGDGVPQVIVVLTDGHSKDGLALPSAELKSADVNVFAIGVEDADEGALKEIASEPLNMHMFNLENFTSLHDIVGNLVSCVHSSVSPERAGDTETLKDITAQDSADIIFLIDGSNNTGSVNFAVILDFLVNLLEKLPIGTQQIRVGVVQFSDEPRTMFSLDTYSTKAQVLGAVKALGFAGGELANIGLALDFVVENHFTRAGGSRVEEGVPQVLVLISAGPSSDEIRYGVVALKQASVFSFGLGAQAASRAELQHIATDDNLVFTVPEFRSFGDLQEKLLPYIVGVAQRHIVLKPPTIVTQVIEVNKRDIVFLVDGSSALGLANFNAIRDFIAKVIQRLEIGQDLIQVAVAQYADTVRPEFYFNTHPTKREVITAVRKMKPLDGSALYTGSALDFVRNNLFTSSAGYRAAEGIPKLLVLITGGKSLDEISQPAQELKRSSIMAFAIGNKGADQAELEEIAFDSSLVFIPAEFRAAPLQGMLPGLLAPLRTLSGTPEESKRDILFLFDGSANLVGQFPVVRDFLYKIIDELNVKPEGTRIAVAQYSDDVKVESRFDEHQSKPEILNLVKRMKIKTGKALNLGYALDYAQRYIFVKSAGSRIEDGVLQFLVLLVAGRSSDRVDGPASNLKQSGVVPFIFQAKNADPAELEQIVLSPAFILAAESLPKIGDLHPQIVNLLKSVHNGAPAPVSGEKDVVFLLDGSEGVRSGFPLLKEFVQRVVESLDVGQDRVRVAVVQYSDRTRPEFYLNSYMNKQDVVNAVRQLTLLGGPTPNTGAALEFVLRNILVSSAGSRITEGVPQLLIVLTADRSGDDVRNPSVVVKRGGAVPIGIGIGNADITEMQTISFIPDFAVAIPTFRQLGTVQQVISERVTQLTREELSRLQPVLQPLPSPGVGGKRDVVFLIDGSQSAGPEFQYVRTLIERLVDYLDVGFDTTRVAVIQFSDDPKVEFLLNAHSSKDEVQNAVQRLRPKGGRQINVGNALEYVSRNIFKRPLGSRIEEGVPQFLVLISSGKSDDEVDDPAVELKQFGVAPFTIARNADQEELVKISLSPEYVFSVSTFRELPSLEQKLLTPITTLTSEQIQKLLASTRYPPPAVESDAADIVFLIDSSEGVRPDGFAHIRDFVSRIVRRLNIGPSKVRVGVVQFSNDVFPEFYLKTYRSQAPVLDAIRRLRLRGGSPLNTGKALEFVARNLFVKSAGSRIEDGVPQHLVLVLGGKSQDDVSRFAQVIRSSGIVSLGVGDRNIDRTELQTITNDPRLVFTVREFRELPNIEERIMNSFGPSAATPAPPGVDTPPPSRPEKKKADIVFLLDGSINFRRDSFQEVLRFVSEIVDTVYEDGDSIQVGLVQYNSDPTDEFFLKDFSTKRQIIDAINKVVYKGGRHANTKVGLEHLRVNHFVPEAGSRLDQRVPQIAFVITGGKSVEDAQDVSLALTQRGVKVFAVGVRNIDSEEVGKIASNSATAFRVGNVQELSELSEQVLETLHDAMHETLCPGVTDAAKACNLDVILGFDGSRDQNVFVAQKGFESKVDAILNRISQMHRVSCSGGRSPTVRVSVVANTPSGPVEAFDFDEYQPEMLEKFRNMRSQHPYVLTEDTLKVYLNKFRQSSPDSVKVVIHFTDGADGDLADLHRASENLRQEGVRALILVGLERVVNLERLMHLEFGRGFMYDRPLRLNLLDLDYELAEQLDNIAEKACCGVPCKCSGQRGDRGPIGSIGPKGIPGEDGYRGYPGDEGGPGERGPPGVNGTQGFQGCPGQRGVKGSRGFPGEKGEVGEIGLDGLDGEDGDKGLPGSSGEKGNPGRRGDKGPRGEKGERGDVGIRGDPGNPGQDSQERGPKGETGDLGPMGVPGRDGVPGGPGETGKNGGFGRRGPPGAKGNKGGPGQPGFEGEQGTRGAQGPAGPAGPPGLIGEQGISGPRGSGGAAGAPGERGRTGPLGRKGEPGEPGPKGGIGNRGPRGETGDDGRDGVGSEGRRGKKGERGFPGYPGPKGNPGEPGLNGTTGPKGIRGRRGNSGPPGIVGQKGDPGYPGPAGPKGNRGDSIDQCALIQSIKDKCPCCYGPLECPVFPTELAFALDTSEGVNQDTFGRMRDVVLSIVNDLTIAESNCPRGARVAVVTYNNEVTTEIRFADSKRKSVLLDKIKNLQVALTSKQQSLETAMSFVARNTFKRVRNGFLMRKVAVFFSNTPTRASPQLREAVLKLSDAGITPLFLTRQEDRQLINALQINNTAVGHALVLPAGRDLTDFLENVLTCHVCLDICNIDPSCGFGSWRPSFRDRRAAGSDVDIDMAFILDSAETTTLFQFNEMKKYIAYLVRQLDMSPDPKASQHFARVAVVQHAPSESVDNASMPPVKVEFSLTDYGSKEKLVDFLSRGMTQLQGTRALGSAIEYTIENVFESAPNPRDLKIVVLMLTGEVPEQQLEEAQRVILQAKCKGYFFVVLGIGRKVNIKEVYTFASEPNDVFFKLVDKSTELNEEPLMRFGRLLPSFVSSENAFYLSPDIRKQCDWFQGDQPTKNLVKFGHKQVNVPNNVTSSPTSNPVTTTKPVTTTKPVTTTTKPVTTTTKPVTIINQPSVKPAAAKPAPAKPVAAKPVATKMATVRPPVAVKPATAAKPVAAKPAAVRPPAAAAAKPVATKPEVPRPQAAKPAATKPATTKPMVKMSREVQVFEITENSAKLHWERAEPPGPYFYDLTVTSAHDQSLVLKQNLTVTDRVIGGLLAGQTYHVAVVCYLRSQVRATYHGSFSTKKSQPPPPQPARSASSSTINLMVSTEPLALTETDICKLPKDEGTCRDFILKWYYDPNTKSCARFWYGGCGGNENKFGSQKECEKVCAPVLAKPGVISVMGT

SEQ ID NO: 1069 - protein, 2976 aa, Homo sapiens
MRKHRHLPLVAVFCLFLSGFPTTHAQQQQADVKNGAAADIIFLVDSSWTIGEEHFQLVREFLYDVVKSLAVGENDFHFALVQFNGNPHTEFLLNTYRTKQEVLSHISNMSYIGGTNQTGKGLEYIMQSHLTKAAGSRAGDGVPQVIVVLTDGHSKDGLALPSAELKSADVNVFAIGVEDADEGALKEIASEPLNMHMFNLENFTSLHDIVGNLVSCVHSSVSPERAGDTETLKDITVIEVNKRDIVFLVDGSSALGLANFNAIRDFIAKVIQRLEIGQDLIQVAVAQYADTVRPEFYFNTHPTKREVITAVRKMKPLDGSALYTGSALDFVRNNLFTSSAGYRAAEGIPKLLVLITGGKSLDEISQPAQELKRSSIMAFAIGNKGADQAELEEIAFDSSLVFIPAEFRAAPLQGMLPGLLAPLRTLSGTPEVHSNKRDIIFLLDGSANVGKTNFPYVRDFVMNLVNSLDIGNDNIRVGLVQFSDTPVTEFSLNTYQTKSDILGHLRQLQLQGGSGLNTGSALSYVYANHFTEAGGSRIREHVPQLLLLLTAGQSEDSYLQAANALTRAGILTFCVGASQANKAELEQIAFNPSLVYLMDDFSSLPALPQQLIQPLTTYVSGGVEEVPLAQPESKRDILFLFDGSANLVGQFPVVRDFLYKIIDELNVKPEGTRIAVAQYSDDVKVESRFDEHQSKPEILNLVKRMKIKTGKALNLGYALDYAQRYIFVKSAGSRIEDGVLQFLVLLVAGRSSDRVDGPASNLKQSGVVPFIFQAKNADPAELEQIVLSPAFILAAESLPKIGDLHPQIVNLLKSVHNGAPAPVSGEKDVVFLLDGSEGVRSGFPLLKEFVQRVVESLDVGQDRVRVAVVQYSDRTRPEFYLNSYMNKQDVVNAVRQLTLLGGPTPNTGAALEFVLRNILVSSAGSRITEGVPQLLIVLTADRSGDDVRNPSVVVKRGGAVPIGIGIGNADITEMQTISFIPDFAVAIPTFRQLGTVQQVISERVTQLTREELSRLQPVLQPLPSPGVGGKRDVVFLIDGSQSAGPEFQYVRTLIERLVDYLDVGFDTTRVAVIQFSDDPKVEFLLNAHSSKDEVQNAVQRLRPKGGRQINVGNALEYVSRNIFKRPLGSRIEEGVPQFLVLISSGKSDDEVDDPAVELKQFGVAPFTIARNADQEELVKISLSPEYVFSVSTFRELPSLEQKLLTPITTLTSEQIQKLLASTRYPPPAVESDAADIVFLIDSSEGVRPDGFAHIRDFVSRIVRRLNIGPSKVRVGVVQFSNDVFPEFYLKTYRSQAPVLDAIRRLRLRGGSPLNTGKALEFVARNLFVKSAGSRIEDGVPQHLVLVLGGKSQDDVSRFAQVIRSSGIVSLGVGDRNIDRTELQTITNDPRLVFTVREFRELPNIEERIMNSFGPSAATPAPPGVDTPPPSRPEKKKADIVFLLDGSINFRRDSFQEVLRFVSEIVDTVYEDGDSIQVGLVQYNSDPTDEFFLKDFSTKRQIIDAINKVVYKGGRHANTKVGLEHLRVNHFVPEAGSRLDQRVPQIAFVITGGKSVEDAQDVSLALTQRGVKVFAVGVRNIDSEEVGKIASNSATAFRVGNVQELSELSEQVLETLHDAMHETLCPGVTDAAKACNLDVILGFDGSRDQNVFVAQKGFESKVDAILNRISQMHRVSCSGGRSPTVRVSVVANTPSGPVEAFDFDEYQPEMLEKFRNMRSQHPYVLTEDTLKVYLNKFRQSSPDSVKVVIHFTDGADGDLADLHRASENLRQEGVRALILVGLERVVNLERLMHLEFGRGFMYDRPLRLNLLDLDYELAEQLDNIAEKACCGVPCKCSGQRGDRGPIGSIGPKGIPGEDGYRGYPGDEGGPGERGPPGVNGTQGFQGCPGQRGVKGSRGFPGEKGEVGEIGLDGLDGEDGDKGLPGSSGEKGNPGRRGDKGPRGEKGERGDVGIRGDPGNPGQDSQERGPKGETGDLGPMGVPGRDGVPGGPGETGKNGGFGRRGPPGAKGNKGGPGQPGFEGEQGTRGAQGPAGPAGPPGLIGEQGISGPRGSGGAAGAPGERGRTGPLGRKGEPGEPGPKGGIGNRGPRGETGDDGRDGVGSEGRRGKKGERGFPGYPGPKGNPGEPGLNGTTGPKGIRGRRGNSGPPGIVGQKGDPGYPGPAGPKGNRGDSIDQCALIQSIKDKCPCCYGPLECPVFPTELAFALDTSEGVNQDTFGRMRDVVLSIVNDLTIAESNCPRGARVAVVTYNNEVTTEIRFADSKRKSVLLDKIKNLQVALTSKQQSLETAMSFVARNTFKRVRNGFLMRKVAVFFSNTPTRASPQLREAVLKLSDAGITPLFLTRQEDRQLINALQINNTAVGHALVLPAGRDLTDFLENVLTCHVCLDICNIDPSCGFGSWRPSFRDRRAAGSDVDIDMAFILDSAETTTLFQFNEMKKYIAYLVRQLDMSPDPKASQHFARVAVVQHAPSESVDNASMPPVKVEFSLTDYGSKEKLVDFLSRGMTQLQGTRALGSAIEYTIENVFESAPNPRDLKIVVLMLTGEVPEQQLEEAQRVILQAKCKGYFFVVLGIGRKVNIKEVYTFASEPNDVFFKLVDKSTELNEEPLMRFGRLLPSFVSSENAFYLSPDIRKQCDWFQGDQPTKNLVKFGHKQVNVPNNVTSSPTSNPVTTTKPVTTTKPVTTTTKPVTTTTKPVTIINQPSVKPAAAKPAPAKPVAAKPVATKMATVRPPVAVKPATAAKPVAAKPAAVRPPAAAAAKPVATKPEVPRPQAAKPAATKPATTKPMVKMSREVQVFEITENSAKLHWERAEPPGPYFYDLTVTSAHDQSLVLKQNLTVTDRVIGGLLAGQTYHVAVVCYLRSQVRATYHGSFSTKKSQPPPPQPARSASSSTINLMVSTEPLALTETDICKLPKDEGTCRDFILKWYYDPNTKSCARFWYGGCGGNENKFGSQKECEKVCAPVLAKPGVISVMGT

SEQ ID NO: 1070 - protein, 2971 aa, Homo sapiens
MRKHRHLPLVAVFCLFLSGFPTTHAQQQQAAQDSADIIFLIDGSNNTGSVNFAVILDFLVNLLEKLPIGTQQIRVGVVQFSDEPRTMFSLDTYSTKAQVLGAVKALGFAGGELANIGLALDFVVENHFTRAGGSRVEEGVPQVLVLISAGPSSDEIRYGVVALKQASVFSFGLGAQAASRAELQHIATDDNLVFTVPEFRSFGDLQEKLLPYIVGVAQRHIVLKPPTIVTQVIEVNKRDIVFLVDGSSALGLANFNAIRDFIAKVIQRLEIGQDLIQVAVAQYADTVRPEFYFNTHPTKREVITAVRKMKPLDGSALYTGSALDFVRNNLFTSSAGYRAAEGIPKLLVLITGGKSLDEISQPAQELKRSSIMAFAIGNKGADQAELEEIAFDSSLVFIPAEFRAAPLQGMLPGLLAPLRTLSGTPEVHSNKRDIIFLLDGSANVGKTNFPYVRDFVMNLVNSLDIGNDNIRVGLVQFSDTPVTEFSLNTYQTKSDILGHLRQLQLQGGSGLNTGSALSYVYANHFTEAGGSRIREHVPQLLLLLTAGQSEDSYLQAANALTRAGILTFCVGASQANKAELEQIAFNPSLVYLMDDFSSLPALPQQLIQPLTTYVSGGVEEVPLAQPESKRDILFLFDGSANLVGQFPVVRDFLYKIIDELNVKPEGTRIAVAQYSDDVKVESRFDEHQSKPEILNLVKRMKIKTGKALNLGYALDYAQRYIFVKSAGSRIEDGVLQFLVLLVAGRSSDRVDGPASNLKQSGVVPFIFQAKNADPAELEQIVLSPAFILAAESLPKIGDLHPQIVNLLKSVHNGAPAPVSGEKDVVFLLDGSEGVRSGFPLLKEFVQRVVESLDVGQDRVRVAVVQYSDRTRPEFYLNSYMNKQDVVNAVRQLTLLGGPTPNTGAALEFVLRNILVSSAGSRITEGVPQLLIVLTADRSGDDVRNPSVVVKRGGAVPIGIGIGNADITEMQTISFIPDFAVAIPTFRQLGTVQQVISERVTQLTREELSRLQPVLQPLPSPGVGGKRDVVFLIDGSQSAGPEFQYVRTLIERLVDYLDVGFDTTRVAVIQFSDDPKVEFLLNAHSSKDEVQNAVQRLRPKGGRQINVGNALEYVSRNIFKRPLGSRIEEGVPQFLVLISSGKSDDEVDDPAVELKQFGVAPFTIARNADQEELVKISLSPEYVFSVSTFRELPSLEQKLLTPITTLTSEQIQKLLASTRYPPPAVESDAADIVFLIDSSEGVRPDGFAHIRDFVSRIVRRLNIGPSKVRVGVVQFSNDVFPEFYLKTYRSQAPVLDAIRRLRLRGGSPLNTGKALEFVARNLFVKSAGSRIEDGVPQHLVLVLGGKSQDDVSRFAQVIRSSGIVSLGVGDRNIDRTELQTITNDPRLVFTVREFRELPNIEERIMNSFGPSAATPAPPGVDTPPPSRPEKKKADIVFLLDGSINFRRDSFQEVLRFVSEIVDTVYEDGDSIQVGLVQYNSDPTDEFFLKDFSTKRQIIDAINKVVYKGGRHANTKVGLEHLRVNHFVPEAGSRLDQRVPQIAFVITGGKSVEDAQDVSLALTQRGVKVFAVGVRNIDSEEVGKIASNSATAFRVGNVQELSELSEQVLETLHDAMHETLCPGVTDAAKACNLDVILGFDGSRDQNVFVAQKGFESKVDAILNRISQMHRVSCSGGRSPTVRVSVVANTPSGPVEAFDFDEYQPEMLEKFRNMRSQHPYVLTEDTLKVYLNKFRQSSPDSVKVVIHFTDGADGDLADLHRASENLRQEGVRALILVGLERVVNLERLMHLEFGRGFMYDRPLRLNLLDLDYELAEQLDNIAEKACCGVPCKCSGQRGDRGPIGSIGPKGIPGEDGYRGYPGDEGGPGERGPPGVNGTQGFQGCPGQRGVKGSRGFPGEKGEVGEIGLDGLDGEDGDKGLPGSSGEKGNPGRRGDKGPRGEKGERGDVGIRGDPGNPGQDSQERGPKGETGDLGPMGVPGRDGVPGGPGETGKNGGFGRRGPPGAKGNKGGPGQPGFEGEQGTRGAQGPAGPAGPPGLIGEQGISGPRGSGGAAGAPGERGRTGPLGRKGEPGEPGPKGGIGNRGPRGETGDDGRDGVGSEGRRGKKGERGFPGYPGPKGNPGEPGLNGTTGPKGIRGRRGNSGPPGIVGQKGDPGYPGPAGPKGNRGDSIDQCALIQSIKDKCPCCYGPLECPVFPTELAFALDTSEGVNQDTFGRMRDVVLSIVNDLTIAESNCPRGARVAVVTYNNEVTTEIRFADSKRKSVLLDKIKNLQVALTSKQQSLETAMSFVARNTFKRVRNGFLMRKVAVFFSNTPTRASPQLREAVLKLSDAGITPLFLTRQEDRQLINALQINNTAVGHALVLPAGRDLTDFLENVLTCHVCLDICNIDPSCGFGSWRPSFRDRRAAGSDVDIDMAFILDSAETTTLFQFNEMKKYIAYLVRQLDMSPDPKASQHFARVAVVQHAPSESVDNASMPPVKVEFSLTDYGSKEKLVDFLSRGMTQLQGTRALGSAIEYTIENVFESAPNPRDLKIVVLMLTGEVPEQQLEEAQRVILQAKCKGYFFVVLGIGRKVNIKEVYTFASEPNDVFFKLVDKSTELNEEPLMRFGRLLPSFVSSENAFYLSPDIRKQCDWFQGDQPTKNLVKFGHKQVNVPNNVTSSPTSNPVTTTKPVTTTKPVTTTTKPVTTTTKPVTIINQPSVKPAAAKPAPAKPVAAKPVATKMATVRPPVAVKPATAAKPVAAKPAAVRPPAAAAAKPVATKPEVPRPQAAKPAATKPATTKPMVKMSREVQVFEITENSAKLHWERAEPPGPYFYDLTVTSAHDQSLVLKQNLTVTDRVIGGLLAGQTYHVAVVCYLRSQVRATYHGSFSTKKSQPPPPQPARSASSSTINLMVSTEPLALTETDICKLPKDEGTCRDFILKWYYDPNTKSCARFWYGGCGGNENKFGSQKECEKVCAPVLAKPGVISVMGT

SEQ ID NO: 1071 - protein, 1036 aa, Homo sapiens
MRKHRHLPLVAVFCLFLSGFPTTHAQQQQAVIEVNKRDIVFLVDGSSALGLANFNAIRDFIAKVIQRLEIGQDLIQVAVAQYADTVRPEFYFNTHPTKREVITAVRKMKPLDGSALYTGSALDFVRNNLFTSSAGYRAAEGIPKLLVLITGGKSLDEISQPAQELKRSSIMAFAIGNKGADQAELEEIAFDSSLVFIPAEFRAAPLQGMLPGLLAPLRTLSGTPEVHSNKRDIIFLLDGSANVGKTNFPYVRDFVMNLVNSLDIGNDNIRVGLVQFSDTPVTEFSLNTYQTKSDILGHLRQLQLQGGSGLNTGSALSYVYANHFTEAGGSRIREHVPQLLLLLTAGQSEDSYLQAANALTRAGILTFCVGASQANKAELEQIAFNPSLVYLMDDFSSLPALPQQLIQPLTTYVSGGVEEVPLAQPESKRDILFLFDGSANLVGQFPVVRDFLYKIIDELNVKPEGTRIAVAQYSDDVKVESRFDEHQSKPEILNLVKRMKIKTGKALNLGYALDYAQRYIFVKSAGSRIEDGVLQFLVLLVAGRSSDRVDGPASNLKQSGVVPFIFQAKNADPAELEQIVLSPAFILAAESLPKIGDLHPQIVNLLKSVHNGAPAPVSGEKDVVFLLDGSEGVRSGFPLLKEFVQRVVESLDVGQDRVRVAVVQYSDRTRPEFYLNSYMNKQDVVNAVRQLTLLGGPTPNTGAALEFVLRNILVSSAGSRITEGVPQLLIVLTADRSGDDVRNPSVVVKRGGAVPIGIGIGNADITEMQTISFIPDFAVAIPTFRQLGTVQQVISERVTQLTREELSRLQPVLQPLPSPGVGGKRDVVFLIDGSQSAGPEFQYVRTLIERLVDYLDVGFDTTRVAVIQFSDDPKVEFLLNAHSSKDEVQNAVQRLRPKGGRQINVGNALEYVSRNIFKRPLGSRIEEGVPQFLVLISSGKSDDEVDDPAVELKQFGVAPFTIARNADQEELVKISLSPEYVFSVSTFRELPSLEQKLLTPITTLTSEQIQKLLASTRYPPPGEMGASEVLLGAFSI

SEQ ID NO: 1072 - protein, 2971 aa, Homo sapiens; identical to SEQ ID NO: 1070

SEQ ID NO: 1073 - protein, 2615 aa, Homo sapiens
MKILLIIFVLIIWTETLADQSPGPGPVYADVVFLVDSSDHLGPKSFPFVKTFINKMINSLPIEANKYRVALAQYSDEFHSEFHLSTFKGRSPMLNHLKKNFQFIGGSLQIGKALQEAHRTYFSAPINGRDRKQFPPILVVLASAESEDEVEEASKALQKDGVKIISVGVQKASEENLKAMATSHFHFNLRTIRDLSTFSQNMTQIIKDVTKYKEGAVDADMQVHFPISCQKDSLADLVFLVDESLGTGGNLRHLQTFLENITSSMDVKENCMRLGLMSYSNSAKTISFLKSSTTQSEFQQQIKNLSIQVGKSNTGAAIDQMRRDGFSESYGSRRAQGVPQIAVLVTHRPSDDEVHDAALNLRLEDVNVFALSIQGANNTQLEEIVSYPPEQTISTLKSYADLETYSTKFLKKLQNEIWSQISTYAEQRNLDKTGCVDTKEADIHFLIDGSSSIQEKQFEQIKRFMLEVTEMFSIGPDKVRVGVVQYSDDTEVEFYITDYSNDIDLRKAIFNIKQLTGGTYTGKALDYILQIIKNGMKDRMSKVPCYLIVLTDGMSTDRVVEPAKRLRAEQITVHAVGIGAANKIELQEIAGKEERVSFGQNFDALKSIKNEVVREICAEKGCEDMKADIMFLVDSSWSIGNENFRKMKIFMKNLLTKIQIGADKTQIGVVQFSDKTKEEFQLNRYFTQQEISDAIDRMSLINEGTLTGKALNFVGQYFTHSKGARLGAKKFLILITDGVAQDDVRDPARILRGKDVTIFSVGVYNANRSQLEEISGDSSLVFHVENFDHLKALERKLIFRVCALHDCKRITLLDVVFVLDHSGSIKKQYQDHMINLTIHLVKKADVGRDRVQFGALKYSDQPNILFYLNTYSNRSAIIENLRKRRDTGGNTYTAKALKHANALFTEEHGSRIKQNVKQMLIVITDGESHDHDQLNDTALELRNKGITIFAVGVGKANQKELEGMAGNKNNTIYVDNFDKLKDVFTLVQERMCTEAPEVCHLQEADVIFLCDGSDRVSNSDFVTMTTFLSDLIDNFDIQSQRMKIGMAQFGSNYQSIIELKNSLTKTQWKTQIQNVSKSGGFPRIDFALKKVSNMFNLHAGGRRNAGVPQTLVVITSGDPRYDVADAVKTLKDLGICVLVLGIGDVYKEHLLPITGNSEKIITFQDFDKLKNVDVKKRIIREICQSCGKTNCFMDIVVGFDISTHVQGQPLFQGHPQLESYLPGILEDISSIKGVSCGAGTEAQVSLAFKVNSDQGFPAKFQIYQKAVFDSLLQVNVSGPTHLNAQFLRSLWDTFKDKSASRGQVLLIFSDGLQSESNIMLENQSDRLREAGLDALLVVSLNTTAHHEFSSFEFGKRFDYRTHLTIGMRELGKKLSQYLGNIAERTCCCTFCKCPGIPGPHGTRGLQAMKGSQGLKGSRGHRGEDGNPGVRGDTGPQGDKGIAGCPGAWGQKGLKGFSGPKGGHGDDGIDGLDGEEGCHGFPGIKGEKGDPGSQGSPGSRGAPGQYGEKGFPGDPGNPGQNNNIKGQKGSKGEQGRQGRSGQKGVQGSPSSRGSRGREGQRGLRGVSGEPGNPGPTGTLGAEGLQGPQGSQGNPGRKGEKGSQGQKGPQGSPGLMGAKGSTGRPGLLGKKGEPGLPGDLGPVGQTGQRGRQGDSGIPGYGQMGRKGVKGPRGFPGDAGQKGDIGNPGIPGGPGPKGFRGLALTVGLKGEEGSRGLPGPPGQRGIKGMAGQPVYSQCDLIRFLREHSLCSLEKCPAYPTELVFALDNSYDVTEESFNKTRDIITSIVNDLNIRENNCPVGARVAMVSYNSGTSYLIRWSDYNRKKQLLQQLSQIKYQDTTEPRDVGNAMRFVTRNVFKRTYAGANVRRVAVFFSNGQTASRSSIITATMEFSALDISPTVFAFDERVFLEAFGFDNTGTFQVIPVPPNGENQTLERLRRCALCYDKCFPNACIREAFLPEDSYMDVVFLIDNSRNIAKDEFKAVKALVSSVIDNFNIASDPLISDSGDRIALLSYSPWESSRRKMGTVKTEFDFITYDNQLLMKNHIQTSFQQLNGEATIGRALLWTTENLFPETPYLRKHKVIFVVSAGENYERKEFVKMMALRAKCQGYVIFVISLGSTRKDDMEELASYPLDQHLIQLGRIHKPDLNYIAKFLKPFLYSVRRGFNQYPPPMLEDACRLINLGGENIQNDGFQFVTELQEDFLGGNGFIGQELNSGRESPFVKTEDNGSDYLVYLPSQMFEPQKLMINYEKDQKSAEIASLTSGHENYGRKEEPDHTYEPGDVSLQEYYMDVAFLIDASQRVGSDEFKEVKAFITSVLDYFHIAPTPLTSTLGDRVAVLSYSPPGYMPNTEECPVYLEFDLVTYNSIHQMKHHLQDSQQLNGDVFIGHALQWTIDNVFVGTPNLRKNKVIFVISAGETNSLDKDVLRNVSLRAKCQGYSIFVFSFGPKHNDKELEELASHPLDHHLVQLGRTHKPDWNYIIKFVKPFVHLIRRAINKYPTEDMKATCVNMTSPNPENGGTENTVLLLPGIYEIKTENGDLFDEFDSQAQHLLVLGNNHSSGSETATDLMQKLYLLFSTEKLAMKDKEKAHLEEISALVVDKQQEKEDKEMEATDI

SEQ ID NO: 1074 - protein, 2615 aa, Homo sapiens
MKILLIIFVLIIWTETLADQSPGPGPVYADVVFLVDSSDHLGPKSFPFVKTFINKMINSLPIEANKYRVALAQYSDEFHSEFHLSTFKGRSPMLNHLKKNFQFIGGSLQIGKALQEAHRTYFSAPINGRDRKQFPPILVVLASAESEDEVEEASKALQKDGVKIISVGVQKASEENLKAMATSHFHFNLRTIRDLSTFSQNMTQIIKDVTKYKEGAVDADMQVHFPISCQKDSLADLVFLVDESLGTGGNLRHLQTFLENITSSMDVKENCMRLGLMSYSNSAKTISFLKSSTTQSEFQQQIKNLSIQVGKSNTGAAIDQMRRDGFSESYGSRRAQGVPQIAVLVTHRPSDDEVHDAALNLRLEDVNVFALSIQGANNTQLEEIVSYPPEQTISTLKSYADLETYSTKFLKKLQNEIWSQISTYAEQRNLDKTGCVDTKEADIHFLIDGSSSIQEKQFEQIKRFMLEVTEMFSIGPDKVRVGVVQYSDDTEVEFYITDYSNDIDLRKAIFNIKQLTGGTYTGKALDYILQIIKNGMKDRMSKVPCYLIVLTDGMSTDRVVEPAKRLRAEQITVHAVGIGAANKIELQEIAGKEERVSFGQNFDALKSIKNEVVREICAEKGCEDMKADIMFLVDSSWSIGNENFRKMKIFMKNLLTKIQIGADKTQIGVVQFSDKTKEEFQLNRYFTQQEISDAIDRMSLINEGTLTGKALNFVGQYFTHSKGARLGAKKFLILITDGVAQDDVRDPARILRGKDVTIFSVGVYNANRSQLEEISGDSSLVFHVENFDHLKALERKLIFRVCALHDCKRITLLDVVFVLDHSGSIKKQYQDHMINLTIHLVKKADVGRDRVQFGALKYSDQPNILFYLNTYSNRSAIIENLRKRRDTGGNTYTAKALKHANALFTEEHGSRIKQNVKQMLIVITDGESHDHDQLNDTALELRNKGITIFAVGVGKANQKELEGMAGNKNNTIYVDNFDKLKDVFTLVQERMCTEAPEVCHLQEADVIFLCDGSDRVSNSDFVTMTTFLSDLIDNFDIQSQRMKIGMAQFGSNYQSIIELKNSLTKTQWKTQIQNVSKSGGFPRIDFALKKVSNMFNLHAGGRRNAGVPQTLVVITSGDPRYDVADAVKTLKDLGICVLVLGIGDVYKEHLLPITGNSEKIITFQDFDKLKNVDVKKRIIREICQSCGKTNCFMDIVVGFDISTHVQGQPLFQGHPQLESYLPGILEDISSIKGVSCGAGTEAQVSLAFKVNSDQGFPAKFQIYQKAVFDSLLQVNVSGPTHLNAQFLRSLWDTFKDKSASRGQVLLIFSDGLQSESNIMLENQSDRLREAGLDALLVVSLNTTAHHEFSSFEFGKRFDYRTHLTIGMRELGKKLSQYLGNIAERTCCCTFCKCPGIPGPHGTRGLQAMKGSQGLKGSRGHRGEDGNPGVRGDTGPQGDKGIAGCPGAWGQKGLKGFSGPKGGHGDDGIDGLDGEEGCHGFPGIKGEKGDPGSQGSPGSRGAPGQYGEKGFPGDPGNPGQNNNIKGQKGSKGEQGRQGRSGQKGVQGSPSSRGSRGREGQRGLRGVSGEPGNPGPTGTLGAEGLQGPQGSQGNPGRKGEKGSQGQKGPQGSPGLMGAKGSTGRPGLLGKKGEPGLPGDLGPVGQTGQRGRQGDSGIPGYGQMGRKGVKGPRGFPGDAGQKGDIGNPGIPGGPGPKGFRGLALTVGLKGEEGSRGLPGPPGQRGIKGMAGQPVYSQCDLIRFLREHSPCWKEKCPAYPTELVFALDNSYDVTEESFNKTRDIITSIVNDLNIRENNCPVGARVAMVSYNSGTSYLIRWSDYNRKKQLLQQLSQIKYQDTTEPRDVGNAMRFVTRNVFKRTYAGANVRRVAVFFSNGQTASRSSIITATMEFSALDISPTVFAFDERVFLEAFGFDNTGTFQVIPVPPNGENQTLERLRRCALCYDKCFPNACIREAFLPEDSYMDVVFLIDNSRNIAKDEFKAVKALVSSVIDNFNIASDPLISDSGDRIALLSYSPWESSRRKMGTVKTEFDFITYDNQLLMKNHIQTSFQQLNGEATIGRALLWTTENLFPETPYLRKHKVIFVVSAGENYERKEFVKMMALRAKCQGYVIFVISLGSTRKDDMEELASYPLDQHLIQLGRIHKPDLNYIAKFLKPFLYSVRRGFNQYPPPMLEDACRLINLGGENIQNDGFQFVTELQEDFLGGNGFIGQELNSGRESPFVKTEDNGSDYLVYLPSQMFEPQKLMINYEKDQKSAEIASLTSGHENYGRKEEPDHTYEPGDVSLQEYYMDVAFLIDASQRVGSDEFKEVKAFITSVLDYFHIAPTPLTSTLGDRVAVLSYSPPGYMPNTEECPVYLEFDLVTYNSIHQMKHHLQDSQQLNGDVFIGHALQWTIDNVFVGTPNLRKNKVIFVISAGETNSLDKDVLRNVSLRAKCQGYSIFVFSFGPKHNDKELEELASHPLDHHLVQLGRTHKPDWNYIIKFVKPFVHLIRRAINKYPTEDMKATCVNMTSPNPENGGTENTVLLLPGIYEIKTENGDLFDEFDSQAQHLLVLGNNHSSGSETATDLMQKLYLLFSTEKLAMKDKEKAHLEEISALVVDKQQEKEDKEMEATDI

SEQ ID NO: 1075 - protein, 557 aa, Homo sapiens
IGRALLWTTENLFPETPYLRKHKVIFVVSAGENYERKEFVKMMALRAKCQGYVIFVISLGSTRKDDMEELASYPLDQHLIQLGRIHKPDLNYIAKFLKPFLYSVRRGFNQYPPPMLEDACRLINLGGENIQNDGFQFVTELQEDFLGGNGFIGQELNSGRESPFVKTEDNGSDYLVYLPSQMFEPQKLMINYEKDQKSAEIASLTSGHENYGRKEEPDHTYEPGDVSLQEYYMDVAFLIDASQRVGSDEFKEVKAFITSVLDYFHIAPTPLTSTLGDRVAVLSYSPPGYMPNTEECPVYLEFDLVTYNSIHQMKHHLQDSQQLNGDVFIGHALQWTIDNVFVGTPNLRKNKVIFVISAGETNSLDKDVLRNVSLRAKCQGYSIFVFSFGPKHNDKELEELASHPLDHHLVQLGRTHKPDWNYIIKFVKPFVHLIRRAINKYPTEDMKATCVNMTSPNPENGGTENTVLLLPGIYEIKTENGDLFDEFDSQAQHLLVLGNNHSSGSETATDLMQKLYLLFSTEKLAMKDKEKAHLEEISALVVDKQQEKEDGEDTRSS

SEQ ID NO: 1076 - protein, 2526 aa, Homo sapiens
MKILLIIFVLIIWTETLADQSPGPGPVYADVVFLVDSSDHLGPKSFPFVKTFINKMINSLPIEANKYRVALAQYSDEFHSEFHLSTFKGRSPMLNHLKKNFQFIGGSLQIGKALQEAHRTYFSAPINGRDRKQFPPILVVLASAESEDEVEEASKALQKDGVKIISVGVQKASEENLKAMATSHFHFNLRTIRDLSTFSQNMTQIIKDVTKYKEGAVDADMQVHFPISCQKDSLADLVFLVDESLGTGGNLRHLQTFLENITSSMDVKENCMRLGLMSYSNSAKTISFLKSSTTQSEFQQQIKNLSIQVGKSNTGAAIDQMRRDGFSESYGSRRAQGVPQIAVLVTHRPSDDEVHDAALNLRLEDVNVFALSIQGANNTQLEEIVSYPPEQTISTLKSYADLETYSTKFLKKLQNEIWSQISTYAEQRNLDKTGCVDTKEADIHFLIDGSSSIQEKQFEQIKRFMLEVTEMFSIGPDKVRVGVVQYSDDTEVEFYITDYSNDIDLRKAIFNIKQLTGGTYTGKALDYILQIIKNGMKDRMSKVPCYLIVLTDGMSTDRVVEPAKRLRAEQITVHAVGIGAANKIELQEIAGKEERVSFGQNFDALKSIKNEVVREICAEKGCEDMKADIMFLVDSSWSIGNENFRKMKIFMKNLLTKIQIGADKTQIGVVQFSDKTKEEFQLNRYFTQQEISDAIDRMSLINEGTLTGKALNFVGQYFTHSKGARLGAKKFLILITDGVAQDDVRDPARILRGKDVTIFSVGVYNANRSQLEEISGDSSLVFHVENFDHLKALERKLIFRVCALHDCKRITLLDVVFVLDHSGSIKKQYQDHMINLTIHLVKKADVGRDRVQFGALKYSDQPNILFYLNTYSNRSAIIENLRKRRDTGGNTYTAKALKHANALFTEEHGSRIKQNVKQMLIVITDGESHDHDQLNDTALELRNKGITIFAVGVGKANQKELEGMAGNKNNTIYVDNFDKLKDVFTLVQERMCTEAPEVCHLQEADVIFLCDGSDRVSNSDFVTMTTFLSDLIDNFDIQSQRMKIGMAQFGSNYQSIIELKNSLTKTQWKTQIQNVSKSGGFPRIDFALKKVSNMFNLHAGGRRNAGVPQTLVVITSGDPRYDVADAVKTLKDLGICVLVLGIGDVYKEHLLPITGNSEKIITFQDFDKLKNVDVKKRIIREICQSCGKTNCFMDIVVGFDISTHVQGQPLFQGHPQLESYLPGILEDISSIKGVSCGAGTEAQVSLAFKVNSDQGFPAKFQIYQKAVFDSLLQVNVSGPTHLNAQFLRSLWDTFKDKSASRGQVLLIFSDGLQSESNIMLENQSDRLREAGLDALLVVSLNTTAHHEFSSFEFGKRFDYRTHLTIGMRELGKKLSQYLGNIAERTCCCTFCKCPGIPGPHGTRGLQAMKGSQGLKGSRGHRGEDGNPGVRGDTGPQGDKGIAGCPGAWGQKGLKGFSGPKGGHGDDGIDGLDGEEGCHGFPGIKGEKGDPGSQGSPGSRGAPGQYGEKGFPGDPGNPGQNNNIKGQKGSKGEQGRQGRSGQKGVQGSPSSRGSRGREGQRGLRGVSGEPGNPGPTGTLGAEGLQGPQGSQGNPGRKGEKGSQGQKGPQGSPGLMGAKGSTGRPGLLGKKGEPGLPGDLGPVGQTGQRGRQGDSGIPGYGQMGRKGVKGPRGFPGDAGQKGDIGNPGIPGGPGPKGFRGLALTVGLKGEEGSRGLPGPPGQRGIKGMAGQPVYSQCDLIRFLREHSLCSLEKCPAYPTELVFALDNSYDVTEESFNKTRDIITSIVNDLNIRENNCPVGARVAMVSYNSGTSYLIRWSDYNRKKQLLQQLSQIKYQDTTEPRDVGNAMRFVTRNVFKRTYAGANVRRVAVFFSNGQTASRSSIITATMEFSALDISPTVFAFDERVFLEAFGFDNTGTFQVIPVPPNGENQTLERLRRCALCYDKCFPNACIREAFLPEDSYMDVVFLIDNSRNIAKDEFKAVKALVSSVIDNFNIASDPLISDSGDRIALLSYSPWESSRRKMGTVKTEFDFITYDNQLLMKNHIQTSFQQLNGEATIGRALLWTTENLFPETPYLRKHKVIFVVSAGENYERKEFVKMMALRAKCQGYVIFVISLGSTRKDDMEELASYPLDQHLIQLGRIHKPDLNYIAKFLKPFLYSVRRGFNQYPPPMLEDACRLINLGGENIQNDGFQFVTELQEDFLGGNGFIGQELNSGRESPFVKTEDNGSDYLVYLPSQMFEPQKLMINYEKDQKSAEIASLTSGHENYGRKEEPDHTYEPGDVSLQEYYMDVAFLIDASQRVGSDEFKEVKAFITSVLDYFHIAPTPLTSTLGDRVAVLSYSPPGYMPNTEECPVYLEFDLVTYNSIHQMKHHLQDSQQLNGDVFIGHALQWTIDNVFVGTPNLRKNKVIFVISAGETNSLDKDVLRNVSLRAKCQGYSIFVFSFGPKHNDKELEELASHPLDHHLVQLGRTHKPDWNYIIKFVKPFVHLIRRAINKYPTEDMKATCVNMTSPNPENGGTENTVLW

SEQ ID NO: 1077 - protein, 443 aa, Homo sapiens
NQYPPPMLEDACRLINLGGENIQNDGFQFVTELQEDFLGGNGFIGQELNSGRESPFVKTEDNGSDYLVYLPSQMFEPQKLMINYEKDQKSAEIASLTSGHENYGRKEEPDHTYEPGDVSLQEYYMDVAFLIDASQRVGSDEFKEVKAFITSVLDYFHIAPTPLTSTLGDRVAVLSYSPPGYMPNTEECPVYLEFDLVTYNSIHQMKHHLQDSQQLNGDVFIGHALQWTIDNVFVGTPNLRKNKVIFVISAGETNSLDKDVLRNVSLRAKCQGYSIFVFSFGPKHNDKELEELASHPLDHHLVQLGRTHKPDWNYIIKFVKPFVHLIRRAINKYPTEDMKATCVNMTSPNPENGGTENTVLLLPGIYEIKTENGDLFDEFDSQAQHLLVLGNNHSSGSETATDLMQKLYLLFSTEKLAMKDKEKAHLEEISALVVDKQQEKEDL

SEQ ID NO: 1078 - protein, 2263 aa, Homo sapiens
MMLLILFLVIICSHISVNQDSGPEYADVVFLVDSSDRLGSKSFPFVKMFITKMISSLPIEADKYRVALAQYSDKLHSEFHLSTFKGRSPMLNHLRKNFGFIGGSLQIGKALQEAHRTYFSAPANGRDKKQFPPILVVLASSESEDNVEEASKALRKDGVKIISVGVQKASEENLKAMATSQFHFNLRTVRDLSMFSQNMTHIIKDVIKYKEGAVDDIFVEACQGPSMADVVFLLDMSINGSEENFDYLKGFLEESVSALDIKENCMRVGLVAYSNETKVINSLSMGINKSEVLQHIQNLSPRTGKAYTGAAIKKLRKEVFSARNGSRKNQGVPQIAVLVTHRDSEDNVTKAAVNLRREGVTIFTLGIEGASDTQLEKIASHPAEQYVSKLKTFADLAAHNQTFLKKLRNQITHTVSVFSERTETLKSGCVDTEEADIYLLIDGSGSTQATDFHEMKTFLSEVVGMFNIAPHKVRVGAVQYADSWDLEFEINKYSNKQDLGKAIENIRQMGGNTNTGAALNFTLSLLQKAKKQRGNKVPCHLVVLTNGMSKDSILEPANRLREEHIRVYAIGIKEANQTQLREIAGEEKRVYYVHDFDALKDIRNQVVQEICTEEACKEMKADIMFLVDSSGSIGPENFSKMKTFMKNLVSKSQIGPDRVQIGVVQFSDINKEEFQLNRFMSQSDISNAIDQMAHIGQTTLTGSALSFVSQYFSPTKGARPNIRKFLILITDGEAQDIVKEPAVVLRQEGVIIYSVGVFGSNVTQLEEISGRPEMVFYVENFDILQRIEDDLVFGICSPREECKRIEVLDVVFVIDSSGSIDYDEYNIMKDFMIGLVKKADVGKNQVRFGALKYADDPEVLFYLDDFGTKLEVISVLQNDQAMGGSTYTAEALGFSDHMFTEARGSRLNKGVPQVLIVITDGESHDADKLNATAKALRDKGILVLAVGIDGANPVELLAMAGSSDKYFFVETFGGLKGIFSDVTASVCNSSKVDCEIDKVDLVFLMDGSTSIQPNDFKKMKEFLASVVQDFDVSLNRVRIGAAQFSDTYHPEFPLGTFIGEKEISFQIENIKQIFGNTHIGAALREVEHYFRPDMGSRINTGTPQVLLVLTDGQSQDEVAQAAEALRHRGIDIYSVGIGDVDDQQLIQITGTAEKKLTVHNFDELKKVNKRIVRNICTTAGESNCFVDVVVGFDVSTQEKGQTLLEGQPWMETYLQDILRAISSLNGVSCEVGTETQVSVAFQVTNAMEKYSPKFEIYSENILNSLKDITVKGPSLLNANLLDSLWDTFQNKSAARGKVVLLFSDGLDDDVEKLEQKSDELRKEGLNALITVALDGPADSSDLADLPYIEFGKGFEYRTQLSIGMRELGSRLSKQLVNVAERTCCCLFCKCIGGDGTMGDPGPPGKRGPPGFKGSEGYLGEEGIAGERGAPGPVGEQGTKGCYGTKGPKGNRGLNGQEGEVGENGIDGLNGEQGDNGLPGRKGEKGDEGSQGSPGKRGTPGDRGAKGLRGDPGAPGVDSSIEGPTGLKGERGRQGRRGWPGPPGTPGSRRKTAAHGRRGHTGPQGTAGIPGPDGLEGSLGLKGPQGPRGEAGVKGEKGGVGSKGPQGPPGPGGEAGNQGRLGSQGNKGEPGDLGEKGAVGFPGPRGLQGNDGSPGYGSVGRKGAKGQEGFPGESGPKGEIGDPGGPGETGLKGARGKMISAGLPGEMGSPGEPGPPGRKGVKGAKGLASFSTCELIQYVRDRSPGRHGKPECPVHPTELVFALDHSRDVTEQEFERMKEMMAFLVRDIKVRENSCPVGAHIAILSYNSHARHLVRFSDAYKKSQLLREIETIPYERSSASREIGRAMRFISRNVFKRTLPGAHTRKIATFFSSGQSADAHSITTAAMEFGALEIIPVVITFSNVPSVRRAFAIDDTGTFQVIVVPSGADYIPALERLQRCTFCYDVCKPDASCDQARPPPVQSYMDAAFLLDASRNMGSAEFEDIRAFLGALLDHFEITPEPETSVTGDRVALLSHAPPDFLPNTQKSPVRAEFNLTTYRSKRLMKRHVHESVKQLNGDAFIGHALQWTLDNVFLSTPNLRRNKVIFVISAGETSHLDGEILKKESLRAKCQGYALFVFSLGPIWDDKELEDLASHPLDHHLVQLGRIHKPDHSYGVKFVKSFINSIRRAINKYPPINLKIKCNRLNSIDPKQPPRPFRSFVPGPLKATLKEDVLQKAKFFQDKKYLSRVARSGRDDAIQNFMRSTSHTFKNGRMIESAPKQHD

SEQ ID NO: 1079 - protein, 2263 aa, Homo sapiens
MMLLILFLVIICSHISVNQDSGPEYADVVFLVDSSDRLGSKSFPFVKMFITKMISSLPIEADKYRVALAQYSDKLHSEFHLSTFKGRSPMLNHLRKNFGFIGGSLQIGKALQEAHRTYFSAPANGRDKKQFPPILVVLASSESEDNVEEASKALRKDGVKIISVGVQKASEENLKAMATSQFHFNLRTVRDLSMFSQNMTHIIKDVIKYKEGAVDDIFVEACQGPSMADVVFLLDMSINGSEENFDYLKGFLEESVSALDIKENCMRVGLVAYSNETKVINSLSMGINKSEVLQHIQNLSPRTGKAYTGAAIKKLRKEVFSARNGSRKNQGVPQIAVLVTHRDSEDNVTKAAVNLRREGVTIFTLGIEGASDTQLEKIASHPAEQYVSKLKTFADLAAHNQTFLKKLRNQITHTVSVFSERTETLKSGCVDTEEADIYLLIDGSGSTQATDFHEMKTFLSEVVGMFNIAPHKVRVGAVQYADSWDLEFEINKYSNKQDLGKAIENIRQMGGNTNTGAALNFTLSLLQKAKKQRGNKVPCHLVVLTNGMSKDSILEPANRLREEHIRVYAIGIKEANQTQLREIAGEEKRVYYVHDFDALKDIRNQVVQEICTEEACKEMKADIMFLVDSSGSIGPENFSKMKTFMKNLVSKSQIGPDRVQIGVVQFSDINKEEFQLNRFMSQSDISNAIDQMAHIGQTTLTGSALSFVSQYFSPTKGARPNIRKFLILITDGEAQDIVKEPAVVLRQEGVIIYSVGVFGSNVTQLEEISGRPEMVFYVENFDILQRIEDDLVFGICSPREECKRIEVLDVVFVIDSSGSIDYDEYNIMKDFMIGLVKKADVGKNQVRFGALKYADDPEVLFYLDDFGTKLEVISVLQNDQAMGGSTYTAEALGFSDHMFTEARGSRLNKGVPQVLIVITDGESHDADKLNATAKALRDKGILVLAVGIDGANPVELLAMAGSSDKYFFVETFGGLKGIFSDVTASVCNSSKVDCEIDKVDLVFLMDGSTSIQPNDFKKMKEFLASVVQDFDVSLNRVRIGAAQFSDTYHPEFPLGTFIGEKEISFQIENIKQIFGNTHIGAALREVEHYFRPDMGSRINTGTPQVLLVLTDGQSQDEVAQAAEALRHRGIDIYSVGIGDVDDQQLIQITGTAEKKLTVHNFDELKKVNKRIVRNICTTAGESNCFVDVVVGFDVSTQEKGQTLLEGQPWMETYLQDILRAISSLNGVSCEVGTETQVSVAFQVTNAMEKYSPKFEIYSENILNSLKDITVKGPSLLNANLLDSLWDTFQNKSAARGKVVLLFSDGLDDDVEKLEQKSDELRKEGLNALITVALDGPADSSDLADLPYIEFGKGFEYRTQLSIGMRELGSRLSKQLVNVAERTCCCLFCKCIGGDGTMGDPGPPGKRGPPGFKGSEGYLGEEGIAGERGAPGPVGEQGTKGCYGTKGPKGNRGLNGQEGEVGENGIDGLNGEQGDNGLPGRKGEKGDEGSQGSPGKRGTPGDRGAKGLRGDPGAPGVDSSIEGPTGLKGERGRQGRRGWPGPPGTPGSRRKTAAHGRRGHTGPQGTAGIPGPDGLEGSLGLKGPQGPRGEAGVKGEKGGVGSKGPQGPPGPGGEAGNQGRLGSQGNKGEPGDLGEKGAVGFPGPRGLQGNDGSPGYGSVGRKGAKGQEGFPGESGPKGEIGDPGGPGETGLKGARGKMISAGLPGEMGSPGEPGPPGRKGVKGAKGLASFSTCELIQYVRDRSPGQHRKPECPVHPTELVFALDHSRDVTEQEFERMKEMMAFLVRDIKVRENSCPVGAHIAILSYNSHARHLVRFSDAYKKSQLLREIETIPYERSSASREIGRAMRFISRNVFKRTLPGAHTRKIATFFSSGQSADAHSITTAAMEFGALEIIPVVITFSNVPSVRRAFAIDDTGTFQVIVVPSGADYIPALERLQRCTFCYDVCKPDASCDQARPPPVQSYMDAAFLLDASRNMGSAEFEDIRAFLGALLDHFEITPEPETSVTGDRVALLSHAPPDFLPNTQKSPVRAEFNLTTYRSKRLMKRHVHESVKQLNGDAFIGHALQWTLDNVFLSTPNLRRNKVIFVISAGETSHLDGEILKKESLRAKCQGYALFVFSLGPIWDDKELEDLASHPLDHHLVQLGRIHKPDHSYGVKFVKSFINSIRRAINKYPPINLKIKCNRLNSIDPKQPPRPFRSFVPGPLKATLKEDVLQKAKFFQDKKYLSRVARSGRDDAIQNFMRSTSHTFKNGRMIESAPKQHD

SEQ ID NO: 1080 - protein, 703 aa, Homo sapiens
MLGTLTPLSSLLLLLLVLVLGCGPRASSGGGAGGAAGYAPVKYIQPMQKGPVGPPFREGKGQYLEMPLPLLPMDLKGEPGPPGKPGPRGPPGPPGFPGKPGMGKPGLHGQPGPAGPPGFSRMGKAGPPGLPGKVGPPGQPGLRGEPGIRGDQGLRGPPGPPGLPGPSGITIPGKPGAQGVPGPPGFQGEPGPQGEPGPPGDRGLKGDNGVGQPGLPGAPGQGGAPGPPGLPGPAGLGKPGLDGLPGAPGDKGESGPPGVPGPRGEPGAVGPKGPPGVDGVGVPGAAGLPGPQGPSGAKGEPGTRGPPGLIGPTGYGMPGLPGPKGDRGPAGVPGLLGDRGEPGEDGEPGEQGPQGLGGPPGLPGSAGLPGRRGPPGPKGEAGPGGPPGVPGIRGDQGPSGLAGKPGVPGERGLPGAHGPPGPTGPKGEPGFTGRPGGPGVAGALGQKGDLGLPGQPGLRGPSGIPGLQGPAGPIGPQGLPGLKGEPGLPGPPGEGRAGEPGTAGPTGPPGVPGSPGITGPPGPPGPPGPPGAPGAFDETGIAGLHLPNGGVEGAVLGKGGKPQFGLGELSAHATPAFTAVLTSPFPASGMPVKFDRTLYNGHSGYNPATGIFTCPVGGVYYFAYHVHVKGTNVWVALYKNNVPATYTYDEYKKGYLDQASGGAVLQLRPNDQVWVQMPSDQANGLYSTEYIHSSFSGFLLCPT

SEQ ID NO: 1081 - protein, 427 aa, Homo sapiens
MLGTLTPLSSLLLLLLVLVLGCGPRASSGGGAGGAAGYAPVKYIQPMQKGPVGPPFREGKGQYLEMPLPLLPMDLKGEPGPPGKPGPRGPPGPPGFPGKPGMGKPGLHGQPGPAGPPGFSRMGKAGPPGLPGKVGPPGQPGLRGEPGIRGDQGLRGPPGPPGLPGPSGITIPGKPGAQGVPGPPGFQGEPGPQGEPGPPGDRGLKGDNGVGQPGLPGAPGQGGAPGPPGLPGPAGLGKPGLDGLPGAPGDKGESGPPGAFDETGIAGLHLPNGGVEGAVLGKGGKPQFGLGELSAHATPAFTAVLTSPFPASGMPVKFDRTLYNGHSGYNPATGIFTCPVGGVYYFAYHVHVKGTNVWVALYKNNVPATYTYDEYKKGYLDQASGGAVLQLRPNDQVWVQMPSDQANGLYSTEYIHSSFSGFLLCPT

SEQ ID NO: 1082 - protein, 703 aa, Homo sapiens; identical to SEQ ID NO: 1080

SEQ ID NO: 1083 - protein, 638 aa, Homo sapiens
MPLPLLPMDLKGEPGPPGKPGPRGPPGPPGFPGKPGMGKPGLHGQPGPAGPPGFSRMGKAGPPGLPGKVGPPGQPGLRGEPGIRGDQGLRGPPGPPGLPGPSGITIPGKPGAQGVPGPPGFQGEPGPQGEPGPPGDRGLKGDNGVGQPGLPGAPGQGGAPGPPGLPGPAGLGKPGLDGLPGAPGDKGESGPPGVPGPRGEPGAVGPKGPPGVDGVGVPGAAGLPGPQGPSGAKGEPGTRGPPGLIGPTGYGMPGLPGPKGDRGPAGVPGLLGDRGEPGEDGEPGEQGPQGLGGPPGLPGSAGLPGRRGPPGPKGEAGPGGPPGVPGIRGDQGPSGLAGKPGVPGERGLPGAHGPPGPTGPKGEPGFTGRPGGPGVAGALGQKGDLGLPGQPGLRGPSGIPGLQGPAGPIGPQGLPGLKGEPGLPGPPGEGRAGEPGTAGPTGPPGVPGSPGITGPPGPPGPPGPPGAPGAFDETGIAGLHLPNGGVEGAVLGKGGKPQFGLGELSAHATPAFTAVLTSPFPASGMPVKFDRTLYNGHSGYNPATGIFTCPVGGVYYFAYHVHVKGTNVWVALYKNNVPATYTYDEYKKGYLDQASGGAVLQLRPNDQVWVQMPSDQANGLYSTEYIHSSFSGFLLCPT

SEQ ID NO: 1084 - protein, 680 aa, Homo sapiens
MLPQIPFLLLVSLNLVHGVFYAERYQMPTGIKGPLPNTKTQFFIPYTIKSKGIAVRGEQGTPGPPGPAGPRGHPGPSGPPGKPGYGSPGLQGEPGLPGPPGPSAVGKPGVPGLPGKPGERGPYGPKGDVGPAGLPGPRGPPGPPGIPGPAGISVPGKPGQQGPTGAPGPRGFPGEKGAPGVPGMNGQKGEMGYGAPGRPGERGLPGPQGPTGPSGPPGVGKRGENGVPGQPGIKGDRGFPGEMGPIGPPGPQGPPGERGPEGIGKPGAAGAPGQPGIPGTKGLPGAPGIAGPPGPPGFGKPGLPGLKGERGPAGLPGGPGAKGEQGPAGLPGKPGLTGPPGNMGPQGPKGIPGSHGLPGPKGETGPAGPAGYPGAKGERGSPGSDGKPGYPGKPGLDGPKGNPGLPGPKGDPGVGGPPGLPGPVGPAGAKGMPGHNGEAGPRGAPGIPGTRGPIGPPGIPGFPGSKGDPGSPGPPGPAGIATKGLNGPTGPPGPPGPRGHSGEPGLPGPPGPPGPPGQAVMPEGFIKAGQRPSLSGTPLVSANQGVTGMPVSAFTVILSKAYPAIGTPIPFDKILYNRQQHYDPRTGIFTCQIPGIYYFSYHVHVKGTHVWVGLYKNGTPVMYTYDEYTKGYLDQASGSAIIDLTENDQVWLQLPNAESNGLYSSEYVHSSFSGFLVAPM

SEQ ID NO: 1085 - protein, 680 aa, Homo sapiens; identical to SEQ ID NO: 1084

SEQ ID NO: 1086 - protein, 51 aa, Homo sapiens
MLPQIPFLLLVSLNLVHGVFYAERYQMPTGIKGPLPNTKTQFFIPYTIKSK

SEQ ID NO: 1087 - protein, 216 aa, Homo sapiens
MLPQIPFLLLVSLNLVHGVFYAERYQMPTGIKGPLPNTKTQFFIPYTIKSKGIAVRGEQGTPGPPGPAGPRGHPGPSGPPGKPGYGSPGLQGEPGLPGPPGPSAVGKPGVPGLPGKPGERGPYGPKGDVGPAGLPGPRGPPGPPGIPGPAGISVPGKPGQQGPTGAPGPRGFPGEKGAPGVPGMNGQKGEMGYGAPGRPGERGLPGPQGPTGPSGP

SEQ ID NO: 1088 - protein, 1736 aa, Homo sapiens
MERCSRCHRLLLLLPLVLGLSAAPGWAGAPPVDVLRALRFPSLPDGVRRAKGICPADVAYRVARPAQLSAPTRQLFPGGFPKDFSLLTVVRTRPGLQAPLLTLYSAQGVRQLGLELGRPVRFLYEDQTGRPQPPSQPVFRGLSLADGKWHRVAVAVKGQSVTLIVDCKKRVTRPLPRSARPVLDTHGVIIFGARILDEEVFEGDVQELAIVPGVQAAYESCEQKELECEGGQRERPQNQQPHRAQRSPQQQPSRLHRPQNQEPQSQPTESLYYDYEPPYYDVMTTGTTPDYQDPTPGEEEEILESSLLPPLEEEQTDLQVPPTADRFQAEEYGEGGTDPPEGPYDYTYGYGDDYREETELGPALSAETAHSGAAAHGPRGLKGEKGEPAVLEPGMLVEGPPGPEGPAGLIGPPGIQGNPGPVGDPGERGPPGRAGLPGSDGAPGPPGTSLMLPFRFGSGGGDKGPVVAAQEAQAQAILQQARLALRGPPGPMGYTGRPGPLGQPGSPGLKGESGDLGPQGPRGPQGLTGPPGKAGRRGRAGADGARGMPGDPGVKGDRGFDGLPGLPGEKGHRGDTGAQGLPGPPGEDGERGDDGEIGPRGLPGESGPRGLLGPKGPPGIPGPPGVRGMDGPQGPKGSLGPQGEPGPPGQQGTPGTQGLPGPQGAIGPHGEKGPQGKPGLPGMPGSDGPPGHPGKEGPPGTKGNQGPSGPQGPLGYPGPRGVKGVDGIRGLKGHKGEKGEDGFPGFKGDIGVKGDRGEVGVPGSRGEDGPEGPKGRTGPTGDPGPPGLMGEKGKLGVPGLPGYPGRQGPKGSLGFPGFPGASGEKGARGLSGKSGPRGERGPTGPRGQRGPRGATGKSGAKGTSGGDGPHGPPGERGLPGPQGPNGFPGPKGPPGPPGKDGLPGHPGQRGEVGFQGKTGPPGPPGVVGPQGAAGETGPMGERGHPGPPGPPGEQGLPGTAGKEGTKGDPGPPGAPGKDGPAGLRGFPGERGLPGTAGGPGLKGNEGPSGPPGPAGSPGERGAAGSGGPIGPPGRPGPQGPPGAAGEKGVPGEKGPIGPTGRDGVQGPVGLPGPAGPPGVAGEDGDKGEVGDPGQKGTKGNKGEHGPPGPPGPIGPVGQPGAAGADGEPGARGPQGHFGAKGDEGTRGFNGPPGPIGLQGLPGPSGEKGETGDVGPMGPPGPPGPRGPAGPNGADGPQGPPGGVGNLGPPGEKGEPGESGSPGIQGEPGVKGPRGERGEKGESGQPGEPGPPGPKGPTGDDGPKGNPGPVGFPGDPGPPGEGGPRGQDGAKGDRGEDGEPGQPGSPGPTGENGPPGPLGKRGPAGSPGSEGRQGGKGAKGDPGAIGAPGKTGPVGPAGPAGKPGPDGLRGLPGSVGQQGRPGATGQAGPPGPVGPPGLPGLRGDAGAKGEKGHPGLIGLIGPPGEQGEKGDRGLPGPQGSPGQKGEMGIPGASGPIGPGGPPGLPGPAGPKGAKGATGPGGPKGEKGVQGPPGHPGPPGEVIQPLPIQMPKKTRRSVDGSRLMQEDEAIPTGGAPGSPGGLEEIFGSLDSLREEIEQMRRPTGTQDSPARTCQDLKLCHPELPDGEYWVDPNQGCARDAFRVFCNFTAGGETCVTPRDDVTQFSYVDSEGSPVGVVQLTFLRLLSVSAHQDVSYPCSGAARDGPLRLRGANEDELSPETSPYVKEFRDGCQTQQGRTVLEVRTPVLEQLPVLDASFSDLGAPPRRGGVLLGPVCFMG

SEQ ID NO: 1089 - protein, 1715 aa, Homo sapiens
MERCSRCHRLLLLLPLVLGLSAAPGWAGAPPVDVLRALRFPSLPDGVRRAKGICPADVAYRVARPAQLSAPTRQLFPGGFPKDFSLLTVVRTRPGLQAPLLTLYSAQGVRQLGLELGRPVRFLYEDQTGRPQPPSQPVFRGLSLADGKWHRVAVAVKGQSVTLIVDCKKRVTRPLPRSARPVLDTHGVIIFGARILDEEVFEGDVQELAIVPGVQAAYESCEQKELECEGGQRERPQNQQPHRAQRSPQQQPSRLHRPQNQEPQSQPTESLYYDYEPPYYDVMTTGTTPDYQEQTDLQVPPTADRFQAEEYGEGGTDPPEGPYDYTYGYGDDYREETELGPALSAETAHSGAAAHGPRGLKGEKGEPAVLEPGMLVEGPPGPEGPAGLIGPPGIQGNPGPVGDPGERGPPGRAGLPGSDGAPGPPGTSLMLPFRFGSGGGDKGPVVAAQEAQAQAILQQARLALRGPPGPMGYTGRPGPLGQPGSPGLKGESGDLGPQGPRGPQGLTGPPGKAGRRGRAGADGARGMPGDPGVKGDRGFDGLPGLPGEKGHRGDTGAQGLPGPPGEDGERGDDGEIGPRGLPGESGPRGLLGPKGPPGIPGPPGVRGMDGPQGPKGSLGPQGEPGPPGQQGTPGTQGLPGPQGAIGPHGEKGPQGKPGLPGMPGSDGPPGHPGKEGPPGTKGNQGPSGPQGPLGYPGPRGVKGVDGIRGLKGHKGEKGEDGFPGFKGDIGVKGDRGEVGVPGSRGEDGPEGPKGRTGPTGDPGPPGLMGEKGKLGVPGLPGYPGRQGPKGSLGFPGFPGASGEKGARGLSGKSGPRGERGPTGPRGQRGPRGATGKSGAKGTSGGDGPHGPPGERGLPGPQGPNGFPGPKGPPGPPGKDGLPGHPGQRGEVGFQGKTGPPGPPGVVGPQGAAGETGPMGERGHPGPPGPPGEQGLPGTAGKEGTKGDPGPPGAPGKDGPAGLRGFPGERGLPGTAGGPGLKGNEGPSGPPGPAGSPGERGAAGSGGPIGPPGRPGPQGPPGAAGEKGVPGEKGPIGPTGRDGVQGPVGLPGPAGPPGVAGEDGDKGEVGDPGQKGTKGNKGEHGPPGPPGPIGPVGQPGAAGADGEPGARGPQGHFGAKGDEGTRGFNGPPGPIGLQGLPGPSGEKGETGDVGPMGPPGPPGPRGPAGPNGADGPQGPPGGVGNLGPPGEKGEPGESGSPGIQGEPGVKGPRGERGEKGESGQPGEPGPPGPKGPTGDDGPKGNPGPVGFPGDPGPPGEGGPRGQDGAKGDRGEDGEPGQPGSPGPTGENGPPGPLGKRGPAGSPGSEGRQGGKGAKGDPGAIGAPGKTGPVGPAGPAGKPGPDGLRGLPGSVGQQGRPGATGQAGPPGPVGPPGLPGLRGDAGAKGEKGHPGLIGLIGPPGEQGEKGDRGLPGPQGSPGQKGEMGIPGASGPIGPGGPPGLPGPAGPKGAKGATGPGGPKGEKGVQGPPGHPGPPGEVIQPLPIQMPKKTRRSVDGSRLMQEDEAIPTGGAPGSPGGLEEIFGSLDSLREEIEQMRRPTGTQDSPARTCQDLKLCHPELPDGEYWVDPNQGCARDAFRVFCNFTAGGETCVTPRDDVTQFSYVDSEGSPVGVVQLTFLRLLSVSAHQDVSYPCSGAARDGPLRLRGANEDELSPETSPYVKEFRDGCQTQQGRTVLEVRTPVLEQLPVLDASFSDLGAPPRRGGVLLGPVCFMG

SEQ ID NO: 1090 - protein, 1629 aa, Homo sapiens
MERCSRCHRLLLLLPLVLGLSAAPGWAGAPPVDVLRALRFPSLPDGVRRAKGICPADVAYRVARPAQLSAPTRQLFPGGFPKDFSLLTVVRTRPGLQAPLLTLYSAQGVRQLGLELGRPVRFLYEDQTGRPQPPSQPVFRGLSLADGKWHRVAVAVKGQSVTLIVDCKKRVTRPLPRSARPVLDTHGVIIFGARILDEEVFEGDVQELAIVPGVQAAYESCEQKELECEGGQRERPQNQQPHRAQRSPQQQPSRLHRPQNQEPQSQAAHGPRGLKGEKGEPAVLEPGMLVEGPPGPEGPAGLIGPPGIQGNPGPVGDPGERGPPGRAGLPGSDGAPGPPGTSLMLPFRFGSGGGDKGPVVAAQEAQAQAILQQARLALRGPPGPMGYTGRPGPLGQPGSPGLKGESGDLGPQGPRGPQGLTGPPGKAGRRGRAGADGARGMPGDPGVKGDRGFDGLPGLPGEKGHRGDTGAQGLPGPPGEDGERGDDGEIGPRGLPGESGPRGLLGPKGPPGIPGPPGVRGMDGPQGPKGSLGPQGEPGPPGQQGTPGTQGLPGPQGAIGPHGEKGPQGKPGLPGMPGSDGPPGHPGKEGPPGTKGNQGPSGPQGPLGYPGPRGVKGVDGIRGLKGHKGEKGEDGFPGFKGDIGVKGDRGEVGVPGSRGEDGPEGPKGRTGPTGDPGPPGLMGEKGKLGVPGLPGYPGRQGPKGSLGFPGFPGASGEKGARGLSGKSGPRGERGPTGPRGQRGPRGATGKSGAKGTSGGDGPHGPPGERGLPGPQGPNGFPGPKGPPGPPGKDGLPGHPGQRGEVGFQGKTGPPGPPGVVGPQGAAGETGPMGERGHPGPPGPPGEQGLPGTAGKEGTKGDPGPPGAPGKDGPAGLRGFPGERGLPGTAGGPGLKGNEGPSGPPGPAGSPGERGAAGSGGPIGPPGRPGPQGPPGAAGEKGVPGEKGPIGPTGRDGVQGPVGLPGPAGPPGVAGEDGDKGEVGDPGQKGTKGNKGEHGPPGPPGPIGPVGQPGAAGADGEPGARGPQGHFGAKGDEGTRGFNGPPGPIGLQGLPGPSGEKGETGDVGPMGPPGPPGPRGPAGPNGADGPQGPPGGVGNLGPPGEKGEPGESGSPGIQGEPGVKGPRGERGEKGESGQPGEPGPPGPKGPTGDDGPKGNPGPVGFPGDPGPPGEGGPRGQDGAKGDRGEDGEPGQPGSPGPTGENGPPGPLGKRGPAGSPGSEGRQGGKGAKGDPGAIGAPGKTGPVGPAGPAGKPGPDGLRGLPGSVGQQGRPGATGQAGPPGPVGPPGLPGLRGDAGAKGEKGHPGLIGLIGPPGEQGEKGDRGLPGPQGSPGQKGEMGIPGASGPIGPGGPPGLPGPAGPKGAKGATGPGGPKGEKGVQGPPGHPGPPGEVIQPLPIQMPKKTRRSVDGSRLMQEDEAIPTGGAPGSPGGLEEIFGSLDSLREEIEQMRRPTGTQDSPARTCQDLKLCHPELPDGEYWVDPNQGCARDAFRVFCNFTAGGETCVTPRDDVTQFSYVDSEGSPVGVVQLTFLRLLSVSAHQDVSYPCSGAARDGPLRLRGANEDELSPETSPYVKEFRDGCQTQQGRTVLEVRTPVLEQLPVLDASFSDLGAPPRRGGVLLGPVCFMG

SEQ ID NO: 1091 - protein, 1650 aa, Homo sapiens
MERCSRCHRLLLLLPLVLGLSAAPGWAGAPPVDVLRALRFPSLPDGVRRAKGICPADVAYRVARPAQLSAPTRQLFPGGFPKDFSLLTVVRTRPGLQAPLLTLYSAQGVRQLGLELGRPVRFLYEDQTGRPQPPSQPVFRGLSLADGKWHRVAVAVKGQSVTLIVDCKKRVTRPLPRSARPVLDTHGVIIFGARILDEEVFEGDVQELAIVPGVQAAYESCEQKELECEGGQRERPQNQQPHRAQRSPQQQPSRLHRPQNQEPQSQDPTPGEEEEILESSLLPPLEEAAHGPRGLKGEKGEPAVLEPGMLVEGPPGPEGPAGLIGPPGIQGNPGPVGDPGERGPPGRAGLPGSDGAPGPPGTSLMLPFRFGSGGGDKGPVVAAQEAQAQAILQQARLALRGPPGPMGYTGRPGPLGQPGSPGLKGESGDLGPQGPRGPQGLTGPPGKAGRRGRAGADGARGMPGDPGVKGDRGFDGLPGLPGEKGHRGDTGAQGLPGPPGEDGERGDDGEIGPRGLPGESGPRGLLGPKGPPGIPGPPGVRGMDGPQGPKGSLGPQGEPGPPGQQGTPGTQGLPGPQGAIGPHGEKGPQGKPGLPGMPGSDGPPGHPGKEGPPGTKGNQGPSGPQGPLGYPGPRGVKGVDGIRGLKGHKGEKGEDGFPGFKGDIGVKGDRGEVGVPGSRGEDGPEGPKGRTGPTGDPGPPGLMGEKGKLGVPGLPGYPGRQGPKGSLGFPGFPGASGEKGARGLSGKSGPRGERGPTGPRGQRGPRGATGKSGAKGTSGGDGPHGPPGERGLPGPQGPNGFPGPKGPPGPPGKDGLPGHPGQRGEVGFQGKTGPPGPPGVVGPQGAAGETGPMGERGHPGPPGPPGEQGLPGTAGKEGTKGDPGPPGAPGKDGPAGLRGFPGERGLPGTAGGPGLKGNEGPSGPPGPAGSPGERGAAGSGGPIGPPGRPGPQGPPGAAGEKGVPGEKGPIGPTGRDGVQGPVGLPGPAGPPGVAGEDGDKGEVGDPGQKGTKGNKGEHGPPGPPGPIGPVGQPGAAGADGEPGARGPQGHFGAKGDEGTRGFNGPPGPIGLQGLPGPSGEKGETGDVGPMGPPGPPGPRGPAGPNGADGPQGPPGGVGNLGPPGEKGEPGESGSPGIQGEPGVKGPRGERGEKGESGQPGEPGPPGPKGPTGDDGPKGNPGPVGFPGDPGPPGEGGPRGQDGAKGDRGEDGEPGQPGSPGPTGENGPPGPLGKRGPAGSPGSEGRQGGKGAKGDPGAIGAPGKTGPVGPAGPAGKPGPDGLRGLPGSVGQQGRPGATGQAGPPGPVGPPGLPGLRGDAGAKGEKGHPGLIGLIGPPGEQGEKGDRGLPGPQGSPGQKGEMGIPGASGPIGPGGPPGLPGPAGPKGAKGATGPGGPKGEKGVQGPPGHPGPPGEVIQPLPIQMPKKTRRSVDGSRLMQEDEAIPTGGAPGSPGGLEEIFGSLDSLREEIEQMRRPTGTQDSPARTCQDLKLCHPELPDGEYWVDPNQGCARDAFRVFCNFTAGGETCVTPRDDVTQFSYVDSEGSPVGVVQLTFLRLLSVSAHQDVSYPCSGAARDGPLRLRGANEDELSPETSPYVKEFRDGCQTQQGRTVLEVRTPVLEQLPVLDASFSDLGAPPRRGGVLLGPVCFMG

SEQ ID NO: 1092 - protein, 1655 aa, Homo sapiens
MERCSRCHRLLLLLPLVLGLSAAPGWAGAPPVDVLRALRFPSLPDGVRRAKGICPADVAYRVARPAQLSAPTRQLFPGGFPKDFSLLTVVRTRPGLQAPLLTLYSAQGVRQLGLELGRPVRFLYEDQTGRPQPPSQPVFRGLSLADGKWHRVAVAVKGQSVTLIVDCKKRVTRPLPRSARPVLDTHGVIIFGARILDEEVFEGDVQELAIVPGVQAAYESCEQKELECEGGQRERPQNQQPHRAQRSPQQQPSRLHRPQNQEPQSQPTESLYYDYEPPYYDVMTTGTTPDYQAAHGPRGLKGEKGEPAVLEPGMLVEGPPGPEGPAGLIGPPGIQGNPGPVGDPGERGPPGRAGLPGSDGAPGPPGTSLMLPFRFGSGGGDKGPVVAAQEAQAQAILQQARLALRGPPGPMGYTGRPGPLGQPGSPGLKGESGDLGPQGPRGPQGLTGPPGKAGRRGRAGADGARGMPGDPGVKGDRGFDGLPGLPGEKGHRGDTGAQGLPGPPGEDGERGDDGEIGPRGLPGESGPRGLLGPKGPPGIPGPPGVRGMDGPQGPKGSLGPQGEPGPPGQQGTPGTQGLPGPQGAIGPHGEKGPQGKPGLPGMPGSDGPPGHPGKEGPPGTKGNQGPSGPQGPLGYPGPRGVKGVDGIRGLKGHKGEKGEDGFPGFKGDIGVKGDRGEVGVPGSRGEDGPEGPKGRTGPTGDPGPPGLMGEKGKLGVPGLPGYPGRQGPKGSLGFPGFPGASGEKGARGLSGKSGPRGERGPTGPRGQRGPRGATGKSGAKGTSGGDGPHGPPGERGLPGPQGPNGFPGPKGPPGPPGKDGLPGHPGQRGEVGFQGKTGPPGPPGVVGPQGAAGETGPMGERGHPGPPGPPGEQGLPGTAGKEGTKGDPGPPGAPGKDGPAGLRGFPGERGLPGTAGGPGLKGNEGPSGPPGPAGSPGERGAAGSGGPIGPPGRPGPQGPPGAAGEKGVPGEKGPIGPTGRDGVQGPVGLPGPAGPPGVAGEDGDKGEVGDPGQKGTKGNKGEHGPPGPPGPIGPVGQPGAAGADGEPGARGPQGHFGAKGDEGTRGFNGPPGPIGLQGLPGPSGEKGETGDVGPMGPPGPPGPRGPAGPNGADGPQGPPGGVGNLGPPGEKGEPGESGSPGIQGEPGVKGPRGERGEKGESGQPGEPGPPGPKGPTGDDGPKGNPGPVGFPGDPGPPGEGGPRGQDGAKGDRGEDGEPGQPGSPGPTGENGPPGPLGKRGPAGSPGSEGRQGGKGAKGDPGAIGAPGKTGPVGPAGPAGKPGPDGLRGLPGSVGQQGRPGATGQAGPPGPVGPPGLPGLRGDAGAKGEKGHPGLIGLIGPPGEQGEKGDRGLPGPQGSPGQKGEMGIPGASGPIGPGGPPGLPGPAGPKGAKGATGPGGPKGEKGVQGPPGHPGPPGEVIQPLPIQMPKKTRRSVDGSRLMQEDEAIPTGGAPGSPGGLEEIFGSLDSLREEIEQMRRPTGTQDSPARTCQDLKLCHPELPDGEYWVDPNQGCARDAFRVFCNFTAGGETCVTPRDDVTQFSYVDSEGSPVGVVQLTFLRLLSVSAHQDVSYPCSGAARDGPLRLRGANEDELSPETSPYVKEFRDGCQTQQGRTVLEVRTPVLEQLPVLDASFSDLGAPPRRGGVLLGPVCFMG

SEQ ID NO: 1093 - protein, 1689 aa, Homo sapiens
MERCSRCHRLLLLLPLVLGLSAAPGWAGAPPVDVLRALRFPSLPDGVRRAKGICPADVAYRVARPAQLSAPTRQLFPGGFPKDFSLLTVVRTRPGLQAPLLTLYSAQGVRQLGLELGRPVRFLYEDQTGRPQPPSQPVFRGLSLADGKWHRVAVAVKGQSVTLIVDCKKRVTRPLPRSARPVLDTHGVIIFGARILDEEVFEGDVQELAIVPGVQAAYESCEQKELECEGGQRERPQNQQPHRAQRSPQQQPSRLHRPQNQEPQSQEQTDLQVPPTADRFQAEEYGEGGTDPPEGPYDYTYGYGDDYREETELGPALSAETAHSGAAAHGPRGLKGEKGEPAVLEPGMLVEGPPGPEGPAGLIGPPGIQGNPGPVGDPGERGPPGRAGLPGSDGAPGPPGTSLMLPFRFGSGGGDKGPVVAAQEAQAQAILQQARLALRGPPGPMGYTGRPGPLGQPGSPGLKGESGDLGPQGPRGPQGLTGPPGKAGRRGRAGADGARGMPGDPGVKGDRGFDGLPGLPGEKGHRGDTGAQGLPGPPGEDGERGDDGEIGPRGLPGESGPRGLLGPKGPPGIPGPPGVRGMDGPQGPKGSLGPQGEPGPPGQQGTPGTQGLPGPQGAIGPHGEKGPQGKPGLPGMPGSDGPPGHPGKEGPPGTKGNQGPSGPQGPLGYPGPRGVKGVDGIRGLKGHKGEKGEDGFPGFKGDIGVKGDRGEVGVPGSRGEDGPEGPKGRTGPTGDPGPPGLMGEKGKLGVPGLPGYPGRQGPKGSLGFPGFPGASGEKGARGLSGKSGPRGERGPTGPRGQRGPRGATGKSGAKGTSGGDGPHGPPGERGLPGPQGPNGFPGPKGPPGPPGKDGLPGHPGQRGEVGFQGKTGPPGPPGVVGPQGAAGETGPMGERGHPGPPGPPGEQGLPGTAGKEGTKGDPGPPGAPGKDGPAGLRGFPGERGLPGTAGGPGLKGNEGPSGPPGPAGSPGERGAAGSGGPIGPPGRPGPQGPPGAAGEKGVPGEKGPIGPTGRDGVQGPVGLPGPAGPPGVAGEDGDKGEVGDPGQKGTKGNKGEHGPPGPPGPIGPVGQPGAAGADGEPGARGPQGHFGAKGDEGTRGFNGPPGPIGLQGLPGPSGEKGETGDVGPMGPPGPPGPRGPAGPNGADGPQGPPGGVGNLGPPGEKGEPGESGSPGIQGEPGVKGPRGERGEKGESGQPGEPGPPGPKGPTGDDGPKGNPGPVGFPGDPGPPGEGGPRGQDGAKGDRGEDGEPGQPGSPGPTGENGPPGPLGKRGPAGSPGSEGRQGGKGAKGDPGAIGAPGKTGPVGPAGPAGKPGPDGLRGLPGSVGQQGRPGATGQAGPPGPVGPPGLPGLRGDAGAKGEKGHPGLIGLIGPPGEQGEKGDRGLPGPQGSPGQKGEMGIPGASGPIGPGGPPGLPGPAGPKGAKGATGPGGPKGEKGVQGPPGHPGPPGEVIQPLPIQMPKKTRRSVDGSRLMQEDEAIPTGGAPGSPGGLEEIFGSLDSLREEIEQMRRPTGTQDSPARTCQDLKLCHPELPDGEYWVDPNQGCARDAFRVFCNFTAGGETCVTPRDDVTQFSYVDSEGSPVGVVQLTFLRLLSVSAHQDVSYPCSGAARDGPLRLRGANEDELSPETSPYVKEFRDGCQTQQGRTVLEVRTPVLEQLPVLDASFSDLGAPPRRGGVLLGPVCFMG

SEQ ID NO: 1094 - protein, 1710 aa, Homo sapiens
MERCSRCHRLLLLLPLVLGLSAAPGWAGAPPVDVLRALRFPSLPDGVRRAKGICPADVAYRVARPAQLSAPTRQLFPGGFPKDFSLLTVVRTRPGLQAPLLTLYSAQGVRQLGLELGRPVRFLYEDQTGRPQPPSQPVFRGLSLADGKWHRVAVAVKGQSVTLIVDCKKRVTRPLPRSARPVLDTHGVIIFGARILDEEVFEGDVQELAIVPGVQAAYESCEQKELECEGGQRERPQNQQPHRAQRSPQQQPSRLHRPQNQEPQSQDPTPGEEEEILESSLLPPLEEEQTDLQVPPTADRFQAEEYGEGGTDPPEGPYDYTYGYGDDYREETELGPALSAETAHSGAAAHGPRGLKGEKGEPAVLEPGMLVEGPPGPEGPAGLIGPPGIQGNPGPVGDPGERGPPGRAGLPGSDGAPGPPGTSLMLPFRFGSGGGDKGPVVAAQEAQAQAILQQARLALRGPPGPMGYTGRPGPLGQPGSPGLKGESGDLGPQGPRGPQGLTGPPGKAGRRGRAGADGARGMPGDPGVKGDRGFDGLPGLPGEKGHRGDTGAQGLPGPPGEDGERGDDGEIGPRGLPGESGPRGLLGPKGPPGIPGPPGVRGMDGPQGPKGSLGPQGEPGPPGQQGTPGTQGLPGPQGAIGPHGEKGPQGKPGLPGMPGSDGPPGHPGKEGPPGTKGNQGPSGPQGPLGYPGPRGVKGVDGIRGLKGHKGEKGEDGFPGFKGDIGVKGDRGEVGVPGSRGEDGPEGPKGRTGPTGDPGPPGLMGEKGKLGVPGLPGYPGRQGPKGSLGFPGFPGASGEKGARGLSGKSGPRGERGPTGPRGQRGPRGATGKSGAKGTSGGDGPHGPPGERGLPGPQGPNGFPGPKGPPGPPGKDGLPGHPGQRGEVGFQGKTGPPGPPGVVGPQGAAGETGPMGERGHPGPPGPPGEQGLPGTAGKEGTKGDPGPPGAPGKDGPAGLRGFPGERGLPGTAGGPGLKGNEGPSGPPGPAGSPGERGAAGSGGPIGPPGRPGPQGPPGAAGEKGVPGEKGPIGPTGRDGVQGPVGLPGPAGPPGVAGEDGDKGEVGDPGQKGTKGNKGEHGPPGPPGPIGPVGQPGAAGADGEPGARGPQGHFGAKGDEGTRGFNGPPGPIGLQGLPGPSGEKGETGDVGPMGPPGPPGPRGPAGPNGADGPQGPPGGVGNLGPPGEKGEPGESGSPGIQGEPGVKGPRGERGEKGESGQPGEPGPPGPKGPTGDDGPKGNPGPVGFPGDPGPPGEGGPRGQDGAKGDRGEDGEPGQPGSPGPTGENGPPGPLGKRGPAGSPGSEGRQGGKGAKGDPGAIGAPGKTGPVGPAGPAGKPGPDGLRGLPGSVGQQGRPGATGQAGPPGPVGPPGLPGLRGDAGAKGEKGHPGLIGLIGPPGEQGEKGDRGLPGPQGSPGQKGEMGIPGASGPIGPGGPPGLPGPAGPKGAKGATGPGGPKGEKGVQGPPGHPGPPGEVIQPLPIQMPKKTRRSVDGSRLMQEDEAIPTGGAPGSPGGLEEIFGSLDSLREEIEQMRRPTGTQDSPARTCQDLKLCHPELPDGEYWVDPNQGCARDAFRVFCNFTAGGETCVTPRDDVTQFSYVDSEGSPVGVVQLTFLRLLSVSAHQDVSYPCSGAARDGPLRLRGANEDELSPETSPYVKEFRDGCQTQQGRTVLEVRTPVLEQLPVLDASFSDLGAPPRRGGVLLGPVCFMG

SEQ ID NO: 1095 - protein, 1650 aa, Homo sapiens
MERCSRCHRLLLLLPLVLGLSAAPGWAGAPPVDVLRALRFPSLPDGVRRAKGICPADVAYRVARPAQLSAPTRQLFPGGFPKDFSLLTVVRTRPGLQAPLLTLYSAQGVRQLGLELGRPVRFLYEDQTGRPQPPSQPVFRGLSLADGKWHRVAVAVKGQSVTLIVDCKKRVTRPLPRSARPVLDTHGVIIFGARILDEEVFEGDVQELAIVPGVQAAYESCEQKELECEGGQRERPQNQQPHRAQRSPQQQPSRLHRPQNQEPQSQDPTPGEEEEILESSLLPPLEEAAHGPRGLKGEKGEPAVLEPGMLVEGPPGPEGPAGLIGPPGIQGNPGPVGDPGERGPPGRAGLPGSDGAPGPPGTSLMLPFRFGSGGGDKGPVVAAQEAQAQAILQQARLALRGPPGPMGYTGRPGPLGQPGSPGLKGESGDLGPQGPRGPQGLTGPPGKAGRRGRAGADGARGMPGDPGVKGDRGFDGLPGLPGEKGHRGDTGAQGLPGPPGEDGERGDDGEIGPRGLPGESGPRGLLGPKGPPGIPGPPGVRGMDGPQGPKGSLGPQGEPGPPGQQGTPGTQGLPGPQGAIGPHGEKGPQGKPGLPGMPGSDGPPGHPGKEGPPGTKGNQGPSGPQGPLGYPGPRGVKGVDGIRGLKGHKGEKGEDGFPGFKGDIGVKGDRGEVGVPGSRGEDGPEGPKGRTGPTGDPGPPGLMGEKGKLGVPGLPGYPGRQGPKGSLGFPGFPGASGEKGARGLSGKSGPRGERGPTGPRGQRGPRGATGKSGAKGTSGGDGPHGPPGERGLPGPQGPNGFPGPKGPLGPPGKDGLPGHPGQRGEVGFQGKTGPPGPPGVVGPQGAAGETGPMGERGHPGPPGPPGEQGLPGTAGKEGTKGDPGPPGAPGKDGPAGLRGFPGERGLPGTAGGPGLKGNEGPSGPPGPAGSPGERGAAGSGGPIGPPGRPGPQGPPGAAGEKGVPGEKGPIGPTGRDGVQGPVGLPGPAGPPGVAGEDGDKGEVGDPGQKGTKGNKGEHGPPGPPGPIGPVGQPGAAGADGEPGARGPQGHFGAKGDEGTRGFNGPPGPIGLQGLPGPSGEKGETGDVGPMGPPGPPGPRGPAGPNGADGPQGPPGGVGNLGPPGEKGEPGESGSPGIQGEPGVKGPRGERGEKGESGQPGEPGPPGPKGPTGDDGPKGNPGPVGFPGDPGPPGEGGPRGQDGAKGDRGEDGEPGQPGSPGPTGENGPPGPLGKRGPAGSPGSEGRQGGKGAKGDPGAIGAPGKTGPVGPAGPAGKPGPDGLRGLPGSVGQQGRPGATGQAGPPGPVGPPGLPGLRGDAGAKGEKGHPGLIGLIGPPGEQGEKGDRGLPGPQGSPGQKGEMGIPGASGPIGPGGPPGLPGPAGPKGAKGATGPGGPKGEKGVQGPPGHPGPPGEVIQPLPIQMPKKTRRSVDGSRLMQEDEAIPTGGAPGSPGGLEEIFGSLDSLREEIEQMRRPTGTQDSPARTCQDLKLCHPELPDGEYWVDPNQGCARDAFRVFCNFTAGGETCVTPRDDVTQFSYVDSEGSPVGVVQLTFLRLLSVSAHQDVSYPCSGAARDGPLRLRGANEDELSPETSPYVKEFRDGCQTQQGRTVLEVRTPVLEQLPVLDASFSDLGAPPRRGGVLLGPVCFMG

SEQ ID NO: 1096 - protein, 290 aa, Homo sapiens
MERCSRCHRLLLLLPLVLGLSAAPGWAGAPPVDVLRALRFPSLPDGVRRAKGICPADVAYRVARPAQLSAPTRQLFPGGFPKDFSLLTVVRTRPGLQAPLLTLYSAQGVRQLGLELGRPVRFLYEDQTGRPQPPSQPVFRGLSLADGKWHRVAVAVKGQSVTLIVDCKKRVTRPLPRSARPVLDTHGVIIFGARILDEEVFEGDVQELAIVPGVQAAYESCEQKELECEGGQRERPQNQQPHRAQRSPQQQPSRLHRPQNQEPQSQVRELGEPPSAAHPREGRHPGISPP

SEQ ID NO: 1097 - protein, 1650 aa, Homo sapiens; identical to SEQ ID NO: 1091

SEQ ID NO: 1098 - protein, 290 aa, Homo sapiens; identical to SEQ ID NO: 1096

SEQ ID NO: 1099 - protein, 306 aa, Homo sapiens [sequence omitted]

SEQ ID NO: 1100 - protein, 1676 aa, Homo sapiens
MERCSRCHRLLLLLPLVLGLSAAPGWAGAPPVDVLRALRFPSLPDGVRRAKGICPADVAYRVARPAQLSAPTRQLFPGGFPKDFSLLTVVRTRPGLQAPLLTLYSAQGVRQLGLELGRPVRFLYEDQTGRPQPPSQPVFRGLSLADGKWHRVAVAVKGQSVTLIVDCKKRVTRPLPRSARPVLDTHGVIIFGARILDEEVFEGDVQELAIVPGVQAAYESCEQKELECEGGQRERPQNQQPHRAQRSPQQQPSRLHRPQNQEPQSQPTESLYYDYEPPYYDVMTTGTTPDYQDPTPGEEEEILESSLLPPLEEAAHGPRGLKGEKGEPAVLEPGMLVEGPPGPEGPAGLIGPPGIQGNPGPVGDPGERGPPGRAGLPGSDGAPGPPGTSLMLPFRFGSGGGDKGPVVAAQEAQAQAILQQARLALRGPPGPMGYTGRPGPLGQPGSPGLKGESGDLGPQGPRGPQGLTGPPGKAGRRGRAGADGARGMPGDPGVKGDRGFDGLPGLPGEKGHRGDTGAQGLPGPPGEDGERGDDGEIGPRGLPGESGPRGLLGPKGPPGIPGPPGVRGMDGPQGPKGSLGPQGEPGPPGQQGTPGTQGLPGPQGAIGPHGEKGPQGKPGLPGMPGSDGPPGHPGKEGPPGTKGNQGPSGPQGPLGYPGPRGVKGVDGIRGLKGHKGEKGEDGFPGFKGDIGVKGDRGEVGVPGSRGEDGPEGPKGRTGPTGDPGPPGLMGEKGKLGVPGLPGYPGRQGPKGSLGFPGFPGASGEKGARGLSGKSGPRGERGPTGPRGQRGPRGATGKSGAKGTSGGDGPHGPPGERGLPGPQGPNGFPGPKGPPGPPGKDGLPGHPGQRGEVGFQGKTGPPGPPGVVGPQGAAGETGPMGERGHPGPPGPPGEQGLPGTAGKEGTKGDPGPPGAPGKDGPAGLRGFPGERGLPGTAGGPGLKGNEGPSGPPGPAGSPGERGAAGSGGPIGPPGRPGPQGPPGAAGEKGVPGEKGPIGPTGRDGVQGPVGLPGPAGPPGVAGEDGDKGEVGDPGQKGTKGNKGEHGPPGPPGPIGPVGQPGAAGADGEPGARGPQGHFGAKGDEGTRGFNGPPGPIGLQGLPGPSGEKGETGDVGPMGPPGPPGPRGPAGPNGADGPQGPPGGVGNLGPPGEKGEPGESGSPGIQGEPGVKGPRGERGEKGESGQPGEPGPPGPKGPTGDDGPKGNPGPVGFPGDPGPPGEGGPRGQDGAKGDRGEDGEPGQPGSPGPTGENGPPGPLGKRGPAGSPGSEGRQGGKGAKGDPGAIGAPGKTGPVGPAGPAGKPGPDGLRGLPGSVGQQGRPGATGQAGPPGPVGPPGLPGLRGDAGAKGEKGHPGLIGLIGPPGEQGEKGDRGLPGPQGSPGQKGEMGIPGASGPIGPGGPPGLPGPAGPKGAKGATGPGGPKGEKGVQGPPGHPGPPGEVIQPLPIQMPKKTRRSVDGSRLMQEDEAIPTGGAPGSPGGLEEIFGSLDSLREEIEQMRRPTGTQDSPARTCQDLKLCHPELPDGEYWVDPNQGCARDAFRVFCNFTAGGETCVTPRDDVTQFSYVDSEGSPVGVVQLTFLRLLSVSAHQDVSYPCSGAARDGPLRLRGANEDELSPETSPYVKEFRDGCQTQQGRTVLEVRTPVLEQLPVLDASFSDLGAPPRRGGVLLGPVCFMG

SEQ ID NO: 1101 - protein, 624 aa, Homo sapiens
MERCSRCHRLLLLLPLVLGLSAAPGWAGAPPVDVLRALRFPSLPDGVRRAKGICPADVAYRVARPAQLSAPTRQLFPGGFPKDFSLLTVVRTRPGLQAPLLTLYSAQGVRQLGLELGRPVRFLYEDQTGRPQPPSQPVFRGLSLADGKWHRVAVAVKGQSVTLIVDCKKRVTRPLPRSARPVLDTHGVIIFGARILDEEVFEGDVQELAIVPGVQAAYESCEQKELECEGGQRERPQNQQPHRAQRSPQQQPSRLHRPQNQEPQSQPTESLYYDYKPPYYDVMTTGTTPDYQDPTPGEEEEILESSLLPPLEEEQTDLQVPPTADRFQAEEYGEGGTDPPEGPYDYTYGYGDDYREETELGPALSAETAHSGAAAHGPRGLKGEKGEPAVLEPGMLVEGPPGPEGPAGLIGPPGIQGNPGPVGDPGERGPPGRAGLPGSDGAPGPPGTSLMLPFRFGSGGGDKGPVVAAQEAQAQAILQQARLALRGPPGPMGYTGRPGPLGQPGSPGLKGESGDLGPQGPRGPQGLTGPPGKAGRRGRAGADGARGMPGDPGVKGDRGFDGLPGLPGEKGHRGDTGAQGLPGPPGEDGERGDDGEIGPRGLPGESGPRGLLGPKGPPGIPGPP

SEQ ID NO: 1102 - protein, 1650 aa, Homo sapiens
MERCSRCHRLLLLLPLVLGLSAAPGWAGAPPVDVLRALRFPSLPDGVRRAKGICPADVAYRVARPAQLSAPTRQLFPGGFPKDFSLLTVVRTRPGLQAPLLTLYSAQGVRQLGLELGPPVRFLYEDQTGRPQPPSQPVFRGLSLADGKWHRVAVAVKGQSVTLIVDCKKRVTRPLPRSARPVLDTHGVIIFGARILDEEVFEGDVQELAIVPGVQAAYESCEQKELECEGGQRERPQNQQPHRAQRSPQQQPSRLHRPQNQEPQSQDPTPGEEEEILESSLLPPLEEAAHGPRGLKGEKGEPAVLEPGMLVEGPPGPEGPAGLIGPPGIQGNPGPVGDPGERGPPGRAGLPGSDGAPGPPGTSLMLPFRFGSGGGDKGPVVAAQEAQAQAILQQARLALRGPPGPMGYTGRPGPLGQPGSPGLKGESGDLGPQGPRGPQGLTGPPGKAGRRGRAGADGARGMPGDPGVKGDRGFDGLPGLPGEKGHRGDTGAQGLPGPPGEDGERGDDGEIGPRGLPGESGPRGLLGPKGPPGIPGPPGVRGMDGPQGPKGSLGPQGEPGPPGQQGTPGTQGLPGPQGAIGPHGEKGPQGKPGLPGMPGSDGPPGHPGKEGPPGTKGNQGPSGPQGPLGYPGPRGVKGVDGIRGLKGHKGEKGEDGFPGFKGDIGVKGDRGEVGVPGSRGEDGPEGPKGRTGPTGDPGPPGLMGEKGKLGVPGLPGYPGRQGPKGSLGFPGFPGASGEKGARGLSGKSGPRGERGPTGPRGQRGPRGATGKSGAKGTSGGDGPHGPPGERGLPGPQGPNGFPGPKGPPGPPGKDGLPGHPGQRGEVGFQGKTGPPGPPGVVGPQGAAGETGPMGERGHPGPPGPPGEQGLPGTAGKEGTKGDPGPPGAPGKDGPAGLRGFPGERGLPGTAGGPGLKGNEGPSGPPGPAGSPGERGAAGSGGPIGPPGRPGPQGPPGAAGEKGVPGEKGPIGPTGRDGVQGPVGLPGPAGPPGVAGEDGDKGEVGDPGQKGTKGNKGEHGPPGPPGPIGPVGQPGAAGADGEPGARGPQGHFGAKGDEGTRGFNGPPGPIGLQGLPGPSGEKGETGDVGPMGPPGPPGPRGPAGPNGADGPQGPPGGVGNLGPPGEKGEPGESGSPGIQGEPGVKGPRGERGEKGESGQPGEPGPPGPKGPTGDDGPKGNPGPVGFPGDPGPPGEGGPRGQDGAKGDRGEDGEPGQPGSPGPTGENGPPGPLGKRGPAGSPGSEGRQGGKGAKGDPGAIGAPGKTGPVGPAGPAGKPGPDGLRGLPGSVGQQGRPGATGQAGPPGPVGPPGLPGLRGDAGAKGEKGHPGLIGLIGPPGEQGEKGDRGLPGPQGSPGQKGEMGIPGASGPIGPGGPPGLPGPAGPKGAKGATGPGGPKGEKGVQGPPGHPGPPGEVIQPLPIQMPKKTRRSVDGSRLMQEDEAIPTGGAPGSPGGLEEIFGSLDSLREEIEQMRRPTGTQDSPARTCQDLKLCHPELPDGEYWVDPNQGCARDAFRVFCNFTAGGETCVTPRDDVTQFSYVDSEGSPVGVVQLTFLRLLSVSAHQDVSYPCSGAARDGPLRLRGANEDELSPETSPYVKEFRDGCQTQQGRTVLEVRTPVLEQLPVLDASFSDLGAPPRRGGVLLGPVCFMG

SEQ ID NO: 1103 - protein, 333 aa, Homo sapiens
  MOD_RES (1)..(1): Any amino acid
XNQSPQAHRSTVPHTAGLGQLCLLGFGMDWRASEAWMVPRAPKGAWDPRESQDLLDNRAPLGPRVFPGPRVPSALMERRVLKGSQGSPACLGPPGEVIQPLPIQMPKKTRRSVDGSRLMQEDEAIPTGGAPGSPGGLEEIFGSLDSLREEIEQMRRPTGTQDSPARTCQDLKLCHPELPDGEYWVDPNQGCARDAFRVFCNFTAGGETCVTPRDDVTQFSYVDSEGSPVGVVQLTFLRLLSVSAHQDVSYPCSGAARDGPLRLRGANEDELSPETSPYVKEFRDGCQTQQGRTVLEVRTPVLEQLPVLDASFSDLGAPPRRGGVLLGPVCFMG

SEQ ID NO: 1104 - protein, 263 aa, Homo sapiens
  MOD_RES (1)..(1): Any amino acid
XAPPVDVLRALRFPSLPDGVRRAKGICPADVAYRVARPAQLSAPTRQLFPGGFPKDFSLLTVVRTRPGLQAPLLTLYSAQGVRQLGLELGRPVRFLYEDQTGRPQPPSQPVFRGLSLADGKWHRVAVAVKGQSVTLIVDCKKRVTRPLPRSARPVLDTHGVIIFGARILDEEVFEGDVQELAIVPGVQAAYESCEQKELECEGGQRERPQNQQPHRAQRSPQQQPSRLHRPQNQEPQSQVRELGEPPSAAHPREGRHPGISPP

SEQ ID NO: 1105 - protein, 290 aa, Homo sapiens
MERCSRCHRLLLLLPLVLGLSAAPGWAGAPPVDVLRALRFPSLPDGVRRAKGICPADVAYRVARPAQLSAPTRQLFPGGFPKDFSLLTVVRTRPGLQAPLLTLYSAQGVRQLGLELGPPVRFLYEDQTGRPQPPSQPVFRGLSLADGKWHRVAVAVKGQSVTLIVDCKKRVTRPLPRSARPVLDTHGVIIFGARILDEEVFEGDVQELAIVPGVQAAYESCEQKELECEGGQRERPQNQQPHRAQRSPQQQPSRLHRPQNQEPQSQVRELGEPPSAAHPREGRHPGISPP

SEQ ID NO: 1106 - protein, 624 aa, Homo sapiens
MERCSRCHRLLLLLPLVLGLSAAPGWAGAPPVDVLRALRFPSLPDGVRRAKGICPADVAYRVARPAQLSAPTRQLFPGGFPKDFSLLTVVRTRPGLQAPLLTLYSAQGVRQLGLELGRPVRFLYEDQTGRPQPPSQPVFRGLSLADGKWHRVAVAVKGQSVTLIVDCKKRVTRPLPRSARPVLDTHGVIIFGARILDEEVFEGDVQELAIVPGVQAAYESCEQKELECEGGQRERPQNQQPHRAQRSPQQQPSRLHRPQNQEPQSQPTESLYYDYEPPYYDVMTTGTTPDYQDPTPGEEEEILESSLLPPLEEEQTDLQVPPTADRFQAEEYGEGGTDPPEGPYDYTYGYGDDYREETELGPALSAETAHSGAAAHGPRGLKGEKGEPAVLEPGMLVEGPPGPEGPAGLIGPPGIQGNPGPVGDPGERGPPGRAGLPGSDGAPGPPGTSLMLPFRFGSGGGDKGPVVAAQEAQAQAILQQARLALRGPPGPMGYTGRPGPLGQPGSPGLKGESGDLGPQGPRGPQGLTGPPGKAGRRGRAGADGARGMPGDPGVKGDRGFDGLPGLPGEKGHRGDTGAQGLPGPPGEDGERGDDGEIGPRGLPGESGPRGLLGPKGPPGIPGPP

SEQ ID NO: 1107 - protein, 290 aa, Homo sapiens; identical to SEQ ID NO: 1096

SEQ ID NO: 1108 - protein, 333 aa, Homo sapiens; identical to SEQ ID NO: 1103
  MOD_RES (1)..(1): Any amino acid

SEQ ID NO: 1109 - protein, 1623 aa, Homo sapiens
  MOD_RES (1)..(1): Any amino acid
XAPPVDVLRALRFPSLPDGVRRAKGICPADVAYRVARPAQLSAPTRQLFPGGFPKDFSLLTVVRTRPGLQAPLLTLYSAQGVRQLGLELGRPVRFLYEDQTGRPQPPSQPVFRGLSLADGKWHRVAVAVKGQSVTLIVDCKKRVTRPLPRSARPVLDTHGVIIFGARILDEEVFEGDVQELAIVPGVQAAYESCEQKELECEGGQRERPQNQQPHRAQRSPQQQPSRLHRPQNQEPQSQDPTPGEEEEILESSLLPPLEEAAHGPRGLKGEKGEPAVLEPGMLVEGPPGPEGPAGLIGPPGIQGNPGPVGDPGERGPPGRAGLPGSDGAPGPPGTSLMLPFRFGSGGGDKGPVVAAQEAQAQAILQQARLALRGPPGPMGYTGRPGPLGQPGSPGLKGESGDLGPQGPRGPQGLTGPPGKAGRRGRAGADGARGMPGDPGVKGDRGFDGLPGLPGEKGHRGDTGAQGLPGPPGEDGERGDDGEIGPRGLPGESGPRGLLGPKGPPGIPGPPGVRGMDGPQGPKGSLGPQGEPGPPGQQGTPGTQGLPGPQGAIGPHGEKGPQGKPGLPGMPGSDGPPGHPGKEGPPGTKGNQGPSGPQGPLGYPGPRGVKGVDGIRGLKGHKGEKGEDGFPGFKGDIGVKGDRGEVGVPGSRGEDGPEGPKGRTGPTGDPGPPGLMGEKGKLGVPGLPGYPGRQGPKGSLGFPGFPGASGEKGARGLSGKSGPRGERGPTGPRGQRGPRGATGKSGAKGTSGGDGPHGPPGERGLPGPQGPNGFPGPKGPPGPPGKDGLPGHPGQRGEVGFQGKTGPPGPPGVVGPQGAAGETGPMGERGHPGPPGPPGEQGLPGTAGKEGTKGDPGPPGAPGKDGPAGLRGFPGERGLPGTAGGPGLKGNEGPSGPPGPAGSPGERGAAGSGGPIGPPGRPGPQGPPGAAGEKGVPGEKGPIGPTGRDGVQGPVGLPGPAGPPGVAGEDGDKGEVGDPGQKGTKGNKGEHGPPGPPGPIGPVGQPGAAGADGEPGARGPQGHFGAKGDEGTRGFNGPPGPIGLQGLPGPSGEKGETGDVGPMGPPGPPGPRGPAGPNGADGPQGPPGGVGNLGPPGEKGEPGESGSPGIQGEPGVKGPRGERGEKGESGQPGEPGPPGPKGPTGDDGPKGNPGPVGFPGDPGPPGEGGPRGQDGAKGDRGEDGEPGQPGSPGPTGENGPPGPLGKRGPAGSPGSEGRQGGKGAKGDPGAIGAPGKTGPVGPAGPAGKPGPDGLRGLPGSVGQQGRPGATGQAGPPGPVGPPGLPGLRGDAGAKGEKGHPGLIGLIGPPGEQGEKGDRGLPGPQGSPGQKGEMGIPGASGPIGPGGPPGLPGPAGPKGAKGATGPGGPKGEKGVQGPPGHPGPPGEVIQPLPIQMPKKTRRSVDGSRLMQEDEAIPTGGAPGSPGGLEEIFGSLDSLREEIEQMRRPTGTQDSPARTCQDLKLCHPELPDGEYWVDPNQGCARDAFRVFCNFTAGGETCVTPRDDVTQFSYVDSEGSPVGVVQLTFLRLLSVSAHQDVSYPCSGAARDGPLRLRGANEDELSPETSPYVKEFRDGCQTQQGRTVLEVRTPVLEQLPVLDASFSDLGAPPRRGGVLLGPVCFMG

SEQ ID NO: 1110 - protein, 1650 aa, Homo sapiens; identical to SEQ ID NO: 1091

SEQ ID NO: 1111 - protein, 290 aa, Homo sapiens; identical to SEQ ID NO: 1096

SEQ ID NO: 1112 - protein, 597 aa, Homo sapiens
  MOD_RES (1)..(1): Any amino acid
XAPPVDVLRALRFPSLPDGVRRAKGICPADVAYRVARPAQLSAPTRQLFPGGFPKDFSLLTVVRTRPGLQAPLLTLYSAQGVRQLGLELGRPVRFLYEDQTGRPQPPSQPVFRGLSLADGKWHRVAVAVKGQSVTLIVDCKKRVTRPLPRSARPVLDTHGVIIFGARILDEEVFEGDVQELAIVPGVQAAYESCEQKELECEGGQRERPQNQQPHRAQRSPQQQPSRLHRPQNQEPQSQPTESLYYDYKPPYYDVMTTGTTPDYQDPTPGEEEEILESSLLPPLEEEQTDLQVPPTADRFQAEEYGEGGTDPPEGPYDYTYGYGDDYREETELGPALSAETAHSGAAAHGPRGLKGEKGEPAVLEPGMLVEGPPGPEGPAGLIGPPGIQGNPGPVGDPGERGPPGRAGLPGSDGAPGPPGTSLMLPFRFGSGGGDKGPVVAAQEAQAQAILQQARLALRGPPGPMGYTGRPGPLGQPGSPGLKGESGDLGPQGPRGPQGLTGPPGKAGRRGRAGADGARGMPGDPGVKGDRGFDGLPGLPGEKGHRGDTGAQGLPGPPGEDGERGDDGEIGPRGLPGESGPRGLLGPKGPPGIPGPP

SEQ ID NO: 1113 - protein, 1650 aa, Homo sapiens; identical to SEQ ID NO: 1091

SEQ ID NO: 1114 - protein, 624 aa, Homo sapiens; identical to SEQ ID NO: 1106

SEQ ID NO: 1115 - protein, 624 aa, Homo sapiens
MERCSRCHRLLLLLPLVLGLSAAPGWAGAPPVDVLRALRFPSLPDGVRRAKGICPADVAYRVARPAQLSAPTRQLFPGGFPKDFSLLTVVRTRPGLQAPLLTLYSAQGVRQLGLELGPPVRFLYEDQTGRPQPPSQPVFRGLSLADGKWHRVAVAVKGQSVTLIVDCKKRVTRPLPRSARPVLDTHGVIIFGARILDEEVFEGDVQELAIVPGVQAAYESCEQKELECEGGQRERPQNQQPHRAQRSPQQQPSRLHRPQNQEPQSQPTESLYYDYKPPYYDVMTTGTTPDYQDPTPGEEEEILESSLLPPLEEEQTDLQVPPTADRFQAEEYGEGGTDPPEGPYDYTYGYGDDYREETELGPALSAETAHSGAAAHGPRGLKGEKGEPAVLEPGMLVEGPPGPEGPAGLIGPPGIQGNPGPVGDPGERGPPGRAGLPGSDGAPGPPGTSLMLPFRFGSGGGDKGPVVAAQEAQAQAILQQARLALRGPPGPMGYTGRPGPLGQPGSPGLKGESGDLGPQGPRGPQGLTGPPGKAGRRGRAGADGARGMPGDPGVKGDRGFDGLPGLPGEKGHRGDTGAQGLPGPPGEDGERGDDGEIGPRGLPGESGPRGLLGPKGPPGIPGPP

SEQ ID NO: 1116 - protein, 624 aa, Homo sapiens; identical to SEQ ID NO: 1101

SEQ ID NO: 1117 - protein, 290 aa, Homo sapiens; identical to SEQ ID NO: 1096

SEQ ID NO: 1118 - protein, 624 aa, Homo sapiens; identical to SEQ ID NO: 1106

SEQ ID NO: 1119 - protein, 1689 aa, Homo sapiens
MERCSRCHRLLLLLPLVLGLSAAPGWAGAPPVDVLRALRFPSLPDGVRRAKGICPADVAYRVARPAQLSAPTRQLFPGGFPKDFSLLTVVRTRPGLQAPLLTLYSAQGVRQLGLELGPPVRFLYEDQTGRPQPPSQPVFRGLSLADGKWHRVAVAVKGQSVTLIVDCKKRVTRPLPRSARPVLDTHGVIIFGARILDEEVFEGDVQELAIVPGVQAAYESCEQKELECEGGQRERPQNQQPHRAQRSPQQQPSRLHRPQNQEPQSQEQTDLQVPPTADRFQAEEYGEGGTDPPEGPYDYTYGYGDDYREETELGPALSAETAHSGAAAHGPRGLKGEKGEPAVLEPGMLVEGPPGPEGPAGLIGPPGIQGNPGPVGDPGERGPPGRAGLPGSDGAPGPPGTSLMLPFRFGSGGGDKGPVVAAQEAQAQAILQQARLALRGPPGPMGYTGRPGPLGQPGSPGLKGESGDLGPQGPRGPQGLTGPPGKAGRRGRAGADGARGMPGDPGVKGDRGFDGLPGLPGEKGHRGDTGAQGLPGPPGEDGERGDDGEIGPRGLPGESGPRGLLGPKGPPGIPGPPGVRGMDGPQGPKGSLGPQGEPGPPGQQGTPGTQGLPGPQGAIGPHGEKGPQGKPGLPGMPGSDGPPGHPGKEGPPGTKGNQGPSGPQGPLGYPGPRGVKGVDGIRGLKGHKGEKGEDGFPGFKGDIGVKGDRGEVGVPGSRGEDGPEGPKGRTGPTGDPGPPGLMGEKGKLGVPGLPGYPGRQGPKGSLGFPGFPGASGEKGARGLSGKSGPRGERGPTGPRGQRGPRGATGKSGAKGTSGGDGPHGPPGERGLPGPQGPNGFPGPKGPPGPPGKDGLPGHPGQRGEVGFQGKTGPPGPPGVVGPQGAAGETGPMGERGHPGPPGPPGEQGLPGTAGKEGTKGDPGPPGAPGKDGPAGLRGFPGERGLPGTAGGPGLKGNEGPSGPPGPAGSPGERGAAGSGGPIGPPGRPGPQGPPGAAGEKGVPGEKGPIGPTGRDGVQGPVGLPGPAGPPGVAGEDGDKGEVGDPGQKGTKGNKGEHGPPGPPGPIGPVGQPGAAGADGEPGARGPQGHFGAKGDEGTRGFNGPPGPIGLQGLPGPSGEKGETGDVGPMGPPGPPGPRGPAGPNGADGPQGPPGGVGNLGPPGEKGEPGESGSPGIQGEPGVKGPRGERGEKGESGQPGEPGPPGPKGPTGDDGPKGNPGPVGFPGDPGPPGEGGPRGQDGAKGDRGEDGEPGQPGSPGPTGENGPPGPLGKRGPAGSPGSEGRQGGKGAKGDPGAIGAPGKTGPVGPAGPAGKPGPDGLRGLPGSVGQQGRPGATGQAGPPGPVGPPGLPGLRGDAGAKGEKGHPGLIGLIGPPGEQGEKGDRGLPGPQGSPGQKGEMGIPGASGPIGPGGPPGLPGPAGPKGAKGATGPGGPKGEKGVQGPPGHPGPPGEVIQPLPIQMPKKTRRSVDGSRLMQEDEAIPTGGAPGSPGGLEEIFGSLDSLREEIEQMRRPTGTQDSPARTCQDLKLCHPELPDGEYWVDPNQGCARDAFRVFCNFTAGGETCVTPRDDVTQFSYVDSEGSPVGVVQLTFLRLLSVSAHQDVSYPCSGAARDGPLRLRGANEDELSPETSPYVKEFRDGCQTQQGRTVLEVRTPVLEQLPVLDASFSDLGAPPRRGGVLLGPVCFMG

SEQ ID NO: 1120 - protein, 1710 aa, Homo sapiens
MERCSRCHRLLLLLPLVLGLSAAPGWAGAPPVDVLRALRFPSLPDGVRRAKGICPADVAYRVARPAQLSAPTRQLFPGGFPKDFSLLTVVRTRPGLQAPLLTLYSAQGVRQLGLELGPPVRFLYEDQTGRPQPPSQPVFRGLSLADGKWHRVAVAVKGQSVTLIVDCKKRVTRPLPRSARPVLDTHGVIIFGARILDEEVFEGDVQELAIVPGVQAAYESCEQKELECEGGQRERPQNQQPHRAQRSPQQQPSRLHRPQNQEPQSQDPTPGEEEEILESSLLPPLEEEQTDLQVPPTADRFQAEEYGEGGTDPPEGPYDYTYGYGDDYREETELGPALSAETAHSGAAAHGPRGLKGEKGEPAVLEPGMLVEGPPGPEGPAGLIGPPGIQGNPGPVGDPGERGPPGRAGLPGSDGAPGPPGTSLMLPFRFGSGGGDKGPVVAAQEAQAQAILQQARLALRGPPGPMGYTGRPGPLGQPGSPGLKGESGDLGPQGPRGPQGLTGPPGKAGRRGRAGADGARGMPGDPGVKGDRGFDGLPGLPGEKGHRGDTGAQGLPGPPGEDGERGDDGEIGPRGLPGESGPRGLLGPKGPPGIPGPPGVRGMDGPQGPKGSLGPQGEPGPPGQQGTPGTQGLPGPQGAIGPHGEKGPQGKPGLPGMPGSDGPPGHPGKEGPPGTKGNQGPSGPQGPLGYPGPRGVKGVDGIRGLKGHKGEKGEDGFPGFKGDIGVKGDRGEVGVPGSRGEDGPEGPKGRTGPTGDPGPPGLMGEKGKLGVPGLPGYPGRQGPKGSLGFPGFPGASGEKGARGLSGKSGPRGERGPTGPRGQRGPRGATGKSGAKGTSGGDGPHGPPGERGLPGPQGPNGFPGPKGPPGPPGKDGLPGHPGQRGEVGFQGKTGPPGPPGVVGPQGAAGETGPMGERGHPGPPGPPGEQGLPGTAGKEGTKGDPGPPGAPGKDGPAGLRGFPGERGLPGTAGGPGLKGNEGPSGPPGPAGSPGERGAAGSGGPIGPPGRPGPQGPPGAAGEKGVPGEKGPIGPTGRDGVQGPVGLPGPAGPPGVAGEDGDKGEVGDPGQKGTKGNKGEHGPPGPPGPIGPVGQPGAAGADGEPGARGPQGHFGAKGDEGTRGFNGPPGPIGLQGLPGPSGEKGETGDVGPMGPPGPPGPRGPAGPNGADGPQGPPGGVGNLGPPGEKGEPGESGSPGIQGEPGVKGPRGERGEKGESGQPGEPGPPGPKGPTGDDGPKGNPGPVGFPGDPGPPGEGGPRGQDGAKGDRGEDGEPGQPGSPGPTGENGPPGPLGKRGPAGSPGSEGRQGGKGAKGDPGAIGAPGKTGPVGPAGPAGKPGPDGLRGLPGSVGQQGRPGATGQAGPPGPVGPPGLPGLRGDAGAKGEKGHPGLIGLIGPPGEQGEKGDRGLPGPQGSPGQKGEMGIPGASGPIGPGGPPGLPGPAGPKGAKGATGPGGPKGEKGVQGPPGHPGPPGEVIQPLPIQMPKKTRRSVDGSRLMQEDEAIPTGGAPGSPGGLEEIFGSLDSLREEIEQMRRPTGTQDSPARTCQDLKLCHPELPDGEYWVDPNQGCARDAFRVFCNFTAGGETCVTPRDDVTQFSYVDSEGSPVGVVQLTFLRLLSVSAHQDVSYPCSGAARDGPLRLRGANEDELSPETSPYVKEFRDGCQTQQGRTVLEVRTPVLEQLPVLDASFSDLGAPPRRGGVLLGPVCFMG

SEQ ID NO: 1121 - protein, 1655 aa, Homo sapiens
MERCSRCHRLLLLLPLVLGLSAAPGWAGAPPVDVLRALRFPSLPDGVRRAKGICPADVAYRVARPAQLSAPTRQLFPGGFPKDFSLLTVVRTRPGLQAPLLTLYSAQGVRQLGLELGRPVRFLYEDQTGRPQPPSQPVFRGLSLADGKWHRVAVAVKGQSVTLIVDCKKRVTRPLPRSARPVLDTHGVIIFGARILDEEVFEGDVQELAIVPGVQAAYESCEQKELECEGGQRERPQNQQPHRAQRSPQQQPSRLHRPQNQEPQSQPTESLYYDYEPPYYDVMTTGTTPDYQAAHGPRGLKGEKGEPAVLEPGMLVEGPPGPEGPAGLIGPPGIQGNPGPVGDPGERGPPGRAGLPGSDGAPGPPGTSLMLPFRFGSGGGDKGPVVAAQEAQAQAILQQARLALRGPPGPMGYTGRPGPLGQPGSPGLKGESGDLGPQGPRGPQGLTGPPGKAGRRGRAGADGARGMPGDPGVKGDRGFDGLPGLPGEKGHRGDTGAQGLPGPPGEDGERGDDGEIGPRGLPGESGPRGLLGPKGPPGIPGPPGVRGMDGPQGPKGSLGPQGEPGPPGQQGTPGTQGLPGPQGAIGPHGEKGPQGKPGLPGMPGSDGPPGHPGKEGPPGTKGNQGPSGPQGPLGYPGPRGVKGVDGIRGLKGHKGEKGEDGFPGFKGDIGVKGDRGEVGVPGSRGEDGPEGPKGRTGPTGDPGPPGLMGEKGKLGVPGLPGYPGRQGPKGSLGFPGFPGASGEKGARGLSGKSGPRGERGPTGPRGQRGPRGATGKSGAKGTSGGDGPHGPPGERGLPGPQGPNGFPGPKGPLGPPGKDGLPGHPGQRGEVGFQGKTGPPGPPGVVGPQGAAGETGPMGERGHPGPPGPPGEQGLPGTAGKEGTKGDPGPPGAPGKDGPAGLRGFPGERGLPGTAGGPGLKGNEGPSGPPGPAGSPGERGAAGSGGPIGPPGRPGPQGPPGAAGEKGVPGEKGPIGPTGRDGVQGPVGLPGPAGPPGVAGEDGDKGEVGDPGQKGTKGNKGEHGPPGPPGPIGPVGQPGAAGADGEPGARGPQGHFGAKGDEGTRGFNGPPGPIGLQGLPGPSGEKGETGDVGPMGPPGPPGPRGPAGPNGADGPQGPPGGVGNLGPPGEKGEPGESGSPGIQGEPGVKGPRGERGEKGESGQPGEPGPPGPKGPTGDDGPKGNPGPVGFPGDPGPPGEGGPRGQDGAKGDRGEDGEPGQPGSPGPTGENGPPGPLGKRGPAGSPGSEGRQGGKGAKGDPGAIGAPGKTGPVGPAGPAGKPGPDGLRGLPGSVGQQGRPGATGQAGPPGPVGPPGLPGLRGDAGAKGEKGHPGLIGLIGPPGEQGEKGDRGLPGPQGSPGQKGEMGIPGASGPIGPGGPPGLPGPAGPKGAKGATGPGGPKGEKGVQGPPGHPGPPGEVIQPLPIQMPKKTRRSVDGSRLMQEDEAIPTGGAPGSPGGLEEIFGSLDSLREEIEQMRRPTGTQDSPARTCQDLKLCHPELPDGEYWVDPNQGCARDAFRVFCNFTAGGETCVTPRDDVTQFSYVDSEGSPVGVVQLTFLRLLSVSAHQDVSYPCSGAARDGPLRLRGANEDELSPETSPYVKEFRDGCQTQQGRTVLEVRTPVLEQLPVLDASFSDLGAPPRRGGVLLGPVCFMG

SEQ ID NO: 1122 - protein, 1655 aa, Homo sapiens
MERCSRCHRLLLLLPLVLGLSAAPGWAGAPPVDVLRALRFPSLPDGVRRAKGICPADVAYRVARPAQLSAPTRQLFPGGFPKDFSLLTVVRTRPGLQAPLLTLYSAQGVRQLGLELGRPVRFLYEDQTGRPQPPSQPVFRGLSLADGKWHRVAVAVKGQSVTLIVDCKKRVTRPLPRSARPVLDTHGVIIFGARILDEEVFEGDVQELAIVPGVQAAYESCEQKELECEGGQRERPQNQQPHRAQRSPQQQPSRLHRPQNQEPQSQPTESLYYDYKPPYYDVMTTGTTPDYQAAHGPRGLKGEKGEPAVLEPGMLVEGPPGPEGPAGLIGPPGIQGNPGPVGDPGERGPPGRAGLPGSDGAPGPPGTSLMLPFRFGSGGGDKGPVVAAQEAQAQAILQQARLALRGPPGPMGYTGRPGPLGQPGSPGLKGESGDLGPQGPRGPQGLTGPPGKAGRRGRAGADGARGMPGDPGVKGDRGFDGLPGLPGEKGHRGDTGAQGLPGPPGEDGERGDDGEIGPRGLPGESGPRGLLGPKGPPGIPGPPGVRGMDGPQGPKGSLGPQGEPGPPGQQGTPGTQGLPGPQGAIGPHGEKGPQGKPGLPGMPGSDGPPGHPGKEGPPGTKGNQGPSGPQGPLGYPGPRGVKGVDGIRGLKGHKGEKGEDGFPGFKGDIGVKGDRGEVGVPGSRGEDGPEGPKGRTGPTGDPGPPGLMGEKGKLGVPGLPGYPGRQGPKGSLGFPGFPGASGEKGARGLSGKSGPRGERGPTGPRGQRGPRGATGKSGAKGTSGGDGPHGPPGERGLPGPQGPNGFPGPKGPPGPPGKDGLPGHPGQRGEVGFQGKTGPPGPPGVVGPQGAAGETGPMGERGHPGPPGPPGEQGLPGTAGKEGTKGDPGPPGAPGKDGPAGLRGFPGERGLPGTAGGPGLKGNEGPSGPPGPAGSPGERGAAGSGGPIGPPGRPGPQGPPGAAGEKGVPGEKGPIGPTGRDGVQGPVGLPGPAGPPGVAGEDGDKGEVGDPGQKGTKGNKGEHGPPGPPGPIGPVGQPGAAGADGEPGARGPQGHFGAKGDEGTRGFNGPPGPIGLQGLPGPSGEKGETGDVGPMGPPGPPGPRGPAGPNGADGPQGPPGGVGNLGPPGEKGEPGESGSPGIQGEPGVKGPRGERGEKGESGQPGEPGPPGPKGPTGDDGPKGNPGPVGFPGDPGPPGEGGPRGQDGAKGDRGEDGEPGQPGSPGPTGENGPPGPLGKRGPAGSPGSEGRQGGKGAKGDPGAIGAPGKTGPVGPAGPAGKPGPDGLRGLPGSVGQQGRPGATGQAGPPGPVGPPGLPGLRGDAGAKGEKGHPGLIGLIGPPGEQGEKGDRGLPGPQGSPGQKGEMGIPGASGPIGPGGPPGLPGPAGPKGAKGATGPGGPKGEKGVQGPPGHPGPPGEVIQPLPIQMPKKTRRSVDGSRLMQEDEAIPTGGAPGSPGGLEEIFGSLDSLREEIEQMRRPTGTQDSPARTCQDLKLCHPELPDGEYWVDPNQGCARDAFRVFCNFTAGGETCVTPRDDVTQFSYVDSEGSPVGVVQLTFLRLLSVSAHQDVSYPCSGAARDGPLRLRGANEDELSPETSPYVKEFRDGCQTQQGRTVLEVRTPVLEQLPVLDASFSDLGAPPRRGGVLLGPVCFMG

SEQ ID NO: 1123 - protein, 1676 aa, Homo sapiens
MERCSRCHRLLLLLPLVLGLSAAPGWAGAPPVDVLRALRFPSLPDGVRRAKGICPADVAYRVARPAQLSAPTRQLFPGGFPKDFSLLTVVRTRPGLQAPLLTLYSAQGVRQLGLELGPPVRFLYEDQTGRPQPPSQPVFRGLSLADGKWHRVAVAVKGQSVTLIVDCKKRVTRPLPRSARPVLDTHGVIIFGARILDEEVFEGDVQELAIVPGVQAAYESCEQKELECEGGQRERPQNQQPHRAQRSPQQQPSRLHRPQNQEPQSQPTESLYYDYKPPYYDVMTTGTTPDYQDPTPGEEEEILESSLLPPLEEAAHGPRGLKGEKGEPAVLEPGMLVEGPPGPEGPAGLIGPPGIQGNPGPVGDPGERGPPGRAGLPGSDGAPGPPGTSLMLPFRFGSGGGDKGPVVAAQEAQAQAILQQARLALRGPPGPMGYTGRPGPLGQPGSPGLKGESGDLGPQGPRGPQGLTGPPGKAGRRGRAGADGARGMPGDPGVKGDRGFDGLPGLPGEKGHRGDTGAQGLPGPPGEDGERGDDGEIGPRGLPGESGPRGLLGPKGPPGIPGPPGVRGMDGPQGPKGSLGPQGEPGPPGQQGTPGTQGLPGPQGAIGPHGEKGPQGKPGLPGMPGSDGPPGHPGKEGPPGTKGNQGPSGPQGPLGYPGPRGVKGVDGIRGLKGHKGEKGEDGFPGFKGDIGVKGDRGEVGVPGSRGEDGPEGPKGRTGPTGDPGPPGLMGEKGKLGVPGLPGYPGRQGPKGSLGFPGFPGASGEKGARGLSGKSGPRGERGPTGPRGQRGPRGATGKSGAKGTSGGDGPHGPPGERGLPGPQGPNGFPGPKGPPGPPGKDGLPGHPGQRGEVGFQGKTGPPGPPGVVGPQGAAGETGPMGERGHPGPPGPPGEQGLPGTAGKEGTKGDPGPPGAPGKDGPAGLRGFPGERGLPGTAGGPGLKGNEGPSGPPGPAGSPGERGAAGSGGPIGPPGRPGPQGPPGAAGEKGVPGEKGPIGPTGRDGVQGPVGLPGPAGPPGVAGEDGDKGEVGDPGQKGTKGNKGEHGPPGPPGPIGPVGQPGAAGADGEPGARGPQGHFGAKGDEGTRGFNGPPGPIGLQGLPGPSGEKGETGDVGPMGPPGPPGPRGPAGPNGADGPQGPPGGVGNLGPPGEKGEPGESGSPGIQGEPGVKGPRGERGEKGESGQPGEPGPPGPKGPTGDDGPKGNPGPVGFPGDPGPPGEGGPRGQDGAKGDRGEDGEPGQPGSPGPTGENGPPGPLGKRGPAGSPGSEGRQGGKGAKGDPGAIGAPGKTGPVGPAGPAGKPGPDGLRGLPGSVGQQGRPGATGQAGPPGPVGPPGLPGLRGDAGAKGEKGHPGLIGLIGPPGEQGEKGDRGLPGPQGSPGQKGEMGIPGASGPIGPGGPPGLPGPAGPKGAKGATGPGGPKGEKGVQGPPGHPGPPGEVIQPLPIQMPKKTRRSVDGSRLMQEDEAIPTGGAPGSPGGLEEIFGSLDSLREEIEQMRRPTGTQDSPARTCQDLKLCHPELPDGEYWVDPNQGCARDAFRVFCNFTAGGETCVTPRDDVTQFSYVDSEGSPVGVVQLTFLRLLSVSAHQDVSYPCSGAARDGPLRLRGANEDELSPETSPYVKEFRDGCQTQQGRTVLEVRTPVLEQLPVLDASFSDLGAPPRRGGVLLGPVCFMG

SEQ ID NO: 1124 - protein, 1676 aa, Homo sapiens
MERCSRCHRLLLLLPLVLGLSAAPGWAGAPPVDVLRALRFPSLPDGVRRAKGICPADVAYRVARPAQLSAPTRQLFPGGFPKDFSLLTVVRTRPGLQAPLLTLYSAQGVRQLGLELGRPVRFLYEDQTGRPQPPSQPVFRGLSLADGKWHRVAVAVKGQSVTLIVDCKKRVTRPLPRSARPVLDTHGVIIFGARILDEEVFEGDVQELAIVPGVQAAYESCEQKELECEGGQRERPQNQQPHRAQRSPQQQPSRLHRPQNQEPQSQPTESLYYDYKPPYYDVMTTGTTPDYQDPTPGEEEEILESSLLPPLEEAAHGPRGLKGEKGEPAVLEPGMLVEGPPGPEGPAGLIGPPGIQGNPGPVGDPGERGPPGRAGLPGSDGAPGPPGTSLMLPFRFGSGGGDKGPVVAAQEAQAQAILQQARLALRGPPGPMGYTGRPGPLGQPGSPGLKGESGDLGPQGPRGPQGLTGPPGKAGRRGRAGADGARGMPGDPGVKGDRGFDGLPGLPGEKGHRGDTGAQGLPGPPGEDGERGDDGEIGPRGLPGESGPRGLLGPKGPPGIPGPPGVRGMDGPQGPKGSLGPQGEPGPPGQQGTPGTQGLPGPQGAIGPHGEKGPQGKPGLPGMPGSDGPPGHPGKEGPPGTKGNQGPSGPQGPLGYPGPRGVKGVDGIRGLKGHKGEKGEDGFPGFKGDIGVKGDRGEVGVPGSRGEDGPEGPKGRTGPTGDPGPPGLMGEKGKLGVPGLPGYPGRQGPKGSLGFPGFPGASGEKGARGLSGKSGPRGERGPTGPRGQRGPRGATGKSGAKGTSGGDGPHGPPGERGLPGPQGPNGFPGPKGPPGPPGKDGLPGHPGQRGEVGFQGKTGPPGPPGVVGPQGAAGETGPMGERGHPGPPGPPGEQGLPGTAGKEGTKGDPGPPGAPGKDGPAGLRGFPGERGLPGTAGGPGLKGNEGPSGPPGPAGSPGERGAAGSGGPIGPPGRPGPQGPPGAAGEKGVPGEKGPIGPTGRDGVQGPVGLPGPAGPPGVAGEDGDKGEVGDPGQKGTKGNKGEHGPPGPPGPIGPVGQPGAAGADGEPGARGPQGHFGAKGDEGTRGFNGPPGPIGLQGLPGPSGEKGETGDVGPMGPPGPPGPRGPAGPNGADGPQGPPGGVGNLGPPGEKGEPGESGSPGIQGEPGVKGPRGERGEKGESGQPGEPGPPGPKGPTGDDGPKGNPGPVGFPGDPGPPGEGGPRGQDGAKGDRGEDGEPGQPGSPGPTGENGPPGPLGKRGPAGSPGSEGRQGGKGAKGDPGAIGAPGKTGPVGPAGPAGKPGPDGLRGLPGSVGQQGRPGATGQAGPPGPVGPPGLPGLRGDAGAKGEKGHPGLIGLIGPPGEQGEKGDRGLPGPQGSPGQKGEMGIPGASGPIGPGGPPGLPGPAGPKGAKGATGPGGPKGEKGVQGPPGHPGPPGEVIQPLPIQMPKKTRRSVDGSRLMQEDEAIPTGGAPGSPGGLEEIFGSLDSLREEIEQMRRPTGTQDSPARTCQDLKLCHPELPDGEYWVDPNQGCARDAFRVFCNFTAGGETCVTPRDDVTQFSYVDSEGSPVGVVQLTFLRLLSVSAHQDVSYPCSGAARDGPLRLRGANEDELSPETSPYVKEFRDGCQTQQGRTVLEVRTPVLEQLPVLDASFSDLGAPPRRGGVLLGPVCFMG

SEQ ID NO: 1125 - protein, 1676 aa, Homo sapiens; identical to SEQ ID NO: 1100

SEQ ID NO: 1126 - protein, 1715 aa, Homo sapiens
MERCSRCHRLLLLLPLVLGLSAAPGWAGAPPVDVLRALRFPSLPDGVRRAKGICPADVAYRVARPAQLSAPTRQLFPGGFPKDFSLLTVVRTRPGLQAPLLTLYSAQGVRQLGLELGRPVRFLYEDQTGRPQPPSQPVFRGLSLADGKWHRVAVAVKGQSVTLIVDCKKRVTRPLPRSARPVLDTHGVIIFGARILDEEVFEGDVQELAIVPGVQAAYESCEQKELECEGGQRERPQNQQPHRAQRSPQQQPSRLHRPQNQEPQSQPTESLYYDYEPPYYDVMTTGTTPDYQEQTDLQVPPTADRFQAEEYGEGGTDPPEGPYDYTYGYGDDYREETELGPALSAETAHSGAAAHGPRGLKGEKGEPAVLEPGMLVEGPPGPEGPAGLIGPPGIQGNPGPVGDPGERGPPGRAGLPGSDGAPGPPGTSLMLPFRFGSGGGDKGPVVAAQEAQAQAILQQARLALRGPPGPMGYTGRPGPLGQPGSPGLKGESGDLGPQGPRGPQGLTGPPGKAGRRGRAGADGARGMPGDPGVKGDRGFDGLPGLPGEKGHRGDTGAQGLPGPPGEDGERGDDGEIGPRGLPGESGPRGLLGPKGPPGIPGPPGVRGMDGPQGPKGSLGPQGEPGPPGQQGTPGTQGLPGPQGAIGPHGEKGPQGKPGLPGMPGSDGPPGHPGKEGPPGTKGNQGPSGPQGPLGYPGPRGVKGVDGIRGLKGHKGEKGEDGFPGFKGDIGVKGDRGEVGVPGSRGEDGPEGPKGRTGPTGDPGPPGLMGEKGKLGVPGLPGYPGRQGPKGSLGFPGFPGASGEKGARGLSGKSGPRGERGPTGPRGQRGPRGATGKSGAKGTSGGDGPHGPPGERGLPGPQGPNGFPGPKGPLGPPGKDGLPGHPGQRGEVGFQGKTGPPGPPGVVGPQGAAGETGPMGERGHPGPPGPPGEQGLPGTAGKEGTKGDPGPPGAPGKDGPAGLRGFPGERGLPGTAGGPGLKGNEGPSGPPGPAGSPGERGAAGSGGPIGPPGRPGPQGPPGAAGEKGVPGEKGPIGPTGRDGVQGPVGLPGPAGPPGVAGEDGDKGEVGDPGQKGTKGNKGEHGPPGPPGPIGPVGQPGAAGADGEPGARGPQGHFGAKGDEGTRGFNGPPGPIGLQGLPGPSGEKGETGDVGPMGPPGPPGPRGPAGPNGADGPQGPPGGVGNLGPPGEKGEPGESGSPGIQGEPGVKGPRGERGEKGESGQPGEPGPPGPKGPTGDDGPKGNPGPVGFPGDPGPPGEGGPRGQDGAKGDRGEDGEPGQPGSPGPTGENGPPGPLGKRGPAGSPGSEGRQGGKGAKGDPGAIGAPGKTGPVGPAGPAGKPGPDGLRGLPGSVGQQGRPGATGQAGPPGPVGPPGLPGLRGDAGAKGEKGHPGLIGLIGPPGEQGEKGDRGLPGPQGSPGQKGEMGIPGASGPIGPGGPPGLPGPAGPKGAKGATGPGGPKGEKGVQGPPGHPGPPGEVIQPLPIQMPKKTRRSVDGSRLMQEDEAIPTGGAPGSPGGLEEIFGSLDSLREEIEQMRRPTGTQDSPARTCQDLKLCHPELPDGEYWVDPNQGCARDAFRVFCNFTAGGETCVTPRDDVTQFSYVDSEGSPVGVVQLTFLRLLSVSAHQDVSYPCSGAARDGPLRLRGANEDELSPETSPYVKEFRDGCQTQQGRTVLEVRTPVLEQLPVLDASFSDLGAPPRRGGVLLGPVCFMG

SEQ ID NO: 1127 - protein, 1602 aa, Homo sapiens
GAPPVDVLRALRFPSLPDGVRRAKGICPADVAYRVARPAQLSAPTRQLFPGGFPKDFSLLTVVRTRPGLQAPLLTLYSAQGVRQLGLELGRPVRFLYEDQTGRPQPPSQPVFRGLSLADGKWHRVAVAVKGQSVTLIVDCKKRVTRPLPRSARPVLDTHGVIIFGARILDEEVFEGDVQELAIVPGVQAAYESCEQKELECEGGQRERPQNQQPHRAQRSPQQQPSRLHRPQNQEPQSQAAHGPRGLKGEKGEPAVLEPGMLVEGPPGPEGPAGLIGPPGIQGNPGPVGDPGERGPPGRAGLPGSDGAPGPPGTSLMLPFRFGSGGGDKGPVVAAQEAQAQAILQQARLALRGPPGPMGYTGRPGPLGQPGSPGLKGESGDLGPQGPRGPQGLTGPPGKAGRRGRAGADGARGMPGDPGVKGDRGFDGLPGLPGEKGHRGDTGAQGLPGPPGEDGERGDDGEIGPRGLPGESGPRGLLGPKGPPGIPGPPGVRGMDGPQGPKGSLGPQGEPGPPGQQGTPGTQGLPGPQGAIGPHGEKGPQGKPGLPGMPGSDGPPGHPGKEGPPGTKGNQGPSGPQGPLGYPGPRGVKGVDGIRGLKGHKGEKGEDGFPGFKGDIGVKGDRGEVGVPGSRGEDGPEGPKGRTGPTGDPGPPGLMGEKGKLGVPGLPGYPGRQGPKGSLGFPGFPGASGEKGARGLSGKSGPRGERGPTGPRGQRGPRGATGKSGAKGTSGGDGPHGPPGERGLPGPQGPNGFPGPKGPPGPPGKDGLPGHPGQRGEVGFQGKTGPPGPPGVVGPQGAAGETGPMGERGHPGPPGPPGEQGLPGTAGKEGTKGDPGPPGAPGKDGPAGLRGFPGERGLPGTAGGPGLKGNEGPSGPPGPAGSPGERGAAGSGGPIGPPGRPGPQGPPGAAGEKGVPGEKGPIGPTGRDGVQGPVGLPGPAGPPGVAGEDGDKGEVGDPGQKGTKGNKGEHGPPGPPGPIGPVGQPGAAGADGEPGARGPQGHFGAKGDEGTRGFNGPPGPIGLQGLPGPSGEKGETGDVGPMGPPGPPGPRGPAGPNGADGPQGPPGGVGNLGPPGEKGEPGESGSPGIQGEPGVKGPRGERGEKGESGQPGEPGPPGPKGPTGDDGPKGNPGPVGFPGDPGPPGEGGPRGQDGAKGDRGEDGEPGQPGSPGPTGENGPPGPLGKRGPAGSPGSEGRQGGKGAKGDPGAIGAPGKTGPVGPAGPAGKPGPDGLRGLPGSVGQQGRPGATGQAGPPGPVGPPGLPGLRGDAGAKGEKGHPGLIGLIGPPGEQGEKGDRGLPGPQGSPGQKGEMGIPGASGPIGPGGPPGLPGPAGPKGAKGATGPGGPKGEKGVQGPPGHPGPPGEVIQPLPIQMPKKTRRSVDGSRLMQEDEAIPTGGAPGSPGGLEEIFGSLDSLREEIEQMRRPTGTQDSPARTCQDLKLCHPELPDGEYWVDPNQGCARDAFRVFCNFTAGGETCVTPRDDVTQFSYVDSEGSPVGVVQLTFLRLLSVSAHQDVSYPCSGAARDGPLRLRGANEDELSPETSPYVKEFRDGCQTQQGRTVLEVRTPVLEQLPVLDASFSDLGAPPRRGGVLLGPVCFMG

SEQ ID NO: 1128 - protein, 1683 aa, Homo sapiens
GAPPVDVLRALRFPSLPDGVRRAKGICPADVAYRVARPAQLSAPTRQLFPGGFPKDFSLLTVVRTRPGLQAPLLTLYSAQGVRQLGLELGRPVRFLYEDQTGRPQPPSQPVFRGLSLADGKWHRVAVAVKGQSVTLIVDCKKRVTRPLPRSARPVLDTHGVIIFGARILDEEVFEGDVQELAIVPGVQAAYESCEQKELECEGGQRERPQNQQPHRAQRSPQQQPSRLHRPQNQEPQSQDPTPGEEEEILESSLLPPLEEEQTDLQVPPTADRFQAEEYGEGGTDPPEGPYDYTYGYGDDYREETELGPALSAETAHSGAAAHGPRGLKGEKGEPAVLEPGMLVEGPPGPEGPAGLIGPPGIQGNPGPVGDPGERGPPGRAGLPGSDGAPGPPGTSLMLPFRFGSGGGDKGPVVAAQEAQAQAILQQARLALRGPPGPMGYTGRPGPLGQPGSPGLKGESGDLGPQGPRGPQGLTGPPGKAGRRGRAGADGARGMPGDPGVKGDRGFDGLPGLPGEKGHRGDTGAQGLPGPPGEDGERGDDGEIGPRGLPGESGPRGLLGPKGPPGIPGPPGVRGMDGPQGPKGSLGPQGEPGPPGQQGTPGTQGLPGPQGAIGPHGEKGPQGKPGLPGMPGSDGPPGHPGKEGPPGTKGNQGPSGPQGPLGYPGPRGVKGVDGIRGLKGHKGEKGEDGFPGFKGDIGVKGDRGEVGVPGSRGEDGPEGPKGRTGPTGDPGPPGLMGEKGKLGVPGLPGYPGRQGPKGSLGFPGFPGASGEKGARGLSGKSGPRGERGPTGPRGQRGPRGATGKSGAKGTSGGDGPHGPPGERGLPGPQGPNGFPGPKGPPGPPGKDGLPGHPGQRGEVGFQGKTGPPGPPGVVGPQGAAGETGPMGERGHPGPPGPPGEQGLPGTAGKEGTKGDPGPPGAPGKDGPAGLRGFPGERGLPGTAGGPGLKGNEGPSGPPGPAGSPGERGAAGSGGPIGPPGRPGPQGPPGAAGEKGVPGEKGPIGPTGRDGVQGPVGLPGPAGPPGVAGEDGDKGEVGDPGQKGTKGNKGEHGPPGPPGPIGPVGQPGAAGADGEPGARGPQGHFGAKGDEGTRGFNGPPGPIGLQGLPGPSGEKGETGDVGPMGPPGPPGPRGPAGPNGADGPQGPPGGVGNLGPPGEKGEPGESGSPGIQGEPGVKGPRGERGEKGESGQPGEPGPPGPKGPTGDDGPKGNPGPVGFPGDPGPPGEGGPRGQDGAKGDRGEDGEPGQPGSPGPTGENGPPGPLGKRGPAGSPGSEGRQGGKGAKGDPGAIGAPGKTGPVGPAGPAGKPGPDGLRGLPGSVGQQGRPGATGQAGPPGPVGPPGLPGLRGDAGAKGEKGHPGLIGLIGPPGEQGEKGDRGLPGPQGSPGQKGEMGIPGASGPIGPGGPPGLPGPAGPKGAKGATGPGGPKGEKGVQGPPGHPGPPGEVIQPLPIQMPKKTRRSVDGSRLMQEDEAIPTGGAPGSPGGLEEIFGSLDSLREEIEQMRRPTGTQDSPARTCQDLKLCHPELPDGEYWVDPNQGCARDAFRVFCNFTAGGETCVTPRDDVTQFSYVDSEGSPVGVVQLTFLRLLSVSAHQDVSYPCSGAARDGPLRLRGANEDELSPETSPYVKEFRDGCQTQQGRTVLEVRTPVLEQLPVLDASFSDLGAPPRRGGVLLGPVCFMG

SEQ ID NO: 1129 - protein, 1710 aa, Homo sapiens; identical to SEQ ID NO: 1094

SEQ ID NO: 1130 - protein, 1710 aa, Homo sapiens; identical to SEQ ID NO: 1094

SEQ ID NO: 1131 - protein, 1676 aa, Homo sapiens
MERCSRCHRLLLLLPLVLGLSAAPGWAGAPPVDVLRALRFPSLPDGVRRAKGICPADVAYRVARPAQLSAPTRQLFPGGFPKDFSLLTVVRTRPGLQAPLLTLYSAQGVRQLGLELGRPVRFLYEDQTGRPQPPSQPVFRGLSLADGKWHRVAVAVKGQSVTLIVDCKKRVTRPLPRSARPVLDTHGVIIFGARILDEEVFEGDVQELAIVPGVQAAYESCEQKELECEGGQRERPQNQQPHRAQRSPQQQPSRLHRPQNQEPQSQPTESLYYDYEPPYYDVMTTGTTPDYQDPTPGEEEEILESSLLPPLEEAAHGPRGLKGEKGEPAVLEPGMLVEGPPGPEGPAGLIGPPGIQGNPGPVGDPGERGPPGRAGLPGSDGAPGPPGTSLMLPFRFGSGGGDKGPVVAAQEAQAQAILQQARLALRGPPGPMGYTGRPGPLGQPGSPGLKGESGDLGPQGPRGPQGLTGPPGKAGRRGRAGADGARGMPGDPGVKGDRGFDGLPGLPGEKGHRGDTGAQGLPGPPGEDGERGDDGEIGPRGLPGESGPRGLLGPKGPPGIPGPPGVRGMDGPQGPKGSLGPQGEPGPPGQQGTPGTQGLPGPQGAIGPHGEKGPQGKPGLPGMPGSDGPPGHPGKEGPPGTKGNQGPSGPQGPLGYPGPRGVKGVDGIRGLKGHKGEKGEDGFPGFKGDIGVKGDRGEVGVPGSRGEDGPEGPKGRTGPTGDPGPPGLMGEKGKLGVPGLPGYPGRQGPKGSLGFPGFPGASGEKGARGLSGKSGPRGERGPTGPRGQRGPRGATGKSGAKGTSGGDGPHGPPGERGLPGPQGPNGFPGPKGPLGPPGKDGLPGHPGQRGEVGFQGKTGPPGPPGVVGPQGAAGETGPMGERGHPGPPGPPGEQGLPGTAGKEGTKGDPGPPGAPGKDGPAGLRGFPGERGLPGTAGGPGLKGNEGPSGPPGPAGSPGERGAAGSGGPIGPPGRPGPQGPPGAAGEKGVPGEKGPIGPTGRDGVQGPVGLPGPAGPPGVAGEDGDKGEVGDPGQKGTKGNKGEHGPPGPPGPIGPVGQPGAAGADGEPGARGPQGHFGAKGDEGTRGFNGPPGPIGLQGLPGPSGEKGETGDVGPMGPPGPPGPRGPAGPNGADGPQGPPGGVGNLGPPGEKGEPGESGSPGIQGEPGVKGPRGERGEKGESGQPGEPGPPGPKGPTGDDGPKGNPGPVGFPGDPGPPGEGGPRGQDGAKGDRGEDGEPGQPGSPGPTGENGPPGPLGKRGPAGSPGSEGRQGGKGAKGDPGAIGAPGKTGPVGPAGPAGKPGPDGLRGLPGSVGQQGRPGATGQAGPPGPVGPPGLPGLRGDAGAKGEKGHPGLIGLIGPPGEQGEKGDRGLPGPQGSPGQKGEMGIPGASGPIGPGGPPGLPGPAGPKGAKGATGPGGPKGEKGVQGPPGHPGPPGEVIQPLPIQMPKKTRRSVDGSRLMQEDEAIPTGGAPGSPGGLEEIFGSLDSLREEIEQMRRPTGTQDSPARTCQDLKLCHPELPDGEYWVDPNQGCARDAFRVFCNFTAGGETCVTPRDDVTQFSYVDSEGSPVGVVQLTFLRLLSVSAHQDVSYPCSGAARDGPLRLRGANEDELSPETSPYVKEFRDGCQTQQGRTVLEVRTPVLEQLPVLDASFSDLGAPPRRGGVLLGPVCFMG

SEQ ID NO: 1132 - protein, 306 aa, Homo sapiens [sequence omitted]

SEQ ID NO: 1133 - protein, 1689 aa, Homo sapiens
MERCSRCHRLLLLLPLVLGLSAAPGWAGAPPVDVLRALRFPSLPDGVRRAKGICPADVAYRVARPAQLSAPTRQLFPGGFPKDFSLLTVVRTRPGLQAPLLTLYSAQGVRQLGLELGRPVRFLYEDQTGRPQPPSQPVFRGLSLADGKWHRVAVAVKGQSVTLIVDCKKRVTRPLPRSARPVLDTHGVIIFGARILDEEVFEGDVQELAIVPGVQAAYESCEQKELECEGGQRERPQNQQPHRAQRSPQQQPSRLHRPQNQEPQSQEQTDLQVPPTADRFQAEEYGEGGTDPPEGPYDYTYGYGDDYREETELGPALSAETAHSGAAAHGPRGLKGEKGEPAVLEPGMLVEGPPGPEGPAGLIGPPGIQGNPGPVGDPGERGPPGRAGLPGSDGAPGPPGTSLMLPFRFGSGGGDKGPVVAAQEAQAQAILQQARLALRGPPGPMGYTGRPGPLGQPGSPGLKGESGDLGPQGPRGPQGLTGPPGKAGRRGRAGADGARGMPGDPGVKGDRGFDGLPGLPGEKGHRGDTGAQGLPGPPGEDGERGDDGEIGPRGLPGESGPRGLLGPKGPPGIPGPPGVRGMDGPQGPKGSLGPQGEPGPPGQQGTPGTQGLPGPQGAIGPHGEKGPQGKPGLPGMPGSDGPPGHPGKEGPPGTKGNQGPSGPQGPLGYPGPRGVKGVDGIRGLKGHKGEKGEDGFPGFKGDIGVKGDRGEVGVPGSRGEDGPEGPKGRTGPTGDPGPPGLMGEKGKLGVPGLPGYPGRQGPKGSLGFPGFPGASGEKGARGLSGKSGPRGERGPTGPRGQRGPRGATGKSGAKGTSGGDGPHGPPGERGLPGPQGPNGFPGPKGPLGPPGKDGLPGHPGQRGEVGFQGKTGPPGPPGVVGPQGAAGETGPMGERGHPGPPGPPGEQGLPGTAGKEGTKGDPGPPGAPGKDGPAGLRGFPGERGLPGTAGGPGLKGNEGPSGPPGPAGSPGERGAAGSGGPIGPPGRPGPQGPPGAAGEKGVPGEKGPIGPTGRDGVQGPVGLPGPAGPPGVAGEDGDKGEVGDPGQKGTKGNKGEHGPPGPPGPIGPVGQPGAAGADGEPGARGPQGHFGAKGDEGTRGFNGPPGPIGLQGLPGPSGEKGETGDVGPMGPPGPPGPRGPAGPNGADGPQGPPGGVGNLGPPGEKGEPGESGSPGIQGEPGVKGPRGERGEKGESGQPGEPGPPGPKGPTGDDGPKGNPGPVGFPGDPGPPGEGGPRGQDGAKGDRGEDGEPGQPGSPGPTGENGPPGPLGKRGPAGSPGSEGRQGGKGAKGDPGAIGAPGKTGPVGPAGPAGKPGPDGLRGLPGSVGQQGRPGATGQAGPPGPVGPPGLPGLRGDAGAKGEKGHPGLIGLIGPPGEQGEKGDRGLPGPQGSPGQKGEMGIPGASGPIGPGGPPGLPGPAGPKGAKGATGPGGPKGEKGVQGPPGHPGPPGEVIQPLPIQMPKKTRRSVDGSRLMQEDEAIPTGGAPGSPGGLEEIFGSLDSLREEIEQMRRPTGTQDSPARTCQDLKLCHPELPDGEYWVDPNQGCARDAFRVFCNFTAGGETCVTPRDDVTQFSYVDSEGSPVGVVQLTFLRLLSVSAHQDVSYPCSGAARDGPLRLRGANEDELSPETSPYVKEFRDGCQTQQGRTVLEVRTPVLEQLPVLDASFSDLGAPPRRGGVLLGPVCFMG

SEQ ID NO: 1134 - protein, 1629 aa, Homo sapiens; identical to SEQ ID NO: 1090

SEQ ID NO: 1135 - protein, 1736 aa, Homo sapiens
MERCSRCHRLLLLLPLVLGLSAAPGWAGAPPVDVLRALRFPSLPDGVRRAKGICPADVAYRVARPAQLSAPTRQLFPGGFPKDFSLLTVVRTRPGLQAPLLTLYSAQGVRQLGLELGRPVRFLYEDQTGRPQPPSQPVFRGLSLADGKWHRVAVAVKGQSVTLIVDCKKRVTRPLPRSARPVLDTHGVIIFGARILDEEVFEGDVQELAIVPGVQAAYESCEQKELECEGGQRERPQNQQPHRAQRSPQQQPSRLHRPQNQEPQSQPTESLYYDYEPPYYDVMTTGTTPDYQDPTPGEEEEILESSLLPPLEEEQTDLQVPPTADRFQAEEYGEGGTDPPEGPYDYTYGYGDDYREETELGPALSAETAHSGAAAHGPRGLKGEKGEPAVLEPGMLVEGPPGPEGPAGLIGPPGIQGNPGPVGDPGERGPPGRAGLPGSDGAPGPPGTSLMLPFRFGSGGGDKGPVVAAQEAQAQAILQQARLALRGPPGPMGYTGRPGPLGQPGSPGLKGESGDLGPQGPRGPQGLTGPPGKAGRRGRAGADGARGMPGDPGVKGDRGFDGLPGLPGEKGHRGDTGAQGLPGPPGEDGERGDDGEIGPRGLPGESGPRGLLGPKGPPGIPGPPGVRGMDGPQGPKGSLGPQGEPGPPGQQGTPGTQGLPGPQGAIGPHGEKGPQGKPGLPGMPGSDGPPGHPGKEGPPGTKGNQGPSGPQGPLGYPGPRGVKGVDGIRGLKGHKGEKGEDGFPGFKGDIGVKGDRGEVGVPGSRGEDGPEGPKGRTGPTGDPGPPGLMGEKGKLGVPGLPGYPGRQGPKGSLGFPGFPGASGEKGARGLSGKSGPRGERGPTGPRGQRGPRGATGKSGAKGTSGGDGPHGPPGERGLPGPQGPNGFPGPKGPLGPPGKDGLPGHPGQRGEVGFQGKTGPPGPPGVVGPQGAAGETGPMGERGHPGPPGPPGEQGLPGTAGKEGTKGDPGPPGAPGKDGPAGLRGFPGERGLPGTAGGPGLKGNEGPSGPPGPAGSPGERGAAGSGGPIGPPGRPGPQGPPGAAGEKGVPGEKGPIGPTGRDGVQGPVGLPGPAGPPGVAGEDGDKGEVGDPGQKGTKGNKGEHGPPGPPGPIGPVGQPGAAGADGEPGARGPQGHFGAKGDEGTRGFNGPPGPIGLQGLPGPSGEKGETGDVGPMGPPGPPGPRGPAGPNGADGPQGPPGGVGNLGPPGEKGEPGESGSPGIQGEPGVKGPRGERGEKGESGQPGEPGPPGPKGPTGDDGPKGNPGPVGFPGDPGPPGEGGPRGQDGAKGDRGEDGEPGQPGSPGPTGENGPPGPLGKRGPAGSPGSEGRQGGKGAKGDPGAIGAPGKTGPVGPAGPAGKPGPDGLRGLPGSVGQQGRPGATGQAGPPGPVGPPGLPGLRGDAGAKGEKGHPGLIGLIGPPGEQGEKGDRGLPGPQGSPGQKGEMGIPGASGPIGPGGPPGLPGPAGPKGAKGATGPGGPKGEKGVQGPPGHPGPPGEVIQPLPIQMPKKTRRSVDGSRLMQEDEAIPTGGAPGSPGGLEEIFGSLDSLREEIEQMRRPTGTQDSPARTCQDLKLCHPELPDGEYWVDPNQGCARDAFRVFCNFTAGGETCVTPRDDVTQFSYVDSEGSPVGVVQLTFLRLLSVSAHQDVSYPCSGAARDGPLRLRGANEDELSPETSPYVKEFRDGCQTQQGRTVLEVRTPVLEQLPVLDASFSDLGAPPRRGGVLLGPVCFMG

SEQ ID NO: 1136 - protein, 1736 aa, Homo sapiens
MERCSRCHRLLLLLPLVLGLSAAPGWAGAPPVDVLRALRFPSLPDGVRRAKGICPADVAYRVARPAQLSAPTRQLFPGGFPKDFSLLTVVRTRPGLQAPLLTLYSAQGVRQLGLELGRPVRFLYEDQTGRPQPPSQPVFRGLSLADGKWHRVAVAVKGQSVTLIVDCKKRVTRPLPRSARPVLDTHGVIIFGARILDEEVFEGDVQELAIVPGVQAAYESCEQKELECEGGQRERPQNQQPHRAQRSPQQQPSRLHRPQNQEPQSQPTESLYYDYKPPYYDVMTTGTTPDYQDPTPGEEEEILESSLLPPLEEEQTDLQVPPTADRFQAEEYGEGGTDPPEGPYDYTYGYGDDYREETELGPALSAETAHSGAAAHGPRGLKGEKGEPAVLEPGMLVEGPPGPEGPAGLIGPPGIQGNPGPVGDPGERGPPGRAGLPGSDGAPGPPGTSLMLPFRFGSGGGDKGPVVAAQEAQAQAILQQARLALRGPPGPMGYTGRPGPLGQPGSPGLKGESGDLGPQGPRGPQGLTGPPGKAGRRGRAGADGARGMPGDPGVKGDRGFDGLPGLPGEKGHRGDTGAQGLPGPPGEDGERGDDGEIGPRGLPGESGPRGLLGPKGPPGIPGPPGVRGMDGPQGPKGSLGPQGEPGPPGQQGTPGTQGLPGPQGAIGPHGEKGPQGKPGLPGMPGSDGPPGHPGKEGPPGTKGNQGPSGPQGPLGYPGPRGVKGVDGIRGLKGHKGEKGEDGFPGFKGDIGVKGDRGEVGVPGSRGEDGPEGPKGRTGPTGDPGPPGLMGEKGKLGVPGLPGYPGRQGPKGSLGFPGFPGASGEKGARGLSGKSGPRGERGPTGPRGQRGPRGATGKSGAKGTSGGDGPHGPPGERGLPGPQGPNGFPGPKGPPGPPGKDGLPGHPGQRGEVGFQGKTGPPGPPGVVGPQGAAGETGPMGERGHPGPPGPPGEQGLPGTAGKEGTKGDPGPPGAPGKDGPAGLRGFPGERGLPGTAGGPGLKGNEGPSGPPGPAGSPGERGAAGSGGPIGPPGRPGPQGPPGAAGEKGVPGEKGPIGPTGRDGVQGPVGLPGPAGPPGVAGEDGDKGEVGDPGQKGTKGNKGEHGPPGPPGPIGPVGQPGAAGADGEPGARGPQGHFGAKGDEGTRGFNGPPGPIGLQGLPGPSGEKGETGDVGPMGPPGPPGPRGPAGPNGADGPQGPPGGVGNLGPPGEKGEPGESGSPGIQGEPGVKGPRGERGEKGESGQPGEPGPPGPKGPTGDDGPKGNPGPVGFPGDPGPPGEGGPRGQDGAKGDRGEDGEPGQPGSPGPTGENGPPGPLGKRGPAGSPGSEGRQGGKGAKGDPGAIGAPGKTGPVGPAGPAGKPGPDGLRGLPGSVGQQGRPGATGQAGPPGPVGPPGLPGLRGDAGAKGEKGHPGLIGLIGPPGEQGEKGDRGLPGPQGSPGQKGEMGIPGASGPIGPGGPPGLPGPAGPKGAKGATGPGGPKGEKGVQGPPGHPGPPGEVIQPLPIQMPKKTRRSVDGSRLMQEDEAIPTGGAPGSPGGLEEIFGSLDSLREEIEQMRRPTGTQDSPARTCQDLKLCHPELPDGEYWVDPNQGCARDAFRVFCNFTAGGETCVTPRDDVTQFSYVDSEGSPVGVVQLTFLRLLSVSAHQDVSYPCSGAARDGPLRLRGANEDELSPETSPYVKEFRDGCQTQQGRTVLEVRTPVLEQLPVLDASFSDLGAPPRRGGVLLGPVCFMG

SEQ ID NO: 1137 - protein, 1736 aa, Homo sapiens; identical to SEQ ID NO: 1136

SEQ ID NO: 1138 - protein, 1689 aa, Homo sapiens; identical to SEQ ID NO: 1093

SEQ ID NO: 1139 - protein, 306 aa, Homo sapiens [sequence omitted]

SEQ ID NO: 1140 - protein, 1710 aa, Homo sapiens
MERCSRCHRLLLLLPLVLGLSAAPGWAGAPPVDVLRALRFPSLPDGVRRAKGICPADVAYRVARPAQLSAPTRQLFPGGFPKDFSLLTVVRTRPGLQAPLLTLYSAQGVRQLGLELGRPVRFLYEDQTGRPQPPSQPVFRGLSLADGKWHRVAVAVKGQSVTLIVDCKKRVTRPLPRSARPVLDTHGVIIFGARILDEEVFEGDVQELAIVPGVQAAYESCEQKELECEGGQRERPQNQQPHRAQRSPQQQPSRLHRPQNQEPQSQDPTPGEEEEILESSLLPPLEEEQTDLQVPPTADRFQAEEYGEGGTDPPEGPYDYTYGYGDDYREETELGPALSAETAHSGAAAHGPRGLKGEKGEPAVLEPGMLVEGPPGPEGPAGLIGPPGIQGNPGPVGDPGERGPPGRAGLPGSDGAPGPPGTSLMLPFRFGSGGGDKGPVVAAQEAQAQAILQQARLALRGPPGPMGYTGRPGPLGQPGSPGLKGESGDLGPQGPRGPQGLTGPPGKAGRRGRAGADGARGMPGDPGVKGDRGFDGLPGLPGEKGHRGDTGAQGLPGPPGEDGERGDDGEIGPRGLPGESGPRGLLGPKGPPGIPGPPGVRGMDGPQGPKGSLGPQGEPGPPGQQGTPGTQGLPGPQGAIGPHGEKGPQGKPGLPGMPGSDGPPGHPGKEGPPGTKGNQGPSGPQGPLGYPGPRGVKGVDGIRGLKGHKGEKGEDGFPGFKGDIGVKGDRGEVGVPGSRGEDGPEGPKGRTGPTGDPGPPGLMGEKGKLGVPGLPGYPGRQGPKGSLGFPGFPGASGEKGARGLSGKSGPRGERGPTGPRGQRGPRGATGKSGAKGTSGGDGPHGPPGERGLPGPQGPNGFPGPKGPLGPPGKDGLPGHPGQRGEVGFQGKTGPPGPPGVVGPQGAAGETGPMGERGHPGPPGPPGEQGLPGTAGKEGTKGDPGPPGAPGKDGPAGLRGFPGERGLPGTAGGPGLKGNEGPSGPPGPAGSPGERGAAGSGGPIGPPGRPGPQGPPGAAGEKGVPGEKGPIGPTGRDGVQGPVGLPGPAGPPGVAGEDGDKGEVGDPGQKGTKGNKGEHGPPGPPGPIGPVGQPGAAGADGEPGARGPQGHFGAKGDEGTRGFNGPPGPIGLQGLPGPSGEKGETGDVGPMGPPGPPGPRGPAGPNGADGPQGPPGGVGNLGPPGEKGEPGESGSPGIQGEPGVKGPRGERGEKGESGQPGEPGPPGPKGPTGDDGPKGNPGPVGFPGDPGPPGEGGPRGQDGAKGDRGEDGEPGQPGSPGPTGENGPPGPLGKRGPAGSPGSEGRQGGKGAKGDPGAIGAPGKTGPVGPAGPAGKPGPDGLRGLPGSVGQQGRPGATGQAGPPGPVGPPGLPGLRGDAGAKGEKGHPGLIGLIGPPGEQGEKGDRGLPGPQGSPGQKGEMGIPGASGPIGPGGPPGLPGPAGPKGAKGATGPGGPKGEKGVQGPPGHPGPPGEVIQPLPIQMPKKTRRSVDGSRLMQEDEAIPTGGAPGSPGGLEEIFGSLDSLREEIEQMRRPTGTQDSPARTCQDLKLCHPELPDGEYWVDPNQGCARDAFRVFCNFTAGGETCVTPRDDVTQFSYVDSEGSPVGVVQLTFLRLLSVSAHQDVSYPCSGAARDGPLRLRGANEDELSPETSPYVKEFRDGCQTQQGRTVLEVRTPVLEQLPVLDASFSDLGAPPRRGGVLLGPVCFMG

SEQ ID NO: 1141 - protein, 1689 aa, Homo sapiens; identical to SEQ ID NO: 1093

SEQ ID NO: 1142 - protein, 1629 aa, Homo sapiens; identical to SEQ ID NO: 1090

SEQ ID NO: 1143 - protein, 306 aa, Homo sapiens [sequence omitted]

SEQ ID NO: 1144 - protein, 1655 aa, Homo sapiens
MERCSRCHRLLLLLPLVLGLSAAPGWAGAPPVDVLRALRFPSLPDGVRRAKGICPADVAYRVARPAQLSAPTRQLFPGGFPKDFSLLTVVRTRPGLQAPLLTLYSAQGVRQLGLELGPPVRFLYEDQTGRPQPPSQPVFRGLSLADGKWHRVAVAVKGQSVTLIVDCKKRVTRPLPRSARPVLDTHGVIIFGARILDEEVFEGDVQELAIVPGVQAAYESCEQKELECEGGQRERPQNQQPHRAQRSPQQQPSRLHRPQNQEPQSQPTESLYYDYKPPYYDVMTTGTTPDYQAAHGPRGLKGEKGEPAVLEPGMLVEGPPGPEGPAGLIGPPGIQGNPGPVGDPGERGPPGRAGLPGSDGAPGPPGTSLMLPFRFGSGGGDKGPVVAAQEAQAQAILQQARLALRGPPGPMGYTGRPGPLGQPGSPGLKGESGDLGPQGPRGPQGLTGPPGKAGRRGRAGADGARGMPGDPGVKGDRGFDGLPGLPGEKGHRGDTGAQGLPGPPGEDGERGDDGEIGPRGLPGESGPRGLLGPKGPPGIPGPPGVRGMDGPQGPKGSLGPQGEPGPPGQQGTPGTQGLPGPQGAIGPHGEKGPQGKPGLPGMPGSDGPPGHPGKEGPPGTKGNQGPSGPQGPLGYPGPRGVKGVDGIRGLKGHKGEKGEDGFPGFKGDIGVKGDRGEVGVPGSRGEDGPEGPKGRTGPTGDPGPPGLMGEKGKLGVPGLPGYPGRQGPKGSLGFPGFPGASGEKGARGLSGKSGPRGERGPTGPRGQRGPRGATGKSGAKGTSGGDGPHGPPGERGLPGPQGPNGFPGPKGPPGPPGKDGLPGHPGQRGEVGFQGKTGPPGPPGVVGPQGAAGETGPMGERGHPGPPGPPGEQGLPGTAGKEGTKGDPGPPGAPGKDGPAGLRGFPGERGLPGTAGGPGLKGNEGPSGPPGPAGSPGERGAAGSGGPIGPPGRPGPQGPPGAAGEKGVPGEKGPIGPTGRDGVQGPVGLPGPAGPPGVAGEDGDKGEVGDPGQKGTKGNKGEHGPPGPPGPIGPVGQPGAAGADGEPGARGPQGHFGAKGDEGTRGFNGPPGPIGLQGLPGPSGEKGETGDVGPMGPPGPPGPRGPAGPNGADGPQGPPGGVGNLGPPGEKGEPGESGSPGIQGEPGVKGPRGERGEKGESGQPGEPGPPGPKGPTGDDGPKGNPGPVGFPGDPGPPGEGGPRGQDGAKGDRGEDGEPGQPGSPGPTGENGPPGPLGKRGPAGSPGSEGRQGGKGAKGDPGAIGAPGKTGPVGPAGPAGKPGPDGLRGLPGSVGQQGRPGATGQAGPPGPVGPPGLPGLRGDAGAKGEKGHPGLIGLIGPPGEQGEKGDRGLPGPQGSPGQKGEMGIPGASGPIGPGGPPGLPGPAGPKGAKGATGPGGPKGEKGVQGPPGHPGPPGEVIQPLPIQMPKKTRRSVDGSRLMQEDEAIPTGGAPGSPGGLEEIFGSLDSLREEIEQMRRPTGTQDSPARTCQDLKLCHPELPDGEYWVDPNQGCARDAFRVFCNFTAGGETCVTPRDDVTQFSYVDSEGSPVGVVQLTFLRLLSVSAHQDVSYPCSGAARDGPLRLRGANEDELSPETSPYVKEFRDGCQTQQGRTVLEVRTPVLEQLPVLDASFSDLGAPPRRGGVLLGPVCFMG

SEQ ID NO: 1145 - protein, 1736 aa, Homo sapiens
MERCSRCHRLLLLLPLVLGLSAAPGWAGAPPVDVLRALRFPSLPDGVRRAKGICPADVAYRVARPAQLSAPTRQLFPGGFPKDFSLLTVVRTRPGLQAPLLTLYSAQGVRQLGLELGPPVRFLYEDQTGRPQPPSQPVFRGLSLADGKWHRVAVAVKGQSVTLIVDCKKRVTRPLPRSARPVLDTHGVIIFGARILDEEVFEGDVQELAIVPGVQAAYESCEQKELECEGGQRERPQNQQPHRAQRSPQQQPSRLHRPQNQEPQSQPTESLYYDYKPPYYDVMTTGTTPDYQDPTPGEEEEILESSLLPPLEEEQTDLQVPPTADRFQAEEYGEGGTDPPEGPYDYTYGYGDDYREETELGPALSAETAHSGAAAHGPRGLKGEKGEPAVLEPGMLVEGPPGPEGPAGLIGPPGIQGNPGPVGDPGERGPPGRAGLPGSDGAPGPPGTSLMLPFRFGSGGGDKGPVVAAQEAQAQAILQQARLALRGPPGPMGYTGRPGPLGQPGSPGLKGESGDLGPQGPRGPQGLTGPPGKAGRRGRAGADGARGMPGDPGVKGDRGFDGLPGLPGEKGHRGDTGAQGLPGPPGEDGERGDDGEIGPRGLPGESGPRGLLGPKGPPGIPGPPGVRGMDGPQGPKGSLGPQGEPGPPGQQGTPGTQGLPGPQGAIGPHGEKGPQGKPGLPGMPGSDGPPGHPGKEGPPGTKGNQGPSGPQGPLGYPGPRGVKGVDGIRGLKGHKGEKGEDGFPGFKGDIGVKGDRGEVGVPGSRGEDGPEGPKGRTGPTGDPGPPGLMGEKGKLGVPGLPGYPGRQGPKGSLGFPGFPGASGEKGARGLSGKSGPRGERGPTGPRGQRGPRGATGKSGAKGTSGGDGPHGPPGERGLPGPQGPNGFPGPKGPPGPPGKDGLPGHPGQRGEVGFQGKTGPPGPPGVVGPQGAAGETGPMGERGHPGPPGPPGEQGLPGTAGKEGTKGDPGPPGAPGKDGPAGLRGFPGERGLPGTAGGPGLKGNEGPSGPPGPAGSPGERGAAGSGGPIGPPGRPGPQGPPGAAGEKGVPGEKGPIGPTGRDGVQGPVGLPGPAGPPGVAGEDGDKGEVGDPGQKGTKGNKGEHGPPGPPGPIGPVGQPGAAGADGEPGARGPQGHFGAKGDEGTRGFNGPPGPIGLQGLPGPSGEKGETGDVGPMGPPGPPGPRGPAGPNGADGPQGPPGGVGNLGPPGEKGEPGESGSPGIQGEPGVKGPRGERGEKGESGQPGEPGPPGPKGPTGDDGPKGNPGPVGFPGDPGPPGEGGPRGQDGAKGDRGEDGEPGQPGSPGPTGENGPPGPLGKRGPAGSPGSEGRQGGKGAKGDPGAIGAPGKTGPVGPAGPAGKPGPDGLRGLPGSVGQQGRPGATGQAGPPGPVGPPGLPGLRGDAGAKGEKGHPGLIGLIGPPGEQGEKGDRGLPGPQGSPGQKGEMGIPGASGPIGPGGPPGLPGPAGPKGAKGATGPGGPKGEKGVQGPPGHPGPPGEVIQPLPIQMPKKTRRSVDGSRLMQEDEAIPTGGAPGSPGGLEEIFGSLDSLREEIEQMRRPTGTQDSPARTCQDLKLCHPELPDGEYWVDPNQGCARDAFRVFCNFTAGGETCVTPRDDVTQFSYVDSEGSPVGVVQLTFLRLLSVSAHQDVSYPCSGAARDGPLRLRGANEDELSPETSPYVKEFRDGCQTQQGRTVLEVRTPVLEQLPVLDASFSDLGAPPRRGGVLLGPVCFMG

SEQ ID NO: 1146 - protein, 1715 aa, Homo sapiens; identical to SEQ ID NO: 1089

SEQ ID NO: 1147 - protein, 1629 aa, Homo sapiens
MERCSRCHRLLLLLPLVLGLSAAPGWAGAPPVDVLRALRFPSLPDGVRRAKGICPADVAYRVARPAQLSAPTRQLFPGGFPKDFSLLTVVRTRPGLQAPLLTLYSAQGVRQLGLELGRPVRFLYEDQTGRPQPPSQPVFRGLSLADGKWHRVAVAVKGQSVTLIVDCKKRVTRPLPRSARPVLDTHGVIIFGARILDEEVFEGDVQELAIVPGVQAAYESCEQKELECEGGQRERPQNQQPHRAQRSPQQQPSRLHRPQNQEPQSQAAHGPRGLKGEKGEPAVLEPGMLVEGPPGPEGPAGLIGPPGIQGNPGPVGDPGERGPPGRAGLPGSDGAPGPPGTSLMLPFRFGSGGGDKGPVVAAQEAQAQAILQQARLALRGPPGPMGYTGRPGPLGQPGSPGLKGESGDLGPQGPRGPQGLTGPPGKAGRRGRAGADGARGMPGDPGVKGDRGFDGLPGLPGEKGHRGDTGAQGLPGPPGEDGERGDDGEIGPRGLPGESGPRGLLGPKGPPGIPGPPGVRGMDGPQGPKGSLGPQGEPGPPGQQGTPGTQGLPGPQGAIGPHGEKGPQGKPGLPGMPGSDGPPGHPGKEGPPGTKGNQGPSGPQGPLGYPGPRGVKGVDGIRGLKGHKGEKGEDGFPGFKGDIGVKGDRGEVGVPGSRGEDGPEGPKGRTGPTGDPGPPGLMGEKGKLGVPGLPGYPGRQGPKGSLGFPGFPGASGEKGARGLSGKSGPRGERGPTGPRGQRGPRGATGKSGAKGTSGGDGPHGPPGERGLPGPQGPNGFPGPKGPLGPPGKDGLPGHPGQRGEVGFQGKTGPPGPPGVVGPQGAAGETGPMGERGHPGPPGPPGEQGLPGTAGKEGTKGDPGPPGAPGKDGPAGLRGFPGERGLPGTAGGPGLKGNEGPSGPPGPAGSPGERGAAGSGGPIGPPGRPGPQGPPGAAGEKGVPGEKGPIGPTGRDGVQGPVGLPGPAGPPGVAGEDGDKGEVGDPGQKGTKGNKGEHGPPGPPGPIGPVGQPGAAGADGEPGARGPQGHFGAKGDEGTRGFNGPPGPIGLQGLPGPSGEKGETGDVGPMGPPGPPGPRGPAGPNGADGPQGPPGGVGNLGPPGEKGEPGESGSPGIQGEPGVKGPRGERGEKGESGQPGEPGPPGPKGPTGDDGPKGNPGPVGFPGDPGPPGEGGPRGQDGAKGDRGEDGEPGQPGSPGPTGENGPPGPLGKRGPAGSPGSEGRQGGKGAKGDPGAIGAPGKTGPVGPAGPAGKPGPDGLRGLPGSVGQQGRPGATGQAGPPGPVGPPGLPGLRGDAGAKGEKGHPGLIGLIGPPGEQGEKGDRGLPGPQGSPGQKGEMGIPGASGPIGPGGPPGLPGPAGPKGAKGATGPGGPKGEKGVQGPPGHPGPPGEVIQPLPIQMPKKTRRSVDGSRLMQEDEAIPTGGAPGSPGGLEEIFGSLDSLREEIEQMRRPTGTQDSPARTCQDLKLCHPELPDGEYWVDPNQGCARDAFRVFCNFTAGGETCVTPRDDVTQFSYVDSEGSPVGVVQLTFLRLLSVSAHQDVSYPCSGAARDGPLRLRGANEDELSPETSPYVKEFRDGCQTQQGRTVLEVRTPVLEQLPVLDASFSDLGAPPRRGGVLLGPVCFMG

SEQ ID NO: 1148 - protein, 306 aa, Homo sapiens [sequence omitted]

SEQ ID NO: 1149 - protein, 1655 aa, Homo sapiens; identical to SEQ ID NO: 1092

SEQ ID NO: 1150 - protein, 306 aa, Homo sapiens [sequence omitted]

SEQ ID NO: 1151 - protein, 1736 aa, Homo sapiens; identical to SEQ ID NO: 1088

SEQ ID NO: 1152 - protein, 306 aa, Homo sapiens [sequence omitted]

SEQ ID NO: 1153 - protein, 1689 aa, Homo sapiens; identical to SEQ ID NO: 1093

SEQ ID NO: 1154 - protein, 1629 aa, Homo sapiens
MERCSRCHRLLLLLPLVLGLSAAPGWAGAPPVDVLRALRFPSLPDGVRRAKGICPADVAYRVARPAQLSAPTRQLFPGGFPKDFSLLTVVRTRPGLQAPLLTLYSAQGVRQLGLELGPPVRFLYEDQTGRPQPPSQPVFRGLSLADGKWHRVAVAVKGQSVTLIVDCKKRVTRPLPRSARPVLDTHGVIIFGARILDEEVFEGDVQELAIVPGVQAAYESCEQKELECEGGQRERPQNQQPHRAQRSPQQQPSRLHRPQNQEPQSQAAHGPRGLKGEKGEPAVLEPGMLVEGPPGPEGPAGLIGPPGIQGNPGPVGDPGERGPPGRAGLPGSDGAPGPPGTSLMLPFRFGSGGGDKGPVVAAQEAQAQAILQQARLALRGPPGPMGYTGRPGPLGQPGSPGLKGESGDLGPQGPRGPQGLTGPPGKAGRRGRAGADGARGMPGDPGVKGDRGFDGLPGLPGEKGHRGDTGAQGLPGPPGEDGERGDDGEIGPRGLPGESGPRGLLGPKGPPGIPGPPGVRGMDGPQGPKGSLGPQGEPGPPGQQGTPGTQGLPGPQGAIGPHGEKGPQGKPGLPGMPGSDGPPGHPGKEGPPGTKGNQGPSGPQGPLGYPGPRGVKGVDGIRGLKGHKGEKGEDGFPGFKGDIGVKGDRGEVGVPGSRGEDGPEGPKGRTGPTGDPGPPGLMGEKGKLGVPGLPGYPGRQGPKGSLGFPGFPGASGEKGARGLSGKSGPRGERGPTGPRGQRGPRGATGKSGAKGTSGGDGPHGPPGERGLPGPQGPNGFPGPKGPPGPPGKDGLPGHPGQRGEVGFQGKTGPPGPPGVVGPQGAAGETGPMGERGHPGPPGPPGEQGLPGTAGKEGTKGDPGPPGAPGKDGPAGLRGFPGERGLPGTAGGPGLKGNEGPSGPPGPAGSPGERGAAGSGGPIGPPGRPGPQGPPGAAGEKGVPGEKGPIGPTGRDGVQGPVGLPGPAGPPGVAGEDGDKGEVGDPGQKGTKGNKGEHGPPGPPGPIGPVGQPGAAGADGEPGARGPQGHFGAKGDEGTRGFNGPPGPIGLQGLPGPSGEKGETGDVGPMGPPGPPGPRGPAGPNGADGPQGPPGGVGNLGPPGEKGEPGESGSPGIQGEPGVKGPRGERGEKGESGQPGEPGPPGPKGPTGDDGPKGNPGPVGFPGDPGPPGEGGPRGQDGAKGDRGEDGEPGQPGSPGPTGENGPPGPLGKRGPAGSPGSEGRQGGKGAKGDPGAIGAPGKTGPVGPAGPAGKPGPDGLRGLPGSVGQQGRPGATGQAGPPGPVGPPGLPGLRGDAGAKGEKGHPGLIGLIGPPGEQGEKGDRGLPGPQGSPGQKGEMGIPGASGPIGPGGPPGLPGPAGPKGAKGATGPGGPKGEKGVQGPPGHPGPPGEVIQPLPIQMPKKTRRSVDGSRLMQEDEAIPTGGAPGSPGGLEEIFGSLDSLREEIEQMRRPTGTQDSPARTCQDLKLCHPELPDGEYWVDPNQGCARDAFRVFCNFTAGGETCVTPRDDVTQFSYVDSEGSPVGVVQLTFLRLLSVSAHQDVSYPCSGAARDGPLRLRGANEDELSPETSPYVKEFRDGCQTQQGRTVLEVRTPVLEQLPVLDASFSDLGAPPRRGGVLLGPVCFMG

SEQ ID NO: 1155 - protein, 1629 aa, Homo sapiens; identical to SEQ ID NO: 1090

SEQ ID NO: 1156 - protein, 1710 aa, Homo sapiens; identical to SEQ ID NO: 1094

SEQ ID NO: 1157 - protein, 1715 aa, Homo sapiens
MERCSRCHRLLLLLPLVLGLSAAPGWAGAPPVDVLRALRFPSLPDGVRRAKGICPADVAYRVARPAQLSAPTRQLFPGGFPKDFSLLTVVRTRPGLQAPLLTLYSAQGVRQLGLELGRPVRFLYEDQTGRPQPPSQPVFRGLSLADGKWHRVAVAVKGQSVTLIVDCKKRVTRPLPRSARPVLDTHGVIIFGARILDEEVFEGDVQELAIVPGVQAAYESCEQKELECEGGQRERPQNQQPHRAQRSPQQQPSRLHRPQNQEPQSQPTESLYYDYKPPYYDVMTTGTTPDYQEQTDLQVPPTADRFQAEEYGEGGTDPPEGPYDYTYGYGDDYREETELGPALSAETAHSGAAAHGPRGLKGEKGEPAVLEPGMLVEGPPGPEGPAGLIGPPGIQGNPGPVGDPGERGPPGRAGLPGSDGAPGPPGTSLMLPFRFGSGGGDKGPVVAAQEAQAQAILQQARLALRGPPGPMGYTGRPGPLGQPGSPGLKGESGDLGPQGPRGPQGLTGPPGKAGRRGRAGADGARGMPGDPGVKGDRGFDGLPGLPGEKGHRGDTGAQGLPGPPGEDGERGDDGEIGPRGLPGESGPRGLLGPKGPPGIPGPPGVRGMDGPQGPKGSLGPQGEPGPPGQQGTPGTQGLPGPQGAIGPHGEKGPQGKPGLPGMPGSDGPPGHPGKEGPPGTKGNQGPSGPQGPLGYPGPRGVKGVDGIRGLKGHKGEKGEDGFPGFKGDIGVKGDRGEVGVPGSRGEDGPEGPKGRTGPTGDPGPPGLMGEKGKLGVPGLPGYPGRQGPKGSLGFPGFPGASGEKGARGLSGKSGPRGERGPTGPRGQRGPRGATGKSGAKGTSGGDGPHGPPGERGLPGPQGPNGFPGPKGPPGPPGKDGLPGHPGQRGEVGFQGKTGPPGPPGVVGPQGAAGETGPMGERGHPGPPGPPGEQGLPGTAGKEGTKGDPGPPGAPGKDGPAGLRGFPGERGLPGTAGGPGLKGNEGPSGPPGPAGSPGERGAAGSGGPIGPPGRPGPQGPPGAAGEKGVPGEKGPIGPTGRDGVQGPVGLPGPAGPPGVAGEDGDKGEVGDPGQKGTKGNKGEHGPPGPPGPIGPVGQPGAAGADGEPGARGPQGHFGAKGDEGTRGFNGPPGPIGLQGLPGPSGEKGETGDVGPMGPPGPPGPRGPAGPNGADGPQGPPGGVGNLGPPGEKGEPGESGSPGIQGEPGVKGPRGERGEKGESGQPGEPGPPGPKGPTGDDGPKGNPGPVGFPGDPGPPGEGGPRGQDGAKGDRGEDGEPGQPGSPGPTGENGPPGPLGKRGPAGSPGSEGRQGGKGAKGDPGAIGAPGKTGPVGPAGPAGKPGPDGLRGLPGSVGQQGRPGATGQAGPPGPVGPPGLPGLRGDAGAKGEKGHPGLIGLIGPPGEQGEKGDRGLPGPQGSPGQKGEMGIPGASGPIGPGGPPGLPGPAGPKGAKGATGPGGPKGEKGVQGPPGHPGPPGEVIQPLPIQMPKKTRRSVDGSRLMQEDEAIPTGGAPGSPGGLEEIFGSLDSLREEIEQMRRPTGTQDSPARTCQDLKLCHPELPDGEYWVDPNQGCARDAFRVFCNFTAGGETCVTPRDDVTQFSYVDSEGSPVGVVQLTFLRLLSVSAHQDVSYPCSGAARDGPLRLRGANEDELSPETSPYVKEFRDGCQTQQGRTVLEVRTPVLEQLPVLDASFSDLGAPPRRGGVLLGPVCFMG

SEQ ID NO: 1158 - protein, 1715 aa, Homo sapiens
MERCSRCHRLLLLLPLVLGLSAAPGWAGAPPVDVLRALRFPSLPDGVRRAKGICPADVAYRVARPAQLSAPTRQLFPGGFPKDFSLLTVVRTRPGLQAPLLTLYSAQGVRQLGLELGPPVRFLYEDQTGRPQPPSQPVFRGLSLADGKWHRVAVAVKGQSVTLIVDCKKRVTRPLPRSARPVLDTHGVIIFGARILDEEVFEGDVQELAIVPGVQAAYESCEQKELECEGGQRERPQNQQPHRAQRSPQQQPSRLHRPQNQEPQSQPTESLYYDYKPPYYDVMTTGTTPDYQEQTDLQVPPTADRFQAEEYGEGGTDPPEGPYDYTYGYGDDYREETELGPALSAETAHSGAAAHGPRGLKGEKGEPAVLEPGMLVEGPPGPEGPAGLIGPPGIQGNPGPVGDPGERGPPGRAGLPGSDGAPGPPGTSLMLPFRFGSGGGDKGPVVAAQEAQAQAILQQARLALRGPPGPMGYTGRPGPLGQPGSPGLKGESGDLGPQGPRGPQGLTGPPGKAGRRGRAGADGARGMPGDPGVKGDRGFDGLPGLPGEKGHRGDTGAQGLPGPPGEDGERGDDGEIGPRGLPGESGPRGLLGPKGPPGIPGPPGVRGMDGPQGPKGSLGPQGEPGPPGQQGTPGTQGLPGPQGAIGPHGEKGPQGKPGLPGMPGSDGPPGHPGKEGPPGTKGNQGPSGPQGPLGYPGPRGVKGVDGIRGLKGHKGEKGEDGFPGFKGDIGVKGDRGEVGVPGSRGEDGPEGPKGRTGPTGDPGPPGLMGEKGKLGVPGLPGYPGRQGPKGSLGFPGFPGASGEKGARGLSGKSGPRGERGPTGPRGQRGPRGATGKSGAKGTSGGDGPHGPPGERGLPGPQGPNGFPGPKGPPGPPGKDGLPGHPGQRGEVGFQGKTGPPGPPGVVGPQGAAGETGPMGERGHPGPPGPPGEQGLPGTAGKEGTKGDPGPPGAPGKDGPAGLRGFPGERGLPGTAGGPGLKGNEGPSGPPGPAGSPGERGAAGSGGPIGPPGRPGPQGPPGAAGEKGVPGEKGPIGPTGRDGVQGPVGLPGPAGPPGVAGEDGDKGEVGDPGQKGTKGNKGEHGPPGPPGPIGPVGQPGAAGADGEPGARGPQGHFGAKGDEGTRGFNGPPGPIGLQGLPGPSGEKGETGDVGPMGPPGPPGPRGPAGPNGADGPQGPPGGVGNLGPPGEKGEPGESGSPGIQGEPGVKGPRGERGEKGESGQPGEPGPPGPKGPTGDDGPKGNPGPVGFPGDPGPPGEGGPRGQDGAKGDRGEDGEPGQPGSPGPTGENGPPGPLGKRGPAGSPGSEGRQGGKGAKGDPGAIGAPGKTGPVGPAGPAGKPGPDGLRGLPGSVGQQGRPGATGQAGPPGPVGPPGLPGLRGDAGAKGEKGHPGLIGLIGPPGEQGEKGDRGLPGPQGSPGQKGEMGIPGASGPIGPGGPPGLPGPAGPKGAKGATGPGGPKGEKGVQGPPGHPGPPGEVIQPLPIQMPKKTRRSVDGSRLMQEDEAIPTGGAPGSPGGLEEIFGSLDSLREEIEQMRRPTGTQDSPARTCQDLKLCHPELPDGEYWVDPNQGCARDAFRVFCNFTAGGETCVTPRDDVTQFSYVDSEGSPVGVVQLTFLRLLSVSAHQDVSYPCSGAARDGPLRLRGANEDELSPETSPYVKEFRDGCQTQQGRTVLEVRTPVLEQLPVLDASFSDLGAPPRRGGVLLGPVCFMG

SEQ ID NO: 1159 - protein, 1676 aa, Homo sapiens; identical to SEQ ID NO: 1124

SEQ ID NO: 1160 - protein, 1655 aa, Homo sapiens; identical to SEQ ID NO: 1122

SEQ ID NO: 1161 - protein, 1715 aa, Homo sapiens; identical to SEQ ID NO: 1157

SEQ ID NO: 1162 - protein, 3063 aa, Homo sapiens
MRSRLPPALAALGAALLLSSIEAEVDPPSDLNFKIIDENTVHMSWAKPVDPIVGYRITVDPTTDGPTKEFTLSASTTETLLSELVPETEYVVTITSYDEVEESVPVIGQLTIQTGSSTKPVEKKPGKTEIQKCSVSAWTDLVFLVDGSWSVGRNNFKYILDFIAALVSAFDIGEEKTRVGVVQYSSDTRTEFNLNQYYQRDELLAAIKKIPYKGGNTMTGDAIDYLVKNTFTESAGARVGFPKVAIIITDGKSQDEVEIPARELRNVGVEVFSLGIKAADAKELKQIASTPSLNHVFNVANFDAIVDIQNEIISQVCSGVDEQLGELVSGEEVVEPPSNLIAMEVSSKYVKLNWNPSPSPVTGYKVILTPMTAGSRQHALSVGPQTTTLSVRDLSADTEYQISVSAMKGMTSSEPISIMEKTQPMKVQVECSRGVDIKADIVFLVDGSYSIGIANFVKVRAFLEVLVKSFEISPNRVQISLVQYSRDPHTEFTLKKFTKVEDIIEAINTFPYRGGSTNTGKAMTYVREKIFVPSKGSRSNVPKVMILITDGKSSDAFRDPAIKLRNSDVEIFAVGVKDAVRSELEAIASPPAETHVFTVEDFDAFQRISFELTQSICLRIEQELAAIKKKAYVPPKDLSFSEVTSYGFKTNWSPAGENVFSYHITYKEAAGDDEVTVVEPASSTSVVLSSLKPETLYLVNVTAEYEDGFSIPLAGEETTEEVKGAPRNLKVTDETTDSFKITWTQAPGRVLRYRIIYRPVAGGESREVTTPPNQRRRTLENLIPDTKYEVSVIPEYFSGPGTPLTGNAATEEVRGNPRDLRVSDPTTSTMKLSWSGAPGKVKQYLVTYTPVAGGETQEVTVRGDTTNTVLQGLKEGTQYALSVTALYASGAGDALFGEGTTLEERGSPQDLVTKDITDTSIGAYWTSAPGMVRGYRVSWKSLYDDVDTGEKNLPEDAIHTMIENLQPETKYRISVFATYSSGEGEPLTGDATTELSQDSKTLKVDEETENTMRVTWKPAPGKVVNYRVVYRPHGRGKQMVAKVPPTVTSTVLKRLQPQTTYDITVLPIYKMGEGKLRQGSGTTASRFKSPRNLKTSDPTMSSFRVTWEPAPGEVKGYKVTFHPTGDDRRLGELVVGPYDNTVVLEELRAGTTYKVNVFGMFDGGESSPLVGQEMTTLSDTTVMPILSSGMECLTRAEADIVLLVDGSWSIGRANFRTVRSFISRIVEVFDIGPKRVQIALAQYSGDPRTEWQLNAHRDKKSLLQAVANLPYKGGNTLTGMALNFIRQQNFRTQAGMRPRARKIGVLITDGKSQDDVEAPSKKLKDEGVELFAIGIKNADEVELKMIATDPDDTHAYNVADFESLSRIVDDLTINLCNSVKGPGDLEAPSNLVISERTHRSFRVSWTPPSDSVDRYKVEYYPVSGGKRQEFYVSRMETSTVLKDLKPETEYVVNVYSVVEDEYSEPLKGTEKTLPVPVVSLNIYDVGPTTMHVQWQPVGGATGYILSYKPVKDTEPTRPKEVRLGPTVNDMQLTDLVPNTEYAVTVQAVLHDLTSEPVTVREVTLPLPRPQDLKLRDVTHSTMNVFWEPVPGKVRKYIVRYKTPEEDVKEVEVDRSETSTSLKDLFSQTLYTVSVSAVHDEGESPPVTAQETTRPVPAPTNLKITEVTSEGFRGTWDHGASDVSLYRITWAPFGSSDKMETILNGDENTLVFENLNPNTIYEVSITAIYPDESESDDLIGSERTLPILTTQAPKSGPRNLQVYNATSNSLTVKWDPASGRVQKYRITYQPSTGEGNEQTTTIGGRQNSVVLQKLKPDTPYTITVSSLYPDGEGGRMTGRGKTKPLNTVRNLRVYDPSTSTLNVRWDHAEGNPRQYKLFYAPAAGGPEELVPIPGNTNYAILRNLQPDTSYTVTVVPVYTEGDGGRTSDTGRTLMRGLARNVQVYNPTPNSLDVRWDPAPGPVLQYRVVYSPVDGTRPSESIVVPGNTRMVHLERLIPDTLYSVNLVALYSDGEGNPSPAQGRTLPRSGPRNLRVFGETTNSLSVAWDHADGPVQQYRIIYSPTVGDPIDEYTTVPGRRNNVILQPLQPDTPYKITVIAVYEDGDGGHLTGNGRTVGLLPPQNIHISDEWYTRFRVSWDPSPSPVLGYKIVYKPVGSNEPMEAFVGEMTSYTLHNLNPSTTYDVNVYAQYDSGLSVPLTDQGTTLYLNVTDLKTYQIGWDTFCVKWSPHRAATSYRLKLSPADGTRGQEITVRGSETSHCFTGLSPDTDYGVTVFVQTPNLEGPGVSVKEHTTVKPTEAPTEPPTPPPPPTIPPARDVCKGAKADIVFLTDASWSIGDDNFNKVVKFIFNTVGGFDEISPAGIQVSFVQYSDEVKSEFKLNTYNDKALALGALQNIRYRGGNTRTGKALTFIKEKVLTWESGMRKNVPKVLVVVTDGRSQDEVKKAALVIQQSGFSVFVVGVADVDYNELANIASKPSERHVFIVDDFESFEKIEDNLITFVCETATSSCPLIYLDGYTSPGFKMLEAYNLTEKNFASVQGVSLESGSFPSYSAYRIQKNAFVNQPTADLHPNGLPPSYTIILLFRLLPETPSDPFAIWQITDRDYKPQVGVIADPSSKTLSFFNKDTRGEVQTVTFDTEEVKTLFYGSFHKVHIVVTSKSVKIYIDCYEIIEKDIKEAGNITTDGYEILGKLLKGERKSAAFQIQSFDIVCSPVWTSRDRCCDIPSRRDEGKCPAFPNSCTCTQDSVGPPGPPGPAGGPGAKGPRGERGISGAIGPPGPRGDIGPPGPQGPPGPQGPNGLSIPGEQGRQGMKGDAGEPGLPGRTGTPGLPGPPGPMGPPGDRGFTGKDGAMGPRGPPGPPGSPGSPGVTGPSGKPGKPGDHGRPGPSGLKGEKGDRGDIASQNMMRAVARQVCEQLISGQMNRFNQMLNQIPNDYQSSRNQPGPPGPPGPPGSAGARGEPGPGGRPGFPGTPGMQGPPGERGLPGEKGERGTGSSGPRGLPGPPGPQGESRTGPPGSTGSRGPPGPPGRPGNSGIRGPPGPPGYCDSSQCASIPYNGQGYPGSG

SEQ ID NO: 1163 - protein, 1899 aa, Homo sapiens
MRSRLPPALAALGAALLLSSIEAEGMECLTRAEADIVLLVDGSWSIGRANFRTVRSFISRIVEVFDIGPKRVQIALAQYSGDPRTEWQLNAHRDKKSLLQAVANLPYKGGNTLTGMALNFIRQQNFRTQAGMRPRARKIGVLITDGKSQDDVEAPSKKLKDEGVELFAIGIKNADEVELKMIATDPDDTHAYNVADFESLSRIVDDLTINLCNSVKGPGDLEAPSNLVISERTHRSFRVSWTPPSDSVDRYKVEYYPVSGGKRQEFYVSRMETSTVLKDLKPETEYVVNVYSVVEDEYSEPLKGTEKTLPVPVVSLNIYDVGPTTMHVQWQPVGGATGYILSYKPVKDTEPTRPKEVRLGPTVNDMQLTDLVPNTEYAVTVQAVLHDLTSEPVTVREVTLPLPRPQDLKLRDVTHSTMNVFWEPVPGKVRKYIVRYKTPEEDVKEVEVDRSETSTSLKDLFSQTLYTVSVSAVHDEGESPPVTAQETTRPVPAPTNLKITEVTSEGFRGTWDHGASDVSLYRITWAPFGSSDKMETILNGDENTLVFENLNPNTIYEVSITAIYPDESESDDLIGSERTLPILTTQAPKSGPRNLQVYNATSNSLTVKWDPASGRVQKYRITYQPSTGEGNEQTTTIGGRQNSVVLQKLKPDTPYTITVSSLYPDGEGGRMTGRGKTKPLNTVRNLRVYDPSTSTLNVRWDHAEGNPRQYKLFYAPAAGGPEELVPIPGNTNYAILRNLQPDTSYTVTVVPVYTEGDGGRTSDTGRTLMRGLARNVQVYNPTPNSLDVRWDPAPGPVLQYRVVYSPVDGTRPSESIVVPGNTRMVHLERLIPDTLYSVNLVALYSDGEGNPSPAQGRTLPRSGPRNLRVFGETTNSLSVAWDHADGPVQQYRIIYSPTVGDPIDEYTTVPGRRNNVILQPLQPDTPYKITVIAVYEDGDGGHLTGNGRTVGLLPPQNIHISDEWYTRFRVSWDPSPSPVLGYKIVYKPVGSNEPMEAFVGEMTSYTLHNLNPSTTYDVNVYAQYDSGLSVPLTDQGTTLYLNVTDLKTYQIGWDTFCVKWSPHRAATSYRLKLSPADGTRGQEITVRGSETSHCFTGLSPDTDYGVTVFVQTPNLEGPGVSVKEHTTVKPTEAPTEPPTPPPPPTIPPARDVCKGAKADIVFLTDASWSIGDDNFNKVVKFIFNTVGGFDEISPAGIQVSFVQYSDEVKSEFKLNTYNDKALALGALQNIRYRGGNTRTGKALTFIKEKVLTWESGMRKNVPKVLVVVTDGRSQDEVKKAALVIQQSGFSVFVVGVADVDYNELANIASKPSERHVFIVDDFESFEKIEDNLITFVCETATSSCPLIYLDGYTSPGFKMLEAYNLTEKNFASVQGVSLESGSFPSYSAYRIQKNAFVNQPTADLHPNGLPPSYTIILLFRLLPETPSDPFAIWQITDRDYKPQVGVIADPSSKTLSFFNKDTRGEVQTVTFDTEEVKTLFYGSFHKVHIVVTSKSVKIYIDCYEIIEKDIKEAGNITTDGYEILGKLLKGERKSAAFQIQSFDIVCSPVWTSRDRCCDIPSRRDEGKCPAFPNSCTCTQDSVGPPGPPGPAGGPGAKGPRGERGISGAIGPPGPRGDIGPPGPQGPPGPQGPNGLSIPGEQGRQGMKGDAGEPGLPGRTGTPGLPGPPGPMGPPGDRGFTGKDGAMGPRGPPGPPGSPGSPGVTGPSGKPGKPGDHGRPGPSGLKGEKGDRGDIASQNMMRAVARQVCEQLISGQMNRFNQMLNQIPNDYQSSRNQPGPPGPPGPPGSAGARGEPGPGGRPGFPGTPGMQGPPGERGLPGEKGERGTGSSGPRGLPGPPGPQGESRTGPPGSTGSRGPPGPPGRPGNSGIRGPPGPPGYCDSSQCASIPYNGQGYPGSG

SEQ ID NO: 1164 - protein, 2987 aa, Homo sapiens
MRSRLPPALAALGAALLLSSIEAEVDPPSDLNFKIIDENTVHMSWAKPVDPIVGYRITVDPTTDGPTKEFTLSASTTETLLSELVPETEYVVTITSYDEVEESVPVIGQLTIQTGSSTKPVEKKPGKTEIQKCSVSAWTDLVFLVDGSWSVGRNNFKYILDFIAALVSAFDIGEEKTRVGVVQYSSDTRTEFNLNQYYQRDELLAAIKKIPYKGGNTMTGDAIDYLVKNTFTESAGARVGFPKVAIIITDGKSQDEVEIPARELRNVGVEVFSLGIKAADAKELKQIASTPSLNHVFNVANFDAIVDIQNEIISQVCSGVDEQLGELVSGEEVVEPPSNLIAMEVSSKYVKLNWNPSPSPVTGYKVILTPMTAGSRQHALSVGPQTTTLSVRDLSADTEYQISVSAMKGMTSSEPISIMEKTQPMKVQVECSRGVDIKADIVFLVDGSYSIGIANFVKVRAFLEVLVKSFEISPNRVQISLVQYSRDPHTEFTLKKFTKVEDIIEAINTFPYRGGSTNTGKAMTYVREKIFVPSKGSRSNVPKVMILITDGKSSDAFRDPAIKLRNSDVEIFAVGVKDAVRSELEAIASPPAETHVFTVEDFDAFQRISFELTQSICLRIEQELAAIKKKAYVPPKDLSFSEVTSYGFKTNWSPAGENVFSYHITYKEAAGDDEVTVVEPASSTSVVLSSLKPETLYLVNVTAEYEDGFSIPLAGEETTEEVKGAPRNLKVTDETTDSFKITWTQAPGRVLRYRIIYRPVAGGESREVTTPPNQRRRTLENLIPDTKYEVSVIPEYFSGPGTPLTGNAATEEVRGNPRDLRVSDPTTSTMKLSWSGAPGKVKQYLVTYTPVAGGETQEVTVRGDTTNTVLQGLKEGTQYALSVTALYASGAGDALFGEGTTLEERGSPQDLVTKDITDTSIGAYWTSAPGMVRGYRVSWKSLYDDVDTGEKNLPEDAIHTMIENLQPETKYRISVFATYSSGEGEPLTGDATTELSQDSKTLKVDEETENTMRVTWKPAPGKVVNYRVVYRPHGRGKQMVAKVPPTVTSTVLKRLQPQTTYDITVLPIYKMGEGKLRQGSGTTASRFKSPRNLKTSDPTMSSFRVTWEPAPGEVKGYKVTFHPTGDDRRLGELVVGPYDNTVVLEELRAGTTYKVNVFGMFDGGESSPLVGQEMTTLSDTTVMPILSSGMECLTRAEADIVLLVDGSWSIGRANFRTVRSFISRIVEVFDIGPKRVQIALAQYSGDPRTEWQLNAHRDKKSLLQAVANLPYKGGNTLTGMALNFIRQQNFRTQAGMRPRARKIGVLITDGKSQDDVEAPSKKLKDEGVELFAIGIKNADEVELKMIATDPDDTHAYNVADFESLSRIVDDLTINLCNSVKGPGDLEAPSNLVISERTHRSFRVSWTPPSDSVDRYKVEYYPVSGGKRQEFYVSRMETSTVLKDLKPETEYVVNVYSVVEDEYSEPLKGTEKTLPVPVVSLNIYDVGPTTMHVQWQPVGGATGYILSYKPVKDTEPTRPKEVRLGPTVNDMQLTDLVPNTEYAVTVQAVLHDLTSEPVTVREVTLPLPRPQDLKLRDVTHSTMNVFWEPVPGKVRKYIVRYKTPEEDVKEVEVDRSETSTSLKDLFSQTLYTVSVSAVHDEGESPPVTAQETTRPVPAPTNLKITEVTSEGFRGTWDHGASDVSLYRITWAPFGSSDKMETILNGDENTLVFENLNPNTIYEVSITAIYPDESESDDLIGSERTLPILTTQAPKSGPRNLQVYNATSNSLTVKWDPASGRVQKYRITYQPSTGEGNEQTTTIGGRQNSVVLQKLKPDTPYTITVSSLYPDGEGGRMTGRGKTKPLNTVRNLRVYDPSTSTLNVRWDHAEGNPRQYKLFYAPAAGGPEELVPIPGNTNYAILRNLQPDTSYTVTVVPVYTEGDGGRTSDTGRTLMRGLARNVQVYNPTPNSLDVRWDPAPGPVLQYRVVYSPVDGTRPSESIVVPGNTRMVHLERLIPDTLYSVNLVALYSDGEGNPSPAQGRTLPRSGPRNLRVFGETTNSLSVAWDHADGPVQQYRIIYSPTVGDPIDEYTTVPGRRNNVILQPLQPDTPYKITVIAVYEDGDGGHLTGNGRTVGLLPPQNIHISDEWYTRFRVSWDPSPSPVLGYKIVYKPVGSNEPMEAFVGEMTSYTLHNLNPSTTYDVNVYAQYDSGLSVPLTDQGTTLYLNVTDLKTYQIGWDTFCVKWSPHRAATSYRLKLSPADGTRGQEITVRGSETSHCFTGLSPDTDYGVTVFVQTPNLEGPGVSVKEHTTVKPTEAPTEPPTPPPPPTIPPARDVCKGAKADIVFLTDASWSIGDDNFNKVVKFIFNTVGGFDEISPAGIQVSFVQYSDEVKSEFKLNTYNDKALALGALQNIRYRGGNTRTGKALTFIKEKVLTWESGMRKNVPKVLVVVTDGRSQDEVKKAALVIQQSGFSVFVVGVADVDYNELANIASKPSERHVFIVDDFESFEKIEDNLITFVCETATSSCPLIYLDGYTSPGFKMLEAYNLTEKNFASVQGVSLESGSFPSYSAYRIQKNAFVNQPTADLHPNGLPPSYTIILLFRLLPETPSDPFAIWQITDRDYKPQVGVIADPSSKTLSFFNKDTRGEVQTVTFDTEEVKTLFYGSFHKRDEGKCPAFPNSCTCTQDSVGPPGPPGPAGGPGAKGPRGERGISGAIGPPGPRGDIGPPGPQGPPGPQGPNGLSIPGEQGRQGMKGDAGEPGLPGRTGTPGLPGPPGPMGPPGDRGFTGKDGAMGPRGPPGPPGSPGSPGVTGPSGKPGKPGDHGRPGPSGLKGEKGDRGDIASQNMMRAVARQVCEQLISGQMNRFNQMLNQIPNDYQSSRNQPGPPGPPGPPGSAGARGEPGPGGRPGFPGTPGMQGPPGERGLPGEKGERGTGSSGPRGLPGPPGPQGESRTGPPGSTGSRGPPGPPGRPGNSGIRGPPGPPGYCDSSQCASIPYNGQGYPGSG

SEQ ID NO: 1165 - protein, 695 aa, Homo sapiens
MVAERTHKAAATGARGPGELGAPGTVALVAARAERGARLPSPGSCGLLTLALCSLALSLLAHFRTAELQARVLRLEAERGEQQMETAILGRVNQLLDEKWKLHSRRRREAPKTSPGCNCPPGPPGPTGRPGLPGDKGAIGMPGRVGSPGDAGLSIIGPRGPPGQPGTRGFPGFPGPIGLDGKPGHPGPKGDMGLTGPPGQPGPQGQKGEKGQCGEYPHRECLSSMPAALRSSQIIALKGEQSQASIQGPPGPPGPPGPSGPLGHPGLPGPMGPPGLPGPPGPKGDPGIQGYHGRKGERGMPGMPGKHGAKGAPGIAVAGMKGEPGIPGTKGEKGAEGSPGLPGLLGQKGEKGDAGNSIGGGRGEPGPPGLPGPPGPKGEAGVDGQVGPPGQPGDKGERGAAGEQGPDGPKGSKGEPGKGEMVDYNGNINEALQEIRTLALMGPPGLPGQIGPPGAPGIPGQKGEIGLPGPPGHDGEKGPRGKPGDMGPPGPQGPPGKDGPPGVKGENGHPGSPGEKGEKGETGQAGSPGEKGEAGEKGNPGAEVPGLPGPEGPPGPPGLQGVPGPKGEAGLDGAKGEKGFQGEKGDRGPLGLPGASGLDGRPGPPGTPGPIGVPGPAGPKGERGSKGDPGMTGPTGAAGLPGLHGPPGDKGNRGERGKKGSRGPKGDKGDQGAPGLDAPCPLGEDGLPVQGCWNK

SEQ ID NO: 1166 - protein, 717 aa, Homo sapiens
MVAERTHKAAATGARGPGELGAPGTVALVAARAERGARLPSPGSCGLLTLALCSLALSLLAHFRTAELQARVLRLEAERGEQQMETAILGRVNQLLDEKWKLHSRRRREAPKTSPGCNCPPAFQGPTGRPGLPGDKGAIGMPGRVGSPGDAGLSIIGPRGPPGQPGTRGFPGFPGPIGLDGKPGHPGPKGDMGLTGPPGQPGPQGQKGEKGQCGEYPHRECLSSMPAALRSSQIIALKLLPLLNSVRLAPPPVIKRRTFQGEQSQASIQGPPGPPGPPGPSGPLGHPGLPGPMGPPGLPGPPGPKGDPGIQGYHGRKGERGMPGMPGKHGAKGAPGIAVAGMKGEPGIPGTKGEKGAEGSPGLPGLLGQKGEKGDAGNSIGGGRGEPGPPGLPGPPGPKGEAGVDGQVGPPGQPGDKGERGAAGEQGPDGPKGSKGEPGKGEMVDYNGNINEALQEIRTLALMGPPGLPGQIGPPGAPGIPGQKGEIGLPGPPGHDGEKGPRGKPGDMGPPGPQGPPGKDGPPGVKGENGHPGSPGEKGEKGETGQAGSPGEKGEAGEKGNPGAEVPGLPGPEGPPGPPGLQGVPGPKGEAGLDGAKGEKGFQGEKGDRGPLGLPGASGLDGRPGPPGTPGPIGVPGPAGPKGERGSKGDPGMTGPTGAAGLPGLHGPPGDKGNRGERGKKGSRGPKGDKGDQGAPGLDAPCPLGEDGLPVQGCWNK

SEQ ID NO: 1167 - protein, 683 aa, Homo sapiens
MVAERTHKAAATGARGPGELGAPGTVALVAARAERGARLPSPGSCGLLTLALCSLALSLLAHFRTAELQARVLRLEAERGEQQMETAILGRVNQLLDEKWKLHSRRRREAPKTSPGCNCPPGPPGPTGRPGLPGDKGAIGMPGRVGSPGDAGLSIIGPRGPPGQPGTRGFPGFPGPIGLDGKPGHPGPKGDMGLTGPPGQPGPQGQKGEKGQCGEYPHRECLSSMPAALRSSQIIALKGEQSQASIQGPPGPPGPPGPSGPLGHPGLPGPMGPPGLPGPPGPKGDPGIQGYHGRKGERGMPGMPGKHGAKGAPGIAVAGMKGEPGIPGTKGEKGAEGSPGLPGLLGQKGEKGDAGNSIGGGRGEPGPPGLPGPPGPKGEAGVDGQVGPPGQPGDKGERGAAGEQGPDGPKGSKGEPGKGEMVDYNGNINEALQEIRTLALMGPPGLPGQIGPPGAPGIPGQKGEIGLPGPPGHDGEKGPRGKPGDMGPPGPQGPPGKDGPPGVKGENGHPGSPGEKGEKGETGQAGSPGEKGEAGEKGNPGAEVPGLPGPEGPPGPPGLQGVPGPKGEAGLDGAKGEKGFQGEKGDRGPLGLPGTPGPIGVPGPAGPKGERGSKGDPGMTGPTGAAGLPGLHGPPGDKGNRGERGKKGSRGPKGDKGDQGAPGLDAPCPLGEDGLPVQGCWNK

SEQ ID NO: 1168 - protein, 688 aa, Homo sapiens
MVAERTHKAAATGARGPGELGAPGTVALVAARAERGARLPSPGSCGLLTLALCSLALSLLAHFRTAELQARVLRLEAERGEQQMETAILGRVNQLLDEKWKLHSRRRREAPKTSPGCNCPPAFQGPTGRPGLPGQPGTRGFPGFPGPIGLDGKPGHPGPKGDMGLTGPPGQPGPQGQKGEKGQCGEYPHRECLSSMPAALRSSQIIALKLLPLLNSVRLAPPPVIKRRTFQGEQSQASIQGPPGPPGPPGPSGPLGHPGLPGPMGPPGLPGPPGPKGDPGIQGYHGRKGERGMPGMPGKHGAKGAPGIAVAGMKGEPGIPGTKGEKGAEGSPGLPGLLGQKGEKGDAGNSIGGGRGEPGPPGLPGPPGPKGEAGVDGQVGPPGQPGDKGERGAAGEQGPDGPKGSKGEPGKGEMVDYNGNINEALQEIRTLALMGPPGLPGQIGPPGAPGIPGQKGEIGLPGPPGHDGEKGPRGKPGDMGPPGPQGPPGKDGPPGVKGENGHPGSPGEKGEKGETGQAGSPGEKGEAGEKGNPGAEVPGLPGPEGPPGPPGLQGVPGPKGEAGLDGAKGEKGFQGEKGDRGPLGLPGASGLDGRPGPPGTPGPIGVPGPAGPKGERGSKGDPGMTGPTGAAGLPGLHGPPGDKGNRGERGKKGSRGPKGDKGDQGAPGLDAPCPLGEDGLPVQGCWNK

SEQ ID NO: 1169 - protein, 695 aa, Homo sapiens
MVAERTHKAAATGARGPGELGAPGTVALVAARAERGARLPSPGSCGLLTLALCSLALSLLAHFRTAELQARVLRLEAERGEQQMETAILGRVNQLLDEKWKLHSRRRREAPKTSPGCNCPPAFQGPTGRPGLPGDKGAIGMPGRVGSPGDAGLSIIGPRGPPGQPGTRGFPGFPGPIGLDGKPGHPGPKGDMGLTGPPGQPGPQGQKGEKGQCGEYPHRECLSSMPAALRSSQIIALKGEQSQASIQGPPGPPGPPGPSGPLGHPGLPGPMGPPGLPGPPGPKGDPGIQGYHGRKGERGMPGMPGKHGAKGAPGIAVAGMKGEPGIPGTKGEKGAEGSPGLPGLLGQKGEKGDAGNSIGGGRGEPGPPGLPGPPGPKGEAGVDGQVGPPGQPGDKGERGAAGEQGPDGPKGSKGEPGKGEMVDYNGNINEALQEIRTLALMGPPGLPGQIGPPGAPGIPGQKGEIGLPGPPGHDGEKGPRGKPGDMGPPGPQGPPGKDGPPGVKGENGHPGSPGEKGEKGETGQAGSPGEKGEAGEKGNPGAEVPGLPGPEGPPGPPGLQGVPGPKGEAGLDGAKGEKGFQGEKGDRGPLGLPGASGLDGRPGPPGTPGPIGVPGPAGPKGERGSKGDPGMTGPTGAAGLPGLHGPPGDKGNRGERGKKGSRGPKGDKGDQGAPGLDAPCPLGEDGLPVQGCWNK

SEQ ID NO: 1170 - protein, 698 aa, Homo sapiens
MVAERTHKAAATGARGPGELGAPGTVALVAARAERGARLPSPGSCGLLTLALCSLALSLLAHFRTAELQARVLRLEAERGEQQMETAILGRVNQLLDEKWKLHSRRRREAPKTSPGCNCPPAFQGPTGRPGLPGDKGAIGMPGRVGSPGDAGLSIIGPRGPPGQPGTRGFPGFPGPIGLDGKPGHPGPKGDMGLTGPPGQPGPQGQKGEKGQCGEYPHRLLPLLNSVRLAPPPVIKRRTFQGEQSQASIQGPPGPPGPPGPSGPLGHPGLPGPMGPPGLPGPPGPKGDPGIQGYHGRKGERGMPGMPGKHGAKGAPGIAVAGMKGEPGIPGTKGEKGAEGSPGLPGLLGQKGEKGDAGNSIGGGRGEPGPPGLPGPPGPKGEAGVDGQVGPPGQPGDKGERGAAGEQGPDGPKGSKGEPGKGEMVDYNGNINEALQEIRTLALMGPPGLPGQIGPPGAPGIPGQKGEIGLPGPPGHDGEKGPRGKPGDMGPPGPQGPPGKDGPPGVKGENGHPGSPGEKGEKGETGQAGSPGEKGEAGEKGNPGAEVPGLPGPEGPPGPPGLQGVPGPKGEAGLDGAKGEKGFQGEKGDRGPLGLPGASGLDGRPGPPGTPGPIGVPGPAGPKGERGSKGDPGMTGPTGAAGLPGLHGPPGDKGNRGERGKKGSRGPKGDKGDQGAPGLDAPCPLGEDGLPVQGCWNK

SEQ ID NO: 1171 - protein, 645 aa, Homo sapiens
MVAERTHKAAATGARGPGELGAPGTVALVAARAERGARLPSPGSCGLLTLALCSLALSLLAHFRTAELQARVLRLEAERGEQQMETAILGRVNQLLDEKWKLHSRRRREAPKTSPGCNCPPGPPGQPGTRGFPGFPGPIGLDGKPGHPGPKGDMGLTGPPGQPGPQGQKGEKGQCGEYPHRLLPLLNSVRLAPPPVIKRRTFQGEQSQASIQGPPGPPGPPGPSGPLGHPGLPGPMGPPGLPGPPGPKGDPGIQGYHGRKGERGMPGMPGKHGAKGAPGIAVAGMKGEPGIPGTKGEKGAEGSPGLPGLLGQKGEKGDAGNSIGGGRGEPGPPGLPGPPGPKGEAGVDGQVGPPGQPGDKGERGAAGEQGPDGPKGSKGEPGKGEMVDYNGNINEALQPSRGPALRGPPGLPGQIGPPGAPGIPGQKGEIGLPGPPGHDGEKGPRGKPGDMGPPGPQGPPGKDGPPGVKGENGHPGSPGEKGEKGETGQAGSPVPGLPGPEGPPGPPGLQGVPGPKGEAGLDGAKGEKGFQGEKGDRGPLGLPGASGLDGRPGPPGTPGPIGVPGPAGPKGERGSKGDPGMTGPTGAAGLPGLHGPPGDKGNRGERGKKGSRGPKGDKGDQGAPGLDAPCPLGEDGLPVQGCWNK

SEQ ID NO: 1172 - protein, 702 aa, Homo sapiens
MVAERTHKAAATGARGPGELGAPGTVALVAARAERGARLPSPGSCGLLTLALCSLALSLLAHFRTAELQARVLRLEAERGEQQMETAILGRVNQLLDEKWKLHSRRRREAPKTSPGCNCPPAFQGPTGRPGLPGDKGAIGMPGRVGSPGDAGLSIIGPRGPPGQPGTRGFPGFPGPIGLDGKPGHPGPKGDMGLTGPPGQPGPQGQKGEKGQCGEYPHRECLSSMPAALRSSQIIALKLLPLLNSVRLAPPPVIKRRTFQGEQSQASIQGPPGPPGPPGPSGPLGHPGLPGPMGPPGLPGPPGPKGDPGIQGYHGRKGERGMPGMPGKHGAKGAPGIAVAGMKGEPGIPGTKGEKGAEGSPGLPGLLGQKGEKGDAGNSIGGGRGEPGPPGLPGPPGPKGEAGVDGQVGPPGQPGDKGERGAAGEQGPDGPKGSKGEPGKGEMVDYNGNINEALQEIRTLALMGPPGLPGQIGPPGAPGIPGQKGEIGLPGPPGHDGEKGPRGKPGDMGPPGPQGPPGKDGPPGVKGENGHPGSPGEKGEKGETGQAGSPVPGLPGPEGPPGPPGLQGVPGPKGEAGLDGAKGEKGFQGEKGDRGPLGLPGASGLDGRPGPPGTPGPIGVPGPAGPKGERGSKGDPGMTGPTGAAGLPGLHGPPGDKGNRGERGKKGSRGPKGDKGDQGAPGLDAPCPLGEDGLPVQGCWNK

SEQ ID NO: 1173 - protein, 703 aa, Homo sapiens
MVAERTHKAAATGARGPGELGAPGTVALVAARAERGARLPSPGSCGLLTLALCSLALSLLAHFRTAELQARVLRLEAERGEQQMETAILGRVNQLLDEKWKLHSRRRREAPKTSPGCNCPPGPPGPTGRPGLPGDKGAIGMPGRVGSPGDAGLSIIGPRGPPGQPGTRGFPGFPGPIGLDGKPGHPGPKGDMGLTGPPGQPGPQGQKGEKGQCGEYPHRECLSSMPAALRSSQIIALKLLPLLNSVRLAPPPVIKRRTFQGEQSQASIQGPPGPPGPPGPSGPLGHPGLPGPMGPPGLPGPPGPKGDPGIQGYHGRKGERGMPGMPGKHGAKGAPGIAVAGMKGEPGIPGTKGEKGAEGSPGLPGLLGQKGEKGDAGNSIGGGRGEPGPPGLPGPPGPKGEAGVDGQVGPPGQPGDKGERGAAGEQGPDGPKGSKGEPGKGEMVDYNGNINEALQPSRGPALRGPPGLPGQIGPPGAPGIPGQKGEIGLPGPPGHDGEKGPRGKPGDMGPPGPQGPPGKDGPPGVKGENGHPGSPGEKGEKGETGQAGSPGEKGEAGEKGNPGAEGLQGVPGPKGEAGLDGAKGEKGFQGEKGDRGPLGLPGASGLDGRPGPPGTPGPIGVPGPAGPKGERGSKGDPGMTGPTGAAGLPGLHGPPGDKGNRGERGKKGSRGPKGDKGDQGAPGLDAPCPLGEDGLPVQGCWNK

SEQ ID NO: 1174 - protein, 691 aa, Homo sapiens
MVAERTHKAAATGARGPGELGAPGTVALVAARAERGARLPSPGSCGLLTLALCSLALSLLAHFRTAELQARVLRLEAERGEQQMETAILGRVNQLLDEKWKLHSRRRREAPKTSPGCNCPPGPPGPTGRPGLPGDKGAIGMPGRVGSPGDAGLSIIGPRGPPGQPGTRGFPGFPGPIGLDGKPGHPGPKGDMGLTGPPGQPGPQGQKGEKGQCGEYPHRECLSSMPAALRSSQIIALKLLPLLNSVRLAPPPVIKRRTFQGEQSQASIQGPPGPPGPPGPSGPLGHPGLPGPMGPPGLPGPPGPKGDPGIQGYHGRKGERGMPGMPGKHGAKGAPGIAVAGMKGEPGIPGTKGEKGAEGSPGLPGLLGQKGEKGDAGNSIGGGRGEPGPPGLPGPPGPKGEAGVDGQVGPPGQPGDKGERGAAGEQGPDGPKGSKGEPGKGEMVDYNGNINEALQPSRGPALRGPPGLPGQIGPPGAPGIPGQKGEIGLPGPPGHDGEKGPRGKPGDMGPPGPQGPPGKDGPPGVKGENGHPGSPGEKGEKGETGQAGSPGEKGEAGEKGNPGAEGLQGVPGPKGEAGLDGAKGEKGFQGEKGDRGPLGLPGTPGPIGVPGPAGPKGERGSKGDPGMTGPTGAAGLPGLHGPPGDKGNRGERGKKGSRGPKGDKGDQGAPGLDAPCPLGEDGLPVQGCWNK

SEQ ID NO: 1175 - protein, 705 aa, Homo sapiens
MVAERTHKAAATGARGPGELGAPGTVALVAARAERGARLPSPGSCGLLTLALCSLALSLLAHFRTAELQARVLRLEAERGEQQMETAILGRVNQLLDEKWKLHSRRRREAPKTSPGCNCPPAFQGPTGRPGLPGSPGDAGLSIIGPRGPPGQPGTRGFPGFPGPIGLDGKPGHPGPKGDMGLTGPPGQPGPQGQKGEKGQCGEYPHRECLSSMPAALRSSQIIALKLLPLLNSVRLAPPPVIKRRTFQGEQSQASIQGPPGPPGPPGPSGPLGHPGLPGPMGPPGLPGPPGPKGDPGIQGYHGRKGERGMPGMPGKHGAKGAPGIAVAGMKGEPGIPGTKGEKGAEGSPGLPGLLGQKGEKGDAGNSIGGGRGEPGPPGLPGPPGPKGEAGVDGQVGPPGQPGDKGERGAAGEQGPDGPKGSKGEPGKGEMVDYNGNINEALQEIRTLALMGPPGLPGQIGPPGAPGIPGQKGEIGLPGPPGHDGEKGPRGKPGDMGPPGPQGPPGKDGPPGVKGENGHPGSPGEKGEKGETGQAGSPGEKGEAGEKGNPGAEVPGLPGPEGPPGPPGLQGVPGPKGEAGLDGAKGEKGFQGEKGDRGPLGLPGASGLDGRPGPPGTPGPIGVPGPAGPKGERGSKGDPGMTGPTGAAGLPGLHGPPGDKGNRGERGKKGSRGPKGDKGDQGAPGLDAPCPLGEDGLPVQGCWNK

SEQ ID NO: 1176 - protein, 717 aa, Homo sapiens
MVAERTHKAAATGARGPGELGAPGTVALVAARAERGARLPSPGSCGLLTLALCSLALSLLAHFRTAELQARVLRLEAERGEQQMETAILGRVNQLLDEKWKLHSRRRREAPKTSPGCNCPPGPPGPTGRPGLPGDKGAIGMPGRVGSPGDAGLSIIGPRGPPGQPGTRGFPGFPGPIGLDGKPGHPGPKGDMGLTGPPGQPGPQGQKGEKGQCGEYPHRECLSSMPAALRSSQIIALKLLPLLNSVRLAPPPVIKRRTFQGEQSQASIQGPPGPPGPPGPSGPLGHPGLPGPMGPPGLPGPPGPKGDPGIQGYHGRKGERGMPGMPGKHGAKGAPGIAVAGMKGEPGIPGTKGEKGAEGSPGLPGLLGQKGEKGDAGNSIGGGRGEPGPPGLPGPPGPKGEAGVDGQVGPPGQPGDKGERGAAGEQGPDGPKGSKGEPGKGEMVDYNGNINEALQEIRTLALMGPPGLPGQIGPPGAPGIPGQKGEIGLPGPPGHDGEKGPRGKPGDMGPPGPQGPPGKDGPPGVKGENGHPGSPGEKGEKGETGQAGSPGEKGEAGEKGNPGAEVPGLPGPEGPPGPPGLQGVPGPKGEAGLDGAKGEKGFQGEKGDRGPLGLPGASGLDGRPGPPGTPGPIGVPGPAGPKGERGSKGDPGMTGPTGAAGLPGLHGPPGDKGNRGERGKKGSRGPKGDKGDQGAPGLDAPCPLGEDGLPVQGCWNK

SEQ ID NO: 1177 - protein, 668 aa, Homo sapiens
MVAERTHKAAATGARGPGELGAPGTVALVAARAERGARLPSPGSCGLLTLALCSLALSLLAHFRTAELQARVLRLEAERGEQQMETAILGRVNQLLDEKWKLHSRRRREAPKTSPGCNCPPGPPGPTGRPGLPGDKGAIGMPGRVGSPGDAGLSIIGPRGPPGQPGTRGFPGFPGPIGLDGKPGHPGPKGDMGLTGPPGQPGPQGQKGEKGQCGEYPHRECLSSMPAALRSSQIIALKGEQSQASIQGPPGPPGPPGPSGPLGHPGLPGPMGPPGLPGPPGPKGDPGIQGYHGRKGERGMPGMPGKHGAKGAPGIAVAGMKGEPGIPGTKGEKGAEGSPGLPGLLGQKGEKGDAGNSIGGGRGEPGPPGLPGPPGPKGEAGVDGQVGPPGQPGDKGERGAAGEQGPDGPKGSKGEPGKGEMVDYNGNINEALQEIRTLALMGPPGLPGQIGPPGAPGIPGQKGEIGLPGPPGHDGEKGPRGKPGDMGPPGPQGPPGKDGPPGVKGENGHPGSPGEKGEKGETGQAGSPVPGLPGPEGPPGPPGLQGVPGPKGEAGLDGAKGEKGFQGEKGDRGPLGLPGTPGPIGVPGPAGPKGERGSKGDPGMTGPTGAAGLPGLHGPPGDKGNRGERGKKGSRGPKGDKGDQGAPGLDAPCPLGEDGLPVQGCWNK

SEQ ID NO: 1178 - protein, 610 aa, Homo sapiens
MVAERTHKAAATGARGPGELGAPGTVALVAARAERGARLPSPGSCGLLTLALCSLALSLLAHFRTAELQARVLRLEAERGEQQMETAILGRVNQLLDEKWKLHSRRRREAPKTSPGCNCPPGPPGPTGRPGLPGQPGTRGFPGFPGPIGLDGKPGHPGPKGDMGLTGPPGQPGPQGQKGEKGQCGEYPHRECLSSMPAALRSSQIIALKGEQSQASIQGPPGPPGPPGPSGPLGHPGLPGPMGPPGLPGPPGPKGDPGIQGYHGRKGERGMPGMPGKHGAKGAPGIAVAGMKGEPGIPGTKGEKGAEGSPGLPGLLGQKGEKGDAGNSIGGGRGEPGPPGLPGPPGPKGEAGVDGQVGPPGQPGDKGERGAAGEQGPDGPKGSKGEPGKGEMVDYNGNINEALQEIRTLALMGPPGLPGQIGPPGAPGIPGQKGEIGLPGPPGHDGEKGPRGKPGDMGPPGPQGPPGKDGPPGVKGENGHPGSPGEKGEKGETGQAGSPVPGLPGPEGPPGPPGLQGVPGPKGEAGLDGAKGEKGFQGEKGDRGPLGLPGTPGPIGVPGPAGPKGERGSKGDPGMTGPTGAAGLPGLHGPPGDKGNRGEDGLPVQGCWNK

SEQ ID NO: 1179 - protein, 645 aa, Homo sapiens
MVAERTHKAAATGARGPGELGAPGTVALVAARAERGARLPSPGSCGLLTLALCSLALSLLAHFRTAELQARVLRLEAERGEQQMETAILGRVNQLLDEKWKLHSRRRREAPKTSPGCNCPPGPPGQPGTRGFPGFPGPIGLDGKPGHPGPKGDMGLTGPPGQPGPQGQKGEKGQCGEYPHRLLPLLNSVRLAPPPVIKRRTFQGEQSQASIQGPPGPPGPPGPSGPLGHPGLPGPMGPPGLPGPPGPKGDPGIQGYHGRKGERGMPGMPGKHGAKGAPGIAVAGMKGEPGIPGTKGEKGAEGSPGLPGLLGQKGEKGDAGNSIGGGRGEPGPPGLPGPPGPKGEAGVDGQVGPPGQPGDKGERGAAGEQGPDGPKGSKGEPGKGEMVDYNGNINEALQEIRTLALMGPPGLPGQIGPPGAPGIPGQKGEIGLPGPPGHDGEKGPRGKPGDMGPPGPQGPPGKDGPPGVKGENGHPGSPGEKGEKGETGQAGSPVPGLPGPEGPPGPPGLQGVPGPKGEAGLDGAKGEKGFQGEKGDRGPLGLPGASGLDGRPGPPGTPGPIGVPGPAGPKGERGSKGDPGMTGPTGAAGLPGLHGPPGDKGNRGERGKKGSRGPKGDKGDQGAPGLDAPCPLGEDGLPVQGCWNK

SEQ ID NO: 1180 - protein, 1701 aa, Homo sapiens
MKIFQRKMRYWLLPPFLAIVYFCTIVQGQVAPPTRLRYNVISHDSIQISWKAPRGKFGGYKLLVTPTSGGKTNQLNLQNTATKAIIQGLMPDQNYTVQIIAYNKDKESKPAQGQFRIKDLEKRKDPKPRVKVVDRGNGSRPSSPEEVKFVCQTPAIADIVILVDGSWSIGRFNFRLVRHFLENLVTAFDVGSEKTRIGVKNADVNELQEIASEPDSTHVYNVAEFDLMHTVVESLTRTLCSRVEEQDREIKASAHAITGPPTELITSEVTARSFMVNWTHAPGNVEKYRVVYYPTRGGKPDEVVVDGTVSSTVLKNLMSLTEYQIAVFAIYAHTASEGLRGTETTLALPMASDLLLYDVTENSMRVKWDAVPGASGYLILYAPLTEGLAGDEKEMKIGETHTDIELSGLLPNTEYTVTVYAMFGEEASDPVTGQETTLALSPPRNLRISNVGSNSARLTWDPTSRQINGYRIVYNNADGTEINEVEVDPITTFPLKGLTPLTEYTIAIFSIYDEGQSEPLTGVFTTEEVPAQQYLEIDEVTTDSFRVTWHPLSADEGLHKLMWIPVYGGKTEEVVLKEEQDSHVIEGLEPGTEYEVSLLAVLDDGSESEVVTAVGTTLDSFWTEPATTIVPTTSVTSVFQTGIRNLVVGDETTSSLRVKWDISDSDVQQFRVTYMTAQGDPEEEVIGTVMVPGSQNNLLLKPLLPDTEYKVTVTPIYTDGEGVSVSAPGKTLPSSGPQNLRVSEEWYNRLRITWDPPSSPVKGYRIVYKPVSVPGPTLETFVGADINTILITNLLSGMDYNVKIFASQASGFSDALTGMVKTLFLGVTNLQAKHVEMTSLCAHWQVHRHATAYRVVIESLQDRQKQESTVGGGTTRHCFYGLQPDSEYKISVYTKLQEIEGPSVSIMEKTQSLPTRPPTFPPTIPPAKEVCKAAKADLVFMVDGSWSIGDENFNKIISFLYSTVGALNKIGTDGTQVAMVQFTDDPRTEFKLNAYKTKETLLDAIKHISYKGGNTKTGKAIKYVRDTLFTAESGTRRGIPKVIVVITDGRSQDDVNKISREMQLDGYSIFAIGVADADYSELVSIGSKPSARHVFFVDDFDAFKKIEDELITFVCETASATCPVVHKDGIDLAGFKMMEMFGLVEKDFSSVEGVSMEPGTFNVFPCYQLHKDALVSQPTRYLHPEGLPSDYTISFLFRILPDTPQEPFALWEILNKNSDPLVGVILDNGGKTLTYFNYDQSGDFQTVTFEGPEIRKIFYGSFHKLHIVVSETLVKVVIDCKQVGEKAMNASANITSDGVEVLGKMVRSRGPGGNSAPFQLQMFDIVCSTSWANTDKCCELPGLRDDESCPDLPHSCSCSETNEVALGPAGPPGGPGLRGPKGQQGEPGPKGPDGPRGEIGLPGPQGPPGPQGPSGLSIQGMPGMPGEKGEKGDTGLPGPQGIPGGVGSPGRDGSPGQRGLPGKDGSSGPPGPPGPIGIPGTPGVPGITGSMGPQGALGPPGVPGAKGERGERGDLQSQAMVRSVARQVCEQLIQSHMARYTAILNQIPSHSSSIRTVQGPPGEPGRPGSPGAPGEQGPPGTPGFPGNAGVPGTPGERGLTGIKGEKGNPGVGTQGPRGPPGPAGPSGESRPGSPGPPGSPGPRGPPGHLGVPGPQGPSGQPGYCDPSSCSAYGVRAPHPDQPEFTPVQDELEAMELWGPGV

SEQ ID NO: 1181 - protein, 1796 aa, Homo sapiens
MKIFQRKMRYWLLPPFLAIVYFCTIVQGQVAPPTRLRYNVISHDSIQISWKAPRGKFGGYKLLVTPTSGGKTNQLNLQNTATKAIIQGLMPDQNYTVQIIAYNKDKESKPAQGQFRIKDLEKRKDPKPRVKVVDRGNGSRPSSPEEVKFVCQTPAIADIVILVDGSWSIGRFNFRLVRHFLENLVTAFDVGSEKTRIGLAQYSGDPRIEWHLNAFSTKDEVIEAVRNLPYKGGNTLTGLALNYIFENSFKPEAGSRTGVSKIGILITDGKSQDDIIPPSRNLRESGVELFAIGVKNADVNELQEIASEPDSTHVYNVAEFDLMHTVVESLTRTLCSRVEEQDREIKASAHAITGPPTELITSEVTARSFMVNWTHAPGNVEKYRVVYYPTRGGKPDEVVVDGTVSSTVLKNLMSLTEYQIAVFAIYAHTASEGLRGTETTLALPMASDLLLYDVTENSMRVKWDAVPGASGYLILYAPLTEGLAGDEKEMKIGETHTDIELSGLLPNTEYTVTVYAMFGEEASDPVTGQETTLALSPPRNLRISNVGSNSARLTWDPTSRQINGYRIVYNNADGTEINEVEVDPITTFPLKGLTPLTEYTIAIFSIYDEGQSEPLTGVFTTEEVPAQQYLEIDEVTTDSFRVTWHPLSADEGLHKLMWIPVYGGKTEEVVLKEEQDSHVIEGLEPGTEYEVSLLAVLDDGSESEVVTAVGTTLDSFWTEPATTIVPTTSVTSVFQTGIRNLVVGDETTSSLRVKWDISDSDVQQFRVTYMTAQGDPEEEVIGTVMVPGSQNNLLLKPLLPDTEYKVTVTPIYTDGEGVSVSAPGKTLPSSGPQNLRVSEEWYNRLRITWDPPSSPVKGYRIVYKPVSVPGPTLETFVGADINTILITNLLSGMDYNVKIFASQASGFSDALTGMVKTLFLGVTNLQAKHVEMTSLCAHWQVHRHATAYRVVIESLQDRQKQESTVGGGTTRHCFYGLQPDSEYKISVYTKLQEIEGPSVSIMEKTQSLPTRPPTFPPTIPPAKEVCKAAKADLVFMVDGSWSIGDENFNKIISFLYSTVGALNKIGTDGTQVAMVQFTDDPRTEFKLNAYKTKETLLDAIKHISYKGGNTKTGKAIKYVRDTLFTAESGTRRGIPKVIVVITDGRSQDDVNKISREMQLDGYSIFAIGVADADYSELVSIGSKPSARHVFFVDDFDAFKKIEDELITFVCETASATCPVVHKDGIDLAGFKMMEMFGLVEKDFSSVEGVSMEPGTFNVFPCYQLHKDALVSQPTRYLHPEGLPSDYTISFLFRILPDTPQEPFALWEILNKNSDPLVGVILDNGGKTLTYFNYDQSGDFQTVTFEGPEIRKIFYGSFHKLHIVVSETLVKVVIDCKQVGEKAMNASANITSDGVEVLGKMVRSRGPGGNSAPFQLQMFDIVCSTSWANTDKCCELPGLRDDESCPDLPHSCSCSETNEVALGPAGPPGGPGLRGPKGQQGEPGPKGPDGPRGEIGLPGPQGPPGPQGPSGLSIQGMPGMPGEKGEKGDTGLPGPQGIPGGVGSPGRDGSPGQRGLPGKDGSSGPPGPPGPIGIPGTPGVPGITGSMGPQGALGPPGVPGAKGERGERGDLQSQAMVRSVARQVCEQLIQSHMARYTAILNQIPSHSSSIRTVQGPPGEPGRPGSPGAPGEQGPPGTPGFPGNAGVPGTPGERGLTGIKGEKGNPGVGTQGPRGPPGPAGPSGESRPGSPGPPGSPGPRGPPGHLGVPGPQGPSGQPGYCDPSSCSAYGVRAPHPDQPEFTPVQDELEAMELWGPGV

SEQ ID NO: 1182 - protein, 1780 aa, Homo sapiens
MKIFQRKMRYWLLPPFLAIVYFCTIVQGQVAPPTRLRYNVISHDSIQISWKAPRGKFGGYKLLVTPTSGGKTNQLNLQNTATKAIIQGLMPDQNYTVQIIAYNKDKESKPAQGQFRIKDLEKRKDPKPRVKVVDRGNGSRPSSPEEVKFVCQTPAIADIVILVDGSWSIGRFNFRLVRHFLENLVTAFDVGSEKTRIGLAQYSGDPRIEWHLNAFSTKDEVIEAVRNLPYKGGNTLTGLALNYIFENSFKPEAGSRTGVSKIGILITDGKSQDDIIPPSRNLRESGVELFAIGVKNADVNELQEIASEPDSTHVYNVAEFDLMHTVVESLTRTLCSRVEEQDREIKASAHAITGPPTELITSEVTARSFMVNWTHAPGNVEKYRVVYYPTRGGKPDEVVVDGTVSSTVLKNLMSLTEYQIAVFAIYAHTASEGLRGTETTLALPMASDLLLYDVTENSMRVKWDAVPGASGYLILYAPLTEGLAGDEKEMKIGETHTDIELSGLLPNTEYTVTVYAMFGEEASDPVTGQETTLALSPPRNLRISNVGSNSARLTWDPTSRQINGYRIVYNNADGTEINEVEVDPITTFPLKGLTPLTEYTIAIFSIYDEGQSEPLTGVFTTEEVPAQQYLEIDEVTTDSFRVTWHPLSADEGLHKLMWIPVYGGKTEEVVLKEEQDSHVIEGLEPGTEYEVSLLAVLDDGSESEVVTAVGTTLDSFWTEPATTIVPTTSVTSVFQTGIRNLVVGDETTSSLRVKWDISDSDVQQFRVTYMTAQGDPEEEVIGTVMVPGSQNNLLLKPLLPDTEYKVTVTPIYTDGEGVSVSAPGKTLPSSGPQNLRVSEEWYNRLRITWDPPSSPVKGYRIVYKPVSVPGPTLETFVGADINTILITNLLSGMDYNVKIFASQASGFSDALTGMVKTLFLGVTNLQAKHVEMTSLCAHWQVHRHATAYRVVIESLQDRQKQESTVGGGTTRHCFYGLQPDSEYKISVYTKLQEIEGPSVSIMEKTQSLPTRPPTFPPTIPPAKEVCKAAKADLVFMVDGSWSIGDENFNKIISFLYSTVGALNKIGTDGTQVAMVQFTDDPRTEFKLNAYKTKETLLDAIKHISYKGGNTKTGKAIKYVRDTLFTAESGTRRGIPKVIVVITDGRSQDDVNKISREMQLDGYSIFAIGVADADYSELVSIGSKPSARHVFFVDDFDAFKKIEDELITFVCETASATCPVVHKDGIDLAGFKMMEMFGLVEKDFSSVEGVSMEPGTFNVFPCYQLHKDALVSQPTRYLHPEGLPSDYTISFLFRILPDTPQEPFALWEILNKNSDPLVGVILDNGGKTLTYFNYDQSGDFQTVTFEGPEIRKIFYGSFHKLHIVVSETLVKVVIDCKQVGEKAMNASANITSDGVEVLGKMVRSRGPGGNSAPFQLQMFDIVCSTSWANTDKCCELPGLRDDESCPDLPHSCSCSETNEVALGPAGPPGGPGLRGPKGQQGEPGPKGPDGPRGEIGLPGPQGPPGPQGPSGLSIQGMPGMPGEKGEKGDTGLPGPQGIPGGVGSPGRDGSPGQRGLPGKDGSSGPPGPPGPIGIPGTPGVPGITGSMGPQGALGPPGVPGAKGERGERGDLQSQAMVRSVARQVCEQLIQSHMARYTAILNQIPSHSSSIRTVQGPPGEPGRPGSPGAPGEQGPPGTPGFPGNAGVPGTPGERGLTGIKGEKGNPGVGTQGPRGPPGPAGPSGESRPGSPGPPGSPGPRGPPGHLGVPGPQGPSGQPGYCDPSSCSAYGVRDLIPYNDYQH

SEQ ID NO: 1183 - protein, 534 aa, Homo sapiens
MKIFQRKMRYWLLPPFLAIVYFCTIVQGQVAPPTRLRYNVISHDSIQISWKAPRGKFGGYKLLVTPTSGGKTNQLNLQNTATKAIIQGLMPDQNYTVQIIAYNKDKESKPAQGQFRIKDLEKRKDPKPRVKVVDRGNGSRPSSPEEVKFVCQTPAIADIVILVDGSWSIGRFNFRLVRHFLENLVTAFDVGSEKTRIGLAQYSGDPRIEWHLNAFSTKDEVIEAVRNLPYKGGNTLTGLALNYIFENSFKPEAGSRTGVSKIGILITDGKSQDDIIPPSRNLRESGVELFAIGVKNADVNELQEIASEPDSTHVYNVAEFDLMHTVVESLTRTLCSRVEEQDREIKASAHAITGPPTELITSEVTARSFMVNWTHAPGNVEKYRVVYYPTRGGKPDEVVVDGTVSSTVLKNLMSLTEYQIAVFAIYAHTASEGLRGTETTLALPMASDLLLYDVTENSMRVKWDAVPGASGYLILYAPLTEGLAGDEKEMKIGETHTDIELSGLLPNTEYTVTVYAMFGEEASDPVTGQETTSP

SEQ ID NO: 1184 - protein, 1142 aa, Homo sapiens
MRLTGPWKLWLWMSIFLLPASTSVTVRDKTEESCPILRIEGHQLTYDNINKLEVSGFDLGDSFSLRRAFCESDKTCFKLGSALLIRDTIKIFPKGLPEEYSVAAMFRVRRNAKKERWFLWQVLNQQNIPQISIVVDGGKKVVEFMFQATEGDVLNYIFRNRELRPLFDRQWHKLGISIQSQVISLYMDCNLIARRQTDEKDTVDFHGRTVIATRASDGKPVDIELHQLKIYCSANLIAQETCCEISDTKCPEQDGFGNIASSWVTAHASKMSSYLPAKQELKDQCQCIPNKGEAGLPGAPGSPGQKGHKGEPGENGLHGAPGFPGQKGEQGFEGSKGETGEKGEQGEKGDPALAGLNGENGLKGDLGPHGPPGPKGEKGDTGPPGPPALPGSLGIQGPQGPPGKEGQRGRRGKTGPPGKPGPPGPPGPPGIQGIHQTLGGYYNKDNKGNDEHEAGGLKGDKGETGLPGFPGSVGPKGQKGEPGEPFTKGEKGDRGEPGVIGSQGVKGEPGDPGPPGLIGSPGLKGQQGSAGSMGPRGPPGDVGLPGEHGIPGKQGIKGEKGDPGGIIGPPGLPGPKGEAGPPGKSLPGEPGLDGNPGAPGPRGPKGERGLPGVHGSPGDIGPQGIGIPGRTGAQGPAGEPGIQGPRGLPGLPGTPGTPGNDGVPGRDGKPGLPGPPGDPIALPLLGDIGALLKNFCGNCQASVPGLKSNKGEEGGAGEPGKYDSMARKGDIGPRGPPGIPGREGPKGSKGERGYPGIPGEKGDEGLQGIPGIPGAPGPTGPPGLMGRTGHPGPTGAKGEKGSDGPPGKPGPPGPPGIPFNERNGMSSLYKIKGGVNVPSYPGPPGPPGPKGDPGPVGEPGAMGLPGLEGFPGVKGDRGPAGPPGIAGMSGKPGAPGPPGVPGEPGERGPVGDIGFPGPEGPSGKPGINGKDGIPGAQGIMGKPGDRGPKGERGDQGIPGDRGSQGERGKPGLTGMKGAIGPMGPPGNKGSMGSPGHQGPPGSPGIPGIPADAVSFEEIKKYINQEVLRIFEERMAVFLSQLKLPAAMLAAQAYGRPGPPGKDGLPGPPGDPGPQGYRGQKGERGEPGIGLPGSPGLPGTSALGLPGSPGAPGPQGPPGPSGRCNPEDCLYPVSHAHQRTGGN

SEQ ID NO: 1185 - protein, 153 aa, Homo sapiens
GINGKDGIPGAQGIMGKPGDRGPKGERGDQGIPGDRGSQGERGKPGLTGMKGAIGPMGPPGNKGSMGSPGHQGPPGSPGIPGIPADAVSFEEIKKYINQEVLRIFEERMAVFLSQLKLPAAMLAAQAYGRPGPPGKDGLPGPPGDPGPQEVDV

SEQ ID NO: 1186 - protein, 1388 aa, Homo sapiens
MAPRRNNGQCWCLLMLLSVSTPLPAVTQTRGATETASQGHLDLTQLIGVPLPSSVSFVTGYGGFPAYSFGPGANVGRPARTLIPSTFFRDFAISVVVKPSSTRGGVLFAITDAFQKVIYLGLRLSGVEDGHQRIILYYTEPGSHVSQEAAAFSVPVMTHRWNRFAMIVQGEEVTLLVNCEEHSRIPFQRSSQALAFESSAGIFMGNAGATGLERFTGSLQQLTVHPDPRTPEELCDPEESSASGETSGLQEADGVAEILEAVTYTQASPKEAKVEPINTPPTPSSPFEDMELSGEPVPEGTLETTNMSIIQHSSPKQGSGEILNDTLEGVHSVDGDPITDSGSGAGAFLDIAEEKNLAATAAGLAEVPISTAGEAEASSVPTGGPTLSMSTENPEEGVTPGPDNEERLAATAAGEAEALASMPGEVEASGVAPGELDLSMSAQSLGEEATVGPSSEDSLTTAAAATEVSLSTFEDEEASGVPTDGLAPLTATMAPERAVTSGPGDEEDLAAATTEEPLITAGGEESGSPPPDGPPLPLPTVAPERWITPAQREHVGMKGQAGPKGEKGDAGEELPGPPEPSGPVGPTAGAEAEGSGLGWGSDVGSGSGDLVGSEQLLRGPPGPPGPPGLPGIPGKPGTDVFMGPPGSPGEDGPAGEPGPPGPEGQPGVDGATGLPGMKGEKGARGPNGSVGEKGDPGNRGLPGPPGKKGQAGPPGVMGPPGPPGPPGPPGPGCTMGLGFEDTEGSGSTQLLNEPKLSRPTAAIGLKGEKGDRGPKGERGMDGASIVGPPGPRGPPGHIKVLSNSLINITHGFMNFSDIPELVGPPGPDGLPGLPGFPGPRGPKGDTGLPGFPGLKGEQGEKGEPGAILTEDIPLERLMGKKGEPGMHGAPGPMGPKGPPGHKGEFGLPGRPGRPGLNGLKGTKGDPGVIMQGPPGLPGPPGPPGPPGAVINIKGAIFPIPVRPHCKMPVDTAHPGSPELITFHGVKGEKGSWGLPGSKGEKGDQGAQGPPGPPLDLAYLRHFLNNLKGENGDKGFKGEKGEKGDINGSFLMSGPPGLPGNPGPAGQKGETVVGPQGPPGAPGLPGPPGFGRPGDPGPPGPPGPPGPPAILGAAVALPGPPGPPGQPGLPGSRNLVTAFSNMDDMLQKAHLVIEGTFIYLRDSTEFFIRVRDGWKKLQLGELIPIPADSPPPPALSSNPHQLLPPPNPISSANYEKPALHLAALNMPFSGDIRADFQCFKQARAAGLLSTYRAFLSSHLQDLSTIVRKAERYSLPIVNLKGQVLFNNWDSIFSGHGGQFNMHIPIYSFDGRDIMTDPSWPQKVIWHGSSPHGVRLVDNYCEAWRTADTAVTGLASPLSTGKILDQKAYSCANRLIVLCIENSFMTDARK

SEQ ID NO: 1187 - protein, 745 aa, Homo sapiens
MAPRRNNGQCWCLLMLLSVPLPSSVSFVTGYGGFPAYSFGPGANVGRPARTLIPSTFFRDFAISVVVKPSSTRGGVLFAITDAFQKVIYLGLRLSGVEDGHQRIILYYTEPGSHVSQEAAAFSVPVMTHRWNRFAMIVQGEEVTLLVNCEEHSRIPFQRSSQALAFESSAGIFMGNAGATGLERFTGSLQQLTVHPDPRTPEELCDPEESSASGETSGLQEADGVAEILEAVTYTQASPKEAKVEPINTPPTPSSPFEDMELSGEPVPEGTLETTNMSIIQHSSPKQGSGEILNDTLEGVHSVDGDPITDSGSGAGAFLDIAEEKNLAATAAGLAEVPISTAGEAEASSVPTGGPTLSMSTENPEEGVTPGPDNEERLAATAAGEAEALASMPGEVEASGVAPGELDLSMSAQSLGEEATVGPSSEDSLTTAAAATEVSLSTFEDEEASGVPTDGLAPLTATMAPERAVTSGPGDEEDLAAATTEEPLITAGGEESGSPPPDGPPLPLPTVAPERWITPAQREHVGMKGQAGPKGEKGDAGEELPGPPEPSGPVGPTAGAEAEGSGLGWGSDVGSGSGDLVGSEQLLRGPPGPPGPPGLPGIPGKPGTDVFMGPPGSPGEDGPAGEPGPPGPEGQPGVDGATGLPGMKGEKGARGPNGSVGEKGDPGNRGLPGPPGKKGQAGPPGVMGPPGPPGPPGPPGPGCTMGLGFEDTEGSGSTQLLNEPKLSSPTPTPQFYDFHLAIVEL

SEQ ID NO: 1188 - protein, 1604 aa, Homo sapiens
MWVSWAPGLWLLGLWATFGHGANTGAQCPPSQQEGLKLEHSSSLPANVTGFNLIHRLSLMKTSAIKKIRNPKGPLILRLGAAPVTQPTRRVFPRGLPEEFALVLTLLLKKHTHQKTWYLFQVTDANGYPQISLEVNSQERSLELRAQGQDGDFVSCIFPVPQLFDLRWHKLMLSVAGRVASVHVDCSSASSQPLGPRRPMRPVGHVFLGLDAEQGKPVSFDLQQVHIYCDPELVLEEGCCEILPAGCPPETSKARRDTQSNELIEINPQSEGKVYTRCFCLEEPQNSEVDAQLTGRISQKAERGAKVHQETAADECPPCVHGARDSNVSEWRVGPEGGKGERGLPGPPGSKGEKGARGNDCVRISPDAPLQCAEGPKGEKGESGALGPSGLPGSTGEKGQKGEKGDGGIKGVPGKPGRDGRPGEICVIGPKGQKGDPGFVGPEGLAGEPGPPGLPGPPGIGLPGTPGDPGGPPGPKGDKGSSGIPGKEGPGGKPGKPGVKGEKGDPCEVCPTLPEGFQNFVGLPGKPGPKGEPGDPVPARGDPGIQGIKGEKGEPCLSCSSVVGAQHLVSSTGASGDVGSPGFGLPGLPVKAGVPGLSPGGNFGEAGPAGSPGPPGPVGPAGIKGAKGEPCEPCPALSNLQDGDVRVVALPGPSGEKGEPGPPGFGLPGKQGKAGERGLKGQKGDAGNPGDPGTPGTTGRPGLSGEPGVQGPAGPKGEKGDGCTACPSLQGTVTDMAGRPGQPGPKGEQGPEGVGRPGKPGQPGLPGVQGPPGLKGVQGEPGPPGRGVQGPQGEPGAPGLPGIQGLPGPRGPPGPTGEKGAQGSPGVKGATGPVGPPGASVSGPPGRDGQQGQTGLRGTPGEKGPRGEKGEPGECSCPSQGDLIFSGMPGAPGLWMGSSWQPGPQGPPGIPGPPGPPGVPGLQGVPGNNGLPGQPGLTAELGALALGSHWGSPSICGDCVQGQRAHPGYLVEKGEKGDQGIPGVPGLDNCAQCFLSLERPRAEEARGDNSEGDPGCVGSPGLPGPPGLPGQRGEEGPPGMRGSPGPPGPIGPPGFPGAVGSPGLPGLQGERGLTGLTGDKGEPGPPGQPGYPGATGPPGLPGIKGERGYTGSAGEKGEPGPPGSEGLPGPPGPAGPRGERGPQGNSGEKGDQGFQGQPGFPGPPGPPGFPGKVGSPGPPGPQAEKGSEGIRGPSGLPGSPGPPGPPGIQGPAGLDGLDGKDGKPGLRGDPGPAGPPGLMGPPGFKGKTGHPGLPGPKGDCGKPGPPGSTGRPGAEGEPGAMGPQGRPGPPGHVGPPGPPGQPGPAGISAVGLKGDRGATGERGLAGLPGQPGPPGHPGPPGEPGTDGAAGKEGPPGKQGFYGPPGPKGDPGAAGQKGQAGEKGRAGMPGGPGKSGSMGPVGPPGPAGERGHPGAPGPSGSPGLPGVPGSMGDMVNYDEIKRFIRQEIIKMFDERMAYYTSRMQFPMEMAAAPGRPGPPGKDGAPGRPGAPGSPGLPGQIGREGRQGLPGVRGLPGTKGEKGDIGIGIAGENGLPGPPGPQGPPGYGKMGATGPMGQQGIPGIPGPPGPMGQPGKAGHCNPSDCFGAMPMEQQYPPMKTMKGPFG

SEQ ID NO: 1189 - protein, 1604 aa, Homo sapiens
MWVSWAPGLWLLGLWATFGHGANTGAQCPPSQQEGLKLEHSSSLPANVTGFNLIHRLSLMKTSAIKKIRNPKGPLILRLGAAPVTQPTRRVFPRGLPEEFALVLTLLLKKHTHQKTWYLFQVTDANGYPQISLEVNSQERSLELRAQGQDGDFVSCIFPVPQLFDLRWHKLMLSVAGRVASVHVDCSSASSQPLGPRRPMRPVGHVFLGLDAEQGKPVSFDLQQVHIYCDPELVLEEGCCEILPAGCPPETSKARRDTQSNELIEINPQSEGKVYTRCFCLEEPQNSEVDAQLTGRISQKAERGAKVHQETAADECPPCVHGARDSNVTLAPSGPKGGKGERGLPGPPGSKGEKGARGNDCVRISPDAPLQCAEGPKGEKGESGALGPSGLPGSTGEKGQKGEKGDGGIKGVPGKPGRDGRPGEICVIGPKGQKGDPGFVGPEGLAGEPGPPGLPGPPGIGLPGTPGDPGGPPGPKGDKGSSGIPGKEGPGGKPGKPGVKGEKGDPCEVCPTLPEGFQNFVGLPGKPGPKGEPGDPVPARGDPGIQGIKGEKGEPCLSCSSVVGAQHLVSSTGASGDVGSPGFGLPGLPGRAGVPGLKGEKGNFGEAGPAGSPGPPGPVGPAGIKGAKGEPCEPCPALSNLQDGDVRVVALPGPSGEKGEPGPPGFGLPGKQGKAGERGLKGQKGDAGNPGDPGTPGTTGRPGLSGEPGVQGPAGPKGEKGDGCTACPSLQGTVTDMAGRPGQPGPKGEQGPEGVGRPGKPGQPGLPGVQGPPGLKGVQGEPGPPGRGVQGPQGEPGAPGLPGIQGLPGPRGPPGPTGEKGAQGSPGVKGATGPVGPPGASVSGPPGRDGQQGQTGLRGTPGEKGPRGEKGEPGECSCPSQGDLIFSGMPGAPGLWMGSSWQPGPQGPPGIPGPPGPPGVPGLQGVPGNNGLPGQPGLTAELGSLPIEQHLLKSICGDCVQGQRAHPGYLVEKGEKGDQGIPGVPGLDNCAQCFLSLERPRAEEARGDNSEGDPGCVGSPGLPGPPGLPGQRGEEGPPGMRGSPGPPGPIGPPGFPGAVGSPGLPGLQGERGLTGLTGDKGEPGPPGQPGYPGATGPPGLPGIKGERGYTGSAGEKGEPGPPGSEGLPGPPGPAGPRGERGPQGNSGEKGDQGFQGQPGFPGPPGPPGFPGKVGSPGPPGPQAEKGSEGIRGPSGLPGSPGPPGPPGIQGPAGLDGLDGKDGKPGLRGDPGPAGPPGLMGPPGFKGKTGHPGLPGPKGDCGKPGPPGSTGRPGAEGEPGAMGPQGRPGPPGHVGPPGPPGQPGPAGISAVGLKGDRGATGERGLAGLPGQPGPPGHPGPPGEPGTDGAAGKEGPPGKQGFYGPPGPKGDPGAAGQKGQAGEKGRAGMPGGPGKSGSMGPVGPPGPAGERGHPGAPGPSGSPGLPGVPGSMGDMVNYDEIKRFIRQEIIKMFDERMAYYTSRMQFPMEMAAAPGRPGPPGKDGAPGRPGAPGSPGLPGQIGREGRQGLPGVRGLPGTKGEKGDIGIGIAGENGLPGPPGPQGPPGYGKMGATGPMGQQGIPGIPGPPGPMGQPGKAGHCNPSDCFGAMPMEQQYPPMKTMKGPFG

SEQ ID NO: 1190 - protein, 1497 aa, Homo sapiens
MDVTKKNKRDGTEVTERIVTETVTTRLTSLPPKGGTSNGYAKTASLGGGSRLEKQSLTHGSSGYINSTGSTRGHASTSSYRRAHSPASTLPNSPGSTFERKTHVTRHAYEGSSSGNSSPEYPRKEFASSSTRGRSQTRESEIRVRLQSASPSTRWTELDDVKRLLKGSRSASVSPTRNSSNTLPIPKKGTVETKIVTASSQSVSGTYDATILDANLPSHVWSSTLPAGSSMGTYHNNMTTQSSSLLNTNAYSAGSVFGVPNNMASCSPTLHPGLSTSSSVFGMQNNLAPSLTTLSHGTTTTSTAYGVKKNMPQSPAAVNTGVSTSAACTTSVQSDDLLHKDCKFLILEKDNTPAKKEMELLIMTKDSGKVFTASPASIAATSFSEDTLKKEKQAAYNADSGLKAEANGDLKTVSTKGKTTTADIHSYGSSGGGGSGGGGGVGGAGGGPWGPAPAWCPCGSCCSWWKWLLGLLLTWLLLLGLLFGLIALAEEVRKLKARVDELERIRRSILPYGDSMDRIEKDRLQGMAPAAGADLDKIGLHSDSQEELWMFVRKKLMMEQENGNLRGSPGPKGDMGSPGPKGDRGFPGTPGIPGPLGHPGPQGPKGQKGSVGDPGMEGPMGQRGREGPMGPRGEAGPPGSGEKGERGAAGEPGPHGPPGVPGSVGPKGSSGSPGPQGPPGPVGLQGLRGEVGLPGVKGDKGPMGPPGPKGDQGEKGPRGLTGEPGMRGLPGAVGEPGAKGAMGPAGPDGHQGPRGEQGLTGMPGIRGPPGPSGDPGKPGLTGPQGPQGLPGTPGRPGIKGEPGAPGKIVTSEGSSMLTVPGPPGPPGAMGPPGPPGAPGPAGPAGLPGHQEVLNLQGPPGPPGPRGPPGPSIPGPPGPRGPPGEGLPGPPGPPGSFLSNSETFLSGPPGPPGPPGPKGDQGPPGPRGHQGEQGLPGFSTSGSSSFGLNLQGPPGPPGPQGPKGDKGDPGVPGALGIPSGPSEGGSSSTMYVSGPPGPPGPPGPPGSISSSGQEIQQYISEYMQSDSIRSYLSGVQGPPGPPGPPGPVTTITGETFDYSELASHVVSYLRTSGYGVSLFSSSISSEDILAVLQRDDVRQYLRQYLMGPRGPPGPPGASGDGSLLSLDYAELSSRILSYMSSSGISIGLPGPPGPPGLPGTSYEELLSLLRGSEFRGIVGPPGPPGPPGIPGNVWSSISVEDLSSYLHTAGLSFIPGPPGPPGPPGPRGPPGVSGALATYAAENSDSFRSELISYLTSPDVRSFIVGPPGPPGPQGPPGDSRLLSTDASHSRGSSSSSHSSSVRRGSSYSSSMSTGGGGAGSLGAGGAFGEAAGDRGPYGTDIGPGGGYGAAAEGGMYAGNGGLLGADFAGDLDYNELAVRVSESMQRQGLLQGMAYTVQGPPGQPGPQGPPGISKVFSAYSNVTADLMDFFQTYGAIQGPPGQKGEMGTPGPKGDRGPAGPPGHPGPPGPRGHKGEKGDKGDQVYAGRRRRRSIAVKP

SEQ ID NO: 1191 - protein, 417 aa, Homo sapiens
MDVTKKNKRDGTEVTERIVTETVTTRLTSLPPKGGTSNGYAKTASLGGGSRLEKQSLTHGSSGYINSTGSTRGHASTSSYRRAHSPASTLPNSPGSTFERKTHVTRHAYEGSSSGNSSPEYPRKEFASSSTRGRSQTRESEIRVRLQSASPSTRWTELDDVKRLLKGSRSASVSPTRNSSNTLPIPKKGTVETKIVTASSQSVSGTYDATILDANLPSHVWSSTLPAGSSMGTYHNNMTTQSSSLLNTNAYSAGSVFGVPNNMASCSPTLHPGLSTSSSVFGMQNNLAPSLTTLSHGTTTTSTAYGVKKNMPQSPAAVNTGVSTSAACTTSVQSDDLLHKDCKFLILEKDNTPAKKEMELLIMTKDSGKVFTASPASIAATSFSEDTLKKEKQAAYNADSGLKAEANGKNKYDCCPP

SEQ ID NO: 1192 - protein, 66 aa, Homo sapiens
  MOD_RES (1)..(1): Any amino acid
XYGAIQGPPGQKGEMGTPGPKGDRGPAGPPGHPGPPGPRGHKGEKGDKGDQVYAGRRRRRSIAVKP

SEQ ID NO: 1193 - protein, 604 aa, Homo sapiens
MDVTKKNKRDGTEVTERIVTETVTTRLTSLPPKGGTSNGYAKTASLGGGSRLEKQSLTHGSSGYINSTGSTRGHASTSSYRRAHSPASTLPNSPGSTFERKTHVTRHAYEASSSTRGRSQTRESEIRVRLQSASPSTRWTELDDVKRLLKGSRSASVSPTRNSSNTLPIPKKGTVETKIVTASSQSVSGTYDATILDANLPSHVWSSTLPAGSSMGTYHNNMTTQSSSLLNTNAYSAGSVFGVPNNMASCSPTLHPGLSTSSSVFGMQNNLAPSLTTLSHGTTTTSTAYGVKKNMPQSPAAVNTGVSTSAACTTSVQSDDLLHKDCKFLILEKDNTPAKKEMELLIMTKDSGKVFTASPASIAATSFSEDTLKKEKQAAYNADSGLKAEANGDLKTVSTKGKTTTADIHSYGSSGGGGSGGGGGVGGAGGGPWGPAPAWCPCGSCCSWWKWLLGLLLTWLLLLGLLFGLIALAEEVRKLKARVDELERIRRSILPYGDSMDRIEKDRLQGMAPAAGADLDKIGLHSDSQEELWMFVRKKLMMEQENGNLRGSPGPKGDMGSPGPKGDRGFPGTPGIPGPLGHPGPQGPKGQKGSVGDPGMEGPM

SEQ ID NO: 1194 - protein, 1316 aa, Homo sapiens
MSSGDPAHLGLCLWLWLGATLGREQVQASGLLRLAVLPEDRLQMKWRESEGSGLGYLVQVKPMAGDSEQEVILTTKTPKATVGGLSPSKGYTLQIFELTGSGRFLLARREFVIEDLKSSSLDRSSQRPLGSGAPEPTPSHTGSPDPEQASEPQVAFTPSQDPRTPAGPQFRCLPPVPADMVFLVDGSWSIGHSHFQQVKDFLASVIAPFEIGPDKVQVGLTQYSGDAQTEWDLNSLSTKEQVLAAVRRLRYKGGNTFTGLALTHVLGQNLQPAAGLRPEAAKVVILVTDGKSQDDVHTAARVLKDLGVNVFAVGVKNADEAELRLLASPPRDITVHSVLDFLQLGALAGLLSRLICQRLQGGSPRQGPAAAPALDTLPAPTSLVLSQVTSSSIRLSWTPAPRHPLKYLIVWRASRGGTPREVVVEGPAASTELHNLASRTEYLVSVFPIYEGGVGEGLRGLVTTAPLPPPRALTLAAVTPRTVHLTWQPSAGATHYLVRCSPASPKGEEEEREVQVGRPEVLLDGLEPGRDYEVSVQSLRGPEGSEARGIRARTPTLAPPRHLGFSDVSHDAARVFWEGAPRPVRLVRVTYVSSEGGHSGQTEAPGNATSATLGPLSSSTTYTVRVTCLYPGGGSSTLTGRVTTKKAPSPSQLSMTELPGDAVQLAWVAAAPSGVLVYQITWTPLGEGKAHEISVPGNLGTAVLPGLGRHTEYDVTILAYYRDGARSDPVSLRYTPSTVSRSPPSNLALASETPDSLQVSWTPPLGRVLHYWLTYAPASGLGPEKSVSVPGARSHVTLPDLQAATKYRVLVSAIYAAGRSEAVSATGQTACPALRPDGSLPGFDLMVAFSLVEKAYASIRGVAMEPSAFGGTPTFTLFKDAQLTRRVSDVYPAPLPPEHTIVFLVRLLPETPREAFALWQMTAEDFQPLLGVLLDAGKKSLTYFHRDPRAALQEATFDPQEVRKIFFGSFHKVHVAVGRSKVRLYVDCRKVAERPLGEMGSPPAAGFVTLGRLAKARGPRSSSAAFQLQMLQIVCSDTWADEDRCCELPASRDGETCPAFVSACSCSSETPGPPGPQGPPGLPGRNGTPGEQGFPGPRGEPGPPGQMGPEGPGGQQGSPGTQGRAVQGPVGPPGVKGEKGDHGLPGLQGHPGHQGIPGRVGLQGPKGMRGLEGTAGLPGPPGPRGFQGMAGARGTSGERGPPGTVGPTGLPGPKGERGEKGEPQSLATLYQLVSQASHVSKFDSFHENTRPPMPILEQKLEPGTEPLGSPGTRSKALVPGEWGRGGRHLEGRGEPGAVGQMGSPGQQGASTQGLWE

SEQ ID NO: 1195 - protein, 1284 aa, Homo sapiens
MSSGDPAHLGLCLWLWLGATLGREQVQASGLLRLAVLPEDRLQMKWRESEGSGLGYLVQVKPMAGDSEQEVILTTKTPKATVGGLSPSKGYTLQIFELTGSGRFLLARREFVIEDLKSSSLDRSSQRPLGSGAPEPTPSHTGSPDPEQASEPQVAFTPSQDPRTPAGPQFRCLPPVPADMVFLVDGSWSIGHSHFQQVKDFLASVIAPFEIGPDKVQVGLTQYSGDAQTEWDLNSLSTKEQVLAAVRRLRYKGGNTFTGLALTHVLGQNLQPAAGLRPEAAKVVILVTDGKSQDDVHTAARVLKDLGVNVFAVGVKNADEAELRLLASPPRDITVHSVLDFLQLGALAGLLSRLICQRLQGGSPRQGPAAAPALDTLPAPTSLVLSQVTSSSIRLSWTPAPRHPLKYLIVWRASRGGTPREVVVEGPAASTELHNLASRTEYLVSVFPIYEGGVGEGLRGLVTTAPLPPPRALTLAAVTPRTVHLTWQPSAGATHYLVRCSPASPKGEEEEREVQVGRPEVLLDGLEPGRDYEVSVQSLRGPEGSEARGIRARTPTLAPPRHLGFSDVSHDAARVFWEGAPRPVRLVRVTYVSSEGGHSGQTEAPGNATSATLGPLSSSTTYTVRVTCLYPGGGSSTLTGRVTTKKAPSPSQLSMTELPGDAVQLAWVAAAPSGVLVYQITWTPLGEGKAHEISVPGNLGTAVLPGLGRHTEYDVTILAYYRDGARSDPVSLRYTPSTVSRSPPSNLALASETPDSLQVSWTPPLGRVLHYWLTYAPASGLGPEKSVSVPGARSHVTLPDLQAATKYRVLVSAIYAAGRSEAVSATGQTACPALRPDGSLPGFDLMVAFSLVEKAYASIRGVAMEPSAFGGTPTFTLFKDAQLTRRVSDVYPAPLPPEHTIVFLVRLLPETPREAFALWQMTAEDFQPLLGVLLDAGKKSLTYFHRDPRAALQEATFDPQEVRKIFFGSFHKVHVAVGRSKVRLYVDCRKVAERPLGEMGSPPAAGFVTLGRLAKARGPRSSSAAFQLQMLQIVCSDTWADEDRCCELPASRDGETCPAFVSACSCSSETPGPPGPQGPPGLPGRNGTPGEQGFPGPRGPPGVKGEKGDHGLPGLQGHPGHQGIPGRVGLQGPKGMRGLEGTAGLPGPPGPRGFQGMAGARGTSGERGPPGTVGPTGLPGPKGERGEKGEPQSLATLYQLVSQASHVSKFDSFHENTRPPMPILEQKLEPGTEPLGSPGTRSKALVPGEWGRGGRHLEGRGEPGAVGQMGSPGQQGASTQGLWE

SEQ ID NO: 1196 - protein, 1297 aa, Homo sapiens
MSSGDPAHLGLCLWLWLGATLGREQVQASGLLRLAVLPEDRLQMKWRESEGSGLGYLVQVKPMAGDSEQEVILTTKTPKATVGGLSPSKGYTLQIFELTGSGRFLLARREFVIEDLKSSSLDRSSQRPLGSGAPEPTPSHTGSPDPEQASEPQVAFTPSQDPRTPGGSEWRETGPQFRCLPPVPADMVFLVDGSWSIGHSHFQQVKDFLASVIAPFEIGPDKVQVGLTQYSGDAQTEWDLNSLSTKEQVLAAVRRLRYKGGNTFTGLALTHVLGQNLQPAAGLRPEAAKVVILVTDGKSQDDVHTAARVLKDLGVNVFAVGVKNADEAELRLLASPPRDITVHSVLDFLQLGALAGLLSRLICQRLQGGSPRQGPAAAPALDTLPAPTSLVLSQVTSSSIRLSWTPAPRHPLKYLIVWRASRGGTPREVVVEGPAASTELHNLASRTEYLVSVFPIYEGGVGEGLRGLVTTAPLPPPRALTLAAVTPRTVHLTWQPSAGATHYLVRCSPASPKGEEEEREVQVGRPEVLLDGLEPGRDYEVSVQSLRGPEGSEARGIRARTPTLAPPRHLGFSDVSHDAARVFWEGAPRPVRLVRVTYVSSEGGHSGQTEAPGNATSATLGPLSSSTTYTVRVTCLYPGGGSSTLTGRVTTKKAPSPSQLSMTELPGDAVQLAWVAAAPSGVLVYQITWTPLGEGKAHEISVPGNLGTAVLPGLGRHTEYDVTILAYYRDGARSDPVSLRYTPSTVSRSPPSNLALASETPDSLQVSWTPPLGRVLHYWLTYAPASGLGPEKSVSVPGARSHVTLPDLQAATKYRVLVSAIYAAGRSEAVSATGQTACPALRPDGSLPGFDLMVAFSLVEKAYASIRGVAMEPSAFGGTPTFTLFKDAQLTRRVSDVYPAPLPPEHTIVFLVRLLPETPREAFALWQMTAEDFQPLLGVLLDAGKKSLTYFHRDPRAALQEATFDPQEVRKIFFGSFHKVHVAVGRSKVRLYVDCRKVAERPLGEMGSPPAAGFVTLGRLAKARGPRSSSAAFQLQMLQIVCSDTWADEDRCCELPASRDGETCPAFVSACSCSSETPGPPGPQGPPGLPGRNGTPGEQGFPGPRGPPGVKGEKGDHGLPGLQGHPGHQGIPGRVGLQGPKGMRGLEGTAGLPGPPGPRGFQGMAGARGTSGERGPPGTVGPTGLPGPKGERGEKGEPQSLATLYQLVSQACESAIQTHVSKFDSFHENTRPPMPILEQKLEPGTEPLGSPGTRSKALVPGEWGRGGRHLEGRGEPGAVGQMGSPGQQGASTQGLWE

SEQ ID NO: 1197 - protein, 1297 aa, Homo sapiens; identical to SEQ ID NO: 1196

SEQ ID NO: 1198 - protein, 957 aa, Homo sapiens
MAHYITFLCMVLVLLLQNSVLAEDGEVRSSCRTAPTDLVFILDGSYSVGPENFEIVKKWLVNITKNFDIGPKFIQVGVVQYSDYPVLEIPLGSYDSGEHLTAAVESILYLGGNTKTGKAIQFALDYLFAKSSRFLTKIAVVLTDGKSQDDVKDAAQAARDSKITLFAIGVGSETEDAELRAIANKPSSTYVFYVEDYIAISKIREVMKQKLCEESVCPTRIPVAARDERGFDILLGLDVNKKVKKRIQLSPKKIKGYEVTSKVDLSELTSNVFPEGLPPSYVFVSTQRFKVKKIWDLWRILTIDGRPQIAVTLNGVDKILLFTTTSVINGSQVVTFANPQVKTLFDEGWHQIRLLVTEQDVTLYIDDQQIENKPLHPVLGILINGQTQIGKYSGKEETVQFDVQKLRIYCDPEQNNRETACEIPGFNGECLNGPSDVGSTPAPCICPPGKPGLQGPKGDPGLPGNPGYPGQPGQDGKPGYQGIAGTPGVPGSPGIQGARGLPGYKGEPGRDGDKGDRGLPGFPGLHGMPGSKGEMGAKGDKGSPGFYGKKGAKGEKGNAGFPGLPGPAGEPGRHGKDGLMGSPGFKGEAGSPGAPGQDGTRGEPGIPGFPGNRGLMGQKGEIGPPGQQGKKGAPGMPGLMGSNGSPGQPGTPGSKGSKGEPGIQGMPGASGLKGEPGATGSPGEPGYMGLPGIQGKKGDKGNQGEKGIQGQKGENGRQGIPGQQGIQGHHGAKGERGEKGEPGVRGAIGSKGESGVDGLMGPAGPKGQPGDPGPQGPPGLDGKPGREFSEQFIRQVCTDVIRAQLPVLLQSGRIRNCDHCLSQHGSPGIPGPPGPIGPEGPRGLPGLPGRDGVPGLVGVPGRPGVRGLKGLPGRNGEKGSQGFGYPGEQGPPGPPGPEGPPGISKEGPPGDPGLPGKDGDHGKPGIQGQPGPPGICDPSLCFSVIARRDPFRKGPNY

SEQ ID NO: 1199 - protein, 323 aa, Homo sapiens
MIASGIPGFPGNRGLMGQKGEIGPPGQQGKKGAPGMPGLMGSNGSPGQPGTPGSKGSKGEPGIQGMPGASGLKGEPGATGSPGEPGYMGLPGIQGKKGDKGNQGEKGIQGQKGENGRQGIPGQQGIQGHHGAKGERGEKGEPGVRGAIGSKGESGVDGLMGPAGPKGQPGDPGPQGPPGLDGKPGREFSEQFIRQVCTDVIRGPEGPRGLPGLPGRDGVPGLVGVPGRPGVRGLKGLPGRNGEKGSQGFGYPGEQGPPGPPGPEGPPGISKEGPPGDPGLPGKDGDHGKPGIQGQPGPPGICDPSLCFSVIARRDPFRKGPNY

SEQ ID NO: 1200 - protein, 954 aa, Homo sapiens
MAHYITFLCMVLVLLLQNSVLAEDGEVRSSCRTAPTDLVFILDGSYSVGPENFEIVKKWLVNITKNFDIGPKFIQVGVVQYSDYPVLEIPLGSYDSGEHLTAAVESILYLGGNTKTGKAIQFALDYLFAKSSRFLTKIAVVLTDGKSQDDVKDAAQAARDSKITLFAIGVGSETEDAELRAIANKPSSTYVFYVEDYIAISKIREVMKQKLCEESVCPTRIPVAARDERGFDILLGLDVNKKVKKRIQLSPKKIKGYEVTSKVDLSELTSNVFPEGLPPSYVFVSTQRFKVKKIWDLWRILTIDGRPQIAVTLNGVDKILLFTTTSVINGSQVVTFANPQVKTLFDEGWHQIRLLVTEQDVTLYIDDQQIENKPLHPVLGILINGQTQIGKYSGKEETVQFDVQKLRIYCDPEQNNRETACEIPGFCLNGPSDVGSTPAPCICPPGKPGLQGPKGDPGLPGNPGYPGQPGQDGKPGYQGIAGTPGVPGSPGIQGARGLPGYKGEPGRDGDKGDRGLPGFPGLHGMPGSKGEMGAKGDKGSPGFYGKKGAKGEKGNAGFPGLPGPAGEPGRHGKDGLMGSPGFKGEAGSPGAPGQDGTRGEPGIPGFPGNRGLMGQKGEIGPPGQQGKKGAPGMPGLMGSNGSPGQPGTPGSKGSKGEPGIQGMPGASGLKGEPGATGSPGEPGYMGLPGIQGKKGDKGNQGEKGIQGQKGENGRQGIPGQQGIQGHHGAKGERGEKGEPGVRGAIGSKGESGVDGLMGPAGPKGQPGDPGPQGPPGLDGKPGREFSEQFIRQVCTDVIRAQLPVLLQSGRIRNCDHCLSQHGSPGIPGPPGPIGPEGPRGLPGLPGRDGVPGLVGVPGRPGVRGLKGLPGRNGEKGSQGFGYPGEQGPPGPPGPEGPPGISKEGPPGDPGLPGKDGDHGKPGIQGQPGPPGICDPSLCFSVIARRDPFRKGPNY

SEQ ID NO: 1201 - protein, 136 aa, Homo sapiens
MAHYITFLCMVLVLLLQNSVLAEDGEVRSSCRTAPTDLVFILDGSYSVGPENFEIVKKWLVNITKNFDIGPKFIQVGVVQYSDYPVLEIPLGSYDSGEHLTAAVESILYLGGNTKTGKAIQFALDYLFAKSSRFLT

SEQ ID NO: 1202 - protein, 954 aa, Homo sapiens; identical to SEQ ID NO: 1200

SEQ ID NO: 1203 - protein, 957 aa, Homo sapiens
MAHYITFLCMVLVLLLQNSVLAEDGEVRSSCRTAPTDLVFILDGSYSVGPENFEIVKKWLVNITKNFDIGPKFIQVGVVQYSDYPVLEIPLGSYDSGEHLTAAVESILYLGGNTKTGKAIQFALDYLFAKSSRFLTKIAVVLTDGKSQDDVKDAAQAARDSKITLFAIGVGSETEDAELRAIANKPSSTYVFYVEDYIAISKIREVMKQKLCEESVCPTRIPVAARDERGFDILLGLDVNKKVKKRIQLSPKKIKGYEVTSKVDLSELTSNVFPEGLPPSYVFVSTQRFKVKKIWDLWRILTIDGRPQIAVTLNGVDKILLFTTTSVINGSQVVTFANPQVKTLFDEGWHQIRLLVTEQDVTLYIDDQQIENKPLHPVLGILINGQTQIGKYSGKEETVQFDVQKLRIYCDPEQNNRETACEIPGFVMECLNGPSDVGSTPAPCICPPGKPGLQGPKGDPGLPGNPGYPGQPGQDGKPGYQGIAGTPGVPGSPGIQGARGLPGYKGEPGRDGDKGDRGLPGFPGLHGMPGSKGEMGAKGDKGSPGFYGKKGAKGEKGNAGFPGLPGPAGEPGRHGKDGLMGSPGFKGEAGSPGAPGQDGTRGEPGIPGFPGNRGLMGQKGEIGPPGQQGKKGAPGMPGLMGSNGSPGQPGTPGSKGSKGEPGIQGMPGASGLKGEPGATGSPGEPGYMGLPGIQGKKGDKGNQGEKGIQGQKGENGRQGIPGQQGIQGHHGAKGERGEKGEPGVRGAIGSKGESGVDGLMGPAGPKGQPGDPGPQGPPGLDGKPGREFSEQFIRQVCTDVIRAQLPVLLQSGRIRNCDHCLSQHGSPGIPGPPGPIGPEGPRGLPGLPGRDGVPGLVGVPGRPGVRGLKGLPGRNGEKGSQGFGYPGEQGPPGPPGPEGPPGISKEGPPGDPGLPGKDGDHGKPGIQGQPGPPGICDPSLCFSVIARRDPFRKGPNY

SEQ ID NO: 1204 - protein, 1626 aa, Homo sapiens
MAGLRGNAVAGLLWMLLLWSGGGGCQAQRAGCKSVHYDLVFLLDTSSSVGKEDFEKVRQWVANLVDTFEVGPDRTRVGVVRYSDRPTTAFELGLFGSQEEVKAAARRLAYHGGNTNTGDALRYITARSFSPHAGGRPRDRAYKQVAILLTDGRSQDLVLDAAAAAHRAGIRIFAVGVGEALKEELEEIASEPKSAHVFHVSDFNAIDKIRGKLRRRLCENVLCPSVRVEGDRFKHTNGGTKEITGFDLMDLFSVKEILGKRENGAQSSYVRMGSFPVVQSTEDVFPQGLPDEYAFVTTFRFRKTSRKEDWYIWQVIDQYSIPQVSIRLDGENKAVEYNAVGAMKDAVRVVFRGSRVNDLFDRDWHKMALSIQAQNVSLHIDCALVQTLPIEERENIDIQGKTVIGKRLYDSVPIDFDLQRIVIYCDSRHAELETCCDIPSGPCQVTVVTEPPPPPPPQRPPTPGSEQIGFLKTINCSCPAGEKGEMGVAGPMGLPGPKGDIGAIGPVGAPGPKGEKGDVGIGPFGQGEKGEKGSLGLPGPPGRDGSKGMRGEPGELGEPGLPGEVGMRGPQGPPGLPGPPGRVGAPGLQGERGEKGTRGEKGERGLDGFPGKPGDTGQQGRPGPSGVAGPQGEKGDVGPAGPPGVPGSVVQQEGLKGEQGAPGPRGHQGAPGPPGARGPIGPEGRDGPPGLQGLRGKKGDMGPPGIPGLLGLQGPPGPPGVPGPPGPGGSPGLPGEIGFPGKPGPPGPTGPPGKDGPNGPPGPPGTKGEPGERGEDGLPGKPGLRGEIGEQGLAGRPGEKGEAGLPGAPGFPGVRGEKGDQGEKGELGLPGLKGDRGEKGEAGPAGPPGLPGTTSLFTPHPRMPGEQGPKGEKGDPGLPGEPGLQGRPGELGPQGPTGPPGAKGQEGAHGAPGAAGNPGAPGHVGAPGPSGPPGSVGAPGLRGTPGKDGERGEKGAAGEEGSPGPVGPRGDPGAPGLPGPPGKGKDGEPGLRGSPGLPGPLGTKAACGKVRGSENCALGGQCVKGDRGAPGIPGSPGSRGDPGIGVAGPPGPSGPPGDKGSPGSRGLPGFPGPQGPAGRDGAPGNPGERGPPGKPGLSSLLSPGDINLLAKDVCNDCPPGPPGLPGLPGFKGDKGVPGKPGREGTEGKKGEAGPPGLPGPPGIAGPQGSQGERGADGEVGQKGDQGHPGVPGFMGPPGNPGPPGADGIAGAAGPPGIQGSPGKEGPPGPQGPSGLPGIPGEEGKEGRDGKPGPPGEPGKAGEPGLPGPEGARGPPGFKGHTGDSGAPGPRGESGAMGLPGQEGLPGKDGDTGPTGPQGPQGPRGPPGKNGSPGSPGEPGPSGTPGQKGSKGENGSPGLPGFLGPRGPPGEPGEKGVPGKEGVPGKPGEPGFKGERGDPGIKGDKGPPGGKGQPGDPGIPGHKGHTGLMGPQGLPGENGPVGPPGPPGQPGFPGLRGESPSMETLRRLIQEELGKQLETRLAYLLAQMPPAYMKSSQGRPGPPGPPGKDGLPGRAGPMGEPGRPGQGGLEGPSGPIGPKGERGAKGDPGAPGVGLRGEMGPPGIPGQPGEPGYAKDGLPGIPGPQGETGPAGHPGLPGPPGPPGQCDPSQCAYFASLAARPGNVKGP

SEQ ID NO: 1205 - protein, 1606 aa, Homo sapiens
MAGLRGNAVAGLLWMLLLWSGGGGCQAQRAGCKSVHYDLVFLLDTSSSVGKEDFEKVRQWVANLVDTFEVGPDRTRVGVVRYSDRPTTAFELGLFGSQEEVKAAARRLAYHGGNTNTGDALRYITARSFSPHAGGRPRDRAYKQVAILLTDGRSQDLVLDAAAAAHRAGIRIFAVGVGEALKEELEEIASEPKSAHVFHVSDFNAIDKIRGKLRRRLCENVLCPSVRVEGDRFKHTNGGTKEITGFDLMDLFSVKEILGKRENGAQSSYVRMGSFPVVQSTEDVFPQGLPDEYAFVTTFRFRKTSRKEDWYIWQVIDQYSIPQVSIRLDGENKAVEYNAVGAMKDAVRVVFRGSRVNDLFDRDWHKMALSIQAQNVSLHIDCALVQTLPIEERENIDIQGKTVIGKRLYDSVPIDFDLQRIVIYCDSRHAELETCCDIPSGPCQVTVVTEPPPPPPPQRPPTPGSEQIGFLKTINCSCPAGEKGEMGVAGPMGLPGPKGDIGAIGPVGAPGPKGEKGDVGIGPFGQGEKGEKGSLGLPGPPGRDGSKGMRGEPGELGEPGLPGEVGMRGPQGPPGLPGPPGRVGAPGLQGERGEKGTRGEKGERGLDGFPGKPGDTGQQGRPGPSGVAGPQGEKGDVGPAGPPGVPGSVVQQEGLKGEQGAPGPRGHQGAPGPPGARGPIGPEGRDGPPGLQGLRGKKGDMGPPGIPGLLGLQGPPGPPGVPGPPGPGGSPGLPGEIGFPGKPGPPGPTGPPGKDGPNGPPGPPGTKGEPGERGEDGLPGKPGLRGEIGEQGLAGRPGEKGEAGLPGAPGFPGVRGEKGDQGEKGELGLPGLKGDRGEKGEAGPAGPPGLPGTTSLFTPHPRMPGEQGPKGEKGDPGLPGEPGLQGRPGELGPQGPTGPPGAKGQEGAHGAPGAAGNPGAPGHVGAPGPSGPPGSVGAPGLRGTPGKDGERGEKGAAGEEGSPGPVGPRGDPGAPGLPGPPGKGKDGEPGLRGSPGLPGPLGTKGDRGAPGIPGSPGSRGDPGIGVAGPPGPSGPPGDKGSPGSRGLPGFPGPQGPAGRDGAPGNPGERGPPGKPGLSSLLSPGDINLLAKDVCNDCPPGPPGLPGLPGFKGDKGVPGKPGREGTEGKKGEAGPPGLPGPPGIAGPQGSQGERGADGEVGQKGDQGHPGVPGFMGPPGNPGPPGADGIAGAAGPPGIQGSPGKEGPPGPQGPSGLPGIPGEEGKEGRDGKPGPPGEPGKAGEPGLPGPEGARGPPGFKGHTGDSGAPGPRGESGAMGLPGQEGLPGKDGDTGPTGPQGPQGPRGPPGKNGSPGSPGEPGPSGTPGQKGSKGENGSPGLPGFLGPRGPPGEPGEKGVPGKEGVPGKPGEPGFKGERGDPGIKGDKGPPGGKGQPGDPGIPGHKGHTGLMGPQGLPGENGPVGPPGPPGQPGFPGLRGESPSMETLRRLIQEELGKQLETRLAYLLAQMPPAYMKSSQGRPGPPGPPGKDGLPGRAGPMGEPGRPGQGGLEGPSGPIGPKGERGAKGDPGAPGVGLRGEMGPPGIPGQPGEPGYAKDGLPGIPGPQGETGPAGHPGLPGPPGPPGQCDPSQCAYFASLAARPGNVKGP

SEQ ID NO: 1206 - protein, 1319 aa, Homo sapiens
MAGLRGNAVAGLLWMLLLWSGGGGCQAQRAGCKSVHYDLVFLLDTSSSVGKEDFEKVRQWVANLVDTFEVGPDRTRVGVVRYSDRPTTAFELGLFGSQEEVKAAARRLAYHGGNTNTGDALRYITARSFSPHAGGRPRDRAYKQVAILLTDGRSQDLVLDAAAAAHRAGIRIFAVGVGEALKEELEEIASEPKSAHVFHVSDFNAIDKIRGKLRRRLCENVLCPSVRVEGDRFKHTNGGTKEITGFDLMDLFSVKEILGKRENGAQSSYVRMGSFPVVQSTEDVFPQGLPDEYAFVTTFRFRKTSRKEDWYIWQVIDQYSIPQVSIRLDGENKAVEYNAVAGPQGEKGDVGPAGPPGVPGSVVQQEGLKGEQGAPGPRGHQGAPGPPGARGPIGPEGRDGPPGLQGLRGKKGDMGPPGIPGLLGLQGPPGPPGVPGPPGPGGSPGLPGEIGFPGKPGPPGPTGPPGKDGPNGPPGPPGTKGEPGERGEDGLPGKPGLRGEIGEQGLAGRPGEKGEAGLPGAPGFPGVRGEKGDQGEKGELGLPGLKGDRGEKGEAGPAGPPGLPGTTSLFTPHPRMPGEQGPKGEKGDPGLPGEPGLQGRPGELGPQGPTGPPGAKGQEGAHGAPGAAGNPGAPGHVGAPGPSGPPGSVGAPGLRGTPGKDGERGEKGAAGEEGSPGPVGPRGDPGAPGLPGPPGKGKDGEPGLRGSPGLPGPLGTKGDRGAPGIPGSPGSRGDPGIGVAGPPGPSGPPGDKGSPGSRGLPGFPGPQGPAGRDGAPGNPGERGPPGKPGLSSLLSPGDINLLAKDVCNDCPPGPPGLPGLPGFKGDKGVPGKPGREGTEGKKGEAGPPGLPGPPGIAGPQGSQGERGADGEVGQKGDQGHPGVPGFMGPPGNPGPPGADGIAGAAGPPGIQGSPGKEGPPGPQGPSGLPGIPGEEGKEGRDGKPGPPGEPGKAGEPGLPGPEGARGPPGFKGHTGDSGAPGPRGESGAMGLPGQEGLPGKDGDTGPTGPQGPQGPRGPPGKNGSPGSPGEPGPSGTPGQKGSKGENGSPGLPGFLGPRGPPGEPGEKGVPGKEGVPGKPGEPGFKGERGDPGIKGDKGPPGGKGQPGDPGIPGHKGHTGLMGPQGLPGENGPVGPPGPPGQPGFPGLRGESPSMETLRRLIQEELGKQLETRLAYLLAQMPPAYMKSSQGRPGPPGPPGKDGLPGRAGPMGEPGRPGQGGLEGPSGPIGPKGERGAKGDPGAPGVGLRGEMGPPGIPGQPGEPGYAKDGLPGIPGPQGETGPAGHPGLPGPPGPPGQCDPSQCAYFASLAARPGNVKGP

SEQ ID NO: 1207 - protein, 1714 aa, Homo sapiens
MHLRAHRTRRGKVSPTAKTKSLLHFIVLCVAGVVVHAQEQGIDILHQLGLGGKDVRHSSPATAVPSASTPLPQGVHLTESGVIFKNDAYIETPFVKILPVNLGQPFTILTGLQSHRVNNAFLFSIRNKNRLQLGVQLLPKKLVVHIRGKQPAVFNYSVHDEQWHSFAITIRNQSVSMFVECGKKYFSTETIPEVQTFDSNSVFTLGSMNNNSIHFEGIVCQLDIIPSAEASADYCRYVKQQCRQADKYQPETSIPCTTLIPTKIPEHSPPPKLFAEKVLSEDTFTEGKSIPNIIKNDSETVYKRQEHQISRSQLSSLQSGNVSAVDLTNHGIQAKEMITEEDTQTNFSLSVTTHRISEAKMNTKEKFSSLLNMSDNITQHDDRVTGLSLFKKMPSILPQIKQDTITNLKKAITANLHTNELMEMQPILNTSLHRVTNEPSVDNHLDLRKEGEFYPDATYPIENSYETELYDYYYYEDLNTMLEMEYLRGPKGDTGPPGPPGPAGIPGPSGKRGPRGIPGPHGNPGLPGLPGPKGPKGDPGFSPGQPVPGEKGDQGLSGLMGPPGMQGDKGLKGHPGLPGLPGEQGIPGFAGNIGSPGYPGRQGLAGPEGNPGPKGAQGFIGSPGEAGQLGPEGERGIPGIRGKKGFKGRQGFPGDFGDRGPAGLDGSPGLVGGTGPPGFPGLRGSVGPVGPIGPAGIPGPMGLSGNKGLPGIKGDKGEQGTAGELGEPGYPGDKGAVGLPGPPGMRGKSGPSGQTGDPGLQGPSGPPGPEGFPGDIGIPGQNGPEGPKGLLGNRGPPGPPGLKGTQGEEGPIGAFGELGPRGKPGQKGYAGEPGPEGLKGEVGDQGNIGKIGETGPVGLPGEVGMTGSIGEKGERGSPGPLGPQGEKGVMGYPGPPGVPGPIGPLGLPGHVGARGPPGSQGPKGQRGSRGPDGLLGEQGIQGAKGEKGDQGKRGPHGLIGKTGNPGERGFQGKPGLQGLPGSTGDRGLPGEPGLRGLQGDVGPPGEMGMEGPPGTEGESGLQGEPGAKGDVGTAGSVGGTGEPGLRGEPGAPGEEGLQGKDGLKGVPGGRGLPGEDGEKGEMGLPGIIGPLGRSGQTGLPGPEGIVGIPGQRGRPGKKGDKGQIGPTGEVGSRGPPGKIGKSGPKGARGTRGAVGHLGLMGPDGEPGIPGYRGHQGQPGPSGLPGPKGEKGYPGEDSTVLGPPGPRGEPGPVGDQGERGEPGAEGYKGHVGVPGLRGATGQQGPPGEPGDQGEQGLKGERGSEGNKGKKGAPGPSGKPGIPGLQGLLGPKGIQGYHGADGISGNPGKIGPPGKQGLPGIRGGPGRTGLAGAPGPPGVKGSSGLPGSPGIQGPKGEQGLPGQPGIQGKRGHRGAQGDQGPCGDPGLKGQPGEYGVQGLTGFQGFPGPKGPEGDAGIVGISGPKGPIGHRGNTGPLGREGIIGPTGRTGPRGEKGFRGETGPQGPRGQPGPPGPPGAPGPRKQMDINAAIQALIESNTALQMESYQNTEVTLIDHSEEIFKTLNYLSNLLHSIKNPLGTRDNPARICKDLLNCEQKVSDGKYWIDPNLGCPSDAIEVFCNFSAGGQTCLPPVSVTKLEFGVGKVQMNFLHLLSSEATHIITIHCLNTPRWTSTQTSGPGLPIGFKGWNGQIFKVNTLLEPKVLSDDCKIQDGSWHKATFLFHTQEPNQLPVIEVQKLPHLKTERKYYIDSSSVCFL

SEQ ID NO: 1208 - protein, 1693 aa, Homo sapiens
MHLRAHRTRRGKVSPTAKTKSLLHFIVLCVAGVVVHAQEQGIDILHQLGLGGKDVRHSSPATAVPSASTPLPQGVHLTESGVIFKNDAYIETPFVKILPVNLGQPFTILTGLQSHRVNNAFLFSIRNKNRLQLGVQLLPKKLVVHIRGKQPAVFNYSVHDEQWHSFAITIRNQSVSMFVECGKKYFSTETIPEVQTFDSNSVFTLGSMNNNSIHFEGIVCQLDIIPSAEASADYCRYVKQQCRQADKYQPETSIPCTTLIPTKIPEHSPPPKLFAEKVLSEDTFTEGKSIPNIIKNDSETVYKRQEHQISRSQLSSLQSGNVSAVDLTNHGIQAKEMITEEDTQTNFSLSVTTHRISEAKMNTKEKFSSLLNMSDNITQHDDRVTGLSLFKKMPSILPQIKQDTITNLKKAITANLHTNELMEMQPILNTSLHRVTNEPSVDNHLDLRKEGEFYPDATYPIENSYETELYDYYYYEDLNTMLEMEYLRGPKGDTGPPGPPGPAGIPGPSGKRGPRGIPGPHGNPGLPGLPGPKGPKGDPGFSPGQPVPGEKGDQGLSGLMGPPGMQGDKGLKGHPGLPGLPGEQGIPGFAGNIGSPGYPGRQGLAGPEGNPGPKGAQGFIGSPGEAGQLGPEGERGIPGIRGKKGFKGRQGFPGDFGDRGPAGLDGSPGLVGGTGPPGFPGLRGSVGPVGPIGPAGIPGPMGLSGNKGLPGIKGDKGEQGTAGELGEPGYPGDKGAVGLPGPPGMRGKSGPSGQTGDPGLQGPSGPPGPEGFPGDIGIPGQNGPEGPKGLLGNRGPPGPPGLKGTQGEEGPIGAFGELGPRGKPGQKGYAGEPGPEGLKGEVGDQGNIGKIGETGPVGLPGEVGMTGSIGEKGERGSPGPLGPQGEKGVMGYPGPPGVPGPIGPLGLPGHVGARGPPGSQGPKGQRGSRGPDGLLGEQGIQGAKGEKGDQGKRGPHGLIGKTGNPGERGFQGKPGLQGLPGSTGDRGLPGEPGLRGLQGDVGPPGEMGMEGPPGTEGESGLQGEPGAKGDVGTAGSVGGTGEPGLRGEPGAPGEEGLQGKDGLKGVPGGRGLPGEDGEKGEMGLPGIIGPLGRSGQTGLPGPEGIVGIPGQRGRPGKKGDKGQIGPTGEVGSRGPPGKIGKSGPKGARGTRGAVGHLGLMGPDGEPGIPGYRGHQGQPGPSGLPGPKGEKGYPGEDSTVLGPPGPRGEPGPVGDQGERGEPGAEGYKGHVGVPGLRGATGQQGPPGEPGDQGEQGLKGERGSEGNKGKKGAPGPSGKPGIPGLQGLLGPKGIQGYHGADGISGNPGKIGPPGKQGLPGIRGGPGRTGLAGAPGPPGVKGSSGLPGSPGIQGPKGEQGLPGQPGIQGKRGHRGAQGDQGPCGDPGLKGQPGEYGVQGLTGFQGFPGPKGPEGDAGIVGISGPKGPIGHRGNTGPLGREGIIGPTGRTGPRGEKGFRGETKQMDINAAIQALIESNTALQMESYQNTEVTLIDHSEEIFKTLNYLSNLLHSIKNPLGTRDNPARICKDLLNCEQKVSDGKYWIDPNLGCPSDAIEVFCNFSAGGQTCLPPVSVTKLEFGVGKVQMNFLHLLSSEATHIITIHCLNTPRWTSTQTSGPGLPIGFKGWNGQIFKVNTLLEPKVLSDDCKIQDGSWHKATFLFHTQEPNQLPVIEVQKLPHLKTERKYYIDSSSVCFL

SEQ ID NO: 1209 - protein, 81 aa, Homo sapiens
MHLRAHRTRRGKVSPTAKTKSLLHFIVLCVAGVVVHAQEQGIDILHQLGLGGKDVRHSSPATAVPSASTPLPQGVHLTESG

SEQ ID NO: 1210 - protein, 656 aa, Homo sapiens
MLLKKHAGKGGGREPRSEDPTPAEQHCARTMPPCAVLAALLSVVAVVSCLYLGVKTNDLQARIAALESAKGAPSIHLLPDTLDHLKTMVQEKVERLLAQKSYEHMAKIRIAREAPSECNCPAGPPGKRGKRGRRGESAGPPGAPAPSQGPPGPKGDKGEQGDQGPRMVFPKINHGFLSADQQLIKRRLIKGDQGQAGPPGPPGPPGPRGPPGDTGKDGPRGMPGVPGEPGKPGEQGLMGPLGPPGQKGSIGAPGIPGMNGQKGEPGLPGAVGQNGIPGPKGEPGEQGEKGDAGENGPKGDTGEKGDPGSSAAGIKGEPGESGRPGQKGEPGLPGLPGLPGIKGEPGFIGPQGEPGLPGLPGTKGERGEAGPPGRGERGEPGAPGPKGKQGESGTRGPKGSKGDRGEKGDSGAQGPRGPPGQKGDQGATEIIDYNGNLHEALQRITTLTVTGPPGPPGPQGLQGPKGEQGSPGIPGMDGEQGLKGSKGDMGDPGMTGEKGGIGLPGLPGANGMKGEKGDSGMPGPQGPSIIGPPGPPGPHGPPGPMGPHGLPGPKGTDGPMGPHGPAGPKGERGEKGAMGEPGPRGPYGLPGKDGEPGLDGFPGPRGEKGDLGEKGEKGFRGVKGEKGEPGQPGLDGLDAPCQLGPDGLPMPGCWQK

SEQ ID NO: 1211 - protein, 642 aa, Homo sapiens
MLLKKHAGKGGGREPRSEDPTPAEQHCARTMPPCAVLAALLSVVAVVSCLYLGVKTNDLQARIAALESAKGAPSIHLLPDTLDHLKTMVQEKVERLLAQKSYEHMAKIRIAREAPSECNCPAGPPGKRGKRGRRGESGPPGQPGPQGPPGPKGDKGEQGDQGPRMVFPKINHGFLSADQQLIKRRLIKGDQGQAGPPGPPGPPGPRGPPGDTGKDGPRGMPGVPGEPGKPGEQGLMGPLGPPGQKGSIGAPGIPGMNGQKGEPGLPGAVGQNGIPGPKGEPGEQGEKGDAGENGPKGDTGEKGDPGSSAAGIKGEPGESGRPGQKGEPGLPGLPGLPGIKGEPGFIGPQGEPGLPGLPGTKGERGEAGPPGRGERGEPGAPGPKGKQGESGTRGPKGSKGDRGEKGDSGAQGPRGPPGQKGDQGATEIIDYNGNLHEALQRITTLTVTGPPGPPGPQGLQGPKGEQGSPGIPGMDGEQGLKGSKGDMGDPGMTGEKGGIGLPGLPGANGMKGEKGDSGMPGPQGPSIIGPPGPPGPHGPPGPMGPHGLPGPKGTDGPMGPHGPAGPKGERGEKGAMGEPGPRGPYGLPGKDGEPGLDGFPGPRGEKGDLGEKGEKVTSPSQHVPCLILLLLSALLFSLCDSI

SEQ ID NO: 1212 - protein, 654 aa, Homo sapiens
MLLKKHAGKGGGREPRSEDPTPAEQHCARTMPPCAVLAALLSVVAVVSCLYLGVKTNDLQARIAALESAKGAPSIHLLPDTLDHLKTMVQEKVERLLAQKSYEHMAKIRIAREAPSECNCPAGPPGKRGKRGRRGESGPPGQPGPQGPPGPKGDKGEQGDQGPRMVFPKINHGFLSADQQLIKRRLIKGDQGQAGPPGPPGPPGPRGPPGDTGKDGPRGMPGVPGEPGKPGEQGLMGPLGPPGQKGSIGAPGIPGMNGQKGEPGLPGAVGQNGIPGPKGEPGEQGEKGDAGENGPKGDTGEKGDPGSSAAGIKGEPGESGRPGQKGEPGLPGLPGLPGIKGEPGFIGPQGEPGLPGLPGTKGERGEAGPPGRGERGEPGAPGPKGKQGESGTRGPKGSKGDRGEKGDSGAQGPRGPPGQKGDQGATEIIDYNGNLHEALQRITTLTVTGPPGPPGPQGLQGPKGEQGSPGIPGMDGEQGLKGSKGDMGDPGMTGEKGGIGLPGLPGANGMKGEKGDSGMPGPQGPSIIGPPGPPGPHGPPGPMGPHGLPGPKGTDGPMGPHGPAGPKGERGEKGAMGEPGPRGPYGLPGKDGEPGLDGFPGPRGEKGDLGEKGEKGFRGVKGEKGEPGQPGLDGLDAPCQLGPDGLPMPGCWQK

SEQ ID NO: 1213 - protein, 583 aa, Homo sapiens
MLLKKHAGKGGGREPRSEDPTPAEQHCARTMPPCAVLAALLSVVAVVSCLYLGVKTNDLQARIAALESAKGAPSIHLLPDTLDHLKTMVQEKVERLLAQKSYEHMAKIRIAREAPSECNCPAGPPGKRGKRGRRGESAGPPGGPPGPKGDKGEQGDQGPRMVFPKINHGFLSADQQLIKRRLIKGDQGQAGPPGPPGPPGPRGPPGDTGKDGPRGMPGVPGEPGKPGEQGLMGPLGPPGQKGSIGAPGIPGMNGQKGEPGLPGAVGQNGIPGPKGEPGEQGEKGDAGENGPKGDTGEKGDPGSSAAGIKGEPGESGRPGQKGEPGFIGPQGEPGLPGLPGTKGERGEAGPPGRGERGEPGAPGPKGKQGESGTRGPKGSKGDRGEKGDSGAQGPRGPPGQKGDQGATEIIDYNGNLHEALQRITTLTVTGPPGPPGPQGLQGPKGEQGSPGIPGMDGEQGLKGSKGDMGDPGMTGEKGGIGLPGLPGANGMKGEKGDSGMPGPQGPSIIGPPGPPGPHGPPGPMGPHGLPGPKGTDGPMGPHGPAGPKGERGEKGAMGEPGPRGPYGLPQGPDGLPMPGCWQK

SEQ ID NO: 1214 - protein, 498 aa, Homo sapiens
MLLKKHAGKGGGREPRSEDPTPAEQHCARTMPPCAVLAALLSVVAVVSCLYLGVKTNDLQARIAALESAKGAPSIHLLPDTLDHLKTMVQEKVERLLAQKSYEHMAKIRIAREAPSECNCPAGPPGKRGKRGRRGESAGPPGAPAPSQGPPGPKGDKGEQGDQGPRGPLGPPGQKGSIGAPGIPGMNGQKGEPGLPGAVGQNGIPGPKGEPGEQGEKGDAGENGPKGDTGEKGDPGSSAAGIKGEPGESGRPGQKGEPGLPGLPGLPGIKGEPGFIGPQGEPGLPGLPGTKGERGEAGPPGRGERGEPGAPGPKGKQGESGTRGPKGSKGDRGEKGDSGAQGPRGPPGQKGDQGATEIIDYNGNLHEALQRITTLTVTGPPGPPGPQGLQGPKGEQGSPGIPGMDGEQGLKGSKGDMGDPGSQWNERRKRRFWNAGSTGSFYHRPTRPTRSPWPTWPHGTSWTSWTKGSIWLRRKARIPGYRWSYGTPWPCRSQRRKS

SEQ ID NO: 1215 - protein, 70 aa, Homo sapiens
MLLKKHAGKGGGREPRSEDPTPAEQHCARTMPPCAVLAALLSVVAVVSCLYLGVKTNDLQARIAALESAK

SEQ ID NO: 1216 - protein, 29 aa, Homo sapiens
  MOD_RES (1)..(1): Any amino acid
XGPRGEKGDLGEKGEKGPDGLPMPGCWQK

SEQ ID NO: 1217 - protein, 1860 aa, Homo sapiens
MGAGSARGARGTAAAAAARGGGFLFSWILVSFACHLASTQGAPEDVDILQRLGLSWTKAGSPAPPGVIPFQSGFIFTQRARLQAPTGTVIPAALGTELALVLSLCSHRVNHAFLFAVRSQKRKLQLGLQFLPGKTVVHLGSRRSVAFDLDMHDGRWHHLALELRGRTVTLVTACGQRRVPVLLPFHRDPALDPGGSFLFGKMNPHAVQFEGALCQFSIYPVTQVAHNYCTHLRKQCGQADTYQSPLGPLFSQDSGRPFTFQSDLALLGLENLTTATPALGSLPAGRGPRGTVAPATPTKPQRTSPTNPHQHMAVGGPAQTPLLPAKLSASNALDPMLPASVGGSTRTPRPAAAQPSQKITATKIPKSLPTKPSAPSTSIVPIKSPHPTQKTAPSSFTKSALPTQKQVPPTSRPVPARVSRPAEKPIQRNPGMPRPPPPSTRPLPPTTSSSKKPIPTLARTEAKITSHASKPASARTSTHKPPPFTALSSSPAPTPGSTRSTRPPATMVPPTSGTSTPRTAPAVPTPGSAPTGSKKPIGSEASKKAGPKSSPRKPVPLRPGKAARDVPLSDLTTRPSPRQPQPSQQTTPALVLAPAQFLSSSPRPTSSGYSIFHLAGSTPFPLLMGPPGPKGDCGLPGPPGLPGLPGIPGARGPRGPPGPYGNPGLPGPPGAKGQKGDPGLSPGKAHDGAKGDMGLPGLSGNPGPPGRKGHKGYPGPAGHPGEQGQPGPEGSPGAKGYPGRQGLPGPVGDPGPKGSRGYIGLPGLFGLPGSDGERGLPGVPGKRGKMGMPGFPGVFGERGPPGLDGNPGELGLPGPPGVPGLIGDLGVLGPIGYPGPKGMKGLMGSVGEPGLKGDKGEQGVPGVSGDPGFQGDKGSQGLPGFPGARGKPGPLGKVGDKGSIGFPGPPGPEGFPGDIGPPGDNGPEGMKGKPGARGLPGPRGQLGPEGDEGPMGPPGAPGLEGQPGRKGFPGRPGLDGVKGEPGDPGRPGPVGEQGFMGFIGLVGEPGIVGEKGDRGMMGPPGVPGPKGSMGHPGMPGGMGTPGEPGPQGPPGSRGPPGMRGAKGRRGPRGPDGPAGEQGSRGLKGPPGPQGRPGRPGQQGVAGERGHLGSRGFPGIPGPSGPPGTKGLPGEPGPQGPQGPIGPPGEMGPKGPPGAVGEPGLPGEAGMKGDLGPLGTPGEQGLIGQRGEPGLEGDSGPMGPDGLKGDRGDPGPDGEHGEKGQEGLMGEDGPPGPPGVTGVRGPEGKSGKQGEKGRTGAKGAKGYQGQLGEMGVPGDPGPPGTPGPKGSRGSLGPTGAPGRMGAQGEPGLAGYDGHKGIVGPLGPPGPKGEKGEQGEDGKAEGPPGPPGDRGPVGDRGDRGEPGDPGYPGQEGVQGLRGKPGQQGQPGHPGPRGWPGPKGSKGAEGPKGKQGKAGAPGRRGVQGLQGLPGPRGVVGRQGLEGIAGPDGLPGRDGQAGQQGEQGDDGDPGPMGPAGKRGNPGVAGLPGAQGPPGFKGESGLPGQLGPPGKRGTEGRTGLPGNQGEPGSKGQPGDSGEMGFPGMAGLFGPKGPPGDIGFKGIQGPRGPPGLMGKEGIVGPLGILGPSGLPGPKGDKGSRGDWGLQGPRGPPGPRGRPGPPGPPGGPIQLQQDDLGAAFQTWMDTSGALRPESYSYPDRLVLDQGGEIFKTLHYLSNLIQSIKTPLGTKENPARVCRDLMDCEQKMVDGTYWVDPNLGCSSDTIEVSCNFTHGGQTCLKPITASKVEFAISRVQMNFLHLLSSEVTQHITIHCLNMTVWQEGTGQTPAKQAVRFRAWNGQIFEAGGQFRPEVSMDGCKVQDGRWHQTLFTFRTQDPQQLPIISVDNLPPASSGKQYRLEVGPACFL

SEQ ID NO: 1218 - protein, 1867 aa, Homo sapiens
MGAGSARGARGTAAAAAARGGGFLFSWILVSFACHLASTQGAPEDVDILQRLGLSWTKAGSPAPPGVIPFQSGFIFTQRARLQAPTGTVIPAALGTELALVLSLCSHRVNHAFLFAVRSQKRKLQLGLQFLPGKTVVHLGSRRSVAFDLDMHDGRWHHLALELRGRTVTLVTACGQRRVPVLLPFHRDPALDPGGSFLFGKMNPHAVQFEGALCQFSIYPVTQVAHNYCTHLRKQCGQADTYQSPLGPLFSQDSGRPFTFQSDLALLGLENLTTATPALGSLPAGRGPRGTVAPATPTKPQRTSPTNPHQHMAVGGPAQTPLLPAKLSASNALDPMLPASVGGSTRTPRPAAAQPSQKITATKIPKSLPTKPSAPSTSIVPIKSPHPTQKTAPSSFTKSALPTQKQVPPTSRPVPARVSRPAEKPIQRNPGMPRPPPPSTRPLPPTTSSSKKPIPTLARTEAKITSHASKPASARTSTHKPPPFTALSSSPAPTPGSTRSTRPPATMVPPTSGTSTPRTAPAVPTPGSAPTGSKKPIGSEASKKAGPKSSPRKPVPLRPGKAARDVPLSDLTTRPSPRQPQPSQQTTPALVLAPAQFLSSSPRPTSSGYSIFHLAGSTPFPLLMGPPGPKGDCGLPGPPGLPGLPGIPGARGPRGPPGPYGNPGLPGPPGAKGQKGDPGLSPGKAHDGAKGDMGLPGLSGNPGPPGRKGHKGYPGPAGHPGEQGQPGPEGSPGAKGYPGRQGLPGPVGDPGPKGSRGYIGLPGLFGLPGSDGERGLPGVPGKRGKMGMPGFPGVFGERGPPGLDGNPGELGLPGPPGVPGLIGDLGVLGPIGYPGPKGMKGLMGSVGEPGLKGDKGEQGVPGVSGDPGFQGDKGSQGLPGFPGARGKPGPLGKVGDKGSIGFPGPPGPEGFPGDIGPPGDNGPEGMKGKPGARGLPGPRGQLGPEGDEGPMGPPGAPGLEGQPGRKGFPGRPGLDGVKGEPGDPGRPGPVGEQGFMGFIGLVGEPGIVGEKGDRGMMGPPGVPGPKGSMGHPGMPGGMGTPGEPGPQGPPGSRGPPGMRGAKGRRGPRGPDGPAGEQGSRGLKGPPGPQGRPGRPGQQGVAGERGHLGSRGFPGIPGPSGPPGTKGLPGEPGPQGPQGPIGPPGEMGPKGPPGAVGEPGLPGEAGMKGDLGPLGTPGEQGLIGQRGEPGLEGDSGPMGPDGLKGDRGDPGPDGEHGEKGQEGLMGEDGPPGPPGVTGVRGPEGKSGKQGEKGRTGAKGAKGYQGQLGEMGVPGDPGPPGTPGPKGSRGSLGPTGAPGRMGAQGEPGLAGYDGHKGIVGPLGPPGPKGEKGEQGEDGKAEGPPGPPGDRGPVGDRGDRGEPGDPGYPGQEGVQGLRGKPGQQGQPGHPGPRGWPGPKGSKGAEGPKGKQGKAGAPGRRGVQGLQGLPGPRGVVGRQGLEGIAGPDGLPGRDGQAGQQGEQGDDGDPGPMGPAGKRGNPGVAGLPGAQGPPGFKGESGLPGQLGPPGKRGTEGRTGLPGNQGEPGSKGQPGDSGEMGFPGMAGLFGPKGPPGDIGFKGIQGPRGPPGLMGKEGIVGPLGILGPSGLPGPKGDKGSRGDWGLQGPRGPPGPRGRPGPPVDPGGPRYIPCLFLAQQQDDLGAAFQTWMDTSGALRPESYSYPDRLVLDQGGEIFKTLHYLSNLIQSIKTPLGTKENPARVCRDLMDCEQKMVDGTYWVDPNLGCSSDTIEVSCNFTHGGQTCLKPITASKVEFAISRVQMNFLHLLSSEVTQHITIHCLNMTVWQEGTGQTPAKQAVRFRAWNGQIFEAGGQFRPEVSMDGCKVQDGRWHQTLFTFRTQDPQQLPIISVDNLPPASSGKQYRLEVGPACFL

SEQ ID NO: 1219 - protein, 714 aa, Homo sapiens
LSWTKAGSPAPPGVIPFQSGFIFTQRARLQAPTGTVIPAALGTELALVLSLCSHRVNHAFLFAVRSQKRKLQLGLQFLPGKTVVHLGSRRSVAFDLDMHDGRWHHLALELRGRTVTLVTACGQRRVPVLLPFHRDPALDPGGSFLFGKMNPHAVQFEGALCQFSIYPVTQVAHNYCTHLRKQCGQADTYQSPLGPLFSQDSGRPFTFQSDLALLGLENLTTATPALGSLPAGRGPRGTVAPATPTKPQRTSPTNPHQHMAVGGPAQTPLLPAKLSASNALDPMLPASVGGSTRTPRPAAAQPSQKITATKIPKSLPTKPSAPSTSIVPIKSPHPTQKTAPSSFTKSALPTQKQVPPTSRPVPARVSRPAEKPIQRNPGMPRPPPPSTRPLPPTTSSSKKPIPTLARTEAKITSHASKPASARTSTHKPPPFTALSSSPAPTPGSTRSTRPPATMVPPTSGTSTPRTAPAVPTPGSAPTGSKKPIGSEASKKAGPKSSPRKPVPLRPGKAARDVPLSDLTTRPSPRQPQPSQQTTPALVLAPAQFLSSSPRPTSSGYSIFHLAGSTPFPLLMGPPGPKGDCGLPGPPGLPGLPGIPGARGPRGPPGPYGNPGLPGPPGAKGDMGLPGLSGNPGPPGRKGLPGPVGDPGPKGSRGYIGLPGLFGLPGSDGERGLPGVPGKRGKMGMPVLLPQSSEARGGNSMPSEGALAGRHGSHL

SEQ ID NO: 1220 - protein, 713 aa, Homo sapiens
MWNRYFVFYLLLLSAFTSQTVSGQRKKGPKSNLLARKSDVQGSICFIDIVFIVDSSESSKIALFDKQKDFVDSLSDKIFQLTPGRSLEYDIKLAALQFSSSVQIDPPFSSWKDLQTFKQKVKSMNLIGQGTFSYYAISNATRLLKREGRKDGVKVVLLMTDGIDHPKNPDVQSISEDARISGISFITIALSTVVNEAKLRLISGDSSSEPTLLLSDPTLVDKIQDRLEMLFEIQCERKICECEKGDPGDPGPPGTHGNPGIKGERGPKGNPGNAQKGEAGERGPGGIPGYKGDKGERGECGKPGIKGDKGSPGPYGPKGPRGIQGITGPPGDPGPKGFQGNKGEPGPPGPYGSPGAPGIGQQGIKGERGQEGRPGAPGPIGVGEPGQPGPRGPEGVPGERGLPGEGFPGPKGEKGSEGPTGPQGLQGLSIKGEKGDIGPVGPQGPMGIPGIGSQGEQGIQGPIGPPGPQGPAGQGLPGSKGEVGQMGPTGPRGPVGIGVQGPKGEPGSIGLPGQPGVPGEDGAAGKKGEAGLPGARGPEGPPGKGQPGPKGDEGKKGSKGNQGQRGLPGPEGPKGEPGIMGPFGMPGTSIPGPPGPKGDRGGPGIPGFKGEPGLSIRGPKGVQGPRGPVGAPGLKGDGYPGVPGPRGLPGPPGPMGLRGVGDTGAKTLNTSHGLEDPSCPDCSFCHFSLAADIQPKWPALLQLIPASGTRQDG

SEQ ID NO: 1221 - protein, 1125 aa, Homo sapiens
MWNRYFVFYLLLLSAFTSQTVSGQRKKGPKSNLLARKSDVQGSICFIDIVFIVDSSESSKIALFDKQKDFVDSLSDKIFQLTPGRSLEYDIKLAALQFSSSVQIDPPFSSWKDLQTFKQKVKSMNLIGQGTFSYYAISNATRLLKREGRKDGVKVVLLMTDGIDHPKNPDVQSISEDARISGISFITIALSTVVNEAKLRLISGDSSSEPTLLLSDPTLVDKIQDRLDILFEKKCERKICECEKGDPGDPGPPGTHGNPGIKGERGPKGNPGNAQKGEAGERGPGGIPGYKGDKGERGECGKPGIKGDKGSPGPYGPKGPRGIQGITGPPGDPGPKGFQGNKGEPGPPGPYGSPGAPGIGQQGIKGERGQEGRPGAPGPIGVGEPGQPGPRGPEGVPGERGLPGEGFPGPKGEKGSEGPTGPQGLQGLSIKGEKGDIGPVGPQGPMGIPGIGSQGEQGIQGPIGPPGPQGPAGQGLPGSKGEVGQMGPTGPRGPVGIGVQGPKGEPGSIGLPGQPGVPGEDGAAGKKGEAGLPGARGPEGPPGKGQPGPKGDEGKKGSKGNQGQRGLPGPEGPKGEPGIMGPFGMPGTSIPGPPGPKGDRGGPGIPGFKGEPGLSIRGPKGVQGPRGPVGAPGLKGDGYPGVPGPRGLPGPPGPMGLRGVGDTGAKGEPGVRGPPGPSGPRGVGTQGPKGDTGQKGLPGPPGPPGYGSQGIKGEQGPQGFPGPKGTMGHGLPGQKGEHGERGDVGKKGDKGEIGEPGSPGKQGLQGPKGDLGLTKEEIIKLITEICGCGPKCKETPLELVFVIDSSESVGPENFQIIKNFVKTMADRVALDLATARIGIINYSHKVEKVANLKQFSSKDDFKLAVDNMQYLGEGTYTATALQAANDMFEDARPGVKKVALVITDGQTDSRDKEKLTEVVKNASDTNVEIFVIGVVKKNDPNFEIFHKEMNLIATDPEHVYQFDDFFTLQDTLKQKLFQKICEDFDSYLVQIFGSSSPQPGFGMSGEELSESTPEPQKEISESLSVTRDQDEDDKAPEPTWADDLPATTSSEATTTPRPLLSTPVDGAEDPRCLEALKPGNCGEYVVRWYYDKQVNSCARFWFSGCNGSGNRFNSEKECQETCIQG

SEQ ID NO: 1222 - protein, 334 aa, Homo sapiens [sequence omitted]

SEQ ID NO: 1223 - protein, 80 aa, Homo sapiens
ATTSSEATTTPRPLLSTPVDGAEDPRCLEALKPGNCGEYVVRWYYDKQVNSCARFWFSGCNGSGNRFNSEKECQETCIQG

SEQ ID NO: 1224 - protein, 528 aa, Homo sapiens
MGSSRAPWMGRVGGHGMLALLLAGLLLPGTLAKSIGTFSDPCKDPTRITSPNDPCLTGKGDSSGFSSYSGSSSSGSSISSARSSGGGSSGSSSGSSIAQGGSAGSFKPGTGYSQVSYSSGSGSSLQGASGSSQLGSSSSHSGSSGSHSGSSSHSSSSSSFQFSSSSFQVGNGSALPTNDNSYRGILNPSQPGQSSSSSQTFGVSSSGQSVSSNQRPCSSDIPDSPCSGGPIVSHSGPYIPSSHSVSGGQRPVVVVVDQHGSGAPGVVQGPPCSNGGLPGKPCPPITSVDKSYGGYEVVGGSSDSYLVPGMTYSKGKIYPVGYFTKENPVKGSPGVPSFAAGPPISEGKYFSSNPIIPSQSAASSAIAFQPVGTGGVQLCGGGSTGSKGPCSPSSSRVPSSSSISSSSGLPYHPCGSASQSPCSPPGTGSFSSSSSSQSSGKIILQPCGSKSSSSGHPCMSVSSLTLTGGPDGSPHPDPSAGAKPCGSSSAGKIPCRSIRDILAQVKPLGPQLADPEVFLPQGELLDSP

SEQ ID NO: 1225 - protein, 529 aa, Homo sapiens
MGSSRAPWMGRVGGHGMMALLLAGLLLPGTLAKSIGTFSDPCKDPTRITSPNDPCLTGKGDSSGFSSYSGSSSSGSSISSARSSGGGSSGSSSGSSIAQGGSAGSFKPGTGYSQVSYSSGSGSSLQGASGSSQLGSSSSHSGNSGSHSGSSSSHSSSSSSFQFSSSSFQVGNGSALPTNDNSYRGILNPSQPGQSSSSSQTFGVSSSGQSVSSNQRPCSSDIPDSPCSGGPIVSHSGPYIPSSHSVSGGQRPVVVVVDQHGSGAPGVVQGPPCSNGGLPGKPCPPITSVDKSYGGYEVVGGSSDSYLVPGMTYSKGKIYPVGYFTKENPVKGSPGVPSFAAGPPISEGKYFSSNPIIPSQSAASSAIAFQPVGTGGVQLCGGGSTGSKGPCSPSSSRVPSSSSISSSSGLPYHPCGSASQSPCSPPGTGSFSSSSSSQSSGKIILQPCGSKSSSSGHPCMSVSSLTLTGGPDGSPHPDPSAGAKPCGSSSAGKIPCRSIRDILAQVKPLGPQLADPEVFLPQGELLNSP

SEQ ID NO: 1226 - protein, 529 aa, Homo sapiens
MGSSRAPWMGRVGGHGMMALLLAGLLLPGTLAKSIGTFSDPCKDPTRITSPNDPCLTGKGDSSGFSSYSGSSSSGSSISSARSSGGGSSGSSSGSSIAQGGSAGSFKPGTGYSQVSYSSGSGSSLQGASGSSQLGSSSSHSGSSGSHSGSSSSHSSSSSSFQFSSSSFQVGNGSALPTNDNSYRGILNPSQPGQSSSSSQTFGVSSSGQSVSSNQRPCSSDIPDSPCSGGPIVSHSGPYIPSSHSVSGGQRPVVVVVDQHGSGAPGVVQGPPCSNGGLPGKPCPPITSVDKSYGGYEVVGGSSDSYLVPGMTYSKGKIYPVGYFTKENPVKGSPGVPSFAAGPPISEGKYFSSNPIIPSQSAASSAIAFQPVGTGGVQLCGGGSTGSKGPCSPSSSRVPSSSSISSSAGSPYHPCGSASQSPCSPPGTGSFSSSSSSQSSGKIILQPCGSKSSSSGHPCMSVSSLTLTGGPDGSPHPDPSAGAKPCGSSSAGKIPCRSIRDILAQVKPLGPQLADPEVFLPQGELLDSP

SEQ ID NO: 1227 - protein, 529 aa, Homo sapiens [sequence omitted]

SEQ ID NO: 1228 - protein, 529 aa, Homo sapiens
MGSSRAPWMGRVGGHGMMALLLAGLLLPGTLAKSIGTFSDPCKDPTRITSPNDPCLTGKGDSSGFSSYSGSSSSGSSISSARSSGGGSSGSSSGSSIAQGGSAGSFKPGTGYSQVSYSSGSGSSLQGASGSSQLGSSSSHSGSSGSHSGSSSSHSSSSSSFQFSSSSFQVGNGSALPTNDNSYRGILNPSQPGQSSSSSQTSGVSSSGQSVSSNQRPCSSDIPDSPCSGGPIVSHSGPYIPSSHSVSGGQRPVVVVVDQHGSGAPGVVQGPPCSNGGLPGKPCPPITSVDKSYGGYEVVGGSSDSYLVPGMTYSKGKIYPVGYFTKENPVKGSPGVPSFAAGPPISEGKYFSSNPIIPSQSAASSAIAFQPVGTGGVQLCGGGSTGSKGPCSPSSSRVPSSSSISSSSGSPYHPCGSASQSPCSPPGTGSFSSSSSSQSSGKIILQPCGSKSSSSGHPCMSVSSLTLTGGPDGSPHPDPSAGAKPCGSSSAGKIPCRSIRDILAQVKPLGPQLADPEVFLPQGELLDSP

SEQ ID NO: 1229 - protein, 529 aa, Homo sapiens; identical to SEQ ID NO: 1228

SEQ ID NO: 1230 - protein, 84 aa, Homo sapiens
VLHSFTDAIFDEWMKRFNPPADAWPQELAPIGHNRMYNMVPFFPPVTNEELFLTSDQLGYSYAIDLPDFQANFICSYLVSVHQE

SEQ ID NO: 1231 - protein, 519 aa, Homo sapiens
MSPLWWGFLLSCLGCKILPGAQGQFPRVCMTVDSLVNKECCPRLGAESANVCGSQQGRGQCTEVRADTRPWSGPYILRNQDDRELWPRKFFHRTCKCTGNFAGYNCGDCKFGWTGPNCERKKPPVIRQNIHSLSPQEREQFLGALDLAKKRVHPDYVITTQHWLGLLGPNGTQPQFANCSVYDFFVWLHYYSVRDTLLGPGRPYRAIDFSHQGPAFVTWHRYHLLCLERDLQRLIGNESFALPYWNFATGRNECDVCTDQLFGAARPDDPTLISRNSRFSSWETVCDSLDDYNHLVTLCNGTYEGLLRRNQMGRNSMKLPTLKDIRDCLSLQKFDNPPFFQNSTFSFRNALEGFDKADGTLDSQVMSLHNLVHSFLNGTNALPHSAANDPIFVVLHSFTDAIFDEWMKRFNPPADAWPQELAPIGHNRMYNMVPFFPPVTNEELFLTSDQLGYSYAIDLPVSVEETPGWPTTLLVVMGTLVALVGLFVLLAFLQYRRLRKGYTPLMETHLSSKRYTEEA

SEQ ID NO: 1232 - protein, 552 aa, Homo sapiens
MSPLWWGFLLSCLGCKILPGAQGQFPRVCMTVDSLVNKECCPRLGAESANVCGSQQGRGQCTEVRADTRPWSGPYILRNQDDRELWPRKFFHRTCKCTGNFAGYNCGDCKFGWTGPNCERKKPPVIRQNIHSLSPQEREQFLGALDLAKKRVHPDYVITTQHWLGLLGPNGTQPQFANCSVYDFFVWLHYYSVRDTLLGPGRPYRAIDFSHQGPAFVTWHRYHLLCLERDLQRLIGNESFALPYWNFATGRNECDVCTDQLFGAARPDDPTLISRNSRFSSWETVCDSLDDYNHLVTLCNGTYEGLLRRNQMGRNSMKLPTLKDIRDCLSLQKFDNPPFFQNSTFSFRNALEGFDKADGTLDSQVMSLHNLVHSFLNGTNALPHSAANDPIFVVISNRLLYNATTNILEHVRKEKATKELPSLHVLVLHSFTDAIFDEWMKRFNPPADAWPQELAPIGHNRMYNMVPFFPPVTNEELFLTSDQLGYSYAIDLPVSVEETPGWPTTLLVVMGTLVALVGLFVLLAFLQYRRLRKGYTPLMETHLSSKRYTEEA

SEQ ID NO: 1233 - protein, 448 aa, Homo sapiens
MAHVGDCTQTPWLPVLVVSLMCSARAEYSNCGENEYYNQTTGLCQECPPCGPGEEPYLSCGYGTKDEDYGCVPCPAEKFSKGGYQICRRHKDCEGFFRATVLTPGDMENDAECGPCLPGYYMLENRPRNIYGMVCYSCLLAPPNTKECVGATSGASANFPGTSGSSTLSPFQHAHKELSGQGHLATALIIAMSTIFIMAIAIVLIIMFYILKTKPSAPACCTSHPGKSVEAQVSKDEEKKEAPDNVVMFSEKDEFEKLTATPAKPTKSENDASSENEQLLSRSVDSDEEPAPDKQGSPELCLLSLVHLAREKSATSNKSAGIQSRRKKILDVYANVCGVVEGLSPTELPFDCLEKTSRMLSSTYNSEKAVVKTWRHLAESFGLKRDEIGGMTDGMQLFDRISTAGYSIPELLTKLVQIERLDAVESLCADILEWAGVVPPASQPHAAS

SEQ ID NO: 1234 - protein, 480 aa, Homo sapiens
MAHVGDCTQTPWLPVLVVSLMCSARAEYSNCGENEYYNQTTGLCQECPPCGPGEEPYLSCGYGTKDEDYGCVPCPAEKFSKGGYQICRRHKDCEGFFRATVLTPGDMENDAECGPCLPGYYMLENRPRNIYGMVCYSCLLAPPNTKECVGATSGASANFPGTSGSSTLSPFQHAHKELSGQGHLATALIIAMSTIFIMAIAIVLIIMFYILKTKPSAPGDGPHAPVPCFLDSPSTPPVGEPGCSLPPLSPACCTSHPGKSVEAQVSKDEEKKEAPDNVVMFSEKDEFEKLTATPAKPTKSENDASSENEQLLSRSVDSDEEPAPDKQGSPELCLLSLVHLAREKSATSNKSAGIQSRRKKILDVYANVCGVVEGLSPTELPFDCLEKTSRMLSSTYNSEKAVVKTWRHLAESFGLKRDEIGGMTDGMQLFDRISTAGYSIPELLTKLVQIERLDAVESLCADILEWAGVVPPASQPHAAS

SEQ ID NO: 1235 - protein, 480 aa, Homo sapiens; identical to SEQ ID NO: 1234

SEQ ID NO: 1236 - protein, 318 aa, Homo sapiens
MDCQENEYWDQWGRCVTCQRCGPGQELSKDCGYGEGGDAYCTACPPRRYKSSWGHHRCQSCITCAVINRVQKVNCTATSNAVCGDCLPRFYRKTRIGGLQDQECIPCTKQTPTSEVQCAFQLSLVEADTPTVPPQEATLVALVSSLLVVFTLAFLGLFFLYCKQFFNRHCQREKLIIFSDPVPASLNLIPEFAGGLLQFEADKTAKEESLFPVPPSKETSAESQVSENIFQTQPLNPILEDDCSSTSGFPTQESFTMASCTSESHSHWVHSPIECTELDLQKFSSSASYTGAETLGGNTVESTGDRLELNVPFEVPSP

SEQ ID NO: 1237 - protein, 297 aa, Homo sapiens
MDCQENEYWDQWGRCVTCQRCGPGQELSKDCGYGEGGDAYCTACPPRRYKSSWGHHRCQSCITCAVINRVQKVNCTATSNAVCGDCLPRFYRKTRIGGLQDQECIPCTKQTPTSEVQCAFQLSLVEADTPTVPPQEATLVALVSSLLVVFTLAFLGLFFLYCKQFFNRHCQRGGLLQFEADKTAKEESLFPVPPSKETSAESQVSENIFQTQPLNPILEDDCSSTSGFPTQESFTMASCTSESHSHWVHSPIECTELDLQKFSSSASYTGAETLGGNTVESTGDRLELNVPFEVPSP

SEQ ID NO: 1238 - protein, 297 aa, Homo sapiens; identical to SEQ ID NO: 1237

SEQ ID NO: 1239 - protein, 318 aa, Homo sapiens; identical to SEQ ID NO: 1236

SEQ ID NO: 1240 - protein, 173 aa, Homo sapiens
MSTGTNGDGVSPANGVVLDRSYPRCLPVELSGGRYTHSAPSGGHTCCTGGLLQFEADKTAKEESLFPVPPSKETSAESQVSENIFQTQPLNPILEDDCSSTSGFPTQESFTMASCTSESHSHWVHSPIECTELDLQKFSSSASYTGAETLGGNTVESTGDRLELNVPFEVPSP

SEQ ID NO: 1241 - protein, 297 aa, Homo sapiens; identical to SEQ ID NO: 1237

SEQ ID NO: 1242 - protein, 215 aa, Homo sapiens
MGLRTTKQMGRGTKAPGHQEDHMVKEPVEDTDPSTLSFNMSDKYPIQDTELPKAEECDTITLNCPRNSDMKNQGEENGFPDSTGDPLPEISKDNSCKENCTCSSCLLRAPTISDLLNDQDLLDVIRIKLDPCHPTVKNWRNFASKWGMSYDELCFLEQRPQSPTLEFLLRNSQRTVGQLMELCRLYHRADVEKVLRRWVDEEWPKRERGDPSRHF

SEQ ID NO: 1243 - protein, 205 aa, Homo sapiens
MASPDDPLRADHMVKEPVEDTDPSTLSFNMSDKYPIQDTELPKAEECDTITLNCPRNSDMKNQGEENGFPDSTGDPLPEISKDNSCKENCTCSSCLLRAPTISDLLNDQDLLDVIRIKLDPCHPTVKNWRNFASKWGMSYDELCFLEQRPQSPTLEFLLRNSQRTVGQLMELCRLYHRADVEKVLRRWVDEEWPKRERGDPSRHF

SEQ ID NO: 1244 - protein, 84 aa, Homo sapiens
MVKEPVEDTDPSTLSFNMSDKYPIQDTELPKAEECDTITLNCPRNSDMKNQGEENGFPDSTGDPLPEISKDNSCKENCTCSSCL

SEQ ID NO: 1245 - protein, 724 aa, Homo sapiens
MAGLTAAAPRPGVLLLLLSILHPSRPGGVPGAIPGGVPGGVFYPGAGLGALGGGALGPGGKPLKPVPGGLAGAGLGAGLGAFPAVTFPGALVPGGVADAAAAYKAAKAGAGLGGVPGVGGLGVSAGAVVPQPGAGVKPGKVPGVGLPGVYPGGVLPGARFPGVGVLPGVPTGAGVKPKAPGVGGAFAGIPGVGPFGGPQPGVPLGYPIKAPKLPGGYGLPYTTGKLPYGYGPGGVAGAAGKAGYPTGTGVGPQAAAAAAAKAAAKFGAGAAGVLPGVGGAGVPGVPGAIPGIGGIAGVGTPAAAAAAAAAAKAAKYGAAAGLVPGGPGFGPGVVGVPGAGVPGVGVPGAGIPVVPGAGIPGAAVPGVVSPEAAAKAAAKAAKYGARPGVGVGGIPTYGVGAGGFPGFGVGVGGIPGVAGVPGVGGVPGVGGVPGVGISPEAQAAAAAKAAKYGVGTPAAAAAKAAAKAAQFGLVPGVGVAPGVGVAPGVGVAPGVGLAPGVGVAPGVGVAPGVGVAPGIGPGGVAAAAKSAAKVAAKAQLRAAAGLGAGIPGLGVGVGVPGLGVGAGVPGLGVGAGVPGFGAVPGALAAAKAAKYGAAVPGVLGGLGALGGVGIPGGVVGAGPAAAAAAAKAAAKAAQFGLVGAAGLGGLGVGGLGVPGVGGLGGIPPAAAAKAAKYGAAGLGGVLGGAGQFPLGGVAARPGFGLSPIFPGGACLGKACGRKRK

SEQ ID NO: 1246 - protein, 757 aa, Homo sapiens
MAGLTAAAPRPGVLLLLLSILHPSRPGGVPGAIPGGVPGGVFYPGAGLGALGGGALGPGGKPLKPVPGGLAGAGLGAGLGAFPAVTFPGALVPGGVADAAAAYKAAKAGAGLGGVPGVGGLGVSAGAVVPQPGAGVKPGKVPGVGLPGVYPGGVLPGARFPGVGVLPGVPTGAGVKPKAPGVGGAFAGIPGVGPFGGPQPGVPLGYPIKAPKLPGGYGLPYTTGKLPYGYGPGGVAGAAGKAGYPTGTGVGPQAAAAAAAKAAAKFGAGAAGVLPGVGGAGVPGVPGAIPGIGGIAGVGTPAAAAAAAAAAKAAKYGAAAGLVPGGPGFGPGVVGVPGAGVPGVGVPGAGIPVVPGAGIPGAAVPGVVSPEAAAKAAAKAAKYGARPGVGVGGIPTYGVGAGGFPGFGVGVGGIPGVAGVPGVGGVPGVGGVPGVGISPEAQAAAAAKAAKYGVGTPAAAAAKAAAKAAQFGLVPGVGVAPGVGVAPGVGVAPGVGLAPGVGVAPGVGVAPGVGVAPGIGPGGVAAAAKSAAKVAAKAQLRAAAGLGAGIPGLGVGVGVPGLGVGAGVPGLGVGAGVPGFGAGADEGVRRSLSPELREGDPSSSQHLPSTPSSPRVPGALAAAKAAKYGAAVPGVLGGLGALGGVGIPGGVVGAGPAAAAAAAKAAAKAAQFGLVGAAGLGGLGVGGLGVPGVGGLGGIPPAAAAKAAKYGAAGLGGVLGGAGQFPLGGVAARPGFGLSPIFPGGACLGKACGRKRK

SEQ ID NO: 1247 - protein, 711 aa, Homo sapiens
MAGLTAAAPRPGVLLLLLSILHPSRPGGVPGAIPGGVPGGVFYPGAGLGALGGGALGPGGKPLKPVPGGLAGAGLGAGLGAFPAVTFPGALVPGGVADAAAAYKAAKAGAGLGGVPGVGGLGVSAAPSVPGAVVPQPGAGVKPGKVPGVGLPGVYPGGVLPGARFPGVGVLPGVPTGAGVKPKAPGVGGAFAGIPGVGPFGGPQPGVPLGYPIKAPKLPGGYGLPYTTGKLPYGYGPGGVAGAAGKAGYPTGTGVGPQAAAAAAAKAAAKFGAGAAGVLPGVGGAGVPGVPGAIPGIGGIAGVGTPAAAAAAAAAAKAAKYGAAAGLVPGGPGFGPGVVGVPGAGVPGVGVPGAGIPVVPGAGIPGAAVPGVVSPEAAAKAAAKAAKYGARPGVGVGGIPTYGVGAGGFPGFGVGVGGIPGVAGVPGVGGVPGVGGVPGVGISPEAQAAAAAKAAKYGVGTPAAAAAKAAAKAAQFGLVPGVGVAPGVGVAPGVGVAPGVGLAPGVGVAPGVGVAPGVGVAPGIGPGGVAAAAKSAAKVAAKAQLRAAAGLGAGIPGLGVGVGVPGLGVGAGVPGLGVGAGVPGFGAVPGALAAAKAAKYGAAVPGVLGGLGALGGVGIPGGVVGAGPAAAAAAAKAAAKAAQFGLVGAAGLGGLGVGGLGVPGVGGLGGIPPAAAAKAAKYGVAARPGFGLSPIFPGGACLGKACGRKRK

SEQ ID NO: 1248 - protein, 792 aa, Homo sapiens
MAGLTAAAPRPGVLLLLLSILHPSRPGGVPGAIPGGVPGGVFYPGAGLGALGGGALGPGGKPLKPVPGGLAGAGLGAGLGAFPAVTFPGALVPGGVADAAAAYKAAKAGAGLGGVPGVGGLGVSAGAVVPQPGAGVKPGKVPGVGLPGVYPGGVLPGARFPGVGVLPGVPTGAGVKPKAPGVGGAFAGIPGVGPFGGPQPGVPLGYPIKAPKLPGGYGLPYTTGKLPYGYGPGGVAGAAGKAGYPTGTGVGPQAAAAAAAKAAAKFGAGAAGVLPGVGGAGVPGVPGAIPGIGGIAGVGTPAAAAAAAAAAKAAKYGAAAGLVPGGPGFGPGVVGVPGAGVPGVGVPGAGIPVVPGAGIPGAAVPGVVSPEAAAKAAAKAAKYGARPGVGVGGIPTYGVGAGGFPGFGVGVGGIPGVAGVPGVGGVPGVGGVPGVGISPEAQAAAAAKAAKYGAAGAGVLGGLVPGAPGAVPGVPGTGGVPGVGTPAAAAAKAAAKAAQFALLNLAGLVPGVGVAPGVGVAPGVGVAPGVGLAPGVGVAPGVGVAPGVGVAPGIGPGGVAAAAKSAAKVAAKAQLRAAAGLGAGIPGLGVGVGVPGLGVGAGVPGLGVGAGVPGFGAGADEGVRRSLSPELREGDPSSSQHLPSTPSSPRVPGALAAAKAAKYGAAVPGVLGGLGALGGVGIPGGVVGAGPAAAAAAAKAAAKAAQFGLVGAAGLGGLGVGGLGVPGVGGLGGIPPAAAAKAAKYGAAGLGGVLGGAGQFPLGGVAARPGFGLSPIFPGGACLGKACGRKRK

SEQ ID NO: 1249 - protein, 677 aa, Homo sapiens
MAGLTAAAPRPGVLLLLLSILHPSRPGGVPGAIPGGVPGGVFYPALGPGGKPLKPVPGGLAGAGLGAGLGAFPAVTFPGALVPGGVADAAAAYKAAKAGAGLGGVPGVGGLGVSAGAVVPQPGAGVKPGKVPGVGLPGVYPGGVLPGARFPGVGVLPGVPTGAGVKPKAPGVGGAFAGIPGVGPFGGPQPGVPLGYPIKAPKLPGGYGLPYTTGKLPYGYGPGGVAGAAGKAGYPTGTGVGPQAAAAAAAKAAAKFGAGAAGVLPGVGGAGVPGVPGAIPGIGGIAGVGTPAAAAAAAAAAKAAKYGAAAGLVPGGPGFGPGVVGVPGAGVPGVGVPGAGIPVVPGAGIPGAAVPGVVSPEAAAKAAAKAAKYGARPGVGVGGIPTYGVGAGGFPGFGVGVGGIPGVAGVPGVGGVPGVGGVPGVGISPEAQAAAAAKAAKYGLVPGVGVAPGVGVAPGVGVAPGVGLAPGVGVAPGVGVAPGVGVAPGIGPGGVAAAAKSAAKVAAKAQLRAAAGLGAGIPGLGVGVGVPGLGVGAGVPGLGVGAGVPGFGAVPGALAAAKAAKYGAAVPGVLGGLGALGGVGIPGGVVGAGPAAAAAAAKAAAKAAQFGLVGAAGLGGLGVGGLGVPGVGGLGGIPPAAAAKAAKYGVAARPGFGLSPIFPGGACLGKACGRKRK

SEQ ID NO: 1250 - protein, 705 aa, Homo sapiens
MAGLTAAAPRPGVLLLLLSILHPSRPGGVPGAIPGGVPGGVFYPGAGLGALGGGALGPGGKPLKPVPGGLAGAGLGAGLGAFPAVTFPGALVPGGVADAAAAYKAAKAGAGLGGVPGVGGLGVSAGAVVPQPGAGVKPGKVPGVGLPGVYPGGVLPGARFPGVGVLPGVPTGAGVKPKAPGVGGAFAGIPGVGPFGGPQPGVPLGYPIKAPKLPGGYGLPYTTGKLPYGYGPGGVAGAAGKAGYPTGTGVGPQAAAAAAAKAAAKFGAGAAGVLPGVGGAGVPGVPGAIPGIGGIAGVGTPAAAAAAAAAAKAAKYGAAAGLVPGGPGFGPGVVGVPGAGVPGVGVPGAGIPVVPGAGIPGAAVPGVVSPEAAAKAAAKAAKYGARPGVGVGGIPTYGVGAGGFPGFGVGVGGIPGVAGVPGVGGVPGVGGVPGVGISPEAQAAAAAKAAKYGLVPGVGVAPGVGVAPGVGVAPGVGLAPGVGVAPGVGVAPGVGVAPGIGPGGVAAAAKSAAKVAAKAQLRAAAGLGAGIPGLGVGVGVPGLGVGAGVPGLGVGAGVPGFGAVPGALAAAKAAKYGAAVPGVLGGLGALGGVGIPGGVVGAGPAAAAAAAKAAAKAAQFGLVGAAGLGGLGVGGLGVPGVGGLGGIPPAAAAKAAKYGAAGLGGVLGGAGQFPLGGVAARPGFGLSPIFPGGACLGKACGRKRK

SEQ ID NO: 1251 - protein, 214 aa, Homo sapiens
MAGLTAAAPRPGVLLLLLSILHPSRPGGVPGAIPGGVPGGVFYPGAGLGALGGGALGPGGKPLKPVPGGLAGAGLGAGLGAFPAVTFPGALVPGGVADAAAAYKAAKAGAGLGGVPGVGGLGVSAGAVVPQPGAGVKPGKVPGVGLPGVYPGGVLPGVGPFGGPQPGVPLGYPIKAPKLPGGYGLPYTTGKLPYGYGPGGVAGAAGKAGYPTGT

SEQ ID NO: 1252 - protein, 167 aa, Homo sapiens [sequence omitted]

SEQ ID NO: 1253 - protein, 692 aa, Homo sapiens
MAGLTAAAPRPGVLLLLLSILHPSRPGGVPGAIPGGVPGGVFYPGAGLGALGGGALGPGGKPLKPVPGGLAGAGLGAGLGAFPAVTFPGALVPGGVADAAAAYKAAKAGAGLGGVPGVGGLGVSAAPSVPGAVVPQPGAGVKPGKVPGVGLPGVYPGGVLPGARFPGVGVLPGVPTGAGVKPKAPGVGGAFAGIPGVGPFGGPQPGVPLGYPIKAPKLPGGYGLPYTTGKLPYGYGPGGVAGAAGKAGYPTGTGVGPQAAAAAAAKAAAKFGAGAAGVLPGVGGAGVPGVPGAIPGIGGIAGVGTPAAAAAAAAAAKAAKYGAAAGLVPGGPGFGPGVVGVPGAGVPGVGVPGAGIPVVPGAGIPGAAVPGVVSPEAAAKAAAKAAKYGARPGVGVGGIPTYGVGAGGFPGFGVGVGGIPGVAGVPGVGGVPGVGGVPGVGISPEAQAAAAAKAAKYGLVPGVGVAPGVGVAPGVGVAPGVGLAPGVGVAPGVGVAPGVGVAPGIGPGGVAAAAKSAAKVAAKAQLRAAAGLGAGIPGLGVGVGVPGLGVGAGVPGLGVGAGVPGFGAVPGALAAAKAAKYGAAVPGVLGGLGALGGVGIPGGVVGAGPAAAAAAAKAAAKAAQFGLVGAAGLGGLGVGGLGVPGVGGLGGIPPAAAAKAAKYGVAARPGFGLSPIFPGGACLGKACGRKRK

SEQ ID NO: 1254 - protein, 168 aa, Homo sapiens
MAGLTAAAPRPGVLLLLLSILHPSRPGGVPGAIPGGVPGGVFYPGAGLGALGGGALGPGGKPLKPGVGPFGGPQPGVPLGYPIKAPKLPGYGPGGVAGAAGKAGYPTGTGVGPQAAAAAAAKAAAKFGAGAAGVLPGVGGAGVPGVPGAIPGIGGIAGVGTPAAAAAA

SEQ ID NO: 1255 - protein, 294 aa, Homo sapiens
MAGLTAAAPRPGVLLLLLSILHPSRPGGVPGAIPGGVPGGVFYPGAGLGALGGGALGPGGKPLKPGLGAFPAVTFPGALVPGGVADAAAAYKAAKAGAGLGGVPGVGGLGVSAGAVVPQPGAGVKPGKVPGVGLPGVYPGGVLPGARFPGVGVLPGVPTGAGVKPKAPGVGPFGGPQPGVPLGYPIKAPKLPGGYGLPYTTGKLPYGYGPGGVAGAAGKAGYPTGTGVGPQAAAAAAAKAAAKFGAGAAGVLPGVGGAGVPGVPGAIPGIGGIAGVGTPAAAAAAAAAAKAAKY

SEQ ID NO: 1256 - protein, 176 aa, Homo sapiens
MAGLTAAAPRPGVLLLLLSILHPSRPGGVPGAIPGGVPGGVFYPGAGLGALGGGALGPGGKPLKPVPGGLAGAGLGAGLGAFPAVTFPGALVPGGVADAAAAYKAAKAGAGLGGVPGVGGLGVSAGAVVPQPGAGVKPGKVPGVGGAFAGIPGVGPFGGPQPGVPLGYPIKAPKLP

SEQ ID NO: 1257 - protein, 663 aa, Homo sapiens
MAGLTAAAPRPGVLLLLLSILHPSRPGGVPGAIPGGVPGGVFYPGAGLGALGGGALGPGGKPLKPVPGGLAGAGLGAGAGLGGVPGVGGLGVSAGAVVPQPGAGVKPGKVPGVGLPGVYPGGVLPGARFPGVGVLPGVPTGAGVKPKAPGVGGAFAGIPGVGPFGGPQPGVPLGYPIKAPKLPGGYGLPYTTGKLPYGYGPGGVAGAAGKAGYPTGTGVGPQAAAAAAAKAAAKFGAGAAGVLPGVGGAGVPGVPGAIPGIGGIAGVGTPAAAAAAAAAAKAAKYGAAAGLVPGGPGFGPGVVGVPGAGVPGVGVPGAGIPVVPGAGIPGAAVPGVVSPEAAAKAAAKAAKYGARPGVGVGGIPTYGVGAGGFPGFGVGVGGIPGVAGVPGVGGVPGVGGVPGVGISPEAQAAAAAKAAKYGVGTPAAAAAKAAAKAAQFGLVPGVGVAPGVGVAPGIGPGGVAAAAKSAAKVAAKAQLRAAAGLGAGIPGLGVGVGVPGLGVGAGVPGLGVGAGVPGFGAVPGALAAAKAAKYGAAVPGVLGGLGALGGVGIPGGVVGAGPAAAAAAAKAAAKAAQFGLVGAAGLGGLGVGGLGVPGVGGLGGIPPAAAAKAAKYGAAGLGGVLGGAGQFPLGGVAARPGFGLSPIFPGGACLGKACGRKRK

SEQ ID NO: 1258 - protein, 706 aa, Homo sapiens
MAGLTAAAPRPGVLLLLLSILHPSRPGGVPGAIPGGVPGGVFYPGAGLGALGGGALGPGGKPLKPVPGGLAGAGLGAGLGAFPAVTFPGALVPGGVADAAAAYKAAKAGAGLGGVPGVGGLGVSAGAVVPQPGAGVKPGKVPGVGLPGVYPGGVLPGARFPGVGVLPGVPTGAGVKPKAPGVGGAFAGIPGVGPFGGPQPGVPLGYPIKAPKLPGGYGLPYTTGKLPYGYGPGGVAGAAGKAGYPTGTGVGPQAAAAAAAKAAAKFGAGAAGVLPGVGGAGVPGVPGAIPGIGGIAGVGTPAAAAAAAAAAKAAKYGAAAGLVPGGPGFGPGVVGVPGAGVPGVGVPGAGIPVVPGAGIPGAAVPGVVSPEAAAKAAAKAAKYGARPGVGVGGIPTYGVGAGGFPGFGVGVGGIPGVAGVPGVGGVPGVGGVPGVGISPEAQAAAAAKAAKYGVGTPAAAAAKAAAKAAQFGLVPGVGVAPGVGVAPGVGVAPGVGLAPGVGVAPGVGVAPGVGVAPGIGPGGVAAAAKSAAKVAAKAQLRAAAGLGAGIPGLGVGVGVPGLGVGAGVPGLGVGAGVPGFGAVPGALAAAKAAKYGAAVPGVLGGLGALGGVGIPGGVVGAGPAAAAAAAKAAAKAAQFGLVGAAGLGGLGVGGLGVPGVGGLGGIPPAAAAKAAKYGVAARPGFGLSPIFPGGACLGKACGRKRK

SEQ ID NO: 1259 - protein, 714 aa, Homo sapiens
MAGLTAAAPRPGVLLLLLSILHPSRPGGVPGAIPGGVPGGVFYPALGPGGKPLKPVPGGLAGAGLGAGLGAFPAVTFPGALVPGGVADAAAAYKAAKAGAGLGGVPGVGGLGVSAGAVVPQPGAGVKPGKVPGVGLPGVYPGGVLPGARFPGVGVLPGVPTGAGVKPKAPGVGGAFAGIPGVGPFGGPQPGVPLGYPIKAPKLPGGYGLPYTTGKLPYGYGPGGVAGAAGKAGYPTGTGVGPQAAAAAAAKAAAKFGAGAAGVLPGVGGAGVPGVPGAIPGIGGIAGVGTPAAAAAAAAAAKAAKYGAAAGLVPGGPGFGPGVVGVPGAGVPGVGVPGAGIPVVPGAGIPGAAVPGVVSPEAAAKAAAKAAKYGARPGVGVGGIPTYGVGAGGFPGFGVGVGGIPGVAGVPGVGGVPGVGGVPGVGISPEAQAAAAAKAAKYGVGTPAAAAAKAAAKAAQFGLVPGVGVAPGVGVAPGVGVAPGVGLAPGVGVAPGVGVAPGVGVAPGIGPGGVAAAAKSAAKVAAKAQLRAAAGLGAGIPGLGVGVGVPGLGVGAGVPGLGVGAGVPGFGAVPGALAAAKAAKYGAAVPGVLGGLGALGGVGIPGGVVGAGPAAAAAAAKAAAKAAQFGLVGAAGLGGLGVGGLGVPGVGGLGGIPPAAAAKAAKYGAAGLGGVLGGAGQFPLGGVAARPGFGLSPIFPGGACLGKACGRKRK

SEQ ID NO: 1260 - protein, 225 aa, Homo sapiens
MAALASSLIRQKREVREPGGSRPVSAQRRVCPRGTKSLCQKQLLILLSKVRLCGGRPARPDRGPEPQLKGIVTKLFCRQGFYLQANPDGSIQGTPEDTSSFTHFNLIPVGLRVVTIQSAKLGHYMAMNAEGLLYSSPHFTAECRFKECVFENYYVLYASALYRQRRSGRAWYLGLDKEGQVMKGNRVKKTKAAAHFLPKLLEVAMYQEPSLHSVPEASPSSPPAP

SEQ ID NO: 1261 - protein, 181 aa, Homo sapiens
MESKEPQLKGIVTRLFSQQGYFLQMHPDGTIDGTKDENSDYTLFNLIPVGLRVVAIQGVKASLYVAMNGEGYLYSSDVFTPECKFKESVFENYYVIYSSTLYRQQESGRAWFLGLNKEGQIMKGNRVKKTKPSSHFVPKPIEVCMYREPSLHEIGEKQGRSRKSSGTPTMNGGKVVNQDST

SEQ ID NO: 1262 - protein, 181 aa, Homo sapiens
MEKTEPQLKGIVTRLFSQQGYFLQMHPDGTIDGTKDENSDYTLFNLIPVGLRVVAIQGVKASLYVAMNGEGYLYSSDVFTPECKFKESVFENYYVIYSSTLYRQQESGRAWFLGLNKEGQIMKGNRVKKTKPSSHFVPKPIEVCMYREPSLHEIGEKQGRSRKSSGTPTMNGGKVVNQDST

SEQ ID NO: 1263 - protein, 107 aa, Homo sapiens
MESKEPQLKGIVTRLFSQQGYFLQMHPDGTIDGTKDENSDYTLFNLIPVGLRVVAIQGVKASLYVAMNGEGYLYSSDVFTPECKFKESVFENYYVIYSSTLYRQQES

SEQ ID NO: 1264 - protein, 181 aa, Homo sapiens; identical to SEQ ID NO: 1261

SEQ ID NO: 1265 - protein, 181 aa, Homo sapiens; identical to SEQ ID NO: 1261

SEQ ID NO: 1266 - protein, 243 aa, Homo sapiens
MAAAIASSLIRQKRQARESNSDRVSASKRRSSPSKDGRSLCERHVLGVFSKVRFCSGRKRPVRRRPEPQLKGIVTRLFSQQGYFLQMHPDGTIDGTKDENSDYTLFNLIPVGLRVVAIQGVKASLYVAMNGEGYLYSSDVFTPECKFKESVFENYYVIYSSTLYRQQESGRAWFLGLNKEGQIMKGNRVKKTKPSSHFVPKPIEVCMYREPSLHEIGEKQGRSRKSSGTPTMNGGKVVNQDST

SEQ ID NO: 1267 - protein, 192 aa, Homo sapiens
MALLRKSYSEPQLKGIVTKLYSRQGYHLQLQADGTIDGTKDEDSTYTLFNLIPVGLRVVAIQGVQTKLYLAMNSEGYLYTSELFTPECKFKESVFENYYVTYSSMIYRQQQSGRGWYLGLNKEGEIMKGNHVKKNKPAAHFLPKPLKVAMYKEPSLHDLTEFSRSGSGTPTKSRSVSGVLNGGKSMSHNEST

SEQ ID NO: 1268 - protein, 245 aa, Homo sapiens
MAAAIASSLIRQKRQAREREKSNACKCVSSPSKGKTSCDKNKLNVFSRVKLFGSKKRRRRRPEPQLKGIVTKLYSRQGYHLQLQADGTIDGTKDEDSTYTLFNLIPVGLRVVAIQGVQTKLYLAMNSEGYLYTSELFTPECKFKESVFENYYVTYSSMIYRQQQSGRGWYLGLNKEGEIMKGNHVKKNKPAAHFLPKPLKVAMYKEPSLHDLTEFSRSGSGTPTKSRSVSGVLNGGKSMSHNEST

SEQ ID NO: 1269 - protein, 255 aa, Homo sapiens
MSGKVTKPKEEKDASKVLDDAPPGTQEYIMLRQDSIQSAELKKKESPFRAKCHEIFCCPLKQVHHKENTEPEEPQLKGIVTKLYSRQGYHLQLQADGTIDGTKDEDSTYTLFNLIPVGLRVVAIQGVQTKLYLAMNSEGYLYTSELFTPECKFKESVFENYYVTYSSMIYRQQQSGRGWYLGLNKEGEIMKGNHVKKNKPAAHFLPKPLKVAMYKEPSLHDLTEFSRSGSGTPTKSRSVSGVLNGGKSMSHNEST

SEQ ID NO: 1270 - protein, 43 aa, Homo sapiens
MLRQDSIQSAELKKKESPFRAKCHEIFCCPLKQVHHKENTEPE

SEQ ID NO: 1271 - protein, 221 aa, Homo sapiens
MSGKVTKPKEEKDASKVLDDAPPGTQEYIMLRQDSIQSAELKKKESPFRAKCHEIFCCPLKQVHHKENTEPEEPQLKGIVTKLYSRQGYHLQLQADGTIDGTKDEDSTYTLFNLIPVGLRVVAIQGVQTKLYLAMNSEGYLYTSELFTPECKFKESVFENYYVTYSSMIYRQQQSGRGWYLGLNKEGEIMKGNHVKKNKPAAHFLPKPLKVAMYKEPSLHD

SEQ ID NO: 1272 - protein, 226 aa, Homo sapiens
MLRQDSIQSAELKKKESPFRAKCHEIFCCPLKQVHHKENTEPEEPQLKGIVTKLYSRQGYHLQLQADGTIDGTKDEDSTYTLFNLIPVGLRVVAIQGVQTKLYLAMNSEGYLYTSELFTPECKFKESVFENYYVTYSSMIYRQQQSGRGWYLGLNKEGEIMKGNHVKKNKPAAHFLPKPLKVAMYKEPSLHDLTEFSRSGSGTPTKSRSVSGVLNGGKSMSHNEST

SEQ ID NO: 1273 - protein, 98 aa, Homo sapiens
MSGKVTKPKEEKDASKVLDDAPPGTQEYIMLRQDSIQSAELKKKESPFRAKCHEIFCCPLKQVHHKENTEPEEPQLKGIVTKLYSRQGYHLQLQADGT

SEQ ID NO: 1274 - protein, 207 aa, Homo sapiens [sequence omitted]

SEQ ID NO: 1275 - protein, 199 aa, Homo sapiens
MSGKVTKPKEEKDASKEPQLKGIVTKLYSRQGYHLQLQADGTIDGTKDEDSTYTLFNLIPVGLRVVAIQGVQTKLYLAMNSEGYLYTSELFTPECKFKESVFENYYVTYSSMIYRQQQSGRGWYLGLNKEGEIMKGNHVKKNKPAAHFLPKPLKVAMYKEPSLHDLTEFSRSGSGTPTKSRSVSGVLNGGKSMSHNEST

SEQ ID NO: 1276 - protein, 252 aa, Homo sapiens
MVKPVPLFRRTDFKLLLCNHKDLFFLRVSKLLDCFSPKSMWFLWNIFSKGTHMLQCLCGKSLKKNKNPTDPQLKGIVTRLYCRQGYYLQMHPDGALDGTKDDSTNSTLFNLIPVGLRVVAIQGVKTGLYIAMNGEGYLYPSELFTPECKFKESVFENYYVIYSSMLYRQQESGRAWFLGLNKEGQAMKGNRVKKTKPAAHFLPKPLEVAMYREPSLHDVGETVPKPGVTPSKSTSASAIMNGGKPVNKSKTT

SEQ ID NO: 1277 - protein, 247 aa, Homo sapiens
MAAAIASGLIRQKRQAREQHWDRPSASRRRSSPSKNRGLCNGNLVDIFSKVRIFGLKKRRLRRQDPQLKGIVTRLYCRQGYYLQMHPDGALDGTKDDSTNSTLFNLIPVGLRVVAIQGVKTGLYIAMNGEGYLYPSELFTPECKFKESVFENYYVIYSSMLYRQQESGRAWFLGLNKEGQAMKGNRVKKTKPAAHFLPKPLEVAMYREPSLHDVGETVPKPGVTPSKSTSASAIMNGGKPVNKSKTT

SEQ ID NO: 1278 - protein, 116 aa, Homo sapiens
  MOD_RES (1)..(1): Any amino acid
XILEFISLAVGLISIRGVDSGLYLGMNERGELYGSKKLTRECVFREQFEENWYNTYASTLYKHSDSERQYYVALNKDGSPREGYRTKRHQKFTHFLPRPVDPSKLPSMSRDLFHYR

SEQ ID NO: 1279 - protein, 216 aa, Homo sapiens
MGAARLLPNLTLCLQLLILCCQTQGENHPSPNFNQYVRDQGAMTDQLSRRQIREYQLYSRTSGKHVQVTGRRISATAEDGNKFAKLIVETDTFGSRVRIKGAESEKYICMNKRGKLIGKPSGKSKDCVFTEIVLENNYTAFQNARHEGWFMAFTRQGRPRQASRSRQNQREAHFIKRLYQGQLPFPNHAEKQKQFEFVGSAPTRRTKRTRRPQPLT

SEQ ID NO: 1280 - protein, 205 aa, Homo sapiens
MGAARLLPNLTLCLQLLILCCQTQYVRDQGAMTDQLSRRQIREYQLYSRTSGKHVQVTGRRISATAEDGNKFAKLIVETDTFGSRVRIKGAESEKYICMNKRGKLIGKPSGKSKDCVFTEIVLENNYTAFQNARHEGWFMAFTRQGRPRQASRSRQNQREAHFIKRLYQGQLPFPNHAEKQKQFEFVGSAPTRRTKRTRRPQPLT

SEQ ID NO: 1281 - protein, 207 aa, Homo sapiens
MYSAPSACTCLCLHFLLLCFQVQVLVAEENVDFRIHVENQTRARDDVSRKQLRLYQLYSRTSGKHIQVLGRRISARGEDGDKYAQLLVETDTFGSQVRIKGKETEFYLCMNRKGKLVGKPDGTSKECVFIEKVLENNYTALMSAKYSGWYVGFTKKGRPRKGPKTRENQQDVHFMKRYPKGQPELQKPFKYTTVTKRSRRIRPTHPA

SEQ ID NO: 1282 - protein, 216 aa, Homo sapiens
MRSGCVVVHVWILAGLWLAVAGRPLAFSDAGPHVHYGWGDPIRLRHLYTSGPHGLSSCFLRIRADGVVDCARGQSAHSLLEIKAVALRTVAIKGVHSVRYLCMGADGKMQGLLQYSEEDCAFEEEIRPDGYNVYRSEKHRLPVSLSSAKQRQLYKNRGFLPLSHFLPMLPMVPEEPEDLRGHLESDMFSSPLETDSMDPFGLVTGLEAVRSPSFEK

SEQ ID NO: 1283 - protein, 211 aa, Homo sapiens
MAPLAEVGGFLGGLEGLGQQVGSHFLLPPAGERPPLLGERRSAAERSARGGPGAAQLAHLHGILRRRQLYCRTGFHLQILPDGSVQGTRQDHSLFGILEFISVAVGLVSIRGVDSGLYLGMNDKGELYGSEKLTSECIFREQFEENWYNTYSSNIYKHGDTGRRYFVALNKDGTPRDGARSKRHQKFTHFLPRPVDPERVPELYKDLLMYT

SEQ ID NO: 1284 - protein, 78 aa, Homo sapiens
MAPLAEVGGFLGGLEGLGQQVGSHFLLPPAGERPPAALLPHRLPPADPARRQRAGHPAGPQPLRYLGIHQCGSGTGQY

SEQ ID NO: 1285 - protein, 129 aa, Homo sapiens
MGDPVVTETPTLLGLPEQRRAAVRHVNKGAGILEIRSVHVGVVVIKAVSSGFYVAMNRRGRLYGSRLYTVDCRFRERIEENGHNTYASQRWRRRGQPMFLALDRRGGPRPGGRTRRYHLSAHFLPVLVS

SEQ ID NO: 1286 - protein, 170 aa, Homo sapiens
MRRRLWLGLAWLLLARAPDAAGTPSASRGPRSYPHLEGDVRWRRLFSSTHFFLRVDPGGRVQGTRWRHGQDSILEIRSVHVGVVVIKAVSSGFYVAMNRRGRLYGSRLYTVDCRFRERIEENGHNTYASQRWRRRGQPMFLALDRRGGPRPGGRTRRYHLSAHFLPVLVS

SEQ ID NO: 1287 - protein, 251 aa, Homo sapiens
MLGARLRLWVCALCSVCSMSVLRAYPNASPLLGSSWGGLIHLYTATARNSYHLQIHKNGHVDGAPHQTIYSALMIRSEDAGFVVITGVMSRRYLCMDFRGNIFGSHYFDPENCRFQHQTLENGYDVYHSPQYHFLVSLGRAKRAFLPGMNPPPYSQFLSRRNEIPLIHFNTPIPRRHTRSAEDDSERDPLNVLKPRARMTPAPASCSQELPSAEDNSPMASDPLGVVRGGRVNTHAGGTGPEGCRPFAKFI

SEQ ID NO: 1288 - protein, 239 aa, Homo sapiens
MGLIWLLLLSLLEPGWPAAGPGARLRRDAGGRGGVYEHLGGAPRRRKLYCATKYHLQLHPSGRVNGSLENSAYSILEITAVEVGIVAIRGLFSGRYLAMNKRGRLYASEHYSAECEFVERIHELGYNTYASRLYRTVSSTPGARRQPSAERLWYVSVNGKGRPRRGFKTRRTQKSSLFLPRVLDHRDHEMVRQLQSGLPRPPGKGVQPRRRRQKQSPDNLEPSHVQASRLGSQLEASAH

SEQ ID NO: 1289 - protein, 206 aa, Homo sapiens
MSGPGTAAVALLPAVLLALLAPWAGRGGAAAPTAPNGTLEAELERRWESLVALSLARLPVAAQPKEAAVQSGAGDYLLGIKRLRRLYCNVGIGFHLQALPDGRIGGAHADTRDSLLELSPVERGVVSIFGVASRFFVAMSSKGKLYGSPFFTDECTFKEILLPNNYNAYESYKYPGMFIALSKNGKTKKGNRVSPTMKVTHFLPRL

SEQ ID NO: 1290 - protein, 268 aa, Homo sapiens
MSLSFLLLLFFSHLILSAWAHGEKRLAPKGQPGPAATDRNPRGSSSRQSSSSAMSSSSASSSPAASLGSQGSGLEQSSFQWSPSGRRTGSLYCRVGIGFHLQIYPDGKVNGSHEANMLSVLEIFAVSQGIVGIRGVFSNKFLAMSKKGKLHASAKFTDDCKFRERFQENSYNTYASAIHRTEKTGREWYVALNKRGKAKRGCSPRVKPQHISTHFLPRFKQSEQPELSFTVTVPEKKKPPSPIKPKIPLSAPRKNTNSVKYRLKFRFG

SEQ ID NO: 1291 - protein, 123 aa, Homo sapiens
MSLSFLLLLFFSHLILSAWAHGEKRLAPKGQPGPAATDRNPRGSSSRQSSSSAMSSSSASSSPAASLGSQGSGLEQSSFQWSPSGRRTGSLYCRVGIGFHLQIYPDGKVNGSHEANMLSQVHR

SEQ ID NO: 1292 - protein, 208 aa, Homo sapiens
MALGQKLFITMSRGAGRLQGTLWALVFLGILVGMVVPSPAGTRANNTLLDSRGWGTLLSRSRAGLAGEIAGVNWESGYLVGIKRQRRLYCNVGIGFHLQVLPDGRISGTHEENPYSLLEISTVERGVVSLFGVRSALFVAMNSKGRLYATPSFQEECKFRETLLPNNYNAYESDLYQGTYIALSKYGRVKRGSKVSPIMTVTHFLPRI

SEQ ID NO: 1293 - protein, 244 aa, Homo sapiens
MGSPRSALSCLLLHLLVLCLQAQEGPGRGPALGRELASLFRAGREPQGVSQQVTVQSSPNFTQHVREQSLVTDQLSRRLIRTYQLYSRTSGKHVQVLANKRINAMAEDGDPFAKLIVETDTFGSRVRVRGAETGLYICMNKKGKLIAKSNGKGKDCVFTEIVLENNYTALQNAKYEGWYMAFTRKGRPRKGSKTRQHQREVHFMKRLPRGHHTTEQSLRFEFLNYPPFTRSLRGSQRTWAPEPR

SEQ ID NO: 1294 - protein, 233 aa, Homo sapiens
MGSPRSALSCLLLHLLVLCLQAQEGPGRGPALGRELASLFRAGREPQGVSQQHVREQSLVTDQLSRRLIRTYQLYSRTSGKHVQVLANKRINAMAEDGDPFAKLIVETDTFGSRVRVRGAETGLYICMNKKGKLIAKSNGKGKDCVFTEIVLENNYTALQNAKYEGWYMAFTRKGRPRKGSKTRQHQREVHFMKRLPRGHHTTEQSLRFEFLNYPPFTRSLRGSQRTWAPEPR

SEQ ID NO: 1295 - protein, 204 aa, Homo sapiens
MGSPRSALSCLLLHLLVLCLQAQHVREQSLVTDQLSRRLIRTYQLYSRTSGKHVQVLANKRINAMAEDGDPFAKLIVETDTFGSRVRVRGAETGLYICMNKKGKLIAKSNGKGKDCVFTEIVLENNYTALQNAKYEGWYMAFTRKGRPRKGSKTRQHQREVHFMKRLPRGHHTTEQSLRFEFLNYPPFTRSLRGSQRTWAPEPR

SEQ ID NO: 1296 - protein, 215 aa, Homo sapiens
MGSPRSALSCLLLHLLVLCLQAQVTVQSSPNFTQHVREQSLVTDQLSRRLIRTYQLYSRTSGKHVQVLANKRINAMAEDGDPFAKLIVETDTFGSRVRVRGAETGLYICMNKKGKLIAKSNGKGKDCVFTEIVLENNYTALQNAKYEGWYMAFTRKGRPRKGSKTRQHQREVHFMKRLPRGHHTTEQSLRFEFLNYPPFTRSLRGSQRTWAPEPR

SEQ ID NO: 1297 - protein, 208 aa, Homo sapiens
MAPLGEVGNYFGVQDAVPFGNVPVLPVDSPVLLSDHLGQSEAGGLPRGPAVTDLDHLKGILRRRQLYCRTGFHLEIFPNGTIQGTRKDHSRFGILEFISIAVGLVSIRGVDSGLYLGMNEKGELYGSEKLTQECVFREQFEENWYNTYSSNLYKHVDTGRRYYVALNKDGTPREGTRTKRHQKFTHFLPRPVDPDKVPELYKDILSQS

SEQ ID NO: 1298 - protein, 2391 aa, Homo sapiens
MTDLLRSVVTVIDVFYKYTKQDGECGTLSKGELKELLEKELHPVLKNPDDPDTVDVIMHMLDRDHDRRLDFTEFLLMIFKLTMACNKVLSKEYCKASGSKKHRRGHRHQEEESETEEDEEDTPGHKSGYRHSSWSEGEEHGYSSGHSRGTVKCRHGSNSRRLGRQGNLSSSGNQEGSQKRYHRSSCGHSWSGGKDRHGSSSVELRERINKSHISPSRESGEEYESGSGSNSWERKGHGGLSCGLETSGHESNSTQSRIREQKLGSSCSGSGDSGRRSHACGYSNSSGCGRPQNASSSCQSHRFGGQGNQFSYIQSGCQSGIKGGQGHGCVSGGQPSGCGQPESNPCSQSYSQRGYGARENGQPQNCGGQWRTGSSQSSCCGQYGSGGSQSCSNGQHEYGSCGRFSNSSSSNEFSKCDQYGSGSSQSTSFEQHGTGLSQSSGFEQHVCGSGQTCGQHESTSSQSLGYDQHGSSSGKTSGFGQHGSGSGQSSGFGQCGSGSGQSSGFGQHGSVSGQSSGFGQHGSVSGQSSGFGQHESRSRQSSYGQHGSGSSQSSGYGQYGSRETSGFGQHGLGSGQSTGFGQYGSGSGQSSGFGQHGSGSGQSSGFGQHESRSGQSSYGQHSSGSSQSSGYGQHGSRQTSGFGQHGSGSSQSTGFGQYGSGSGQSSGFGQHVSGSGQSSGFGQHESRSGHSSYGQHGFGSSQSSGYGQHGSSSGQTSGFGQHELSSGQSSSFGQHGSGSGQSSGFGQHGSGSGQSSGFGQHESRSGQSSYGQHSSGSSQSSGYGQHGSRQTSGFGQHGSGSSQSTGFGQYGSGSGQSAGFGQHGSGSGQSSGFGQHESRSHQSSYGQHGSGSSQSSGYGQHGSSSGQTSGFGQHRSSSGQYSGFGQHGSGSGQSSGFGQHGTGSGQYSGFGQHESRSHQSSYGQHGSGSSQSSGYGQHGSSSGQTFGFGQHRSGSGQSSGFGQHGSGSGQSSGFGQHESGSGKSSGFGQHESRSSQSNYGQHGSGSSQSSGYGQHGSSSGQTTGFGQHRSSSGQYSGFGQHGSGSDQSSGFGQHGTGSGQSSGFGQYESRSRQSSYGQHGSGSSQSSGYGQHGSNSGQTSGFGQHRPGSGQSSGFGQYGSGSGQSSGFGQHGSGTGKSSGFAQHEYRSGQSSYGQHGTGSSQSSGCGQHESGSGPTTSFGQHVSGSDNFSSSGQHISDSGQSTGFGQYGSGSGQSTGLGQGESQQVESGSTVHGRQETTHGQTINTTRHSQSGQGQSTQTGSRVTRRRRSSQSENSDSEVHSKVSHRHSEHIHTQAGSHYPKSGSTVRRRQGTTHGQRGDTTRHGHSGHGQSTQTGSRTSGRQRFSHSDATDSEVHSGVSHRPHSQEQTHSQAGSQHGESESTVHERHETTYGQTGEATGHGHSGHGQSTQRGSRTTGRRGSGHSESSDSEVHSGGSHRPQSQEQTHGQAGSQHGESGSTVHGRHGTTHGQTGDTTRHAHYHHGKSTQRGSSTTGRRGSGHSESSDSEVHSGGSHTHSGHTHGQSGSQHGESESIIHDRHRITHGQTGDTTRHSYSGHEQTTQTGSRTTGRQRTSHSESTDSEVHSGGSHRPHSREHTYGQAGSQHEEPEFTVHERHGTTHGQIGDTTGHSHSGHGQSTQRGSRTTGRQRSSHSESSDSEVHSGVSHTHTGHTHGQAGSQHGQSESIVPERHGTTHGQTGDTTRHAHYHHGLTTQTGSRTTGRRGSGHSEYSDSEGYSGVSHTHSGHTHGQARSQHGESESIVHERHGTIHGQTGDTTRHAHSGHGQSTQTGSRTTGRRSSGHSEYSDSEGHSGFSQRPHSRGHTHGQAGSQHGESESIVDERHGTTHGQTGDTSGHSQSGHGQSTQSGSSTTGRRRSGHSESSDSEVHSGGSHTHSGHTHSQARSQHGESESTVHKRHQTTHGQTGDTTEHGHPSHGQTIQTGSRTTGRRGSGHSEYSDSEGPSGVSHTHSGHTHGQAGSHYPESGSSVHERHGTTHGQTADTTRHGHSGHGQSTQRGSRTTGRRASGHSEYSDSEGHSGVSHTHSGHAHGQAGSQHGESGSSVHERHGTTHGQTGDTTRHAHSGHGQSTQRGSRTAGRRGSGHSESSDSEVHSGVSHTHSGHTYGQARSQHGESGSAIHGRQGTIHGQTGDTTRHGQSGHGQSTQTGSRTTGRQRSSHSESSDSEVHSEASPTHSGHTHSQAGSRHGQSGSSGHGRQGTTHGQTGDTTRHAHYGYGQSTQRGSRTTGRRGSGHSESSDSEVHSWGSHTHSGHIQGQAGSQQRQPGSTVHGRLETTHGQTGDTTRHGHSGYGQSTQTGSRSSRASHFQSHSSERQRHGSSQVWKHGSYGPAEYDYGHTGYGPSGGSRKSISNSHLSWSTDSTANKQLSRH

SEQ ID NO: 1299 - protein, 208 aa, Homo sapiens
MKLLPSVVLKLFLAAVLSALVTGESLERLRRGLAAGTSNPDPPTVSTDQLLPLGGGRDRKVRDLQEADLDLLRVTLSSKPQALATPNKEEHGKRKKKGKGLGKKRDPCLRKYKDFCIHGECKYVKELRAPSCICHPGYHGERCHGLSLPVENRLYTYDHTTILAVVAVVLSSVCLLVIVGLLMFRYHRRGGYDVENEEKVKLGMTNSH

SEQ ID NO: 1300 - protein, 208 aa, Homo sapiens; identical to SEQ ID NO: 1299

SEQ ID NO: 1301 - protein, 325 aa, Homo sapiens
MLPRVGCPALPLPPPPLLPLLLLLLGASGGGGGARAEVLFRCPPCTPERLAACGPPPVAPPAAVAAVAGGARMPCAELVREPGCGCCSVCARLEGEACGVYTPRCGQGLRCYPHPGSELPLQALVMGEGTCEKRRDAEYGASPEQVADNGDDHSEGGLVENHVDSTMNMLGGGGSAGRKPLKSGMKELAVFREKVTEQHRQMGKGGKHHLGLEEPKKLRPPPARTPCQQELDQVLERISTMRLPDERGPLEHLYSLHIPNCDKHGLYNLKQCKMSLNGQRGECWCVNPNTGKLIQGAPTIRGDPECHLFYNEQQEARGVHTQRMQ

SEQ ID NO: 1302 - protein, 240 aa, Homo sapiens
MTPHRLLPPLLLLLALLLAASPGGALARCPGCGQGVQAGCPGGCVEEEDGGSPAEGCAEAEGCLRREGQECGVYTPNCAPGLQCHPPKDDEAPLRALLLGRGRCLPARAPAVAEENPKESKPQAGTARPQDVNRRDQQRNPGTSTTPSQPNSAGVQDTEMGPCRRHLDSVLQQLQTEVYRGAQTLYVPNCDHRGFYRKRQCRSSQGQRRGPCWCVDRMGKSLPGSPDGNGSSSCPTGSSG

SEQ ID NO: 1303 - protein, 136 aa, Homo sapiens
MTPHRLLPPLLLLLALLLAASPGGALARCPGCGQGVQAGCPGGCVEEEDGGSPAEGCAEAEGCLRREGQECGVYTPNCAPGLQCHPPKDDEAPLRALLLGRGRCLPARAPAVLSSPRTLRKLSPEPGATCSCRGES

SEQ ID NO: 1304 - protein, 238 aa, Homo sapiens
MTPHRLLPPLLLLLALLLAASPGGALARCPGCGQGVQAGCPGGCVEEEDGGSPAEGCAEAEGCLRREGQECGVYTPNCAPGLQCHPPKDDEAPLRALLLGRGRCLPARAPAEENPKESKPQAGTARPQDVNRRDQQRNPGTSTTPSQPNSAGVQDTEMGPCRRHLDSVLQQLQTEVYRGAQTLYVPNCDHRGFYRKRQCRSSQGQRRGPCWCVDRMGKSLPGSPDGNGSSSCPTGSSG

SEQ ID NO: 1305 - protein, 278 aa, Homo sapiens
MPRLSLLLPLLLLLLLPLLPPLSPSLGIRDVGGRRPKCGPCRPEGCPAPAPCPAPGISALDECGCCARCLGAEGASCGGRAGGRCGPGLVCASQAAGAAPEGTGLCVCAQRGTVCGSDGRSYPSVCALRLRARHTPRAHPGHLHKARDGPCEFAPVVVVPPRSVHNVTGAQVGLSCEVRAVPTPVITWRKVTKSPEGTQALEELPGDHVNIAVQVRGGPSDHEATAWILINPLRKEDEGVYQCHAANMVGEAESHSTVTVLDLSKYRSFHFPAPDDRM

SEQ ID NO: 1306 - protein, 152 aa, Homo sapiens
MCSLPMARYYISFLPEPLPAKSLQHGVPLSLDSSLSSLLEKICILPNRGLARTKVPIFLGIQGGSRCLACVETEEGPSLQLEDVNIEELYKGGEEATRFTFFQSSSGSAFRLEAAAWPGWFLCGPAEPQQPVQLTKESEPSARTKFYFEQSW

SEQ ID NO: 1307 - protein, 152 aa, Homo sapiens
MCSLPMARYYIIKYADQKALYTRDGQLLVGDPVADNCCAEKICILPNRGLARTKVPIFLGIQGGSRCLACVETEEGPSLQLEDVNIEELYKGGEEATRFTFFQSSSGSAFRLEAAAWPGWFLCGPAEPQQPVQLTKESEPSARTKFYFEQSW

SEQ ID NO: 1308 - protein, 152 aa, Homo sapiens; identical to SEQ ID NO: 1307

SEQ ID NO: 1309 - protein, 271 aa, Homo sapiens
MAKVPDMFEDLKNCYSENEEDSSSIDHLSLNQKSFYHVSYGPLHEGCMDQSVSLSISETSKTSKLTFKESMVVVATNGKVLKKRRLSLSQSITDDDLEAIANDSEEEIIKPRSAPFSFLSNVKYNFMRIIKYEFILNDALNQSIIRANDQYLTAAALHNLDEAVKFDMGAYKSSKDDAKITVILRISKTQLYVTAQDEDQPVLLKEMPEIPKTITGSETNLLFFWETHGTKNYFTSVAHPNLFIATKQDYWVCLAGGPPSITDFQILENQA

SEQ ID NO: 1310 - protein, 199 aa, Homo sapiens
MNCVCRLVLVVLSLWPDTAVAPGPPPGPPRVSPDPRAELDSTVLLTRSLLADTRQLAAQLRDKFPADGDHNLDSLPTLAMSAGALGALQLPGVLTRLRADLLSYLRHVQWLRRAGGSSLKTLEPELGTLQARLDRLLRRLQLLMSRLALPQPPPDPPAPPLAPPSSAWGGIRAAHAILGGLHLTLDWAVRGLLLLKTRL

SEQ ID NO: 1311 - protein, 328 aa, Homo sapiens
MCHQQLVISWFSLVFLASPLVAIWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCS

SEQ ID NO: 1312 - protein, 146 aa, Homo sapiens
MHPLLNPLLLALGLMALLLTTVIALTCLGGFASPGPVPPSTALRELIEELVNITQNQKAPLCNGSMVWSINLTAGMYCAALESLINVSGCSAIEKTQRMLSGFCPHKVSAGQFSSLHVRDTKIEVAQFVKDLLLHLKKLFREGQFN

SEQ ID NO: 1313 - protein, 1332 aa, Homo sapiens
MESHSRAGKSRKSAKFRSISRSLMLCNAKTSDDGSSPDEKYPDPFEISLAQGKEGIFHSSVQLADTSEAGPSSVPDLALASEAAQLQAAGNDRGKTCRRIFFMKESSTASSREKPGKLEAQSSNFLFPKACHQRARSNSTSVNPYCTREIDFPMTKKSAAPTDRQPYSLCSNRKSLSQQLDCPAGKAAGTSRPTRSLSTAQLVQPSGGLQASVISNIVLMKGQAKGLGFSIVGGKDSIYGPIGIYVKTIFAGGAAAADGRLQEGDEILELNGESMAGLTHQDALQKFKQAKKGLLTLTVRTRLTAPPSLCSHLSPPLCRSLSSSTCITKDSSSFALESPSAPISTAKPNYRIMVEVSLQKEAGVGLGIGLCSVPYFQCISGIFVHTLSPGSVAHLDGRLRCGDEIVEISDSPVHCLTLNEVYTILSHCDPGPVPIIVSRHPDPQVSEQQLKEAVAQAVENTKFGKERHQWSLEGVKRLESSWHGRPTLEKEREKNSAPPHRRAQKVMIRSSSDSSYMSGSPGGSPGSGSAEKPSSDVDISTHSPSLPLAREPVVLSIASSRLPQESPPLPESRDSHPPLRLKKSFEILVRKPMSSKPKPPPRKYFKSDSDPQKSLEERENSSCSSGHTPPTCGQEARELLPLLLPQEDTAGRSPSASAGCPGPGIGPQTKSSTEGEPGWRRASPVTQTSPIKHPLLKRQARMDYSFDTTAEDPWVRISDCIKNLFSPIMSENHGHMPLQPNASLNEEEGTQGHPDGTPPKLDTANGTPKVYKSADSSTVKKGPPVAPKPAWFRQSLKGLRNRASDPRGLPDPALSTQPAPASREHLGSHIRASSSSSSIRQRISSFETFGSSQLPDKGAQRLSLQPSSGEAAKPLGKHEEGRFSGLLGRGAAPTLVPQQPEQVLSSGSPAASEARDPGVSESPPPGRQPNQKTLPPGPDPLLRLLSTQAEESQGPVLKMPSQRARSFPLTRSQSCETKLLDEKTSKLYSISSQVSSAVMKSLLCLPSSISCAQTPCIPKEGASPTSSSNEDSAANGSAETSALDTGFSLNLSELREYTEGLTEAKEDDDGDHSSLQSGQSVISLLSSEELKKLIEEVKVLDEATLKQLDGIHVTILHKEEGAGLGFSLAGGADLENKVITVHRVFPNGLASQEGTIQKGNEVLSINGKSLKGTTHHDALAILRQAREPRQAVIVTRKLTPEAMPDLNSSTDSAASASAASDVSVESTAEATVCTVTLEKMSAGLGFSLEGGKGSLHGDKPLTINRIFKGAASEQSETVQPGDEILQLGGTAMQGLTRFEAWNIIKALPDGPVTIVIRRKSLQSKETTAAGDS

SEQ ID NO: 1314 - protein, 720 aa, Homo sapiens
MCSVLPVAVTGVKRLESSWHGRPTLEKEREKNSAPPHRRAQKVMIRSSSDSSYMSGSPGGSPGSGSAEKPSSDVDISTHSPSLPLAREPVVLSIASSRLPQESPPLPESRDSHPPLRLKKSFEILVRKPMSSKPKPPPRKYFKSDSDPQKSLEERENSSCSSGHTPPTCGQEARELLPLLLPQEDTAGRSPSASAGCPGPGIGPQTKSSTEGEPGWRRASPVTQTSPIKHPLLKRQARMDYSFDTTAEDPWVRISDCIKNLFSPIMSENHGHMPLQPNASLNEEEGTQGHPDGTPPKLDTANGTPKVYKSADSSTVKKGPPVAPKPAWFRQSLKGLRNRASDPRGLPDPALSTQPAPASREHLGSHIRASSSSSSIRQRISSFETFGSSQLPDKGAQRLSLQPSSGEAAKPLGKHEEGRFSGLLGRGAAPTLVPQQPEQVLSSGSPAASEARDPGVSESPPPGRQPNQKTLPPGPDPLLRLLSTQAEESQGPVLKMPSQRARSFPLTRSQSCETKLLDEKTSKLYSISSQVSSAVMKSLLCLPSSISCAQTPCIPKEGASPTSSSNEDSAANGSAETSALDTGFSLNLSELREYTEGLTEAKEDDDGDHSSLQSGQSVISLLSSEELKKLIEEVKVLDEATLKQLDGIHVTILHKEEGAGLGFSLAGGADLENKVITVHRVFPNGLASQEGTIQKGNEVLSINGKSLKGTTHHARPQLLH

SEQ ID NO: 1315 - protein, 1163 aa, Homo sapiens
MERGAREMAAPGDCPAGKAAGTSRPTRSLSTAQLVQPSGGLQASVISNIVLMKGQAKGLGFSIVGGKDSIYGPIGIYVKTIFAGGAAAADGRLQEGDEILELNGESMAGLTHQDALQKFKQAKKGLLTLTVRTRLTAPPSLCSHLSPPLCRSLSSSTCITKDSSSFALESPSAPISTAKPNYRIMVEVSLQKEAGVGLGIGLCSVPYFQCISGIFVHTLSPGSVAHLDGRLRCGDEIVEISDSPVHCLTLNEVYTILSHCDPGPVPIIVSRHPDPQVSEQQLKEAVAQAVENTKFGKERHQWSLEGVKRLESSWHGRPTLEKEREKNSAPPHRRAQKVMIRSSSDSSYMSGSPGGSPGSGSAEKPSSDVDISTHSPSLPLAREPVVLSIASSRLPQESPPLPESRDSHPPLRLKKSFEILVRKPMSSKPKPPPRKYFKSDSDPQKSLEERENSSCSSGHTPPTCGQEARELLPLLLPQEDTAGRSPSASAGCPGPGIGPQTKSSTEGEPGWRRASPVTQTSPIKHPLLKRQARMDYSFDTTAEDPWVRISDCIKNLFSPIMSENHGHMPLQPNASLNEEEGTQGHPDGTPPKLDTANGTPKVYKSADSSTVKKGPPVAPKPAWFRQSLKGLRNRASDPRGLPDPALSTQPAPASREHLGSHIRASSSSSSIRQRISSFETFGSSQLPDKGAQRLSLQPSSGEAAKPLGKHEEGRFSGLLGRGAAPTLVPQQPEQVLSSGSPAASEARDPGVSESPPPGRQPNQKTLPPGPDPLLRLLSTQAEESQGPVLKMPSQRARSFPLTRSQSCETKLLDEKTSKLYSISSQVSSAVMKSLLCLPSSISCAQTPCIPKEGASPTSSSNEDSAANGSAETSALDTGFSLNLSELREYTEGLTEAKEDDDGDHSSLQSGQSVISLLSSEELKKLIEEVKVLDEATLKQLDGIHVTILHKEEGAGLGFSLAGGADLENKVITVHRVFPNGLASQEGTIQKGNEVLSINGKSLKGTTHHDALAILRQAREPRQAVIVTRKLTPEAMPDLNSSTDSAASASAASDVSVESTEATVCTVTLEKMSAGLGFSLEGGKGSLHGDKPLTINRIFKGAASEQSETVQPGDEILQLGGTAMQGLTRFEAWNIIKALPDGPVTIVIRRKSLQSKETTAAGDS

SEQ ID NO: 1316 - protein, 631 aa, Homo sapiens
MDYSFDTTAEDPWVRISDCIKNLFSPIMSENHGHMPLQPNASLNEEEGTQGHPDGTPPKLDTANGTPKVYKSADSSTVKKGPPVAPKPAWFRQSLKGLRNRASDPRGLPDPALSTQPAPASREHLGSHIRASSSSSSIRQRISSFETFGSSQLPDKGAQRLSLQPSSGEAAKPLGKHEEGRFSGLLGRGAAPTLVPQQPEQVLSSGSPAASEARDPGVSESPPPGRQPNQKTLPPGPDPLLRLLSTQAEESQGPVLKMPSQRARSFPLTRSQSCETKLLDEKTSKLYSISSQVSSAVMKSLLCLPSSISCAQTPCIPKEGASPTSSSNEDSAANGSAETSALDTGFSLNLSELREYTEGLTEAKEDDDGDHSSLQSGQSVISLLSSEELKKLIEEVKVLDEATLKQLDGIHVTILHKEEGAGLGFSLAGGADLENKVITVHRVFPNGLASQEGTIQKGNEVLSINGKSLKGTTHHDALAILRQAREPRQAVIVTRKLTPEAMPDLNSSTDSAASASAASDVSVESTAEATVCTVTLEKMSAGLGFSLEGGKGSLHGDKPLTINRIFKGAASEQSETVQPGDEILQLGGTAMQGLTRFEAWNIIKALPDGPVTIVIRRKSLQSKETTAAGDS

SEQ ID NO: 1317 - protein, 657 aa, Homo sapiens
MWLPVKELTIHECQQMSTYRAPNQEARELLPLLLPQEDTAGRSPSASAGCPGPGIGPQTKSSTEGEPGWRRASPVTQTSPIKHPLLKRQARMDYSFDTTAEDPWVRISDCIKNLFSPIMSENHGHMPLQPNASLNEEEGTQGHPDGTPPKLDTANGTPKVYKSADSSTVKKGPPVAPKPAWFRQSLKGLRNRASDPRGLPDPALSTQPAPASREHLGSHIRASSSSSSIRQRISSFETFGSSQLPDKGAQRLSLQPSSGEAAKPLGKHEEGRFSGLLGRGAAPTLVPQQPEQVLSSGSPAASEARDPGVSESPPPGRQPNQKTLPPGPDPLLRLLSTQAEESQGPVLKMPSQRARSFPLTRSQSCETKLLDEKTSKLYSISSQVSSAVMKSLLCLPSSISCAQTPCIPKEGASPTSSSNEDSAANGSAETSALDTGFSLNLSELREYTEGLTEAKEDDDGDHSSLQSGQSVISLLSSEELKKLIEEVKVLDEATLKQLDGIHVTILHKEEGAGLGFSLAGGADLENKVITVHRVFPNGLASQEGTIQKGNEVLSINGKSLKGTTHHDALAILRQAREPRQAVIVTRKLTPEAMPDLNSSTDSAASASAASDVSVESTEATVCTVTLEKMSAGLGFSLEGGKGSLHGDKPLTINRIFK

SEQ ID NO: 1318 - protein, 454 aa, Homo sapiens
MESHSRAGKSRKSAKFRSISRSLMLCNAKTSDDGSSPDEKYPDPFEISLAQGKEGIFHSSVQLADTSEAGPSSVPDLALASEAAQLQAAGNDRGKTCRRIFFMKESSTASSREKPGKLEAQSSNFLFPKACHQRARSNSTSVNPYCTREIDFPMTKKSAAPTDRQPYSLCSNRKSLSQQLDCPAGKAAGTSRPTRSLSTAQLVQPSGGLQASVISNIVLMKGQAKGLGFSIVGGKDSIYGPIGIYVKTIFAGGAAAADGRLQEGDEILELNGESMAGLTHQDALQKFKQAKKGLLTLTVRTRLTAPPSLCSHLSPPLCRSLSSSTCITKDSSSFALESPSAPISTAKPNYRIMVEVSLQKEAGVGLGIGLCSVPYFQCISGIFVHTLSPGSVAHLDGRLRCGDEIVEISDSPVHCLTLNEVYTILSHCDPGPVPIIVSRHPDPQKEEMEAQEVK

SEQ ID NO: 1319 - protein, 560 aa, Homo sapiens
MDYSFDTTAEDPWVRISDCIKNLFSPIMSENHGHMPLQPNASLNEEEGTQGHPDGTPPKLDTANGTPKVYKSADSSTVKKGPPVAPKPAWFRQSLKGLRNRASDPRGLPDPALSTQPAPASREHLGSHIRASSSSSSIRQRISSFETFGSSQLPDKGAQRLSLQPSSGEAAKPLGKHEEGRFSGLLGRGAAPTLVPQQPEQVLSSGSPAASEARDPGVSESPPPGRQPNQKTLPPGPDPLLRLLSTQAEESQGPVLKMPSQRARSFPLTRSQSCETKLLDEKTSKLYSISSQVSSAVMKSLLCLPSSISCAQTPCIPKEGASPTSSSNEDSAANGSAETSALDTGFSLNLSELREYTEGLTEAKEDDDGDHSSLQSGQSVISLLSSEELKKLIEEVKVLDEATLKQLDGIHVTILHKEEGAGLGFSLAGGADLENKVITVHRVFPNGLASQEGTIQKGNEVLSINGKSLKGTTHHDALAILRQAREPRQAVIVTRKLTPEAMPDLNSSTDSAASASAASDVSVESTEATVCTVTLEDVGRAGLQPGRREGLPTRRQASHH

SEQ ID NO: 1320 - protein, 1331 aa, Homo sapiens
MESHSRAGKSRKSAKFRSISRSLMLCNAKTSDDGSSPDEKYPDPFEISLAQGKEGIFHSSVQLADTSEAGPSSVPDLALASEAAQLQAAGNDRGKTCRRIFFMKESSTASSREKPGKLEAQSSNFLFPKACHQRARSNSTSVNPYCTREIDFPMTKKSAAPTDRQPYSLCSNRKSLSQQLDCPAGKAAGTSRPTRSLSTAQLVQPSGGLQASVISNIVLMKGQAKGLGFSIVGGKDSIYGPIGIYVKTIFAGGAAAADGRLQEGDEILELNGESMAGLTHQDALQKFKQAKKGLLTLTVRTRLTAPPSLCSHLSPPLCRSLSSSTCITKDSSSFALESPSAPISTAKPNYRIMVEVSLQKEAGVGLGIGLCSVPYFQCISGIFVHTLSPGSVAHLDGRLRCGDEIVEISDSPVHCLTLNEVYTILSHCDPGPVPIIVSRHPDPQVSEQQLKEAVAQAVENTKFGKERHQWSLEGVKRLESSWHGRPTLEKEREKNSAPPHRRAQKVMIRSSSDSSYMSGSPGGSPGSGSAEKPSSDVDISTHSPSLPLAREPVVLSIASSRLPQESPPLPESRDSHPPLRLKKSFEILVRKPMSSKPKPPPRKYFKSDSDPQKSLEERENSSCSSGHTPPTCGQEARELLPLLLPQEDTAGRSPSASAGCPGPGIGPQTKSSTEGEPGWRRASPVTQTSPIKHPLLKRQARMDYSFDTTAEDPWVRISDCIKNLFSPIMSENHGHMPLQPNASLNEEEGTQGHPDGTPPKLDTANGTPKVYKSADSSTVKKGPPVAPKPAWFRQSLKGLRNRASDPRGLPDPALSTQPAPASREHLGSHIRASSSSSSIRQRISSFETFGSSQLPDKGAQRLSLQPSSGEAAKPLGKHEEGRFSGLLGRGAAPTLVPQQPEQVLSSGSPAASEARDPGVSESPPPGRQPNQKTLPPGPDPLLRLLSTQAEESQGPVLKMPSQRARSFPLTRSQSCETKLLDEKTSKLYSISSQVSSAVMKSLLCLPSSISCAQTPCIPKEGASPTSSSNEDSAANGSAETSALDTGFSLNLSELREYTEGLTEAKEDDDGDHSSLQSGQSVISLLSSEELKKLIEEVKVLDEATLKQLDGIHVTILHKEEGAGLGFSLAGGADLENKVITVHRVFPNGLASQEGTIQKGNEVLSINGKSLKGTTHHDALAILRQAREPRQAVIVTRKLTPEAMPDLNSSTDSAASASAASDVSVESTEATVCTVTLEKMSAGLGFSLEGGKGSLHGDKPLTINRIFKGAASEQSETVQPGDEILQLGGTAMQGLTRFEAWNIIKALPDGPVTIVIRRKSLQSKETTAAGDS

SEQ ID NO: 1321 - protein, 594 aa, Homo sapiens
MESHSRAGKSRKSAKFRSISRSLMLCNAKTSDDGSSPDEKYPDPFEISLAQGKEGIFHSSVQLADTSEAGPSSVPDLALASEAAQLQAAGNDRGKTCRRIFFMKESSTASSREKPGKLEAQSSNFLFPKACHQRARSNSTSVNPYCTREIDFPMTKKSAAPTDRQPYSLCSNRKSLSQQLDCPAGKAAGTSRPTRSLSTAQLVQPSGGLQASVISNIVLMKGQAKGLGFSIVGGKDSIYGPIGIYVKTIFAGGAAAADGRLQEGDEILELNGESMAGLTHQDALQKFKQAKKGLLTLTVRTRLTAPPSLCSHLSPPLCRSLSSSTCITKDSSSFALESPSAPISTAKPNYRIMVEVSLQKEAGVGLGIGLCSVPYFQCISGIFVHTLSPGSVAHLDGRLRCGDEIVEISDSPVHCLTLNEVYTILSHCDPGPVPIIVSRHPDPQVSEQQLKEAVAQAVENTKFGKERHQWSLEGVKRLESSWHGRPTLEKEREKNSAPPHRRAQKVMIRSSSDSSYMSGSPGGSPGSGSAEKPSSDVDISTHSPSLPLAREPVVLSIASSRLPQESPPLPESRDSHPPLRLKKSFEILVRKPMS

SEQ ID NO: 1322 - protein, 155 aa, Homo sapiens
MTPGKTSLVSLLLLLSLEAIVKAGITIPRNPGCPNSEDKNFPRTVMVNLNIHNRNTNTNPKRSSDYYNRSTSPWNLHRNEDPERYPSVIWEAKCRHLGCINADGNVDYHMNSVPIQQEILVLRREPPHCPNSFRLEKILVSVGCTCVTPIVHHVA

SEQ ID NO: 1323 - protein, 180 aa, Homo sapiens
MDWPHNLLFLLTISIFLGLGQPRSPKSKRKGQGRPGPLAPGPHQVPLDLVSRMKPYARMEEYERNIEEMVAQLRNSSELAQRKCEVNLQLWMSNKRSLSPWGYSINHDPSRIPVDLPEARCLCLGCVNPFTMQEDRSMVSVPVFSQVPVRRRLCPPPPRTGPCRQRAVMETIAVGCTCIF

SEQ ID NO: 1324 - protein, 197 aa, Homo sapiens
MTLLPGLLFLTWLHTCLAHHDPSLRGHPHSHGTPHCYSAEELPLGQAPPHLLARGAKWGQALPVALVSSLEAASHRGRHERPSATTQCPVLRPEEVLEADTHQRSISPWRYRVDTDEDRYPQKLAFAECLCRGCIDARTGRETAALNSVRLLQSLLVLRRRPCSRDGSGLPTPGAFAFHTEFIHVPVGCTCVLPRSV

SEQ ID NO: 1325 - protein, 202 aa, Homo sapiens
MLVAGFLLALPPSWAAGAPRAGRRPARPRGCADRPEELLEQLYGRLAAGVLSAFHHTLQLGPREQARNASCPAGGRPADRRFRPPTNLRSVSPWAYRISYDPARYPRYLPEAYCLCRGCLTGLFGEEDVRFRSAPVYMPTVVLRRTPACAGGRSVYTEAYVTIPVGCTCVPEPEKDADSINSSIDKQGAKLLLGPNDAPAGP

SEQ ID NO: 1326 - protein, 163 aa, Homo sapiens
MTVKTLHGPAMVKYLLLSILGLAFLSEAAARKIPKVGHTFFQKPESCPPVPGGSMKLDIGIINENQRVSMSRNIESRSTSPWNYTVTWDPNRYPSEVVQAQCRNLGCINAQGKEDISMNSVPIQQETLVVRRKHQGCSVSFQLEKVLVTVGCTCVTPVIHHVQ

SEQ ID NO: 1327 - protein, 176 aa, Homo sapiens
MKASSLAFSLLSAAFYLLWTPSTGLKTLNLGSCVIATNLQEIRNGFSEIRGSVQAKDGNIDIRILRRTESLQDTKPANRCCLLRHLLRLYLDRVFKNYQTPDHYTLRKISSLANSFLTIKKDLRLCHAHMTCHCGEEAMKKYSQILSHFEKLEPQAAVVKALGELDILLQWMEETE

SEQ ID NO: 1328 - protein, 176 aa, Homo sapiens; identical to SEQ ID NO: 1327

SEQ ID NO: 1329 - protein, 151 aa, Homo sapiens
MKASSLAFSLLSAAFYLLWTPSTGLKTLNLGSCVIATNLQEIRNGFSEIRGSVQAKDGNIDIRILRRTESLQDTKPANRCCLLRHLLRLYLDRVFKNYQTPDHYTLRKISSLANSFLTIKKDLRLCLEPQAAVVKALGELDILLQWMEETE

SEQ ID NO: 1330 - protein, 179 aa, Homo sapiens
MAALQKSVSSFLMGTLATSCLLLLALLVQGGAAAPISSHCRLDKSNFQQPYITNRTFMLAKEASLADNNTDVRLIGEKLFHGVSMSERCYLMKQVLNFTLEEVLFPQSDRFQPYMQEVVPFLARLSNRLSTCHIEGDDLHIQRNVQKLKDTVKKLGESGEIKAIGELDLLFMSLRNACI

SEQ ID NO: 1331 - protein, 179 aa, Homo sapiens; identical to SEQ ID NO: 1330

SEQ ID NO: 1332 - protein, 629 aa, Homo sapiens
MNQVTIQWDAVIALYILFSWCHGGITNINCSGHIWVEPATIFKMGMNISIYCQAAIKNCQPRKLHFYKNGIKERFQITRINKTTARLWYKNFLEPHASMYCTAECPKHFQETLICGKDISSGYPPDIPDEVTCVIYEYSGNMTCTWNAGKLTYIDTKYVVHVKSLETEEEQQYLTSSYINISTDSLQGGKKYLVWVQAANALGMEESKQLQIHLDDIVIPSAAVISRAETINATVPKTIIYWDSQTTIEKVSCEMRYKATTNQTWNVKEFDTNFTYVQQSEFYLEPNIKYVFQVRCQETGKRYWQPWSSLFFHKTPETVPQVTSKAFQHDTWNSGLTVASISTGHLTSDNRGDIGLLLGMIVFAVMLSILSLIGIFNRSFRTGIKRRILLLIPKWLYEDIPNMKNSNVVKMLQENSELMNNNSSEQVLYVDPMITEIKEIFIPEHKPTDYKKENTGPLETRDYPQNSLFDNTTVVYIPDLNTGYKPQISNFLPEGSHLSNNNEITSLTLKPPVDSLDSGNNPRLQKHPNFAFSVSSVNSLSNTIFLGELSLILNQGECSSPDIQNSVEEETTMLLENDSPSETIPEQTLLPDEFVSCLGIVNEELPSINTYFPQNILESHFNRISLLEK

SEQ ID NO: 1333 - protein, 356 aa, Homo sapiens
MNQVTIQWDAVIALYILFSWCHGGITNINCSGHIWVEPATIFKMGMNISIYCQAAIKNCQPRKLHFYKNGIKERFQITRINKTTARLWYKNFLEPHASMYCTAECPKHFQETLICGKDISSGYPPDIPDEVTCVIYEYSGNMTCTWNAGKLTYIDTKYVVHVKSLETEEEQQYLTSSYINISTDSLQGGKKYLVWVQAANALGMEESKQLQIHLDDIVIPSAAVISRAETINATVPKTIIYWDSQTTIEKVSCEMRYKATTNQTWNVKEFDTNFTYVQQSEFYLEPNIKYVFQVRCQETGKRYWQPWSSLFFHKTPETVPQVTSKAFQHDTWNSGLTVASISTGHLTSGLKEGSYC

SEQ ID NO: 1334 - protein, 374 aa, Homo sapiens
MILRPYQPCGTVKEFDTNFTYVQQSEFYLEPNIKYVFQVRCQETGKRYWQPWSSLFFHKTPETVPQVTSKAFQHDTWNSGLTVASISTGHLTSDNRGDIGLLLGMIVFAVMLSILSLIGIFNRSFRTGIKRRILLLIPKWLYEDIPNMKNSNVVKMLQENSELMNNNSSEQVLYVDPMITEIKEIFIPEHKPTDYKKENTGPLETRDYPQNSLFDNTTVVYIPDLNTGYKPQISNFLPEGSHLSNNNEITSLTLKPPVDSLDSGNNPRLQKHPNFAFSVSSVNSLSNTIFLGELSLILNQGECSSPDIQNSVEEETTMLLENDSPSETIPEQTLLPDEFVSCLGIVNEELPSINTYFPQNILESHFNRISLLEK

SEQ ID NO: 1335 - protein, 117 aa, Homo sapiens
MTCTWNAGKLTYIDTKYVVHVKSLETEEEQQYLTSSYINISTDSLQGGKKYVFQVRCQETGKRYWQPWSSLFFHKTPETVPQVTSKAFQHDTWNSGLTVASISTGHLTSGLKEGSYC

SEQ ID NO: 1336 - protein, 391 aa, Homo sapiens
  MOD_RES (1)..(1): Any amino acid
XHFLLPPLSKKSLLPPTMILRPYQPCGTVKEFDTNFTYVQQSEFYLEPNIKYVFQVRCQETGKRYWQPWSSLFFHKTPETVPQVTSKAFQHDTWNSGLTVASISTGHLTSDNRGDIGLLLGMIVFAVMLSILSLIGIFNRSFRTGIKRRILLLIPKWLYEDIPNMKNSNVVKMLQENSELMNNNSSEQVLYVDPMITEIKEIFIPEHKPTDYKKENTGPLETRDYPQNSLFDNTTVVYIPDLNTGYKPQISNFLPEGSHLSNNNEITSLTLKPPVDSLDSGNNPRLQKHPNFAFSVSSVNSLSNTIFLGELSLILNQGECSSPDIQNSVEEETTMLLENDSPSETIPEQTLLPDEFVSCLGIVNEELPSINTYFPQNILESHFNRISLLEK

SEQ ID NO: 1337 - protein, 275 aa, Homo sapiens
MTCTWNAGKLTYIDTKYVVHVKSLETEEEQQYLTSSYINISTDSLQGGKKYLVWVQAANALGMEESKQLQIHLDDIVIPSAAVISRAETINATVPKTIIYWDSQTTIEKVSCEMRYKATTNQTWNVKEFDTNFTYVQQSEFYLEPNIKYVFQVRCQETGKRYWQPWSSLFFHKTPETDNRGDIGLLLGMIVFAVMLSILSLIGIFNRSFRTGIKRRILLLIPKWLYEDIPNMKNSNVVKMLQENSELMNNNSSEQVLYVDPMITEIKEIFIPEHK

SEQ ID NO: 1338 - protein, 204 aa, Homo sapiens
MTCTWNAGKLTYIDTKYVVHVKSLETEEEQQYLTSSYINISTDSLQGGKKYLVWVQAANALGMEESKQLQIHLDDIVPQVTSKAFQHDTWNSGLTVASISTGHLTSDNRGDIGLLLGMIVFAVMLSILSLIGIFNRSFRTGIKRRILLLIPKWLYEDIPNMKNSNVVKMLQENSELMNNNSSEQVLYVDPMITEIKEIFIPEHK

SEQ ID NO: 1339 - protein, 146 aa, Homo sapiens
MNISIYCQAAIKNCQPRKLHFYKNGIKERFQITRINKTTARLWYKNFLEPHASMYCTAECPKHFQETLICGKDISSGYPPDIPDEVTCVIYEYSGNMTCTWNAGKLTYIDTKYVVHVKRLKNLTPILHMCNSQNSTWSQTLSTYFK

SEQ ID NO: 1340 - protein, 142 aa, Homo sapiens
MTCTWNAGKLTYIDTKYVVHVKSLETEEEQQYLTSSYINISTDSLQGGKKYLVWVQAANALGMEESKQLQIHLDDIVIPSAAVISRAETINATVPKTIIYWDSQTTIEKVSCEMRYKATTNQTWNFPRSHQKHSNMTHGILG

SEQ ID NO: 1341 - protein, 222 aa, Homo sapiens
MNISIYCQAAIKNCQPRKLHFYKNGIKERFQITRINKTTARLWYKNFLEPHASMYCTAECPKHFQETLICGKDISSGYPPDIPDEVTCVIYEYSGNMTCTWNAGKLTYIDTKYVVHVKSLETEEEQQYLTSSYINISTDSLQGGKKYLVWVQAANALGMEESKQLQIHLDDIVIPSAAVISRAETINATVPKTIIYWDSQTTIEKVSCEMRYKATTNQTWND

SEQ ID NO: 1342 - protein, 189 aa, Homo sapiens
MLGSRAVMLLLLLPWTAQGRAVPGGSSPAWTQCQQLSQKLCTLAWSAHPLVGHMDLREEGDEETTNDVPHIQCGDGCDPQGLRDNSQFCLQRIHQGLIFYEKLLGSDIFTGEPSLLPDSPVGQLHASLLGLSQLLQPEGHHWETQQIPSLSPSQPWQRLLLRFKILRSLQAFVAVAARVFAHGAATLSP

SEQ ID NO: 1343 - protein, 206 aa, Homo sapiens
MNFQQRLQSLWTLARPFCPPLLATASQMQMVVLPCLGFTLLLWSQVSGAQGQEFHFGPCQVKGVVPQKLWEAFWAVKDTMQAQDNITSARLLQQEVLQNVSDAESCYLVHTLLEFYLKTVFKNYHNRTVEVRTLKSFSTLANNFVLIVSQLQPSQENEMFSIRDSAHRRFLLFRRAFKQLDVEAALTKALGEVDILLTWMQKFYKL

SEQ ID NO: 1344 - protein, 154 aa, Homo sapiens
MNFQQRLQSLWTLASRPFCPPLLATASQMQMVVLPCLGFTLLLWSQVSGAQGQEFHFGPCQVKGVVPQKLWEAFWAVKDTMQAQDNITSARLLQQEVLQNVSQENEMFSIRDSAHRRFLLFRRAFKQLDVEAALTKALGEVDILLTWMQKFYKL

SEQ ID NO: 1345 - protein, 207 aa, Homo sapiens
MNFQQRLQSLWTLASRPFCPPLLATASQMQMVVLPCLGFTLLLWSQVSGAQGQEFHFGPCQVKGVVPQKLWEAFWAVKDTMQAQDNITSARLLQQEVLQNVSDAESCYLVHTLLEFYLKTVFKNYHNRTVEVRTLKSFSTLANNFVLIVSQLQPSQENEMFSIRDSAHRRFLLFRRAFKQLDVEAALTKALGEVDILLTWMQKFYKL

SEQ ID NO: 1346 - protein, 177 aa, Homo sapiens
MRERPRLGEDSSLISLFLQVVAFLAMVMGTHTYSHWPSCCPSKGQDTSEELLRWSTVPVPPLEPARPNRHPESCRASEDGPLNSRAISPWRYELDRDLNRLPQDLYHARCLCPHCVSLQTGSHMDPRGNSELLYHNQTVFYRRPCHGEKGTHKGYCLERRLYRVSLACVCVRPRVMG

SEQ ID NO: 1347 - protein, 161 aa, Homo sapiens
MYQVVAFLAMVMGTHTYSHWPSCCPSKGQDTSEELLRWSTVPVPPLEPARPNRHPESCRASEDGPLNSRAISPWRYELDRDLNRLPQDLYHARCLCPHCVSLQTGSHMDPRGNSELLYHNQTVFYRRPCHGEKGTHKGYCLERRLYRVSLACVCVRPRVMG

SEQ ID NO: 1348 - protein, 171 aa, Homo sapiens
MLVNFILRCGLLLVTLSLAIAKHKQSSFTKSCYPRGTLSQAVDALYIKAAWLKATIPEDRIKNIRLLKKKTKKQFMKNCQFQEQLLSFFMEDVFGQLQLQGCKKIRFVEDFHSLRQKLSHCISCASSAREMKSITRMKRIFYRIGNKGIYKAISELDILLSWIKKLLESSQ

SEQ ID NO: 1349 - protein, 243 aa, Homo sapiens
MGQTAGDLGWRLSLLLLPLLLVQAGVWGFPRPPGRPQLSLQELRREFTVSLHLARKLLSEVRGQAHRFAESHLPGVNLYLLPLGEQLPDVSLTFQAWRRLSDPERLCFISTTLQPFHALLGGLGTQGRWTNMERMQLWAMRLDLRDLQRHLRFQVLAAGFNLPEEEEEEEEEEEEERKGLLPGALGSALQGPAQVSWPQLLSTYRLLHSLELVLSRAVRELLLLSKAGHSVWPLGFPTLSPQP

SEQ ID NO: 1350 - protein, 200 aa, Homo sapiens
MKLDMTGDCTPVLVLMAAVLTVTGAVPVARLHGALPDARGCHIAQFKSLSPQELQAFKRAKDALEESLLLKDCRCHSRLFPRTWDLRQLQVRERPMALEAELALTLKVLEATADTDPALVDVLDQPLHTLHHILSQFRACIQPQPTAGPRTRGRLHHWLYRLQEAPKKESPGCLEASVTFNLFRLLTRDLNCVASGDLCV

SEQ ID NO: 1351 - protein, 196 aa, Homo sapiens
MTGDCMPVLVLMAAVLTVTGAVPVARLRGALPDARGCHIAQFKSLSPQELQAFKRAKDALEESLLLKDCKCRSRLFPRTWDLRQLQVRERPVALEAELALTLKVLEATADTDPALGDVLDQPLHTLHHILSQLRACIQPQPTAGPRTRGRLHHWLHRLQEAPKKESPGCLEASVTFNLFRLLTRDLNCVASGDLCV

SEQ ID NO: 1352 - protein, 200 aa, Homo sapiens
MAAAWTVVLVTLVLGLAVAGPVPTSKPTTTGKGCHIGRFKSLSPQELASFKKARDALEESLKLKNWSCSSPVFPGNWDLRLLQVRERPVALEAELALTLKVLEAAAGPALEDVLDQPLHTLHHILSQLQACIQPQPTAGPRPRGRLHHWLHRLQEAPKKESAGCLEASVTFNLFRLLTRDLKYVADGNLCLRTSTHPEST

SEQ ID NO: 1353 - protein, 164 aa, Homo sapiens
MASHSGPSTSVLFLFCCLGGWLASHTLPVRLLRPSDDVQKIVEELQSLSKMLLKDVEEEKGVLVSQNYTLPCLSPDAQPPNNIHSPAIRAYLKTIRQLDNKSVIDEIIEHLDKLIFQDAPETNISVPTDTHECKRFILTISQQFSECMDLALKSLTSGAQQATT

SEQ ID NO: 1354 - protein, 168 aa, Homo sapiens
MCFPKVLSDDMKKLKARMVMSSLAELEDDFKEGYLETVAAYYEEQHPELTPLLEKERDGLRCRGNRSPVPDVEDPATEEPGESFCDKVMRWFQAMLQRLQTWWHGVLAWVKEKVVALVHAVQALWKQFQSFCCSLSELFMSSFQSYGAPRGDKEELTPQKCSEPQSSK

SEQ ID NO: 1355 - protein, 188 aa, Homo sapiens
MCFPKVLSDDMKKLKARMHQAIERFYDKMQNAESGRGQVMSSLAELEDDFKEGYLETVAAYYEEQHPELTPLLEKERDGLRCRGNRSPVPDVEDPATEEPGESFCDKVMRWFQAMLQRLQTWWHGVLAWVKEKVVALVHAVQALWKQFQSFCCSLSELFMSSFQSYGAPRGDKEELTPQKCSEPQSSK

SEQ ID NO: 1356 - protein, 179 aa, Homo sapiens
MCFPKVLSDDMKKLKARMHQAIERFYDKMQNAESGRGQDDFKEGYLETVAAYYEEQHPELTPLLEKERDGLRCRGNRSPVPDVEDPATEEPGESFCDKVMRWFQAMLQRLQTWWHGVLAWVKEKVVALVHAVQALWKQFQSFCCSLSELFMSSFQSYGAPRGDKEELTPQKCSEPQSSK

SEQ ID NO: 1357 - protein, 131 aa, Homo sapiens
MCFPKVLSDDMKKLKARMHQAIERFYDKMQNAESGRGQVMSSLAELEDDFKEGYLETVAAYYEEQHPELTPLLEKERDGLRCRGNRSPVPDVEDPATEEPGESFCDKSYGAPRGDKEELTPQKCSEPQSSK

SEQ ID NO: 1358 - protein, 234 aa, Homo sapiens
MCFPKVLSDDMKKLKARMVMLLPTSAQGLGAWVSACDTEDTVGHLGPWRDKDPALWCQLCLSSQHQAIERFYDKMQNAESGRGQVMSSLAELEDDFKEGYLETVAAYYEEQHPELTPLLEKERDGLRCRGNRSPVPDVEDPATEEPGESFCDKVMRWFQAMLQRLQTWWHGVLAWVKEKVVALVHAVQALWKQFQSFCCSLSELFMSSFQSYGAPRGDKEELTPQKCSEPQSSK

SEQ ID NO: 1359 - protein, 188 aa, Homo sapiens; identical to SEQ ID NO: 1355

SEQ ID NO: 1360 - protein, 188 aa, Homo sapiens; identical to SEQ ID NO: 1355

SEQ ID NO: 1361 - protein, 188 aa, Homo sapiens; identical to SEQ ID NO: 1355

SEQ ID NO: 1362 - protein, 188 aa, Homo sapiens; identical to SEQ ID NO: 1355

SEQ ID NO: 1363 - protein, 188 aa, Homo sapiens; identical to SEQ ID NO: 1355

SEQ ID NO: 1364 - protein, 188 aa, Homo sapiens; identical to SEQ ID NO: 1355

SEQ ID NO: 1365 - protein, 188 aa, Homo sapiens; identical to SEQ ID NO: 1355

SEQ ID NO: 1366 - protein, 168 aa, Homo sapiens; identical to SEQ ID NO: 1354

SEQ ID NO: 1367 - protein, 178 aa, Homo sapiens
MKKLKARMHQAIERFYDKMQNAESGRGQVMSSLAELEDDFKEGYLETVAAYYEEQHPELTPLLEKERDGLRCRGNRSPVPDVEDPATEEPGESFCDKVMRWFQAMLQRLQTWWHGVLAWVKEKVVALVHAVQALWKQFQSFCCSLSELFMSSFQSYGAPRGDKEELTPQKCSEPQSSK

SEQ ID NO: 1368 - protein, 188 aa, Homo sapiens; identical to SEQ ID NO: 1355

SEQ ID NO: 1369 - protein, 234 aa, Homo sapiens; identical to SEQ ID NO: 1358

SEQ ID NO: 1370 - protein, 234 aa, Homo sapiens; identical to SEQ ID NO: 1358

SEQ ID NO: 1371 - protein, 179 aa, Homo sapiens; identical to SEQ ID NO: 1356

SEQ ID NO: 1372 - protein, 225 aa, Homo sapiens
MCFPKVLSDDMKKLKARMVMLLPTSAQGLGAWVSACDTEDTVGHLGPWRDKDPALWCQLCLSSQHQAIERFYDKMQNAESGRGQVMSSLAELEDDFKEGYLETVAAYYEEQHPELTPLLEKERDGLRCRGNRSPVPDVEDPATEEPGESFCDKVMRWFQAMLQRLQTWWHGVLAWVKEKVVALVHAVQALWKQFQSFCCSLSELFMSSFQSYGAPRGDKEELTPQ

SEQ ID NO: 1373 - protein, 131 aa, Homo sapiens; identical to SEQ ID NO: 1357

SEQ ID NO: 1374 - protein, 131 aa, Homo sapiens; identical to SEQ ID NO: 1357

SEQ ID NO: 1375 - protein, 168 aa, Homo sapiens; identical to SEQ ID NO: 1354

SEQ ID NO: 1376 - protein, 188 aa, Homo sapiens; identical to SEQ ID NO: 1355

SEQ ID NO: 1377 - protein, 270 aa, Homo sapiens
MKPKMKYSTNKISTAKWKNTASKALCFKLGKSQQKAKEVCPMYFMKLRSGLMIKKEACYFRRETTKRPSLKTGRKHKRHLVLAACQQQSTVECFAFGISGVQKYTRALHDSSITGISPITEYLASLSTYNDQSITFALEDESYEIYVEDLKKDEKKDKVLLSYYESQHPSNESGDGVDGKMLMVTLSPTKDFWLHANNKEHSVELHKCEKPLPDQAFFVLHNMHSNCVSFECKTDPGVFIGVKDNHLALIKVDSSENLCTENILFKLSET

SEQ ID NO: 1378 - protein, 144 aa, Homo sapiens
MKPKMKYSTNKISTAKWKNTASKALCFKLGNKVLLSYYESQHPSNESGDGVDGKMLMVTLSPTKDFWLHANNKEHSVELHKCEKPLPDQAFFVLHNMHSNCVSFECKTDPGVFIGVKDNHLALIKVDSSENLCTENILFKLSET

SEQ ID NO: 1379 - protein, 228 aa, Homo sapiens
MKPKMKYSTNKISTAKWKNTASKALCFKLGKSQQKAKEVCPMYFMKLRSGLMIKKEACYFRRETTKRPSLKTGRKHKRHLVLAACQQQSTVECFAFGISGVQKYTRALHDSSITDKVLLSYYESQHPSNESGDGVDGKMLMVTLSPTKDFWLHANNKEHSVELHKCEKPLPDQAFFVLHNMHSNCVSFECKTDPGVFIGVKDNHLALIKVDSSENLCTENILFKLSET

SEQ ID NO: 1380 - protein, 242 aa, Homo sapiens
MPRGFTWLRYLGIFLGVALGNEPLEMWPLTQNEECTVTGFLRDKLQYRSRLQYMKHYFPINYKISVPYEGVFRIANVTRLQRAQVSERELRYLWVLVSLSATESVQDVLLEGHPSWKYLQEVETLLLNVQQGLTDVEVSPKVESVLSLLNAPGPNLKLVRPKALLDNCFRVMELLYCSCCKQSSVLNWQDCEVPSPQSCSPEPSLQYAATQLYPPPPWSPSSPPHSTGSVRPVRAQGEGLLP

SEQ ID NO: 1381 - protein, 242 aa, Homo sapiens; identical to SEQ ID NO: 1380

SEQ ID NO: 1382 - protein, 158 aa, Homo sapiens
MEKALKIDTPQQGSIQDINHRVWVLQDQTLIAVPRKDRMSPVTIALISCRHVETLEKDRGNPIYLGLNGLNLCLMCAKVGDQPTLQLKEKDIMDLYNQPEPVKSFLFYHSQSGRNSTFESVAFPGWFIAVSSEGGCPLILTQELGKANTTDFGLTMLF

SEQ ID NO: 1383 - protein, 43 aa, Homo sapiens
STFESVAFPGWFIAVSSEGGCPLILTQELGKANTTDFGLILVE

SEQ ID NO: 1384 - protein, 164 aa, Homo sapiens
MNPQREAAPKSYAIRDSRQMVWVLSGNSLIAAPLSRSIKPVTLHLIACRDTEFSDKEKGNMVYLGIKGKDLCLFCAEIQGKPTLQLKLQGSQDNIGKDTCWKLVGIHTCINLDVRESCFMGTLDQWGIGVGRKKWKSSFQHHHLRKKDKDFSSMRTNIGMPGRM

SEQ ID NO: 1385 - protein, 157 aa, Homo sapiens
MNPQREAAPKSYAIRDSRQMVWVLSGNSLIAAPLSRSIKPVTLHLIACRDTEFSDKEKGNMVYLGIKGKDLCLFCAEIQGKPTLQLKEKNIMDLYVEKKAQKPFLFFHNKEGSTSVFQSVSYPGWFIATSTTSGQPIFLTKERGITNNTNFYLDSVE

SEQ ID NO: 1386 - protein, 169 aa, Homo sapiens
MRGTPGDADGGGRAVYQSMCKPITGTINDLNQQVWTLQGQNLVAVPRSDSVTPVTVAVITCKYPEALEQGRGDPIYLGIQNPEMCLYCEKVGEQPTLQLKEQKIMDLYGQPEPVKPFLFYRAKTGRTSTLESVAFPDWFIASSKRDQPIILTSELGKSYNTAFELNIND

SEQ ID NO: 1387 - protein, 38 aa, Homo sapiens
MRGTPGDADGGGRAVYQSMCKPITGTINDLNQQVWTLQ

SEQ ID NO: 1388 - protein, 218 aa, Homo sapiens
MSFVGENSGVKMGSEDWEKDEPQCCLEDPAGSPLEPGPSLPTMNFVHTSPKVKNLNPKKFSIHDQDHKVLVLDSGNLIAVPDKNYIRPEIFFALASSLSSASAEKGSPILLGVSKGEFCLYCDKDKGQSHPSLQLKKEKLMKLAAQKESARRPFIFYRAQVGSWNMLESAAHPGWFICTSCNCNEPVGVTDKFENRKHIEFSFQPVCKAEMSPSEVSD

SEQ ID NO: 1389 - protein, 192 aa, Homo sapiens
MSGCDRRETETKGKNSFKKRLRGPKVKNLNPKKFSIHDQDHKVLVLDSGNLIAVPDKNYIRPEIFFALASSLSSASAEKGSPILLGVSKGEFCLYCDKDKGQSHPSLQLKKEKLMKLAAQKESARRPFIFYRAQVGSWNMLESAAHPGWFICTSCNCNEPVGVTDKFENRKHIEFSFQPVCKAEMSPSEVSD

SEQ ID NO: 1390 - protein, 157 aa, Homo sapiens
MSFVGENSGVKMGSEDWEKDEPQCCLEEIFFALASSLSSASAEKGSPILLGVSKGEFCLYCDKDKGQSHPSLQLKKEKLMKLAAQKESARRPFIFYRAQVGSWNMLESAAHPGWFICTSCNCNEPVGVTDKFENRKHIEFSFQPVCKAEMSPSEVSD

SEQ ID NO: 1391 - protein, 197 aa, Homo sapiens
MSFVGENSGVKMGSEDWEKDEPQCCLEGPKVKNLNPKKFSIHDQDHKVLVLDSGNLIAVPDKNYIRPEIFFALASSLSSASAEKGSPILLGVSKGEFCLYCDKDKGQSHPSLQLKKEKLMKLAAQKESARRPFIFYRAQVGSWNMLESAAHPGWFICTSCNCNEPVGVTDKFENRKHIEFSFQPVCKAEMSPSEVSD

SEQ ID NO: 1392 - protein, 178 aa, Homo sapiens
MSFVGENSGVKMGSEDWEKDEPQCCLEDPAGSPLEPGPSLPTMNFVHTKIFFALASSLSSASAEKGSPILLGVSKGEFCLYCDKDKGQSHPSLQLKKEKLMKLAAQKESARRPFIFYRAQVGSWNMLESAAHPGWFICTSCNCNEPVGVTDKFENRKHIEFSFQPVCKAEMSPSEVSD

SEQ ID NO: 1393 - protein, 589 aa, Homo sapiens
MPNDDFCPGLTIKAMGAERAPQRQPCTLHLLVLVPILLSLVASQDWKAERSQDPFEKCMQDPDYEQLLKVVTWGLNRTLKPQRVIVVGAGVAGLVAAKVLSDAGHKVTILEADNRIGGRIFTYRDQNTGWIGELGAMRMPSSHRILHKLCQGLGLNLTKFTQYDKNTWTEVHEVKLRNYVVEKVPEKLGYALRPQEKGHSPEDIYQMALNQALKDLKALGCRKAMKKFERHTLLEYLLGEGNLSRPAVQLLGDVMSEDGFFYLSFAEALRAHSCLSDRLQYSRIVGGWDLLPRALLSSLSGLVLLNAPVVAMTQGPHDVHVQIETSPPARNLKVLKADVVLLTASGPAVKRITFSPPLPRHMQEALRRLHYVPATKVFLSFRRPFWREEHIEGGHSNTDRPSRMIFYPPPREGALLLASYTWSDAAAAFAGLSREEALRLALDDVAALHGPVVRQLWDGTGVVKRWAEDQHSQGGFVVQPPALWQTEKDDWTVPYGRIYFAGEHTAYPHGWVETAVKSALRAAIKINSRKGPASDTASPEGHASDMEGQGHVHGVASSPSHDLAKEEGSHPPVQGQLSLQNTTHTRTSH

SEQ ID NO: 1394 - protein, 567 aa, Homo sapiens
MAPLALHLLVLVPILLSLVASQDWKAERSQDPFEKCMQDPDYEQLLKVVTWGLNRTLKPQRVIVVGAGVAGLVAAKVLSDAGHKVTILEADNRIGGRIFTYRDQNTGWIGELGAMRMPSSHRILHKLCQGLGLNLTKFTQYDKNTWTEVHEVKLRNYVVEKVPEKLGYALRPQEKGHSPEDIYQMALNQALKDLKALGCRKAMKKFERHTLLEYLLGEGNLSRPAVQLLGDVMSEDGFFYLSFAEALRAHSCLSDRLQYSRIVGGWDLLPRALLSSLSGLVLLNAPVVAMTQGPHDVHVQIETSPPARNLKVLKADVVLLTASGPAVKRITFSPPLPRHMQEALRRLHYVPATKVFLSFRRPFWREEHIEGGHSNTDRPSRMIFYPPPREGALLLASYTWSDAAAAFAGLSREEALRLALDDVAALHGPVVRQLWDGTGVVKRWAEDQHSQGGFVVQPPALWQTEKDDWTVPYGRIYFAGEHTAYPHGWVETAVKSALRAAIKINSRKGPASDTASPEGHASDMEGQGHVHGVASSPSHDLAKEEGSHPPVQGQLSLQNTTHTRTSH

SEQ ID NO: 1395 - protein, 589 aa, Homo sapiens; identical to SEQ ID NO: 1393

SEQ ID NO: 1396 - protein, 134 aa, Homo sapiens
MRMLLHLSLLALGAAYVYAIPTEIPTSALVKETLALLSTHRTLLIANETLRIPVPVHKNHQLCTEEIFQGIGTLESQTVQGGTVERLFKNLSLIKKYIDGQKKKCGEERRRVNQFLDYLQEFLGVMNTEWIIES

SEQ ID NO: 1397 - protein, 144 aa, Homo sapiens
MLLAMVLTSALLLCSVAGQGCPTLAGILDINFLINKMQEDPASKCHCSANVTSCLCLGIPSDNCTRPCFSERLSQMTNTTMQTRYPLIFSRVKKSVEVLKNNKCPYFSCEQPCNQTTAGNALTFLKSLLEIFQKEKMRGMRGKI

SEQ ID NO: 1398 - protein, 702 aa, Homo sapiens
MRPMRIFVNDDRHVMAKHSSVYPTQEELEAVQNMVSHTERALKAVSDWIDEQEKGSSEQAESDNMDVPPEDDSKEGAGEQKTEHMTRTLRGVMRVGLVAKGLLLKGDLDLELVLLCKEKPTTALLDKVADNLAIQLAAVTEDKYEILQSVDDAAIVIKNTKEPPLSLTIHLTSPVVREEMEKVLAGETLSVNDPPDVLDRQKCLAALASLRHAKWFQARANGLKSCVIVIRVLRDLCTRVPTWGPLRGWPLELLCEKSIGTANRPMGAGEALRRVLECLASGIVMPDGSGIYDPCEKEATDAIGHLDRQQREDITQSAQHALRLAAFGQLHKVLGMDPLPSKMPKKPKNENPVDYTVQIPPSTTYAITPMKRPMEEDGEEKSPSKKKKKIQKKEEKAEPPQAMNALMRLNQLKPGLQYKLVSQTGPVHAPIFTMSVEVDGNSFEASGPSKKTAKLHVAVKVLQDMGLPTGAEGRDSSKGEDSAEETEAKPAVVAPAPVVEAVSTPSAAFPSDATAEQGPILTKHGKNPVMELNEKRRGLKYELISETGGSHDKRFVMEVEVDGQKFQGAGSNKKVAKAYAALAALEKLFPDTPLALDANKKKRAPVPVRGGPKFAAKPHNPGFGMGGPMHNEVPPPPNLRGRGRGGSIRGRGRGRGFGGANHGGYMNAGAGYGSYGYGGNSATAGYSDFFTDCYGYHDFGSS

SEQ ID NO: 1399 - protein, 702 aa, Homo sapiens; identical to SEQ ID NO: 1398

SEQ ID NO: 1400 - protein, 894 aa, Homo sapiens
MRPMRIFVNDDRHVMAKHSSVYPTQEELEAVQNMVSHTERALKAVSDWIDEQEKGSSEQAESDNMDVPPEDDSKEGAGEQKTEHMTRTLRGVMRVGLVAKGLLLKGDLDLELVLLCKEKPTTALLDKVADNLAIQLAAVTEDKYEILQSVDDAAIVIKNTKEPPLSLTIHLTSPVVREEMEKVLAGETLSVNDPPDVLDRQKCLAALASLRHAKWFQARANGLKSCVIVIRVLRDLCTRVPTWGPLRGWPLELLCEKSIGTANRPMGAGEALRRVLECLASGIVMPDGSGIYDPCEKEATDAIGHLDRQQREDITQSAQHALRLAAFGQLHKVLGMDPLPSKMPKKPKNENPVDYTVQIPPSTTYAITPMKRPMEEDGEEKSPSKKKKKIQKKEEKAEPPQAMNALMRLNQLKPGLQYKLVSQTGPVHAPIFTMSVEVDGNSFEASGPSKKTAKLHVAVKVLQDMGLPTGAEGRDSSKGEDSAEETEAKPAVVAPAPVVEAVSTPSAAFPSDATAEQGPILTKHGKNPVMELNEKRRGLKYELISETGGSHDKRFVMEVEVDGQKFQGAGSNKKVAKAYAALAALEKLFPDTPLALDANKKKRAPVPVRGGPKFAAKPHNPGFGMGGPMHNEVPPPPNLRGRGRGGSIRGRGRGRGFGGANHGGYMNAGAGYGSYGYGGNSATAGYSQFYSNGGHSGNASGGGGGGGGGSSGYGSYYQGDNYNSPVPPKHAGKKQPHGGQQKPSYGSGYQSHQGQQQSYNQSPYSNYGPPQGKQKGYNHGQGSYSYSNSYNSPGGGGGSDYNYESKFNYSGSGGRSGGNSYGSGGASYNPGSHGGYGGGSGGGSSYQGKQGGYSQSNYNSPGSGQNYSGPPSSYQSSQGGYGRNADHSMNYQYR

SEQ ID NO: 1401 - protein, 764 aa, Homo sapiens
MRPMRIFVNDDRHVMAKHSSVYPTQEELEAVQNMVSHTERALKAVSDWIDEQEKGSSEQAESDNMDVPPEDDSKEGAGEQKTEHMTRTLRGVMRVGLVAKGLLLKGDLDLELVLLCKEKPTTALLDKVADNLAIQLAAVTEDKYEILQSVDDAAIVIKNTKEPPLSLTIHLTSPVVREEMEKVLAGETLSVNDPPDVLDRQKCLAALASLRHAKWFQARANGLKSCVIVIRVLRDLCTRVPTWGPLRGWPLELLCEKSIGTANRPMGAGEALRRVLECLASGIVMPDGSGIYDPCEKEATDAIGHLDRQQREDITQSAQHALRLAAFGQLHKVLGMDPLPSKMPKKPKNENPVDYTVQIPPSTTYAITPMKRPMEEDGEEKSPSKKKKKIQKKEEKAEPPQAMNALMRLNQLKPGLQYKLVSQTGPVHAPIFTMSVEVDGNSFEASGPSKKTAKLHVAVKVLQDMGLPTGAEGRDSSKGEDSAEETEAKPAVVAPAPVVEAVSTPSAAFPSDATAEQGPILTKHGKNPVMELNEKRRGLKYELISETGGSHDKRFVMEVEVDGQKFQGAGSNKKVAKAYAALAALEKLFPDTPLALDANKKKRAPVPVRGGPKFAAKPHNPGFGMGGPMHNEVPPPPNLRGRGRGGSIRGRGRGRGFGGANHGGYMNAGAGYGSYGYGGNSATAGYSKSSRPPPPSRPRCCVVRCSGSPCGPSCDPYLAVFGTPCLQWFVSCHYNFVWVEFLSFCSSVSLCLFTLRVSGNSVCL

SEQ ID NO: 1402 - protein, 706 aa, Homo sapiens
MRPMRIFVNDDRHVMAKHSSVYPTQEELEAVQNMVSHTERALKAVSDWIDEQEKGSSEQAESDNMDVPPEDDSKEGAGEQKTEHMTRTLRGVMRVGLVAKGLLLKGDLDLELVLLCKEKPTTALLDKVADNLAIQLAAVTEDKYEILQSVDDAAIVIKNTKEPPLSLTIHLTSPVVREEMEKVLAGETLSVNDPPDVLDRQKCLAALASLRHAKWFQARANGLKSCVIVIRVLRDLCTRVPTWGPLRGWPLELLCEKSIGTANRPMGAGEALRRVLECLASGIVMPDGSGIYDPCEKEATDAIGHLDRQQREDITQSAQHALRLAAFGQLHKVLGMDPLPSKMPKKPKNENPVDYTVQIPPSTTYAITPMKRPMEEDGEEKSPSKKKKKIQKKEEKAEPPQAMNALMRLNQLKPGLQYKLVSQTGPVHAPIFTMSVEVDGNSFEASGPSKKTAKLHVAVKVLQDMGLPTGAEGRDSSKGEDSAEETEAKPAVVAPAPVVEAVSTPSAAFPSDATAENVKQQGPILTKHGKNPVMELNEKRRGLKYELISETGGSHDKRFVMEVEVDGQKFQGAGSNKKVAKAYAALAALEKLFPDTPLALDANKKKRAPVPVRGGPKFAAKPHNPGFGMGGPMHNEVPPPPNLRGRGRGGSIRGRGRGRGFGGANHGGYMNAGAGYGSYGYGGNSATAGYSDFFTDCYGYHDFGSS

SEQ ID NO: 1403 - protein, 690 aa, Homo sapiens
MRPMRIFVNDDRHVMAKHSSVYPTQEELEAVQNMVSHTERALKAVSDWIDEQEKGSSEQAESDNMDVPPEDDSKEGAGEQKTEHMTRTLRGVMRVGLVAKGLLLKGDLDLELVLLCKEKPTTALLDKVADNLAIQLAAVTEDKYEILQSVDDAAIVIKNTKEPPLSLTIHLTSPVVREEMEKVLAGETLSVNDPPDVLDRQKCLAALASLRHAKWFQARANGLKSCVIVIRVLRDLCTRVPTWGPLRGWPLELLCEKSIGTANRPMGAGEALRRVLECLASGIVMPDGSGIYDPCEKEATDAIGHLDRQQREDITQSAQHALRLAAFGQLHKVLGMDPLPSKMPKKPKNENPVDYTVQIPPSTTYAITPMKRPMEEDGEEKSPSKKKKKIQKKEEKAEPPQAMNALMRLNQLKPGLQYKLVSQTGPVHAPIFTMSVEVDGNSFEASGPSKKTAKLHVAVKVLQDMGLPTGAEGRDSSKGEDSAEETEAKPAVVAPAPVVEAVSTPSAAFPSDATAEQGPILTKHGKNPVMELNEKRRGLKYELISETGGSHDKRFVMEVEVDGQKFQGAGSNKKVAKAYAALAALEKLFPDTPLALDANKKKRAPVPVRGGPKFAAKPHNPGFGMGGPMHNEVPPPPNLRGRGRGGSIRGRGRGRGFGGANHGGYMNAGAGYGSYGYGGNSATAGYTGFV

SEQ ID NO: 1404 - protein, 898 aa, Homo sapiens
MRPMRIFVNDDRHVMAKHSSVYPTQEELEAVQNMVSHTERALKAVSDWIDEQEKGSSEQAESDNMDVPPEDDSKEGAGEQKTEHMTRTLRGVMRVGLVAKGLLLKGDLDLELVLLCKEKPTTALLDKVADNLAIQLAAVTEDKYEILQSVDDAAIVIKNTKEPPLSLTIHLTSPVVREEMEKVLAGETLSVNDPPDVLDRQKCLAALASLRHAKWFQARANGLKSCVIVIRVLRDLCTRVPTWGPLRGWPLELLCEKSIGTANRPMGAGEALRRVLECLASGIVMPDGSGIYDPCEKEATDAIGHLDRQQREDITQSAQHALRLAAFGQLHKVLGMDPLPSKMPKKPKNENPVDYTVQIPPSTTYAITPMKRPMEEDGEEKSPSKKKKKIQKKEEKAEPPQAMNALMRLNQLKPGLQYKLVSQTGPVHAPIFTMSVEVDGNSFEASGPSKKTAKLHVAVKVLQDMGLPTGAEGRDSSKGEDSAEETEAKPAVVAPAPVVEAVSTPSAAFPSDATAENVKQQGPILTKHGKNPVMELNEKRRGLKYELISETGGSHDKRFVMEVEVDGQKFQGAGSNKKVAKAYAALAALEKLFPDTPLALDANKKKRAPVPVRGGPKFAAKPHNPGFGMGGPMHNEVPPPPNLRGRGRGGSIRGRGRGRGFGGANHGGYMNAGAGYGSYGYGGNSATAGYSQFYSNGGHSGNASGGGGGGGGGSSGYGSYYQGDNYNSPVPPKHAGKKQPHGGQQKPSYGSGYQSHQGQQQSYNQSPYSNYGPPQGKQKGYNHGQGSYSYSNSYNSPGGGGGSDYNYESKFNYSGSGGRSGGNSYGSGGASYNPGSHGGYGGGSGGGSSYQGKQGGYSQSNYNSPGSGQNYSGPPSSYQSSQGGYGRNADHSMNYQYR

SEQ ID NO: 1405 - protein, 293 aa, Homo sapiens [sequence omitted]

SEQ ID NO: 1406 - protein, 293 aa, Homo sapiens [sequence omitted]

SEQ ID NO: 1407 - protein, 293 aa, Homo sapiens [sequence omitted]

SEQ ID NO: 1408 - protein, 702 aa, Homo sapiens
MPINKSEKPESCDNVKVVVRCRPLNEREKSMCYKQAVSVDEMRGTITVHKTDSSNEPPKTFTFDTVFGPESKQLDVYNLTARPIIDSVLEGYNGTIFAYGQTGTGKTFTMEGVRAIPELRGIIPNSFAHIFGHIAKAEGDTRFLVRVSYLEIYNEEVRDLLGKDQTQRLEVKERPDVGVYIKDLSAYVVNNADDMDRIMTLGHKNRSVGATNMNEHSSRSHAIFTITIECSEKGIDGNMHVRMGKLHLVDLAGSERQAKTGATGQRLKEATKINLSLSTLGNVISALVDGKSTHVPYRNSKLTRLLQDSLGGNSKTMMCANIGPADYNYDETISTLRYANRAKNIKNKARINEDPKDALLRQFQKEIEELKKKLEEGEEISGSDISGSEEDDDEEGEVGEDGEKRKKRRDQAGKKKVSPDKMIEMQAKIDEERKALETKLDMEEEERNKARAELEKREKDLLKAQQEHQSLLEKLSALEKKVIVGGVDLLAKAEEQEKLLEESNMELEERRKRAEQLRRELEEKEQERLDIEEKYTSLQEEAQGKTKKLKKVWTMLMAAKSEMADLQQEHQREIEGLLENIRQLSRELRLQMLIIDNFIPRDYQEMIENYVHWNEDIGEWQLKCVAYTGNNMRKQTPVPDKKEKDPFEVDLSHVYLAYTEESLRQSLMKLERPRTSKGKARPKTGRRKRSAKPETVIDSLLQ

SEQ ID NO: 1409 - protein, 699 aa, Homo sapiens
MPINKSEKPESCDNVKVVVRCRPLNEREKSMCYKQAVSVDEMRGTITVHKTDSSNEPPKTFTFDTVFGPESKQLDVYNLTARPIIDSVLEGYNGTIFAYGQTGTGKTFTMEGVRAIPELRGIIPNSFAHIFGHIAKAEGDTRFLVRVSYLEIYNEEVRDLLGKDQTQRLEVKERPDVGVYIKDLSAYVVNNADDMDRIMTLGHKNRSVGATNMNEHSSRSHAIFTITIECSEKGIDGNMHVRMGKLHLVDLAGSERQAKTGATGQRLKEATKINLSLSTLGNVISALVDGKSTHVPYRNSKLTRLLQDSLGGNSKTMMCANIGPADYNYDETISTLRYANRAKNIKNKARINEDPKDALLRQFQKEIEELKKKLEEGEEISGSDISGSEEDDDEEGEVGEDGEKRKKRRGKKKVSPDKMIEMQAKIDEERKALETKLDMEEEERNKARAELEKREKDLLKAQQEHQSLLEKLSALEKKVIVGGVDLLAKAEEQEKLLEESNMELEERRKRAEQLRRELEEKEQERLDIEEKYTSLQEEAQGKTKKLKKVWTMLMAAKSEMADLQQEHQREIEGLLENIRQLSRELRLQMLIIDNFIPRDYQEMIENYVHWNEDIGEWQLKCVAYTGNNMRKQTPVPDKKEKDPFEVDLSHVYLAYTEESLRQSLMKLERPRTSKGKARPKTGRRKRSAKPETVIDSLLQ

SEQ ID NO: 1410 - protein, 409 aa, Homo sapiens
MCYKQAVSVDEMRGTITVHKTDSSNEPPKTFTFDTVFGPESKQLDVYNLTARPIIDSVLEGYNGTIFAYGQTGTGKTFTMEGVRAIPELRGIIPNSFAHIFGHIAKAEGDTRFLVRVSYLEIYNEEVRDLLGKDQTQRLEVKERPDVGVYIKDLSAYVVNNADDMDRIMTLGHKNRSVGATNMNEHSSRSHAIFTITIECSEKGIDGNMHVRMGKLHLVDLAGSERQAKTGATGQRLKEATKINLSLSTLGNVISALVDGKSTHVPYRNSKLTRLLQDSLGGNSKTMMCANIGPADYNYDETISTLRYANRAKNIKNKARINEDPKDALLRQFQKEIEELKKKLEEGEEISGSDISGSEEDDDEEGEVGEDGEKRKKRRGKKKVSPDKMIEMQAKIDEERKKKKKKKKK

SEQ ID NO: 1411 - protein, 726 aa, Homo sapiens
MPINKSEKPESCDNVKVVVRCRPLNEREKSMCYKQAVSVDEMRGTITVHKTDSSNEPPKTFTFDTVFGPESKQLDVYNLTARPIIDSVLEGYNGTIFAYGQTGTGKTFTMEGVRAIPELRGIIPNSFAHIFGHIAKAEGDTRFLVRVSYLEIYNEEVRDLLGKDQTQRLEVKERPDVGVYIKDLSAYVVNNADDMDRIMTLGHKNRSVGATNMNEHSSRSHAIFTITIECSEKGIDGNMHVRMGKLHLVDLAGSERQAKTGATGQRLKEATKINLSLSTLGNVISALVDGKSTHVPYRNSKLTRLLQDSLGGNSKTMMCANIGPADYNYDETISTLRYANRAKNIKNKARINEDPKDALLRQFQKEIEELKKKLEEGEEISGSDISGSEEDDDEEGEVGEDGEKRKKRRGSSSSSSSDSTCSVIEKPLDKFLPIQIGKKKVSPDKMIEMQAKIDEERKALETKLDMEEEERNKARAELEKREKDLLKAQQEHQSLLEKLSALEKKVIVGGVDLLAKAEEQEKLLEESNMELEERRKRAEQLRRELEEKEQERLDIEEKYTSLQEEAQGKTKKLKKVWTMLMAAKSEMADLQQEHQREIEGLLENIRQLSRELRLQMLIIDNFIPRDYQEMIENYVHWNEDIGEWQLKCVAYTGNNMRKQTPVPDKKEKDPFEVDLSHVYLAYTEESLRQSLMKLERPRTSKGKARPKTGRRKRSAKPETVIDSLLQ

SEQ ID NO: 1412 - protein, 344 aa, Homo sapiens
MVSVNSSHCFYNDSFKYTLYGCMFSMVFVLGLISNCVAIYIFICVLKVRNETTTYMINLAMSDLLFVFTLPFRIFYFTTRNWPFGDLLCKISVMLFYTNMYGSILFLTCISVDRFLAIVYPFKSKTLRTKRNAKIVCTGVWLTVIGGSAPAVFVQSTHSQGNNASEACFENFPEATWKTYLSRIVIFIEIVGFFIPLILNVTCSSMVLKTLTKPVTLSRSKINKTKVLKMIFVHLIIFCFCFVPYNINLILYSLVRTQTFVNCSVVAAVRTMYPITLCIAVSNCCFDPIVYYFTSDTIQNSIKMKNWSVRRSDFRFSEVHGAENFIQHNLQTLKSKIFDNESAA

SEQ ID NO: 1413 - protein, 344 aa, Homo sapiens; identical to SEQ ID NO: 1412

SEQ ID NO: 1414 - protein, 264 aa, Homo sapiens
MLRGPWAFHYNVSSHGCQLLPWTQHSPHTRLRRSGRCDLFQKKDYVRTCIMNNGVGYRGTMATTVGGLPCQAWSHKFPNDHKYTPTLRNGLEENFCRNPDGDPGGPWCYTTDPAVRFQSCGIKSCREAACVWCNGEEYRGAVDRTESGRECQRWDLQHPHQHPFEPGKFLDQGLDDNYCRNPDGSERPWCYTTDPQIEREFCDLPRCGSEAQPRQEATTVSCFRGKGEGYRGTANTTTAGVPCQRWDAQIPHQHRFTPEKYACK

SEQ ID NO: 1415 - protein, 725 aa, Homo sapiens
MGLWWVTVQPPARRMGWLPLLLLLTQCLGVPGQRSPLNDFQVLRGTELQHLLHAVVPGPWQEDVADAEECAGRCGPLMDCRAFHYNVSSHGCQLLPWTQHSPHTRLRRSGRCDLFQKKDYVRTCIMNNGVGYRGTMATTVGGLPCQAWSHKFPNDHKYTPTLRNGLEENFCRNPDGDPGGPWCYTTDPAVRFQSCGIKSCREAACVWCNGEEYRGAVDRTESGRECQRWDLQHPHQHPFEPGKFLDQGLDDNYCRNPDGSERPWCYTTDPQIEREFCDLPRCGSEAQPRQEATTVSCFRGKGEGYRGTANTTTAGVPCQRWDAQIPHQHRFTPEKYACKDLRENFCRNPDGSEAPWCFTLRPGMRAAFCYQIRRCTDDVRPQDCYHGAGEQYRGTVSKTRKGVQCQRWSAETPHKPQFTFTSEPHAQLEENFCRNPDGDSHGPWCYTMDPRTPFDYCALRRCADDQPPSILDPPDQVQFEKCGKRVDRLDQRRSKLRVVGGHPGNSPWTVSLRNRQGQHFCGGSLVKEQWILTARQCFSSCHMPLTGYEVWLGTLFQNPQHGEPSLQRVPVAKMVCGPSGSQLVLLKLERSVTLNQRVALICLPPEWYVVPPGTKCEIAGWGETKGTGNDTVLNVALLNVISNQECNIKHRGRVRESEMCTEGLLAPVGACEGDYGGPLACFTHNCWVLEGIIIPNRVCARSRWPAVFTRVSVFVDWIHKVMRLG

SEQ ID NO: 1416 - protein, 164 aa, Homo sapiens
MGWLPLLLLLTQCLGVPGQRSPLNDFQVLRGTELQHLLHAVVPGPWQEDVADAEECAGRCGPLMDCRAFHYNVSSHGCQLLPWTQHSPHTRLRRSGRCDLFQKKGTRPLSGMAWKRTSAVTLMATPEVLGATQQTLLCASRAAASNPAGRPRVSGAMARNTAAR

SEQ ID NO: 1417 - protein, 689 aa, Homo sapiens
MAPAPVTLLAPGAASSMSCSQPGQRSPSNDFQVLRGTELQHLLHAVVPGPWQEDVADAEECAGRCGPLMDCWAFHYNVSSHGCQLLPWTQHSPHSRLWHSGRCDLFQEKGEWGYMPTLRNGLEENFCRNPDGDPGGPWCHTTDPAVRFQSCSIKSCRVAACVWCNGEEYRGAVDRTESGRECQRWDLQHPHQHPFEPGKFLDQGLDDNYCRNPDGSERPWCYTTDPQIEREFCDLPRCGSEAQPRQEATSVSCFRGKGEGYRGTANTTTAAYLASVGTRKSHISTDLRQKNTRASEVGGGAGVGTCCCGDLRENFCWNLDGSEAPWCFTLRPGTRVGFCYQIRRCTDDVRPQDCYHGAGEQYRGTVSKTRKGVQCQRWSAETPHKLQALTLGRHALMSGTRAWKWLRLPCHDFAPAPASVHIYLRTACTTGGELLPDPDGDSHGPWCYTMDPRTPFDYCALRRCDQVQFEKCGKRVDRLDQRRSKLRVAGGHPGNSPWTVSLRNRHMPLTGYEVWLGTLFQNPQHGEPGLQRVPVAKMLCGPSGSQLVLLKLERSVTLNQRVALICLPPEWYVVPPGTKCEIAGWGETKGTGNDTVLNVALLNVISNQECNIKHRGHVRESEMCTEGLLAPVGACEGDYGGPLACFTHNCWVLKGIRIPNRVCTRSRWPAVFTRVSVFVDWIHKVMRLG

SEQ ID NO: 1418 - protein, 565 aa, Homo sapiens
MTSRCSGAQSYLLHAVVPGPWQEDVADAEECAGRCGPLMDCWAFHYNVSSHGCQLLPWTQHSPHSRLWHSGRCDLFQEKDYIRTCIMNNGVGYRGTMATTVGGLSCQAWSHKFPNDHKYMPTLRNGLEENFCRNPDGDPGGPWCHTTDPAVRFQSCSIKSCRVAACVWCNGEEYRGAVDRTESGRECQRWDLQHPHQHPFEPGKFLDQGLDDNYCRNPDGSERPWCYTTDPQIEREFCDLPRCGSEAQPRQEATSVSCFRGKGEGYRGTANTTTGVPCQRWDAQIPHQHRFTPEKYACKDLRENFCWNLDGSEAPWCFTLRPGTRVGFCYQIRRCTDDVRPQDCYHGAGEQYRGTVSKTRKGVQCQRWSAETPHKLQFTFTSEPHAQLEENFCQPDGDSHGPWCYTMDPRTPFDYCALRRCADDQPPSILDPPNQVQFEKCGKRVDRLDQRRSKLRVAGGHPGNSPWTVSLRNRQGQHFCAGSLVKEQWILTARQCFSSCHMPLTGYEVWLGTLFQNPQHGEPGLQRVPVAKMLCGPSGSQLVLLKLERSVTLNQRVALICLPPE

SEQ ID NO: 1419 - protein, 715 aa, Homo sapiens
MAPAPVTLLAPGAASSMSCSQPGQRSPSNDFQVLRGTELQHLLHAVVPGPWQEDVADAEECAGRCGPLMDCWAFHYNVSSHGCQLLPWTQHSPHSRLWHSGRCDLFQEKGEWGYMPTLRNGLEENFCRNPDGDPGGPWCHTTDPAVRFQSCSIKSCRVAACVWCNGEEYRGAVDRTESGRECQRWDLQHPHQHPFEPGKFLDQGLDDNYCRNPDGSERPWCYTTDPQIEREFCDLPRCGSEAQPRQEATSVSCFRGKGEGYRGTANTTTAAYLASVGTRKSHISTDLRQKNTRASEVGGGAGVGTCCCGDLRENFCWNLDGSEAPWCFTLRPGTRVGFCYQIRRCTDDVRPQDCYHGAGEQYRGTVSKTRKGVQCQRWSAETPHKLQALTLGRHALMSGTRAWKWLRLPCHDFAPAPASVHIYLRTACTTGGELLPDPDGDSHGPWCYTMDPRTPFDYCALRRCDQVQFEKCGKRVDRLDQRRSKLRVAGGHPGNSPWTVSLRNRQGQHFCAGSLVKEQWILTARQCFSSCHMPLTGYEVWLGTLFQNPQHGEPGLQRVPVAKMLCGPSGSQLVLLKLERSVTLNQRVALICLPPEWYVVPPGTKCEIAGWGETKGTGNDTVLNVALLNVISNQECNIKHRGHVRESEMCTEGLLAPVGACEGDYGGPLACFTHNCWVLKGIRIPNRVCTRSRWPAVFTRVSVFVDWIHKVMRLG

SEQ ID NO: 1420 - protein, 366 aa, Homo sapiens
MRVMAPRALLLLLSGGLALTETWACSHSMRYFDTAVSRPGRGEPRFISVGYVDDTQFVRFDSDAASPRGEPRAPWVEQEGPEYWDRETQKYKRQAQADRVSLRNLRGYYNQSEDGSHTLQRMSGCDLGPDGRLLRGYDQSAYDGKDYIALNEDLRSWTAADTAAQITQRKLEAARAAEQLRAYLEGTCVEWLRRYLENGKETLQRAEPPKTHVTHHPLSDHEATLRCWALGFYPAEITLTWQRDGEDQTQDTELVETRPAGDGTFQKWAAVVVPSGQEQRYTCHMQHEGLQEPLTLSWEPSSQPTIPIMGIVAGLAVLVVLAVLGAVVTAMMCRRKSSGGKGGSCSQAACSNSAQGSDESLITCKA

SEQ ID NO: 1421 - protein, 131 aa, Homo sapiens
MRVMAPRALLLLLSGGLALTETWACSHSMRYFDTAVSRPGRGEPRFISVGYVDDTQFVRFDSDAASPRGEPRAPWVEQEGPEYWDRETQKYKRQAQADRVSLRNLRGYYNQSEDEDVWLRPGARRAPPPRV

SEQ ID NO: 1422 - protein, 372 aa, Homo sapiens
MRVMAPRTLILLLSGALALTETWACSHSMRYFYTAVSRPGRGEPRFIAVGYVDDTQFVQFDSDAASPRGEPRAPWVEQEGPEYWDRETQKYKRQAQTDRVNLRKLRGYYNQSEAGSHTLQRMYGCDLGPDGRLLRGYNQFAYDGKDYIALNEDLRSWTAADKAAQITQRKWEAAREAEQRRAYLEGTCVEWLRRYLENGKKTLQRAEHPKTHVTHHPVSDHEATLRCWALGFYPAEITLTWQRDGEDQTQDTELVETRPAGDGTFQKWAAVVVPSGEEQRYTCHVQHEGLPEPLTLRWGPSSQPTIPIVGIVAGLAVLAVLAVLGAVMAVVMCRRKSSGHFLPTGGKGGSCSQAASSNSAQGSDESLIACKA

SEQ ID NO: 1423 - protein, 372 aa, Homo sapiens
MRVMAPRALLLLLSGGLALTETWACSHSMRYFDTAVSRPGRGEPRFISVGYVDDTQFVRFDSDAASPRGEPRAPWVEQEGPEYWDRETQKYKRQAQADRVSLRNLRGYYNQSEDGSHTLQRMSGCDLGPDGRLLRGYDQSAYDGKDYIALNEDLRSWTAADTAAQITQRKLEAARAAEQLRAYLEGTCVEWLRRYLENGKETLQRAEPPKTHVTHHPLSDHEATLRCWALGFYPAEITLTWQRDGEDQTQDTELVETRPAGDGTFQKWAAVVVPSGQEQRYTCHMQHEGLQEPLTLSWEPSSQPTIPIMGIVAGLAVLVVLAVLGAVVTAMMCRRKSSGHFLPTGGKGGSCSQAACSNSAQGSDESLITCKA

SEQ ID NO: 1424 - protein, 397 aa, Homo sapiens
MRVMAPRTLILLLSGALALTETWACSHSMRYFYTAVSRPGRGEPRFIAVGYVDDTQFVQFDSDAASPRGEPRAPWVEQEGPEYWDRETQKYKRQAQTDRVNLRKLRGYYNQSEAGSHTLQRMYGCDLGPDGRLLRGYNQFAYDGKDYIALNEDLRSWTAADKAAQITQRKWEAAREAEQRRAYLEGTCVEWLRRYLENGKKTLQRAEHPKTHVTHHPVSDHEATLRCWALGFYPAEITLTWQRDGEDQTQDTELVETRPAGDGTFQKWAAVVVPSGEEQRYTCHVQHEGLPEPLTLRWGPSSQPTIPIVGIVAGLAVLAVLAVLGAVMAVVMCRRKSSGREGVRSGVWPATVPRALMSLSSLVKPETAACVGLRCRISSHLSFVTSRASGISFCKGI

SEQ ID NO: 1425 - protein, 372 aa, Homo sapiens; identical to SEQ ID NO: 1422

SEQ ID NO: 1426 - protein, 397 aa, Homo sapiens
MRVMAPRALLLLLSGGLALTETWACSHSMRYFDTAVSRPGRGEPRFISVGYVDDTQFVRFDSDAASPRGEPRAPWVEQEGPEYWDRETQKYKRQAQADRVSLRNLRGYYNQSEDGSHTLQRMSGCDLGPDGRLLRGYDQSAYDGKDYIALNEDLRSWTAADTAAQITQRKLEAARAAEQLRAYLEGTCVEWLRRYLENGKETLQRAEPPKTHVTHHPLSDHEATLRCWALGFYPAEITLTWQRDGEDQTQDTELVETRPAGDGTFQKWAAVVVPSGQEQRYTCHMQHEGLQEPLTLSWEPSSQPTIPIMGIVAGLAVLVVLAVLGAVVTAMMCRRKSSGREGVKSGVWAATVPRALMSLSSLVKPETAACVGLRCRISSHLSFVTSRASGISFCKGT

SEQ ID NO: 1427 - protein, 366 aa, Homo sapiens
MRVMAPRTLILLLSGALALTETWACSHSMRYFYTAVSRPGRGEPRFIAVGYVDDTQFVQFDSDAASPRGEPRAPWVEQEGPEYWDRETQKYKRQAQTDRVNLRKLRGYYNQSEAGSHTLQRMYGCDLGPDGRLLRGYNQFAYDGKDYIALNEDLRSWTAADKAAQITQRKWEAAREAEQRRAYLEGTCVEWLRRYLENGKKTLQRAEHPKTHVTHHPVSDHEATLRCWALGFYPAEITLTWQRDGEDQTQDTELVETRPAGDGTFQKWAAVVVPSGEEQRYTCHVQHEGLPEPLTLRWGPSSQPTIPIVGIVAGLAVLAVLAVLGAVMAVVMCRRKSSGGKGGSCSQAASSNSAQGSDESLIACKA

SEQ ID NO: 1428 - protein, 366 aa, Homo sapiens; identical to SEQ ID NO: 1427

SEQ ID NO: 1429 - protein, 397 aa, Homo sapiens; identical to SEQ ID NO: 1424

SEQ ID NO: 1430 - protein, 397 aa, Homo sapiens
MRVMAPRTLILLLSGALALTETWACSHSMRYFYTAVSRPGRGEPRFIAVGYVDDTQFVRFDSDAASPRGEPRAPWVEQEGPEYWDRETQKYKRQAQTDRVSLRNLRGYYNQSEAGSHTLQWMYGCDLGPDGRLLRGYDQSAYDGKDYIALNEDLRSWTAADTAAQITQRKWEAARAAEQQRAYLEGTCVEWLRRYLENGKETLQRAEHPKTHVTHHLVSDHEATLRCWALGFYPAEITLTWQRDGEDQTQDTELVETRPAGDGTFQKWAAVVVPSGEEQRYTCHVQHEGLPEPLTLRWEPSSQPTIPIVGIVAGLAVLAVLAVLGAVVAVVMCRRKSSGREGVRSGVWPATVPRALMSLSSLVKPETAACVGLRCRISSHLSFVTSRASGISFCKGI

SEQ ID NO: 1431 - protein, 261 aa, Homo sapiens
  MOD_RES (1)..(1): Any amino acid
XRVMAPRALLLLLSGGLALTETWACSHSMRYFDTAVSRPGRGEPRFISVGYVDDTQFVRFDSDAASPRGEPRAPWVEQEGPEYWDRETQKYKRQAQADRVSLRNLRGYYNQSEDGSHTLQRMSGCDLGPDGRLLRGYDQSAYDGKDYIALNEDLRSWTAADTAAQITQRKLEAARAAEQLRAYLEGTCVEWLRRYLENGKETLQRAEPPKTHVTHHPLSDHEASRRWNLPEVGSCGGAFWTRAEIHVPYAARGAARAPHPE

SEQ ID NO: 1432 - protein, 372 aa, Homo sapiens
MRVMAPRTLILLLSGALALTETWAGSHSMRYFYTAVSRPGRGEPHFIAVGYVDDTQFVRFDSDAASPRGEPRAPWVEQEGPEYWDRETQKYKRQAQTDRVSLRNLRGYYNQSEAGSHIIQRMYGCDVGPDGRLLRGYDQYAYDGKDYIALNEDLRSWTAADTAAQITQRKWEAAREAEQLRAYLEGLCVEWLRRYLKNGKETLQRAEHPKTHVTHHPVSDHEATLRCWALGFYPAEITLTWQWDGEDQTQDTELVETRPAGDGTFQKWAAVVVPSGEEQRYTCHVQHEGLPEPLTLRWEPSSQPTIPIVGIVAGLAVLAVLAVLGAVVAVVMCRRKSSGHFLPTGGKGGSCSQAASSNSAQGSDESLIACKA

SEQ ID NO: 1433 - protein, 339 aa, Homo sapiens
MRVMAPRTLILLLSGALALTETWACSHSMRYFYTAVSRPGRGEPRFIAVGYVDDTQFVRFDSDAASPRGEPRAPWVEQEGPEYWDRETQKYKRQAQTDRVSLRNLRGYYNQSEAGSHTLQWMYGCDLGPDGRLLRGYDQSAYDGKDYIALNEDLRSWTAADTAAQITQRKWEAARAAEQQRAYLEGTCVEWLRRYLENGKETLQRAEHPKTHVTHHLVSDHEATLRCWALGFYPAEITLTWQRDGEDQTQDTELVETRPAGDGTFQKWAAVVVPSGEEQRYTCHVQHEGLPEPLTLRWEPSSQPTIPIVGIVAGLAVLAVLAVLGAVVAVVMCRRKSSA

SEQ ID NO: 1434 - protein, 366 aa, Homo sapiens
MRVMAPRTLILLLSGALALTETWACSHSMRYFDTAVSRPGRGEPRFISVGYVDDTQFVRFDSDAASPRGEPRAPWVEQEGPEYWDRETQKYKRQAQADRVNLRKLRGYYNQSEDGSHTLQWMYGCDLGPDGRLLRGYDQSAYDGKDYIALNEDLRSWTAADTAAQITQRKWEAAREAEQWRAYLEGTCVEWLRRYLENGKETLQRAEHPKTHVTHHPVSDHEATLRCWALGFYPAEITLTWQRDGEDQTQDTELVETRPAGDGTFQKWAAVVVPSGEEQRYTCHVQHEGLPEPLTLRWEPSSQPTIPIVGIVAGLAVLAVLAVLGAVMAVVMCRRKSSGGKGGSCSQAASSNSAQGSDESLIACKA

SEQ ID NO: 1435 - protein, 368 aa, Homo sapiens
MRVMAPRALLLLLSGGLALTETWACSHSMRYFDTAVSRPGRGEPRFISVGYVDDTQFVRFDSDAASPRGEPRAPWVEQEGPEYWDRETQNYKRQAQADRVSLRNLRGYYNQSEDGSHTLQRMYGCDLGPDGRLLRGYDQSAYDGKDYIALNEDLRSWTAADTAAQITQRKLEAARAAEQLRAYLEGTCVEWLRRYLENGKETLQRAEPPKTHVTHHPLSDHEATLRCWALGFYPAEITLTWQRDGEDQTQDTELVETRPAGDGTFQKWAAVVVPSGQEQRYTCHMQHEGLQEPLTLSWEPSSQPTIPIMGIVAGLAVLVVLAVLGAVVTAMMCRRKSSAACVGLRCRISSHLSFVTSRASGISFCKGV

SEQ ID NO: 1436 - protein, 397 aa, Homo sapiens
MRVMAPRTLILLLSGALALTETWACSHSMRYFDTAVSRPGRGEPRFISVGYVDDTQFVRFDSDAASPRGEPRAPWVEQEGPEYWDRETQKYKRQAQADRVNLRKLRGYYNQSEDGSHTLQWMYGCDLGPDGRLLRGYDQSAYDGKDYIALNEDLRSWTAADTAAQITQRKWEAAREAEQWRAYLEGTCVEWLRRYLENGKETLQRAEHPKTHVTHHPVSDHEATLRCWALGFYPAEITLTWQRDGEDQTQDTELVETRPAGDGTFQKWAAVVVPSGEEQRYTCHVQHEGLPEPLTLRWEPSSQPTIPIVGIVAGLAVLAVLAVLGAVMAVVMCRRKSSGREGVRSGVWPATVPRALMSLSSLVKPETAACVGLRCRISSHLSFVTSRASGISFCKGI

SEQ ID NO: 1437 - protein, 372 aa, Homo sapiens
MRVMAPRALLLLLSGGLALTETWACSHSMRYFDTAVSRPGRGEPRFISVGYVDDTQFVRFDSDAASPRGEPRAPWVEQEGPEYWDRETQNYKRQAQADRVSLRNLRGYYNQSEDGSHTLQRMYGCDLGPDGRLLRGYDQSAYDGKDYIALNEDLRSWTAADTAAQITQRKLEAARAAEQLRAYLEGTCVEWLRRYLENGKETLQRAEPPKTHVTHHPLSDHEATLRCWALGFYPAEITLTWQRDGEDQTQDTELVETRPAGDGTFQKWAAVVVPSGQEQRYTCHMQHEGLQEPLTLSWEPSSQPTIPIMGIVAGLAVLVVLAVLGAVVTAMMCRRKSSGHFLPTGGKGGSCSQAACSNSAQGSDESLITCKA

SEQ ID NO: 1438 - protein, 366 aa, Homo sapiens
MRVMAPRALLLLLSGGLALTETWACSHSMRYFDTAVSRPGRGEPRFISVGYVDDTQFVRFDSDAASPRGEPRAPWVEQEGPEYWDRETQNYKRQAQADRVSLRNLRGYYNQSEDGSHTLQRMYGCDLGPDGRLLRGYDQSAYDGKDYIALNEDLRSWTAADTAAQITQRKLEAARAAEQLRAYLEGTCVEWLRRYLENGKETLQRAEPPKTHVTHHPLSDHEATLRCWALGFYPAEITLTWQRDGEDQTQDTELVETRPAGDGTFQKWAAVVVPSGQEQRYTCHMQHEGLQEPLTLSWEPSSQPTIPIMGIVAGLAVLVVLAVLGAVVTAMMCRRKSSGGKGGSCSQAACSNSAQGSDESLITCKA

SEQ ID NO: 1439 - protein, 368 aa, Homo sapiens
MRVMAPRTLILLLSGALALTETWAGSHSMRYFYTAVSRPGRGEPHFIAVGYVDDTQFVRFDSDAASPRGEPRAPWVEQEGPEYWDRETQKYKRQAQTDRVSLRNLRGYYNQSEAGSHIIQRMYGCDVGPDGRLLRGYDQYAYDGKDYIALNEDLRSWTAADTAAQITQRKWEAAREAEQLRAYLEGLCVEWLRRYLKNGKETLQRAEHPKTHVTHHPVSDHEATLRCWALGFYPAEITLTWQWDGEDQTQDTELVETRPAGDGTFQKWAAVVVPSGEEQRYTCHVQHEGLPEPLTLRWEPSSQPTIPIVGIVAGLAVLAVLAVLGAVVAVVMCRRKSSAACVGLRCRISSHLSFVTSRASGISFCKGI

SEQ ID NO: 1440 - protein, 397 aa, Homo sapiens
MRVMAPRALLLLLSGGLALTETWACSHSMRYFDTAVSRPGRGEPRFISVGYVDDTQFVRFDSDAASPRGEPRAPWVEQEGPEYWDRETQNYKRQAQADRVSLRNLRGYYNQSEDGSHTLQRMYGCDLGPDGRLLRGYDQSAYDGKDYIALNEDLRSWTAADTAAQITQRKLEAARAAEQLRAYLEGTCVEWLRRYLENGKETLQRAEPPKTHVTHHPLSDHEATLRCWALGFYPAEITLTWQRDGEDQTQDTELVETRPAGDGTFQKWAAVVVPSGQEQRYTCHMQHEGLQEPLTLSWEPSSQPTIPIMGIVAGLAVLVVLAVLGAVVTAMMCRRKSSGREGVKSGVWAATVPRALMSLSSLVKPETAACVGLRCRISSHLSFVTSRASGISFCKGV

SEQ ID NO: 1441 - protein, 355 aa, Homo sapiens
MRVMAPRTLILLLSGALALTETWAGSHSMRYFYTAVSRPGRGEPHFIAVGYVDDTQFVRFDSDAASPRGEPRAPWVEQEGPEYWDRETQKYKRQAQTDRVSLRNLRGYYNQSEAGSHIIQRMYGCDVGPDGRLLRGYDQYAYDGKDYIALNEDLRSWTAADTAAQITQRKWEAAREAEQLRAYLEGLCVEWLRRYLKNGKETLQRAEHPKTHVTHHPVSDHEATLRCWALGFYPAEITLTWQWDGEDQTQDTELVETRPAGDGTFQKWAAVVVPSGEEQRYTCHVQHEGLPEPLTLRWEPSSQPTIPIVGIVAGLAVLAVLAVLGAVVAVVMCRRKSSASNSAQGSDESLIACKA

SEQ ID NO: 1442 - protein, 368 aa, Homo sapiens
MRVMAPRTLILLLSGALALTETWACSHSMRYFYTAVSRPGRGEPRFIAVGYVDDTQFVQFDSDAASPRGEPRAPWVEQEGPEYWDRETQKYKRQAQTDRVNLRKLRGYYNQSEAGSHTLQRMYGCDLGPDGRLLRGYNQFAYDGKDYIALNEDLRSWTAADKAAQITQRKWEAAREAEQRRAYLEGTCVEWLRRYLENGKKTLQRAEHPKTHVTHHPVSDHEATLRCWALGFYPAEITLTWQRDGEDQTQDTELVETRPAGDGTFQKWAAVVVPSGEEQRYTCHVQHEGLPEPLTLRWGPSSQPTIPIVGIVAGLAVLAVLAVLGAVMAVVMCRRKSSAACVGLRCRISSHLSFVTSRASGISFCKGI

SEQ ID NO: 1443 - protein, 261 aa, Homo sapiens
  MOD_RES (1)..(1): Any amino acid
XRVMAPRTLILLLSGALALTETWACSHSMRYFYTAVSRPGRGEPRFIAVGYVDDTQFVRFDSDAASPRGEPRAPWVEQEGPEYWDRETQKYKRQAQTDRVSLRNLRGYYNQSEAGSHTLQWMYGCDLGPDGRLLRGYDQSAYDGKDYIALNEDLRSWTAADTAAQITQRKWEAARAAEQQRAYLEGTCVEWLRRYLENGKETLQRAEHPKTHVTHHLVSDHEASRRWNLPEVGSCGGAFWRRAEIHVPCAARGAAGAPHPE

SEQ ID NO: 1444 - protein, 366 aa, Homo sapiens
MRVMAPRTLILLLSGALALTETWACSHSMRYFYTAVSRPGRGEPRFIAVGYVDDTQFVRFDSDAASPRGEPRAPWVEQEGPEYWDRETQKYKRQAQTDRVSLRNLRGYYNQSEAGSHTLQWMYGCDLGPDGRLLRGYDQSAYDGKDYIALNEDLRSWTAADTAAQITQRKWEAARAAEQQRAYLEGTCVEWLRRYLENGKETLQRAEHPKTHVTHHLVSDHEATLRCWALGFYPAEITLTWQRDGEDQTQDTELVETRPAGDGTFQKWAAVVVPSGEEQRYTCHVQHEGLPEPLTLRWEPSSQPTIPIVGIVAGLAVLAVLAVLGAVVAVVMCRRKSSGGKGGSCSQAASSNSAQGSDESLIACKA

SEQ ID NO: 1445 - protein, 261 aa, Homo sapiens
  MOD_RES (1)..(1): Any amino acid
XRVMAPRTLILLLSGALALTETWAGSHSMRYFYTAVSRPGRGEPHFIAVGYVDDTQFVRFDSDAASPRGEPRAPWVEQEGPEYWDRETQKYKRQAQTDRVSLRNLRGYYNQSEAGSHIIQRMYGCDVGPDGRLLRGYDQYAYDGKDYIALNEDLRSWTAADTAAQITQRKWEAAREAEQLRAYLEGLCVEWLRRYLKNGKETLQRAEHPKTHVTHHPVSDHEASRRWNLPEVGSCGGAFWRRAEIHVPCAARGAAGAPHPE

SEQ ID NO: 1446 - protein, 261 aa, Homo sapiens
  MOD_RES (1)..(1): Any amino acid
XRVMAPRTLILLLSGALALTETWACSHSMRYFYTAVSRPGRGEPRFIAVGYVDDTQFVQFDSDAASPRGEPRAPWVEQEGPEYWDRETQKYKRQAQTDRVNLRKLRGYYNQSEAGSHTLQRMYGCDLGPDGRLLRGYNQFAYDGKDYIALNEDLRSWTAADKAAQITQRKWEAAREAEQRRAYLEGTCVEWLRRYLENGKKTLQRAEHPKTHVTHHPVSDHEASRRWNLPEVGSCGGAFWRRAEIHVPCAARGAARAPHPE

SEQ ID NO: 1447 - protein, 261 aa, Homo sapiens; identical to SEQ ID NO: 1446
  MOD_RES (1)..(1): Any amino acid

SEQ ID NO: 1448 - protein, 372 aa, Homo sapiens
MRVMAPRTLILLLSGALALTETWACSHSMRYFYTAVSRPGRGEPRFIAVGYVDDTQFVRFDSDAASPRGEPRAPWVEQEGPEYWDRETQKYKRQAQTDRVSLRNLRGYYNQSEAGSHTLQWMYGCDLGPDGRLLRGYDQSAYDGKDYIALNEDLRSWTAADTAAQITQRKWEAARAAEQQRAYLEGTCVEWLRRYLENGKETLQRAEHPKTHVTHHLVSDHEATLRCWALGFYPAEITLTWQRDGEDQTQDTELVETRPAGDGTFQKWAAVVVPSGEEQRYTCHVQHEGLPEPLTLRWEPSSQPTIPIVGIVAGLAVLAVLAVLGAVVAVVMCRRKSSGHFLPTGGKGGSCSQAASSNSAQGSDESLIACKA

SEQ ID NO: 1449 - protein, 261 aa, Homo sapiens
  MOD_RES (1)..(1): Any amino acid
XRVMAPRTLILLLSGALALTETWACSHSMRYFDTAVSRPGRGEPRFISVGYVDDTQFVRFDSDAASPRGEPRAPWVEQEGPEYWDRETQKYKRQAQADRVNLRKLRGYYNQSEDGSHTLQWMYGCDLGPDGRLLRGYDQSAYDGKDYIALNEDLRSWTAADTAAQITQRKWEAAREAEQWRAYLEGTCVEWLRRYLENGKETLQRAEHPKTHVTHHPVSDHEASRRWNLPEVGSCGGAFWRRAEIHVPCAARGAARAPHPE

SEQ ID NO: 1450 - protein, 368 aa, Homo sapiens
MRVMAPRTLILLLSGALALTETWACSHSMRYFDTAVSRPGRGEPRFISVGYVDDTQFVRFDSDAASPRGEPRAPWVEQEGPEYWDRETQKYKRQAQADRVNLRKLRGYYNQSEDGSHTLQWMYGCDLGPDGRLLRGYDQSAYDGKDYIALNEDLRSWTAADTAAQITQRKWEAAREAEQWRAYLEGTCVEWLRRYLENGKETLQRAEHPKTHVTHHPVSDHEATLRCWALGFYPAEITLTWQRDGEDQTQDTELVETRPAGDGTFQKWAAVVVPSGEEQRYTCHVQHEGLPEPLTLRWEPSSQPTIPIVGIVAGLAVLAVLAVLGAVMAVVMCRRKSSAACVGLRCRISSHLSFVTSRASGISFCKGI

SEQ ID NO: 1451 - protein, 261 aa, Homo sapiens
  MOD_RES (1)..(1): Any amino acid
XRVMAPRALLLLLSGGLALTETWACSHSMRYFDTAVSRPGRGEPRFISVGYVDDTQFVRFDSDAASPRGEPRAPWVEQEGPEYWDRETQNYKRQAQADRVSLRNLRGYYNQSEDGSHTLQRMYGCDLGPDGRLLRGYDQSAYDGKDYIALNEDLRSWTAADTAAQITQRKLEAARAAEQLRAYLEGTCVEWLRRYLENGKETLQRAEPPKTHVTHHPLSDHEASRRWNLPEVGSCGGAFWTRAEIHVPYAARGAARAPHPE

SEQ ID NO: 1452 - protein, 366 aa, Homo sapiens
MRVMAPRTLILLLSGALALTETWAGSHSMRYFYTAVSRPGRGEPHFIAVGYVDDTQFVRFDSDAASPRGEPRAPWVEQEGPEYWDRETQKYKRQAQTDRVSLRNLRGYYNQSEAGSHIIQRMYGCDVGPDGRLLRGYDQYAYDGKDYIALNEDLRSWTAADTAAQITQRKWEAAREAEQLRAYLEGLCVEWLRRYLKNGKETLQRAEHPKTHVTHHPVSDHEATLRCWALGFYPAEITLTWQWDGEDQTQDTELVETRPAGDGTFQKWAAVVVPSGEEQRYTCHVQHEGLPEPLTLRWEPSSQPTIPIVGIVAGLAVLAVLAVLGAVVAVVMCRRKSSGGKGGSCSQAASSNSAQGSDESLIACKA

SEQ ID NO: 1453 - protein, 372 aa, Homo sapiens
MRVMAPRTLILLLSGALALTETWACSHSMRYFDTAVSRPGRGEPRFISVGYVDDTQFVRFDSDAASPRGEPRAPWVEQEGPEYWDRETQKYKRQAQADRVNLRKLRGYYNQSEDGSHTLQWMYGCDLGPDGRLLRGYDQSAYDGKDYIALNEDLRSWTAADTAAQITQRKWEAAREAEQWRAYLEGTCVEWLRRYLENGKETLQRAEHPKTHVTHHPVSDHEATLRCWALGFYPAEITLTWQRDGEDQTQDTELVETRPAGDGTFQKWAAVVVPSGEEQRYTCHVQHEGLPEPLTLRWEPSSQPTIPIVGIVAGLAVLAVLAVLGAVMAVVMCRRKSSGHFLPTGGKGGSCSQAASSNSAQGSDESLIACKA

SEQ ID NO: 1454 - protein, 368 aa, Homo sapiens; identical to SEQ ID NO: 1442

SEQ ID NO: 1455 - protein, 224 aa, Homo sapiens
MRVMAPRALLLLLSGGLALTETWACSHSMRYFDTAVSRPGRGEPRFISVGYVDDTQFVRFDSDAASPRGEPRAPWVEQEGPEYWDRETQKYKRQAQADRVSLRNLRGYYNQSEDGSHTLQRMSGCDLGPDGRLLRGYDQSAYDGKDYIALNEDLRSWTAADTAAQITQRKLEAARAAEQLRAYLEGTCVEWLRRYLENGKETLQRAGQDQKSLFLPQRLELSNE

SEQ ID NO: 1456 - protein, 224 aa, Homo sapiens
MRVMAPRTLILLLSGALALTETWACSHSMRYFYTAVSRPGRGEPRFIAVGYVDDTQFVQFDSDAASPRGEPRAPWVEQEGPEYWDRETQKYKRQAQTDRVNLRKLRGYYNQSEAGSHTLQRMYGCDLGPDGRLLRGYNQFAYDGKDYIALNEDLRSWTAADKAAQITQRKWEAAREAEQRRAYLEGTCVEWLRRYLENGKKTLQRAGQDQKSLFLPQRLELSNE

SEQ ID NO: 1457 - protein, 224 aa, Homo sapiens
MRVMAPRALLLLLSGGLALTETWACSHSMRYFDTAVSRPGRGEPRFISVGYVDDTQFVRFDSDAASPRGEPRAPWVEQEGPEYWDRETQNYKRQAQADRVSLRNLRGYYNQSEDGSHTLQRMYGCDLGPDGRLLRGYDQSAYDGKDYIALNEDLRSWTAADTAAQITQRKLEAARAAEQLRAYLEGTCVEWLRRYLENGKETLQRAGQDQKSLFLPQRLELSNE

SEQ ID NO: 1458 - protein, 131 aa, Homo sapiens
MRVMAPRTLILLLSGALALTETWACSHSMRYFYTAVSRPGRGEPRFIAVGYVDDTQFVQFDSDAASPRGEPRAPWVEQEGPEYWDRETQKYKRQAQTDRVNLRKLRGYYNQSEAEDVWLRPGARRAPPPRV

SEQ ID NO: 1459 - protein, 131 aa, Homo sapiens
MRVMAPRALLLLLSGGLALTETWACSHSMRYFDTAVSRPGRGEPRFISVGYVDDTQFVRFDSDAASPRGEPRAPWVEQEGPEYWDRETQNYKRQAQADRVSLRNLRGYYNQSEDEDVWLRPGARRAPPPRV

SEQ ID NO: 1460 - protein, 131 aa, Homo sapiens
MRVMAPRTLILLLSGALALTETWACSHSMRYFDTAVSRPGRGEPRFISVGYVDDTQFVRFDSDAASPRGEPRAPWVEQEGPEYWDRETQKYKRQAQADRVNLRKLRGYYNQSEDVDVWLRPGARRAPPPRV

SEQ ID NO: 1461 - protein, 131 aa, Homo sapiens; identical to SEQ ID NO: 1458

SEQ ID NO: 1462 - protein, 131 aa, Homo sapiens
MRVMAPRTLILLLSGALALTETWACSHSMRYFYTAVSRPGRGEPRFIAVGYVDDTQFVRFDSDAASPRGEPRAPWVEQEGPEYWDRETQKYKRQAQTDRVSLRNLRGYYNQSEAVDVWLRPGARRAPPPRV

SEQ ID NO: 1463 - protein, 131 aa, Homo sapiens
MRVMAPRTLILLLSGALALTETWAGSHSMRYFYTAVSRPGRGEPHFIAVGYVDDTQFVRFDSDAASPRGEPRAPWVEQEGPEYWDRETQKYKRQAQTDRVSLRNLRGYYNQSEAEDVWLRRGARRAPPPRV

SEQ ID NO: 1464 - protein, 403 aa, Homo sapiens
MRVMAPRALLLLLSGGLALTETWACECGVGREAASAERSEGPPGEPRREVGRAGLSPSSPPGSHSMRYFDTAVSRPGRGEPRFISVGYVDDTQFVRFDSDAASPRGEPRAPWVEQEGPEYWDRETQKYKRQAQADRVSLRNLRGYYNQSEDGSHTLQRMSGCDLGPDGRLLRGYDQSAYDGKDYIALNEDLRSWTAADTAAQITQRKLEAARAAEQLRAYLEGTCVEWLRRYLENGKETLQRAEPPKTHVTHHPLSDHEATLRCWALGFYPAEITLTWQRDGEDQTQDTELVETRPAGDGTFQKWAAVVVPSGQEQRYTCHMQHEGLQEPLTLSWEPSSQPTIPIMGIVAGLAVLVVLAVLGAVVTAMMCRRKSSGGKGGSCSQAACSNSAQGSDESLITCKA

SEQ ID NO: 1465 - protein, 403 aa, Homo sapiens
MRVMAPRALLLLLSGGLALTETWACECGVGREAASAERSEGPPGEPRREVGRAGLSPSSPPGSHSMRYFDTAVSRPGRGEPRFISVGYVDDTQFVRFDSDAASPRGEPRAPWVEQEGPEYWDRETQNYKRQAQADRVSLRNLRGYYNQSEDGSHTLQRMYGCDLGPDGRLLRGYDQSAYDGKDYIALNEDLRSWTAADTAAQITQRKLEAARAAEQLRAYLEGTCVEWLRRYLENGKETLQRAEPPKTHVTHHPLSDHEATLRCWALGFYPAEITLTWQRDGEDQTQDTELVETRPAGDGTFQKWAAVVVPSGQEQRYTCHMQHEGLQEPLTLSWEPSSQPTIPIMGIVAGLAVLVVLAVLGAVVTAMMCRRKSSGGKGGSCSQAACSNSAQGSDESLITCKA

SEQ ID NO: 1466 - protein, 326 aa, Homo sapiens
MRVMAPRTLILLLSGALALTETWACSHSMRYFYTAVSRPGRGEPRFIAVGYVDDTQFVRFDSDAASPRGEPRAPWVEQEGPEYWDRETQKYKRQAQTDRVSLRNLRGYYNQSEAGSHTLQWMYGCDLGPDGRLLRGYDQSAYDGKDYIALNEDLRSWTAADTAAQITQRKWEAARAAEQQRAYLEGTCVEWLRRYLENGKETLQRAEHPKTHVTHHLVSDHEATLRCWALGFYPAEITLTWQRDGEDQTQDTELVETRPAGDGTFQKWAAVVVPSGEEQRYTCHVQHEGLPEPLTLRWGGKGGSCSQAASSNSAQGSDESLIACKA

SEQ ID NO: 1467 - protein, 669 aa, Homo sapiens
MGSDPSAPGRPGWTGSLLGDREEAARPRLLPLLLVLLGCLGLGVAAEDAEVHAENWLRLYGYLPQPSRHMSTMRSAQILASALAEMQRFYGIPVTGVLDEETKEWMKRPRCGVPDQFGVRVKANLRRRRKRYALTGRKWNNHHLTFSIQNYTEKLGWYHSMEAVRRAFRVWEQATPLVFQEVPYEDIRLRRQKEADIMVLFASGFHGDSSPFDGTGGFLAHAYFPGPGLGGDTHFDADEPWTFSSTDLHGNNLFLVAVHELGHALGLEHSSNPNAIMAPFYQWKDVDNFKLPEDDLRGIQQLYGTPDGQPQPTQPLPTVTPRRPGRPDHRPPRPPQPPPPGGKPERPPKPGPPVQPRATERPDQYGPNICDGDFDTVAMLRGEMFVFKGRWFWRVRHNRVLDNYPMPIGHFWRGLPGDISAAYERQDGRFVFFKGDRYWLFREANLEPGYPQPLTSYGLGIPYDRIDTAIWWEPTGHTFFFQEDRYWRFNEETQRGDPGYPKPISVWQGIPASPKGAFLSNDAAYTYFYKGTKYWKFDNERLRMEPGYPKSILRDFMGCQEHVEPGPRWPDVARPPFNPHGGAEPGADSAEGDVGDGDGDFGAGVNKDGGSRVVVQMEEVARTVNVVMVLVPLLLLLCVLGLTYALVQMQRKGAPRVLLYCKRSLQEWV

SEQ ID NO: 1468 - protein, 607 aa, Homo sapiens
MILLTFSTGRRLDFVHHSGVFFLQTLLWILCATVCGTEQYFNVEVWLQKYGYLPPTDPRMSVLRSAETMQSALAAMQQFYGINMTGKVDRNTIDWMKKPRCGVPDQTRGSSKFHIRRKRYALTGQKWQHKHITYSIKNVTPKVGDPETRKAIRRAFDVWQNVTPLTFEEVPYSELENGKRDVDITIIFASGFHGDSSPFDGEGGFLAHAYFPGPGIGGDTHFDSDEPWTLGNPNHDGNDLFLVAVHELGHALGLEHSNDPTAIMAPFYQYMETDNFKLPNDDLQGIQKIYGPPDKIPPPTRPLPTVPPHRSIPPADPRKNDRPKPPRPPTGRPSYPGAKPNICDGNFNTLAILRREMFVFKDQWFWRVRNNRVMDGYPMQITYFWRGLPPSIDAVYENSDGNFVFFKGNKYWVFKDTTLQPGYPHDLITLGSGIPPHGIDSAIWWEDVGKTYFFKGDRYWRYSEEMKTMDPGYPKPITVWKGIPESPQGAFVHKENGFTYFYKGKEYWKFNNQILKVEPGYPRSILKDFMGCDGPTDRVKEGHSPPDDVDIVIKLDNTASTVKAIAIVIPCILALCLLVLVYTVFQFKRKGTPRHILYCKRSMQEWV

SEQ ID NO: 1469 - protein, 603 aa, Homo sapiens
MRRRAARGPGPPPPGPGLSRLPLPLLLLLALGTRGGCAAPAPAPRAEDLSLGVEWLSRFGYLPPADPTTGQLQTQEELSKAITAMQQFGGLEATGILDEATLALMKTPRCSLPDLPVLTQARRRRQAPAPTKWNKRNLSWRVRTFPRDSPLGHDTVRALMYYALKVWSDIAPLNFHEVAGSAADIQIDFSKADHNDGYPFDGPGGTVAHAFFPGHHHTAGDTHFDDDEAWTFRSSDAHGMDLFAVAVHEFGHAIGLSHVAAAHSIMRPYYQGPVGDPLRYGLPYEDKVRVWQLYGVRESVSPTAQPEEPPLLPEPPDNRSSAPPRKDVPHRCSTHFDAVAQIRGEAFFFKGKYFWRLTRDRHLVSLQPAQMHRFWRGLPLHLDSVDAVYERTSDHKIVFFKGDRYWVFKDNNVEEGYPRPVSDFSLPPGGIDAAFSWAHNDRTYFFKDQLYWRYDDHTRHMDPGYPAQSPLWRGVPSTLDDAMRWSDGASYFFRGQEYWKVLDGELEVAPGYPQSTARDWLVCGDSQADGSVAAGVDAAEGPRAPPGQHDQSRSEDGYEVCSCTSGASSPPGAPGPLVAATMLLLLPPLSPGALWTAAQALTL

SEQ ID NO: 1470 - protein, 519 aa, Homo sapiens
MQQFGGLEATGILDEATLALMKTPRCSLPDLPVLTQARRRRQAPAPTKWNKRNLSWRVRTFPRDSPLGHDTVRALMYYALKVWSDIAPLNFHEVAGSAADIQIDFSKADHNDGYPFDGPGGTVAHAFFPGHHHTAGDTHFDDDEAWTFRSSDAHGMDLFAVAVHEFGHAIGLSHVAAAHSIMRPYYQGPVGDPLRYGLPYEDKVRVWQLYGVRESVSPTAQPEEPPLLPEPPDNRSSAPPRKDVPHRCSTHFDAVAQIRGEAFFFKGKYFWRLTRDRHLVSLQPAQMHRFWRGLPLHLDSVDAVYERTSDHKIVFFKGDRYWVFKDNNVEEGYPRPVSDFSLPPGGIDAAFSWAHNDRTYFFKDQLYWRYDDHTRHMDPGYPAQSPLWRGVPSTLDDAMRWSDGASYFFRGQEYWKVLDGELEVAPGYPQSTARDWLVCGDSQADGSVAAGVDAAEGPRAPPGQHDQSRSEDGYEVCSCTSGASSPPGAPGPLVAATMLLLLPPLSPGALWTAAQALTL

SEQ ID NO: 1471 - protein, 115 aa, Homo sapiens
MQQFGGLEATGILDEATLALMKTPRCSLPDLPVLTQARRRRQAPAPTKWNKRNLSWRVRTFPRDSPLGHDTVRALMYYALKVWSDIAPLNFHEVAGSAADIQIDFSKADHNDGYP

SEQ ID NO: 1472 - protein, 508 aa, Homo sapiens
MNCQQLWLGFLLPMTVSGRVLGLAEVAPVDYLSQYGYLQKPLEGSNNFKPEDITEALRAFQEASELPVSGQLDDATRARMRQPRCGLEDPFNQKTLKYLLLGRWRKKHLTFRILNLPSTLPPHTARAALRQAFQDWSNVAPLTFQEVQAGAADIRLSFHGRQSSYCSNTFDGPGRVLAHADIPELGSVHFDEDEFWTEGTYRGVNLRIIAAHEVGHALGLGHSRYSQALMAPVYEGYRPHFKLHPDDVAGIQALYGKKSPVIRDEEEEETELPTVPPVPTEPSPMPDPCSSELDAMMLGPRGKTYAFKGDYVWTVSDSGPGPLFRVSALWEGLPGNLDAAVYSPRTQWIHFFKGDKVWRYINFKMSPGFPKKLNRVEPNLDAALYWPLNQKVFLFKGSGYWQWDELARTDFSSYPKPIKGLFTGVPNQPSAAMSWQDGRVYFFKGKVYWRLNQQLRVEKGYPRNISHNWMHCRPRTIDTTPSGGNTTPSGTGITLDTTLSATETTFEY

SEQ ID NO: 1473 - protein, 222 aa, Homo sapiens
MGVTWDFSMSNGGPRGKTYAFKGDYVWTVSDSGPGPLFRVSALWEGLPGNLDAAVYSPRTQWIHFFKGDKVWRYINFKMSPGFPKKLNRVEPNLDAALYWPLNQKVFLFKGSGYWQWDELARTDFSSYPKPIKGLFTGVPNQPSAAMSWQDGRVYFFKGKVYWRLNQQLRVEKGYPRNISHNWMHCRPRTIDTTPSGGNTTPSGTGITLDTTLSATETTFEY

SEQ ID NO: 1474 - protein, 305 aa, Homo sapiens
MNCQQLWLGFLLPMTVSGRVLGLAEVAPVDYLSQYGYLQKPLEGSNNFKPEDITEALRAFQEASELPVSGQLDDATRARMRQPRCGLEDPFNQKTLKYLLLGRWRKKHLTFRILNLPSTLPPHTARAALRQAFQDWSNVAPLTFQEVQAGAADIRLSFHGRQSSYCSNTFDGPGKKSPVIRDEEEEETELPTVPPVPTEPSPMPDPCSSELDAMMLGEAPPLQAVGRRWGQPADPEAWTNGSDMGLQHEQWRAPWEDLCFQGGLCVDCIRFRTGPLVPSVCPLGGAPRKPGCCCLLASNTMDSLL

SEQ ID NO: 1475 - protein, 483 aa, Homo sapiens
MKVLPASGLAVFLIMALKFSTAAPSLVAASPRTWRNNYRLAQAYLDKYYTNKEGHQIGEMVARGSNSMIRKIKELQAFFGLQVTGKLDQTTMNVIKKPRCGVPDVANYRLFPGEPKWKKNTLTYRISKYTPSMSSVEVDKAVEMALQAWSSAVPLSFVRINSGEADIMISFENGDHGDSYPFDGPRGTLAHAFAPGEGLGGDTHFDNAEKWTMGTNGFNLFTVAAHEFGHALGLAHSTDPSALMYPTYKYKNPYGFHLPKDDVKGIQALYGPRKVFLGKPTLPHAPHHKPSIPDLCDSSSSFDAVTMLGKELLLFKDRIFWRRQVHLRTGIRPSTITSSFPQLMSNVDAAYEVAERGTAYFFKGPHYWITRGFQMQGPPRTIYDFGFPRHVQQIDAAVYLREPQKTLFFVGDEYYSYDERKRKMEKDYPKNTEEEFSGVNGQIDAAVELNGYIYFFSGPKTYKYDTEKEDVVSVVKSSSWIGC

SEQ ID NO: 1476 - protein, 569 aa, Homo sapiens
MLAASIFRPTLLLCWLAAPWPTQPESLFHSRDRSDLEPSPLRQAKPIADLHAAQRFLSRYGWSGVWAAWGPSPEGPPETPKGAALAEAVRRFQRANALPASGELDAATLAAMNRPRCGVPDMRPPPPSAPPSPPGPPPRARSRRSPRAPLSLSRRGWQPRGYPDGGAAQAFSKRTLSWRLLGEALSSQLSVADQRRIVALAFRMWSEVTPLDFREDLAAPGAAVDIKLGFGRGRHLGCPRAFDGSGQEFAHAWRLGDIHFDDDEHFTPPTSDTGISLLKVAVHEIGHVLGLPHTYRTGSIMQPNYIPQEPAFELDWSDRKAIQKLYGSCEGSFDTAFDWIRKERNQYGEVMVRFSTYFFRNSWYWLYENRNNRTRYGDPIQILTGWPGIPTHNIDAFVHIWTWKRDERYFFQGNQYWRYDSDKDQALTEDEQGKSYPKLISEGFPGIPSPLDTAFYDRRQKLIYFFKESLVFAFDVNRNRVLNSYPKRITEVFPAVIPQNHPFRNIDSAYYSYAYNSIFFFKGNAYWKVVNDKDKQQNSWLPANGLFPKKFISEKWFDVCDVHISTLNM

SEQ ID NO: 1477 - protein, 390 aa, Homo sapiens
MGRGARVPSEAPGAGVERRWLGAALVALCLLPALVLLARLGAPAVPAWSAAQGDVAALGLSAVPPTRVPGPLAPRRRRYTLTPARLRWDHFNLTYRILSFPRNLLSPRETRRALAAAFRMWSDVSPFSFREVAPEQPSDLRIGFYPINHTDCLVSALHHCFDGPTGELAHAFFPPHGGIHFDDSEYWVLGPTRYSWKKGVWLTDLVHVAAHEIGHALGLMHSQHGRALMHLNATLRGWKALSQDELWGLHRLYGCLDRLFVCASWARRGFCDARRRLMKRLCPSSCDFCYEFPFPTVATTPPPPRTKTRLVPEGRNVTFRCGQKILHKKGKVYWYKDQEPLEFSYPGYLALGEAHLSIIANAVNEGTYTCVVRRQQRVLTTYSWRVRVRG

SEQ ID NO: 1478 - protein, 386 aa, Homo sapiens
MGRGARVPSEAPGAGVERRWLGAALVALCLLPALVLLARLGAPAVPAWSAAQGDVAALGLSAVPPTRVPGPLAPRRRRYTLTPARLRWDHFNLTYRILSFPRNLLSPRETRRALAAAFRMWSDVSPFSFREVAPEQPSDLRIGGRPPPPRPGPARPASQPRAPPRLLPDQPHGLPGLRAAPLLRRPHGGAGPRLLPPARRHPLRRQRVLGPGPHALQLEERRVAHGPGARGGPRDRPRAGPDALTTRPGAHAPERHAARLEGVVPGRAVGAAPALRMPRQAVRVRVLGAEGLLRRSPAAHEEALPQQLRLLLRIPLPHGGHHPTAPQDQNQAGARGQERDLPLRPEDPPQERESVLVQGPGAPGVLLPRLPGPGRGAPEHHRQRRQ

SEQ ID NO: 1479 - protein, 430 aa, Homo sapiens
MGRGARVPSEAPGAGVERRWLGAALVALCLLPALVLLARLGAPAVPAWSAAQGDVAALGLSAVPPTRVPGPLAPRRRRYTLTPARLRWDHFNLTYRILSFPRNLLSPRETRRALAAAFRMWSDVSPFSFREVAPEQPSDLRIGFYPINHTDCLVSALHHCFDGPTGELAHAFFPPHGGIHFDDSEYWVLGPTRYSWKKGDRPGSWRPLLCSTVGCRGRALGQTAGGTFRGGGCHWSLAGVWLTDLVHVAAHEIGHALGLMHSQHGRALMHLNATLRGWKALSQDELWGLHRLYGCLDRLFVCASWARRGFCDARRRLMKRLCPSSCDFCYEFPFPTVATTPPPPRTKTRLVPEGRNVTFRCGQKILHKKGKVYWYKDQEPLEFSYPGYLALGEAHLSIIANAVNEGTYTCVVRRQQRVLTTYSWRVRVRG

SEQ ID NO: 1480 - protein, 238 aa, Homo sapiens
MGRGARVPSEAPGAGVERRWLGAALVALCLLPALVLLARLGAPAVPAWSAAQGDVAALGLSAVPPTRVPGPLAPRRRRYTLTPARLRWDHFNLTYRILSFPRNLLSPRETRRALAAAFRMWSDVSPFSFREVAPEQPSDLRIGFYPINHTDCLVSALHHCFDGPTGELAHAFFPPHGGIHFDDSEYWVLGPTRYSWKKGDRPGWPPGGLSSAAQWAAAVGLWGRRQEGPSGVVAATGV

SEQ ID NO: 1481 - protein, 645 aa, Homo sapiens
MPRSRGGRAAPGPPPPPPPPGQAPRWSRWRVPGRLLLLLLPALCCLPGAARAAAAAAGAGNRAAVAVAVARADEAEAPFAGQNWLKSYGYLLPYDSRASALHSAKALQSAVSTMQQFYGIPVTGVLDQTTIEWMKKPRCGVPDHPHLSRRRRNKRYALTGQKWRQKHITYSIHNYTPKVGELDTRKAIRQAFDVWQKVTPLTFEEVPYHEIKSDRKEADIMIFFASGFHGDSSPFDGEGGFLAHAYFPGPGIGGDTHFDSDEPWTLGNANHDGNDLFLVAVHELGHALGLEHSSDPSAIMAPFYQYMETHNFKLPQDDLQGIQKIYGPPAEPLEPTRPLPTLPVRRIHSPSERKHERQPRPPRPPLGDRPSTPGTKPNICDGNFNTVALFRGEMFVFKDRWFWRLRNNRVQEGYPMQIEQFWKGLPARIDAAYERADGRFVFFKGDKYWVFKEVTVEPGYPHSLGELGSCLPREGIDTALRWEPVGKTYFFKGERYWRYSEERRATDPGYPKPITVWKGIPQAPQGAFISKEGYYTYFYKGRDYWKFDNQKLSVEPGYPRNILRDWMGCNQKEVERRKERRLPQDDVDIMVTINDVPGSVNAVAVVIPCILSLCILVLVYTIFQFKNKTGPQPVTYYKRPVQEWV

SEQ ID NO: 1482 - protein, 593 aa, Homo sapiens
MPRSRGGRAAPGPPLAVARADEAEAPFAGQNWLKSYGYLLPYDSRASALHSAKALQSAVSTMQQFYGIPVTGVLDQTTIEWMKKPRCGVPDHPHLSRRRRNKRYALTGQKWRQKHITYSIHNYTPKVGELDTRKAIRQAFDVWQKVTPLTFEEVPYHEIKSDRKEADIMIFFASGFHGDSSPFDGEGGFLAHAYFPGPGIGGDTHFDSDEPWTLGNANHDGNDLFLVAVHELGHALGLEHSSDPSAIMAPFYQYMETHNFKLPQDDLQGIQKIYGPPAEPLEPTRPLPTLPVRRIHSPSERKHERQPRPPRPPLGDRPSTPGTKPNICDGNFNTVALFRGEMFVFKDRWFWRLRNNRVQEGYPMQIEQFWKGLPARIDAAYERADGRFVFFKGDKYWVFKEVTVEPGYPHSLGELGSCLPREGIDTALRWEPVGKTYFFKGERYWRYSEERRATDPGYPKPITVWKGIPQAPQGAFISKEGYYTYFYKGRDYWKFDNQKLSVEPGYPRNILRDWMGCNQKEVERRKERRLPQDDVDIMVTINDVPGSVNAVAVVIPCILSLCILVLVYTIFQFKNKTGPQPVTYYKRPVQEWV

SEQ ID NO: 1483 - protein, 186 aa, Homo sapiens
MSPADPGTVATMRKPRCSLPDVLGVAGLVRRRRRYALSGSVWKKRTLTWRVRSFPQSSQLSQETVRVLMSYALMAWGMESGLTFHEVDSPQGQEPDILIDFARAFHQDSYPFDGLGGTLAHAFFPGEHPISGDTHFDDEETWTFGSKASQQLEQELAGGSPVDEELGFSRGWRVNPLGPGSPERLS

SEQ ID NO: 1484 - protein, 562 aa, Homo sapiens
MRLRLRLLALLLLLLAPPARAPKPSAQDVSLGVDWLTRYGYLPPPHPAQAQLQSPEKLRDAIKVMQRFAGLPETGRMDPGTVATMRKPRCSLPDVLGVAGLVRRRRRYALSGSVWKKRTLTWRVRSFPQSSQLSQETVRVLMSYALMAWGMESGLTFHEVDSPQGQEPDILIDFARAFHQDSYPFDGLGGTLAHAFFPGEHPISGDTHFDDEETWTFGSKDGEGTDLFAVAVHEFGHALGLGHSSAPNSIMRPFYQGPVGDPDKYRLSQDDRDGLQQLYGKAPQTPYDKPTRKPLAPPPQPPASPTHSPSFPIPDRCEGNFDAIANIRGETFFFKGPWFWRLQPSGQLVSPRPARLHRFWEGLPAQVRVVQAAYARHRDGRILLFSGPQFWVFQDRQLEGGARPLTELGLPPGEEVDAVFSWPQNGKTYLVRGRQYWRYDEAAARPDPGYPRDLSLWEGAPPSPDDVTVSNAGDTYFFKGAHYWRFPKNSIKTEPDAPQPMGPNWLDCPAPSSGPRAPRPPKATPVSETCDCQCELNQAAGRWPAPIPLLLLPLLVGGVASR

SEQ ID NO: 1485 - protein, 261 aa, Homo sapiens
MQLVILRVTIFLPWCFAVPVPPAADHKGWDFVEGYFHQFFLTKKESPLLTQETQTQLLQQFHRNGTDLLDMQMHALLHQPHCGVPDGSDTSISPGRCKWNKHTLTYRIINYPHDMKPSAVKDSIYNAVSIWSNVTPLIFQQVQNGDADIKVSFWQWAHEDGWPFDGPGGILGHAFLPNSGNPGVVHFDKNEHWSASDTGYNLFLVATHEIGHSLGLQHSGNQSSIMYPTYWYHDPRTFQLSADDIQRIQHLYGEKCSSDIP

SEQ ID NO: 1486 - protein, 261 aa, Homo sapiens; identical to SEQ ID NO: 1485

SEQ ID NO: 1487 - protein, 513 aa, Homo sapiens
MKRLLLLFLFFITFSSAFPLVRMTENEENMQLAQAYLNQFYSLEIEGNHLVQSKNRSLIDDKIREMQAFFGLTVTGKLDSNTLEIMKTPRCGVPDVGQYGYTLPGWRKYNLTYRIINYTPDMARAAVDEAIQEGLEVWSKVTPLKFTKISKGIADIMIAFRTRVHGRCPRYFDGPLGVLGHAFPPGPGLGGDTHFDEDENWTKDGAGFNLFLVAAHEFGHALGLSHSNDQTALMFPNYVSLDPRKYPLSQDDINGIQSIYGGLPKEPAKPKEPTIPHACDPDLTFDAITTFRREVMFFKGRHLWRIYYDITDVEFELIASFWPSLPADLQAAYENPRDKILVFKDENFWMIRGYAVLPDYPKSIHTLGFPGRVKKIDAAVCDKTTRKTYFFVGIWCWRFDEMTQTMDKGFPQRVVKHFPGISIRVDAAFQYKGFFFFSRGSKQFEYDIKTKNITRIMRTNTWFQCKEPKNSSFGFDINKEKAHSGGIKILYHKSLSLFIFGIVHLLKNTSIYQ

SEQ ID NO: 1488 - protein, 130 aa, Homo sapiens
MVARVGLLLRALQLLLWGHLDAQPAERGGQELRKEAEAFLEKYGYLNEQVPKAPTSTRFSDAIRAFQWVSQLPVSGVLDRATLRQMTRPRCGVTDTNSYAAWAERISDLFARHRTKMRRKKRFAKQGEHC

SEQ ID NO: 1489 - protein, 519 aa, Homo sapiens
MVARVGLLLRALQLLLWGHLDAQPAERGGQELRKEAEAFLEKYGYLNEQVPKAPTSTRFSDAIRAFQWVSQLPVSGVLDRATLRQMTRPRCGVTDTNSYAAWAERISDLFARHRTKMRRKKRFAKQGNKWYKQHLSYRLVNWPEHPEPAVRGAVRAAFQLWSNVSALEFWEAPATGPADIRLTFFQGDHNDGLGNAFDGPGGALAHAFLPRRGEAHFDQDERWSLSRRRGRNLFVVLAHEIGHTLGLTHSPAPRALMAPYYKRLGRDALLSWDDVLAVQSLYGKPLGGSVAVQLPGKLFTDFETWDSYSPQGRRPETQGPKYCHSSFDAITVDRQQQLYIFKGSHFWEVAADGNVSEPRPLQERWVGLPPNIEAAAVSLNDGDFYFFKGGRCWRFRGPKPVWGLPQLCRAGGLPRHPDAALFFPPLRRLILFKGARYYVLARGGLQVEPYYPRSLQDWGGIPEEVSGALPRPDGSIIFFRDDRYWRLDQAKLQATTSGRWATELPWMGCWHANSGSALF

SEQ ID NO: 1490 - protein, 392 aa, Homo sapiens
MVARVGLLLRALQLLLWGHLDAQPAERGGQELRKEAEAFLEKYGYLNEQVPKAPTSTRFSDAIRAFQWVSQLPVSGVLDRATLRQMTRPRCGVTDTNSYAAWAERISDLFARHRTKMRRKKRFAKQGNKWYKQHLSYRLVNWPEHPEPAVRGAVRAAFQLWSNVSALEFWEAPATGPADIRLTFFQGDHNDGLGNAFDGPGGALAHAFLPRRGEAHFDQDERWSLSRRRGRNLFVVLAHEIGHTLGLTHSPAPRALMAPYYKRLGRDALLSWDDVLAVQSLYGKPLGGSVAVQLPGKLFTDFETWDSYSPQGRRPETQGPKYCHSSFDAITVDRQQQLYIFKGSHFWEVAADGNVSEPRPLQERWVGLPPNIEAAAVSLNDGDFYFFKVQSV

SEQ ID NO: 1491 - protein, 225 aa, Homo sapiens
MVARVGLLLRALQLLLWGHLDAQPAERGGQELRKEAEAFLEKYGYLNEQVPKAPTSTRFSDAIRAFQWVSQLPVSGVLDRATLRQMTRPRCGVTDTNSYAAWAERISDLFARHRTKMRRKKRFAKQGNKWYKQHLSYRLVNWPEHLRSRQFGAPCAPPSSCGATSQRWSSGRPQPQAPLTSGSPSSKGTTTMGWAMPLMAQGAPWRTPSCPAAAKRTSTKMSAGP

SEQ ID NO: 1492 - protein, 467 aa, Homo sapiens [sequence omitted]

SEQ ID NO: 1493 - protein, 305 aa, Homo sapiens
MQRFFGLNVTGKPNEETLDMMKKPRCGVPDSGGFMLTPGNPKWERTNLTYRIRNYTPQLSEAEVERAIKDAFELWSVASPLIFTRISQGEADINIAFYQRDHGDNSPFDGPNGILAHAFQPGQGIGGDAHFDAEETWTNTSANYNLFLVAAHEFGHSLGLAHSSDPGALMYPNYAFRETSNYSLPQDDIDGIQAIYGLSSNPIQPTGPSTPKPCDPSLTFDAITTLRGEILFFKDRYFWRRHPQLQRVEMNFISLFWPSLPTGIQAAYEDFDRDLIFLFKDMITKDNSWSQVIPKAYQVPFRNRE

SEQ ID NO: 1494 - protein, 427 aa, Homo sapiens
MQQIPQEKSINDYLEKFYQLPSNQYQSTRKNGTNVIVEKLKEMQRFFGLNVTGKPNEETLDMMKKPRCGVPDSGGFMLTPGNPKWERTNLTYRIRNYTPQLSEAEVERAIKDAFELWSVASPLIFTRISQGEADINIAFYQRDHGDNSPFDGPNGILAHAFQPGQGIGGDAHFDAEETWTNTSANYNLFLVAAHEFGHSLGLAHSSDPGALMYPNYAFRETSNYSLPQDDIDGIQAIYGLSSNPIQPTGPSTPKPCDPSLTFDAITTLRGEILFFKDRYFWRRHPQLQRVEMNFISLFWPSLPTGIQAAYEDFDRDLIFLFKGNQYWALSGYDILQGYPKDISNYGFPSSVQAIDAAVFYRSKTYFFVNDQFWRYDNQRQFMEPGYPKSISGAFPGIESKVDAVFQQEHFFHVFSGPRYYAFDLIAQ

SEQ ID NO: 1495 - protein, 317 aa, Homo sapiens
MAVQGSQRRLLGSLNSTPTAIPQLGLAANQTGARCLEVSISDGLFLSLGLVSLVENALVVATIAKNRNLHSPMYCFICCLALSDLLVSGSNVLETAVILLLEAGALVARAAVLQQLDNVIDVITCSSMLSSLCFLGAIAVDRYISIFYALRYHSIVTLPRARRAVAAIWVASVVFSTLFIAYYDHVAVLLCLVVFFLAMLVLMAVLYVHMLARACQHAQGIARLHKRQRPVHQGFGLKGAVTLTILLGIFFLCWGPFFLHLTLIVLCPEHPTCGCIFKNFNLFLALIICNAIIDPLIYAFHSQELRRTLKEVLTCSW

SEQ ID NO: 1496 - protein, 297 aa, Homo sapiens
MKHIINSYENINNTARNNSDCPRVVLPEEIFFTISIVGVLENLIVLLAVFKNKNLQAPMYFFICSLAISDMLGSLYKILENILIILRNMGYLKPRGSFETTADDIIDSLFVLSLLGSIFSLSVIAADRYITIFHALRYHSIVTMRRTVVVLTVIWTFCTGTGITMVIFSHHVPTVITFTSLFPLMLVFILCLYVHMFLLARSHTRKISTLPRANMKGAITLTILLGVFIFCWAPFVLHVLLMTFCPSNPYCACYMSLFQVNGMLIMCNAVIDPFIYAFRSPELRDAFKKMIFCSRYW

SEQ ID NO: 1497 - protein, 297 aa, Homo sapiens; identical to SEQ ID NO: 1496

SEQ ID NO: 1498 - protein, 323 aa, Homo sapiens
MNASCCLPSVQPTLPNGSEHLQAPFFSNQSSSAFCEQVFIKPEVFLSLGIVSLLENILVILAVVRNGNLHSPMYFFLCSLAVADMLVSVSNALETIMIAIVHSDYLTFEDQFIQHMDNIFDSMICISLVASICNLLAIAVDRYVTIFYALRYHSIMTVRKALTLIVAIWVCCGVCGVVFIVYSESKMVIVCLITMFFAMMLLMGTLYVHMFLFARLHVKRIAALPPADGVAPQQHSCMKGAVTITILLGVFIFCWAPFFLHLVLIITCPTNPYCICYTAHFNTYLVLIMCNSVIDPLIYAFRSLELRNTFREILCGCNGMNLG

SEQ ID NO: 1499 - protein, 332 aa, Homo sapiens [sequence omitted]

SEQ ID NO: 1500 - protein, 325 aa, Homo sapiens
MNSSFHLHFLDLNLNATEGNLSGPNVKNKSSPCEDMGIAVEVFLTLGVISLLENILVIGAIVKNKNLHSPMYFFVCSLAVADMLVSMSSAWETITIYLLNNKHLVIADAFVRHIDNVFDSMICISVVASMCSLLAIAVDRYVTIFYALRYHHIMTARRSGAIIAGIWAFCTGCGIVFILYSESTYVILCLISMFFAMLFLLVSLYIHMFLLARTHVKRIAALPGASSARQRTSMQGAVTVTMLLGVFTVCWAPFFLHLTLMLSCPQNLYCSRFMSHFNMYLILIMCNSVMDPLIYAFRSQEMRKTFKEIICCRGFRIACSFPRRD

SEQ ID NO: 1501 - protein, 413 aa, Homo sapiens
MLEMLEYNHYQVQTHLENPTKYHIQQAQRQQVKQYLSTTLANKHANQVLSLPCPNQPGDHVMPPVPGSSAPNSPMAMLTLNSNCEKEGFYKFEEQNRAESECPGMNTHSRASCMQMDDVIDDIISLESSYNEEILGLMDPALQMANTLPVSGNLIDLYGNQGLPPPGLTISNSCPANLPNIKRELTESEARALAKERQKKDNHNLIERRRRFNINDRIKELGTLIPKSNDPDMRWNKGTILKASVDYIRKLQREQQRAKELENRQKKLEHANRHLLLRIQELEMQARAHGLSLIPSTGLCSPDLVNRIIKQEPVLENCSQDLLQHHADLTCTTTLDLTDGTITFNNNLGTGTEANQAYSVPTKMGSKLEDILMDDTLSPVGVTDPLLSSVSPGASKTSSRRSSMSMEETEHTC

SEQ ID NO: 1502 - protein, 504 aa, Homo sapiens
MEALRVQMFMPCSFESLYLSSAEHPGASKPPISSSSMTSRILLRQQLMREQMQEQERREQQQKLQAAQFMQQRVPVSQTPAINVSVPTTLPSATQVPMEVLKVQTHLENPTKYHIQQAQRQQVKQYLSTTLANKHANQVLSLPCPNQPGDHVMPPVPGSSAPNSPMAMLTLNSNCEKEGFYKFEEQNRAESECPGMNTHSRASCMQMDDVIDDIISLESSYNEEILGLMDPALQMANTLPVSGNLIDLYGNQGLPPPGLTISNSCPANLPNIKRELTESEARALAKERQKKDNHNLIERRRRFNINDRIKELGTLIPKSNDPDMRWNKGTILKASVDYIRKLQREQQRAKELENRQKKLEHANRHLLLRIQELEMQARAHGLSLIPSTGLCSPDLVNRIIKQEPVLENCSQDLLQHHADLTCTTTLDLTDGTITFNNNLGTGTEANQAYSVPTKMGSKLEDILMDDTLSPVGVTDPLLSSVSPGASKTSSRRSSMSMEETEHTC

SEQ ID NO: 1503 - protein, 519 aa, Homo sapiens
MGHLENTSVVFPRAIFSLCEKETRKLTLCLFSRSSSAEHPGASKPPISSSSMTSRILLRQQLMREQMQEQERREQQQKLQAAQFMQQRVPVSQTPAINVSVPTTLPSATQVPMEVLKVQTHLENPTKYHIQQAQRQQVKQYLSTTLANKHANQVLSLPCPNQPGDHVMPPVPGSSAPNSPMAMLTLNSNCEKEGFYKFEEQNRAESECPGMNTHSRASCMQMDDVIDDIISLESSYNEEILGLMDPALQMANTLPVSGNLIDLYGNQGLPPPGLTISNSCPANLPNIKRELTESEARALAKERQKKDNHNLIERRRRFNINDRIKELGTLIPKSNDPDMRWNKGTILKASVDYIRKLQREQQRAKELENRQKKLEHANRHLLLRIQELEMQARAHGLSLIPSTGLCSPDLVNRIIKQEPVLENCSQDLLQHHADLTCTTTLDLTDGTITFNNNLGTGTEANQAYSVPTKMGSKLEDILMDDTLSPVGVTDPLLSSVSPGASKTSSRRSSMSMEETEHTC

SEQ ID NO: 1504 - protein, 520 aa, Homo sapiens
MQSESGIVPDFEVGEEFHEEPKTYYELKSQPLKSSSSAEHPGASKPPISSSSMTSRILLRQQLMREQMQEQERREQQQKLQAAQFMQQRVPVSQTPAINVSVPTTLPSATQVPMEVLKVQTHLENPTKYHIQQAQRQQVKQYLSTTLANKHANQVLSLPCPNQPGDHVMPPVPGSSAPNSPMAMLTLNSNCEKEGFYKFEEQNRAESECPGMNTHSRASCMQMDDVIDDIISLESSYNEEILGLMDPALQMANTLPVSGNLIDLYGNQGLPPPGLTISNSCPANLPNIKRELTESEARALAKERQKKDNHNLIERRRRFNINDRIKELGTLIPKSNDPDMRWNKGTILKASVDYIRKLQREQQRAKELENRQKKLEHANRHLLLRIQELEMQARAHGLSLIPSTGLCSPDLVNRIIKQEPVLENCSQDLLQHHADLTCTTTLDLTDGTITFNNNLGTGTEANQAYSVPTKMGSKLEDILMDDTLSPVGVTDPLLSSVSPGASKTSSRRSSMSMEETEHTC

SEQ ID NO: 1505 - protein, 419 aa, Homo sapiens
MLEMLEYNHYQVQTHLENPTKYHIQQAQRQQVKQYLSTTLANKHANQVLSLPCPNQPGDHVMPPVPGSSAPNSPMAMLTLNSNCEKEGFYKFEEQNRAESECPGMNTHSRASCMQMDDVIDDIISLESSYNEEILGLMDPALQMANTLPVSGNLIDLYGNQGLPPPGLTISNSCPANLPNIKRELTACIFPTESEARALAKERQKKDNHNLIERRRRFNINDRIKELGTLIPKSNDPDMRWNKGTILKASVDYIRKLQREQQRAKELENRQKKLEHANRHLLLRIQELEMQARAHGLSLIPSTGLCSPDLVNRIIKQEPVLENCSQDLLQHHADLTCTTTLDLTDGTITFNNNLGTGTEANQAYSVPTKMGSKLEDILMDDTLSPVGVTDPLLSSVSPGASKTSSRRSSMSMEETEHTC

SEQ ID NO: 1506 - protein, 495 aa, Homo sapiens
MLYAFWFSHSSSAEHPGASKPPISSSSMTSRILLRQQLMREQMQEQERREQQQKLQAAQFMQQRVPVSQTPAINVSVPTTLPSATQVPMEVLKVQTHLENPTKYHIQQAQRQQVKQYLSTTLANKHANQVLSLPCPNQPGDHVMPPVPGSSAPNSPMAMLTLNSNCEKEGFYKFEEQNRAESECPGMNTHSRASCMQMDDVIDDIISLESSYNEEILGLMDPALQMANTLPVSGNLIDLYGNQGLPPPGLTISNSCPANLPNIKRELTESEARALAKERQKKDNHNLIERRRRFNINDRIKELGTLIPKSNDPDMRWNKGTILKASVDYIRKLQREQQRAKELENRQKKLEHANRHLLLRIQELEMQARAHGLSLIPSTGLCSPDLVNRIIKQEPVLENCSQDLLQHHADLTCTTTLDLTDGTITFNNNLGTGTEANQAYSVPTKMGSKLEDILMDDTLSPVGVTDPLLSSVSPGASKTSSRRSSMSMEETEHTC

SEQ ID NO: 1507 - protein, 526 aa, Homo sapiens
MQSESGIVPDFEVGEEFHEEPKTYYELKSQPLKSSSSAEHPGASKPPISSSSMTSRILLRQQLMREQMQEQERREQQQKLQAAQFMQQRVPVSQTPAINVSVPTTLPSATQVPMEVLKVQTHLENPTKYHIQQAQRQQVKQYLSTTLANKHANQVLSLPCPNQPGDHVMPPVPGSSAPNSPMAMLTLNSNCEKEGFYKFEEQNRAESECPGMNTHSRASCMQMDDVIDDIISLESSYNEEILGLMDPALQMANTLPVSGNLIDLYGNQGLPPPGLTISNSCPANLPNIKRELTACIFPTESEARALAKERQKKDNHNLIERRRRFNINDRIKELGTLIPKSNDPDMRWNKGTILKASVDYIRKLQREQQRAKELENRQKKLEHANRHLLLRIQELEMQARAHGLSLIPSTGLCSPDLVNRIIKQEPVLENCSQDLLQHHADLTCTTTLDLTDGTITFNNNLGTGTEANQAYSVPTKMGSKLEDILMDDTLSPVGVTDPLLSSVSPGASKTSSRRSSMSMEETEHTC

SEQ ID NO: 1508 - protein, 361 aa, Homo sapiens
MEALRVQMFMPCSFESLYLSSAEHPGASKPPISSSSMTSRILLRQQLMREQMQEQERREQQQKLQAAQFMQQRVPVSQTPAINVSVPTTLPSATQVPMEVLKVQTHLENPTKYHIQQAQRQQVKQYLSTTLANKHANQVLSLPCPNQPGDHVMPPVPGSSAPNSPMAMLTLNSNCEKEGFYKFEEQNRAESECPGMNTHSRASCMQMDDVIDDIISLESSYNEEILGLMDPALQMANTLPVSGNLIDLYGNQGLPPPGLTISNSCPANLPNIKRELTACIFPTESEARALAKERQKKDNHNLIERRRRFNINDRIKELGTLIPKSNDPDMRWNKGTILKASVDYIRKLQREQQRAKELENR

SEQ ID NO: 1509 - protein, 117 aa, Homo sapiens
MGHLENTSVVFPRAIFSLCEKETRKLTLCLFSRSSSAEHPGASKPPISSSSMTSRILLRQQLMREQMQEQERREQQQKLQAAQFMQQRVPVSQTPAINVSVPTTLPSATQVPMEVLK

SEQ ID NO: 1510 - protein, 357 aa, Homo sapiens
MLEMLEYNHYQVQTHLENPTKYHIQQAQRQQGFYKFEEQNRAESECPGMNTHSRASCMQMDDVIDDIISLESSYNEEILGLMDPALQMANTLPVSGNLIDLYGNQGLPPPGLTISNSCPANLPNIKRELTESEARALAKERQKKDNHNLIERRRRFNINDRIKELGTLIPKSNDPDMRWNKGTILKASVDYIRKLQREQQRAKELENRQKKLEHANRHLLLRIQELEMQARAHGLSLIPSTGLCSPDLVNRIIKQEPVLENCSQDLLQHHADLTCTTTLDLTDGTITFNNNLGTGTEANQAYSVPTKMGSKLEDILMDDTLSPVGVTDPLLSSVSPGASKTSSRRSSMSMEETEHTC

SEQ ID NO: 1511 - protein, 468 aa, Homo sapiens
MTSRILLRQQLMREQMQEQERREQQQKLQAAQFMQQRVPVSQTPAINVSVPTTLPSATQVPMEVLKVQTHLENPTKYHIQQAQRQQVKQYLSTTLANKHANQVLSLPCPNQPGDHVMPPVPGSSAPNSPMAMLTLNSNCEKEGFYKFEEQNRAESECPGMNTHSRASCMQMDDVIDDIISLESSYNEEILGLMDPALQMANTLPVSGNLIDLYGNQGLPPPGLTISNSCPANLPNIKRELTESEARALAKERQKKDNHNLIERRRRFNINDRIKELGTLIPKSNDPDMRWNKGTILKASVDYIRKLQREQQRAKELENRQKKLEHANRHLLLRIQELEMQARAHGLSLIPSTGLCSPDLVNRIIKQEPVLENCSQDLLQHHADLTCTTTLDLTDGTITFNNNLGTGTEANQAYSVPTKMGSKLEDILMDDTLSPVGVTDPLLSSVSPGASKTSSRRSSMSMEETEHTC

SEQ ID NO: 1512 - protein, 1473 aa, Homo sapiens
MAGGAWGRLACYLEFLKKEELKEFQLLLANKAHSRSSSGETPAQPEKTSGMEVASYLVAQYGEQRAWDLALHTWEQMGLRSLCAQAQEGAGHSPSFPYSPSEPHLGSPSQPTSTAVLMPWIHELPAGCTQGSERRVLRQLPDTSGRRWREISASLLYQALPSSPDHESPSQESPNAPTSTAVLGSWGSPPQPSLAPREQEAPGTQWPLDETSGIYYTEIREREREKSEKGRPPWAAVVGTPPQAHTSLQPHHHPWEPSVRESLCSTWPWKNEDFNQKFTQLLLLQRPHPRSQDPLVKRSWPDYVEENRGHLIEIRDLFGPGLDTQEPRIVILQGAAGIGKSTLARQVKEAWGRGQLYGDRFQHVFYFSCRELAQSKVVSLAELIGKDGTATPAPIRQILSRPERLLFILDGVDEPGWVLQEPSSELCLHWSQPQPADALLGSLLGKTILPEASFLITARTTALQNLIPSLEQARWVEVLGFSESSRKEYFYRYFTDERQAIRAFRLVKSNKELWALCLVPWVSWLACTCLMQQMKRKEKLTLTSKTTTTLCLHYLAQALQAQPLGPQLRDLCSLAAEGIWQKKTLFSPDDLRKHGLDGAIISTFLKMGILQEHPIPLSYSFIHLCFQEFFAAMSYVLEDEKGRGKHSNCIIDLEKTLEAYGIHGLFGASTTRFLLGLLSDEGEREMENIFHCRLSQGRNLMQWVPSLQLLLQPHSLESLHCLYETRNKTFLTQVMAHFEEMGMCVETDMELLVCTFCIKFSRHVKKLQLIEGRQHRSTWSPTMVVLFRWVPVTDAYWQILFSVLKVTRNLKELDLSGNSLSHSAVKSLCKTLRRPRCLLETLRLAGCGLTAEDCKDLAFGLRANQTLTELDLSFNVLTDAGAKHLCQRLRQPSCKLQRLQLVSCGLTSDCCQDLASVLSASPSLKELDLQQNNLDDVGVRLLCEGLRHPACKLIRLGLDQTTLSDEMRQELRALEQEKPQLLIFSRRKPSVMTPTEGLDTGEMSNSTSSLKRQRLGSERAASHVAQANLKLLDVSKIFPIAEIAEESSPEVVPVELLCVPSPASQGDLHTKPLGTDDDFWGPTGPVATEVVDKEKNLYRVHFPVAGSYRWPNTGLCFVMREAVTVEIEFCVWDQFLGEINPQHSWMVAGPLLDIKAEPGAVEAVHLPHFVALQGGHVDTSLFQMAHFKEEGMLLEKPARVELHHIVLENPSFSPLGVLLKMIHNALRFIPVTSVVLLYHRVHPEEVTFHLYLIPSDCSIRKAIDDLEMKFQFVRIHKPPPLTPLYMGCRYTVSGSGSGMLEILPKELELCYRSPGEDQLFSEFYVGHLGSGIRLQVKDKKDETLVWEALVKPGDLMPATTLIPPARIAVPSPLDAPQLLHFVDQYREQLIARVTSVEVVLDKLHGQVLSQEQYERVLAENTRPSQMRKLFSLSQSWDRKCKDGLYQALKETHPHLIMELWEKGSKKGLLPLSS

SEQ ID NO: 1513 - protein, 1399 aa, Homo sapiens
MAGGAWGRLACYLEFLKKEELKEFQLLLANKAHSRSSSGETPAQPEKTSGMEVASYLVAQYGEQRAWDLALHTWEQMGLRSLCAQAQEGAGHSPSFPYSPSEPHLGSPSQPTSTAVLMPWIHELPAGCTQGSERRVLRQLPDTSGRRWREISASLLYQALPSSPDHESPSQESPNAPTSTAVLGSWGSPPQPSLAPREQEAPGTQWPLDETSGIYYTEIREREREKSEKGRPPWAAVVGTPPQAHTSLQPHHHPWEPSVRESLCSTWPWKNEDFNQKFTQLLLLQRPHPRSQDPLVKRSWPDYVEENRGHLIEIRDLFGPGLDTQEPRIVILQGAAGIGKSTLARQVKEAWGRGQLYGDRFQHVFYFSCRELAQSKVVSLAELIGKDGTATPAPIRQILSRPERLLFILDGVDEPGWVLQEPSSELCLHWSQPQPADALLGSLLGKTILPEASFLITARTTALQNLIPSLEQARWVEVLGFSESSRKEYFYRYFTDERQAIRAFRLVKSNKELWALCLVPWVSWLACTCLMQQMKRKEKLTLTSKTTTTLCLHYLAQALQAQPLGPQLRDLCSLAAEGIWQKKTLFSPDDLRKHGLDGAIISTFLKMGILQEHPIPLSYSFIHLCFQEFFAAMSYVLEDEKGRGKHSNCIIDLEKTLEAYGIHGLFGASTTRFLLGLLSDEGEREMENIFHCRLSQGRNLMQWVPSLQLLLQPHSLESLHCLYETRNKTFLTQVMAHFEEMGMCVETDMELLVCTFCIKFSRHVKKLQLIEGRQHRSTWSPTMVVLFRWVPVTDAYWQILFSVLKVTRNLKELDLSGNSLSHSAVKSLCKTLRRPRCLLETLRLAGCGLTAEDCKDLAFGLRANQTLTELDLSFNVLTDAGAKHLCQRLRQPSCKLQRLQLVSCGLTSDCCQDLASVLSASPSLKELDLQQNNLDDVGVRLLCEGLRHPACKLIRLGKPSVMTPTEGLDTGEMSNSTSSLKRQRLGSERAASHVAQANLKLLDVSKIFPIAEIAEESSPEVVPVELLCVPSPASQGDLHTKPLGTDDDFWGPTGPVATEVVDKEKNLYRVHFPVAGSYRWPNTGLCFVMREAVTVEIEFCVWDQFLGEINPQHSWMVAGPLLDIKAEPGAVEAVHLPHFVALQGGHVDTSLFQMAHFKEEGMLLEKPARVELHHIVLENPSFSPLGVLLKMIHNALRFIPVTSVVLLYHRVHPEEVTFHLYLIPSDCSIRKELELCYRSPGEDQLFSEFYVGHLGSGIRLQVKDKKDETLVWEALVKPGDLMPATTLIPPARIAVPSPLDAPQLLHFVDQYREQLIARVTSVEVVLDKLHGQVLSQEQYERVLAENTRPSQMRKLFSLSQSWDRKCKDGLYQALKETHPHLIMELWEKGSKKGLLPLSS

SEQ ID NO: 1514 - protein, 1375 aa, Homo sapiens
MAGGAWGRLACYLEFLKKEELKEFQLLLANKAHSRSSSGETPAQPEKTSGMEVASYLVAQYGEQRAWDLALHTWEQMGLRSLCAQAQEGAGHSPSFPYSPSEPHLGSPSQPTSTAVLMPWIHELPAGCTQGSERRVLRQLPDTSGRRWREISASLLYQALPSSPDHESPSQESPNAPTSTAVLGSWGSPPQPSLAPREQEAPGTQWPLDETSGIYYTEIREREREKSEKGRPPWAAVVGTPPQAHTSLQPHHHPWEPSVRESLCSTWPWKNEDFNQKFTQLLLLQRPHPRSQDPLVKRSWPDYVEENRGHLIEIRDLFGPGLDTQEPRIVILQGAAGIGKSTLARQVKEAWGRGQLYGDRFQHVFYFSCRELAQSKVVSLAELIGKDGTATPAPIRQILSRPERLLFILDGVDEPGWVLQEPSSELCLHWSQPQPADALLGSLLGKTILPEASFLITARTTALQNLIPSLEQARWVEVLGFSESSRKEYFYRYFTDERQAIRAFRLVKSNKELWALCLVPWVSWLACTCLMQQMKRKEKLTLTSKTTTTLCLHYLAQALQAQPLGPQLRDLCSLAAEGIWQKKTLFSPDDLRKHGLDGAIISTFLKMGILQEHPIPLSYSFIHLCFQEFFAAMSYVLEDEKGRGKHSNCIIDLEKTLEAYGIHGLFGASTTRFLLGLLSDEGEREMENIFHCRLSQGRNLMQWVPSLQLLLQPHSLESLHCLYETRNKTFLTQVMAHFEEMGMCVETDMELLVCTFCIKFSRHVKKLQLIEGRQHRSTWSPTMVVLFRWVPVTDAYWQILFSVLKVTRNLKELDLSGNSLSHSAVKSLCKTLRRPRCLLETLRLAGCGLTAEDCKDLAFGLRANQTLTELDLSFNVLTDAGAKHLCQRLRQPSCKLQRLQLVSCGLTSDCCQDLASVLSASPSLKELDLQQNNLDDVGVRLLCEGLRHPACKLIRLGLDQTTLSDEMRQELRALEQEKPQLLIFSRRKPSVMTPTEGLDTGEMSNSTSSLKRQRLGSERAASHVAQANLKLLDVSKIFPIAEIAGKSHEESSPEVVPVELLCVPSPASQGDLHTKPLGTDDDFWGPTGPVATEVVDKEKNLYRVHFPVAGSYRWPNTGLCFVMREAVTVEIEFCVWDQFLGEINPQHSWMVAGPLLDIKAEPGAVEAVHLPHFVALQGGHVDTSLFQMAHFKEEGMLLEKPARVELHHIVLENPSFSPLGVLLKMIHNALRFIPVTSVVLLYHRVHPEEVTFHLYLIPSDCSIRKAIDDLEMKFQFVRIHKPPPLTPLYMGCRYTVSGSGSGMLEILPKELELCYRSPGEDQLFSEFYVGHLGSGIRLQVKDKKDETLVWEALVKPGRNTSQPWNLRCNRDARRY

SEQ ID NO: 1515 - protein, 1473 aa, Homo sapiens; identical to SEQ ID NO: 1512

SEQ ID NO: 1516 - protein, 1429 aa, Homo sapiens
MAGGAWGRLACYLEFLKKEELKEFQLLLANKAHSRSSSGETPAQPEKTSGMEVASYLVAQYGEQRAWDLALHTWEQMGLRSLCAQAQEGAGHSPSFPYSPSEPHLGSPSQPTSTAVLMPWIHELPAGCTQGSERRVLRQLPDTSGRRWREISASLLYQALPSSPDHESPSQESPNAPTSTAVLGSWGSPPQPSLAPREQEAPGTQWPLDETSGIYYTEIREREREKSEKGRPPWAAVVGTPPQAHTSLQPHHHPWEPSVRESLCSTWPWKNEDFNQKFTQLLLLQRPHPRSQDPLVKRSWPDYVEENRGHLIEIRDLFGPGLDTQEPRIVILQGAAGIGKSTLARQVKEAWGRGQLYGDRFQHVFYFSCRELAQSKVVSLAELIGKDGTATPAPIRQILSRPERLLFILDGVDEPGWVLQEPSSELCLHWSQPQPADALLGSLLGKTILPEASFLITARTTALQNLIPSLEQARWVEVLGFSESSRKEYFYRYFTDERQAIRAFRLVKSNKELWALCLVPWVSWLACTCLMQQMKRKEKLTLTSKTTTTLCLHYLAQALQAQPLGPQLRDLCSLAAEGIWQKKTLFSPDDLRKHGLDGAIISTFLKMGILQEHPIPLSYSFIHLCFQEFFAAMSYVLEDEKGRGKHSNCIIDLEKTLEAYGIHGLFGASTTRFLLGLLSDEGEREMENIFHCRLSQGRNLMQWVPSLQLLLQPHSLESLHCLYETRNKTFLTQVMAHFEEMGMCVETDMELLVCTFCIKFSRHVKKLQLIEGRQHRSTWSPTMVVLFRWVPVTDAYWQILFSVLKVTRNLKELDLSGNSLSHSAVKSLCKTLRRPRCLLETLRLAGCGLTAEDCKDLAFGLRANQTLTELDLSFNVLTDAGAKHLCQRLRQPSCKLQRLQLVSCGLTSDCCQDLASVLSASPSLKELDLQQNNLDDVGVRLLCEGLRHPACKLIRLGLDQTTLSDEMRQELRALEQEKPQLLIFSRRKPSVMTPTEGLDTGEMSNSTSSLKRQRLGSERAASHVAQANLKLLDVSKIFPIAEIAEESSPEVVPVELLCVPSPASQGDLHTKPLGTDDDFWGPTGPVATEVVDKEKNLYRVHFPVAGSYRWPNTGLCFVMREAVTVEIEFCVWDQFLGEINPQHSWMVAGPLLDIKAEPGAVEAVHLPHFVALQGGHVDTSLFQMAHFKEEGMLLEKPARVELHHIVLENPSFSPLGVLLKMIHNALRFIPVTSVVLLYHRVHPEEVTFHLYLIPSDCSIRKELELCYRSPGEDQLFSEFYVGHLGSGIRLQVKDKKDETLVWEALVKPGDLMPATTLIPPARIAVPSPLDAPQLLHFVDQYREQLIARVTSVEVVLDKLHGQVLSQEQYERVLAENTRPSQMRKLFSLSQSWDRKCKDGLYQALKETHPHLIMELWEKGSKKGLLPLSS

SEQ ID NO: 1517 - protein, 1443 aa, Homo sapiens
MAGGAWGRLACYLEFLKKEELKEFQLLLANKAHSRSSSGETPAQPEKTSGMEVASYLVAQYGEQRAWDLALHTWEQMGLRSLCAQAQEGAGHSPSFPYSPSEPHLGSPSQPTSTAVLMPWIHELPAGCTQGSERRVLRQLPDTSGRRWREISASLLYQALPSSPDHESPSQESPNAPTSTAVLGSWGSPPQPSLAPREQEAPGTQWPLDETSGIYYTEIREREREKSEKGRPPWAAVVGTPPQAHTSLQPHHHPWEPSVRESLCSTWPWKNEDFNQKFTQLLLLQRPHPRSQDPLVKRSWPDYVEENRGHLIEIRDLFGPGLDTQEPRIVILQGAAGIGKSTLARQVKEAWGRGQLYGDRFQHVFYFSCRELAQSKVVSLAELIGKDGTATPAPIRQILSRPERLLFILDGVDEPGWVLQEPSSELCLHWSQPQPADALLGSLLGKTILPEASFLITARTTALQNLIPSLEQARWVEVLGFSESSRKEYFYRYFTDERQAIRAFRLVKSNKELWALCLVPWVSWLACTCLMQQMKRKEKLTLTSKTTTTLCLHYLAQALQAQPLGPQLRDLCSLAAEGIWQKKTLFSPDDLRKHGLDGAIISTFLKMGILQEHPIPLSYSFIHLCFQEFFAAMSYVLEDEKGRGKHSNCIIDLEKTLEAYGIHGLFGASTTRFLLGLLSDEGEREMENIFHCRLSQGRNLMQWVPSLQLLLQPHSLESLHCLYETRNKTFLTQVMAHFEEMGMCVETDMELLVCTFCIKFSRHVKKLQLIEGRQHRSTWSPTMVVLFRWVPVTDAYWQILFSVLKVTRNLKELDLSGNSLSHSAVKSLCKTLRRPRCLLETLRLAGCGLTAEDCKDLAFGLRANQTLTELDLSFNVLTDAGAKHLCQRLRQPSCKLQRLQLVSCGLTSDCCQDLASVLSASPSLKELDLQQNNLDDVGVRLLCEGLRHPACKLIRLGKPSVMTPTEGLDTGEMSNSTSSLKRQRLGSERAASHVAQANLKLLDVSKIFPIAEIAEESSPEVVPVELLCVPSPASQGDLHTKPLGTDDDFWGPTGPVATEVVDKEKNLYRVHFPVAGSYRWPNTGLCFVMREAVTVEIEFCVWDQFLGEINPQHSWMVAGPLLDIKAEPGAVEAVHLPHFVALQGGHVDTSLFQMAHFKEEGMLLEKPARVELHHIVLENPSFSPLGVLLKMIHNALRFIPVTSVVLLYHRVHPEEVTFHLYLIPSDCSIRKAIDDLEMKFQFVRIHKPPPLTPLYMGCRYTVSGSGSGMLEILPKELELCYRSPGEDQLFSEFYVGHLGSGIRLQVKDKKDETLVWEALVKPGDLMPATTLIPPARIAVPSPLDAPQLLHFVDQYREQLIARVTSVEVVLDKLHGQVLSQEQYERVLAENTRPSQMRKLFSLSQSWDRKCKDGLYQALKETHPHLIMELWEKGSKKGLLPLSS

SEQ ID NO: 1518 - protein, 508 aa, Homo sapiens
MAHFEEMGMCVETDMELLVCTFCIKFSRHVKKLQLIEGRQHRSTWSPTMVVLFRWVPVTDAYWQILFSVLKVTRNLKELDLSGNSLSHSAVKSLCKTLRRPRCLLETLRLAGCGLTAEDCKDLAFGLRANQTLTELDLSFNVLTDAGAKHLCQRLRQPSCKLQRLQLVSCGLTSDCCQDLASVLSASPSLKELDLQQNNLDDVGVRLLCEGLRHPACKLIRLGLDQTTLSDEMRQELRALEQEKPQLLIFSRRKPSVMTPTEGLDTGEMSNSTSSLKRQRLGSERAASHVAQANLKLLDVSKIFPIAEIAEESSPEVVPVELLCVPSPASQGDLHTKPLGTDDDFWGPTGPVATEVVDKEKNLYRVHFPVAGSYRWPNTGLCFVMREAVTVEIEFCVWDQFLGEINPQHSWMVAGPLLDIKAEPGAVEAVHLPHFVALQGGHVDTSLFQMAHFKEEGMLLEKPARVELHHIVLENPSFSPLGVLLKMIHNALRFIPVTSVVLLYHRPS

SEQ ID NO: 1519 - protein, 1375 aa, Homo sapiens; identical to SEQ ID NO: 1514

SEQ ID NO: 1520 - protein, 900 aa, Homo sapiens
MESCYNPGLDGIIEYDDFKLNSSIVEPKEPAPETADGPYLVIVEQPKQRGFRFRYGCEGPSHGGLPGASSEKGRKTYPTVKICNYEGPAKIEVDLVTHSDPPRAHAHSLVGKQCSELGICAVSVGPKDMTAQFNNLGVLHVTKKNMMGTMIQKLQRQRLRSRPQGLTEAEQRELEQEAKELKKVMDLSIVRLRFSAFLRASDGSFSLPLKPVISQPIHDSKSPGASNLKISRMDKTAGSVRGGDEVYLLCDKVQKDDIEVRFYEDDENGWQAFGDFSPTDVHKQYAIVFRTPPYHKMKIERPVTVFLQLKRKRGGDVSDSKQFTYYPLVEDKEEVQRKRRKALPTFSQPFGGGSHMGGGSGGAAGGYGGAGGGGSLGFFPSSLAYSPYQSGAGPMGCYPGGGGGAQMAATVPSRDSGEEAAEPSAPSRTPQCEPQAPEMLQRAREYNARLFGLAQRSARALLDYGVTADARALLAGQRHLLTAQDENGDTPLHLAIIHGQTSVIEQIVYVIHHAQDLGVVNLTNHLHQTPLHLAVITGQTSVVSFLLRVGADPALLDRHGDSAMHLALRAGAGAPELLRALLQSGAPAVPQLLHMPDFEGLYPVHLAVRARSPECLDLLVDSGAEVEATERQGGRTALHLATEMEELGLVTHLVTKLRANVNARTFAGNTPLHLAAGLGYPTLTRLLLKAGADIHAENEEPLCPLPSPPTSDSDSDSEGPEKDTRSSFRGHTPLDLTCSTKVKTLLLNAAQNTMEPPLTPPSPAGPGLSLGDTALQNLEQLLDGPEAQGSWAELAERLGLRSLVDTYRQTTSPSGSLLRSYELAGGDLAGLLEALSDMGLEEGVRLLRGPETRDKLPSTAEVKEDSAYGSQSVEQEAEKLGPPPEPPGGLCHGHPQPQVH

SEQ ID NO: 1521 - protein, 899 aa, Homo sapiens
MESCYNPGLDGIIEYDDFKLNSSIVEPKEPAPETADGPYLVIVEQPKQRGFRFRYGCEGPSHGGLPGASSEKGRKTYPTVKICNYEGPAKIEVDLVTHSDPPRAHAHSLVGKQCSELGICAVSVGPKDMTAQFNNLGVLHVTKKNMMGTMIQKLQRQRLRSRPQGLTEAEQRELEQEAKELKKVMDLSIVRLRFSAFLRASDGSFSLPLKPVISQPIHDSKSPGASNLKISRMDKTAGSVRGGDEVYLLCDKVQKDDIEVRFYEDDENGWQAFGDFSPTDVHKQYAIVFRTPPYHKMKIERPVTVFLQLKRKRGGDVSDSKQFTYYPLVEDKEEVQRKRRKALPTFSQPFGGGSHMGGGSGGAAGGYGGAGGGGSLGFFPSSLAYSPYQSGAGPMGCYPGGGGGAQMAATVPSRDSGEEAAEPSAPSRTPQCEPQAPEMLQRAREYNARLFGLAQRSARALLDYGVTADARALLAGQRHLLTAQDENGDTPLHLAIIHGQTSVIEQIVYVIHHAQDLGVVNLTNHLHQTPLHLAVITGQTSVVSFLLRVGADPALLDRHGDSAMHLALRAGAGAPELLRALLQSGAPAVPQLLHMPDFEGLYPVHLAVRARSPECLDLLVDSGAEVEATERQGGRTALHLATEMEELGLVTHLVTKLRANVNARTFAGNTPLHLAAGLGYPTLTRLLLKAGADIHAENEEPLCPLPSPPTSDSDSDSEGPEKDTRSSFRGHTPLDLTCSTKVKTLLLNAAQNTMEPPLTPPSPAGPGLSLGDTALQNLEQLLDGPEAQGSWAELAERLGLRSLVDTYRQTTSPSGSLLRSYELAGGDLAGLLEALSDMGLEEGVRLLRGPETRDKLPSTEVKEDSAYGSQSVEQEAEKLGPPPEPPGGLCHGHPQPQVH

SEQ ID NO: 1522 - protein, 900 aa, Homo sapiens; identical to SEQ ID NO: 1520

SEQ ID NO: 1523 - protein, 899 aa, Homo sapiens; identical to SEQ ID NO: 1521

SEQ ID NO: 1524 - protein, 267 aa, Homo sapiens
MPRAFLVKKPCVSTCKRNWSELPDEERGEIYVPVSLGFCPPQPYREPEPSVAEPPSCPLALNMSLRDSSYSMAPGPCVVAQLPSEDMGHLTDPQSRDHGFLRTKMKVTLGDSPSGDLFTCRVCQKAFTYQRMLNRHMKCHNDVKRHLCTYCGKGFNDTFDLKRHVRTHTGVRPYKCSLCDKAFTQRCSLESHLKKIHGVQQKYAYKERRAKLYVCEECGCTSESQEGHVLHLKEHHPDSPLLRKTSKKVAVALQNTVTSLLQGSPHL

SEQ ID NO: 1525 - protein, 178 aa, Homo sapiens
  MOD_RES (1)..(1): Any amino acid
XNTDRPDASAVYLHDFQRFLIHEQQEHWAQDLNKVRERMTKFIDDTMRETAEPFLFVDEFLTYLFSRENSIWDEKYDAVDMQDMNNPLSHYWISSSHNTYLTGDQLRSESSPEAYIRCLRMGCRCIELDCWDGPDGKPVIYHGWTRTTKIKFDDVVQAIKDHAFVTSRCPLSWVEVLL

SEQ ID NO: 1526 - protein, 45 aa, Homo sapiens
  MOD_RES (1)..(1): Any amino acid
XDMQDMNNPLSHYWISSSHNTGLLGRARWEAGHLPWLDADYQDQV

SEQ ID NO: 1527 - protein, 159 aa, Homo sapiens
MSTTVNVDSLAEYEKSQIKRALELGTVMTVFSFRKSTPERRTVQVIMETRQVAWSKTADKIEGFLDIMEIKEIRPGKNSKDFERAKAVRQKEDCCFTILYGTQFVLSTLSLAADSKEDAVNWLSGLKILHQEAMNASTPTIIESWLRKQIYSVDQTRRN

SEQ ID NO: 1528 - protein, 364 aa, Homo sapiens
MHRLIFVYTLICANFCSCRDTSATPQSASIKALRNANLRRDDLYRRDETIQVKGNGYVQSPRFPNSYPRNLLLTWRLHSQENTRIQLVFDNQFGLEEAENDICRYDFVEVEDISETSTIIRGRWCGHKEVPPRIKSRTNQIKITFKSDDYFVAKPGFKIYYSLLEDFQPAAASETNWESVTSSISGVSYNSPSVTDPTLIADALDKKIAEFDTVEDLLKYFNPESWQEDLENMYLDTPRYRGRSYHDRKSKVDLDRLNDDAKRYSCTPRNYSVNIREELKLANVVFFPRCLLVQRCGGNCGCGTVNWRSCTCNSGKTVKKYHEVLQFEPGHIKRRGRAKTMALVDIQLDHHERCDCICSSRPPR

SEQ ID NO: 1529 - protein, 370 aa, Homo sapiens
MHRLIFVYTLICANFCSCRDTSATPQSASIKALRNANLRRDESNHLTDLYRRDETIQVKGNGYVQSPRFPNSYPRNLLLTWRLHSQENTRIQLVFDNQFGLEEAENDICRYDFVEVEDISETSTIIRGRWCGHKEVPPRIKSRTNQIKITFKSDDYFVAKPGFKIYYSLLEDFQPAAASETNWESVTSSISGVSYNSPSVTDPTLIADALDKKIAEFDTVEDLLKYFNPESWQEDLENMYLDTPRYRGRSYHDRKSKVDLDRLNDDAKRYSCTPRNYSVNIREELKLANVVFFPRCLLVQRCGGNCGCGTVNWRSCTCNSGKTVKKYHEVLQFEPGHIKRRGRAKTMALVDIQLDHHERCDCICSSRPPR

SEQ ID NO: 1530 - protein, 241 aa, Homo sapiens
MNRCWALFLSLCCYLRLVSAEGDPIPEELYEMLSDHSIRSFDDLQRLLHGDPGEEDGAELDLNMTRSHSGGELESLARGRRSLGSLTIAEPAMIAECKTRTEVFEISRRLIDRTNANFLVWPPCVEVQRCSGCCNNRNVQCRPTQVQLRPVQVRKIEIVRKKPIFKKATVTLEDHLACKCETVAAARPVTRSPGGSQEQRAKTPQTRVTIRTVRVRRPPKGKHRKFKHTHDKTALKETLGA

SEQ ID NO: 1531 - protein, 226 aa, Homo sapiens
MFIMGLGDPIPEELYEMLSDHSIRSFDDLQRLLHGDPGEEDGAELDLNMTRSHSGGELESLARGRRSLGSLTIAEPAMIAECKTRTEVFEISRRLIDRTNANFLVWPPCVEVQRCSGCCNNRNVQCRPTQVQLRPVQVRKIEIVRKKPIFKKATVTLEDHLACKCETVAAARPVTRSPGGSQEQRAKTPQTRVTIRTVRVRRPPKGKHRKFKHTHDKTALKETLGA

SEQ ID NO: 1532 - protein, 136 aa, Homo sapiens
MLSDHSIRSFDDLQRLLHGDPGEEDGAELDLNMTRSHSGGELESLARGRRSLGSLTIAEPAMIAECKTRTEVFEISRRLIDRTNANFLVWPPCVEVQRCSGCCNNRNVQCRPTQVQLRPVQVRKIEIVRKKPIFKK

SEQ ID NO: 1533 - protein, 144 aa, Homo sapiens
MLSDHSIRSFDDLQRLLHGDPGEEDGAELDLNMTRSHSGGELESLARGRRSLGSLTIAEPAMIAECKTRTEVFEISRRLIDRTNANFLVWPPCVEVQRCSGCCNNRNVQCRPTQVQLRPVQVRKIEIVRKKPIFKKATVTLEDH

SEQ ID NO: 1534 - protein, 267 aa, Homo sapiens
MPRSCCSRSGALLLALLLQASMEVRGWCLESSQCQDLTTESNLLECIRACKPDLSAETPMFPGNGDEQPLTENPRKYVMGHFRWDRFGRRNSSSSGSSGAGQKREDVSAGEDCGPLPEGGPEPRSDGAKPGPREGKRSYSMEHFRWGKPVGKKRRPVKVYPNGAEDESAEAFPLEFKRELTGQRLREGDGPDGPADDGAGAQADLEHSLLVAAEKKDEGPYRMEHFRWGSPPKDKRYGGFMTSEKSQTPLVTLFKNAIIKNAYKKGE

SEQ ID NO: 1535 - protein, 267 aa, Homo sapiens; identical to SEQ ID NO: 1534

SEQ ID NO: 1536 - protein, 267 aa, Homo sapiens; identical to SEQ ID NO: 1534

SEQ ID NO: 1537 - protein, 267 aa, Homo sapiens; identical to SEQ ID NO: 1534

SEQ ID NO: 1538 - protein, 246 aa, Homo sapiens
MPRSCCSRSGALLLALLLQASMEVRGWCLESSQCQDLTTESNLLECIRACKPDLSAETPMFPGNGDEQPLTENPRKYVMGHFRWDRFGRRNSSSSGSSGAGQKREDVSAGEDCGPLPEGGPEPRSDGAKPGPREGKRSYSMEHFRWGKPVGKKRRPVKVYPNGAEDESAEAFPLEFKRELTGQRLREGDGPDGPADDGAGAQADLEHSLLVAAEKKDEGPYRMEHFRWGSPPKDKRYGGFMTSEKS

SEQ ID NO: 1539 - protein, 152 aa, Homo sapiens
MTCTDQKSHSQRALGTQTPALQGPQLLNTDPSSEETRPPHVNPDRLCHMEPANHFWHAGDLQAMISKEFHLAATQDDCRKGRTQEDILVPSSHPELFASVLPMAPEEAARLQQPQPLPPPSGIHLSASRTLAPTLLYSSPPSHSPFGLSSLI

SEQ ID NO: 1540 - protein, 104 aa, Homo sapiens
MEPANHFWHAGDLQAMISKEFHLAATQDDCRKGRTQEDILVPSSHPELFASVLPMAPEEAARLQQPQPLPPPSGIHLSASRTLALTLLYSSPPSHSPFGLSSLI

SEQ ID NO: 1541 - protein, 152 aa, Homo sapiens; identical to SEQ ID NO: 1539

SEQ ID NO: 1542 - protein, 152 aa, Homo sapiens
MTCTDQKSHSQRALGTQTPALQGPQLLNTDPSSKETRPPHVNPDRLCHMEPANHFWHAGDLQAMISKEFHLAATQDDCRKGRTQEDILVPSSHPELFASVLPMAPEEAARLQQPQPLPPPSGIHLSASRTLAPTLLYSSPPSHSPFGLSSLI

SEQ ID NO: 1543 - protein, 152 aa, Homo sapiens; identical to SEQ ID NO: 1539

SEQ ID NO: 1544 - protein, 152 aa, Homo sapiens; identical to SEQ ID NO: 1539

SEQ ID NO: 1545 - protein, 150 aa, Homo sapiens
PQTDQKSHSQRALGTQTPALQGPQLLNTDPSSEETHPHVNPDRLCHMEPANHFWHAGDLQAMISKEFHLAATQDDCRKGRTQEDILVPSSHPELFASVLPMAPEEAARLQQPQPLPPPSGIHLSASRTLALTLLYSSPPSHSPFGLSSLI

SEQ ID NO: 1546 - protein, 136 aa, Homo sapiens
MILNWKLLGILVLCLHTRGISGSEGHPSHPPAEDREEAGSPTLPQGPPVPGDPWPGAPPLFEDPPPTRPSRPWRDLPETGVWLPEPPRTDPPQPPRPDDPWPAGPQPPENPWPPAPEVDNRPQEEPDLDPPREEYR

SEQ ID NO: 1547 - protein, 136 aa, Homo sapiens
MILNWKLLGILVLCLHTRGISGSEGHPSHPPAEDREEAGSPTLPQGPPVPGDPWPGAPPLFEDPPPTRPSRPWRDLPETGVWPPEPPRTDPPQPPRPDDPWPAGPQPPENPWPPAPEVDNRPQEEPDLDPPREEYR

SEQ ID NO: 1548 - protein, 136 aa, Homo sapiens; identical to SEQ ID NO: 1547

SEQ ID NO: 1549 - protein, 136 aa, Homo sapiens; identical to SEQ ID NO: 1547

SEQ ID NO: 1550 - protein, 136 aa, Homo sapiens; identical to SEQ ID NO: 1547

SEQ ID NO: 1551 - protein, 136 aa, Homo sapiens; identical to SEQ ID NO: 1547

SEQ ID NO: 1552 - protein, 250 aa, Homo sapiens
ALLLAVIQGRPGAQHDVEALGGLCWALGFETTVRTDPTAQAFQEELAQFREQLDTCRGPVSCALVALMAHGGPRGQLLGADGQEVQPEALMQELSRCQVLQGRPKIFLLQACRGGNRDAGVGPTALPWYWSWLRAPPSVPSHADVLQIYAEAQGSSCRGTPPGSSDQADILTVYSAAEGYVAYRDDKGSDFIQTLVEVLRANPGRDLLELLTEVNRRVCEQEVLGPDCDELRKACLEIRSSLRRRLCLQA

SEQ ID NO: 1553 - protein, 1054 aa, Homo sapiens
MTSYRERSADLARFYTVTEPQRHPRGYTVYKVTARIIVWKRYSDFKKLHKELWQIHKNLFRHSELFPPFAKGIVFGRFDETVIEERRQCAEDLLQFSANIPALYNSKQLEDFFKGGIINDSSELIGPAEAHSDSLIDTFPECSTEGFSSDSDLVSLTVDVDSLAELDDGMASNQNSPIRTFGLNLSSDSSALGAVASDSEQSKTEEERESRSLFPGSLKPKLGKRDYLEKAGELIKLALKKEEEDDYEAASDFYRKGVDLLLEGVQGESSPTRREAVKRRTAEYLMRAESISSLYGKPQLDDVSQPPGSLSSRPLWNLRSPAEELKAFRVLGVIDKVLLVMDTRTEQTFILKGLRKSSEYSRNRKTIIPRCVPNMVCLHKYIISEESVFLVLQHAEGGKLWSYISKFLNRSPEESFDIKEVKKPTLAKVHLQQPTSSPQDSSSFESRGSDGGSMLKALPLKSSLTPSSQDDSNQEDDGQDSSPKWPDSGSSSEEECTTSYLTLCNEYGQEKIEPGSLNEEPFMKTEGNGVDTKAIKSFPAHLAADSDSPSTQLRAHELKFFPNDDPEAVSSPRTSDSLSRSKNSPMEFFRIDSKDSASELLGLDFGEKLYSLKSEPLKPFFTLPDGDSASRSFNTSESKVEFKAQDTISRGSDDSVPVISFKDAAFDDVSGTDEGRPDLLVNLPGELESTREAAAMGPTKFTQTNIGIIENKLLEAPDVLCLRLSTEQCQAHEEKGIEELSDPSGPKSYSITEKHYAQEDPRMLFVAAVDHSSSGDMSLLPSSDPKFQGLGVVESAVTANNTEESLFRICSPLSGANEYIASTDTLKTEEVLLFTDQTDDLAKEEPTSLFQRDSETKGESGLVLEGDKEIHQIFEDLDKKLALASRFYIPEGCIQRWAAEMVVALDALHREGIVCRDLNPNNILLNDRGHIQLTYFSRWSEVEDSCDSDAIERMYCAPEVGAITEETEACDWWSLGAVLFELLTGKTLVECHPAGINTHTTLNMPECVSEEARSLIQQLLQFNPLERLGAGVAGVEDIKSHPFFTPVDWAELMR

SEQ ID NO: 1554 - protein, 1066 aa, Homo sapiens
MTSYRERSADLARFYTVTEPQRHPRGYTVYKVTARVVSRRNPEDVQEIIVWKRYSDFKKLHKELWQIHKNLFRHSELFPPFAKGIVFGRFDETVIEERRQCAEDLLQFSANIPALYNSKQLEDFFKGGIINDSSELIGPAEAHSDSLIDTFPECSTEGFSSDSDLVSLTVDVDSLAELDDGMASNQNSPIRTFGLNLSSDSSALGAVASDSEQSKTEEERESRSLFPGSLKPKLGKRDYLEKAGELIKLALKKEEEDDYEAASDFYRKGVDLLLEGVQGESSPTRREAVKRRTAEYLMRAESISSLYGKPQLDDVSQPPGSLSSRPLWNLRSPAEELKAFRVLGVIDKVLLVMDTRTEQTFILKGLRKSSEYSRNRKTIIPRCVPNMVCLHKYIISEESVFLVLQHAEGGKLWSYISKFLNRSPEESFDIKEVKKPTLAKVHLQQPTSSPQDSSSFESRGSDGGSMLKALPLKSSLTPSSQDDSNQEDDGQDSSPKWPDSGSSSEEECTTSYLTLCNEYGQEKIEPGSLNEEPFMKTEGNGVDTKAIKSFPAHLAADSDSPSTQLRAHELKFFPNDDPEAVSSPRTSDSLSRSKNSPMEFFRIDSKDSASELLGLDFGEKLYSLKSEPLKPFFTLPDGDSASRSFNTSESKVEFKAQDTISRGSDDSVPVISFKDAAFDDVSGTDEGRPDLLVNLPGELESTREAAAMGPTKFTQTNIGIIENKLLEAPDVLCLRLSTEQCQAHEEKGIEELSDPSGPKSYSITEKHYAQEDPRMLFVAAVDHSSSGDMSLLPSSDPKFQGLGVVESAVTANNTEESLFRICSPLSGANEYIASTDTLKTEEVLLFTDQTDDLAKEEPTSLFQRDSETKGESGLVLEGDKEIHQIFEDLDKKLALASRFYIPEGCIQRWAAEMVVALDALHREGIVCRDLNPNNILLNDRGHIQLTYFSRWSEVEDSCDSDAIERMYCAPEVGAITEETEACDWWSLGAVLFELLTGKTLVECHPAGINTHTTLNMPECVSEEARSLIQQLLQFNPLERLGAGVAGVEDIKSHPFFTPVDWAELMR

SEQ ID NO: 1555 - protein, 660 aa, Homo sapiens
MRAESISSLYGKPQLDDVSQPPGSLSSRPLWNLRSPAEELKAFRVLGVIDKVLLVMDTRTEQTFILKGLRKSSEYSRNRKTIIPRCVPNMVCLHKYIISEESVFLVLQHAEGGKLWSYISKFLNRSPEESFDIKEVKKPTLAKVHLQQPTSSPQDSSSFESRGSDGGSMLKALPLKSSLTPSSQDDSNQEDDGQDSSPKWPDSGSSSEEECTTSYLTLCNEYGQEKIEPGSLNEEPFMKTEGNGVDTKAIKSFPAHLAADSDSPSTQLRAHELKFFPNDDPEAVSSPRTSDSLSRSKNSPMEFFRIDSKDSASELLGLDFGEKLYSLKSEPLKPFFTLPDGDSASRSFNTSESKVEFKAQDTISRGSDDSVPVISFKDAAFDDVSGTDEGRPDLLVNLPGELESTREAAAMGPTKFTQTNIGIIENKLLEAPDVLCLRLSTEQCQAHEEKGIEELSDPSGPKSYSITEKHYAQEDPRMLFVAAVDHSSSGDMSLLPSSDPKFQGLGVVESAVTANNTEESLFRICSPLSGANEYIASTDTLKTEEVLLFTDQTDDLAKEEPTSLFQRDSETKGESGLVLEGDKEIHQIFEDLDKKLALASRFYIPEGCIQRWAAEMVVALDALHREGIVCRDLNPNNILLNDRGQELLQMHFFLFAVASN

SEQ ID NO: 1556 - protein, 854 aa, Homo sapiens
MASNQNSPIRTFGLNLSSDSSALGAVASDSEQSKTEEERESRSLFPGSLKPKLGKRDYLEKAGELIKLALKKEEEDDYEAASDFYRKGVDLLLEGVQGESSPTRREAVKRRTAEYLMRAESISSLYGKPQLDDVSQVLLVMDTRTEQTFILKGLRKSSEYSRNRKTIIPRCVPNMVCLHKYIISEESVFLVLQHAEGGKLWSYISKFLNRSPEESFDIKEVKKPTLAKVHLQQPTSSPQDSSSFESRGSDGGSMLKALPLKSSLTPSSQDDSNQEDDGQDSSPKWPDSGSSSEEECTTSYLTLCNEYGQEKIEPGSLNEEPFMKTEGNGVDTKAIKSFPAHLAADSDSPSTQLRAHELKFFPNDDPEAVSSPRTSDSLSRSKNSPMEFFRIDSKDSASELLGLDFGEKLYSLKSEPLKPFFTLPDGDSASRSFNTSESKVEFKAQDTISRGSDDSVPVISFKDAAFDDVSGTDEGRPDLLVNLPGELESTREAAAMGPTKFTQTNIGIIENKLLEAPDVLCLRLSTEQCQAHEEKGIEELSDPSGPKSYSITEKHYAQEDPRMLFVAAVDHSSSGDMSLLPSSDPKFQGLGVVESAVTANNTEESLFRICSPLSGANEYIASTDTLKTEEVLLFTDQTDDLAKEEPTSLFQRDSETKGESGLVLEGDKEIHQIFEDLDKKLALASRFYIPEGCIQRWAAEMVVALDALHREGIVCRDLNPNNILLNDRGHIQLTYFSRWSEVEDSCDSDAIERMYCAPEVGAITEETEACDWWSLGAVLFELLTGKTLVECHPAGINTHTTLNMPECVSEEARSLIQQLLQFNPLERLGAGVAGVEDIKSHPFFTPVDWAELMR

SEQ ID NO: 1557 - protein, 482 aa, Homo sapiens
MAAVFDLDLETEEGSEGEGEPELSPADACPLAELRAAGLEPVGHYEEVELTETSVNVGPERIGPHCFELLRVLGKGGYGKVFQVRKVQGTNLGKIYAMKVLRKAKIVRNAKDTAHTRAERNILESVKHPFIVELAYAFQTGGKLYLILECLSGGELFTHLEREGIFLEDTACFYLAEITLALGHLHSQGIIYRDLKPENIMLSSQGHIKLTDFGLCKESIHEGAVTHTFCGTIEYMAPEILVRSGHNRAVDWWSLGALMYDMLTGSPPFTAENRKKTMDKIIRGKLALPPYLTPDARDLVKKFLKRNPSQRIGGGPGDAADVQRHPFFRHMNWDDLLAWRVDPPFRPCLQSEEDVSQFDTRFTRQTPVDSPDDTALSESANQAFLGFTYVAPSVLDSIKEGFSFQPKLRSPRRLNSSPRAPVSPLKFSPFEGFRPSPSLPEPTELPLPPLLPPPPPSTTAPLPIRPPSGTKKSKRGRGRPGR

SEQ ID NO: 1558 - protein, 154 aa, Homo sapiens
MAAVFDLDLETEEGSEGEGEPELSPADACPLAELRAAGLEPVGHYEEVELTETSVNVGPERIGPHCFELLRVLGKGGYGKVFQVRKVQGTNLGKIYAMKVLRKAKIVRNAKDTAHTRAERNILESVKHPFIVELAYAFQTGGKLYLILECLSVD

SEQ ID NO: 1559 - protein, 154 aa, Homo sapiens; identical to SEQ ID NO: 1558

SEQ ID NO: 1560 - protein, 710 aa, Homo sapiens
MFKFLSFRVRSIQEEVSIKEIAITHHVKEGHEKADPSQFELLKVLGQGSFGKVFLVKKISGSDARQLYAMKVLKKATLKVRDRVRTKMERDILVEVNHPFIVKLHYAFQTEGKLYLILDFLRGGDLFTRLSKEVMFTEEDVKFYLAELALALDHLHSLGIIYRDLKPENILLDEEGHIKLTDFGLSKESIDHEKKAYSFCGTVEYMAPEVVNRRGHTQSADWWSFGVLMFEMLTGTLPFQGKDRKETMTMILKAKLGMPQFLSPEAQSLLRMLFKRNPANRLGAGPDGVEEIKRHSFFSTIDWNKLYRREIHPPFKPATGRPEDTFYFDPEFTAKTPKDSPGIPPSANAHQLFRGFSFVAITSDDESQAMQTVGVHSIVQLHRNSIQFTDGYEVKEDIGVGSYSVCKRCIHKATNMEFAVKIIDKSKRDPTEEIEILLRYGQHPNIITLKDVYDDGKYVYVVTELMKGGELLDKILRQKFFSEREASAVLFTITKTVEYLHAQGVVHRDLKPSNILYVDESGNPESIRICDFGFAKQLRAENGLLMTPCYTANFVAPEVLKRQGYDAACDIWSLGVLLYTMLTGYTPFANGPDDTPEEILARIGSGKFSLSGGYWNSVSDTAKDLVSKMLHVDPHQRLTAALVLRHPWIVHWDQLPQYQLNRQDAPHLVKGAMAATYSALNRNQSPVLEPVGRSTLAQRRGIKKITSTAL

SEQ ID NO: 1561 - protein, 740 aa, Homo sapiens
MPLAQLADPWQKMAVESPSDSAENGQQIMDEPMGEEEINPQTEEVSIKEIAITHHVKEGHEKADPSQFELLKVLGQGSFGKVFLVKKISGSDARQLYAMKVLKKATLKVRDRVRTKMERDILVEVNHPFIVKLHYAFQTEGKLYLILDFLRGGDLFTRLSKEVMFTEEDVKFYLAELALALDHLHSLGIIYRDLKPENILLDEEGHIKLTDFGLSKESIDHEKKAYSFCGTVEYMAPEVVNRRGHTQSADWWSFGVLMFEMLTGTLPFQGKDRKETMTMILKAKLGMPQFLSPEAQSLLRMLFKRNPANRLGAGPDGVEEIKRHSFFSTIDWNKLYRREIHPPFKPATGRPEDTFYFDPEFTAKTPKDSPGIPPSANAHQLFRGFSFVAITSDDESQAMQTVGVHSIVQQLHRNSIQFTDGYEVKEDIGVGSYSVCKRCIHKATNMEFAVKIIDKSKRDPTEEIEILLRYGQHPNIITLKDVYDDGKYVYVVTELMKGGELLDKILRQKFFSEREASAVLFTITKTVEYLHAQGVVHRDLKPSNILYVDESGNPESIRICDFGFAKQLRAENGLLMTPCYTANFVAPEVLKRQGYDAACDIWSLGVLLYTMLTGYTPFANGPDDTPEEILARIGSGKFSLSGGYWNSVSDTAKDLVSKMLHVDPHQRLTAALVLRHPWIVHWDQLPQYQLNRQDAPHLVKGAMAATYSALNRNQSPVLEPVGRSTLAQRRGIKKITSTAL

SEQ ID NO: 1562 - protein, 133 aa, Homo sapiens
MDEPMGEEEINPQTEEVSIKEIAITHHVKEGHEKADPSQFELLKVLGQGSFGKVFLVKKISGSDARQLYAMKVLKKATLKVRDRVRTKMERDILVEVNHPFIVKLHYAFQTEGKLYLILDFLRGGDLFTRLSK

SEQ ID NO: 1563 - protein, 227 aa, Homo sapiens
MFKFLSFRVRSIQEEVSIKEIAITHHVKEGHEKADPSQFELLKVLGQGSFGKVFLVKKISGSDARQLYAMKVLKKATLKVRDRVRTKMERDILVEVNHPFIVKLHYAFQTEGKLYLILDFLRGGDLFTRLSKEVMFTEEDVKFYLAELALALDHLHSLGIIYRDLKPENILLDEEGHIKLTDFGLSKESIDHEKKAYSFCGTVEYMAPEVVNRRGHTQSADWWSFGV

SEQ ID NO: 1564 - protein, 711 aa, Homo sapiens
MDEPMGEEEINPQTEEVSIKEIAITHHVKEGHEKADPSQFELLKVLGQGSFGKVFLVKKISGSDARQLYAMKVLKKATLKVRDRVRTKMERDILVEVNHPFIVKLHYAFQTEGKLYLILDFLRGGDLFTRLSKEVMFTEEDVKFYLAELALALDHLHSLGIIYRDLKPENILLDEEGHIKLTDFGLSKESIDHEKKAYSFCGTVEYMAPEVVNRRGHTQSADWWSFGVLMFEMLTGTLPFQGKDRKETMTMILKAKLGMPQFLSPEAQSLLRMLFKRNPANRLGAGPDGVEEIKRHSFFSTIDWNKLYRREIHPPFKPATGRPEDTFYFDPEFTAKTPKDSPGIPPSANAHQLFRGFSFVAITSDDESQAMQTVGVHSIVQLHRNSIQFTDGYEVKEDIGVGSYSVCKRCIHKATNMEFAVKIIDKSKRDPTEEIEILLRYGQHPNIITLKDVYDDGKYVYVVTELMKGGELLDKILRQKFFSEREASAVLFTITKTVEYLHAQGVVHRDLKPSNILYVDESGNPESIRICDFGFAKQLRAENGLLMTPCYTANFVAPEVLKRQGYDAACDIWSLGVLLYTMLTGYTPFANGPDDTPEEILARIGSGKFSLSGGYWNSVSDTAKDLVSKMLHVDPHQRLTAALVLRHPWIVHWDQLPQYQLNRQDAPHLVKGAMAATYSALNRNQSPVLEPVGRSTLAQRRGIKKITSTAL

SEQ ID NO: 1565 - protein, 712 aa, Homo sapiens
MDEPMGEEEINPQTEEVSIKEIAITHHVKEGHEKADPSQFELLKVLGQGSFGKVFLVKKISGSDARQLYAMKVLKKATLKVRDRVRTKMERDILVEVNHPFIVKLHYAFQTEGKLYLILDFLRGGDLFTRLSKEVMFTEEDVKFYLAELALALDHLHSLGIIYRDLKPENILLDEEGHIKLTDFGLSKESIDHEKKAYSFCGTVEYMAPEVVNRRGHTQSADWWSFGVLMFEMLTGTLPFQGKDRKETMTMILKAKLGMPQFLSPEAQSLLRMLFKRNPANRLGAGPDGVEEIKRHSFFSTIDWNKLYRREIHPPFKPATGRPEDTFYFDPEFTAKTPKDSPGIPPSANAHQLFRGFSFVAITSDDESQAMQTVGVHSIVQQLHRNSIQFTDGYEVKEDIGVGSYSVCKRCIHKATNMEFAVKIIDKSKRDPTEEIEILLRYGQHPNIITLKDVYDDGKYVYVVTELMKGGELLDKILRQKFFSEREASAVLFTITKTVEYLHAQGVVHRDLKPSNILYVDESGNPESIRICDFGFAKQLRAENGLLMTPCYTANFVAPEVLKRQGYDAACDIWSLGVLLYTMLTGYTPFANGPDDTPEEILARIGSGKFSLSGGYWNSVSDTAKDLVSKMLHVDPHQRLTAALVLRHPWIVHWDQLPQYQLNRQDAPHLVKGAMAATYSALNRNQSPVLEPVGRSTLAQRRGIKKITSTAL

SEQ ID NO: 1566 - protein, 524 aa, Homo sapiens
MGDEDDDESCAVELRITEANLTGHEEKVSVENFELLKVLGTGAYGKVFLVRKAGGHDAGKLYAMKVLRKAALVQRAKTQEHTRTERSVLELVRQAPFLVTLHYAFQTDAKLHLILDYVSGGEMFTHLYQRQYFKEAEVRVYGGEIVLALEHLHKLGIIYRDLKLENVLLDSEGHIVLTDFGLSKEFLTEEKERTFSFCGTIEYMAPEIIRSKTGHGKAVDWWSLGILLFELLTGASPFTLEGERNTQAEVSRRILKCSPPFPPRIGPVAQDLLQRLLCKDPKKRLGAGPQGAQEVRNHPFFQGLDWVALAARKIPAPFRPQIRSELDVGNFAEEFTRLEPVYSPPGSPPPGDPRIFQGYSFVAPSILFDHNNAAEIMCKIREGRFSLDGEAWQGVSEEAKELVRGLLTVDPAKRLKLEGLRGSSWLQDGSARSSPPLRTPDVLESSGPAVRSGLNATFMAFNRGKREGFFLKSVENAPLAKRRKQKLRSATASRRGSPAPANPGRAPVASKGAPRRANGPLPPS

SEQ ID NO: 1567 - protein, 772 aa, Homo sapiens
MGDEDDDESCAVELRITEANLTGHEEKVSVENFELLKVLGTGAYGKVFLVRKAGGHDAGKLYAMKVLRKAALVQRAKTQEHTRTERSVLELVRQAPFLVTLHYAFQTDAKLHLILDYVSGGEMFTHLYQRQYFKEAEVRVYGGEIVLALEHLHKLGIIYRDLKLENVLLDSEGHIVLTDFGLSKEFLTEEKERTFSFCGTIEYMAPEIIRSKTGHGKAVDWWSLGILLFELLTGASPFTLEGERNTQAEVSRRILKCSPPFPPRIGPVAQDLLQRLLCKDPKKRLGAGPQGAQEVRNHPFFQGLDWVALAARKIPAPFRPQIRSELDVGNFAEEFTRLEPVYSPPGSPPPGDPRIFQGYSFVAPSILFDHNNAVMTDGLEAPGAGDRPGRAAVARSAMMQDSPFFQQYELDLREPALGQGSFSVCRRCRQRQSGQEFAVKILSRRLEANTQREVAALRLCQSHPNVVNLHEVHHDQLHTYLVLELLRGGELLEHIRKKRHFSESEASQILRSLVSAVSFMHEEAGVVHRDLKPENILYADDTPGAPVKIIDFGFARLRPQSPGVPMQTPCFTLQYAAPELLAQQGYDESCDLWSLGVILYMMLSGQVPFQGASGQGGQSQAAEIMCKIREGRFSLDGEAWQGVSEEAKELVRGLLTVDPAKRLKLEGLRGSSWLQDGSARSSPPLRTPDVLESSGPAVRSGLNATFMAFNRGKREGFFLKSVENAPLAKRRKQKLRSATASRRGSPAPANPGRAPVASKGAPRRANGPLPPS

SEQ ID NO: 1568 - protein, 765 aa, Homo sapiens
MGDEDDDESCAVELRITEANLTGHEEKVSVENFELLKVLGTGAYGKVFLVRKAGGHDAGKLYAMKVLRKAALVQRAKTQEHTRTERSVLELVRQAPFLVTLHYAFQTDAKLHLILDYVSGGEMFTHLYQRQYFKEAEVRVYGGEIVLALEHLHKLGIIYRDLKLENVLLDSEGHIVLTDFGLSKEFLTEEKERTFSFCGTIEYMAPEIIRSKTGHGKAVDWWSLGILLFELLTGASPFTLEGERNTQAEVSRRILKCSPPFPPRIGPVAQDLLQRLLCKDPKKRLGAGPQGAQEVRNHPFFQGLDWVALAARKIPAPFRPQIRSELDVGNFAEEFTRLEPVYSPPGSPPPGDPRIFQGYSFVAPSILFDHNNAVMTDGLEAPGAGDRPGRAAVARSAMMQYELDLREPALGQGSFSVCRRCRQRQSGQEFAVKILSRRLEANTQREVAALRLCQSHPNVVNLHEVHHDQLHTYLVLELLRGGELLEHIRKKRHFSESEASQILRSLVSAVSFMHEEAGVVHRDLKPENILYADDTPGAPVKIIDFGFARLRPQSPGVPMQTPCFTLQYAAPELLAQQGYDESCDLWSLGVILYMMLSGQVPFQGASGQGGQSQAAEIMCKIREGRFSLDGEAWQGVSEEAKELVRGLLTVDPAKRLKLEGLRGSSWLQDGSARSSPPLRTPDVLESSGPAVRSGLNATFMAFNRGKREGFFLKSVENAPLAKRRKQKLRSATASRRGSPAPANPGRAPVASKGAPRRANGPLPPS

SEQ ID NO: 1569 - protein, 705 aa, Homo sapiens
TEANLTGHEEKVSVENFELLKVLGTGAYGKVFLVRKAGGHDAGKLYAMKVLRKAALVQRAKTQEHTRTERSVLELVRQAPFLVTLHYAFQTDAKLHLILDYVSGGEMFTHLYQRQYFKEAEVRVYGGEIVLALEHLHKLGIIYRDLKLENVLLDSEGHIVLTDFGLSKEFLTEEKERTFSFCGTIEYMAPEIIRSKTGHGKAVDWWSLGILLFELLTGASPFTLEGERNTQAEVSRRILKCSPPFPPRIGPVAQDLLQRLLCKDPKKRLGAGPQGAQEVRNHPFFQGLDWVALAARKIPAPFRPQIRSELDVGNFAEEFTRLEPVYSPPGSPPPGDPRIFQGYSFVAPSILFDHNNAVMTDGLEAPGAGDRPGRAAVARSAMMQQYELDLREPALGQGSFSVCRRCRQRQSGQEFAVKILSRRLEANTQREVAALRLCQSHPNVVNLHEVHHDQLHTYLVLELLRGGELLEHIRKKRHFSESEASQILRSLVSAVSFMHEEAGVVHRDLKPENILYADDTPGAPVKIIDFGFARLRPQSPGVPMQTPCFTLQYAAPELLAQQGYDESCDLWSLGVILYMMLSGQVPFQGASGQGGQSQAAEIMCKIREGRFSLDGEAWQGVSEEAKELVRGLLTVDPAKRLKLEGLRGSSWLQDGSARSSPPLRTPDVLESSGPAVRSGLNATFMAFNRGKREGFFLKSVENAPL

SEQ ID NO: 1570 - protein, 802 aa, Homo sapiens
MEEEGGSSGGAAGTSADGGDGGEQLLTVKHELRTANLTGHAEKVGIENFELLKVLGTGAYGKVFLVRKISGHDTGKLYAMKVLKKATIVQKAKTTEHTRTERQVLEHIRQSPFLVTLHYAFQTETKLHLILDYINGGELFTHLSQRERFTEHEVQIYVGEIVLALEHLHKLGIIYRDIKLENILLDSNGHVVLTDFGLSKEFVADETERAYSFCGTIEYMAPDIVRGGDSGHDKAVDWWSLGVLMYELLTGASPFTVDGEKNSQAEISRRILKSEPPYPQEMSALAKDLIQRLLMKDPKKRLGCGPRDADEIKEHLFFQKINWDDLAAKKVPAPFKPVIRDELDVSNFAEEFTEMDPTYSPAALPQSSEKLFQGYSFVAPSILFKRNAAVIDPLQFHMGVERPGVTNVARSAMMKDSPFYQHYDLDLKDKPLGEGSFSICRKCVHKKSNQAFAVKIISKRMEANTQKEITALKLCEGHPNIVKLHEVFHDQLHTFLVMELLNGGELFERIKKKKHFSETEASYIMRKLVSAVSHMHDVGVVHRDLKPENLLFTDENDNLEIKIIDFGFARLKPPDNQPLKTPCFTLHYAAPELLNQNGYDESCDLWSLGVILYTMLSGQVPFQSHDRSLTCTSAVEIMKKIKKGDFSFEGEAWKNVSQEAKDLIQGLLTVDPNKRLKMSGLRYNEWLQDGSQLSSNPLMTPDILGSSGAAVHTCVKATFHAFNKYKREGFCLQNVDKAPLAKRRKMKKTSTSTETRSSSSESSHSSSSHSHGKTTPTKTLQPSNPADSNNPETLFQFSDSVA

SEQ ID NO: 1571 - protein, 549 aa, Homo sapiens
MEEEGGSSGGAAGTSADGGDGGEQLLTVKHELRTANLTGHAEKVGIENFELLKVLGTGAYGKVFLVRKISGHDTGKLYAMKVLKKATIVQKAKTTEHTRTERQVLEHIRQSPFLVTLHYAFQTETKLHLILDYINGGELFTHLSQRERFTEHEVQIYVGEIVLALEHLHKLGIIYRDIKLENILLDSNGHVVLTDFGLSKEFVADETERAYSFCGTIEYMAPDIVRGGDSGHDKAVDWWSLGVLMYELLTGASPFTVDGEKNSQAEISRRILKSEPPYPQEMSALAKDLIQRLLMKDPKKRLGCGPRDADEIKEHLFFQKINWDDLAAKKVPAPFKPVIRDELDVSNFAEEFTEMDPTYSPAALPQSSEKLFQGYSFVAPSILFKRNAAVIDPLQFHMGVERPGVTNVARSAMMKDSPFYQHYDLDLKDKPLGEGSFSICRKCVHKKSNQAFAVKIISKRMEANTQKEITALKLCEGHPNIVKLHEVFHDQLHTFLVMELLNGGELFERIKKKKHFSETEASYIMRKLVSAVSHMHDVGVVHRDLKPEV

SEQ ID NO: 1572 - protein, 723 aa, Homo sapiens
MKVLKKATIVQKAKTTEHTRTERQVLEHIRQSPFLVTLHYAFQTETKLHLILDYINGGELFTHLSQRERFTEHEVQIYVGEIVLALEHLHKLGIIYRDIKLENILLDSNGHVVLTDFGLSKEFVADETERAYSFCGTIEYMAPDIVRGGDSGHDKAVDWWSLGVLMYELLTGASPFTVDGEKNSQAEISRRILKSEPPYPQEMSALAKDLIQRLLMKDPKKRLGCGPRDADEIKEHLFFQKINWDDLAAKKVPAPFKPVIRDELDVSNFAEEFTEMDPTYSPAALPQSSEKLFQGYSFVAPSILFKRNAAVIDPLQFHMGVERPGVTNVARSAMMKDSPFYQHYDLDLKDKPLGEGSFSICRKCVHKKSNQAFAVKIISKRMEANTQKEITALKLCEGHPNIVKLHEVFHDQLHTFLVMELLNGGELFERIKKKKHFSETEASYIMRKLVSAVSHMHDVGVVHRDLKPENLLFTDENDNLEIKIIDFGFARLKPPDNQPLKTPCFTLHYAAPELLNQNGYDESCDLWSLGVILYTMLSGQVPFQSHDRSLTCTSAVEIMKKIKKGDFSFEGEAWKNVSQEAKDLIQGLLTVDPNKRLKMSGLRYNEWLQDGSQLSSNPLMTPDILGSSGAAVHTCVKATFHAFNKYKREGFCLQNVDKAPLAKRRKMKKTSTSTETRSSSSESSHSSSSHSHGKTTPTKTLQPSNPADSNNPETLFQFSDSVA

SEQ ID NO: 1573 - protein, 745 aa, Homo sapiens
MLPFAPQDEPWDREMEVFSGGGASSGEVNGLKMVDEPMEEGEADSCHDEGVVKEIPITHHVKEGYEKADPAQFELLKVLGQGSFGKVFLVRKKTGPDAGQLYAMKVLKKASLKVRDRVRTKMERDILVEVNHPFIVKLHYAFQTEGKLYLILDFLRGGDVFTRLSKEVLFTEEDVKFYLAELALALDHLHQLGIVYRDLKPENILLDEIGHIKLTDFGLSKESVDQEKKAYSFCGTVEYMAPEVVNRRGHSQSADWWSYGVLMFEMLTGTLPFQGKDRNETMNMILKAKLGMPQFLSAEAQSLLRMLFKRNPANRLGSEGVEEIKRHLFFANIDWDKLYKREVQPPFKPASGKPDDTFCFDPEFTAKTPKDSPGLPASANAHQLFKGFSFVATSIAEEYKITPITSANVLPIVQINGNAAQFGEVYELKEDIGVGSYSVCKRCIHATTNMEFAVKIIDKSKRDPSEEIEILMRYGQHPNIITLKDVFDDGRYVYLVTDLMKGGELLDRILKQKCFSEREASDILYVISKTVDYLHCQGVVHRDLKPSNILYMDESASADSIRICDFGFAKQLRGENGLLLTPCYTANFVAPEVLMQQGYDAACDIWSLGVLFYTMLAGYTPFANGPNDTPEEILLRIGNGKFSLSGGNWDNISDGAKDLLSHMLHMDPHQRYTAEQILKHSWITHRDQLPNDQPKRNDVSHVVKGAMVATYSALTHKTFQPVLEPVAASSLAQRRSMKKRTSTGL

SEQ ID NO: 1574 - protein, 745 aa, Homo sapiens
MGLSTSAIWKNTRVEIVNPYEVKRKVKVNGLKMVDEPMEEGEADSCHDEGVVKEIPITHHVKEGYEKADPAQFELLKVLGQGSFGKVFLVRKKTGPDAGQLYAMKVLKKASLKVRDRVRTKMERDILVEVNHPFIVKLHYAFQTEGKLYLILDFLRGGDVFTRLSKEVLFTEEDVKFYLAELALALDHLHQLGIVYRDLKPENILLDEIGHIKLTDFGLSKESVDQEKKAYSFCGTVEYMAPEVVNRRGHSQSADWWSYGVLMFEMLTGTLPFQGKDRNETMNMILKAKLGMPQFLSAEAQSLLRMLFKRNPANRLGSEGVEEIKRHLFFANIDWDKLYKREVQPPFKPASGKPDDTFCFDPEFTAKTPKDSPGLPASANAHQLFKGFSFVATSIAEEYKITPITSANVLPIVQINGNAAQFGEVYELKEDIGVGSYSVCKRCIHATTNMEFAVKIIDKSKRDPSEEIEILMRYGQHPNIITLKDVFDDGRYVYLVTDLMKGGELLDRILKQKCFSEREASDILYVISKTVDYLHCQGVVHRDLKPSNILYMDESASADSIRICDFGFAKQLRGENGLLLTPCYTANFVAPEVLMQQGYDAACDIWSLGVLFYTMLAGYTPFANGPNDTPEEILLRIGNGKFSLSGGNWDNISDGAKDLLSHMLHMDPHQRYTAEQILKHSWITHRDQLPNDQPKRNDVSHVVKGAMVATYSALTHKTFQPVLEPVAASSLAQRRSMKKRTSTGL

SEQ ID NO: 1575 - protein, 541 aa, Homo sapiens
MSLVACECLPSPGLEPEPCSRARSQAHVYLEQIRNRVALGVPDMTKRDYLVDAATQIRLALERDVSEDYEAAFNHYQNGVDVLLRGIHVDPNKERREAVKLKITKYLRRAEEIFNCHLQRPLSSGASPSAVQLVQDPATGGTFVVKSLPRCHMVSRERLTIIPHGVPYMTKLLRYFVSEDSIFLHLEHVQGGTLWSHLLSQAHSRHSGLSSGSTQERMKAQLNPHLNLLTPARLPSGHAPGQDRIALEPPRTSPNLLLAGEAPSTRPQREAEGEPTARTSTSGSSDLPKAPGGHLHLQARRAGQNSDAGPPRGLTWVPEGAGPVLGGCGRGMDQSCLSADGAGRGCGRATWSVREEQVKQWAAEMLVALEALHEQGVLCRDLHPGNLLLDQAGHIRLTYFGQWSEVEPQCCGEAVDNLYSAPEVGGISELTEACDWWSFGSLLYELLTGMALSQSHPSGIQAHTQLQLPEWLSRPAASLLTELLQFEPTRRLGMGEGGVSKLKSHPFFSTIQWSKLVGTSLETHLRTLIHWLSGPKPDCPG

SEQ ID NO: 1576 - protein, 549 aa, Homo sapiens
MSLVACECLPSPGLEPEPCSRARSQAHVYLEQIRNRVALGVPDMTKRDYLVDAATQIRLALERDVSEDYEAAFNHYQNGVDVLLRGIHVDPNKERREAVKLKITKYLRRAEEIFNCHLQRPLSSGASPSAGFSSLRLRPIRTLSSAVEQLRGCRVVGVIEKVQLVQDPATGGTFVVKSLPRCHMVSRERLTIIPHGVPYMTKLLRYFVSEDSIFLHLEHVQGGTLWSHLLSQAHSRHSGLSSGSTQERMKAQLNPHLNLLTPARLPSGHAPGQDRIALEPPRTSPNLLLAGEAPSTRPQREAEGEPTARTSTSGSSDLPKAPGGHLHLQARRAGQNSDAGPPRGLTWVPEGAGPVLGGCGRGMDQSCLSADGAGRGCGRATWSVREEQVKQWAAEMLVALEALHEQGVLCRDLHPGNLLLDQAGHIRLTYFGQWSEVEPQCCGEAVDNLYSAPEVGGISELTEACDWWSFGSLLYELLTGMALSQSHPSGIQAHTQLQLPEWLSRPAASLLTELLQFEPTRRLGMGEGGVSKLKSHPFFSTIQWSKLVG

SEQ ID NO: 1577 - protein, 549 aa, Homo sapiens; identical to SEQ ID NO: 1576

SEQ ID NO: 1578 - protein, 9 aa, Homo sapiens
MSLVACECL

SEQ ID NO: 1579 - protein, 549 aa, Homo sapiens; identical to SEQ ID NO: 1576

SEQ ID NO: 1580 - protein, 605 aa, Homo sapiens
MLPQQVGFVCAVLALVCCASGLFGSLGHKTASASKRVLPDTWRNRKLMAPVNGTQTAKNCTDPAIHEFPTDLFSNKERQHGAVLLHILGALYMFYALAIVCDDFFVPSLEKICERLHLSEDVAGATFMAAGSSTPELFASVIGVFITHGDVGVGTIVGSAVFNILCIIGVCGLFAGQVVRLTWWAVCRDSVYYTISVIVLIVFIYDEQIVWWEGLVLIILYVFYILIMKYNVKMQAFFTVKQKSIANGNPVNSELEAGNDFYDGSYDDPSVPLLGQVKEKPQYGKNPVVMVDEIMSSSPPKFTFPEAGLRIMITNKFGPRTRLRMASRIIINERQRLINSANGVSSKPLQNGRHENIENGNVPVENPEDPQQNQEQQPPPQPPPPEPEPVEADFLSPFSVPEARGDKVKWVFTWPLIFLLCVTIPNCSKPRWEKFFMVTFITATLWIAVFSYIMVWLVTIIGYTLGIPDVIMGITFLAAGTSVPDCMASLIVARQGLGDMAVSNTIGSNVFDILVGLGVPWGLQTMVVNYGSTVKINSRGLVYSVVLLLGSVALTVLGIHLNKWRLDRKLGVYVLVLYAIFLCFSIMIEFNVFTFVNLPMCREDD

SEQ ID NO: 1581 - protein, 352 aa, Homo sapiens
MFYALAIVCDDFFVPSLEKICERLHLSEDVAGATFMAAGSSTPELFASVIGVFITHGDVGVGTISVSFALQFIYDEQIVWWEGLVLIILYVFYILIMKYNVKMQAFFTVKQKSIANGNPVNSELEAGNDFYDGSYDDPSVPLLGQVKEKPQYGKNPVVMVDEIMSSSPPKFTFPEAGLRIMITNKFGPRTRLRMASRIIINERQRLINSANGVSSKPLQNGRHENIENGNVPVENPEDPQQNQEQQPPPQPPPPEPEPVEADFLSPFSVPEARGDKVKWVFTWPLIFLLCVTIPNCSKPRWEKFFMVTFITATLWIAVFSYIMVWLEQREGKQFQHGCSSVDCETHSQPLTP

SEQ ID NO: 1582 - protein, 586 aa, Homo sapiens
MLPQQVGFVCAVLALVCCASGLFGSLGHKTASASKRVLPDTWRNRKLMAPVNGTQTAKNCTDPAIHEFPTDLFSNKERQHGAVLLHILGALYMFYALAIVCDDFFVPSLEKICERLHLSEDVAGATFMAAGSSTPELFASVIGVFITHGDVGVGTIVGSAVFNILCIIGVCGLFAGQVVRLTWWAVCRDSVYYTISVIVLIVFIYDEQIVWWEGLVLIILYVFYILIMKYNVKMQAFFTVKQKSIANGNPVNSELEAVKEKPQYGKNPVVMVDEIMSSSPPKFTFPEAGLRIMITNKFGPRTRLRMASRIIINERQRLINSANGVSSKPLQNGRHENIENGNVPVENPEDPQQNQEQQPPPQPPPPEPEPVEADFLSPFSVPEARGDKVKWVFTWPLIFLLCVTIPNCSKPRWEKFFMVTFITATLWIAVFSYIMVWLVTIIGYTLGIPDVIMGITFLAAGTSVPDCMASLIVARQGLGDMAVSNTIGSNVFDILVGLGVPWGLQTMVVNYGSTVKINSRGLVYSVVLLLGSVALTVLGIHLNKWRLDRKLGVYVLVLYAIFLCFSIMIEFNVFTFVNLPMCREDD

SEQ ID NO: 1583 - protein, 558 aa, Homo sapiens
MAPVNGTQTAKNCTDPAIHEFPTDLFSNKERQHGAVLLHILGALYMFYALAIVCDDFFVPSLEKICERLHLSEDVAGATFMAAGSSTPELFASVIGVFITHGDVGVGTIVGSAVFNILCIIGVCGLFAGQVVRLTWWAVCRDSVYYTISVIVLIVFIYDEQIVWWEGLVLIILYVFYILIMKYNVKMQAFFTVKQKSIANGNPVNSELEAGNDFYDGSYDDPSVPLLGQVKEKPQYGKNPVVMVDEIMSSSPPKFTFPEAGLRIMITNKFGPRTRLRMASRIIINERQRLINSANGVSSKPLQNGRHENIENGNVPVENPEDPQQNQEQQPPPQPPPPEPEPVEADFLSPFSVPEARGDKVKWVFTWPLIFLLCVTIPNCSKPRWEKFFMVTFITATLWIAVFSYIMVWLVTIIGYTLGIPDVIMGITFLAAGTSVPDCMASLIVARQGLGDMAVSNTIGSNVFDILVGLGVPWGLQTMVVNYGSTVKINSRGLVYSVVLLLGSVALTVLGIHLNKWRLDRKLGVYVLVLYAIFLCFSIMIEFNVFTFVNLPMCREDD

SEQ ID NO: 1584 - protein, 603 aa, Homo sapiens
MALRGTLRPLKVRRRREMLPQQVGFVCAVLALVCCASGLFGSLGHKTASASKRVLPDTWRNRKLMAPVNGTQTAKNCTDPAIHEFPTDLFSNKERQHGAVLLHILGALYMFYALAIVCDDFFVPSLEKICERLHLSEDVAGATFMAAGSSTPELFASVIGVFITHGDVGVGTIVGSAVFNILCIIGVCGLFAGQVVRLTWWAVCRDSVYYTISVIVLIVFIYDEQIVWWEGLVLIILYVFYILIMKYNVKMQAFFTVKQKSIANGNPVNSELEAVKEKPQYGKNPVVMVDEIMSSSPPKFTFPEAGLRIMITNKFGPRTRLRMASRIIINERQRLINSANGVSSKPLQNGRHENIENGNVPVENPEDPQQNQEQQPPPQPPPPEPEPVEADFLSPFSVPEARGDKVKWVFTWPLIFLLCVTIPNCSKPRWEKFFMVTFITATLWIAVFSYIMVWLVTIIGYTLGIPDVIMGITFLAAGTSVPDCMASLIVARQGLGDMAVSNTIGSNVFDILVGLGVPWGLQTMVVNYGSTVKINSRGLVYSVVLLLGSVALTVLGIHLNKWRLDRKLGVYVLVLYAIFLCFSIMIEFNVFTFVNLPMCREDD

SEQ ID NO: 1585 - protein, 622 aa, Homo sapiens
MALRGTLRPLKVRRRREMLPQQVGFVCAVLALVCCASGLFGSLGHKTASASKRVLPDTWRNRKLMAPVNGTQTAKNCTDPAIHEFPTDLFSNKERQHGAVLLHILGALYMFYALAIVCDDFFVPSLEKICERLHLSEDVAGATFMAAGSSTPELFASVIGVFITHGDVGVGTIVGSAVFNILCIIGVCGLFAGQVVRLTWWAVCRDSVYYTISVIVLIVFIYDEQIVWWEGLVLIILYVFYILIMKYNVKMQAFFTVKQKSIANGNPVNSELEAGNDFYDGSYDDPSVPLLGQVKEKPQYGKNPVVMVDEIMSSSPPKFTFPEAGLRIMITNKFGPRTRLRMASRIIINERQRLINSANGVSSKPLQNGRHENIENGNVPVENPEDPQQNQEQQPPPQPPPPEPEPVEADFLSPFSVPEARGDKVKWVFTWPLIFLLCVTIPNCSKPRWEKFFMVTFITATLWIAVFSYIMVWLVTIIGYTLGIPDVIMGITFLAAGTSVPDCMASLIVARQGLGDMAVSNTIGSNVFDILVGLGVPWGLQTMVVNYGSTVKINSRGLVYSVVLLLGSVALTVLGIHLNKWRLDRKLGVYVLVLYAIFLCFSIMIEFNVFTFVNLPMCREDD

SEQ ID NO: 1586 - protein, 500 aa, Homo sapiens
MQTKGGQTWARRALLLGILWATAHLPLSGTSLPQRLPRATGNSTQCVISPSSEFPEGFFTRQERRDGGIIIYFLIIVYMFMAISIVCDEYFLPSLEIISESLGLSQDVAGTTFMAAGSSAPELVTAFLGVFITKGDIGISTILGSAIYNLLGICAACGLLSNTVSTLSCWPLFRDCAAYTISAAAVLGIIYDNQVYWYEGALLLLIYGLYVLVLCFDIKINQYIIKKCSPCCACLAKAMERSEQQPLMGWEDEGQPFIRRQSRTDSGIFYEDSGYSQLSISLHGLSQVSEDPPSVFNMPEADLKRIFWVLSLPIITLLFLTTPDCRKKFWKNYFVITFFMSAIWISAFTYILVWMVTITGETLEIPDTVMGLTLLAAGTSIPDTIASVLVARKGKGDMAMSNIVGSNVFDMLCLGIPWFIKTAFINGSAPAEVNSRGLTYITISLNISIIFLFLAVHFNGWKLDRKLGIVCLLSYLGLATLSVLYELGIIGNNKIRGCGG

SEQ ID NO: 1587 - protein, 440 aa, Homo sapiens
MQTKGGQTWARRALLLGILWATAHLPLSGTSLPQRLPRATALGLSQDVAGTTFMAAGSSAPELVTAFLGVFITKGDIGISTILGSAIYNLLGICAACGLLSNTVSTLSCWPLFRDCAAYTISAAAVLGIIYDNQVYWYEGALLLLIYGLYVLVLCFDIKINQYIIKKCSPCCACLAKAMERSEQQPLMGWEDEGQPFIRRQSRTDSGIFYEDSGYSQLSISLHGLSQVSEDPPSVFNMPEADLKRIFWVLSLPIITLLFLTTPDCRKKFWKNYFVITFFMSAIWISAFTYILVWMVTITGETLEIPDTVMGLTLLAAGTSIPDTIASVLVARKGKGDMAMSNIVGSNVFDMLCLGIPWFIKTAFINGSAPAEVNSRGLTYITISLNISIIFLFLAVHFNGWKLDRKLGIVCLLSYLGLATLSVLYELGIIGNNKIRGCGG

SEQ ID NO: 1588 - protein, 183 aa, Homo sapiens
MLSRAVCGTSRQLAPVLGYLGSRQKHSLPDLPYDYGALEPHINAQIMQLHHSKHHAAYVNNLNVTEEKYQEALAKGELLEAIKRDFGSFDKFKEKLTAASVGVQGSGWGWLGFNKERGHLQIAACPNQDPLQGTTGLIPLLGIDVWEHAYYLQYKNVRPDYLKAIWNVINWENVTERYMACKK

SEQ ID NO: 1589 - protein, 183 aa, Homo sapiens; identical to SEQ ID NO: 1588

SEQ ID NO: 1590 - protein, 222 aa, Homo sapiens
MLSRAVCGTSRQLAPVLGYLGSRQKHSLPDLPYDYGALEPHINAQIMQLHHSKHHAAYVNNLNVTEEKYQEALAKGDVTAQIALQPALKFNGGGHINHSIFWTNLSPNGGGEPKGELLEAIKRDFGSFDKFKEKLTAASVGVQGSGWGWLGFNKERGHLQIAACPNQDPLQGTTGLIPLLGIDVWEHAYYLQYKNVRPDYLKAIWNVINWENVTERYMACKK

SEQ ID NO: 1591 - protein, 222 aa, Homo sapiens; identical to SEQ ID NO: 1590

SEQ ID NO: 1592 - protein, 176 aa, Homo sapiens
MQLHHSKHHAAYVNNLNVTEEKYQEALAKGDVTAQIALQPALKFNGGGHINHSIFWTNLSPNGGGEPKGELLEAIKRDFGSFDKFKEKLTAASVGVQGSGWGWLGFNKERGHLQIAACPNQDPLQGTTGLIPLLGIDVWEHAYYLQYKNVRPDYLKAIWNVINWENVTERYMACKK

SEQ ID NO: 1593 - protein, 240 aa, Homo sapiens
MLALLCSCLLLAAGASDAWTGEDSAEPNSDSAEWIRDMYAKVTEIWQEVMQRRDDDGALHAACQVQPSATLDAAQPRVTGVVLFRQLAPRAKLDAFFALEGFPTEPNSSSRAIHVHQFGDLSQGCESTGPHYNPLAVPHPQHPGDFGNFAVRDGSLWRYRAGLAASLAGPHSIVGRAVVVHAGEDDLGRGGNQASVENGNAGRRLACCVVGVCGPGLWERQAREHSERKKRRRESECKAA

SEQ ID NO: 1594 - protein, 129 aa, Homo sapiens
MKILVALAVFFLVSTQLFAEEIGANDDLNYWSDWYDSDQIKEELPEPFEHLLQRIARRPKPQQFFGLMGKRDADSSIEKQVALLKALYGHGQISHKRHKTDSFVGLMGKRALNSVAYERSAMQNYERRR

SEQ ID NO: 1595 - protein, 114 aa, Homo sapiens
MKILVALAVFFLVSTQLFAEEIGANDDLNYWSDWYDSDQIKEELPEPFEHLLQRIARRPKPQQFFGLMGKRDAGHGQISHKRHKTDSFVGLMGKRALNSVAYERSAMQNYERRR

SEQ ID NO: 1596 - protein, 111 aa, Homo sapiens
MKILVALAVFFLVSTQLFAEEIGANDDLNYWSDWYDSDQIKEELPEPFEHLLQRIARRPKPQQFFGLMGKRDADSSIEKQVALLKALYGHGQISHKMAYERSAMQNYERRR

SEQ ID NO: 1597 - protein, 138 aa, Homo sapiens
MTALFLMSMLFGLTCGQAMSFCIPTEYTMHIERRECAYCLTINTTICAGYCMTRDINGKLFLPKYALSQDVCTYRDFIYRTVEIPGCPLHVAPYFSYPVALSCKCGKCNTDYSDCIHEAIKTNYCTKPQKSYLVGFSV

SEQ ID NO: 1598 - protein, 138 aa, Homo sapiens; identical to SEQ ID NO: 1597

SEQ ID NO: 1599 - protein, 805 aa, Homo sapiens
MAQPLAFILDVPETPGDQGQGPSPYDESEVHDSFQQLIQEQSQCTAQEGLELQQREREVTGSSQQTLWRPEGTQSTATLRILASMPSRTIGRSRGAIISQYYNRTVQLRCRSSRPLLGNFVRSAWPSLRLYDLELDPTALEEEEKQSLLVKELQSLAVAQRDHMLRGMPLSLAEKRSLREKSRTPRGKWRGQPGSGGVCSCCGRLRYACVLALHSLGLALLSALQALMPWRYALKRIGGQFGSSVLSYFLFLKTLLAFNALLLLLLVAFIMGPQVAFPPALPGPAPVCTGLELLTGAGCFTHTVMYYGHYSNATLNQPCGSPLDGSQCTPRVGGLPYNMPLAYLSTVGVSFFITCITLVYSMAHSFGESYRVGSTSGIHAITVFCSWDYKVTQKRASRLQQDNIRTRLKELLAEWQLRHSPRSVCGRLRQAAVLGLVWLLCLGTALGCAVAVHVFSEFMIQSPEAAGQEAVLLVLPLVVGLLNLGAPYLCRVLAALEPHDSPVLEVYVAICRNLILKLAILGTLCYHWLGRRVGVLQGQCWEDFVGQELYRFLVMDFVLMLLDTLFGELVWRIISEKKLKRRRKPEFDIARNVLELIYGQTLTWLGVLFSPLLPAVQIIKLLLVFYVKKTSLLANCQAPRRPWLASHMSTVFLTLLCFPAFLGAAVFLCYAVWQVKPSSTCGPFRTLDTMYEAGRVWVRHLEAAGPRVSWLPWVHRYLMENTFFVFLVSALLLAVIYLNIQVVRGQRKVICLLKEQISNEGEDKIFLINKLHSIYERKEREERSRVGTTEEAAAPPALLTDEQDA

SEQ ID NO: 1600 - protein, 287 aa, Homo sapiens
MLLPRSVSSERAPGVPEPEELWEAEMERLRGSGTPVRGLPYAMMDKRLIWQLREPAGVQTLRWQRWQRRRQTVERRLREAAQRLARGLGLWEGALYEIGGLFGTGIRSYFTFLRFLLLLNLLSLLLTASFVLLPLVWLRPPDPGPTLNLTLQCPGSRQSPPGVLRFHNQLWHVLTGRAFTNTYLFYGAYRVGPESSSVYSIRLAYLLSPLACLLLCFCGTLRRLLSTLASGPGAGGPWAPAHWPACPPLPGLPRLQLPPPHHAQVLRAAGAMGGDTWRGRSFLPWGW

SEQ ID NO: 1601 - protein, 726 aa, Homo sapiens
MLLPRSVSSERAPGVPEPEELWEAEMERLRGSGTPVRGLPYAMMDKRLIWQLREPAGVQTLRWQRWQRRRQTVERRLREAAQRLARGLGLWEGALYEIGGLFGTGIRSYFTFLRFLLLLNLLSLLLTASFVLLPLVWLRPPDPGPTLNLTLQCPGSRQSPPGVLRFHNQLWHVLTGRAFTNTYLFYGAYRVGPESSSVYSIRLAYLLSPLACLLLCFCGTLRRMVKGLPQKTLLGQGYQAPLSAKVFSSWDFCIRVQEAATIKKHEISNEFKVELEEGRRFQLMQQQTRAQTACRLLSYLRVNVLNGLLVVGAISAIFWATKYSQDNKEESLFLLLQYLPPGVIALVNFLGPLLFTFLVQLENYPPNTEVNLTLIWCVVLKLASLGMFSVSLGQTILCIGRDKSSCESYGYNVCDYQCWENSVGEELYKLSIFNFLLTVAFAFLVTLPRRLLVDRFSGRFWAWLEREEFLVPKNVLDIVAGQTVTWMGLFYCPLLPLLNSVFLFLTFYIKKYTLLKNSRASSRPFRASSSTFFFQLVLLLGLLLAAVPLGYVVSSIHSSWDCGLFTNYSAPWQVVPELVALGLPPIGQRALHYLGSHAFSFPLLIMLSLVLTVCVSQTQANARAIHRLRKQLVWQVQEKWHLVEDLSRLLPEPGPSDSPGPKYPASQASRPQSFCPGCPCPGSPGHQAPRPGPSVVDAAGLRSPCPGQHGAPASARRFRFPSGAEL

SEQ ID NO: 1602 - protein, 233 aa, Homo sapiens
MSTESMIRDVELAEEALPKKTGGPQGSRRCLFLSLFSFLIVAGATTLFCLLHFGVIGPQREEFPRDLSLISPLAQAVRSSSRTPSDKPVAHVVANPQAEGQLQWLNRRANALLANGVELRDNQLVVPSEGLYLIYSQVLFKGQGCPSTHVLLTHTISRIAVSYQTKVNLLSAIKSPCQRETPEGAEAKPWYEPIYLGGVFQLEKGDRLSAEINRPDYLDFAESGQVYFGIIAL

SEQ ID NO: 1603 - protein, 233 aa, Homo sapiens; identical to SEQ ID NO: 1602

SEQ ID NO: 1604 - protein, 233 aa, Homo sapiens; identical to SEQ ID NO: 1602

SEQ ID NO: 1605 - protein, 233 aa, Homo sapiens; identical to SEQ ID NO: 1602

SEQ ID NO: 1606 - protein, 233 aa, Homo sapiens; identical to SEQ ID NO: 1602

SEQ ID NO: 1607 - protein, 233 aa, Homo sapiens; identical to SEQ ID NO: 1602

SEQ ID NO: 1608 - protein, 233 aa, Homo sapiens; identical to SEQ ID NO: 1602

SEQ ID NO: 1609 - protein, 246 aa, Homo sapiens
MAQVPPPASGERHAGTEDGPIRRNPAGNVARPMVQRLPEPQDVAQCLEVGLFDTPPFYSNSTNSFRNTVEGNDPTGKYDPAVRSLHNLAHLFLNGTGGQTHLSPNDPIFVLLHTFTDAVFDEWLRRYNADISTFPLENAPIGHNRQYNMVPFWPPVTNTEMFVTAPDNLGYTYEIQWPSREFSVPEIIAIAVVGALLLVALIFGTASYLIRARRSMDEANQPLLTDQYQCYAEEYEKLQNPNQSVV

SEQ ID NO: 1610 - protein, 537 aa, Homo sapiens
MSAPKLLSLGCIFFPLLLFQQARAQFPRQCATVEALRSGMCCPDLSPVSGPGTDRCGSSSGRGRCEAVTADSRPHSPQYPHDGRDDREVWPLRFFNRTCHCNGNFSGHNCGTCRPGWRGAACDQRVLIVRRNLLDLSKEEKNHFVRALDMAKRTTHPLFVIATRRSEEILGPDGNTPQFENISIYNYFVWTHYYSVKKTFLGVGQESFGEVDFSHEGPAFLTWHRYHLLRLEKDMQEMLQEPSFSLPYWNFATGKNVCDICTDDLMGSRSNFDSTLISPNSVFSQWRVVCDSLEDYDTLGTLCNSTEDGPIRRNPAGNVARPMVQRLPEPQDVAQCLEVGLFDTPPFYSNSTNSFRNTVEGYSDPTGKYDPAVRSLHNLAHLFLNGTGGQTHLSPNDPIFVLLHTFTDAVFDEWLRRYNADISTFPLENAPIGHNRQYNMVPFWPPVTNTEMFVTAPDNLGYTYEIQWPSREFSVPEIIAIAVVGALLLVALIFGTASYLIRARRSMDEANQPLLTDQYQCYAEEYEKLQNPNQSVV

SEQ ID NO: 1611 - protein, 102 aa, Homo sapiens
MSAPKLLSLGCIFFPLLLFQQARAQFPRQCATVEALRSGMCCPDLSPVSGPGTDRCGSSSGRGRCEAVTADSRPHSPQYPHDGRDDREVWPLRFFNRTCHCN

SEQ ID NO: 1612 - DNA, 1128 bp, Homo sapiens
atggaggaggagatcgccgccctggtgatcgacaacggcagcggcatgtgcaaggccggcttcgccggcgacgacgcccccagagccgtgttccccagcatcgtgggcagacccagacaccagggcgtgatggtgggcatgggccagaaggacagctacgtgggcgacgaggcccagagcaagagaggcatcctgaccctgaagtaccccatcgagcacggcatcgtgaccaactgggacgacatggagaagatctggcaccacaccttctacaacgagctgagagtggcccccgaggagcaccccgtgctgctgaccgaggcccccctgaaccccaaggccaacagagagaagatgacccagatcatgttcgagaccttcaacacccccgccatgtacgtggccatccaggccgtgctgagcctgtacgccagcggcagaaccaccggcatcgtgatggacagcggcgacggcgtgacccacaccgtgcccatctacgagggctacgccctgccccacgccatcctgagactggacctggccggcagagacctgaccgactacctgatgaagatcctgaccgagagaggctacagcttcaccaccaccgccgagagagagatcgtgagagacatcaaggagaagctgtgctacgtggccctggacttcgagcaggagatggccaccgccgccagcagcagcagcctggagaagagctacgagctgcccgacggccaggtgatcaccatcggcaacgagagattcagatgccccgaggccctgttccagcccagcttcctgggcatggagagctgcggcatccacgagaccaccttcaacagcatcatgaagtgcgacgtggacatcagaaaggacctgtacgccaacaccgtgctgagcggcggcaccaccatgtaccccggcatcgccgacagaatgcagaaggagatcaccgccctggcccccagcaccatgaagatcaagatcatcgccccccccgagagaaagtacagcgtgtggatcggcggcagcatcctggccagcctgagcaccttccagcagatgtggatcagcaagcaggagtacgacgagagcggccccagcatcgtgcacagaaagtgcttctag

SEQ ID NO: 1613 - DNA, 1599 bp, Homo sapiens
atgccccagctgtacatctacatcagactgctgggcgcctacctgttcatcatcagcagagtgcagggccagaacctggacagcatgctgcacggcaccggcatgaagagcgacagcgaccagaagaagagcgagaacggcgtgaccctggcccccgaggacaccctgcccttcctgaagtgctactgcagcggccactgccccgacgacgccatcaacaacacctgcatcaccaacggccactgcttcgccatcatcgaggaggacgaccagggcgagaccaccctggccagcggctgcatgaagtacgagggcagcgacttccagtgcaaggacagccccaaggcccagctgagaagaaccatcgagtgctgcagaaccaacctgtgcaaccagtacctgcagcccaccctgccccccgtggtgatcggccccttcttcgacggcagcatcagatggctggtgctgctgatcagcatggccgtgtgcatcatcgccatgatcatcttcagcagctgcttctgctacaagcactactgcaagagcatcagcagcagaagaagatacaacagagacctggagcaggacgaggccttcatccccgtgggcgagagcctgaaggacctgatcgaccagagccagagcagcggcagcggcagcggcctgcccctgctggtgcagagaaccatcgccaagcagatccagatggtgagacaggtgggcaagggcagatacggcgaggtgtggatgggcaagtggagaggcgagaaggtggccgtgaaggtgttcttcaccaccgaggaggccagctggttcagagagaccgagatctaccagaccgtgctgatgagacacgagaacatcctgggcttcatcgccgccgacatcaagggcaccggcagctggacccagctgtacctgatcaccgactaccacgagaacggcagcctgtacgacttcctgaagtgcgccaccctggacaccagagccctgctgaagctggcctacagcgccgcctgcggcctgtgccacctgcacaccgagatctacggcacccagggcaagcccgccatcgcccacagagacctgaagagcaagaacatcctgatcaagaagaacggcagctgctgcatcgccgacctgggcctggccgtgaagttcaacagcgacaccaacgaggtggacgtgcccctgaacaccagagtgggcaccaagagatacatggcccccgaggtgctggacgagagcctgaacaagaaccacttccagccctacatcatggccgacatctacagcttcggcctgatcatctgggagatggccagaagatgcatcaccggcggcatcgtggaggagtaccagctgccctactacaacatggtgcccagcgaccccagctacgaggacatgagagaggtggtgtgcgtgaagagactgagacccatcgtgagcaacagatggaacagcgacgagtgcctgagagccgtgctgaagctgatgagcgagtgctgggcccacaaccccgccagcagactgaccgccctgagaatcaagaagaccctggccaagatggtggagagccaggacgtgaagatctag

SEQ ID NO: 1614 - DNA, 456 bp, Homo sapiens
atgtgcgaggaggaggacagcaccgccctggtgtgcgacaacggcagcggcctgtgcaaggccggcttcgccggcgacgacgcccccagagccgtgttccccagcatcgtgggcagacccagacaccagggcgtgatggtgggcatgggccagaaggacagctacgtgggcgacgaggcccagagcaagagaggcatcctgaccctgaagtaccccatcgagcacggcatcatcaccaactgggacgacatggagaagatctggcaccacagcttctacaacgagctgagagtggcccccgaggagcaccccaccctgctgaccgaggcccccctgaaccccaaggccaacagagagaagatgacccagatcatgttcgagaccttcaacgtgcccgccatgtacgtggccatccaggccgtgctgagcctgtacgccagcggcagaaccacctag

SEQ ID NO: 1615 - DNA, 456 bp, Homo sapiens; identical to SEQ ID NO: 1614

SEQ ID NO: 1616 - DNA, 1134 bp, Homo sapiens
atgtgcgaggaggaggacagcaccgccctggtgtgcgacaacggcagcggcctgtgcaaggccggcttcgccggcgacgacgcccccagagccgtgttccccagcatcgtgggcagacccagacaccagggcgtgatggtgggcatgggccagaaggacagctacgtgggcgacgaggcccagagcaagagaggcatcctgaccctgaagtaccccatcgagcacggcatcatcaccaactgggacgacatggagaagatctggcaccacagcttctacaacgagctgagagtggcccccgaggagcaccccaccctgctgaccgaggcccccctgaaccccaaggccaacagagagaagatgacccagatcatgttcgagaccttcaacgtgcccgccatgtacgtggccatccaggccgtgctgagcctgtacgccagcggcagaaccaccggcatcgtgctggacagcggcgacggcgtgacccacaacgtgcccatctacgagggctacgccctgccccacgccatcatgagactggacctggccggcagagacctgaccgactacctgatgaagatcctgaccgagagaggctacagcttcgtgaccaccgccgagagagagatcgtgagagacatcaaggagaagctgtgctacgtggccctggacttcgagaacgagatggccaccgccgccagcagcagcagcctggagaagagctacgagctgcccgacggccaggtgatcaccatcggcaacgagagattcagatgccccgagaccctgttccagcccagcttcatcggcatggagagcgccggcatccacgagaccacctacaacagcatcatgaagtgcgacatcgacatcagaaaggacctgtacgccaacaacgtgctgagcggcggcaccaccatgtaccccggcatcgccgacagaatgcagaaggagatcaccgccctggcccccagcaccatgaagatcaagatcatcgccccccccgagagaaagtacagcgtgtggatcggcggcagcatcctggccagcctgagcaccttccagcagatgtggatcagcaagcaggagtacgacgaggccggccccagcatcgtgcacagaaagtgcttctag

SEQ ID NO: 1617 - DNA, 999 bp, Homo sapiens
atggtgggcatgggccagaaggacagctacgtgggcgacgaggcccagagcaagagaggcatcctgaccctgaagtaccccatcgagcacggcatcatcaccaactgggacgacatggagaagatctggcaccacagcttctacaacgagctgagagtggcccccgaggagcaccccaccctgctgaccgaggcccccctgaaccccaaggccaacagagagaagatgacccagatcatgttcgagaccttcaacgtgcccgccatgtacgtggccatccaggccgtgctgagcctgtacgccagcggcagaaccaccggcatcgtgctggacagcggcgacggcgtgacccacaacgtgcccatctacgagggctacgccctgccccacgccatcatgagactggacctggccggcagagacctgaccgactacctgatgaagatcctgaccgagagaggctacagcttcgtgaccaccgccgagagagagatcgtgagagacatcaaggagaagctgtgctacgtggccctggacttcgagaacgagatggccaccgccgccagcagcagcagcctggagaagagctacgagctgcccgacggccaggtgatcaccatcggcaacgagagattcagatgccccgagaccctgttccagcccagcttcatcggcatggagagcgccggcatccacgagaccacctacaacagcatcatgaagtgcgacatcgacatcagaaaggacctgtacgccaacaacgtgctgagcggcggcaccaccatgtaccccggcatcgccgacagaatgcagaaggagatcaccgccctggcccccagcaccatgaagatcaagatcatcgccccccccgagagaaagtacagcgtgtggatcggcggcagcatcctggccagcctgagcaccttccagcagatgtggatcagcaagcaggagtacgacgaggccggccccagcatcgtgcacagaaagtgcttctag

SEQ ID NO: 1618 - DNA, 1134 bp, Homo sapiens
atgtgcgacgacgaggagaccaccgccctggtgtgcgacaacggcagcggcctggtgaaggccggcttcgccggcgacgacgcccccagagccgtgttccccagcatcgtgggcagacccagacaccagggcgtgatggtgggcatgggccagaaggacagctacgtgggcgacgaggcccagagcaagagaggcatcctgaccctgaagtaccccatcgagcacggcatcatcaccaactgggacgacatggagaagatctggcaccacaccttctacaacgagctgagagtggcccccgaggagcaccccaccctgctgaccgaggcccccctgaaccccaaggccaacagagagaagatgacccagatcatgttcgagaccttcaacgtgcccgccatgtacgtggccatccaggccgtgctgagcctgtacgccagcggcagaaccaccggcatcgtgctggacagcggcgacggcgtgacccacaacgtgcccatctacgagggctacgccctgccccacgccatcatgagactggacctggccggcagagacctgaccgactacctgatgaagatcctgaccgagagaggctacagcttcgtgaccaccgccgagagagagatcgtgagagacatcaaggagaagctgtgctacgtggccctggacttcgagaacgagatggccaccgccgccagcagcagcagcctggagaagagctacgagctgcccgacggccaggtgatcaccatcggcaacgagagattcagatgccccgagaccctgttccagcccagcttcatcggcatggagagcgccggcatccacgagaccacctacaacagcatcatgaagtgcgacatcgacatcagaaaggacctgtacgccaacaacgtgctgagcggcggcaccaccatgtaccccggcatcgccgacagaatgcagaaggagatcaccgccctggcccccagcaccatgaagatcaagatcatcgccccccccgagagaaagtacagcgtgtggatcggcggcagcatcctggccagcctgagcaccttccagcagatgtggatcagcaagcaggagtacgacgaggccggccccagcatcgtgcacagaaagtgcttctag

SEQ ID NO: 1619 - DNA, 1029 bp, Homo sapiens
atgtgcgacgacgaggagaccaccgccctggtgtgcgacaacggcagcggcctggtgaaggccggcttcgccggcgacgacgcccccagagccgtgttccccagcatcgtgggcagacccagacaccagggcgtgatggtgggcatgggccagaaggacagctacgtgggcgacgaggcccagagcaagagaggcatcctgaccctgaagtaccccatcgagcacggcatcatcaccaaggccaacagagagaagatgacccagatcatgttcgagaccttcaacgtgcccgccatgtacgtggccatccaggccgtgctgagcctgtacgccagcggcagaaccaccggcatcgtgctggacagcggcgacggcgtgacccacaacgtgcccatctacgagggctacgccctgccccacgccatcatgagactggacctggccggcagagacctgaccgactacctgatgaagatcctgaccgagagaggctacagcttcgtgaccaccgccgagagagagatcgtgagagacatcaaggagaagctgtgctacgtggccctggacttcgagaacgagatggccaccgccgccagcagcagcagcctggagaagagctacgagctgcccgacggccaggtgatcaccatcggcaacgagagattcagatgccccgagaccctgttccagcccagcttcatcggcatggagagcgccggcatccacgagaccacctacaacagcatcatgaagtgcgacatcgacatcagaaaggacctgtacgccaacaacgtgctgagcggcggcaccaccatgtaccccggcatcgccgacagaatgcagaaggagatcaccgccctggcccccagcaccatgaagatcaagatcatcgccccccccgagagaaagtacagcgtgtggatcggcggcagcatcctggccagcctgagcaccttccagcagatgtggatcagcaagcaggagtacgacgaggccggccccagcatcgtgcacagaaagtgcttctag

SEQ ID NO: 1620 - DNA, 885 bp, Homo sapiens
atggagaagatctggcaccacaccttctacaacgagctgagagtggcccccgaggagcaccccgtgctgctgaccgaggcccccctgaaccccaaggccaacagagagaagatgacccagatcatgttcgagaccttcaacacccccgccatgtacgtggccatccaggccgtgctgagcctgtacgccagcggcagaaccaccggcatcgtgatggacagcggcgacggcgtgacccacaccgtgcccatctacgagggctacgccctgccccacgccatcctgagactggacctggccggcagagacctgaccgactacctgatgaagatcctgaccgagagaggctacagcttcaccaccaccgccgagagagagatcgtgagagacatcaaggagaagctgtgctacgtggccctggacttcgagcaggagatggccaccgccgccagcagcagcagcctggagaagagctacgagctgcccgacggccaggtgatcaccatcggcaacgagagattcagatgccccgaggccctgttccagcccagcttcctgggcatggagagctgcggcatccacgagaccaccttcaacagcatcatgaagtgcgacgtggacatcagaaaggacctgtacgccaacaccgtgctgagcggcggcaccaccatgtaccccggcatcgccgacagaatgcagaaggagatcaccgccctggcccccagcaccatgaagatcaagatcatcgccccccccgagagaaagtacagcgtgtggatcggcggcagcatcctggccagcctgagcaccttccagcagatgtggatcagcaagcaggagtacgacgagagcggccccagcatcgtgcacagaaagtgcttctag

SEQ ID NO: 1621 - DNA, 1128 bp, Homo sapiens
atggacgacgacatcgccgccctggtggtggacaacggcagcggcatgtgcaaggccggcttcgccggcgacgacgcccccagagccgtgttccccagcatcgtgggcagacccagacaccagggcgtgatggtgggcatgggccagaaggacagctacgtgggcgacgaggcccagagcaagagaggcatcctgaccctgaagtaccccatcgagcacggcatcgtgaccaactgggacgacatggagaagatctggcaccacaccttctacaacgagctgagagtggcccccgaggagcaccccgtgctgctgaccgaggcccccctgaaccccaaggccaacagagagaagatgacccagatcatgttcgagaccttcaacacccccgccatgtacgtggccatccaggccgtgctgagcctgtacgccagcggcagaaccaccggcatcgtgatggacagcggcgacggcgtgacccacaccgtgcccatctacgagggctacgccctgccccacgccatcctgagactggacctggccggcagagacctgaccgactacctgatgaagatcctgaccgagagaggctacagcttcaccaccaccgccgagagagagatcgtgagagacatcaaggagaagctgtgctacgtggccctggacttcgagcaggagatggccaccgccgccagcagcagcagcctggagaagagctacgagctgcccgacggccaggtgatcaccatcggcaacgagagattcagatgccccgaggccctgttccagcccagcttcctgggcatggagagctgcggcatccacgagaccaccttcaacagcatcatgaagtgcgacgtggacatcagaaaggacctgtacgccaacaccgtgctgagcggcggcaccaccatgtaccccggcatcgccgacagaatgcagaaggagatcaccgccctggcccccagcaccatgaagatcaagatcatcgccccccccgagagaaagtacagcgtgtggatcggcggcagcatcctggccagcctgagcaccttccagcagatgtggatcagcaagcaggagtacgacgagagcggccccagcatcgtgcacagaaagtgcttctag

SEQ ID NO: 1622 - DNA, 1044 bp, Homo sapiens
atggacgacgacatcgccgccctggtggtggacaacggcagcggcatgtgcaaggccggcttcgccggcgacgacgcccccagagccgtgttccccagcatcgtgggcagacccagacaccagggcgtgatggtgggcatcgtgaccaactgggacgacatggagaagatctggcaccacaccttctacaacgagctgagagtggcccccgaggagcaccccgtgctgctgaccgaggcccccctgaaccccaaggccaacagagagaagatgacccagatcatgttcgagaccttcaacacccccgccatgtacgtggccatccaggccgtgctgagcctgtacgccagcggcagaaccaccggcatcgtgatggacagcggcgacggcgtgacccacaccgtgcccatctacgagggctacgccctgccccacgccatcctgagactggacctggccggcagagacctgaccgactacctgatgaagatcctgaccgagagaggctacagcttcaccaccaccgccgagagagagatcgtgagagacatcaaggagaagctgtgctacgtggccctggacttcgagcaggagatggccaccgccgccagcagcagcagcctggagaagagctacgagctgcccgacggccaggtgatcaccatcggcaacgagagattcagatgccccgaggccctgttccagcccagcttcctgggcatggagagctgcggcatccacgagaccaccttcaacagcatcatgaagtgcgacgtggacatcagaaaggacctgtacgccaacaccgtgctgagcggcggcaccaccatgtaccccggcatcgccgacagaatgcagaaggagatcaccgccctggcccccagcaccatgaagatcaagatcatcgccccccccgagagaaagtacagcgtgtggatcggcggcagcatcctggccagcctgagcaccttccagcagatgtggatcagcaagcaggagtacgacgagagcggccccagcatcgtgcacagaaagtgcttctag

SEQ ID NO: 1623 - DNA, 243 bp, Homo sapiens
atggacgacgacatcgccgccctggtggtggacaacggcagcggcatgtgcaaggccggcttcgccggcgacgacgcccccagagccgtgttccccagcatcgtgggcagacccagacaccagggcgtgatggtgggcatgggccagaaggacagctacgtgggcgacgaggcccagagcaagagaggcatcctgaccctgaagtaccccatcgagcacggcatcgtgaccaactgggactag

SEQ ID NO: 1624 - DNA, 300 bp, Homo sapiens
atgctgaccatggacgacgacatcgccgccctggtggtggacaacggcagcggcatgtgcaaggccggcttcgccggcgacgacgcccccagagccgtgttccccagcatcgtgggcagacccagacaccagggcgtgatggtgggcatgggccagaaggacagctacgtgggcgacgaggcccagagcaagagaggcatcctgaccctgaagtaccccatcgagcacggcatcgtgaccaactgggacgacatggagaagatctggcaccacaccttctacaacgagctgagagtgtag

SEQ ID NO: 1625 - DNA, 495 bp, Homo sapiens
atggacgacgacatcgccgccctggtggtggacaacggcagcggcatgtgcaaggccggcttcgccggcgacgacgcccccagagccgtgttccccagcatcgtgggcagacccagacaccagggcgtgatggtgggcatgggccagaaggacagctacgtgggcgacgaggcccagagcaagagaggcatcctgaccctgaagtaccccatcgagcacggcatcgtgaccaactgggacgacatggagaagatctggcaccacaccttctacaacgagctgagagtggcccccgaggagcaccccgtgctgctgaccgaggcccccctgaaccccaaggccaacagagagaagatgacccagatcatgttcgagaccttcaacacccccgccatgtacgtggccatccaggccgtgctgagcctgtacgccagcggcagaaccaccggcatcgtgatggacagcggcgacggcgtgacccacaccgtgccctag

SEQ ID NO: 1626 - DNA, 312 bp, Homo sapiens
atggacgacgacatcgccgccctggtggtggacaacggcagcggcatgtgcaaggccggcttcgccggcgacgacgcccccagagccgtgttccccagcatcgtgggcagacccagacaccagggcgtgatggtgggcatgggccagaaggacagctacgtgggcgacgaggcccagagcaagagaggcatcctgaccctgaagtaccccatcgagcacggcatcgtgaccaactgggacgacatggagaagatctggcaccacaccttctacaacgagctgagagtggcccccgaggagcaccccgtgtag

SEQ ID NO: 1627 - DNA, 1056 bp, Homo sapiens
atggacgacgacatcgccgccctggtggtggacaacggcagcggcatgtgcaaggccggcttcgccggcgacgacgcccccagagccgtgttccccagcatcgtgggcagacccagacaccagggcgtgatggtgggcatgggccagaaggacagctacgtgggcgacgaggcccagagcaagagaggcatcctgaccctgaagtaccccatcgagcacggcatcgtgaccaactgggacgacatggagaagatctggcaccacaccttctacaacgagctgagagtggcccccgaggagcaccccgtgctgctgaccgaggcccccctgaaccccaaggccaacagagagaagatgacccagatcatgttcgagaccttcaacacccccgccatgtacgtggccatccaggccgtgctgagcctgtacgccagcggcagaaccaccgccatcctgagactggacctggccggcagagacctgaccgactacctgatgaagatcctgaccgagagaggctacagcttcaccaccaccgccgagagagagatcgtgagagacatcaaggagaagctgtgctacgtggccctggacttcgagcaggagatggccaccgccgccagcagcagcagcctggagaagagctacgagctgcccgacggccaggtgatcaccatcggcaacgagagattcagatgccccgaggccctgttccagcccagcttcctgggcatggagagctgcggcatccacgagaccaccttcaacagcatcatgaagtgcgacgtggacatcagaaaggacctgtacgccaacaccgtgctgagcggcggcaccaccatgtaccccggcatcgccgacagaatgcagaaggagatcaccgccctggcccccagcaccatgaagatcaagatcatcgccccccccgagagaaagtacagcgtgtggatcggcggcagcatcctggccagcctgagcaccttccagcagatgtggatcagcaagcaggagtacgacgagagcggccccagcatcgtgcacagaaagtgcttctag

SEQ ID NO: 1628 - DNA, 1131 bp, Homo sapiens
atgaccgacaacgagctgagcgccctggtggtggacaacggcagcggcatgtgcaaggccggcttcggcggcgacgacgcccccagagccgtgttccccagcatgatcggcagacccagacaccagggcgtgatggtgggcatgggccagaaggactgctacgtgggcgacgaggcccagagcaagagaggcgtgctgaccctgaagtaccccatcgagcacggcgtggtgaccaactgggacgacatggagaagatctggtaccacaccttctacaacgagctgagagtggcccccgacgagcaccccatcctgctgaccgaggcccccctgaaccccaagatcaacagagagaagatgacccagatcatgttcgaggccttcaacacccccgccatgtacgtggccatccaggccgtgctgagcctgtacgccagcggcagaaccaccggcatcgtgatggacagcggcgacggcgtgacccacatcgtgcccatctacgagggctacgccctgccccacgccatcctgagactggacctggccggcagagacctgaccgactacctgatgaagatcctgaccgagagaggctacaacttcaccaccaccgccgagagagagatcgtgagagacgtgaaggagaagctgtgctacgtggccctggacttcgagcaggagatggtgagagccgccgccagcagcagccccgagagaagctacgagctgcccgacggccaggtgatcaccatcggcaacgagagattcagatgccccgaggccatcttccagcccagcttcctgggcatcgagagcagcggcatccacgagaccaccttcaacagcatcatgaagtgcgacgtggacatcagaaaggacctgtacgccaacaccgtgctgagcggcggcagcaccatgtaccccggcatcgccgacagaatgcagaaggagatcatcaccctggcccccagcaccatgaagatcaagatcatcgccccccccgagagaaagtacagcgtgtggatcggcggcagcatcctggccagcctgagcaccttccagcagatgtggatcagcaagcaggagtacgacgaggccggcccccccatcgtgcacagaaagtgcttctag

SEQ ID NO: 1629 - DNA, 1128 bp, Homo sapiens; identical to SEQ ID NO: 1612

SEQ ID NO: 1630 - DNA, 1002 bp, Homo sapiens
atggaggaggagatcgccgccctggtgatcgacaacggcagcggcatgtgcaaggccggcttcgccggcgacgacgcccccagagccgtgttccccagcatcgtgggcagacccagacaccagggcgtgatggtgggcatgggccagaaggacagctacgtgggcgacgaggcccagagcaagagaggcatcctgaccctgaagtaccccatcgagcacggcatcgtgaccaactgggacgacatggagaagatctggcaccacaccttctacaacgagctgagagtggcccccgaggagcaccccgtgctgctgaccgaggcccccctgaaccccaaggccaacagagagaagatgacccagatcatgttcgagacctacgccctgccccacgccatcctgagactggacctggccggcagagacctgaccgactacctgatgaagatcctgaccgagagaggctacagcttcaccaccaccgccgagagagagatcgtgagagacatcaaggagaagctgtgctacgtggccctggacttcgagcaggagatggccaccgccgccagcagcagcagcctggagaagagctacgagctgcccgacggccaggtgatcaccatcggcaacgagagattcagatgccccgaggccctgttccagcccagcttcctgggcatggagagctgcggcatccacgagaccaccttcaacagcatcatgaagtgcgacgtggacatcagaaaggacctgtacgccaacaccgtgctgagcggcggcaccaccatgtaccccggcatcgccgacagaatgcagaaggagatcaccgccctggcccccagcaccatgaagatcaagatcatcgccccccccgagagaaagtacagcgtgtggatcggcggcagcatcctggccagcctgagcaccttccagcagatgtggatcagcaagcaggagtacgacgagagcggccccagcatcgtgcacagaaagtgcttctag

SEQ ID NO: 1631 - DNA, 1131 bp, Homo sapiens
atgtgcgaggaggagaccaccgccctggtgtgcgacaacggcagcggcctgtgcaaggccggcttcgccggcgacgacgcccccagagccgtgttccccagcatcgtgggcagacccagacaccagggcgtgatggtgggcatgggccagaaggacagctacgtgggcgacgaggcccagagcaagagaggcatcctgaccctgaagtaccccatcgagcacggcatcatcaccaactgggacgacatggagaagatctggcaccacagcttctacaacgagctgagagtggcccccgaggagcaccccaccctgctgaccgaggcccccctgaaccccaaggccaacagagagaagatgacccagatcatgttcgagaccttcaacgtgcccgccatgtacgtggccatccaggccgtgctgagcctgtacgccagcggcagaaccaccggcatcgtgctggacagcggcgacggcgtgacccacaacgtgcccatctacgagggctacgccctgccccacgccatcatgagactggacctggccggcagagacctgaccgactacctgatgaagatcctgaccgagagaggctacagcttcgtgaccaccgccgagagagagatcgtgagagacatcaaggagaagctgtgctacgtggccctggacttcgagaacgagatggccaccgccgccagcagcagcagcctggagaagagctacgagctgcccgacggccaggtgatcaccatcggcaacgagagattcagatgccccgagaccctgttccagcccagcttcatcggcatggagagcgccggcatccacgagaccacctacaacagcatcatgaagtgcgacatcgacatcagaaaggacctgtacgccaacaacgtgctgagcggcggcaccaccatgtaccccggcatcgccgacagaatgcagaaggagatcaccgccctggcccccagcaccatgaagatcaagatcatcgccccccccgagagaaagtacagcgtgtggatcggcggcagcatcctggccagcctgagcaccttccagcagatgtggatcagcaagcccgagtacgacgaggccggccccagcatcgtgcacagaaagtgcttctag

SEQ ID NO: 1632 - DNA, 1131 bp, Homo sapiens; identical to SEQ ID NO: 1631

SEQ ID NO: 1633 - DNA, 1164 bp, Homo sapiens
atggtggtggagagagacgacggcagcaccctgatggagatcgacggcgacaagggcaagcagggcggccccacctactacatcgacaccaacgccctgagagtgcccagagagaacatggaggccatcagccccctgaagaacggcatggtggaggactgggacagcttccaggccatcctggaccacacctacaagatgcacgtgaagagcgaggccagcctgcaccccgtgctgatgagcgaggccccctggaacaccagagccaagagagagaagctgaccgagctgatgttcgagcactacaacatccccgccttcttcctgtgcaagaccgccgtgctgaccgccttcgccaacggcagaagcaccggcctgatcctggacagcggcgccacccacaccaccgccatccccgtgcacgacggctacgtgctgcagcagggcatcgtgaagagccccctggccggcgacttcatcaccatgcagtgcagagagctgttccaggagatgaacatcgagctggtgcccccctacatgatcgccagcaaggaggccgtgagagagggcagccccgccaactggaagagaaaggagaagctgccccaggtgaccagaagctggcacaactacatgtgcaactgcgtgatccaggacttccaggccagcgtgctgcaggtgagcgacagcacctacgacgagcaggtggccgcccagatgcccaccgtgcactacgagttccccaacggctacaactgcgacttcggcgccgagagactgaagatccccgagggcctgttcgaccccagcaacgtgaagggcctgagcggcaacaccatgctgggcgtgagccacgtggtgaccaccagcgtgggcatgtgcgacatcgacatcagacccggcctgtacggcagcgtgatcgtggccggcggcaacaccctgatccagagcttcaccgacagactgaacagagagctgagccagaagaccccccccagcatgagactgaagctgatcgccaacaacaccaccgtggagagaagattcagcagctggatcggcggcagcatcctggccagcctgggcaccttccagcagatgtggatcagcaagcaggagtacgaggagggcggcaagcagtgcgtggagagaaagtgcccctag

SEQ ID NO: 1634 - DNA, 1290 bp, Homo sapiens
atgagcggcggcgtgtacggcggcgacgaggtgggcgccctggtgttcgacatcggcagctacaccgtgagagccggctacgccggcgaggactgccccaaggtggacttccccaccgccatcggcatggtggtggagagagacgacggcagcaccctgatggagatcgacggcgacaagggcaagcagggcggccccacctactacatcgacaccaacgccctgagagtgcccagagagaacatggaggccatcagccccctgaagaacggcatggtggaggactgggacagcttccaggccatcctggaccacacctacaagatgcacgtgaagagcgaggccagcctgcaccccgtgctgatgagcgaggccccctggaacaccagagccaagagagagaagctgaccgagctgatgttcgagcactacaacatccccgccttcttcctgtgcaagaccgccgtgctgaccgccttcgccaacggcagaagcaccggcctgatcctggacagcggcgccacccacaccaccgccatccccgtgcacgacggctacgtgctgcagcagggcatcgtgaagagccccctggccggcgacttcatcaccatgcagtgcagagagctgttccaggagatgaacatcgagctggtgcccccctacatgatcgccagcaaggaggccgtgagagagggcagccccgccaactggaagagaaaggagaagctgccccaggtgaccagaagctggcacaactacatgtgcaactgcgtgatccaggacttccaggccagcgtgctgcaggtgagcgacagcacctacgacgagcaggtggccgcccagatgcccaccgtgcactacgagttccccaacggctacaactgcgacttcggcgccgagagactgaagatccccgagggcctgttcgaccccagcaacgtgaagggcctgagcggcaacaccatgctgggcgtgagccacgtggtgaccaccagcgtgggcatgtgcgacatcgacatcagacccggcctgtacggcagcgtgatcgtggccggcggcaacaccctgatccagagcttcaccgacagactgaacagagagctgagccagaagaccccccccagcatgagactgaagctgatcgccaacaacaccaccgtggagagaagattcagcagctggatcggcggcagcatcctggccagcctgggcaccttccagcagatgtggatcagcaagcaggagtacgaggagggcggcaagcagtgcgtggagagaaagtgcccctag

SEQ ID NO: 1635 - DNA, 1164 bp, Homo sapiens; identical to SEQ ID NO: 1633

SEQ ID NO: 1636 - DNA, 153 bp, Homo sapiens
atggtggtggagagagacgacggcagcaccctgatggagatcgacggcgacaagggcaagcagggcggccccacctactacatcgacaccaacgccctgagagtgcccagagagaacatggaggccatcagccccctgaagaacggcatgtag

SEQ ID NO: 1637 - DNA, 1281 bp, Homo sapiens
atgagcggcggcgtgtacggcggcgacgaggtgggcgccctggtgttcgacatcggcagcttcagcgtgagagccggctacgccggcgaggactgccccaaggccgacttccccaccaccgtgggcctgctggccgccgaggagggcggcggcctggagctggagggcgacaaggagaagaagggcaagatcttccacatcgacaccaacgccctgcacgtgcccagagacggcgccgaggtgatgagccccctgaagaacggcatgatcgaggactgggagtgcttcagagccatcctggaccacacctacagcaagcacgtgaagagcgagcccaacctgcaccccgtgctgatgagcgaggccccctggaacaccagagccaagagagagaagctgaccgagctgatgttcgagcagtacaacatccccgccttcttcctgtgcaagaccgccgtgctgaccgccttcgccaacggcagaagcaccggcctggtgctggacagcggcgccacccacaccaccgccatccccgtgcacgacggctacgtgctgcagcagggcatcgtgaagagccccctggccggcgacttcatcagcatgcagtgcagagagctgttccaggagatggccatcgacatcatccccccctacatgatcgccgccaaggagcccgtgagagagggcgccccccccaactggaagaagaaggagaagctgccccaggtgagcaagagctggcacaactacatgtgcaacgaggtgatccaggacttccaggccagcgtgctgcaggtgagcgacagcccctacgacgagcaggtggccgcccagatgcccaccgtgcactacgagatgcccaacggctacaacaccgactacggcgccgagagactgagaatccccgagggcctgttcgaccccagcaacgtgaagggcctgagcggcaacaccatgctgggcgtgggccacgtggtgaccaccagcatcggcatgtgcgacatcgacatcagacccggcctgtacggcagcgtgatcgtgaccggcggcaacaccctgctgcagggcttcaccgacagactgaacagagagctgagccagaagaccccccccagcatgagactgaagctgatcgccagcaacagcaccatggagagaaagttcagcccctggatcggcggcagcatcctggccagcctgggcaccttccagcagatgtggatcagcaagcaggagtacgaggagggcggcaagcagtgcgtggagagaaagtgcccctag

SEQ ID NO: 1638 - DNA, 1308 bp, Homo sapiens
atgtgggccccccccgccgccatcatgggcgacggccccaccaagaaggtgggcaaccaggcccccctgcagacccaggccctgcagaccgccagcctgagagacggccccgccaagagagccgtgtgggtgagacacaccagcagcgagccccaggagcccaccgagagcaaggccgccaaggagagacccaagcaggaggtgaccaaggccgtggtggtggacctgggcaccggctactgcaagtgcggcttcgccggcctgcccagacccacccacaagatcagcaccaccgtgggcaagccctacatggagaccgccaagaccggcgacaacagaaaggagaccttcgtgggccaggagctgaacaacaccaacgtgcacctgaagctggtgaaccccctgagacacggcatcatcgtggactgggacaccgtgcaggacatctgggagtacctgttcagacaggagatgaagatcgcccccgaggagcacgccgtgctggtgagcgacccccccctgagcccccacaccaacagagagaagtacgccgagatgctgttcgaggccttcaacacccccgccatgcacatcgcctaccagagcagactgagcatgtacagctacggcagaaccagcggcctggtggtggaggtgggccacggcgtgagctacgtggtgcccatctacgagggctaccccctgcccagcatcaccggcagactggactacgccggcagcgacctgaccgcctacctgctgggcctgctgaacagcgccggcaacgagttcacccaggaccagatgggcatcgtggaggacatcaagaagaagtgctgcttcgtggccctggaccccatcgaggagaagaaggtgcccctgagcgagcacaccatcagatacgtgctgcccgacggcaaggagatccagctgtgccaggagagattcctgtgcagcgagatgttcttcaagcccagcctgatcaagagcatgcagctgggcctgcacacccagaccgtgagctgcctgaacaagtgcgacatcgccctgaagagagacctgatgggcaacatcctgctgtgcggcggcagcaccatgctgagcggcttccccaacagactgcagaaggagctgagcagcatgtgccccaacgacaccccccaggtgaacgtgctgcccgagagagacagcgccgtgtggaccggcggcagcatcctggccagcctgcagggcttccagcccctgtgggtgcacagattcgagtacgaggagcacggccccttcttcctgtacagaagatgcttctag

SEQ ID NO: 1639 - DNA, 1248 bp, Homo sapiens
atggccaccagaaacagccccatgcccctgggcaccgcccagggcgaccccggcgaggccggcaccagacccggccccgacgccagcctgagagacaccggcgccgccacccagctgaagatgaagcccagaaaggtgcacaagatcaaggccgtgatcatcgacctgggcagccagtactgcaagtgcggctacgccggcgagcccagacccacctacttcatcagcagcaccgtgggcaagagatgccccgaggccgccgacgccggcgacaccagaaagtggaccctggtgggccacgagctgctgaacaccgaggcccccctgaagctggtgaaccccctgaagcacggcatcgtggtggactgggactgcgtgcaggacatctgggagtacatcttcagaaccgccatgaagatcctgcccgaggagcacgccgtgctggtgagcgacccccccctgagccccagcagcaacagagagaagtacgccgagctgatgttcgagaccttcggcatccccgccatgcacgtgaccagccagagcctgctgagcatctacagctacggcaagaccagcggcctggtggtggagagcggccacggcgtgagccacgtggtgcccatcagcgagggcgacgtgctgcccggcctgaccagcagagccgactacgccggcggcgacctgaccaactacctgatgcagctgctgaacgaggccggccacgccttcaccgacgaccacctgcacatcatcgagcacatcaagaagaagtgctgctacgccgccttcctgcccgaggaggagctgggcctggtgcccgaggagctgagagtggactacgagctgcccgacggcaagctgatcaccatcggccaggagagattcagatgcagcgagatgctgttccagcccagcctggccggcagcacccagcccggcctgcccgagctgaccgccgcctgcctgggcagatgccaggacaccggcttcaaggaggagatggccgccaacgtgctgctgtgcggcggctgcaccatgctggacggcttccccgagagattccagagagagctgagcctgctgtgccccggcgacagccccgccgtggccgccgcccccgagagaaagaccagcgtgtggaccggcggcagcatcctggccagcctgcaggccttccagcagctgtgggtgagcaaggaggagttcgaggagagaggcagcgtggccatctacagcaagtgctag

SEQ ID NO: 1640 - DNA, 1101 bp, Homo sapiens
atggccgccagaaccgtgatcatcgaccacggcagcggcttcctgaaggccggcaccgccggctggaacgagccccagatggtgttccccaacatcgtgaactacctgccctgcaaggagaaccccggccccagctacgccagaagaagagtgagcctgggcatcgacatctgccaccccgacaccttcagctaccccatcgagagaggcagaatcctgaactgggagggcgtgcagtacctgtggagcttcgtgctggagaaccacagaagagagcaggaggtgccccccgtgatcatcaccgagacccccctgagagagcccgccgacagaaagaagatgctggagatcctgttcgagctgctgcacgtgcccagcgtgctgctggccgaccagctgcagatgagcctgtacgccagcggcctgctgaccggcgtggtggtggacagcggctacggcctgaccagagtgcagcccttccaccagggcagacccctgcccgccagcggcaagaccctggagttcgccggccaggacctgagcgcctacctgctgaagagcctgttcaaggaggactgcgacagaagatgcctgttccagctggagaccgtggccgtgacccagatgaacaagtgctacgtgccccagaacctgggcgaggccctggacttcagagagagacagcagagcgccctggacgagagcaacacctaccagctgcccgacggcagcagagtggagctgacccccatgcagagagtggcccccgagatgttcttcagcccccaggtgttcgagcagcccggccccagcatccccagagccatcgtggagagcgtggagagctgcgagatcagcctgagacccctgctggtgagccacgtgatggcctgcggcggcaacaccctgtaccccggcttcaccaagagactgttcagagagctgatgggcgaccacgtgagcagcaccaaggccaccgtgtgggagggcagcaacagaaacttcagcgtgtggctgggcgccagcgtggtggcccacctgagcacctaccagagcgagtggatgagcagagaggagtacggcgagcacatgagaatgtag

SEQ ID NO: 1641 - DNA, 1251 bp, Homo sapiens
atggacgccagcagacccaagagcagcgagagccagagcagcctggaggcccccagacccggccccaaccccagccccaacgtggtgaacaagcccctgcagagagacttccccggcatggtggccgacagactgccccccaagaccggcgtggtggtgatcgacatgggcaccggcacctgcaaggtgggcttcgccggccaggccagccccacctacaccgtggccaccatcctgggctgccagcccaagaagcccgccaccagcggccagagcggcctgcagaccttcatcggcgaggccgccagagtgctgcccgagctgaccctggtgcagcccctgagaagcggcatcgtggtggactgggacgccgccgagctgatctggagacacctgctggagcacgacctgagagtggccacccacgaccaccccctgctgttcagcgacccccccttcagccccgccaccaacagagagaagctggtggaggtggccttcgagagcctgagaagccccgccatgtacgtggccagccagagcgtgctgagcgtgtacgcccacggcagagtgagcggcctggtggtggacaccggccacggcgtgacctacaccgtgcccgtgttccagggctacaacctgctgcacgccaccgagagactggacctggccggcaaccacctgaccgccttcctggccgagatgctgctgcaggccggcctgcccctgggccagcaggacctggacctggtggagaacatcaagcaccactactgctacgtggccagcgacttccagaaggagcaggccagacccgagcaggagtacaagagaaccctgaagctgcccgacggcagaaccgtgaccctgggcaaggagctgttccagtgccccgagctgctgttcaacccccccgaggtgcccggcctgagccccgtgggcctgagcaccatggccaagcagagcctgagaaagctgagcctggagatgagagccgacctggcccagaacgtgctgctgtgcggcggcagcagcctgttcaccggcttcgagggcagattcagagccgagctgctgagagccctgcccgccgagacccacgtggtggtggccgcccagcccaccagaaacttcagcgtgtggatcggcggcagcatcctggccagcctgagagccttccagagctgctgggtgctgagagagcagtacgaggagcagggcccctacatcgtgtacagaaagtgctactag

SEQ ID NO: 1642 - DNA, 2763 bp, Homo sapiens
atggaggtgcagctgggcctgggcagagtgtaccccagaccccccagcaagacctacagaggcgccttccagaacctgttccagagcgtgagagaggtgatccagaaccccggccccagacaccccgaggccgccagcgccgccccccccggcgccagcctgctgctgctgcagcagcagcagcagcagcagcagcagcagcagcagcagcagcagcagcagcagcagcagcagcagcaggagaccagccccagacagcagcagcagcagcagggcgaggacggcagcccccaggcccacagaagaggccccaccggctacctggtgctggacgaggagcagcagcccagccagccccagagcgccctggagtgccaccccgagagaggctgcgtgcccgagcccggcgccgccgtggccgccagcaagggcctgccccagcagctgcccgccccccccgacgaggacgacagcgccgcccccagcaccctgagcctgctgggccccaccttccccggcctgagcagctgcagcgccgacctgaaggacatcctgagcgaggccagcaccatgcagctgctgcagcagcagcagcaggaggccgtgagcgagggcagcagcagcggcagagccagagaggccagcggcgcccccaccagcagcaaggacaactacctgggcggcaccagcaccatcagcgacaacgccaaggagctgtgcaaggccgtgagcgtgagcatgggcctgggcgtggaggccctggagcacctgagccccggcgagcagctgagaggcgactgcatgtacgcccccctgctgggcgtgccccccgccgtgagacccaccccctgcgcccccctggccgagtgcaagggcagcctgctggacgacagcgccggcaagagcaccgaggacaccgccgagtacagccccttcaagggcggctacaccaagggcctggagggcgagagcctgggctgcagcggcagcgccgccgccggcagcagcggcaccctggagctgcccagcaccctgagcctgtacaagagcggcgccctggacgaggccgccgcctaccagagcagagactactacaacttccccctggccctggccggccccccccccccccccccccccccccacccccacgccagaatcaagctggagaaccccctggactacggcagcgcctgggccgccgccgccgcccagtgcagatacggcgacctggccagcctgcacggcgccggcgccgccggccccggcagcggcagccccagcgccgccgccagcagcagctggcacaccctgttcaccgccgaggagggccagctgtacggcccctgcggcggcggcggcggcggcggcggcggcggcggcggcggcggcggcggcggcggcggcggcggcggcggcgaggccggcgccgtggccccctacggctacaccagacccccccagggcctggccggccaggagagcgacttcaccgcccccgacgtgtggtaccccggcggcatggtgagcagagtgccctaccccagccccacctgcgtgaagagcgagatgggcccctggatggacagctacagcggcccctacggcgacatgagactggagaccgccagagaccacgtgctgcccatcgactactacttccccccccagaagacctgcctgatctgcggcgacgaggccagcggctgccactacggcgccctgacctgcggcagctgcaaggtgttcttcaagagagccgccgagggcaagcagaagtacctgtgcgccagcagaaacgactgcaccatcgacaagttcagaagaaagaactgccccagctgcagactgagaaagtgctacgaggccggcatgaccctgggcgccagaaagctgaagaagctgggcaacctgaagctgcaggaggagggcgaggccagcagcaccaccagccccaccgaggagaccacccagaagctgaccgtgagccacatcgagggctacgagtgccagcccatcttcctgaacgtgctggaggccatcgagcccggcgtggtgtgcgccggccacgacaacaaccagcccgacagcttcgccgccctgctgagcagcctgaacgagctgggcgagagacagctggtgcacgtggtgaagtgggccaaggccctgcccggcttcagaaacctgcacgtggacgaccagatggccgtgatccagtacagctggatgggcctgatggtgttcgccatgggctggagaagcttcaccaacgtgaacagcagaatgctgtacttcgcccccgacctggtgttcaacgagtacagaatgcacaagagcagaatgtacagccagtgcgtgagaatgagacacctgagccaggagttcggctggctgcagatcaccccccaggagttcctgtgcatgaaggccctgctgctgttcagcatcatccccgtggacggcctgaagaaccagaagttcttcgacgagctgagaatgaactacatcaaggagctggacagaatcatcgcctgcaagagaaagaaccccaccagctgcagcagaagattctaccagctgaccaagctgctggacagcgtgcagcccatcgccagagagctgcaccagttcaccttcgacctgctgatcaagagccacatggtgagcgtggacttccccgagatgatggccgagatcatcagcgtgcaggtgcccaagatcctgagcggcaaggtgaagcccatctacttccacacccagtag

SEQ ID NO: 1643 - DNA, 1167 bp, Homo sapiens
atgatcctgtggctgcacagcctggagaccgccagagaccacgtgctgcccatcgactactacttccccccccagaagacctgcctgatctgcggcgacgaggccagcggctgccactacggcgccctgacctgcggcagctgcaaggtgttcttcaagagagccgccgagggcaagcagaagtacctgtgcgccagcagaaacgactgcaccatcgacaagttcagaagaaagaactgccccagctgcagactgagaaagtgctacgaggccggcatgaccctgggcgccagaaagctgaagaagctgggcaacctgaagctgcaggaggagggcgaggccagcagcaccaccagccccaccgaggagaccacccagaagctgaccgtgagccacatcgagggctacgagtgccagcccatcttcctgaacgtgctggaggccatcgagcccggcgtggtgtgcgccggccacgacaacaaccagcccgacagcttcgccgccctgctgagcagcctgaacgagctgggcgagagacagctggtgcacgtggtgaagtgggccaaggccctgcccggcttcagaaacctgcacgtggacgaccagatggccgtgatccagtacagctggatgggcctgatggtgttcgccatgggctggagaagcttcaccaacgtgaacagcagaatgctgtacttcgcccccgacctggtgttcaacgagtacagaatgcacaagagcagaatgtacagccagtgcgtgagaatgagacacctgagccaggagttcggctggctgcagatcaccccccaggagttcctgtgcatgaaggccctgctgctgttcagcatcatccccgtggacggcctgaagaaccagaagttcttcgacgagctgagaatgaactacatcaaggagctggacagaatcatcgcctgcaagagaaagaaccccaccagctgcagcagaagattctaccagctgaccaagctgctggacagcgtgcagcccatcgccagagagctgcaccagttcaccttcgacctgctgatcaagagccacatggtgagcgtggacttccccgagatgatggccgagatcatcagcgtgcaggtgcccaagatcctgagcggcaaggtgaagcccatctacttccacacccagtag

SEQ ID NO: 1644 - DNA, 2205 bp, Homo sapiens
atggaggtgcagctgggcctgggcagagtgtaccccagaccccccagcaagacctacagaggcgccttccagaacctgttccagagcgtgagagaggtgatccagaaccccggccccagacaccccgaggccgccagcgccgccccccccggcgccagcctgctgctgctgcagcagcagcagcagcagcagcagcagcagcagcagcagcagcagcagcagcagcagcagcagcagcaggagaccagccccagacagcagcagcagcagcagggcgaggacggcagcccccaggcccacagaagaggccccaccggctacctggtgctggacgaggagcagcagcccagccagccccagagcgccctggagtgccaccccgagagaggctgcgtgcccgagcccggcgccgccgtggccgccagcaagggcctgccccagcagctgcccgccccccccgacgaggacgacagcgccgcccccagcaccctgagcctgctgggccccaccttccccggcctgagcagctgcagcgccgacctgaaggacatcctgagcgaggccagcaccatgcagctgctgcagcagcagcagcaggaggccgtgagcgagggcagcagcagcggcagagccagagaggccagcggcgcccccaccagcagcaaggacaactacctgggcggcaccagcaccatcagcgacaacgccaaggagctgtgcaaggccgtgagcgtgagcatgggcctgggcgtggaggccctggagcacctgagccccggcgagcagctgagaggcgactgcatgtacgcccccctgctgggcgtgccccccgccgtgagacccaccccctgcgcccccctggccgagtgcaagggcagcctgctggacgacagcgccggcaagagcaccgaggacaccgccgagtacagccccttcaagggcggctacaccaagggcctggagggcgagagcctgggctgcagcggcagcgccgccgccggcagcagcggcaccctggagctgcccagcaccctgagcctgtacaagagcggcgccctggacgaggccgccgcctaccagagcagagactactacaacttccccctggccctggccggccccccccccccccccccccccccccacccccacgccagaatcaagctggagaaccccctggactacggcagcgcctgggccgccgccgccgcccagtgcagatacggcgacctggccagcctgcacggcgccggcgccgccggccccggcagcggcagccccagcgccgccgccagcagcagctggcacaccctgttcaccgccgaggagggccagctgtacggcccctgcggcggcggcggcggcggcggcggcggcggcggcggcggcggcggcggcggcggcggcggcggcggcggcgaggccggcgccgtggccccctacggctacaccagacccccccagggcctggccggccaggagagcgacttcaccgcccccgacgtgtggtaccccggcggcatggtgagcagagtgccctaccccagccccacctgcgtgaagagcgagatgggcccctggatggacagctacagcggcccctacggcgacatgagactggagaccgccagagaccacgtgctgcccatcgactactacttccccccccagaagacctgcctgatctgcggcgacgaggccagcggctgccactacggcgccctgacctgcggcagctgcaaggtgttcttcaagagagccgccgagggcaagcagaagtacctgtgcgccagcagaaacgactgcaccatcgacaagttcagaagaaagaactgccccagctgcagactgagaaagtgctacgaggccggcatgaccctgggcgccagaaagctgaagaagctgggcaacctgaagctgcaggaggagggcgaggccagcagcaccaccagccccaccgaggagaccacccagaagctgaccgtgagccacatcgagggctacgagtgccagcccatcttcctgaacgtgctggaggccatcgagcccggcgtggtgtgcgccggccacgacaacaaccagcccgacagcttcgccgccctgctgagcagcctgaacgagctgggcgagagacagctggtgcacgtggtgaagtgggccaaggccctgcccgactgcgagagagccgccagcgtgcacttctag

SEQ ID NO: 1645 - DNA, 1596 bp, Homo sapiens
atggaggtgcagctgggcctgggcagagtgtaccccagaccccccagcaagacctacagaggcgccttccagaacctgttccagagcgtgagagaggtgatccagaaccccggccccagacaccccgaggccgccagcgccgccccccccggcgccagcctgctgctgctgcagcagcagcagcagcagcagcagcagcagcagcagcagcagcaggagaccagccccagacagcagcagcagcagcagggcgaggacggcagcccccaggcccacagaagaggccccaccggctacctggtgctggacgaggagcagcagcccagccagccccagagcgccctggagtgccaccccgagagaggctgcgtgcccgagcccggcgccgccgtggccgccagcaagggcctgccccagcagctgcccgccccccccgacgaggacgacagcgccgcccccagcaccctgagcctgctgggccccaccttccccggcctgagcagctgcagcgccgacctgaaggacatcctgagcgaggccagcaccatgcagctgctgcagcagcagcagcaggaggccgtgagcgagggcagcagcagcggcagagccagagaggccagcggcgcccccaccagcagcaaggacaactacctgggcggcaccagcaccatcagcgacaacgccaaggagctgtgcaaggccgtgagcgtgagcatgggcctgggcgtggaggccctggagcacctgagccccggcgagcagctgagaggcgactgcatgtacgcccccctgctgggcgtgccccccgccgtgagacccaccccctgcgcccccctggccgagtgcaagggcagcctgctggacgacagcgccggcaagagcaccgaggacaccgccgagtacagccccttcaagggcggctacaccaagggcctggagggcgagagcctgggctgcagcggcagcgccgccgccggcagcagcggcaccctggagctgcccagcaccctgagcctgtacaagagcggcgccctggacgaggccgccgcctaccagagcagagactactacaacttccccctggccctggccggccccccccccccccccccccccccccacccccacgccagaatcaagctggagaaccccctggactacggcagcgcctgggccgccgccgccgcccagtgcagatacggcgacctggccagcctgcacggcgccggcgccgccggccccggcagcggcagccccagcgccgccgccagcagcagctggcacaccctgttcaccgccgaggagggccagctgtacggcccctgcggcggcggcggcggcggcggcggcggcggcggcggcggcggcggcggcggcggcggcggcggcggcggcgaggccggcgccgtggccccctacggctacaccagacccccccagggcctggccggccaggagagcgacttcaccgcccccgacgtgtggtaccccggcggcatggtgagcagagtgccctaccccagccccacctgcgtgaagagcgagatgggcccctggatggacagctacagcggcccctacggcgacatgagatag

SEQ ID NO: 1646 - DNA, 2217 bp, Homo sapiens
atgcagctgctgcagcagcagcagcaggaggccgtgagcgagggcagcagcagcggcagagccagagaggccagcggcgcccccaccagcagcaaggacaactacctgggcggcaccagcaccatcagcgacaacgccaaggagctgtgcaaggccgtgagcgtgagcatgggcctgggcgtggaggccctggagcacctgagccccggcgagcagctgagaggcgactgcatgtacgcccccctgctgggcgtgccccccgccgtgagacccaccccctgcgcccccctggccgagtgcaagggcagcctgctggacgacagcgccggcaagagcaccgaggacaccgccgagtacagccccttcaagggcggctacaccaagggcctggagggcgagagcctgggctgcagcggcagcgccgccgccggcagcagcggcaccctggagctgcccagcaccctgagcctgtacaagagcggcgccctggacgaggccgccgcctaccagagcagagactactacaacttccccctggccctggccggccccccccccccccccccccccccccacccccacgccagaatcaagctggagaaccccctggactacggcagcgcctgggccgccgccgccgcccagtgcagatacggcgacctggccagcctgcacggcgccggcgccgccggccccggcagcggcagccccagcgccgccgccagcagcagctggcacaccctgttcaccgccgaggagggccagctgtacggcccctgcggcggcggcggcggcggcggcggcggcggcggcggcggcggcggcggcggcggcggcggcggcggcggcgaggccggcgccgtggccccctacggctacaccagacccccccagggcctggccggccaggagagcgacttcaccgcccccgacgtgtggtaccccggcggcatggtgagcagagtgccctaccccagccccacctgcgtgaagagcgagatgggcccctggatggacagctacagcggcccctacggcgacatgagactggagaccgccagagaccacgtgctgcccatcgactactacttccccccccagaagacctgcctgatctgcggcgacgaggccagcggctgccactacggcgccctgacctgcggcagctgcaaggtgttcttcaagagagccgccgagggcaagcagaagtacctgtgcgccagcagaaacgactgcaccatcgacaagttcagaagaaagaactgccccagctgcagactgagaaagtgctacgaggccggcatgaccctgggcgccagaaagctgaagaagctgggcaacctgaagctgcaggaggagggcgaggccagcagcaccaccagccccaccgaggagaccacccagaagctgaccgtgagccacatcgagggctacgagtgccagcccatcttcctgaacgtgctggaggccatcgagcccggcgtggtgtgcgccggccacgacaacaaccagcccgacagcttcgccgccctgctgagcagcctgaacgagctgggcgagagacagctggtgcacgtggtgaagtgggccaaggccctgcccggcttcagaaacctgcacgtggacgaccagatggccgtgatccagtacagctggatgggcctgatggtgttcgccatgggctggagaagcttcaccaacgtgaacagcagaatgctgtacttcgcccccgacctggtgttcaacgagtacagaatgcacaagagcagaatgtacagccagtgcgtgagaatgagacacctgagccaggagttcggctggctgcagatcaccccccaggagttcctgtgcatgaaggccctgctgctgttcagcatcaccttctgcctgcaccccaccagcgtgcccgtggacggcctgaagaaccagaagttcttcgacgagctgagaatgaactacatcaaggagctggacagaatcatcgcctgcaagagaaagaaccccaccagctgcagcagaagattctaccagctgaccaagctgctggacagcgtgcagcccatcgccagagagctgcaccagttcaccttcgacctgctgatcaagagccacatggtgagcgtggacttccccgagatgatggccgagatcatcagcgtgcaggtgcccaagatcctgagcggcaaggtgaagcccatctacttccacacccagtag

SEQ ID NO: 1647 - DNA, 4290 bp, Homo sapiens
atggtggccgccgccgccgccaccgaggccagactgagaagaagaaccgccgccaccgccgccctggccggcagaagcggcggcccccactgggactgggacgtgaccagagccggcagacccggcctgggcgccggcctgagactgcccagactgctgagcccccccctgagacccagactgctgctgctgctgctgctgctgagcccccccctgctgctgctgctgctgccctgcgaggccgaggccgccgccgccgccgccgccgtgagcggcagcgccgccgccgaggccaaggagtgcgacagaccctgcgtgaacggcggcagatgcaaccccggcaccggccagtgcgtgtgccccgccggctgggtgggcgagcagtgccagcactgcggcggcagattcagactgaccggcagcagcggcttcgtgaccgacggccccggcaactacaagtacaagaccaagtgcacctggctgatcgagggccagcccaacagaatcatgagactgagattcaaccacttcgccaccgagtgcagctgggaccacctgtacgtgtacgacggcgacagcatctacgcccccctggtggccgccttcagcggcctgatcgtgcccgagagagacggcaacgagaccgtgcccgaggtggtggccaccagcggctacgccctgctgcacttcttcagcgacgccgcctacaacctgaccggcttcaacatcacctacagcttcgacatgtgccccaacaactgcagcggcagaggcgagtgcaagatcagcaacagcagcgacaccgtggagtgcgagtgcagcgagaactggaagggcgaggcctgcgacatcccccactgcaccgacaactgcggcttcccccacagaggcatctgcaacagcagcgacgtgagaggctgcagctgcttcagcgactggcagggccccggctgcagcgtgcccgtgcccgccaaccagagcttctggaccagagaggagtacagcaacctgaagctgcccagagccagccacaaggccgtggtgaacggcaacatcatgtgggtggtgggcggctacatgttcaaccacagcgactacaacatggtgctggcctacgacctggccagcagagagtggctgcccctgaacagaagcgtgaacaacgtggtggtgagatacggccacagcctggccctgtacaaggacaagatctacatgtacggcggcaagatcgacagcaccggcaacgtgaccaacgagctgagagtgttccacatccacaacgagagctgggtgctgctgacccccaaggccaaggagcagtacgccgtggtgggccacagcgcccacatcgtgaccctgaagaacggcagagtggtgatgctggtgatcttcggccactgccccctgtacggctacatcagcaacgtgcaggagtacgacctggacaagaacacctggagcatcctgcacacccagggcgccctggtgcagggcggctacggccacagcagcgtgtacgaccacagaaccagagccctgtacgtgcacggcggctacaaggccttcagcgccaacaagtacagactggccgacgacctgtacagatacgacgtggacacccagatgtggaccatcctgaaggacagcagattcttcagatacctgcacaccgccgtgatcgtgagcggcaccatgctggtgttcggcggcaacacccacaacgacaccagcatgagccacggcgccaagtgcttcagcagcgacttcatggcctacgacatcgcctgcgacagatggagcgtgctgcccagacccgacctgcaccacgacgtgaacagattcggccacagcgccgtgctgcacaacagcaccatgtacgtgttcggcggcttcaacagcctgctgctgagcgacatcctggtgttcaccagcgagcagtgcgacgcccacagaagcgaggccgcctgcctggccgccggccccggcatcagatgcgtgtggaacaccggcagcagccagtgcatcagctgggccctggccaccgacgagcaggaggagaagctgaagagcgagtgcttcagcaagagaaccctggaccacgacagatgcgaccagcacaccgactgctacagctgcaccgccaacaccaacgactgccactggtgcaacgaccactgcgtgcccagaaaccacagctgcagcgagggccagatcagcatcttcagatacgagaactgccccaaggacaaccccatgtactactgcaacaagaagaccagctgcagaagctgcgccctggaccagaactgccagtgggagcccagaaaccaggagtgcatcgccctgcccgagaacatctgcggcatcggctggcacctggtgggcaacagctgcctgaagatcaccaccgccaaggagaactacgacaacgccaagctgttctgcagaaaccacaacgccctgctggccagcctgaccacccagaagaaggtggagttcgtgctgaagcagctgagaatcatgcagagcagccagagcatgagcaagctgaccctgaccccctgggtgggcctgagaaagatcaacgtgagctactggtgctgggaggacatgagccccttcaccaacagcctgctgcagtggatgcccagcgagcccagcgacgccggcttctgcggcatcctgagcgagcccagcaccagaggcctgaaggccgccacctgcatcaaccccctgaacggcagcgtgtgcgagagacccgccaaccacagcgccaagcagtgcagaaccccctgcgccctgagaaccgcctgcggcgactgcaccagcggcagcagcgagtgcatgtggtgcagcaacatgaagcagtgcgtggacagcaacgcctacgtggccagcttccccttcggccagtgcatggagtggtacaccatgagcacctgcccccccgagaactgcagcggctactgcacctgcagccactgcctggagcagcccggctgcggctggtgcaccgaccccagcaacaccggcaagggcaagtgcatcgagggcagctacaagggccccgtgaagatgcccagccaggcccccaccggcaacttctacccccagcccctgctgaacagcagcatgtgcctggaggacagcagatacaactggagcttcatccactgccccgcctgccagtgcaacggccacagcaagtgcatcaaccagagcatctgcgagaagtgcgagaacctgaccaccggcaagcactgcgagacctgcatcagcggcttctacggcgaccccaccaacggcggcaagtgccagccctgcaagtgcaacggccacgccagcctgtgcaacaccaacaccggcaagtgcttctgcaccaccaagggcgtgaagggcgacgagtgccagctgtgcgaggtggagaacagataccagggcaaccccctgagaggcacctgctactacaccctgctgatcgactaccagttcaccttcagcctgagccaggaggacgacagatactacaccgccatcaacttcgtggccacccccgacgagcagaacagagacctggacatgttcatcaacgccagcaagaacttcaacctgaacatcacctgggccgccagcttcagcgccggcacccaggccggcgaggagatgcccgtggtgagcaagaccaacatcaaggagtacaaggacagcttcagcaacgagaagttcgacttcagaaaccaccccaacatcaccttcttcgtgtacgtgagcaacttcacctggcccatcaagatccagatcgccttcagccagcacagcaacttcatggacctggtgcagttcttcgtgaccttcttcagctgcttcctgagcctgctgctggtggccgccgtggtgtggaagatcaagcagagctgctgggccagcagaagaagagagcagctgctgagagagatgcagcagatggccagcagacccttcgccagcgtgaacgtggccctggagaccgacgaggagccccccgacctgatcggcggcagcatcaagaccgtgcccaagcccatcgccctggagccctgcttcggcaacaaggccgccgtgctgagcgtgttcgtgagactgcccagaggcctgggcggcatccccccccccggccagagcggcctggccgtggccagcgccctggtggacatcagccagcagatgcccatcgtgtacaaggagaagagcggcgccgtgagaaacagaaagcagcagccccccgcccagcccggcacctgcatctag

SEQ ID NO: 1648 - DNA, 3582 bp, Homo sapiens
atggtggccgccgccgccgccaccgaggccagactgagaagaagaaccgccgccaccgccgccctggccggcagaagcggcggcccccactgcgtgaacggcggcagatgcaaccccggcaccggccagtgcgtgtgccccgccggctgggtgggcgagcagtgccagcactgcggcggcagattcagactgaccggcagcagcggcttcgtgaccgacggccccggcaactacaagtacaagaccaagtgcacctggctgatcgagggccagcccaacagaatcatgagactgagattcaaccacttcgccaccgagtgcagctgggaccacctgtacgtgtacgacggcgacagcatctacgcccccctggtggccgccttcagcggcctgatcgtgcccgagagagacggcaacgagaccgtgcccgaggtggtggccaccagcggctacgccctgctgcacttcttcagcgacgccgcctacaacctgaccggcttcaacatcacctacagcttcgacatgtgccccaacaactgcagcggcagaggcgagtgcaagatcagcaacagcagcgacaccgtggagtgcgagtgcagcgagaactggaagggcgaggcctgcgacatcccccactgcaccgacaactgcggcttcccccacagaggcatctgcaacagcagcgacgtgagaggctgcagctgcttcagcgactggcagggccccggctgcagcgtgcccgtgcccgccaaccagagcttctggaccagagaggagtacagcaacctgaagctgcccagagccagccacaaggccgtggtgaacggcaacatcatgtgggtggtgggcggctacatgttcaaccacagcgactacaacatggtgctggcctacgacctggccagcagagagtggctgcccctgaacagaagcgtgaacaacgtggtggtgagatacggccacagcctggccctgtacaaggacaagatctacatgtacggcggcaagatcgacagcaccggcaacgtgaccaacgagctgagagtgttccacatccacaacgagagctgggtgctgctgacccccaaggccaaggagcagtacgccgtggtgggccacagcgcccacatcgtgaccctgaagaacggcagagtggtgatgctggtgatcttcggccactgccccctgtacggctacatcagcaacgtgcaggagtacgacctggacaagaacacctggagcatcctgcacacccagggcgccctggtgcagggcggctacggccacagcagcgtgtacgaccacagaaccagagccctgtacgtgcacggcggctacaaggccttcagcgccaacaagtacagactggccgacgacctgtacagatacgacgtggacacccagatgtggaccatcctgaaggacagcagattcttcagatacctgcacaccgccgtgatcgtgagcggcaccatgctggtgttcggcggcaacacccacaacgacaccagcatgagccacggcgccaagtgcttcagcagcgacttcatggcctacgacatcgcctgcgacagatggagcgtgctgcccagacccgacctgcaccacgacgtgaacagattcggccacagcgccgtgctgcacaacagcaccatgtacgtgttcggcggcttcaacagcctgctgctgagcgacatcctggtgttcaccagcgagcagtgcgacgcccacagaagcgaggccgcctgcctggccgccggccccggcatcagatgcgtgtggaacaccggcagcagccagtgcatcagctgggccctggccaccgacgagcaggaggagaagctgaagagcgagtgcttcagcaagagaaccctggaccacgacagatgcgaccagcacaccgactgctacagctgcaccgccaacaccaacgactgccactggtgcaacgaccactgcgtgcccagaaaccacagctgcagcgagggccagatcagcatcttcagatacgagaactgccccaaggacaaccccatgtactactgcaacaagaagaccagctgcagaagctgcgccctggaccagaactgccagtgggagcccagaaaccaggagtgcatcgccctgcccgagaacatctgcggcatcggctggcacctggtgggcaacagctgcctgaagatcaccaccgccaaggagaactacgacaacgccaagctgttctgcagaaaccacaacgccctgctggccagcctgaccacccagaagaaggtggagttcgtgctgaagcagctgagaatcatgcagagcagccagagcatgagcaagctgaccctgaccccctgggtgggcctgagaaagatcaacgtgagctactggtgctgggaggacatgagccccttcaccaacagcctgctgcagtggatgcccagcgagcccagcgacgccggcttctgcggcatcctgagcgagcccagcaccagaggcctgaaggccgccacctgcatcaaccccctgaacggcagcgtgtgcgagagacccgccaaccacagcgccaagcagtgcagaaccccctgcgccctgagaaccgcctgcggcgactgcaccagcggcagcagcgagtgcatgtggtgcagcaacatgaagcagtgcgtggacagcaacgcctacgtggccagcttccccttcggccagtgcatggagtggtacaccatgagcacctgcccccccgagaactgcagcggctactgcacctgcagccactgcctggagcagcccggctgcggctggtgcaccgaccccagcaacaccggcaagggcaagtgcatcgagggcagctacaagggccccgtgaagatgcccagccaggcccccaccggcaacttctacccccagcccctgctgaacagcagcatgtgcctggaggacagcagatacaactggagcttcatccactgccccgcctgccagtgcaacggccacagcaagtgcatcaaccagagcatctgcgagaagtgcgagaacctgaccaccggcaagcactgcgagacctgcatcagcggcttctacggcgaccccaccaacggcggcaagtgccagccctgcaagtgcaacggccacgccagcctgtgcaacaccaacaccggcaagtgcttctgcaccaccaagggcgtgaagggcgacgagtgccagctgtgcgaggtggagaacagataccagggcaaccccctgagaggcacctgctactacaccctgctgatcgactaccagttcaccttcagcctgagccaggaggacgacagatactacaccgccatcaacttcgtggccacccccgacgagcagaacagagacctggacatgttcatcaacgccagcaagaacttcaacctgaacatcacctgggccgccagcttcagcgccggcacccaggccggcgaggagatgcccgtggtgagcaagaccaacatcaaggagtacaaggacagcttcagcaacgagaagttcgacttcagaaaccaccccaacatcaccttcttcgtgtacgtgagcaacttcacctggcccatcaagatccagtag

SEQ ID NO: 1649 - DNA, 3819 bp, Homo sapiens
atggtggccgccgccgccgccaccgaggccagactgagaagaagaaccgccgccaccgccgccctggccggcagaagcggcggcccccactgggactgggacgtgaccagagccggcagacccggcctgggcgccggcctgagactgcccagactgctgagcccccccctgagacccagactgctgctgctgctgctgctgctgagcccccccctgctgctgctgctgctgccctgcgaggccgaggccgccgccgccgccgccgccgtgagcggcagcgccgccgccgaggccaaggagtgcgacagaccctgcgtgaacggcggcagatgcaaccccggcaccggccagtgcgtgtgccccgccggctgggtgggcgagcagtgccagcactgcggcggcagattcagactgaccggcagcagcggcttcgtgaccgacggccccggcaactacaagtacaagaccaagtgcacctggctgatcgagggccagcccaacagaatcatgagactgagattcaaccacttcgccaccgagtgcagctgggaccacctgtacgtgtacgacggcgacagcatctacgcccccctggtggccgccttcagcggcctgatcgtgcccgagagagacggcaacgagaccgtgcccgaggtggtggccaccagcggctacgccctgctgcacttcttcagcgacgccgcctacaacctgaccggcttcaacatcacctacagcttcgacatgtgccccaacaactgcagcggcagaggcgagtgcaagatcagcaacagcagcgacaccgtggagtgcgagtgcagcgagaactggaagggcgaggcctgcgacatcccccactgcaccgacaactgcggcttcccccacagaggcatctgcaacagcagcgacgtgagaggctgcagctgcttcagcgactggcagggccccggctgcagcgtgcccgtgcccgccaaccagagcttctggaccagagaggagtacagcaacctgaagctgcccagagccagccacaaggccgtggtgaacggcaacatcatgtgggtggtgggcggctacatgttcaaccacagcgactacaacatggtgctggcctacgacctggccagcagagagtggctgcccctgaacagaagcgtgaacaacgtggtggtgagatacggccacagcctggccctgtacaaggacaagatctacatgtacggcggcaagatcgacagcaccggcaacgtgaccaacgagctgagagtgttccacatccacaacgagagctgggtgctgctgacccccaaggccaaggagcagtacgccgtggtgggccacagcgcccacatcgtgaccctgaagaacggcagagtggtgatgctggtgatcttcggccactgccccctgtacggctacatcagcaacgtgcaggagtacgacctggacaagaacacctggagcatcctgcacacccagggcgccctggtgcagggcggctacggccacagcagcgtgtacgaccacagaaccagagccctgtacgtgcacggcggctacaaggccttcagcgccaacaagtacagactggccgacgacctgtacagatacgacgtggacacccagatgtggaccatcctgaaggacagcagattcttcagatacctgcacaccgccgtgatcgtgagcggcaccatgctggtgttcggcggcaacacccacaacgacaccagcatgagccacggcgccaagtgcttcagcagcgacttcatggcctacgacatcgcctgcgacagatggagcgtgctgcccagacccgacctgcaccacgacgtgaacagattcggccacagcgccgtgctgcacaacagcaccatgtacgtgttcggcggcttcaacagcctgctgctgagcgacatcctggtgttcaccagcgagcagtgcgacgcccacagaagcgaggccgcctgcctggccgccggccccggcatcagatgcgtgtggaacaccggcagcagccagtgcatcagctgggccctggccaccgacgagcaggaggagaagctgaagagcgagtgcttcagcaagagaaccctggaccacgacagatgcgaccagcacaccgactgctacagctgcaccgccaacaccaacgactgccactggtgcaacgaccactgcgtgcccagaaaccacagctgcagcgagggccagatcagcatcttcagatacgagaactgccccaaggacaaccccatgtactactgcaacaagaagaccagctgcagaagctgcgccctggaccagaactgccagtgggagcccagaaaccaggagtgcatcgccctgcccgagaacatctgcggcatcggctggcacctggtgggcaacagctgcctgaagatcaccaccgccaaggagaactacgacaacgccaagctgttctgcagaaaccacaacgccctgctggccagcctgaccacccagaagaaggtggagttcgtgctgaagcagctgagaatcatgcagagcagccagagcatgagcaagctgaccctgaccccctgggtgggcctgagaaagatcaacgtgagctactggtgctgggaggacatgagccccttcaccaacagcctgctgcagtggatgcccagcgagcccagcgacgccggcttctgcggcatcctgagcgagcccagcaccagaggcctgaaggccgccacctgcatcaaccccctgaacggcagcgtgtgcgagagacccgccaaccacagcgccaagcagtgcagaaccccctgcgccctgagaaccgcctgcggcgactgcaccagcggcagcagcgagtgcatgtggtgcagcaacatgaagcagtgcgtggacagcaacgcctacgtggccagcttccccttcggccagtgcatggagtggtacaccatgagcacctgcccccccgagaactgcagcggctactgcacctgcagccactgcctggagcagcccggctgcggctggtgcaccgaccccagcaacaccggcaagggcaagtgcatcgagggcagctacaagggccccgtgaagatgcccagccaggcccccaccggcaacttctacccccagcccctgctgaacagcagcatgtgcctggaggacagcagatacaactggagcttcatccactgccccgcctgccagtgcaacggccacagcaagtgcatcaaccagagcatctgcgagaagtgcgagaacctgaccaccggcaagcactgcgagacctgcatcagcggcttctacggcgaccccaccaacggcggcaagtgccagccctgcaagtgcaacggccacgccagcctgtgcaacaccaacaccggcaagtgcttctgcaccaccaagggcgtgaagggcgacgagtgccagctgtgcgaggtggagaacagataccagggcaaccccctgagaggcacctgctactacaccctgctgatcgactaccagttcaccttcagcctgagccaggaggacgacagatactacaccgccatcaacttcgtggccacccccgacgagcagaacagagacctggacatgttcatcaacgccagcaagaacttcaacctgaacatcacctgggccgccagcttcagcgccggcacccaggccggcgaggagatgcccgtggtgagcaagaccaacatcaaggagtacaaggacagcttcagcaacgagaagttcgacttcagaaaccaccccaacatcaccttcttcgtgtacgtgagcaacttcacctggcccatcaagatccaggtgcagaccgagcagtag

SEQ ID NO: 1650 - DNA, 768 bp, Homo sapiens
atgttccaccaggtgagaagagtgatgaccatcctgttcctgaccatggtgatcagctacttcggctgcatgaaggccgcccccatgaaggaggccaacatcagaggccagggcggcctggcctaccccggcgtgagaacccacggcaccctggagagcgtgaacggccccaaggccggcagcagaggcctgaccagcctggccgacaccttcgagcacgtgatcgaggagctgctggacgaggaccagaaggtgagacccaacgaggagaacaacaaggacgccgacctgtacaccagcagagtgatgctgagcagccaggtgcccctggagccccccctgctgttcctgctggaggagtacaagaactacctggacgccgccaacatgagcatgagagtgagaagacacagcgaccccgccagaagaggcgagctgagcgtgtgcgacagcatcagcgagtgggtgaccgccgccgacaagaagaccgccgtggacatgagcggcggcaccgtgaccgtgctggagaaggtgcccgtgagcaagggccagctgaagcagtacttctacgagaccaagtgcaaccccatgggctacaccaaggagggctgcagaggcatcgacaagagacactggaacagccagtgcagaaccacccagagctacgtgagagccctgaccatggacagcaagaagagaatcggctggagattcatcagaatcgacaccagctgcgtgtgcaccctgaccatcaagagaggcagatag

SEQ ID NO: 1651 - DNA, 744 bp, Homo sapiens
atgaccatcctgttcctgaccatggtgatcagctacttcggctgcatgaaggccgcccccatgaaggaggccaacatcagaggccagggcggcctggcctaccccggcgtgagaacccacggcaccctggagagcgtgaacggccccaaggccggcagcagaggcctgaccagcctggccgacaccttcgagcacgtgatcgaggagctgctggacgaggaccagaaggtgagacccaacgaggagaacaacaaggacgccgacctgtacaccagcagagtgatgctgagcagccaggtgcccctggagccccccctgctgttcctgctggaggagtacaagaactacctggacgccgccaacatgagcatgagagtgagaagacacagcgaccccgccagaagaggcgagctgagcgtgtgcgacagcatcagcgagtgggtgaccgccgccgacaagaagaccgccgtggacatgagcggcggcaccgtgaccgtgctggagaaggtgcccgtgagcaagggccagctgaagcagtacttctacgagaccaagtgcaaccccatgggctacaccaaggagggctgcagaggcatcgacaagagacactggaacagccagtgcagaaccacccagagctacgtgagagccctgaccatggacagcaagaagagaatcggctggagattcatcagaatcgacaccagctgcgtgtgcaccctgaccatcaagagaggcagatag

SEQ ID NO: 1652 - DNA, 744 bp, Homo sapiens; identical to SEQ ID NO: 1651

SEQ ID NO: 1653 - DNA, 744 bp, Homo sapiens; identical to SEQ ID NO: 1651

SEQ ID NO: 1654 - DNA, 744 bp, Homo sapiens; identical to SEQ ID NO: 1651

SEQ ID NO: 1655 - DNA, 744 bp, Homo sapiens; identical to SEQ ID NO: 1651

SEQ ID NO: 1656 - DNA, 789 bp, Homo sapiens
atgcagagcagagaggaggagtggttccaccaggtgagaagagtgatgaccatcctgttcctgaccatggtgatcagctacttcggctgcatgaaggccgcccccatgaaggaggccaacatcagaggccagggcggcctggcctaccccggcgtgagaacccacggcaccctggagagcgtgaacggccccaaggccggcagcagaggcctgaccagcctggccgacaccttcgagcacgtgatcgaggagctgctggacgaggaccagaaggtgagacccaacgaggagaacaacaaggacgccgacctgtacaccagcagagtgatgctgagcagccaggtgcccctggagccccccctgctgttcctgctggaggagtacaagaactacctggacgccgccaacatgagcatgagagtgagaagacacagcgaccccgccagaagaggcgagctgagcgtgtgcgacagcatcagcgagtgggtgaccgccgccgacaagaagaccgccgtggacatgagcggcggcaccgtgaccgtgctggagaaggtgcccgtgagcaagggccagctgaagcagtacttctacgagaccaagtgcaaccccatgggctacaccaaggagggctgcagaggcatcgacaagagacactggaacagccagtgcagaaccacccagagctacgtgagagccctgaccatggacagcaagaagagaatcggctggagattcatcagaatcgacaccagctgcgtgtgcaccctgaccatcaagagaggcagatag

SEQ ID NO: 1657 - DNA, 744 bp, Homo sapiens; identical to SEQ ID NO: 1651

SEQ ID NO: 1658 - DNA, 744 bp, Homo sapiens; identical to SEQ ID NO: 1651

SEQ ID NO: 1659 - DNA, 990 bp, Homo sapiens
atgtgcggcgccaccagcttcctgcacgagtgcaccagactgatcctggtgaccacccagaacgccgagttcctgcagaagggcctgcaggtgcacacctgcttcggcgtgtacccccacgccagcgtgtggcacgactgcgccagccagaagaagggctgcgccgtgtacctgcacgtgagcgtggagttcaacaagctgatccccgagaacggcttcatcaagttccaccaggtgagaagagtgatgaccatcctgttcctgaccatggtgatcagctacttcggctgcatgaaggccgcccccatgaaggaggccaacatcagaggccagggcggcctggcctaccccggcgtgagaacccacggcaccctggagagcgtgaacggccccaaggccggcagcagaggcctgaccagcctggccgacaccttcgagcacgtgatcgaggagctgctggacgaggaccagaaggtgagacccaacgaggagaacaacaaggacgccgacctgtacaccagcagagtgatgctgagcagccaggtgcccctggagccccccctgctgttcctgctggaggagtacaagaactacctggacgccgccaacatgagcatgagagtgagaagacacagcgaccccgccagaagaggcgagctgagcgtgtgcgacagcatcagcgagtgggtgaccgccgccgacaagaagaccgccgtggacatgagcggcggcaccgtgaccgtgctggagaaggtgcccgtgagcaagggccagctgaagcagtacttctacgagaccaagtgcaaccccatgggctacaccaaggagggctgcagaggcatcgacaagagacactggaacagccagtgcagaaccacccagagctacgtgagagccctgaccatggacagcaagaagagaatcggctggagattcatcagaatcgacaccagctgcgtgtgcaccctgaccatcaagagaggcagatag

SEQ ID NO: 1660 - DNA, 744 bp, Homo sapiens; identical to SEQ ID NO: 1651

SEQ ID NO: 1661 - DNA, 744 bp, Homo sapiens; identical to SEQ ID NO: 1651

SEQ ID NO: 1662 - DNA, 744 bp, Homo sapiens; identical to SEQ ID NO: 1651

SEQ ID NO: 1663 - DNA, 744 bp, Homo sapiens; identical to SEQ ID NO: 1651

SEQ ID NO: 1664 - DNA, 744 bp, Homo sapiens; identical to SEQ ID NO: 1651

SEQ ID NO: 1665 - DNA, 744 bp, Homo sapiens; identical to SEQ ID NO: 1651

SEQ ID NO: 1666 - DNA, 744 bp, Homo sapiens; identical to SEQ ID NO: 1651

SEQ ID NO: 1667 - DNA, 234 bp, Homo sapiens
atgtgcggcgccaccagcttcctgcacgagtgcaccagactgatcctggtgaccacccagaacgccgagttcctgcagaagggcctgcaggtgcacacctgcttcggcgtgtacccccacgccagcgtgtggcacgactgcgccagccagaagaagggctgcgccgtgtacctgcacgtgagcgtggagttcaacaagctgatccccgagaacggcttcatcaagggctggtag

SEQ ID NO: 1668 - DNA, 894 bp, Homo sapiens
atgagcagcgcccacttcaacagaggccccgcctacggcctgagcgccgaggtgaagaacaagctggcccagaagtacgaccaccagagagagcaggagctgagagagtggatcgagggcgtgaccggcagaagaatcggcaacaacttcatggacggcctgaaggacggcatcatcctgtgcgagttcatcaacaagctgcagcccggcagcgtgaagaagatcaacgagagcacccagaactggcaccagctggagaacatcggcaacttcatcaaggccatcaccaagtacggcgtgaagccccacgacatcttcgaggccaacgacctgttcgagaacaccaaccacacccaggtgcagagcaccctgctggccctggccagcatggccaagaccaagggcaacaaggtgaacgtgggcgtgaagtacgccgagaagcaggagagaaagttcgagcccggcaagctgagagagggcagaaacatcatcggcctgcagatgggcaccaacaagttcgccagccagcagggcatgaccgcctacggcaccagaagacacctgtacgaccccaagctgggcaccgaccagcccctggaccaggccaccatcagcctgcagatgggcaccaacaagggcgccagccaggccggcatgaccgcccccggcaccaagagacagatcttcgagcccggcctgggcatggagcactgcgacaccctgaacgtgagcctgcagatgggcagcaacaagggcgccagccagagaggcatgaccgtgtacggcctgcccagacaggtgtacgaccccaagtactgcctgacccccgagtaccccgagctgggcgagcccgcccacaaccaccacgcccacaactactacaacagcgcctag

SEQ ID NO: 1669 - DNA, 744 bp, Homo sapiens
atggacggcctgaaggacggcatcatcctgtgcgagttcatcaacaagctgcagcccggcagcgtgaagaagatcaacgagagcacccagaactggcaccagctggagaacatcggcaacttcatcaaggccatcaccaagtacggcgtgaagccccacgacatcttcgaggccaacgacctgttcgagaacaccaaccacacccaggtgcagagcaccctgctggccctggccagcatggccaagaccaagggcaacaaggtgaacgtgggcgtgaagtacgccgagaagcaggagagaaagttcgagcccggcaagctgagagagggcagaaacatcatcggcctgcagatgggcaccaacaagttcgccagccagcagggcatgaccgcctacggcaccagaagacacctgtacgaccccaagctgggcaccgaccagcccctggaccaggccaccatcagcctgcagatgggcaccaacaagggcgccagccaggccggcatgaccgcccccggcaccaagagacagatcttcgagcccggcctgggcatggagcactgcgacaccctgaacgtgagcctgcagatgggcagcaacaagggcgccagccagagaggcatgaccgtgtacggcctgcccagacaggtgtacgaccccaagtactgcctgacccccgagtaccccgagctgggcgagcccgcccacaaccaccacgcccacaactactacaacagcgcctag

SEQ ID NO: 1670 - DNA, 834 bp, Homo sapiens
atgctggcccagaagtacgaccaccagagagagcaggagctgagagagtggatcgagggcgtgaccggcagaagaatcggcaacaacttcatggacggcctgaaggacggcatcatcctgtgcgagttcatcaacaagctgcagcccggcagcgtgaagaagatcaacgagagcacccagaactggcaccagctggagaacatcggcaacttcatcaaggccatcaccaagtacggcgtgaagccccacgacatcttcgaggccaacgacctgttcgagaacaccaaccacacccaggtgcagagcaccctgctggccctggccagcatggccaagaccaagggcaacaaggtgaacgtgggcgtgaagtacgccgagaagcaggagagaaagttcgagcccggcaagctgagagagggcagaaacatcatcggcctgcagatgggcaccaacaagttcgccagccagcagggcatgaccgcctacggcaccagaagacacctgtacgaccccaagctgggcaccgaccagcccctggaccaggccaccatcagcctgcagatgggcaccaacaagggcgccagccaggccggcatgaccgcccccggcaccaagagacagatcttcgagcccggcctgggcatggagcactgcgacaccctgaacgtgagcctgcagatgggcagcaacaagggcgccagccagagaggcatgaccgtgtacggcctgcccagacaggtgtacgaccccaagtactgcctgacccccgagtaccccgagctgggcgagcccgcccacaaccaccacgcccacaactactacaacagcgcctag

SEQ ID NO: 1671 - DNA, 930 bp, Homo sapiens
atgagcagcacccagttcaacaagggccccagctacggcctgagcgccgaggtgaagaacagactgctgagcaagtacgacccccagaaggaggccgagctgagaacctggatcgagggcctgaccggcctgagcatcggccccgacttccagaagggcctgaaggacggcaccatcctgtgcaccctgatgaacaagctgcagcccggcagcgtgcccaagatcaacagaagcatgcagaactggcaccagctggagaacctgagcaacttcatcaaggccatggtgagctacggcatgaaccccgtggacctgttcgaggccaacgacctgttcgagagcggcaacatgacccaggtgcaggtgagcctgctggccctggccggcaaggccaagaccaagggcctgcagagcggcgtggacatcggcgtgaagtacagcgagaagcaggagagaaacttcgacgacgccaccatgaaggccggccagtgcgtgatcggcctgcagatgggcaccaacaagtgcgccagccagagcggcatgaccgcctacggcaccagaagacacctgtacgaccccaagaaccacatcctgccccccatggaccacagcaccatcagcctgcagatgggcaccaacaagtgcgccagccaggtgggcatgaccgcccccggcaccagaagacacatctacgacaccaagctgggcaccgacaagtgcgacaacagcagcatgagcctgcagatgggctacacccagggcgccaaccagagcggccaggtgttcggcctgggcagacagatctacgaccccaagtactgcccccagggcaccgtggccgacggcgcccccagcggcaccggcgactgccccgaccccggcgaggtgcccgagtaccccccctactaccaggaggaggccggctactag

SEQ ID NO: 1672 - DNA, 813 bp, Homo sapiens
atgagcagcacccagttcaacaagggccccagctacggcctgagcgccgaggtgaagaacagactgctgagcaagtacgacccccagaaggaggccgagctgagaacctggatcgagggcctgaccggcctgagcatcggccccgacttccagaagggcctgaaggacggcaccatcctgtgcaccctgatgaacaagctgcagcccggcagcgtgcccaagatcaacagaagcatgcagaactggcaccagctggagaacctgagcaacttcatcaaggccatggtgagctacggcatgaaccccgtggacctgttcgaggccaacgacctgttcgagagcggcaacatgacccaggtgcaggtgagcctgctggccctggccggcaagatgggcaccaacaagtgcgccagccagagcggcatgaccgcctacggcaccagaagacacctgtacgaccccaagaaccacatcctgccccccatggaccacagcaccatcagcctgcagatgggcaccaacaagtgcgccagccaggtgggcatgaccgcccccggcaccagaagacacatctacgacaccaagctgggcaccgacaagtgcgacaacagcagcatgagcctgcagatgggctacacccagggcgccaaccagagcggccaggtgttcggcctgggcagacagatctacgaccccaagtactgcccccagggcaccgtggccgacggcgcccccagcggcaccggcgactgccccgaccccggcgaggtgcccgagtaccccccctactaccaggaggaggccggctactag

SEQ ID NO: 1673 - DNA, 867 bp, Homo sapiens
atgagcagcacccagttcaacaagggccccagctacggcctgagcgccgaggtgaagaacagactgctgagcaagtacgacccccagaagaagggcctgaaggacggcaccatcctgtgcaccctgatgaacaagctgcagcccggcagcgtgcccaagatcaacagaagcatgcagaactggcaccagctggagaacctgagcaacttcatcaaggccatggtgagctacggcatgaaccccgtggacctgttcgaggccaacgacctgttcgagagcggcaacatgacccaggtgcaggtgagcctgctggccctggccggcaaggccaagaccaagggcctgcagagcggcgtggacatcggcgtgaagtacagcgagaagcaggagagaaacttcgacgacgccaccatgaaggccggccagtgcgtgatcggcctgcagatgggcaccaacaagtgcgccagccagagcggcatgaccgcctacggcaccagaagacacctgtacgaccccaagaaccacatcctgccccccatggaccacagcaccatcagcctgcagatgggcaccaacaagtgcgccagccaggtgggcatgaccgcccccggcaccagaagacacatctacgacaccaagctgggcaccgacaagtgcgacaacagcagcatgagcctgcagatgggctacacccagggcgccaaccagagcggccaggtgttcggcctgggcagacagatctacgaccccaagtactgcccccagggcaccgtggccgacggcgcccccagcggcaccggcgactgccccgaccccggcgaggtgcccgagtaccccccctactaccaggaggaggccggctactag

SEQ ID NO: 1674 - DNA, 990 bp, Homo sapiens
atgacccacttcaacaagggccccagctacggcctgagcgccgaggtgaagaacaagatcgccagcaagtacgaccaccaggccgaggaggacctgagaaactggatcgaggaggtgaccggcatgagcatcggccccaacttccagctgggcctgaaggacggcatcatcctgtgcgagctgatcaacaagctgcagcccggcagcgtgaagaaggtgaacgagagcagcctgaactggccccagctggagaacatcggcaacttcatcaaggccatccaggcctacggcatgaagccccacgacatcttcgaggccaacgacctgttcgagaacggcaacatgacccaggtgcagaccaccctggtggccctggccggcctggccaagaccaagggcttccacaccaccatcgacatcggcgtgaagtacgccgagaagcagaccagaagattcgacgagggcaagctgaaggccggccagagcgtgatcggcctgcagatgggcaccaacaagtgcgccagccaggccggcatgaccgcctacggcaccagaagacacctgtacgaccccaagatgcagaccgacaagcccttcgaccagaccaccatcagcctgcagatgggcaccaacaagggcgccagccaggccggcatgctggcccccggcaccagaagagacatctacgaccagaagctgaccctgcagcccgtggacaacagcaccatcagcctgcagatgggcaccaacaaggtggccagccagaagggcatgagcgtgtacggcctgggcagacaggtgtacgaccccaagtactgcgccgcccccaccgagcccgtgatccacaacggcagccagggcaccggcaccaacggcagcgagatcagcgacagcgactaccaggccgagtaccccgacgagtaccacggcgagtaccaggacgactaccccagagactaccagtacagcgaccagggcatcgactactag

SEQ ID NO: 1675 - DNA, 852 bp, Homo sapiens
atgacccacttcaacaagggccccagctacggcctgagcgccgaggtgaagaacaagatcgccagcaagtacgaccaccaggccgaggaggacctgagaaactggatcgaggaggtgaccggcatgagcatcggccccaacttccagctgggcctgaaggacggcatcatcctgtgcgagctgatcaacaagctgcagcccggcagcgtgaagaaggtgaacgagagcagcctgaactggccccaggccaagaccaagggcttccacaccaccatcgacatcggcgtgaagtacgccgagaagcagaccagaagattcgacgagggcaagctgaaggccggccagagcgtgatcggcctgcagatgggcaccaacaagtgcgccagccaggccggcatgaccgcctacggcaccagaagacacctgtacgaccccaagatgcagaccgacaagcccttcgaccagaccaccatcagcctgcagatgggcaccaacaagggcgccagccaggccggcatgctggcccccggcaccagaagagacatctacgaccagaagctgaccctgcagcccgtggacaacagcaccatcagcctgcagatgggcaccaacaaggtggccagccagaagggcatgagcgtgtacggcctgggcagacaggtgtacgaccccaagtactgcgccgcccccaccgagcccgtgatccacaacggcagccagggcaccggcaccaacggcagcgagatcagcgacagcgactaccaggccgagtaccccgacgagtaccacggcgagtaccaggacgactaccccagagactaccagtacagcgaccagggcatcgactactag

SEQ ID NO: 1676 - DNA, 558 bp, Homo sapiens
atgagcatcggccccaacttccagctgggcctgaaggacggcatcatcctgtgcgagctgatcaacaagctgcagcccggcagcgtgaagaaggtgaacgagagcagcctgaactggccccagctggagaacatcggcaacttcatcaaggccatccaggcctacggcatgaagccccacgacatcttcgaggccaacgacctgttcgagaacggcaacatgacccaggtgcagaccaccctggtggccctggccggcctggccaagaccaagggcttccacaccaccatcgacatcggcgtgaagtacgccgagaagcagaccagaagattcgacgagggcaagctgaaggccggccagagcgtgatcggcctgcagatgggcaccaacaagtgcgccagccaggccggcatgaccgcctacggcaccagaagacacctgtacgaccccaagatgcagaccgacaagcccttcgaccagaccaccatcagcctgcagatgggcaccaacaagggcgccagccaggccggcatgctggcccccggcaccagaagatag

SEQ ID NO: 1677 - DNA, 990 bp, Homo sapiens; identical to SEQ ID NO: 1674

SEQ ID NO: 1678 - DNA, 867 bp, Homo sapiens
atgagcatcggccccaacttccagctgggcctgaaggacggcatcatcctgtgcgagctgatcaacaagctgcagcccggcagcgtgaagaaggtgaacgagagcagcctgaactggccccagctggagaacatcggcaacttcatcaaggccatccaggcctacggcatgaagccccacgacatcttcgaggccaacgacctgttcgagaacggcaacatgacccaggtgcagaccaccctggtggccctggccggcctggccaagaccaagggcttccacaccaccatcgacatcggcgtgaagtacgccgagaagcagaccagaagattcgacgagggcaagctgaaggccggccagagcgtgatcggcctgcagatgggcaccaacaagtgcgccagccaggccggcatgaccgcctacggcaccagaagacacctgtacgaccccaagatgcagaccgacaagcccttcgaccagaccaccatcagcctgcagatgggcaccaacaagggcgccagccaggccggcatgctggcccccggcaccagaagagacatctacgaccagaagctgaccctgcagcccgtggacaacagcaccatcagcctgcagatgggcaccaacaaggtggccagccagaagggcatgagcgtgtacggcctgggcagacaggtgtacgaccccaagtactgcgccgcccccaccgagcccgtgatccacaacggcagccagggcaccggcaccaacggcagcgagatcagcgacagcgactaccaggccgagtaccccgacgagtaccacggcgagtaccaggacgactaccccagagactaccagtacagcgaccagggcatcgactactag

SEQ ID NO: 1679 - DNA, 2223 bp, Homo sapiens
atgggcgagctgtgcagaagagacagcgccctgaccgccctggacgaggagaccctgtgggagatgatggagagccacagacacagaatcgtgagatgcatctgccccagcagactgaccccctacctgagacaggccaaggtgctgtgccagctggacgaggaggaggtgctgcacagccccagactgaccaacagcgccatgagagccggccacctgctggacctgctgaagaccagaggcaagaacggcgccatcgccttcctggagagcctgaagttccacaaccccgacgtgtacaccctggtgaccggcctgcagcccgacgtggacttcagcaacttcagcggcctgatggagaccagcaagctgaccgagtgcctggccggcgccatcggcagcctgcaggaggagctgaaccaggagaagggccagaaggaggtgctgctgagaagatgccagcagctgcaggagcacctgggcctggccgagaccagagccgagggcctgcaccagctggaggccgaccacagcagaatgaagagagaggtgagcgcccacttccacgaggtgctgagactgaaggacgagatgctgagcctgagcctgcactacagcaacgccctgcaggagaaggagctggccgccagcagatgcagaagcctgcaggaggagctgtacctgctgaagcaggagctgcagagagccaacatggtgagcagctgcgagctggagctgcaggagcagagcctgagaaccgccagcgaccaggagagcggcgacgaggagctgaacagactgaaggaggagaacgagaagctgagaagcctgaccttcagcctggccgagaaggacatcctggagcagagcctggacgaggccagaggcagcagacaggagctggtggagagaatccacagcctgagagagagagccgtggccgccgagagacagagagagcagtactgggaggagaaggagcagaccctgctgcagttccagaagagcaagatggcctgccagctgtacagagagaaggtgaacgccctgcaggcccaggtgtgcgagctgcagaaggagagagaccaggcctacagcgccagagacagcgcccagagagagatcagccagagcctggtggagaaggacagcctgagaagacaggtgttcgagctgaccgaccaggtgtgcgagctgagaacccagctgagacagctgcaggccgagccccccggcgtgctgaagcaggaggccagaaccagagagccctgccccagagagaagcagagactggtgagaatgcacgccatctgccccagagacgacagcgactgcagcctggtgagcagcaccgagagccagctgctgagcgacctgagcgccaccagcagcagagagctggtggacagcttcagaagcagcagccccgccccccccagccagcagagcctgtacaagagagtggccgaggacttcggcgaggagccctggagcttcagcagctgcctggagatccccgagggcgaccccggcgccctgcccggcgccaaggccggcgacccccacctggactacgagctgctggacaccgccgacctgccccagctggagagcagcctgcagcccgtgagccccggcagactggacgtgagcgagagcggcgtgctgatgagaagaagacccgccagaagaatcctgagccaggtgaccatgctggccttccagggcgacgccctgctggagcagatcagcgtgatcggcggcaacctgaccggcatcttcatccacagagtgacccccggcagcgccgccgaccagatggccctgagacccggcacccagatcgtgatggtggactacgaggccagcgagcccctgttcaaggccgtgctggaggacaccaccctggaggaggccgtgggcctgctgagaagagtggacggcttctgctgcctgagcgtgaaggtgaacaccgacggctacaagagactgctgcaggacctggaggccaaggtggccaccagcggcgacagcttctacatcagagtgaacctggccatggagggcagagccaagggcgagctgcaggtgcactgcaacgaggtgctgcacgtgaccgacaccatgttccagggctgcggctgctggcacgcccacagagtgaacagctacaccatgaaggacaccgccgcccacggcaccatccccaactacagcagatag

SEQ ID NO: 1680 - DNA, 3015 bp, Homo sapiens
atgggcgagctgtgcagaagagacagcgccctgaccgccctggacgaggagaccctgtgggagatgatggagagccacagacacagaatcgtgagatgcatctgccccagcagactgaccccctacctgagacaggccaaggtgctgtgccagctggacgaggaggaggtgctgcacagccccagactgaccaacagcgccatgagagccggccacctgctggacctgctgaagaccagaggcaagaacggcgccatcgccttcctggagagcctgaagttccacaaccccgacgtgtacaccctggtgaccggcctgcagcccgacgtggacttcagcaacttcagcggcctgatggagaccagcaagctgaccgagtgcctggccggcgccatcggcagcctgcaggaggagctgaaccaggagaagggccagaaggaggtgctgctgagaagatgccagcagctgcaggagcacctgggcctggccgagaccagagccgagggcctgcaccagctggaggccgaccacagcagaatgaagagagaggtgagcgcccacttccacgaggtgctgagactgaaggacgagatgctgagcctgagcctgcactacagcaacgccctgcaggagaaggagctggccgccagcagatgcagaagcctgcaggaggagctgtacctgctgaagcaggagctgcagagagccaacatggtgagcagctgcgagctggagctgcaggagcagagcctgagaaccgccagcgaccaggagagcggcgacgaggagctgaacagactgaaggaggagaacgagaagctgagaagcctgaccttcagcctggccgagaaggacatcctggagcagagcctggacgaggccagaggcagcagacaggagctggtggagagaatccacagcctgagagagagagccgtggccgccgagagacagagagagcagtactgggaggagaaggagcagaccctgctgcagttccagaagagcaagatggcctgccagctgtacagagagaaggtgaacgccctgcaggcccaggtgtgcgagctgcagaaggagagagaccaggcctacagcgccagagacagcgcccagagagagatcagccagagcctggtggagaaggacagcctgagaagacaggtgttcgagctgaccgaccaggtgtgcgagctgagaacccagctgagacagctgcaggccgagccccccggcgtgctgaagcaggaggccagaaccagagagccctgccccagagagaagcagagactggtgagaatgcacgccatctgccccagagacgacagcgactgcagcctggtgagcagcaccgagagccagctgctgagcgacctgagcgccaccagcagcagagagctggtggacagcttcagaagcagcagccccgccccccccagccagcagagcctgtacaagagagtggccgaggacttcggcgaggagccctggagcttcagcagctgcctggagatccccgagggcgaccccggcgccctgcccggcgccaaggccggcgacccccacctggactacgagctgctggacaccgccgacctgccccagctggagagcagcctgcagcccgtgagccccggcagactggacgtgagcgagagcggcgtgctgatgagaagaagacccgccagaagaatcctgagccaggtgaccatgctggccttccagggcgacgccctgctggagcagatcagcgtgatcggcggcaacctgaccggcatcttcatccacagagtgacccccggcagcgccgccgaccagatggccctgagacccggcacccagatcgtgatggtggactacgaggccagcgagcccctgttcaaggccgtgctggaggacaccaccctggaggaggccgtgggcctgctgagaagagtggacggcttctgctgcctgagcgtgaaggtgaacaccgacggctacaagagactgctgcaggacctggaggccaaggtggccaccagcggcgacagcttctacatcagagtgaacctggccatggagggcagagccaagggcgagctgcaggtgcactgcaacgaggtgctgcacgtgaccgacaccatgttccagggctgcggctgctggcacgcccacagagtgaacagctacaccatgaaggacaccgccgcccacggcaccatccccaactacagcagagcccagcagcagctgatcgccctgatccaggacatgacccagcagtgcaccgtgaccagaaagcccagcagcggcggcccccagaagctggtgagaatcgtgagcatggacaaggccaaggccagccccctgagactgagcttcgacagaggccagctggaccccagcagaatggagggcagcagcacctgcttctgggccgagagctgcctgaccctggtgccctacaccctggtgagaccccacagacccgccagacccagacccgtgctgctggtgcccagagccgtgggcaagatcctgagcgagaagctgtgcctgctgcagggcttcaagaagtgcctggccgagtacctgagccaggaggagtacgaggcctggagccagagaggcgacatcatccaggagggcgaggtgagcggcggcagatgctgggtgaccagacacgccgtggagagcctgatggagaagaacacccacgccctgctggacgtgcagctggacagcgtgtgcaccctgcacagaatggacatcttccccatcgtgatccacgtgagcgtgaacgagaagatggccaagaagctgaagaagggcctgcagagactgggcaccagcgaggagcagctgctggaggccgccagacaggaggagggcgacctggacagagccccctgcctgtacagcagcctggcccccgacggctggagcgacctggacggcctgctgagctgcgtgagacaggccatcgccgacgagcagaagaaggtggtgtggaccgagcagagccccagatag

SEQ ID NO: 1681 - DNA, 1305 bp, Homo sapiens
atggtgagcagctgcgagctggagctgcaggagcagagcctgagaaccgccagcgaccaggagagcggcgacgaggagctgaacagactgaaggaggagaacgagaagctgagaagcctgaccttcagcctggccgagaaggacatcctggagcagagcctggacgaggccagaggcagcagacaggagctggtggagagaatccacagcctgagagagagagccgtggccgccgagagacagagagagcagtactgggaggagaaggagcagaccctgctgcagttccagaagagcaagatggcctgccagctgtacagagagaaggtgaacgccctgcaggcccaggtgtgcgagctgcagaaggagagagaccaggcctacagcgccagagacagcgcccagagagagatcagccagagcctggtggagaaggacagcctgagaagacaggtgttcgagctgaccgaccaggtgtgcgagctgagaacccagctgagacagctgcaggccgagccccccggcgtgctgaagcaggaggccagaaccagagagccctgccccagagagaagcagagactggtgagaatgcacgccatctgccccagagacgacagcgactgcagcctggtgagcagcaccgagagccagctgctgagcgacctgagcgccaccagcagcagagagctggtggacagcttcagaagcagcagccccgccccccccagccagcagagcctgtacaagagagtggccgaggacttcggcgaggagccctggagcttcagcagctgcctggagatccccgagggcgaccccggcgccctgcccggcgccaaggccggcgacccccacctggactacgagctgctggacaccgccgacctgccccagctggagagcagcctgcagcccgtgagccccggcagactggacgtgagcgagagcggcgtgctgatgagaagaagacccgccagaagaatcctgagccaggtgaccatgctggccttccagggcgacgccctgctggagcagatcagcgtgatcggcggcaacctgaccggcatcttcatccacagagtgacccccggcagcgccgccgaccagatggccctgagacccggcacccagatcgtgatggtgagcagagccagacccctgctgagccccggcctgctgatgggcaccgtggccgccggcggcgtgacccaggccgacttcaccagccccagaagatgcagaagcaccctgggctgggccagcgccctgagctgggccgacgtgaagagaagcgcccacctgtag

SEQ ID NO: 1682 - DNA, 3015 bp, Homo sapiens; identical to SEQ ID NO: 1680

SEQ ID NO: 1683 - DNA, 1326 bp, Homo sapiens
atggtgagcagctgcgagctggagctgcaggagcagagcctgagaaccgccagcgaccaggagagcggcgacgaggagctgaacagactgaaggaggagaacgagaagctgagaagcctgaccttcagcctggccgagaaggacatcctggagcagagcctggacgaggccagaggcagcagacaggagctggtggagagaatccacagcctgagagagagagccgtggccgccgagagacagagagagcagtactgggaggagaaggagcagaccctgctgcagttccagaagagcaagatggcctgccagctgtacagagagaaggtgaacgccctgcaggcccaggtgtgcgagctgcagaaggagagagaccaggcctacagcgccagagacagcgcccagagagagatcagccagagcctggtggagaaggacagcctgagaagacaggtgttcgagctgaccgaccaggtgtgcgagctgagaacccagctgagacagctgcaggccgagccccccggcgtgctgaagcaggaggccagaaccagagagccctgccccagagagaagcagagactggtgagaatgcacgccatctgccccagagacgacagcgactgcagcctggtgagcagcaccgagagccagctgctgagcgacctgagcgccaccagcagcagagagctggtggacagcttcagaagcagcagccccgccccccccagccagcagagcctgtacaagagagtggccgaggacttcggcgaggagccctggagcttcagcagctgcctggagatccccgagggcgaccccggcgccctgcccggcgccaaggccggcgacccccacctggactacgagctgctggacaccgccgacctgccccagctggagagcagcctgcagcccgtgagccccggcagactggacgtgagcgagagcggcgtgctgatgagaagaagacccgccagaagaatcctgagccaggtgaccatgctggccttccagggcgacgccctgctggagcagatcagcgtgatcggcggcaacctgaccggcatcttcatccacagagtgacccccggcagcgccgccgaccagatggccctgagacccggcacccagatcgtgatggtgatcagaggctacagcagaacctggagacccaagtggagacccagaggcacccacagcaccagcggcagcacctggccctggagagccggccccaagggcagctgcagatgcatcgccaccagaagctgcaccagccccaccccctgcagcagagccgccgccgccggcatgcccaccgcctag

SEQ ID NO: 1684 - DNA, 2349 bp, Homo sapiens
atgttcccccccagcggcagcaccggcctgatcccccccagccacttccaggccagacccctgagcaccctgcccagaatggcccccacctggctgagcgacatccccctggtgcagccccccggccaccaggacgtgagcgagagaagactggacacccagagaccccaggtgaccatgtgggagagagacgtgagcagcgacagacaggagcccggcagaagaggcagaagctggggcctggagggcagccaggccctgagccagcaggccgaggtgatcgtgagacagctgcaggagctgagaagactggaggaggaggtgagactgctgagagagaccagcctgcagcagaagatgagactggaggcccaggccatggagctggaggccctggccagagccgagaaggccggcagagccgaggccgagggcctgagagccgccctggccggcgccgaggtggtgagaaagaacctggaggagggcagccagagagagctggaggaggtgcagagactgcaccaggagcagctgagcagcctgacccaggcccacgaggaggccctgagcagcctgaccagcaaggccgagggcctggagaagagcctgagcagcctggagaccagaagagccggcgaggccaaggagctggccgaggcccagagagaggccgagctgctgagaaagcagctgagcaagacccaggaggacctggaggcccaggtgaccctggtggagaacctgagaaagtacgtgggcgagcaggtgcccagcgaggtgcacagccagacctgggagctggagagacagaagctgctggagaccatgcagcacctgcaggaggacagagacagcctgcacgccaccgccgagctgctgcaggtgagagtgcagagcctgacccacatcctggccctgcaggaggaggagctgaccagaaaggtgcagcccagcgacagcctggagcccgagttcaccagaaagtgccagagcctgctgaacagatggagagagaaggtgttcgccctgatggtgcagctgaaggcccaggagctggagcacagcgacagcgtgaagcagctgaagggccaggtggccagcctgcaggagaaggtgaccagccagagccaggagcaggccatcctgcagagaagcctgcaggacaaggccgccgaggtggaggtggagagaatgggcgccaagggcctgcagctggagctgagcagagcccaggaggccagaagaagatggcagcagcagaccgccagcgccgaggagcagctgagactggtggtgaacgccgtgagcagcagccagatctggctggagaccaccatggccaaggtggagggcgccgccgcccagctgcccagcctgaacaacagactgagctacgccgtgagaaaggtgcacaccatcagaggcctgatcgccagaaagctggccctggcccagctgagacaggagagctgccccctgcccccccccgtgaccgacgtgagcctggagctgcagcagctgagagaggagagaaacagactggacgccgagctgcagctgagcgccagactgatccagcaggaggtgggcagagccagagagcagggcgaggccgagagacagcagctgagcaaggtggcccagcagctggagcaggagctgcagcagacccaggagagcctggccagcctgggcctgcagctggaggtggccagacagggccagcaggagagcaccgaggaggccgccagcctgagacaggagctgacccagcagcaggagctgtacggccaggccctgcaggagaaggtggccgaggtggagaccagactgagagagcagctgagcgacaccgagagaagactgaacgaggccagaagagagcacgccaaggccgtggtgagcctgagacagatccagagaagagccgcccaggagaaggagagaagccaggagctgagaagactgcaggaggaggccagaaaggaggagggccagagactggccagaagactgcaggagctggagagagacaagaacctgatgctggccaccctgcagcaggagggcctgctgagcagatacaagcagcagagactgctgaccgtgctgcccagcctgctggacaagaagaagagcgtggtgagcagccccagaccccccgagtgcagcgccagcgcccccgtggccgccgccgtgcccaccagagagagcatcaagggcagcctgagcgtgctgctggacgacctgcaggacctgagcgaggccatcagcaaggaggaggccgtgtgccagggcgacaacctggacagatgcagcagcagcaacccccagatgagcagctag

SEQ ID NO: 1685 - DNA, 2349 bp, Homo sapiens
atgttcccccccagcggcagcaccggcctgatcccccccagccacttccaggccagacccctgagcaccctgcccagaatggcccccacctggctgagcgacatccccctggtgcagccccccggccaccaggacgtgagcgagagaagactggacacccagagaccccaggtgaccatgtgggagagagacgtgagcagcgacagacaggagcccggcagaagaggcagaagctggggcctggagggcagccaggccctgagccagcaggccgaggtgatcgtgagacagctgcaggagctgagatggctggaggaggaggtgtggctgctgagagagaccagcctgcagcagaagatgagactggaggcccaggccatggagctggaggccctggccagagccgagaaggccggcagagccgaggccgagggcctgagagccgccctggccggcgccgaggtggtgagaaagaacctggaggagggcagacagagagagctggaggaggtgcagagactgcaccaggagcagctgagcagcctgacccaggcccacgaggaggccctgagcagcctgaccagcaaggccgagggcctggagaagagcctgagcagcctggagaccagaagagccggcgaggccaaggagctggccgaggcccagagagaggccgagctgctgagaaagcagctgagcaagacccaggaggacctggaggcccaggtgaccctggtggagaacctgagaaagtacgtgggcgagcaggtgcccagcgaggtgcacagccagacctgggagctggagagacagaagctgctggagaccatgcagcacctgcaggaggacagagacagcctgcacgccaccgccgagctgctgcaggtgagagtgcagagcctgacccacatcctggccctgcaggaggaggagctgaccagaaaggtgcagcccagcgacagcctggagcccgagttcaccagaaagtgccagagcctgctgaacagatggagagagaaggtgttcgccctgatggtgcagctgaaggcccaggagctggagcacagcgacagcgtgaagcagctgaagggccaggtggccagcctgcaggagaaggtgaccagccagagccaggagcaggccatcctgcagagaagcctgcaggacaaggccgccgaggtggaggtggagagaatgggcgccaagggcctgcagctggagctgagcagagcccaggaggccagaagatggtggcagcagcagaccgccagcgccgaggagcagctgagactggtggtgaacgccgtgagcagcagccagatctggctggagaccaccatggccaaggtggagggcgccgccgcccagctgcccagcctgaacaacagactgagctacgccgtgagaaaggtgcacaccatcagaggcctgatcgccagaaagctggccctggcccagctgagacaggagagctgccccctgcccccccccgtgaccgacgtgagcctggagctgcagcagctgagagaggagagaaacagactggacgccgagctgcagctgagcgccagactgatccagcaggaggtgggcagagccagagagcagggcgaggccgagagacagcagctgagcaaggtggcccagcagctggagcaggagctgcagcagacccaggagagcctggccagcctgggcctgcagctggaggtggccagacagtgccagcaggagagcaccgaggaggccgccagcctgagacaggagctgacccagcagcaggagctgtacggccaggccctgcaggagaaggtggccgaggtggagaccagactgagagagcagctgagcgacaccgagagaagactgaacgaggccagaagagagcacgccaaggccgtggtgagcctgagacagatccagagaagagccgcccaggagaaggagagaagccaggagctgagaagactgcaggaggaggccagaaaggaggagggccagagactggccagaagactgcaggagctggagagagacaagaacctgatgctggccaccctgcagcaggagggcctgctgagcagatacaagcagcagagactgctgaccgtgctgcccagcctgctggacaagaagaagagcgtggtgagcagccccagaccccccgagtgcagcgccagcgcccccgtggccgccgccgtgcccaccagagagagcatcaagggcagcctgagcgtgctgctggacgacctgcaggacctgagcgaggccatcagcaaggaggaggccgtgtgccagggcgacaacctggacagatgcagcagctgcaacccccagatgagcagctag

SEQ ID NO: 1686 - DNA, 2349 bp, Homo sapiens; identical to SEQ ID NO: 1684

SEQ ID NO: 1687 - DNA, 2190 bp, Homo sapiens
atgttcccccccagcggcagcaccggcctgatcccccccagccacttccaggccagacccctgagcaccctgcccagaatggcccccacctggctgagcgacatccccctggtgcagccccccggccaccaggacgtgagcgagagaagactggacacccagagaccccaggtgaccatgtgggagagagacgtgagcagcgacagacaggagcccggcagaagaggcagaagctggggcctggagggcagccaggccctgagccagcaggccgaggtgatcgtgagacagctgcaggagctgagaagactggaggaggaggtgagactgctgagagagaccagcctgcagcagaagatgagactggaggcccaggccatggagctggaggccctggccagagccgagaaggccggcagagccgaggccgagggcctgagagccgccctggccggcgccgaggtggtgagaaagaacctggaggagggcagccagagagagctggaggaggtgcagagactgcaccaggagcagctgagcagcctgacccaggcccacgaggaggccctgagcagcctgaccagcaaggccgagggcctggagaagagcctgagcagcctggagaccagaagagccggcgaggccaaggagctggccgaggcccagagagaggccgagctgctgagaaagcagctgagcaagacccaggaggacctggaggcccaggtgaccctggtggagaacctgagaaagtacgtgggcgagcaggtgcccagcgaggtgcacagccagacctgggagctggagagacagaagctgctggagaccatgcagcacctgcaggaggacagagacagcctgcacgccaccgccgagctgctgcaggtgagagtgcagagcctgacccacatcctggccctgcaggaggaggagctgaccagaaaggtgcagcccagcgacagcctggagcccgagttcaccagaaagtgccagagcctgctgaacagatggagagagaaggtgttcgccctgatggtgcagctgaaggcccaggagctggagcacagcgacagcgtgaagcagctgaagggccaggtggccagcctgcaggagaaggtgaccagccagagccaggagcaggccatcctgcagagaagcctgcaggacaaggccgccgaggtggaggtggagagaatgggcgccaagggcctgcagctggagctgagcagagcccaggaggccagaagaagatggcagcagcagaccgccagcgccgaggagcagctgagactggtggtgaacgccgtgagcagctgccccctgcccccccccgtgaccgacgtgagcctggagctgcagcagctgagagaggagagaaacagactggacgccgagctgcagctgagcgccagactgatccagcaggaggtgggcagagccagagagcagggcgaggccgagagacagcagctgagcaaggtggcccagcagctggagcaggagctgcagcagacccaggagagcctggccagcctgggcctgcagctggaggtggccagacagggccagcaggagagcaccgaggaggccgccagcctgagacaggagctgacccagcagcaggagctgtacggccaggccctgcaggagaaggtggccgaggtggagaccagactgagagagcagctgagcgacaccgagagaagactgaacgaggccagaagagagcacgccaaggccgtggtgagcctgagacagatccagagaagagccgcccaggagaaggagagaagccaggagctgagaagactgcaggaggaggccagaaaggaggagggccagagactggccagaagactgcaggagctggagagagacaagaacctgatgctggccaccctgcagcaggagggcctgctgagcagatacaagcagcagagactgctgaccgtgctgcccagcctgctggacaagaagaagagcgtggtgagcagccccagaccccccgagtgcagcgccagcgcccccgtggccgccgccgtgcccaccagagagagcatcaagggcagcctgagcgtgctgctggacgacctgcaggacctgagcgaggccatcagcaaggaggaggccgtgtgccagggcgacaacctggacagatgcagcagcagcaacccccagatgagcagctag

SEQ ID NO: 1688 - DNA, 2616 bp, Homo sapiens
atgtggccccacagcgccggcgccagaccctgggccagcaccctgaccggcaaggaccccagagtgatggcctgctggtgcctggacggcctgcccagcggcctggccgagccctggagagagctgtggagatggagaagcagacccctgcactgcgtgccccccttcagccccctggccagaagcagcagagaccacagaaacctgagaagaagaggcaacatcgacggctggagacagaacctggagcccagcaacaacgtggagatgttcccccccagcggcagcaccggcctgatcccccccagccacttccaggccagacccctgagcaccctgcccagaatggcccccacctggctgagcgacatccccctggtgcagccccccggccaccaggacgtgagcgagagaagactggacacccagagaccccaggtgaccatgtgggagagagacgtgagcagcgacagacaggagcccggcagaagaggcagaagctggggcctggagggcagccaggccctgagccagcaggccgaggtgatcgtgagacagctgcaggagctgagaagactggaggaggaggtgagactgctgagagagaccagcctgcagcagaagatgagactggaggcccaggccatggagctggaggccctggccagagccgagaaggccggcagagccgaggccgagggcctgagagccgccctggccggcgccgaggtggtgagaaagaacctggaggagggcagccagagagagctggaggaggtgcagagactgcaccaggagcagctgagcagcctgacccaggcccacgaggaggccctgagcagcctgaccagcaaggccgagggcctggagaagagcctgagcagcctggagaccagaagagccggcgaggccaaggagctggccgaggcccagagagaggccgagctgctgagaaagcagctgagcaagacccaggaggacctggaggcccaggtgaccctggtggagaacctgagaaagtacgtgggcgagcaggtgcccagcgaggtgcacagccagacctgggagctggagagacagaagctgctggagaccatgcagcacctgcaggaggacagagacagcctgcacgccaccgccgagctgctgcaggtgagagtgcagagcctgacccacatcctggccctgcaggaggaggagctgaccagaaaggtgcagcccagcgacagcctggagcccgagttcaccagaaagtgccagagcctgctgaacagatggagagagaaggtgttcgccctgatggtgcagctgaaggcccaggagctggagcacagcgacagcgtgaagcagctgaagggccaggtggccagcctgcaggagaaggtgaccagccagagccaggagcaggccatcctgcagagaagcctgcaggacaaggccgccgaggtggaggtggagagaatgggcgccaagggcctgcagctggagctgagcagagcccaggaggccagaagaagatggcagcagcagaccgccagcgccgaggagcagctgagactggtggtgaacgccgtgagcagcagccagatctggctggagaccaccatggccaaggtggagggcgccgccgcccagctgcccagcctgaacaacagactgagctacgccgtgagaaaggtgcacaccatcagaggcctgatcgccagaaagctggccctggcccagctgagacaggagagctgccccctgcccccccccgtgaccgacgtgagcctggagctgcagcagctgagagaggagagaaacagactggacgccgagctgcagctgagcgccagactgatccagcaggaggtgggcagagccagagagcagggcgaggccgagagacagcagctgagcaaggtggcccagcagctggagcaggagctgcagcagacccaggagagcctggccagcctgggcctgcagctggaggtggccagacagggccagcaggagagcaccgaggaggccgccagcctgagacaggagctgacccagcagcaggagctgtacggccaggccctgcaggagaaggtggccgaggtggagaccagactgagagagcagctgagcgacaccgagagaagactgaacgaggccagaagagagcacgccaaggccgtggtgagcctgagacagatccagagaagagccgcccaggagaaggagagaagccaggagctgagaagactgcaggaggaggccagaaaggaggagggccagagactggccagaagactgcaggagctggagagagacaagaacctgatgctggccaccctgcagcaggagggcctgctgagcagatacaagcagcagagactgctgaccgtgctgcccagcctgctggacaagaagaagagcgtggtgagcagccccagaccccccgagtgcagcgccagcgcccccgtggccgccgccgtgcccaccagagagagcatcaagggcagcctgagcgtgctgctggacgacctgcaggacctgagcgaggccatcagcaaggaggaggccgtgtgccagggcgacaacctggacagatgcagcagcagcaacccccagatgagcagctag

SEQ ID NO: 1689 - DNA, 2190 bp, Homo sapiens
atgttcccccccagcggcagcaccggcctgatcccccccagccacttccaggccagacccctgagcaccctgcccagaatggcccccacctggctgagcgacatccccctggtgcagccccccggccaccaggacgtgagcgagagaagactggacacccagagaccccaggtgaccatgtgggagagagacgtgagcagcgacagacaggagcccggcagaagaggcagaagctggggcctggagggcagccaggccctgagccagcaggccgaggtgatcgtgagacagctgcaggagctgagatggctggaggaggaggtgtggctgctgagagagaccagcctgcagcagaagatgagactggaggcccaggccatggagctggaggccctggccagagccgagaaggccggcagagccgaggccgagggcctgagagccgccctggccggcgccgaggtggtgagaaagaacctggaggagggcagacagagagagctggaggaggtgcagagactgcaccaggagcagctgagcagcctgacccaggcccacgaggaggccctgagcagcctgaccagcaaggccgagggcctggagaagagcctgagcagcctggagaccagaagagccggcgaggccaaggagctggccgaggcccagagagaggccgagctgctgagaaagcagctgagcaagacccaggaggacctggaggcccaggtgaccctggtggagaacctgagaaagtacgtgggcgagcaggtgcccagcgaggtgcacagccagacctgggagctggagagacagaagctgctggagaccatgcagcacctgcaggaggacagagacagcctgcacgccaccgccgagctgctgcaggtgagagtgcagagcctgacccacatcctggccctgcaggaggaggagctgaccagaaaggtgcagcccagcgacagcctggagcccgagttcaccagaaagtgccagagcctgctgaacagatggagagagaaggtgttcgccctgatggtgcagctgaaggcccaggagctggagcacagcgacagcgtgaagcagctgaagggccaggtggccagcctgcaggagaaggtgaccagccagagccaggagcaggccatcctgcagagaagcctgcaggacaaggccgccgaggtggaggtggagagaatgggcgccaagggcctgcagctggagctgagcagagcccaggaggccagaagatggtggcagcagcagaccgccagcgccgaggagcagctgagactggtggtgaacgccgtgagcagctgccccctgcccccccccgtgaccgacgtgagcctggagctgcagcagctgagagaggagagaaacagactggacgccgagctgcagctgagcgccagactgatccagcaggaggtgggcagagccagagagcagggcgaggccgagagacagcagctgagcaaggtggcccagcagctggagcaggagctgcagcagacccaggagagcctggccagcctgggcctgcagctggaggtggccagacagtgccagcaggagagcaccgaggaggccgccagcctgagacaggagctgacccagcagcaggagctgtacggccaggccctgcaggagaaggtggccgaggtggagaccagactgagagagcagctgagcgacaccgagagaagactgaacgaggccagaagagagcacgccaaggccgtggtgagcctgagacagatccagagaagagccgcccaggagaaggagagaagccaggagctgagaagactgcaggaggaggccagaaaggaggagggccagagactggccagaagactgcaggagctggagagagacaagaacctgatgctggccaccctgcagcaggagggcctgctgagcagatacaagcagcagagactgctgaccgtgctgcccagcctgctggacaagaagaagagcgtggtgagcagccccagaccccccgagtgcagcgccagcgcccccgtggccgccgccgtgcccaccagagagagcatcaagggcagcctgagcgtgctgctggacgacctgcaggacctgagcgaggccatcagcaaggaggaggccgtgtgccagggcgacaacctggacagatgcagcagctgcaacccccagatgagcagctag

SEQ ID NO: 1690 - DNA, 2349 bp, Homo sapiens; identical to SEQ ID NO: 1685

SEQ ID NO: 1691 - DNA, 2190 bp, Homo sapiens; identical to SEQ ID NO: 1687

SEQ ID NO: 1692 - DNA, 2616 bp, Homo sapiens; identical to SEQ ID NO: 1688

SEQ ID NO: 1693 - DNA, 516 bp, Homo sapiens
atgttcccccccagcggccagtgggaccagaccagaggcgtggtggtggtgagcgcctgggagaccgaccacctgtgcttctgcaacagcagcggcagcaccggcctgatcccccccagccacttccaggccagacccctgagcaccctgcccagaatggcccccacctggctgagcgacatccccctggtgcagccccccggccaccaggacgtgagcgagagaagactggacacccagagaccccaggtgaccatgtgggagagagacgtgagcagcgacagacaggagcccggcagaagaggcagaagctggggcctggagggcagccaggccctgagccagcaggccgaggtgatcgtgagacagctgcaggagctgagaagactggaggaggaggtgagactgctgagagagaccagcctgcagcagaagatgagactggaggcccaggccatggagctggaggccctggccagagccgagaaggccggcagagccgaggccgagggctag

SEQ ID NO: 1694 - DNA, 516 bp, Homo sapiens; identical to SEQ ID NO: 1693

SEQ ID NO: 1695 - DNA, 2190 bp, Homo sapiens; identical to SEQ ID NO: 1689

SEQ ID NO: 1696 - DNA, 2349 bp, Homo sapiens; identical to SEQ ID NO: 1685

SEQ ID NO: 1697 - DNA, 2349 bp, Homo sapiens
atgttcccccccagcggcagcaccggcctgatcccccccagccacttccaggccagacccctgagcaccctgcccagaatggcccccacctggctgagcgacatccccctggtgcagccccccggccaccaggacgtgagcgagagaagactggacacccagagaccccaggtgaccatgtgggagagagacgtgagcagcgacagacaggagcccggcagaagaggcagaagctggggcctggagggcagccaggccctgagccagcaggccgaggtgatcgtgagacagctgcaggagctgagaagactggaggaggaggtgagactgctgagagagaccagcctgcagcagaagatgagactggaggcccaggccatggagctggaggccctggccagagccgagaaggccggcagagccgaggccgagggcctgagagccgccctggccggcgccgaggtggtgagaaagaacctggaggagggcagacagagagagctggaggaggtgcagagactgcaccaggagcagctgagcagcctgacccaggcccacgaggaggccctgagcagcctgaccagcaaggccgagggcctggagaagagcctgagcagcctggagaccagaagagccggcgaggccaaggagctggccgaggcccagagagaggccgagctgctgagaaagcagctgagcaagacccaggaggacctggaggcccaggtgaccctggtggagaacctgagaaagtacgtgggcgagcaggtgcccagcgaggtgcacagccagacctgggagctggagagacagaagctgctggacaccatgcagcacctgcaggaggacagagacagcctgcacgccaccgccgagctgctgcaggtgagagtgcagagcctgacccacatcctggccctgcaggaggaggagctgaccagaaaggtgcagcccagcgacagcctggagcccgagttcaccagaaagtgccagagcctgctgaacagatggagagagaaggtgttcgccctgatggtgcagctgaaggcccaggagctggagcacagcgacagcgtgaagcagctgaagggccaggtggccagcctgcaggagaaggtgaccagccagagccaggagcaggccatcctgcagagaagcctgcaggacaaggccgccgaggtggaggtggagagaatgggcgccaagggcctgcagctggagctgagcagagcccaggaggccagaagaagatggcagcagcagaccgccagcgccgaggagcagctgagactggtggtgaacgccgtgagcagcagccagatctggctggagaccaccatggccaaggtggagggcgccgccgcccagctgcccagcctgaacaacagactgagctacgccgtgagaaaggtgcacaccatcagaggcctgatcgccagaaagctggccctggcccagctgagacaggagagctgccccctgcccccccccgtgaccgacgtgagcctggagctgcagcagctgagagaggagagaaacagactggacgccgagctgcagctgagcgccagactgatccagcaggaggtgggcagagccagagagcagggcgaggccgagagacagcagctgagcaaggtggcccagcagctggagcaggagctgcagcagacccaggagagcctggccagcctgggcctgcagctggaggtggccagacagggccagcaggagagcaccgaggaggccgccagcctgagacaggagctgacccagcagcaggagctgtacggccaggccctgcaggagaaggtggccgaggtggagaccagactgagagagcagctgagcgacaccgagagaagactgaacgaggccagaagagagcacgccaaggccgtggtgagcctgagacagatccagagaagagccgcccaggagaaggagagaagccaggagctgagaagactgcaggaggaggccagaaaggaggagggccagagactggccagaagactgcaggagctggagagagacaagaacctgatgctggccaccctgcagcaggagggcctgctgagcagatacaagcagcagagactgctgaccgtgctgcccagcctgctggacaagaagaagagcgtggtgagcagccccagaccccccgagtgcagcgccagcgcccccgtggccgccgccgtgcccaccagagagagcatcaagggcagcctgagcgtgctgctggacgacctgcaggacctgagcgaggccatcagcaaggaggaggccgtgtgccagggcgacaacctggacagatgcagcagcagcaacccccagatgagcagctag

SEQ ID NO: 1698 - DNA, 384 bp, Homo sapiens
atgttcccccccagcggccagtgggaccagaccagaggcgtggtggtggtgagcgcctgggagaccgaccacctgtgcttctgcaacagcagcggcagcaccggcctgatcccccccagccacttccaggccagacccctgagcaccctgcccagaatggcccccacctggctgagcgacatccccctggtgcagccccccggccaccaggacgtgagcgagagaagactggacacccagagaccccaggtgaccatgtgggagagagacgtgagcagcgacagacaggagcccggcagaagaggcagaagctggggcctggagggcagccaggccctgagccagcaggccgaggtgatcgtgagacagctgcaggagctgtag

SEQ ID NO: 1699 - DNA, 384 bp, Homo sapiens; identical to SEQ ID NO: 1698

SEQ ID NO: 1700 - DNA, 516 bp, Homo sapiens
atgttcccccccagcggccagtgggaccagaccagaggcgtggtggtggtgagcgcctgggagaccgaccacctgtgcttctgcaacagcagcggcagcaccggcctgatcccccccagccacttccaggccagacccctgagcaccctgcccagaatggcccccacctggctgagcgacatccccctggtgcagccccccggccaccaggacgtgagcgagagaagactggacacccagagaccccaggtgaccatgtgggagagagacgtgagcagcgacagacaggagcccggcagaagaggcagaagctggggcctggagggcagccaggccctgagccagcaggccgaggtgatcgtgagacagctgcaggagctgagatggctggaggaggaggtgtggctgctgagagagaccagcctgcagcagaagatgagactggaggcccaggccatggagctggaggccctggccagagccgagaaggccggcagagccgaggccgagggctag

SEQ ID NO: 1701 - DNA, 771 bp, Homo sapiens
tgaagactggacgccgagctgcagctgagcgccagactgatccagcaggaggtgggcagagccagagagcagggcgaggccgagagacagcagctgagcaaggtggcccagcagctggagcaggagctgcagcagacccaggagagcctggccagcctgggcctgcagctggaggtggccagacagggccagcaggagagcaccgaggaggccgccagcctgagacaggagctgacccagcagcaggagctgtacggccaggccctgcaggagaaggtggccgaggtggagaccagactgagagagcagctgagcgacaccgagagaagactgaacgaggccagaagagagcacgccaaggccgtggtgagcctgagacagatccagagaagagccgcccaggagaaggagagaagccaggagctgagaagactgcaggaggaggccagaaaggaggagggccagagactggccagaagactgcaggagctggagagagacaagaacctgatgctgcagagactgctgaccgtgctgcccagcctgctggacaagaagaagagcgtggtgagcagccccagaccccccgagtgcagcgccagcgcccccgtggccgccgccgtgcccaccagagagagcatcaagggcagcctgagcgtgctgctggacgacctgcaggacctgagcgaggccatcagcaaggaggaggccgtgtgccagggcgacaacctggacagatgcagcagcagcaacccccagatgagcagctag

SEQ ID NO: 1702 - DNA, 2349 bp, Homo sapiens; identical to SEQ ID NO: 1697

SEQ ID NO: 1703 - DNA, 771 bp, Homo sapiens; identical to SEQ ID NO: 1701

SEQ ID NO: 1704 - DNA, 771 bp, Homo sapiens
tgaagactggacgccgagctgcagctgagcgccagactgatccagcaggaggtgggcagagccagagagcagggcgaggccgagagacagcagctgagcaaggtggcccagcagctggagcaggagctgcagcagacccaggagagcctggccagcctgggcctgcagctggaggtggccagacagtgccagcaggagagcaccgaggaggccgccagcctgagacaggagctgacccagcagcaggagctgtacggccaggccctgcaggagaaggtggccgaggtggagaccagactgagagagcagctgagcgacaccgagagaagactgaacgaggccagaagagagcacgccaaggccgtggtgagcctgagacagatccagagaagagccgcccaggagaaggagagaagccaggagctgagaagactgcaggaggaggccagaaaggaggagggccagagactggccagaagactgcaggagctggagagagacaagaacctgatgctgcagagactgctgaccgtgctgcccagcctgctggacaagaagaagagcgtggtgagcagccccagaccccccgagtgcagcgccagcgcccccgtggccgccgccgtgcccaccagagagagcatcaagggcagcctgagcgtgctgctggacgacctgcaggacctgagcgaggccatcagcaaggaggaggccgtgtgccagggcgacaacctggacagatgcagcagctgcaacccccagatgagcagctag

SEQ ID NO: 1705 - DNA, 516 bp, Homo sapiens; identical to SEQ ID NO: 1693

SEQ ID NO: 1706 - DNA, 462 bp, Homo sapiens
atgttcccccccagcggcagcaccggcctgatcccccccagccacttccaggccagacccctgagcaccctgcccagaatggcccccacctggctgagcgacatccccctggtgcagccccccggccaccaggacgtgagcgagagaagactggacacccagagaccccaggtgaccatgtgggagagagacgtgagcagcgacagacaggagcccggcagaagaggcagaagctggggcctggagggcagccaggccctgagccagcaggccgaggtgatcgtgagacagctgcaggagctgagaagactggaggaggaggtgagactgctgagagagaccagcctgcagcagaagatgagactggaggcccaggccatggagctggaggccctggccagagccgagaaggccggcagagccgaggccgagggcctgagagccgccctggccggcgcctag

SEQ ID NO: 1707 - DNA, 462 bp, Homo sapiens; identical to SEQ ID NO: 1706

SEQ ID NO: 1708 - DNA, 2349 bp, Homo sapiens; identical to SEQ ID NO: 1685

SEQ ID NO: 1709 - DNA, 651 bp, Homo sapiens
atgtggccccacagcgccggcgccagaccctgggccagcaccctgaccggcaaggaccccagagtgatggcctgctggtgcctggacggcctgcccagcggcctggccgagccctggagagagctgtggagatggagaagcagacccctgcactgcgtgccccccttcagccccctggccagaagcagcagagaccacagaaacctgagaagaagagtggaggccctgcccagaatcctgaagggcaacatcgacggctggagacagaacctggagcccagcaacaacgtggagatgttcccccccagcggcagcaccggcctgatcccccccagccacttccaggccagacccctgagcaccctgcccagaatggcccccacctggctgagcgacatccccctggtgcagccccccggccaccaggacgtgagcgagagaagactggacacccagagaccccaggtgaccatgtgggagagagacgtgagcagcgacagacaggagcccggcagaagaggcagaagctggggcctggagggcagccaggccctgagccagcaggccgaggtgatcgtgagacagctgcaggagctgagaagactggaggaggaggtgagactgctgagagagaccagcctgcagcagtag

SEQ ID NO: 1710 - DNA, 357 bp, Homo sapiens
atgttcccccccagcggcagcaccggcctgatcccccccagccacttccaggccagacccctgagcaccctgcccagaatggcccccacctggctgagcgacatccccctggtgcagccccccggccaccaggacgtgagcgagagaagactggacacccagagaccccaggtgaccatgtgggagagagacgtgagcagcgacagacaggagcccggcagaagaggcagaagctggggcctggagggcagccaggccctgagccagcaggccgaggtgatcgtgagacagctgcaggagctgagaagactggaggaggaggtgagactgctgagagagaccagcctgcagcagtag

SEQ ID NO: 1711 - DNA, 384 bp, Homo sapiens; identical to SEQ ID NO: 1698

SEQ ID NO: 1712 - DNA, 2190 bp, Homo sapiens
atgttcccccccagcggcagcaccggcctgatcccccccagccacttccaggccagacccctgagcaccctgcccagaatggcccccacctggctgagcgacatccccctggtgcagccccccggccaccaggacgtgagcgagagaagactggacacccagagaccccaggtgaccatgtgggagagagacgtgagcagcgacagacaggagcccggcagaagaggcagaagctggggcctggagggcagccaggccctgagccagcaggccgaggtgatcgtgagacagctgcaggagctgagaagactggaggaggaggtgagactgctgagagagaccagcctgcagcagaagatgagactggaggcccaggccatggagctggaggccctggccagagccgagaaggccggcagagccgaggccgagggcctgagagccgccctggccggcgccgaggtggtgagaaagaacctggaggagggcagacagagagagctggaggaggtgcagagactgcaccaggagcagctgagcagcctgacccaggcccacgaggaggccctgagcagcctgaccagcaaggccgagggcctggagaagagcctgagcagcctggagaccagaagagccggcgaggccaaggagctggccgaggcccagagagaggccgagctgctgagaaagcagctgagcaagacccaggaggacctggaggcccaggtgaccctggtggagaacctgagaaagtacgtgggcgagcaggtgcccagcgaggtgcacagccagacctgggagctggagagacagaagctgctggacaccatgcagcacctgcaggaggacagagacagcctgcacgccaccgccgagctgctgcaggtgagagtgcagagcctgacccacatcctggccctgcaggaggaggagctgaccagaaaggtgcagcccagcgacagcctggagcccgagttcaccagaaagtgccagagcctgctgaacagatggagagagaaggtgttcgccctgatggtgcagctgaaggcccaggagctggagcacagcgacagcgtgaagcagctgaagggccaggtggccagcctgcaggagaaggtgaccagccagagccaggagcaggccatcctgcagagaagcctgcaggacaaggccgccgaggtggaggtggagagaatgggcgccaagggcctgcagctggagctgagcagagcccaggaggccagaagaagatggcagcagcagaccgccagcgccgaggagcagctgagactggtggtgaacgccgtgagcagctgccccctgcccccccccgtgaccgacgtgagcctggagctgcagcagctgagagaggagagaaacagactggacgccgagctgcagctgagcgccagactgatccagcaggaggtgggcagagccagagagcagggcgaggccgagagacagcagctgagcaaggtggcccagcagctggagcaggagctgcagcagacccaggagagcctggccagcctgggcctgcagctggaggtggccagacagggccagcaggagagcaccgaggaggccgccagcctgagacaggagctgacccagcagcaggagctgtacggccaggccctgcaggagaaggtggccgaggtggagaccagactgagagagcagctgagcgacaccgagagaagactgaacgaggccagaagagagcacgccaaggccgtggtgagcctgagacagatccagagaagagccgcccaggagaaggagagaagccaggagctgagaagactgcaggaggaggccagaaaggaggagggccagagactggccagaagactgcaggagctggagagagacaagaacctgatgctggccaccctgcagcaggagggcctgctgagcagatacaagcagcagagactgctgaccgtgctgcccagcctgctggacaagaagaagagcgtggtgagcagccccagaccccccgagtgcagcgccagcgcccccgtggccgccgccgtgcccaccagagagagcatcaagggcagcctgagcgtgctgctggacgacctgcaggacctgagcgaggccatcagcaaggaggaggccgtgtgccagggcgacaacctggacagatgcagcagcagcaacccccagatgagcagctag

SEQ ID NO: 1713 - DNA, 951 bp, Homo sapiens
atgttcccccccagcggccaccaggacgtgagcgagagaagactggacacccagagaccccaggtgaccatgtgggagagagacgtgagcagcgacagacaggagcccggcagaagaggcagaagctggggcctggagggcagccaggccctgagccagcaggccgaggtgatcgtgagacagctgcaggagctgagaagactggaggaggaggtgagactgctgagagagaccagcctgcagcagaagatgagactggaggcccaggccatggagctggaggccctggccagagccgagaaggccggcagagccgaggccgagggcctgagagccgccctggccggcgccgaggtggtgagaaagaacctggaggagggcagccagagagagctggaggaggtgcagagactgcaccaggagcagctgagcagcctgacccaggcccacgaggaggccctgagcagcctgaccagcaaggccgagggcctggagaagagcctgagcagcctggagaccagaagagccggcgaggccaaggagctggccgaggcccagagagaggccgagctgctgagaaagcagctgagcaagacccaggaggacctggaggcccaggtgaccctggtggagaacctgagaaagtacgtgggcgagcaggtgcccagcgaggtgcacagccagacctgggagctggagagacagaagctgctggagaccatgcagcacctgcaggaggacagagacagcctgcacgccaccgccgagctgctgcaggtgagagtgcagagcctgacccacatcctggccctgcaggaggaggagctgaccagaaaggtgcagcccagcgacagcctggagcccgagttcaccagaaagtgccagagcctgctgaacagatggagagagaaggtgttcgccctgatggtgcagctgaaggcccaggagtag

SEQ ID NO: 1714 - DNA, 771 bp, Homo sapiens; identical to SEQ ID NO: 1701

SEQ ID NO: 1715 - DNA, 357 bp, Homo sapiens; identical to SEQ ID NO: 1710

SEQ ID NO: 1716 - DNA, 2349 bp, Homo sapiens; identical to SEQ ID NO: 1697

SEQ ID NO: 1717 - DNA, 384 bp, Homo sapiens; identical to SEQ ID NO: 1698

SEQ ID NO: 1718 - DNA, 462 bp, Homo sapiens
atgttcccccccagcggcagcaccggcctgatcccccccagccacttccaggccagacccctgagcaccctgcccagaatggcccccacctggctgagcgacatccccctggtgcagccccccggccaccaggacgtgagcgagagaagactggacacccagagaccccaggtgaccatgtgggagagagacgtgagcagcgacagacaggagcccggcagaagaggcagaagctggggcctggagggcagccaggccctgagccagcaggccgaggtgatcgtgagacagctgcaggagctgagatggctggaggaggaggtgtggctgctgagagagaccagcctgcagcagaagatgagactggaggcccaggccatggagctggaggccctggccagagccgagaaggccggcagagccgaggccgagggcctgagagccgccctggccggcgcctag

SEQ ID NO: 1719 - DNA, 384 bp, Homo sapiens; identical to SEQ ID NO: 1698

SEQ ID NO: 1720 - DNA, 567 bp, Homo sapiens
atgttcccccccagcggcagcaccggcctgatcccccccagccacttccaggccagacccctgagcaccctgcccagaatggcccccacctggctgagcgacatccccctggtgcagccccccggccaccaggacgtgagcgagagaagactggacacccagagaccccaggtgaccatgtgggagagagacgtgagcagcgacagacaggagcccggcagaagaggcagaagctggggcctggagggcagccaggccctgagccagcaggccgaggtgatcgtgagacagctgcaggagctgagaagactggaggaggaggtgagactgctgagagagaccagcctgcagcagaagatgagactggaggcccaggccatggagctggaggccctggccagagccgagaaggccggcagagccgaggccgagggcctgagagccgccctggccggcgccgaggtggtgagaaagaacctggaggagggcagacagagagagctggaggaggtgcagagactgcaccaggagcagctgagcagcctgacccaggcccacgaggagtag

SEQ ID NO: 1721 - DNA, 567 bp, Homo sapiens
atgttcccccccagcggcagcaccggcctgatcccccccagccacttccaggccagacccctgagcaccctgcccagaatggcccccacctggctgagcgacatccccctggtgcagccccccggccaccaggacgtgagcgagagaagactggacacccagagaccccaggtgaccatgtgggagagagacgtgagcagcgacagacaggagcccggcagaagaggcagaagctggggcctggagggcagccaggccctgagccagcaggccgaggtgatcgtgagacagctgcaggagctgagatggctggaggaggaggtgtggctgctgagagagaccagcctgcagcagaagatgagactggaggcccaggccatggagctggaggccctggccagagccgagaaggccggcagagccgaggccgagggcctgagagccgccctggccggcgccgaggtggtgagaaagaacctggaggagggcagacagagagagctggaggaggtgcagagactgcaccaggagcagctgagcagcctgacccaggcccacgaggagtag

SEQ ID NO: 1722 - DNA, 951 bp, Homo sapiens
atgttcccccccagcggccaccaggacgtgagcgagagaagactggacacccagagaccccaggtgaccatgtgggagagagacgtgagcagcgacagacaggagcccggcagaagaggcagaagctggggcctggagggcagccaggccctgagccagcaggccgaggtgatcgtgagacagctgcaggagctgagaagactggaggaggaggtgagactgctgagagagaccagcctgcagcagaagatgagactggaggcccaggccatggagctggaggccctggccagagccgagaaggccggcagagccgaggccgagggcctgagagccgccctggccggcgccgaggtggtgagaaagaacctggaggagggcagacagagagagctggaggaggtgcagagactgcaccaggagcagctgagcagcctgacccaggcccacgaggaggccctgagcagcctgaccagcaaggccgagggcctggagaagagcctgagcagcctggagaccagaagagccggcgaggccaaggagctggccgaggcccagagagaggccgagctgctgagaaagcagctgagcaagacccaggaggacctggaggcccaggtgaccctggtggagaacctgagaaagtacgtgggcgagcaggtgcccagcgaggtgcacagccagacctgggagctggagagacagaagctgctggacaccatgcagcacctgcaggaggacagagacagcctgcacgccaccgccgagctgctgcaggtgagagtgcagagcctgacccacatcctggccctgcaggaggaggagctgaccagaaaggtgcagcccagcgacagcctggagcccgagttcaccagaaagtgccagagcctgctgaacagatggagagagaaggtgttcgccctgatggtgcagctgaaggcccaggagtag

SEQ ID NO: 1723 - DNA, 567 bp, Homo sapiens
atgttcccccccagcggcagcaccggcctgatcccccccagccacttccaggccagacccctgagcaccctgcccagaatggcccccacctggctgagcgacatccccctggtgcagccccccggccaccaggacgtgagcgagagaagactggacacccagagaccccaggtgaccatgtgggagagagacgtgagcagcgacagacaggagcccggcagaagaggcagaagctggggcctggagggcagccaggccctgagccagcaggccgaggtgatcgtgagacagctgcaggagctgagaagactggaggaggaggtgagactgctgagagagaccagcctgcagcagaagatgagactggaggcccaggccatggagctggaggccctggccagagccgagaaggccggcagagccgaggccgagggcctgagagccgccctggccggcgccgaggtggtgagaaagaacctggaggagggcagccagagagagctggaggaggtgcagagactgcaccaggagcagctgagcagcctgacccaggcccacgaggagtag

SEQ ID NO: 1724 - DNA, 2307 bp, Homo sapiens
atgttcccccccagcggcagcaccggcctgatcccccccagccacttccaggccagacccctgagcaccctgcccagaatggcccccacctggctgagcgacatccccctggtgcagccccccggccaccaggacgtgagcgagagaagactggacacccagagaccccaggtgaccatgtgggagagagacgtgagcagcgacagacaggagcccggcagaagaggcagaagctggggcctggagggcagccaggccctgagccagcaggccgaggtgatcgtgagacagctgcaggagctgagaagactggaggaggaggtgagactgctgagagagaccagcctgcagcagaagatgagactggaggcccaggccatggagctggaggccctggccagagccgagaaggccggcagagccgaggccgagggcctgagagccgccctggccggcgccgaggtggtgagaaagaacctggaggagggcagccagagagagctggaggaggtgcagagactgcaccaggagcagctgagcagcctgacccaggcccacgaggaggccctgagcagcctgaccagcaaggccgagggcctggagaagagcctgagcagcctggagaccagaagagccggcgaggccaaggagctggccgaggcccagagagaggccgagctgctgagaaagcagctgagcaagacccaggaggacctggaggcccaggtgaccctggtggagaacctgagaaagtacgtgggcgagcaggtgcccagcgaggtgcacagccagacctgggagctggagagacagaagctgctggagaccatgcagcacctgcaggaggacagagacagcctgcacgccaccgccgagctgctgcaggtgagagtgcagagcctgacccacatcctggccctgcaggaggaggagctgaccagaaaggtgcagcccagcgacagcctggagcccgagttcaccagaaagtgccagagcctgctgaacagatggagagagaaggtgttcgccctgatggtgcagctgaaggcccaggagctggagcacagcgacagcgtgaagcagctgaagggccaggtggccagcctgcaggagaaggtgaccagccagagccaggagcaggccatcctgcagagaagcctgcaggacaaggccgccgaggtggaggtggagagaatgggcgccaagggcctgcagctggagctgagcagagcccaggaggccagaagaagatggcagcagcagaccgccagcgccgaggagcagctgagactggtggtgaacgccgtgagcagcagccagatctggctggagaccaccatggccaaggtggagggcgccgccgcccagctgcccagcctgaacaacagactgagctacgccgtgagaaaggtgcacaccatcagaggcctgatcgccagaaagctggccctggcccagctgagacaggagagctgccccctgcccccccccgtgaccgacgtgagcctggagctgcagcagctgagagaggagagaaacagactggacgccgagctgcagctgagcgccagactgatccagcaggaggtgggcagagccagagagcagggcgaggccgagagacagcagctgagcaaggtggcccagcagctggagcaggagctgcagcagacccaggagagcctggccagcctgggcctgcagctggaggtggccagacagggccagcaggagagcaccgaggaggccgccagcctgagacaggagctgacccagcagcaggagctgtacggccaggccctgcaggagaaggtggccgaggtggagaccagactgagagagcagctgagcgacaccgagagaagactgaacgaggccagaagagagcacgccaaggccgtggtgagcctgagacagatccagagaagagccgcccaggagaaggagagaagccaggagctgagaagactgcaggaggaggccagaaaggaggagggccagagactggccagaagactgcaggagctggagagagacaagaacctgatgctgcagagactgctgaccgtgctgcccagcctgctggacaagaagaagagcgtggtgagcagccccagaccccccgagtgcagcgccagcgcccccgtggccgccgccgtgcccaccagagagagcatcaagggcagcctgagcgtgctgctggacgacctgcaggacctgagcgaggccatcagcaaggaggaggccgtgtgccagggcgacaacctggacagatgcagcagcagcaacccccagatgagcagctag

SEQ ID NO: 1725 - DNA, 951 bp, Homo sapiens
atgttcccccccagcggccaccaggacgtgagcgagagaagactggacacccagagaccccaggtgaccatgtgggagagagacgtgagcagcgacagacaggagcccggcagaagaggcagaagctggggcctggagggcagccaggccctgagccagcaggccgaggtgatcgtgagacagctgcaggagctgagatggctggaggaggaggtgtggctgctgagagagaccagcctgcagcagaagatgagactggaggcccaggccatggagctggaggccctggccagagccgagaaggccggcagagccgaggccgagggcctgagagccgccctggccggcgccgaggtggtgagaaagaacctggaggagggcagacagagagagctggaggaggtgcagagactgcaccaggagcagctgagcagcctgacccaggcccacgaggaggccctgagcagcctgaccagcaaggccgagggcctggagaagagcctgagcagcctggagaccagaagagccggcgaggccaaggagctggccgaggcccagagagaggccgagctgctgagaaagcagctgagcaagacccaggaggacctggaggcccaggtgaccctggtggagaacctgagaaagtacgtgggcgagcaggtgcccagcgaggtgcacagccagacctgggagctggagagacagaagctgctggagaccatgcagcacctgcaggaggacagagacagcctgcacgccaccgccgagctgctgcaggtgagagtgcagagcctgacccacatcctggccctgcaggaggaggagctgaccagaaaggtgcagcccagcgacagcctggagcccgagttcaccagaaagtgccagagcctgctgaacagatggagagagaaggtgttcgccctgatggtgcagctgaaggcccaggagtag

SEQ ID NO: 1726 - DNA, 357 bp, Homo sapiens
atgttcccccccagcggcagcaccggcctgatcccccccagccacttccaggccagacccctgagcaccctgcccagaatggcccccacctggctgagcgacatccccctggtgcagccccccggccaccaggacgtgagcgagagaagactggacacccagagaccccaggtgaccatgtgggagagagacgtgagcagcgacagacaggagcccggcagaagaggcagaagctggggcctggagggcagccaggccctgagccagcaggccgaggtgatcgtgagacagctgcaggagctgagatggctggaggaggaggtgtggctgctgagagagaccagcctgcagcagtag

SEQ ID NO: 1727 - DNA, 2349 bp, Homo sapiens; identical to SEQ ID NO: 1697

SEQ ID NO: 1728 - DNA, 567 bp, Homo sapiens; identical to SEQ ID NO: 1720

SEQ ID NO: 1729 - DNA, 576 bp, Homo sapiens
atgttcccccccagcggccaccaggacgtgagcgagagaagactggacacccagagaccccaggtgaccatgtgggagagagacgtgagcagcgacagacaggagcccggcagaagaggcagaagctggggcctggagggcagccaggccctgagccagcaggccgaggtgatcgtgagacagctgcaggagctgagaagactggaggaggaggtgagactgctgagagagaccagcctgcagcagaagatgagactggaggcccaggccatggagctggaggccctggccagagccgagaaggccggcagagccgaggccgagggcctgagagccgccctggccggcgccgaggtggtgagaaagaacctggaggagggcagccagagagagctggaggaggtgcagagactgcaccaggagcagctgagcagcctgacccaggcccacgaggaggccctgagcagcctgaccagcaaggccgagggcctggagaagagcctgagcagcctggagaccagaagagccggcgaggccaaggagctggccgaggcccagagagaggccgagctgtag

SEQ ID NO: 1730 - DNA, 567 bp, Homo sapiens; identical to SEQ ID NO: 1723

SEQ ID NO: 1731 - DNA, 951 bp, Homo sapiens; identical to SEQ ID NO: 1725

SEQ ID NO: 1732 - DNA, 516 bp, Homo sapiens; identical to SEQ ID NO: 1700

SEQ ID NO: 1733 - DNA, 357 bp, Homo sapiens; identical to SEQ ID NO: 1726

SEQ ID NO: 1734 - DNA, 771 bp, Homo sapiens; identical to SEQ ID NO: 1704

SEQ ID NO: 1735 - DNA, 2508 bp, Homo sapiens
atgtggccccacagcgccggcgccagaccctgggccagcaccctgaccggcaaggaccccagagtgatggcctgctggtgcctggacggcctgcccagcggcctggccgagccctggagagagctgtggagatggagaagcagacccctgcactgcgtgccccccttcagccccctggccagaagcagcagagaccacagaaacctgagaagaagaggcaacatcgacggctggagacagaacctggagcccagcaacaacgtggagatgttcccccccagcggccaccaggacgtgagcgagagaagactggacacccagagaccccaggtgaccatgtgggagagagacgtgagcagcgacagacaggagcccggcagaagaggcagaagctggggcctggagggcagccaggccctgagccagcaggccgaggtgatcgtgagacagctgcaggagctgagaagactggaggaggaggtgagactgctgagagagaccagcctgcagcagaagatgagactggaggcccaggccatggagctggaggccctggccagagccgagaaggccggcagagccgaggccgagggcctgagagccgccctggccggcgccgaggtggtgagaaagaacctggaggagggcagccagagagagctggaggaggtgcagagactgcaccaggagcagctgagcagcctgacccaggcccacgaggaggccctgagcagcctgaccagcaaggccgagggcctggagaagagcctgagcagcctggagaccagaagagccggcgaggccaaggagctggccgaggcccagagagaggccgagctgctgagaaagcagctgagcaagacccaggaggacctggaggcccaggtgaccctggtggagaacctgagaaagtacgtgggcgagcaggtgcccagcgaggtgcacagccagacctgggagctggagagacagaagctgctggagaccatgcagcacctgcaggaggacagagacagcctgcacgccaccgccgagctgctgcaggtgagagtgcagagcctgacccacatcctggccctgcaggaggaggagctgaccagaaaggtgcagcccagcgacagcctggagcccgagttcaccagaaagtgccagagcctgctgaacagatggagagagaaggtgttcgccctgatggtgcagctgaaggcccaggagctggagcacagcgacagcgtgaagcagctgaagggccaggtggccagcctgcaggagaaggtgaccagccagagccaggagcaggccatcctgcagagaagcctgcaggacaaggccgccgaggtggaggtggagagaatgggcgccaagggcctgcagctggagctgagcagagcccaggaggccagaagaagatggcagcagcagaccgccagcgccgaggagcagctgagactggtggtgaacgccgtgagcagcagccagatctggctggagaccaccatggccaaggtggagggcgccgccgcccagctgcccagcctgaacaacagactgagctacgccgtgagaaaggtgcacaccatcagaggcctgatcgccagaaagctggccctggcccagctgagacaggagagctgccccctgcccccccccgtgaccgacgtgagcctggagctgcagcagctgagagaggagagaaacagactggacgccgagctgcagctgagcgccagactgatccagcaggaggtgggcagagccagagagcagggcgaggccgagagacagcagctgagcaaggtggcccagcagctggagcaggagctgcagcagacccaggagagcctggccagcctgggcctgcagctggaggtggccagacagggccagcaggagagcaccgaggaggccgccagcctgagacaggagctgacccagcagcaggagctgtacggccaggccctgcaggagaaggtggccgaggtggagaccagactgagagagcagctgagcgacaccgagagaagactgaacgaggccagaagagagcacgccaaggccgtggtgagcctgagacagatccagagaagagccgcccaggagaaggagagaagccaggagctgagaagactgcaggaggaggccagaaaggaggagggccagagactggccagaagactgcaggagctggagagagacaagaacctgatgctggccaccctgcagcaggagggcctgctgagcagatacaagcagcagagactgctgaccgtgctgcccagcctgctggacaagaagaagagcgtggtgagcagccccagaccccccgagtgcagcgccagcgcccccgtggccgccgccgtgcccaccagagagagcatcaagggcagcctgagcgtgctgctggacgacctgcaggacctgagcgaggccatcagcaaggaggaggccgtgtgccagggcgacaacctggacagatgcagcagcagcaacccccagatgagcagctag

SEQ ID NO: 1736 - DNA, 2190 bp, Homo sapiens; identical to SEQ ID NO: 1712

SEQ ID NO: 1737 - DNA, 384 bp, Homo sapiens; identical to SEQ ID NO: 1698

SEQ ID NO: 1738 - DNA, 462 bp, Homo sapiens; identical to SEQ ID NO: 1706

SEQ ID NO: 1739 - DNA, 567 bp, Homo sapiens; identical to SEQ ID NO: 1721

SEQ ID NO: 1740 - DNA, 462 bp, Homo sapiens; identical to SEQ ID NO: 1706

SEQ ID NO: 1741 - DNA, 462 bp, Homo sapiens; identical to SEQ ID NO: 1718

SEQ ID NO: 1742 - DNA, 951 bp, Homo sapiens; identical to SEQ ID NO: 1722

SEQ ID NO: 1743 - DNA, 651 bp, Homo sapiens; identical to SEQ ID NO: 1709

SEQ ID NO: 1744 - DNA, 516 bp, Homo sapiens; identical to SEQ ID NO: 1693

SEQ ID NO: 1745 - DNA, 357 bp, Homo sapiens; identical to SEQ ID NO: 1710

SEQ ID NO: 1746 - DNA, 423 bp, Homo sapiens
atgttcccccccagcggcagcaccggcctgatcccccccagccacttccaggccagacccctgagcaccctgcccagaatggcccccacctggctgagcgacatccccctggtgcagccccccggccaccaggacgtgagcgagagaagactggacacccagagaccccaggtgaccatgtgggagagagacgtgagcagcgacagacaggagcccggcagaagaggcagaagctggggcctggagggcagccaggccctgagccagcaggccgaggtgatcgtgagacagctgcaggagctgagaagactggaggaggaggtgagactgctgagagagaccagcctgcagcagaagatgagactggaggcccaggccatggagctggaggccctggccagagccgagaaggccggcagatag

SEQ ID NO: 1747 - DNA, 111 bp, Homo sapiens
atgttcccccccagcggcagcaccggcctgatcccccccagccacttccaggccagacccctgagcaccctgcccagaatggcccccacctggctgagcgacatcccctag

SEQ ID NO: 1748 - DNA, 291 bp, Homo sapiens
atgttcccccccagcggcagcaccggcctgatcccccccagccacttccaggccagacccctgagcaccctgcccagaatggcccccacctggctgagcgacatccccctggtgcagccccccggccaccaggacgtgagcgagagaagactggacacccagagaccccaggtgaccatgtgggagagagacgtgagcagcgacagacaggagcccggcagaagaggcagaagctggggcctggagggcagccaggccctgagccagcaggccgaggtgatcgtgagatag

SEQ ID NO: 1749 - DNA, 477 bp, Homo sapiens
atgttcccccccagcggcagcaccggcctgatcccccccagccacttccaggccagacccctgagcaccctgcccagaatggcccccacctggctgagcgacatccccctggtgcagccccccggccaccaggacgtgagcgagagaagactggacacccagagaccccaggtgaccatgtgggagagagacgtgagcagcgacagacaggagcccggcagaagaggcagaagctggggcctggagggcagccaggccctgagccagcaggccgaggtgatcgtgagacagctgcaggagctgagaagactggaggaggaggtgagactgctgagagagaccagcctgcagcagaagatgagactggaggcccaggccatggagctggaggccctggccagagccgagaaggccggcagagccgaggccgagggcctgagagccgccctggccggcgccgaggtggtgagaaagtag

SEQ ID NO: 1750 - DNA, 351 bp, Homo sapiens
atgttcccccccagcggcagcaccggcctgatcccccccagccacttccaggccagacccctgagcaccctgcccagaatggcccccacctggctgagcgacatccccctggtgcagccccccggccaccaggacgtgagcgagagaagactggacacccagagaccccaggtgaccatgtgggagagagacgtgagcagcgacagacaggagcccggcagaagaggcagaagctggggcctggagggcagccaggccctgagccagcaggccgaggtgatcgtgagacagctgcaggagctgagaagactggaggaggaggtgagactgctgagagagaccagcctgtag

SEQ ID NO: 1751 - DNA, 126 bp, Homo sapiens
atgttcccccccagcggcagcaccggcctgatcccccccagccacttccaggccagacccctgagcaccctgcccagaatggcccccacctggctgagcgacatccccctggtgcagcccccctag

SEQ ID NO: 1752 - DNA, 480 bp, Homo sapiens
atgttcccccccagcggccaccaggacgtgagcgagagaagactggacacccagagaccccaggtgaccatgtgggagagagacgtgagcagcgacagacaggagcccggcagaagaggcagaagctggggcctggagggcagccaggccctgagccagcaggccgaggtgatcgtgagacagctgcaggagctgagaagactggaggaggaggtgagactgctgagagagaccagcctgcagcagaagatgagactggaggcccaggccatggagctggaggccctggccagagccgagaaggccggcagagccgaggccgagggcctgagagccgccctggccggcgccgaggtggtgagaaagaacctggaggagggcagccagagagagctggaggaggtgcagagactgcaccaggagcagctgagcagcctgacccaggcccacgaggaggccctgagcagcctgaccagctag

SEQ ID NO: 1753 - DNA, 423 bp, Homo sapiens
atggcccccacctggctgagcgacatccccctggtgcagccccccggccaccaggacgtgagcgagagaagactggacacccagagaccccaggtgaccatgtgggagagagacgtgagcagcgacagacaggagcccggcagaagaggcagaagctggggcctggagggcagccaggccctgagccagcaggccgaggtgatcgtgagacagctgcaggagctgagaagactggaggaggaggtgagactgctgagagagaccagcctgcagcagaagatgagactggaggcccaggccatggagctggaggccctggccagagccgagaaggccggcagagccgaggccgagggcctgagagccgccctggccggcgccgaggtggtgagaaagaacctggaggagggcagccagagatag

SEQ ID NO: 1754 - DNA, 480 bp, Homo sapiens
atgttcccccccagcggcagcaccggcctgatcccccccagccacttccaggccagacccctgagcaccctgcccagaatggcccccacctggctgagcgacatccccctggtgcagccccccggccaccaggacgtgagcgagagaagactggacacccagagaccccaggtgaccatgtgggagagagacgtgagcagcgacagacaggagcccggcagaagaggcagaagctggggcctggagggcagccaggccctgagccagcaggccgaggtgatcgtgagacagctgcaggagctgagaagactggaggaggaggtgagactgctgagagagaccagcctgcagcagaagatgagactggaggcccaggccatggagctggaggccctggccagagccgagaaggccggcagagccgaggccgagggcctgagagccgccctggccggcgccgaggtggtgagaaagaactag

SEQ ID NO: 1755 - DNA, 3714 bp, Homo sapiens
atgagaaagcacagacacctgcccctggtggccgtgttctgcctgttcctgagcggcttccccaccacccacgcccagcagcagcaggccgcccaggacagcgccgacatcatcttcctgatcgacggcagcaacaacaccggcagcgtgaacttcgccgtgatcctggacttcctggtgaacctgctggagaagctgcccatcggcacccagcagatcagagtgggcgtggtgcagttcagcgacgagcccagaaccatgttcagcctggacacctacagcaccaaggcccaggtgctgggcgccgtgaaggccctgggcttcgccggcggcgagctggccaacatcggcctggccctggacttcgtggtggagaaccacttcaccagagccggcggcagcagagtggaggagggcgtgccccaggtgctggtgctgatcagcgccggccccagcagcgacgagatcagatacggcgtggtggccctgaagcaggccagcgtgttcagcttcggcctgggcgcccaggccgccagcagagccgagctgcagcacatcgccaccgacgacaacctggtgttcaccgtgcccgagttcagaagcttcggcgacctgcaggagaagctgctgccctacatcgtgggcgtggcccagagacacatcgtgctgaagccccccaccatcgtgacccaggtgatcgaggtgaacaagagagacatcgtgttcctggtggacggcagcagcgccctgggcctggccaacttcaacgccatcagagacttcatcgccaaggtgatccagagactggagatcggccaggacctgatccaggtggccgtggcccagtacgccgacaccgtgagacccgagttctacttcaacacccaccccaccaagagagaggtgatcaccgccgtgagaaagatgaagcccctggacggcagcgccctgtacaccggcagcgccctggacttcgtgagaaacaacctgttcaccagcagcgccggctacagagccgccgagggcatccccaagctgctggtgctgatcaccggcggcaagagcctggacgagatcagccagcccgcccaggagctgaagagaagcagcatcatggccttcgccatcggcaacaagggcgccgaccaggccgagctggaggagatcgccttcgacagcagcctggtgttcatccccgccgagttcagagccgcccccctgcagggcatgctgcccggcctgctggcccccctgagaaccctgagcggcacccccgaggtgcacagcaacaagagagacatcatcttcctgctggacggcagcgccaacgtgggcaagaccaacttcccctacgtgagagacttcgtgatgaacctggtgaacagcctggacatcggcaacgacaacatcagagtgggcctggtgcagttcagcgacacccccgtgaccgagttcagcctgaacacctaccagaccaagagcgacatcctgggccacctgagacagctgcagctgcagggcggcagcggcctgaacaccggcagcgccctgagctacgtgtacgccaaccacttcaccgaggccggcggcagcagaatcagagagcacgtgccccagctgctgctgctgctgaccgccggccagagcgaggacagctacctgcaggccgccaacgccctgaccagagccggcatcctgaccttctgcgtgggcgccagccaggccaacaaggccgagctggagcagatcgccttcaaccccagcctggtgtacctgatggacgacttcagcagcctgcccgccctgccccagcagctgatccagcccctgaccacctacgtgagcggcggcgtggaggaggtgcccctggcccagcccgagagcaagagagacatcctgttcctgttcgacggcagcgccaacctggtgggccagttccccgtggtgagagacttcctgtacaagatcatcgacgagctgaacgtgaagcccgagggcaccagaatcgccgtggcccagtacagcgacgacgtgaaggtggagagcagattcgacgagcaccagagcaagcccgagatcctgaacctggtgaagagaatgaagatcaagaccggcaaggccctgaacctgggctacgccctggactacgcccagagatacatcttcgtgaagagcgccggcagcagaatcgaggacggcgtgctgcagttcctggtgctgctggtggccggcagaagcagcgacagagtggacggccccgccagcaacctgaagcagagcggcgtggtgcccttcatcttccaggccaagaacgccgaccccgccgagctggagcagatcgtgctgagccccgccttcatcctggccgccgagagcctgcccaagatcggcgacctgcacccccagatcgtgaacctgctgaagagcgtgcacaacggcgcccccgcccccgtgagcggcgagaaggacgtggtgttcctgctggacggcagcgagggcgtgagaagcggcttccccctgctgaaggagttcgtgcagagagtggtggagagcctggacgtgggccaggacagagtgagagtggccgtggtgcagtacagcgacagaaccagacccgagttctacctgaacagctacatgaacaagcaggacgtggtgaacgccgtgagacagctgaccctgctgggcggccccacccccaacaccggcgccgccctggagttcgtgctgagaaacatcctggtgagcagcgccggcagcagaatcaccgagggcgtgccccagctgctgatcgtgctgaccgccgacagaagcggcgacgacgtgagaaaccccagcgtggtggtgaagagaggcggcgccgtgcccatcggcatcggcatcggcaacgccgacatcaccgagatgcagaccatcagcttcatccccgacttcgccgtggccatccccaccttcagacagctgggcaccgtgcagcaggtgatcagcgagagagtgacccagctgaccagagaggagctgagcagactgcagcccgtgctgcagcccctgcccagccccggcgtgggcggcaagagagacgtggtgttcctgatcgacggcagccagagcgccggccccgagttccagtacgtgagaaccctgatcgagagactggtggactacctggacgtgggcttcgacaccaccagagtggccgtgatccagttcagcgacgaccccaaggtggagttcctgctgaacgcccacagcagcaaggacgaggtgcagaacgccgtgcagagactgagacccaagggcggcagacagatcaacgtgggcaacgccctggagtacgtgagcagaaacatcttcaagagacccctgggcagcagaatcgaggagggcgtgccccagttcctggtgctgatcagcagcggcaagagcgacgacgaggtggacgaccccgccgtggagctgaagcagttcggcgtggcccccttcaccatcgccagaaacgccgaccaggaggagctggtgaagatcagcctgagccccgagtacgtgttcagcgtgagcaccttcagagagctgcccagcctggagcagaagctgctgacccccatcaccaccctgaccagcgagcagatccagaagctgctggccagcaccagataccccccccccggcgagatgggcgccagcgaggtgctgctgggcgccttcagcatctag

SEQ ID NO: 1756 - DNA, 7713 bp, Homo sapiens
atgagaaagcacagacacctgcccctggtggccgtgttctgcctgttcctgagcggcttccccaccacccacgcccagcagcagcaggccgtgatcgaggtgaacaagagagacatcgtgttcctggtggacggcagcagcgccctgggcctggccaacttcaacgccatcagagacttcatcgccaaggtgatccagagactggagatcggccaggacctgatccaggtggccgtggcccagtacgccgacaccgtgagacccgagttctacttcaacacccaccccaccaagagagaggtgatcaccgccgtgagaaagatgaagcccctggacggcagcgccctgtacaccggcagcgccctggacttcgtgagaaacaacctgttcaccagcagcgccggctacagagccgccgagggcatccccaagctgctggtgctgatcaccggcggcaagagcctggacgagatcagccagcccgcccaggagctgaagagaagcagcatcatggccttcgccatcggcaacaagggcgccgaccaggccgagctggaggagatcgccttcgacagcagcctggtgttcatccccgccgagttcagagccgcccccctgcagggcatgctgcccggcctgctggcccccctgagaaccctgagcggcacccccgaggagagcaagagagacatcctgttcctgttcgacggcagcgccaacctggtgggccagttccccgtggtgagagacttcctgtacaagatcatcgacgagctgaacgtgaagcccgagggcaccagaatcgccgtggcccagtacagcgacgacgtgaaggtggagagcagattcgacgagcaccagagcaagcccgagatcctgaacctggtgaagagaatgaagatcaagaccggcaaggccctgaacctgggctacgccctggactacgcccagagatacatcttcgtgaagagcgccggcagcagaatcgaggacggcgtgctgcagttcctggtgctgctggtggccggcagaagcagcgacagagtggacggccccgccagcaacctgaagcagagcggcgtggtgcccttcatcttccaggccaagaacgccgaccccgccgagctggagcagatcgtgctgagccccgccttcatcctggccgccgagagcctgcccaagatcggcgacctgcacccccagatcgtgaacctgctgaagagcgtgcacaacggcgcccccgcccccgtgagcggcgagaaggacgtggtgttcctgctggacggcagcgagggcgtgagaagcggcttccccctgctgaaggagttcgtgcagagagtggtggagagcctggacgtgggccaggacagagtgagagtggccgtggtgcagtacagcgacagaaccagacccgagttctacctgaacagctacatgaacaagcaggacgtggtgaacgccgtgagacagctgaccctgctgggcggccccacccccaacaccggcgccgccctggagttcgtgctgagaaacatcctggtgagcagcgccggcagcagaatcaccgagggcgtgccccagctgctgatcgtgctgaccgccgacagaagcggcgacgacgtgagaaaccccagcgtggtggtgaagagaggcggcgccgtgcccatcggcatcggcatcggcaacgccgacatcaccgagatgcagaccatcagcttcatccccgacttcgccgtggccatccccaccttcagacagctgggcaccgtgcagcaggtgatcagcgagagagtgacccagctgaccagagaggagctgagcagactgcagcccgtgctgcagcccctgcccagccccggcgtgggcggcaagagagacgtggtgttcctgatcgacggcagccagagcgccggccccgagttccagtacgtgagaaccctgatcgagagactggtggactacctggacgtgggcttcgacaccaccagagtggccgtgatccagttcagcgacgaccccaaggtggagttcctgctgaacgcccacagcagcaaggacgaggtgcagaacgccgtgcagagactgagacccaagggcggcagacagatcaacgtgggcaacgccctggagtacgtgagcagaaacatcttcaagagacccctgggcagcagaatcgaggagggcgtgccccagttcctggtgctgatcagcagcggcaagagcgacgacgaggtggacgaccccgccgtggagctgaagcagttcggcgtggcccccttcaccatcgccagaaacgccgaccaggaggagctggtgaagatcagcctgagccccgagtacgtgttcagcgtgagcaccttcagagagctgcccagcctggagcagaagctgctgacccccatcaccaccctgaccagcgagcagatccagaagctgctggccagcaccagataccccccccccgccgtggagagcgacgccgccgacatcgtgttcctgatcgacagcagcgagggcgtgagacccgacggcttcgcccacatcagagacttcgtgagcagaatcgtgagaagactgaacatcggccccagcaaggtgagagtgggcgtggtgcagttcagcaacgacgtgttccccgagttctacctgaagacctacagaagccaggcccccgtgctggacgccatcagaagactgagactgagaggcggcagccccctgaacaccggcaaggccctggagttcgtggccagaaacctgttcgtgaagagcgccggcagcagaatcgaggacggcgtgccccagcacctggtgctggtgctgggcggcaagagccaggacgacgtgagcagattcgcccaggtgatcagaagcagcggcatcgtgagcctgggcgtgggcgacagaaacatcgacagaaccgagctgcagaccatcaccaacgaccccagactggtgttcaccgtgagagagttcagagagctgcccaacatcgaggagagaatcatgaacagcttcggccccagcgccgccacccccgccccccccggcgtggacacccccccccccagcagacccgagaagaagaaggccgacatcgtgttcctgctggacggcagcatcaacttcagaagagacagcttccaggaggtgctgagattcgtgagcgagatcgtggacaccgtgtacgaggacggcgacagcatccaggtgggcctggtgcagtacaacagcgaccccaccgacgagttcttcctgaaggacttcagcaccaagagacagatcatcgacgccatcaacaaggtggtgtacaagggcggcagacacgccaacaccaaggtgggcctggagcacctgagagtgaaccacttcgtgcccgaggccggcagcagactggaccagagagtgccccagatcgccttcgtgatcaccggcggcaagagcgtggaggacgcccaggacgtgagcctggccctgacccagagaggcgtgaaggtgttcgccgtgggcgtgagaaacatcgacagcgaggaggtgggcaagatcgccagcaacagcgccaccgccttcagagtgggcaacgtgcaggagctgagcgagctgagcgagcaggtgctggagaccctgcacgacgccatgcacgagaccctgtgccccggcgtgaccgacgccgccaaggcctgcaacctggacgtgatcctgggcttcgacggcagcagagaccagaacgtgttcgtggcccagaagggcttcgagagcaaggtggacgccatcctgaacagaatcagccagatgcacagagtgagctgcagcggcggcagaagccccaccgtgagagtgagcgtggtggccaacacccccagcggccccgtggaggccttcgacttcgacgagtaccagcccgagatgctggagaagttcagaaacatgagaagccagcacccctacgtgctgaccgaggacaccctgaaggtgtacctgaacaagttcagacagagcagccccgacagcgtgaaggtggtgatccacttcaccgacggcgccgacggcgacctggccgacctgcacagagccagcgagaacctgagacaggagggcgtgagagccctgatcctggtgggcctggagagagtggtgaacctggagagactgatgcacctggagttcggcagaggcttcatgtacgacagacccctgagactgaacctgctggacctggactacgagctggccgagcagctggacaacatcgccgagaaggcctgctgcggcgtgccctgcaagtgcagcggccagagaggcgacagaggccccatcggcagcatcggccccaagggcatccccggcgaggacggctacagaggctaccccggcgacgagggcggccccggcgagagaggcccccccggcgtgaacggcacccagggcttccagggctgccccggccagagaggcgtgaagggcagcagaggcttccccggcgagaagggcgaggtgggcgagatcggcctggacggcctggacggcgaggacggcgacaagggcctgcccggcagcagcggcgagaagggcaaccccggcagaagaggcgacaagggccccagaggcgagaagggcgagagaggcgacgtgggcatcagaggcgaccccggcaaccccggccaggacagccaggagagaggccccaagggcgagaccggcgacctgggccccatgggcgtgcccggcagagacggcgtgcccggcggccccggcgagaccggcaagaacggcggcttcggcagaagaggcccccccggcgccaagggcaacaagggcggccccggccagcccggcttcgagggcgagcagggcaccagaggcgcccagggccccgccggccccgccggcccccccggcctgatcggcgagcagggcatcagcggccccagaggcagcggcggcgccgccggcgcccccggcgagagaggcagaaccggccccctgggcagaaagggcgagcccggcgagcccggccccaagggcggcatcggcaacagaggccccagaggcgagaccggcgacgacggcagagacggcgtgggcagcgagggcagaagaggcaagaagggcgagagaggcttccccggctaccccggccccaagggcaaccccggcgagcccggcctgaacggcaccaccggccccaagggcatcagaggcagaagaggcaacagcggcccccccggcatcgtgggccagaagggcgaccccggctaccccggccccgccggccccaagggcaacagaggcgacagcatcgaccagtgcgccctgatccagagcatcaaggacaagtgcccctgctgctacggccccctggagtgccccgtgttccccaccgagctggccttcgccctggacaccagcgagggcgtgaaccaggacaccttcggcagaatgagagacgtggtgctgagcatcgtgaacgacctgaccatcgccgagagcaactgccccagaggcgccagagtggccgtggtgacctacaacaacgaggtgaccaccgagatcagattcgccgacagcaagagaaagagcgtgctgctggacaagatcaagaacctgcaggtggccctgaccagcaagcagcagagcctggagaccgccatgagcttcgtggccagaaacaccttcaagagagtgagaaacggcttcctgatgagaaaggtggccgtgttcttcagcaacacccccaccagagccagcccccagctgagagaggccgtgctgaagctgagcgacgccggcatcacccccctgttcctgaccagacaggaggacagacagctgatcaacgccctgcagatcaacaacaccgccgtgggccacgccctggtgctgcccgccggcagagacctgaccgacttcctggagaacgtgctgacctgccacgtgtgcctggacatctgcaacatcgaccccagctgcggcttcggcagctggagacccagcttcagagacagaagagccgccggcagcgacgtggacatcgacatggccttcatcctggacagcgccgagaccaccaccctgttccagttcaacgagatgaagaagtacatcgcctacctggtgagacagctggacatgagccccgaccccaaggccagccagcacttcgccagagtggccgtggtgcagcacgcccccagcgagagcgtggacaacgccagcatgccccccgtgaaggtggagttcagcctgaccgactacggcagcaaggagaagctggtggacttcctgagcagaggcatgacccagctgcagggcaccagagccctgggcagcgccatcgagtacaccatcgagaacgtgttcgagagcgcccccaaccccagagacctgaagatcgtggtgctgatgctgaccggcgaggtgcccgagcagcagctggaggaggcccagagagtgatcctgcaggccaagtgcaagggctacttcttcgtggtgctgggcatcggcagaaaggtgaacatcaaggaggtgtacaccttcgccagcgagcccaacgacgtgttcttcaagctggtggacaagagcaccgagctgaacgaggagcccctgatgagattcggcagactgctgcccagcttcgtgagcagcgagaacgccttctacctgagccccgacatcagaaagcagtgcgactggttccagggcgaccagcccaccaagaacctggtgaagttcggccacaagcaggtgaacgtgcccaacaacgtgaccagcagccccaccagcaaccccgtgaccaccaccaagcccgtgaccaccaccaagcccgtgaccaccaccaccaagcccgtgaccaccaccaccaagcccgtgaccatcatcaaccagcccagcgtgaagcccgccgccgccaagcccgcccccgccaagcccgtggccgccaagcccgtggccaccaagatggccaccgtgagaccccccgtggccgtgaagcccgccaccgccgccaagcccgtggccgccaagcccgccgccgtgagaccccccgccgccgccgccgccaagcccgtggccaccaagcccgaggtgcccagaccccaggccgccaagcccgccgccaccaagcccgccaccaccaagcccatggtgaagatgagcagagaggtgcaggtgttcgagatcaccgagaacagcgccaagctgcactgggagagagccgagccccccggcccctacttctacgacctgaccgtgaccagcgcccacgaccagagcctggtgctgaagcagaacctgaccgtgaccgacagagtgatcggcggcctgctggccggccagacctaccacgtggccgtggtgtgctacctgagaagccaggtgagagccacctaccacggcagcttcagcaccaagaagagccagcccccccccccccagcccgccagaagcgccagcagcagcaccatcaacctgatggtgagcaccgagcccctggccctgaccgagaccgacatctgcaagctgcccaaggacgagggcacctgcagagacttcatcctgaagtggtactacgaccccaacaccaagagctgcgccagattctggtacggcggctgcggcggcaacgagaacaagttcggcagccagaaggagtgcgagaaggtgtgcgcccccgtgctggccaagcccggcgtgatcagcgtgatgggcacctag

SEQ ID NO: 1757 - DNA, 1938 bp, Homo sapiens
atgctgctgaagaagcacgccggcaagggcggcggcagagagcccagaagcgaggaccccacccccgccgagcagcactgcgccagaaccatgcccccctgcgccgtgctggccgccctgctgagcgtggtggccgtggtgagctgcctgtacctgggcgtgaagaccaacgacctgcaggccagaatcgccgccctggagagcgccaagggcgcccccagcatccacctgctgcccgacaccctggaccacctgaagaccatggtgcaggagaaggtggagagactgctggcccagaagagctacgagcacatggccaagatcagaatcgccagagaggcccccagcgagtgcaactgccccgccggcccccccggcaagagaggcaagagaggcagaagaggcgagagcggcccccccggccagcccggcccccagggcccccccggccccaagggcgacaagggcgagcagggcgaccagggccccagaggcctgcccggcttccccaccgtggccgccctgcacagcaaccagatcctgaccgtgaagggcgaccagggccaggccggcccccccggcccccccggcccccccggccccagaggcccccccggcgacaccggcaaggacggccccagaggcatgcccggcgtgcccggcgagcccggcaagcccggcgagcagggcctgatgggccccctgggcccccccggccagaagggcagcatcggcgcccccggcatccccggcatgaacggccagaagggcgagcccggcctgcccggcgccgtgggccagaacggcatccccggccccaagggcgagcccggcgagcagggcgagaagggcgacgccggcgagaacggccccaagggcgacaccggcgagaagggcgaccccggcagcagcgccgccggcatcaagggcgagcccggcgagagcggcagacccggccagaagggcgagcccggcctgcccggcctgcccggcctgcccggcatcaagggcgagcccggcttcatcggcccccagggcgagcccggcctgcccggcctgcccggcaccaagggcgagagaggcgaggccggcccccccggcagaggcgagagaggcgagcccggcgcccccggccccaagggcgacagaggcgagaagggcgacagcggcgcccagggccccagaggcccccccggccagaagggcgaccagggcgccaccgagatcatcgactacaacggcaacctgcacgaggccctgcagggcccccccggcccccccggcccccagggcctgcagggccccaagggcgagcagggcagccccggcatccccggcatggacggcgagcagggcctgaagggcagcaagggcgacatgggcgaccccggcatgaccggcgagaagggcggcatcggcctgcccggcctgcccggcgccaacggcatgaagggcgagaagggcgacagcggcatgcccggcccccagggccccagcatcatcggcccccccggcccccccggcccccacggcccccccggccccatgggcccccacggcctgcccggccccaagggcgagcccggcctgaacggcgtgaagggcctgaagggcgagcccggccagaagggcgacagaggccccctgggcctgcccggcgccagcggcctggacggcaagcccggcagcagaggcaccgacggccccatgggcccccacggccccgccggccccaagggcgagagaggcgagaagggcgccatgggcgagcccggccccagaggcccctacggcctgcccggcttccccggccccagaggcgagaagggcgacctgggcgagaagggcgagaaggtgaccagccccagccagcacgtgccctgcctgatcctgctgctgctgagcgccctgctgttcagcctgtgcgacagcatctag

SEQ ID NO: 1758 - DNA, 1101 bp, Homo sapiens
atggccgagctgcagcagctgcaggagttcgagatccccaccggcagagaggccctgagaggcaaccacagcgccctgctgagagtggccgactactgcgaggacaactacgtgcaggccaccgacaagagaaaggccctggaggagaccatggccttcaccacccaggccctggccagcgtggcctaccaggtgggcaacctggccggccacaccctgagaatgctggacctgcagggcgccgccctgagacaggtggaggccagagtgagcaccctgggccagatggtgaacatgcacatggagaaggtggccagaagagagatcggcaccctggccaccgtgcagagactgccccccggccagaaggtgatcgcccccgagaacctgccccccctgaccccctactgcagaagacccctgaacttcggctgcctggacgacatcggccacggcatcaaggacctgagcacccagctgagcagaaccggcaccctgagcagaaagagcatcaaggcccccgccacccccgccagcgccaccctgggcagaccccccagaatccccgagcccgtgcacctgcccgtggtgcccgacggcagactgagcgccgccagcagcgccttcagcctggccagcgccggcagcgccgagggcgtgggcggcgcccccacccccaagggccaggccgccccccccgccccccccctgcccagcagcctggaccccccccccccccccgccgccgtggaggtgttccagagaccccccaccctggaggagctgagcccccccccccccgacgaggagctgcccctgcccctggacctgcccccccccccccccctggacggcgacgagctgggcctgcccccccccccccccggcttcggccccgacgagcccagctgggtgcccgccagctacctggagaaggtggtgaccctgtacccctacaccagccagaaggacaacgagctgagcttcagcgagggcaccgtgatctgcgtgaccagaagatacagcgacggctggtgcgagggcgtgagcagcgagggcaccggcttcttccccggcaactacgtggagcccagctgctag

SEQ ID NO: 1759 - DNA, 4257 bp, Homo sapiens
atgatcagactgggcgccccccagaccctggtgctgctgaccctgctggtggccgccgtgctgagatgccagggccaggacgtgagacagcccggccccaagggccagaagggcgagcccggcgacatcaaggacatcgtgggccccaagggcccccccggcccccagggccccgccggcgagcagggccccagaggcgacagaggcgacaagggcgagaagggcgcccccggccccagaggcagagacggcgagcccggcacccccggcaaccccggcccccccggcccccccggcccccccggcccccccggcctgggcggcaacttcgccgcccagatggccggcggcttcgacgagaaggccggcggcgcccagctgggcgtgatgcagggccccatgggccccatgggccccagaggcccccccggccccgccggcgcccccggcccccagggcttccagggcaaccccggcgagcccggcgagcccggcgtgagcggccccatgggccccagaggcccccccggcccccccggcaagcccggcgacgacggcgaggccggcaagcccggcaaggccggcgagagaggcccccccggcccccagggcgccagaggcttccccggcacccccggcctgcccggcgtgaagggccacagaggctaccccggcctggacggcgccaagggcgaggccggcgcccccggcgtgaagggcgagagcggcagccccggcgagaacggcagccccggccccatgggccccagaggcctgcccggcgagagaggcagaaccggccccgccggcgccgccggcgccagaggcaacgacggccagcccggccccgccggcccccccggccccgtgggccccgccggcggccccggcttccccggcgcccccggcgccaagggcgaggccggccccaccggcgccagaggccccgagggcgcccagggccccagaggcgagcccggcacccccggcagccccggccccgccggcgccagcggcaaccccggcaccgacggcatccccggcgccaagggcagcgccggcgcccccggcatcgccggcgcccccggcttccccggccccagaggcccccccggcccccagggcgccaccggccccctgggccccaagggccagaccggcgagcccggcatcgccggcttcaagggcgagcagggccccaagggcgagcccggccccgccggcccccagggcgcccccggccccgccggcgaggagggcaagagaggcgccagaggcgagcccggcggcgtgggccccatcggcccccccggcgagagaggcgcccccggcaacagaggcttccccggccaggacggcctggccggccccaagggcgcccccggcgagagaggccccagcggcctggccggccccaagggcgccaacggcgaccccggcagacccggcgagcccggcctgcccggcgccagaggcctgaccggcagacccggcgacgccggcccccagggcaaggtgggccccagcggcgcccccggcgaggacggcagacccggcccccccggcccccagggcgccagaggccagcccggcgtgatgggcttccccggccccaagggcgccaacggcgagcccggcaaggccggcgagaagggcctgcccggcgcccccggcctgagaggcctgcccggcaaggacggcgagaccggcgccgccggcccccccggccccgccggccccgccggcgagagaggcgagcagggcgcccccggccccagcggcttccagggcctgcccggcccccccggcccccccggcgagggcggcaagcccggcgaccagggcgtgcccggcgaggccggcgcccccggcctggtgggccccagaggcgagagaggcttccccggcgagagaggcagccccggcgcccagggcctgcagggccccagaggcctgcccggcacccccggcaccgacggccccaagggcgccagcggccccgccggcccccccggcgcccagggcccccccggcctgcagggcatgcccggcgagagaggcgccgccggcatcgccggccccaagggcgacagaggcgacgtgggcgagaagggccccgagggcgcccccggcaaggacggcggcagaggcctgaccggccccatcggcccccccggccccgccggcgccaacggcgagaagggcgaggtgggcccccccggccccgccggcagcgccggcgccagaggcgcccccggcgagagaggcgagaccggcccccccggccccgccggcttcgccggcccccccggcgccgacggccagcccggcgccaagggcgagcagggcgaggccggccagaagggcgacgccggcgcccccggcccccagggccccagcggcgcccccggcccccagggccccaccggcgtgaccggccccaagggcgccagaggcgcccagggcccccccggcgccaccggcttccccggcgccgccggcagagtgggcccccccggcagcaacggcaaccccggcccccccggcccccccggccccagcggcaaggacggccccaagggcgccagaggcgacagcggcccccccggcagagccggcgagcccggcctgcagggccccgccggcccccccggcgagaagggcgagcccggcgacgacggccccagcggcgccgagggcccccccggcccccagggcctggccggccagagaggcatcgtgggcctgcccggccagagaggcgagagaggcttccccggcctgcccggccccagcggcgagcccggcaagcagggcgcccccggcgccagcggcgacagaggcccccccggccccgtgggcccccccggcctgaccggccccgccggcgagcccggcagagagggcagccccggcgccgacggcccccccggcagagacggcgccgccggcgtgaagggcgacagaggcgagaccggcgccgtgggcgcccccggcgcccccggcccccccggcagccccggccccgccggccccaccggcaagcagggcgacagaggcgaggccggcgcccagggccccatgggccccagcggccccgccggcgccagaggcatccagggcccccagggccccagaggcgacaagggcgaggccggcgagcccggcgagagaggcctgaagggccacagaggcttcaccggcctgcagggcctgcccggcccccccggccccagcggcgaccagggcgccagcggccccgccggccccagcggccccagaggcccccccggccccgtgggccccagcggcaaggacggcgccaacggcatccccggccccatcggcccccccggccccagaggcagaagcggcgagaccggccccgccggcccccccggcaaccccggcccccccggcccccccggcccccccggccccggcatcgacatgagcgccttcgccggcctgggccccagagagaagggccccgaccccctgcagtacatgagagccgaccaggccgccggcggcctgagacagcacgacgccgaggtggacgccaccctgaagagcctgaacaaccagatcgagagcatcagaagccccgagggcagcagaaagaaccccgccagaacctgcagagacctgaagctgtgccaccccgagtggaagagcggcgactactggatcgaccccaaccagggctgcaccctggacgccatgaaggtgttctgcaacatggagaccggcgagacctgcgtgtaccccaaccccgccaacgtgcccaagaagaactggtggagcagcaagagcaaggagaagaagcacatctggttcggcgagaccatcaacggcggcttccacttcagctacggcgacgacaacctggcccccaacaccgccaacgtgcagatgaccttcctgagactgctgagcaccgagggcagccagaacatcacctaccactgcaagaacagcatcgcctacctggacgaggccgccggcaacctgaagaaggccctgctgatccagggcagcaacgacgtggagatcagagccgagggcaacagcagattcacctacaccgccctgaaggacggctgcaccaagcacaccggcaagtggggcaagaccgtgatcgagtacagaagccagaagaccagcagactgcccatcatcgacatcgcccccatggacatcggcggccccgagcaggagttcggcgtggacatcggccccgtgtgcttcctgtag

SEQ ID NO: 1760 - DNA, 4464 bp, Homo sapiens
atgatcagactgggcgccccccagaccctggtgctgctgaccctgctggtggccgccgtgctgagatgccagggccaggacgtgcaggaggccggcagctgcgtgcaggacggccagagatacaacgacaaggacgtgtggaagcccgagccctgcagaatctgcgtgtgcgacaccggcaccgtgctgtgcgacgacatcatctgcgaggacgtgaaggactgcctgagccccgagatccccttcggcgagtgctgccccatctgccccaccgacctggccaccgccagcggccagcccggccccaagggccagaagggcgagcccggcgacatcaaggacatcgtgggccccaagggcccccccggcccccagggccccgccggcgagcagggccccagaggcgacagaggcgacaagggcgagaagggcgcccccggccccagaggcagagacggcgagcccggcacccccggcaaccccggcccccccggcccccccggcccccccggcccccccggcctgggcggcaacttcgccgcccagatggccggcggcttcgacgagaaggccggcggcgcccagctgggcgtgatgcagggccccatgggccccatgggccccagaggcccccccggccccgccggcgcccccggcccccagggcttccagggcaaccccggcgagcccggcgagcccggcgtgagcggccccatgggccccagaggcccccccggcccccccggcaagcccggcgacgacggcgaggccggcaagcccggcaaggccggcgagagaggcccccccggcccccagggcgccagaggcttccccggcacccccggcctgcccggcgtgaagggccacagaggctaccccggcctggacggcgccaagggcgaggccggcgcccccggcgtgaagggcgagagcggcagccccggcgagaacggcagccccggccccatgggccccagaggcctgcccggcgagagaggcagaaccggccccgccggcgccgccggcgccagaggcaacgacggccagcccggccccgccggcccccccggccccgtgggccccgccggcggccccggcttccccggcgcccccggcgccaagggcgaggccggccccaccggcgccagaggccccgagggcgcccagggccccagaggcgagcccggcacccccggcagccccggccccgccggcgccagcggcaaccccggcaccgacggcatccccggcgccaagggcagcgccggcgcccccggcatcgccggcgcccccggcttccccggccccagaggcccccccggcccccagggcgccaccggccccctgggccccaagggccagaccggcgagcccggcatcgccggcttcaagggcgagcagggccccaagggcgagcccggccccgccggcccccagggcgcccccggccccgccggcgaggagggcaagagaggcgccagaggcgagcccggcggcgtgggccccatcggcccccccggcgagagaggcgcccccggcaacagaggcttccccggccaggacggcctggccggccccaagggcgcccccggcgagagaggccccagcggcctggccggccccaagggcgccaacggcgaccccggcagacccggcgagcccggcctgcccggcgccagaggcctgaccggcagacccggcgacgccggcccccagggcaaggtgggccccagcggcgcccccggcgaggacggcagacccggcccccccggcccccagggcgccagaggccagcccggcgtgatgggcttccccggccccaagggcgccaacggcgagcccggcaaggccggcgagaagggcctgcccggcgcccccggcctgagaggcctgcccggcaaggacggcgagaccggcgccgccggcccccccggccccgccggccccgccggcgagagaggcgagcagggcgcccccggccccagcggcttccagggcctgcccggcccccccggcccccccggcgagggcggcaagcccggcgaccagggcgtgcccggcgaggccggcgcccccggcctggtgggccccagaggcgagagaggcttccccggcgagagaggcagccccggcgcccagggcctgcagggccccagaggcctgcccggcacccccggcaccgacggccccaagggcgccagcggccccgccggcccccccggcgcccagggcccccccggcctgcagggcatgcccggcgagagaggcgccgccggcatcgccggccccaagggcgacagaggcgacgtgggcgagaagggccccgagggcgcccccggcaaggacggcggcagaggcctgaccggccccatcggcccccccggccccgccggcgccaacggcgagaagggcgaggtgggcccccccggccccgccggcagcgccggcgccagaggcgcccccggcgagagaggcgagaccggcccccccggccccgccggcttcgccggcccccccggcgccgacggccagcccggcgccaagggcgagcagggcgaggccggccagaagggcgacgccggcgcccccggcccccagggccccagcggcgcccccggcccccagggccccaccggcgtgaccggccccaagggcgccagaggcgcccagggcccccccggcgccaccggcttccccggcgccgccggcagagtgggcccccccggcagcaacggcaaccccggcccccccggcccccccggccccagcggcaaggacggccccaagggcgccagaggcgacagcggcccccccggcagagccggcgagcccggcctgcagggccccgccggcccccccggcgagaagggcgagcccggcgacgacggccccagcggcgccgagggcccccccggcccccagggcctggccggccagagaggcatcgtgggcctgcccggccagagaggcgagagaggcttccccggcctgcccggccccagcggcgagcccggcaagcagggcgcccccggcgccagcggcgacagaggcccccccggccccgtgggcccccccggcctgaccggccccgccggcgagcccggcagagagggcagccccggcgccgacggcccccccggcagagacggcgccgccggcgtgaagggcgacagaggcgagaccggcgccgtgggcgcccccggcgcccccggcccccccggcagccccggccccgccggccccaccggcaagcagggcgacagaggcgaggccggcgcccagggccccatgggccccagcggccccgccggcgccagaggcatccagggcccccagggccccagaggcgacaagggcgaggccggcgagcccggcgagagaggcctgaagggccacagaggcttcaccggcctgcagggcctgcccggcccccccggccccagcggcgaccagggcgccagcggccccgccggccccagcggccccagaggcccccccggccccgtgggccccagcggcaaggacggcgccaacggcatccccggccccatcggcccccccggccccagaggcagaagcggcgagaccggccccgccggcccccccggcaaccccggcccccccggcccccccggcccccccggccccggcatcgacatgagcgccttcgccggcctgggccccagagagaagggccccgaccccctgcagtacatgagagccgaccaggccgccggcggcctgagacagcacgacgccgaggtggacgccaccctgaagagcctgaacaaccagatcgagagcatcagaagccccgagggcagcagaaagaaccccgccagaacctgcagagacctgaagctgtgccaccccgagtggaagagcggcgactactggatcgaccccaaccagggctgcaccctggacgccatgaaggtgttctgcaacatggagaccggcgagacctgcgtgtaccccaaccccgccaacgtgcccaagaagaactggtggagcagcaagagcaaggagaagaagcacatctggttcggcgagaccatcaacggcggcttccacttcagctacggcgacgacaacctggcccccaacaccgccaacgtgcagatgaccttcctgagactgctgagcaccgagggcagccagaacatcacctaccactgcaagaacagcatcgcctacctggacgaggccgccggcaacctgaagaaggccctgctgatccagggcagcaacgacgtggagatcagagccgagggcaacagcagattcacctacaccgccctgaaggacggctgcaccaagcacaccggcaagtggggcaagaccgtgatcgagtacagaagccagaagaccagcagactgcccatcatcgacatcgcccccatggacatcggcggccccgagcaggagttcggcgtggacatcggccccgtgtgcttcctgtag

SEQ ID NO: 1761 - DNA, 4257 bp, Homo sapiens
atgatcagactgggcgccccccagaccctggtgctgctgaccctgctggtggccgccgtgctgagatgccagggccaggacgtgagaaagcccgcccccgccctggagcccgccgcccccggcagcctgagccagatcgtgggccccaagggcccccccggcccccagggccccgccggcgagcagggccccagaggcgacagaggcgacaagggcgagaagggcgcccccggccccagaggcagagacggcgagcccggcacccccggcaaccccggcccccccggcccccccggcccccccggcccccccggcctgggcggcaacttcgccgcccagatggccggcggcttcgacgagaaggccggcggcgcccagctgggcgtgatgcagggccccatgggccccatgggccccagaggcccccccggccccgccggcgcccccggcccccagggcttccagggcaaccccggcgagcccggcgagcccggcgtgagcggccccatgggccccagaggcccccccggcccccccggcaagcccggcgacgacggcgaggccggcaagcccggcaaggccggcgagagaggcccccccggcccccagggcgccagaggcttccccggcacccccggcctgcccggcgtgaagggccacagaggctaccccggcctggacggcgccaagggcgaggccggcgcccccggcgtgaagggcgagagcggcagccccggcgagaacggcagccccggccccatgggccccagaggcctgcccggcgagagaggcagaaccggccccgccggcgccgccggcgccagaggcaacgacggccagcccggccccgccggcccccccggccccgtgggccccgccggcggccccggcttccccggcgcccccggcgccaagggcgaggccggccccaccggcgccagaggccccgagggcgcccagggccccagaggcgagcccggcacccccggcagccccggccccgccggcgccagcggcaaccccggcaccgacggcatccccggcgccaagggcagcgccggcgcccccggcatcgccggcgcccccggcttccccggccccagaggcccccccggcccccagggcgccaccggccccctgggccccaagggccagaccggcgagcccggcatcgccggcttcaagggcgagcagggccccaagggcgagcccggccccgccggcccccagggcgcccccggccccgccggcgaggagggcaagagaggcgccagaggcgagcccggcggcgtgggccccatcggcccccccggcgagagaggcgcccccggcaacagaggcttccccggccaggacggcctggccggccccaagggcgcccccggcgagagaggccccagcggcctggccggccccaagggcgccaacggcgaccccggcagacccggcgagcccggcctgcccggcgccagaggcctgaccggcagacccggcgacgccggcccccagggcaaggtgggccccagcggcgcccccggcgaggacggcagacccggcccccccggcccccagggcgccagaggccagcccggcgtgatgggcttccccggccccaagggcgccaacggcgagcccggcaaggccggcgagaagggcctgcccggcgcccccggcctgagaggcctgcccggcaaggacggcgagaccggcgccgccggcccccccggccccgccggccccgccggcgagagaggcgagcagggcgcccccggccccagcggcttccagggcctgcccggcccccccggcccccccggcgagggcggcaagcccggcgaccagggcgtgcccggcgaggccggcgcccccggcctggtgggccccagaggcgagagaggcttccccggcgagagaggcagccccggcgcccagggcctgcagggccccagaggcctgcccggcacccccggcaccgacggccccaagggcgccagcggccccgccggcccccccggcgcccagggcccccccggcctgcagggcatgcccggcgagagaggcgccgccggcatcgccggccccaagggcgacagaggcgacgtgggcgagaagggccccgagggcgcccccggcaaggacggcggcagaggcctgaccggccccatcggcccccccggccccgccggcgccaacggcgagaagggcgaggtgggcccccccggccccgccggcagcgccggcgccagaggcgcccccggcgagagaggcgagaccggcccccccggccccgccggcttcgccggcccccccggcgccgacggccagcccggcgccaagggcgagcagggcgaggccggccagaagggcgacgccggcgcccccggcccccagggccccagcggcgcccccggcccccagggccccaccggcgtgaccggccccaagggcgccagaggcgcccagggcccccccggcgccaccggcttccccggcgccgccggcagagtgggcccccccggcagcaacggcaaccccggcccccccggcccccccggccccagcggcaaggacggccccaagggcgccagaggcgacagcggcccccccggcagagccggcgagcccggcctgcagggccccgccggcccccccggcgagaagggcgagcccggcgacgacggccccagcggcgccgagggcccccccggcccccagggcctggccggccagagaggcatcgtgggcctgcccggccagagaggcgagagaggcttccccggcctgcccggccccagcggcgagcccggcaagcagggcgcccccggcgccagcggcgacagaggcccccccggccccgtgggcccccccggcctgaccggccccgccggcgagcccggcagagagggcagccccggcgccgacggcccccccggcagagacggcgccgccggcgtgaagggcgacagaggcgagaccggcgccgtgggcgcccccggcgcccccggcccccccggcagccccggccccgccggccccaccggcaagcagggcgacagaggcgaggccggcgcccagggccccatgggccccagcggccccgccggcgccagaggcatccagggcccccagggccccagaggcgacaagggcgaggccggcgagcccggcgagagaggcctgaagggccacagaggcttcaccggcctgcagggcctgcccggcccccccggccccagcggcgaccagggcgccagcggccccgccggccccagcggccccagaggcccccccggccccgtgggccccagcggcaaggacggcgccaacggcatccccggccccatcggcccccccggccccagaggcagaagcggcgagaccggccccgccggcccccccggcaaccccggcccccccggcccccccggcccccccggccccggcatcgacatgagcgccttcgccggcctgggccccagagagaagggccccgaccccctgcagtacatgagagccgaccaggccgccggcggcctgagacagcacgacgccgaggtggacgccaccctgaagagcctgaacaaccagatcgagagcatcagaagccccgagggcagcagaaagaaccccgccagaacctgcagagacctgaagctgtgccaccccgagtggaagagcggcgactactggatcgaccccaaccagggctgcaccctggacgccatgaaggtgttctgcaacatggagaccggcgagacctgcgtgtaccccaaccccgccaacgtgcccaagaagaactggtggagcagcaagagcaaggagaagaagcacatctggttcggcgagaccatcaacggcggcttccacttcagctacggcgacgacaacctggcccccaacaccgccaacgtgcagatgaccttcctgagactgctgagcaccgagggcagccagaacatcacctaccactgcaagaacagcatcgcctacctggacgaggccgccggcaacctgaagaaggccctgctgatccagggcagcaacgacgtggagatcagagccgagggcaacagcagattcacctacaccgccctgaaggacggctgcaccaagcacaccggcaagtggggcaagaccgtgatcgagtacagaagccagaagaccagcagactgcccatcatcgacatcgcccccatggacatcggcggccccgagcaggagttcggcgtggacatcggccccgtgtgcttcctgtag

SEQ ID NO: 1762 - DNA, 3939 bp, Homo sapiens
atgggccccagactgagcgtgtggctgctgctgctgcccgccgccctgctgctgcacgaggagcacagcagagccgccgccaagggcggctgcgccggcagcggctgcggcaagtgcgactgccacggcgtgaagggccagaagggcgagagaggcctgcccggcctgcagggcgtgatcggcttccccggcatgcagggccccgagggcccccagggcccccccggccagaagggcgacaccggcgagcccggcctgcccggcaccaagggcaccagaggcccccccggcgccagcggctaccccggcaaccccggcctgcccggcatccccggccaggacggcccccccggcccccccggcatccccggctgcaacggcaccaagggcgagagaggccccctgggcccccccggcctgcccggcttcgccggcaaccccggcgaccccggcgagatcctgggccacgtgcccggcatgctgctgaagggcgagagaggcttccccggcatccccggcacccccggcccccccggcctgcccggcctgcagggccccgtgggcccccccggcttcaccggcccccccgtgagcttcggcggctgcctgagcgagttcggccacggcggcatcagcttccccctgaccaagagaagacagggcgaccagggcgtgagcggcccccccggcgtgcccggccaggcccaggtgcaggagaagggcgacttcgccaccaagggcgagaagggccagaagggcgagcccggcttccagggcatgcccggcgtgggcgagaagggcgagcccggcaagcccggccccagaggcaagcccggcaaggacggcgacaagggcgagaagggcagccccggcttccccggcgagcccggctaccccggcctgatcggcagacagggcccccaggtgaacgccggcaccatcgcctaccccctgcccccctgccccgtgatcggcaccggccccctgggcgagaagggcgagagaggctaccccggcacccccggccccagaggcgagcccggccccaagggcagcttcctggccttcttcccccccccccccacccccccccccttcgccggcctgcccgtgcccggccaggccggcgcccccggcttccccggcgagagaggcgagaagggcgacagaggcttccccggcaccagcctgcccggccccagcggcagagacggcctgcccggcccccccggcagccccggcccccccggccagcccggctacaccaacggcatcgtggagtgccagcccggcccccccggcgaccagggcccccccggcatccccggccagcccggcttcatcggcgagatcggcgagaagggccagaagggcgagagctgcctgatctgcgacatcgacggctacagaggcccccccggcccccagggcccccccggcgagatcggcttccccggccagcccggcgccaagggcctgcccggcatcaccggccagagcggcctgcccggcctgcccggccagcagggcgcccccggcatccccggcttccccggcagcaagggcgagatgggcgtgatgggcacccccggccagcccggcagccccggccccgtgggcgcccccggcctgcccggcgagaagggcgaccacggcttccccggcagcagcggccccagaggcgaccccggcctgaagggcgacaagggcgacgtgggcctgcccggcaagcccggcagcatggacaaggtggacatgggcagcatgaagggccagaagggcgaccagggcgagaagggccagatcggccccatcggcgagaagggcagcagaggcgaccccggcacccccggcgtgcccggcaaggacggccaggccggccagcccggccagcccggccccaagggcgaccccggcatcagcggcacccccggcgcccccggcctgcccggccccaagggcagcgtgggcggcatgggcctgcccggcacccccggcgagaagggcgtgcccggcatccccggcccccagggcagccccggcctgcccggcgacaagggcgccaagggcgagaagggccaggccggcccccccggcatcggcatccccggcctgagaggcgagaagggcgaccagggcatcgccggcttccccggcagccccggcgagaagggcgagaagggcagcatcggcatccccggcatgcccggcagccccggcctgaagggcagccccggcagcgtgggctaccccggcagccccggcctgcccggcgagaagggcgacaagggcctgcccggcctggacggcatccccggcgtgaagggcgaggccggcctgcccggcacccccggccccaccggccccgccggccagaagggcgagcccggcagcgacggcatccccggcagcgccggcgagaagggcgagcccggcctgcccggcagaggcttccccggcttccccggcgccaagggcgacaagggcagcaagggcgaggtgggcttccccggcctggccggcagccccggcatccccggcagcaagggcgagcagggcttcatgggcccccccggcccccagggccagcccggcctgcccggcagccccggccacgccaccgagggccccaagggcgacagaggcccccagggccagcccggcctgcccggcctgcccggccccatgggcccccccggcctgcccggcatcgacggcgtgaagggcgacaagggcaaccccggctggcccggcgcccccggcgtgcccggccccaagggcgaccccggcttccagggcatgcccggcatcggcggcagccccggcatcaccggcagcaagggcgacatgggcccccccggcgtgcccggcttccagggccccaagggcctgcccggcctgcagggcatcaagggcgaccagggcgaccagggcgtgcccggcgccaagggcctgcccggcccccccggcccccccggcccctacgacatcatcaagggcgagcccggcctgcccggccccgagggcccccccggcctgaagggcctgcagggcctgcccggccccaagggccagcagggcgtgaccggcctggtgggcatccccggcccccccggcatccccggcttcgacggcgcccccggccagaagggcgagatgggccccgccggccccaccggccccagaggcttccccggcccccccggccccgacggcctgcccggcagcatgggcccccccggcacccccagcgtggaccacggcttcctggtgaccagacacagccagaccatcgacgacccccagtgccccagcggcaccaagatcctgtaccacggctacagcctgctgtacgtgcagggcaacgagagagcccacggccaggacctgggcaccgccggcagctgcctgagaaagttcagcaccatgcccttcctgttctgcaacatcaacaacgtgtgcaacttcgccagcagaaacgactacagctactggctgagcacccccgagcccatgcccatgagcatggcccccatcaccggcgagaacatcagacccttcatcagcagatgcgccgtgtgcgaggcccccgccatggtgatggccgtgcacagccagaccatccagatccccccctgccccagcggctggagcagcctgtggatcggctacagcttcgtgatgcacaccagcgccggcgccgagggcagcggccaggccctggccagccccggcagctgcctggaggagttcagaagcgcccccttcatcgagtgccacggcagaggcacctgcaactactacgccaacgcctacagcttctggctggccaccatcgagagaagcgagatgttcaagaagcccacccccagcaccctgaaggccggcgagctgagaacccacgtgagcagatgccaggtgtgcatgagaagaacctag

SEQ ID NO: 1763 - DNA, 5010 bp, Homo sapiens
atgggccccagactgagcgtgtggctgctgctgctgcccgccgccctgctgctgcacgaggagcacagcagagccgccgccaagggcggctgcgccggcagcggctgcggcaagtgcgactgccacggcgtgaagggccagaagggcgagagaggcctgcccggcctgcagggcgtgatcggcttccccggcatgcagggccccgagggcccccagggcccccccggccagaagggcgacaccggcgagcccggcctgcccggcaccaagggcaccagaggcccccccggcgccagcggctaccccggcaaccccggcctgcccggcatccccggccaggacggcccccccggcccccccggcatccccggctgcaacggcaccaagggcgagagaggccccctgggcccccccggcctgcccggcttcgccggcaaccccggcccccccggcctgcccggcatgaagggcgaccccggcgagatcctgggccacgtgcccggcatgctgctgaagggcgagagaggcttccccggcatccccggcacccccggcccccccggcctgcccggcctgcagggccccgtgggcccccccggcttcaccggcccccccggcccccccggcccccccggcccccccggcgagaagggccagatgggcctgagcttccagggccccaagggcgacaagggcgaccagggcgtgagcggcccccccggcgtgcccggccaggcccaggtgcaggagaagggcgacttcgccaccaagggcgagaagggccagaagggcgagcccggcttccagggcatgcccggcgtgggcgagaagggcgagcccggcaagcccggccccagaggcaagcccggcaaggacggcgacaagggcgagaagggcagccccggcttccccggcgagcccggctaccccggcctgatcggcagacagggcccccagggcgagaagggcgaggccggcccccccggcccccccggcatcgtgatcggcaccggccccctgggcgagaagggcgagagaggctaccccggcacccccggccccagaggcgagcccggccccaagggcttccccggcctgcccggccagcccggcccccccggcctgcccgtgcccggccaggccggcgcccccggcttccccggcgagagaggcgagaagggcgacagaggcttccccggcaccagcctgcccggccccagcggcagagacggcctgcccggcccccccggcagccccggcccccccggccagcccggctacaccaacggcatcgtggagtgccagcccggcccccccggcgaccagggcccccccggcatccccggccagcccggcttcatcggcgagatcggcgagaagggccagaagggcgagagctgcctgatctgcgacatcgacggctacagaggcccccccggcccccagggcccccccggcgagatcggcttccccggccagcccggcgccaagggcgacagaggcctgcccggcagagacggcgtggccggcgtgcccggcccccagggcacccccggcctgatcggccagcccggcgccaagggcgagcccggcgagttctacttcgacctgagactgaagggcgacaagggcgaccccggcttccccggccagcccggcatgaccggcagagccggcagccccggcagagacggccaccccggcctgcccggccccaagggcagccccggcagcgtgggcctgaagggcgagagaggcccccccggcggcgtgggcttccccggcagcagaggcgacaccggcccccccggcccccccggctacggccccgccggccccatcggcgacaagggccaggccggcttccccggcggccccggcagccccggcctgcccggccccaagggcgagcccggcaagatcgtgcccctgcccggcccccccggcgccgagggcctgcccggcagccccggcttccccggcccccagggcgacagaggcttccccggcacccccggcagacccggcctgcccggcgagaagggcgccgtgggccagcccggcatcggcttccccggcccccccggccccaagggcgtggacggcctgcccggcgacatgggcccccccggcacccccggcagacccggcttcaacggcctgcccggcaaccccggcgtgcagggccagaagggcgagcccggcgtgggcctgcccggcctgaagggcctgcccggcctgcccggcatccccggcacccccggcgagaagggcagcatcggcgtgcccggcgtgcccggcgagcacggcgccatcggcccccccggcctgcagggcatcagaggcgagcccggcccccccggcctgcccggcagcgtgggcagccccggcgtgcccggcatcggcccccccggcgccagaggcccccccggcggccagggcccccccggcctgagcggcccccccggcatcaagggcgagaagggcttccccggcttccccggcctggacatgcccggccccaagggcgacaagggcgcccagggcctgcccggcatcaccggccagagcggcctgcccggcctgcccggccagcagggcgcccccggcatccccggcttccccggcagcaagggcgagatgggcgtgatgggcacccccggccagcccggcagccccggccccgtgggcgcccccggcctgcccggcgagaagggcgaccacggcttccccggcagcagcggccccagaggcgaccccggcctgaagggcgacaagggcgacgtgggcctgcccggcaagcccggcagcatggacaaggtggacatgggcagcatgaagggccagaagggcgaccagggcgagaagggccagatcggccccatcggcgagaagggcagcagaggcgaccccggcacccccggcgtgcccggcaaggacggccaggccggccagcccggccagcccggccccaagggcgaccccggcatcagcggcacccccggcgcccccggcctgcccggccccaagggcagcgtgggcggcatgggcctgcccggcacccccggcgagaagggcgtgcccggcatccccggcccccagggcagccccggcctgcccggcgacaagggcgccaagggcgagaagggccaggccggcccccccggcatcggcatccccggcctgagaggcgagaagggcgaccagggcatcgccggcttccccggcagccccggcgagaagggcgagaagggcagcatcggcatccccggcatgcccggcagccccggcctgaagggcagccccggcagcgtgggctaccccggcagccccggcctgcccggcgagaagggcgacaagggcctgcccggcctggacggcatccccggcgtgaagggcgaggccggcctgcccggcacccccggccccaccggccccgccggccagaagggcgagcccggcagcgacggcatccccggcagcgccggcgagaagggcgagcccggcctgcccggcagaggcttccccggcttccccggcgccaagggcgacaagggcagcaagggcgaggtgggcttccccggcctggccggcagccccggcatccccggcagcaagggcgagcagggcttcatgggcccccccggcccccagggccagcccggcctgcccggcagccccggccacgccaccgagggccccaagggcgacagaggcccccagggccagcccggcctgcccggcctgcccggccccatgggcccccccggcctgcccggcatcgacggcgtgaagggcgacaagggcaaccccggctggcccggcgcccccggcgtgcccggccccaagggcgaccccggcttccagggcatgcccggcatcggcggcagccccggcatcaccggcagcaagggcgacatgggcccccccggcgtgcccggcttccagggccccaagggcctgcccggcctgcagggcatcaagggcgaccagggcgaccagggcgtgcccggcgccaagggcctgcccggcccccccggcccccccggcccctacgacatcatcaagggcgagcccggcctgcccggccccgagggcccccccggcctgaagggcctgcagggcctgcccggccccaagggccagcagggcgtgaccggcctggtgggcatccccggcccccccggcatccccggcttcgacggcgcccccggccagaagggcgagatgggccccgccggccccaccggccccagaggcttccccggcccccccggccccgacggcctgcccggcagcatgggcccccccggcacccccagcgtggaccacggcttcctggtgaccagacacagccagaccatcgacgacccccagtgccccagcggcaccaagatcctgtaccacggctacagcctgctgtacgtgcagggcaacgagagagcccacggccaggacctgggcaccgccggcagctgcctgagaaagttcagcaccatgcccttcctgttctgcaacatcaacaacgtgtgcaacttcgccagcagaaacgactacagctactggctgagcacccccgagcccatgcccatgagcatggcccccatcaccggcgagaacatcagacccttcatcagcagatgcgccgtgtgcgaggcccccgccatggtgatggccgtgcacagccagaccatccagatccccccctgccccagcggctggagcagcctgtggatcggctacagcttcgtgatgcacaccagcgccggcgccgagggcagcggccaggccctggccagccccggcagctgcctggaggagttcagaagcgcccccttcatcgagtgccacggcagaggcacctgcaactactacgccaacgcctacagcttctggctggccaccatcgagagaagcgagatgttcaagaagcccacccccagcaccctgaaggccggcgagctgagaacccacgtgagcagatgccaggtgtgcatgagaagaacctag

SEQ ID NO: 1764 - DNA, 3957 bp, Homo sapiens
atgggccccagactgagcgtgtggctgctgctgctgcccgccgccctgctgctgcacgaggagcacagcagagccgccgccaagggcggctgcgccggcagcggctgcggcaagtgcgactgccacggcgtgaagggccagaagggcgagagaggcctgcccggcctgcagggcgtgatcggcttccccggcatgcagggccccgagggcccccagggcccccccggccagaagggcgacaccggcgagcccggcctgcccggcaccaagggcaccagaggcccccccggcgccagcggctaccccggcaaccccggcctgcccggcatccccggccaggacggcccccccggcccccccggcatccccggctgcaacggcaccaagggcgagagaggccccctgggcccccccggcctgcccggcttcgccggcaaccccggcccccccggcctgcccggcatgaagggcgaccccggcgagatcctgggccacgtgcccggcatgctgctgaagggcgagagaggcttccccggcatccccggcacccccggcccccccggcctgcccggcctgcagggccccgtgggcccccccggcttcaccggcccccccggcccccccggcccccccggcccccccggcgagaagggccagatgggcctgagcttccagggccccaagggcgacaagggcgaccagggcgtgagcggcccccccggcgtgcccggccaggcccaggtgcaggagaagggcgacttcgccaccaagggcgagaagggccagaagggcgagcccggcttccagggcatgcccggcgtgggcgagaagggcgagcccggcaagcccggccccagaggcaagcccggcaaggacggcgacaagggcgagaagggcagccccggcttccccggcgagcccggctaccccggcctgatcggcagacagggcccccagggcgagaagggcgaggccggcccccccggcccccccggcatcgtgatcggcaccggccccctgggcgagaagggcgagagaggctaccccggcacccccggccccagaggcgagcccggccccaagggcttccccggcctgcccggccagcccggcccccccggcctgcccgtgcccggccaggccggcgcccccggcttccccggcgagagaggcgagaagggcgacagaggcttccccggcaccagcctgcccggccccagcggcagagacggcctgcccggcccccccggcagccccggcccccccggccagcccggctacaccaacggcatcgtggagtgccagcccggcccccccggcgaccagggcccccccggcatccccggccagcccggcttcatcggcgagatcggcgagaagggccagaagggcgagagctgcctgatctgcgacatcgacggctacagaggcccccccggcccccagggcccccccggcgagatcggcttccccggccagcccggcgccaagggcctgcccggcatcaccggccagagcggcctgcccggcctgcccggccagcagggcgcccccggcatccccggcttccccggcagcaagggcgagatgggcgtgatgggcacccccggccagcccggcagccccggccccgtgggcgcccccggcctgcccggcgagaagggcgaccacggcttccccggcagcagcggccccagaggcgaccccggcctgaagggcgacaagggcgacgtgggcctgcccggcaagcccggcagcatggacaaggtggacatgggcagcatgaagggccagaagggcgaccagggcgagaagggccagatcggccccatcggcgagaagggcagcagaggcgaccccggcacccccggcgtgcccggcaaggacggccaggccggccagcccggccagcccggccccaagggcgaccccggcatcagcggcacccccggcgcccccggcctgcccggccccaagggcagcgtgggcggcatgggcctgcccggcacccccggcgagaagggcgtgcccggcatccccggcccccagggcagccccggcctgcccggcgacaagggcgccaagggcgagaagggccaggccggcccccccggcatcggcatccccggcctgagaggcgagaagggcgaccagggcatcgccggcttccccggcagccccggcgagaagggcgagaagggcagcatcggcatccccggcatgcccggcagccccggcctgaagggcagccccggcagcgtgggctaccccggcagccccggcctgcccggcgagaagggcgacaagggcctgcccggcctggacggcatccccggcgtgaagggcgaggccggcctgcccggcacccccggccccaccggccccgccggccagaagggcgagcccggcagcgacggcatccccggcagcgccggcgagaagggcgagcccggcctgcccggcagaggcttccccggcttccccggcgccaagggcgacaagggcagcaagggcgaggtgggcttccccggcctggccggcagccccggcatccccggcagcaagggcgagcagggcttcatgggcccccccggcccccagggccagcccggcctgcccggcagccccggccacgccaccgagggccccaagggcgacagaggcccccagggccagcccggcctgcccggcctgcccggccccatgggcccccccggcctgcccggcatcgacggcgtgaagggcgacaagggcaaccccggctggcccggcgcccccggcgtgcccggccccaagggcgaccccggcttccagggcatgcccggcatcggcggcagccccggcatcaccggcagcaagggcgacatgggcccccccggcgtgcccggcttccagggccccaagggcctgcccggcctgcagggcatcaagggcgaccagggcgaccagggcgtgcccggcgccaagggcctgcccggcccccccggcccccccggcccctacgacatcatcaagggcgagcccggcctgcccggccccgagggcccccccggcctgaagggcctgcagggcctgcccggccccaagggccagcagggcgtgaccggcctggtgggcatccccggcccccccggcatccccggcttcgacggcgcccccggccagaagggcgagatgggccccgccggccccaccggccccagaggcttccccggcccccccggccccgacggcctgcccggcagcatgggcccccccggcacccccagcgtggaccacggcttcctggtgaccagacacagccagaccatcgacgacccccagtgccccagcggcaccaagatcctgtaccacggctacagcctgctgtacgtgcagggcaacgagagagcccacggccaggacctgggcaccgccggcagctgcctgagaaagttcagcaccatgcccttcctgttctgcaacatcaacaacgtgtgcaacttcgccagcagaaacgactacagctactggctgagcacccccgagcccatgcccatgagcatggcccccatcaccggcgagaacatcagacccttcatcagcagatgcgccgtgtgcgaggcccccgccatggtgatggccgtgcacagccagaccatccagatccccccctgccccagcggctggagcagcctgtggatcggctacagcttcgtgatgcacaccagcgccggcgccgagggcagcggccaggccctggccagccccggcagctgcctggaggagttcagaagcgcccccttcatcgagtgccacggcagaggcacctgcaactactacgccaacgcctacagcttctggctggccaccatcgagagaagcgagatgttcaagaagcccacccccagcaccctgaaggccggcgagctgagaacccacgtgagcagatgccaggtgtgcatgagaagaacctag

SEQ ID NO: 1765 - DNA, 1560 bp, Homo sapiens
atgggccccagactgagcgtgtggctgctgctgctgcccgccgccctgctgctgcacgaggagcacagcagagccgccgccaagggcggctgcgccggcagcggctgcggcaagtgcgactgccacggcgtgaagggccagaagggcgagagaggcctgcccggcctgcagggcgtgatcggcttccccggcatgcagggccccgagggcccccagggcccccccggccagaagggcgacaccggcgagcccggcctgcccggcaccaagggcaccagaggcccccccggcgccagcggctaccccggcaaccccggcctgcccggcatccccggccaggacggcccccccggcccccccggcatccccggctgcaacggcaccaagggcgagagaggccccctgggcccccccggcctgcccggcttcgccggcaaccccggcccccccggcctgcccggcatgaagggcgaccccggcgagatcctgggccacgtgcccggcatgctgctgaagggcgagagaggcttccccggcatccccggcacccccggcccccccggcctgcccggcctgcagggccccgtgggcccccccggcttcaccggcccccccggcccccccggcccccccggcccccccggcgagaagggccagatgggcctgagcttccagggccccaagggcgacaagggcgaccagggcgtgagcggcccccccggcgtgcccggccaggcccaggtgcaggagaagggcgacttcgccaccaagggcgagaagggccagaagggcgagcccggcttccagggcatgcccggcgtgggcgagaagggcgagcccggcaagcccggccccagaggcaagcccggcaaggacggcgacaagggcgagaagggcagccccggcttccccggcgagcccggctaccccggcctgatcggcagacagggcccccagggcgagaagggcgaggccggcccccccggcccccccggcatcgtgatcggcaccggccccctgggcgagaagggcgagagaggctaccccggcacccccggccccagaggcgagcccggccccaagggcttccccggcctgcccggccagcccggcccccccggcctgcccgtgcccggccaggccggcgcccccggcttccccggcgagagaggcgagaagggcgacagaggcttccccggcaccagcctgcccggccccagcggcagagacggcctgcccggcccccccggcagccccggcccccccggccagcccggctacaccaacggcatcgtggagtgccagcccggcccccccggcgaccagggcccccccggcatccccggccagcccggcttcatcggcgagatcggcgagaagggccagaagggcgagagctgcctgatctgcgacatcgacggctacagaggcccccccggcccccagggcccccccggcgagatcggcttccccggccagcccggcgccaagggcgacagaggcctgcccggcagagacggcgtggccggcgtgcccctgctgttccagatccacaagtag

SEQ ID NO: 1766 - DNA, 1797 bp, Homo sapiens
atgagcgacaaccagagctggaacagcagcggcagcgaggaggaccccgagaccgagagcggcccccccgtggagagatgcggcgtgctgagcaagtggaccaactacatccacggctggcaggacagatgggtggtgctgaagaacaacgccctgagctactacaagagcgaggacgagaccgagtacggctgcagaggcagcatctgcctgagcaaggccgtgatcaccccccacgacttcgacgagtgcagattcgacatcagcgtgaacgacagcgtgtggtacctgagagcccaggaccccgaccacagacagcagtggatcgacgccatcgagcagcacaagaccgagagcggctacggcagcgagagcagcctgagaagacacggcagcatggtgagcctggtgagcggcgccagcggctacagcgccaccagcaccagcagcttcaagaagggccacagcctgagagagaagctggccgagatggagaccttcagagacatcctgtgcagacaggtggacaccctgcagaagtacttcgacgcctgcgccgacgccgtgagcaaggacgagctgcagagagacaaggtggtggaggacgacgaggacgacttccccaccaccagaagcgacggcgacttcctgcacagcaccaacggcaacaaggagaagctgttcccccacgtgacccccaagggcatcaacggcatcgacttcaagggcgaggccatcaccttcaaggccaccaccgccggcatcctggccaccctgagccactgcatcgagctgatggtgaagagagaggacagctggcagaagagactggacaaggagaccgagaagaagagaagaaccgaggaggcctacaagaacgccatgaccgagctgaagaagaagagccacttcggcggccccgactacgaggagggccccaacagcctgatcaacgaggaggagttcttcgacgccgtggaggccgccctggacagacaggacaagatcgaggagcagagccagagcgagaaggtgagactgcactggcccaccagcctgcccagcggcgacgccttcagcagcgtgggcacccacagattcgtgcagaaggtggaggagatggtgcagaaccacatgacctacagcctgcaggacgtgggcggcgacgccaactggcagctggtggtggaggagggcgagatgaaggtgtacagaagagaggtggaggagaacggcatcgtgctggaccccctgaaggccacccacgccgtgaagggcgtgaccggccacgaggtgtgcaactacttctggaacgtggacgtgagaaacgactgggagaccaccatcgagaacttccacgtggtggagaccctggccgacaacgccatcatcatctaccagacccacaagagagtgtggcccgccagccagagagacgtgctgtacctgagcgtgatcagaaagatccccgccctgaccgagaacgaccccgagacctggatcgtgtgcaacttcagcgtggaccacgacagcgcccccctgaacaacagatgcgtgagagccaagatcaacgtggccatgatctgccagaccctggtgagcccccccgagggcaaccaggagatcagcagagacaacatcctgtgcaagatcacctacgtggccaacgtgaaccccggcggctgggcccccgccagcgtgctgagagccgtggccaagagagagtaccccaagttcctgaagagattcaccagctacgtgcaggagaagaccgccggcaagcccatcctgttctag

SEQ ID NO: 1767 - DNA, 690 bp, Homo sapiens
aaggtggaggagatggtgcagaaccacatgacctacagcctgcaggacgtgggcggcgacgccaactggcagctggtggtggaggagggcgagatgaaggtgtacagaagagaggtggaggagaacggcatcgtgctggaccccctgaaggccacccacgccgtgaagggcgtgaccggccacgaggtgtgcaactacttctggaacgtggacgtgagaaacgactgggagaccaccatcgagaacttccacgtggtggagaccctggccgacaacgccatcatcatctaccagacccacaagagagtgtggcccgccagccagagagacgtgctgtacctgagcgtgatcagaaagatccccgccctgaccgagaacgaccccgagacctggatcgtgtgcaacttcagcgtggaccacgacagcgcccccctgaacaacagatgcgtgagagccaagatcaacgtggccatgatctgccagaccctggtgagcccccccgagggcaaccaggagatcagcagagacaacatcctgtgcaagatcacctacgtggccaacgtgaaccccggcggctgggcccccgccagcgtgctgagagccgtggccaagagagagtaccccaagttcctgaagagattcaccagctacgtgcaggagaagaccgccggcaagcccatcctgttctag

SEQ ID NO: 1768 - DNA, 2259 bp, Homo sapiens
atgcagcacagctgcatccccaccccccccagccccttcagcgccccccccgccttcctgcccgtggtgaccagagagagcagaagaggcctgagcagcggcggcagcgccggcagaaacgccggcgtgaccgccaccgccgccgccgccgacggctggaagggcagactgcccagccccctggtgctgctgcccagaagcgccagatgccaggccagaagaagaagaggcggcagaaccagcagcctgctgctgctgccccccacccccgagagagccctgttcgccagccccagccccgaccccagccccagaggcctgggcgccagcagcggcgccgccgagggcgccggcgccggcctgctgctgggctgcagagccagcatgagcgacaaccagagctggaacagcagcggcagcgaggaggaccccgagaccgagagcggcccccccgtggagagatgcggcgtgctgagcaagtggaccaactacatccacggctggcaggacagatgggtggtgctgaagaacaacgccctgagctactacaagagcgaggacgagaccgagtacggctgcagaggcagcatctgcctgagcaaggccgtgatcaccccccacgacttcgacgagtgcagattcgacatcagcgtgaacgacagcgtgtggtacctgagagcccaggaccccgaccacagacagcagtggatcgacgccatcgagcagcacaagaccgagagcggctacggcagcgagagcagcctgagaagacacggcagcatggtgagcctggtgagcggcgccagcggctacagcgccaccagcaccagcagcttcaagaagggccacagcctgagagagaagctggccgagatggagaccttcagagacatcctgtgcagacaggtggacaccctgcagaagtacttcgacgcctgcgccgacgccgtgagcaaggacgagctgcagagagacaaggtggtggaggacgacgaggacgacttccccaccaccagaagcgacggcgacttcctgcacagcaccaacggcaacaaggagaagctgttcccccacgtgacccccaagggcatcaacggcatcgacttcaagggcgaggccatcaccttcaaggccaccaccgccggcatcctggccaccctgagccactgcatcgagctgatggtgaagagagaggacagctggcagaagagactggacaaggagaccgagaagaagagaagaaccgaggaggcctacaagaacgccatgaccgagctgaagaagaagagccacttcggcggccccgactacgaggagggccccaacagcctgatcaacgaggaggagttcttcgacgccgtggaggccgccctggacagacaggacaagatcgaggagcagagccagagcgagaaggtgagactgcactggcccaccagcctgcccagcggcgacgccttcagcagcgtgggcacccacagattcgtgcagaagccctacagcagaagcagcagcatgagcagcatcgacctggtgagcgccagcgacgacgtgcacagattcagcagccaggtggaggagatggtgcagaaccacatgacctacagcctgcaggacgtgggcggcgacgccaactggcagctggtggtggaggagggcgagatgaaggtgtacagaagagaggtggaggagaacggcatcgtgctggaccccctgaaggccacccacgccgtgaagggcgtgaccggccacgaggtgtgcaactacttctggaacgtggacgtgagaaacgactgggagaccaccatcgagaacttccacgtggtggagaccctggccgacaacgccatcatcatctaccagacccacaagagagtgtggcccgccagccagagagacgtgctgtacctgagcgtgatcagaaagatccccgccctgaccgagaacgaccccgagacctggatcgtgtgcaacttcagcgtggaccacgacagcgcccccctgaacaacagatgcgtgagagccaagatcaacgtggccatgatctgccagaccctggtgagcccccccgagggcaaccaggagatcagcagagacaacatcctgtgcaagatcacctacgtggccaacgtgaaccccggcggctgggcccccgccagcgtgctgagagccgtggccaagagagagtaccccaagttcctgaagagattcaccagctacgtgcaggagaagaccgccggcaagcccatcctgttctag

SEQ ID NO: 1769 - DNA, 1875 bp, Homo sapiens
atgagcgacaaccagagctggaacagcagcggcagcgaggaggaccccgagaccgagagcggcccccccgtggagagatgcggcgtgctgagcaagtggaccaactacatccacggctggcaggacagatgggtggtgctgaagaacaacgccctgagctactacaagagcgaggacgagaccgagtacggctgcagaggcagcatctgcctgagcaaggccgtgatcaccccccacgacttcgacgagtgcagattcgacatcagcgtgaacgacagcgtgtggtacctgagagcccaggaccccgaccacagacagcagtggatcgacgccatcgagcagcacaagaccgagagcggctacggcagcgagagcagcctgagaagacacggcagcatggtgagcctggtgagcggcgccagcggctacagcgccaccagcaccagcagcttcaagaagggccacagcctgagagagaagctggccgagatggagaccttcagagacatcctgtgcagacaggtggacaccctgcagaagtacttcgacgcctgcgccgacgccgtgagcaaggacgagctgcagagagacaaggtggtggaggacgacgaggacgacttccccaccaccagaagcgacggcgacttcctgcacagcaccaacggcaacaaggagaagctgttcccccacgtgacccccaagggcatcaacggcatcgacttcaagggcgaggccatcaccttcaaggccaccaccgccggcatcctggccaccctgagccactgcatcgagctgatggtgaagagagaggacagctggcagaagagactggacaaggagaccgagaagaagagaagaaccgaggaggcctacaagaacgccatgaccgagctgaagaagaagagccacttcggcggccccgactacgaggagggccccaacagcctgatcaacgaggaggagttcttcgacgccgtggaggccgccctggacagacaggacaagatcgaggagcagagccagagcgagaaggtgagactgcactggcccaccagcctgcccagcggcgacgccttcagcagcgtgggcacccacagattcgtgcagaagccctacagcagaagcagcagcatgagcagcatcgacctggtgagcgccagcgacgacgtgcacagattcagcagccaggtggaggagatggtgcagaaccacatgacctacagcctgcaggacgtgggcggcgacgccaactggcagctggtggtggaggagggcgagatgaaggtgtacagaagagaggtggaggagaacggcatcgtgctggaccccctgaaggccacccacgccgtgaagggcgtgaccggccacgaggtgtgcaactacttctggaacgtggacgtgagaaacgactgggagaccaccatcgagaacttccacgtggtggagaccctggccgacaacgccatcatcatctaccagacccacaagagagtgtggcccgccagccagagagacgtgctgtacctgagcgtgatcagaaagatccccgccctgaccgagaacgaccccgagacctggatcgtgtgcaacttcagcgtggaccacgacagcgcccccctgaacaacagatgcgtgagagccaagatcaacgtggccatgatctgccagaccctggtgagcccccccgagggcaaccaggagatcagcagagacaacatcctgtgcaagatcacctacgtggccaacgtgaaccccggcggctgggcccccgccagcgtgctgagagccgtggccaagagagagtaccccaagttcctgaagagattcaccagctacgtgcaggagaagaccgccggcaagcccatcctgttctag

SEQ ID NO: 1770 - DNA, 381 bp, Homo sapiens
tgacccgccagccagagagacgtgctgtacctgagcgtgatcagaaagatccccgccctgaccgagaacgaccccgagacctggatcgtgtgcaacttcagcgtggaccacgacagcgcccccctgaacaacagatgcgtgagagccaagatcaacgtggccatgatctgccagaccctggtgagcccccccgagggcaaccaggagatcagcagagacaacatcctgtgcaagatcacctacgtggccaacgtgaaccccggcggctgggcccccgccagcgtgctgagagccgtggccaagagagagtaccccaagttcctgaagagattcaccagctacgtgcaggagaagaccgccggcaagcccatcctgttctag

SEQ ID NO: 1771 - DNA, 5064 bp, Homo sapiens
atgtggagcctgcacatcgtgctgatgagatgcagcttcagactgaccaagagcctggccaccggcccctggagcctgatcctgatcctgttcagcgtgcagtacgtgtacggcagcggcaagaagtacatcggcccctgcggcggcagagactgcagcgtgtgccactgcgtgcccgagaagggcagcagaggcccccccggcccccccggcccccagggccccatcggccccctgggcgcccccggccccatcggcctgagcggcgagaagggcatgagaggcgacagaggcccccccggcgccgccggcgacaagggcgacaagggccccaccggcgtgcccggcttccccggcctggacggcatccccggccaccccggcccccccggccccagaggcaagcccggcatgagcggccacaacggcagcagaggcgaccccggcttccccggcggcagaggcgccctgggccccggcggccccctgggccaccccggcgagaagggcgagaagggcaacagcgtgttcatcctgggcgccgtgaagggcatccagggcgacagaggcgaccccggcctgcccggcctgcccggcagctggggcgccggcggccccgccggccccaccggctaccccggcgagcccggcctggtgggcccccccggccagcccggcagacccggcctgaagggcaaccccggcgtgggcgtgaagggccagatgggcgaccccggcgaggtgggccagcagggcagccccggccccaccctgctggtggagccccccgacttctgcctgtacaagggcgagaagggcatcaagggcatccccggcatggtgggcctgcccggcccccccggcagaaagggcgagagcggcatcggcgccaagggcgagaagggcatccccggcttccccggccccagaggcgaccccggcagctacggcagccccggcttccccggcctgaagggcgagctgggcctggtgggcgaccccggcctgttcggcctgatcggccccaagggcgaccccggcaacagaggccaccccggcccccccggcgtgctggtgaccccccccctgcccctgaagggcccccccggcgaccccggcttccccggcagatacggcgagaccggcgacgtgggcccccccggcccccccggcctgctgggcagacccggcgaggcctgcgccggcatgatcggcccccccggcccccagggcttccccggcctgcccggcctgcccggcgaggccggcatccccggcagacccgacagcgcccccggcaagcccggcaagcccggcagccccggcctgcccggcgcccccggcctgcagggcctgcccggcagcagcgtgatctactgcagcgtgggcaaccccggcccccagggcatcaagggcaaggtgggcccccccggcggcagaggccccaagggcgagaagggcaacgagggcctgtgcgcctgcgagcccggccccatgggcccccccggcccccccggcctgcccggcagacagggcagcaagggcgacctgggcctgcccggctggctgggcaccaagggcgaccccggcccccccggcgccgagggcccccccggcctgcccggcaagcacggcgccagcggcccccccggcaacaagggcgccaagggcgacatggtggtgagcagagtgaagggccacaagggcgagagaggccccgacggcccccccggcttccccggccagcccggcagccacggcagagacggccacgccggcgagaagggcgaccccggcccccccggcgaccacgaggacgccacccccggcggcaagggcttccccggccccctgggcccccccggcaaggccggccccgtgggcccccccggcctgggcttccccggcccccccggcgagagaggccaccccggcgtgcccggccaccccggcgtgagaggccccgacggcctgaagggccagaagggcgacaccatcagctgcaacgtgacctaccccggcagacacggcccccccggcttcgacggcccccccggccccaagggcttccccggcccccagggcgcccccggcctgagcggcagcgacggccacaagggcagacccggcacccccggcaccgccgagatccccggcccccccggcttcagaggcgacatgggcgaccccggcttcggcggcgagaagggcagcagccccgtgggcccccccggcccccccggcagccccggcgtgaacggccagaagggcatccccggcgaccccgccttcggccacctgggcccccccggcaagagaggcctgagcggcgtgcccggcatcaagggccccagaggcgaccccggctgccccggcgccgagggccccgccggcatccccggcttcctgggcctgaagggccccaagggcagagagggccacgccggcttccccggcgtgcccggcccccccggccacagctgcgagagaggcgcccccggcatccccggccagcccggcctgcccggctaccccggcagccccggcgcccccggcggcaagggccagcccggcgacgtgggcccccccggccccgccggcatgaagggcctgcccggcctgcccggcagacccggcgcccacggcccccccggcctgcccggcatccccggccccttcggcgacgacggcctgcccggcccccccggccccaagggccccagaggcctgcccggcttccccggcttccccggcgagagaggcaagcccggcgccgagggctgccccggcgccaagggcgagcccggcgagaagggcatgagcggcctgcccggcgacagaggcctgagaggcgccaagggcgccatcggcccccccggcgacgagggcgagatggccatcatcagccagaagggcacccccggcgagcccggcccccccggcgacgacggcttccccggcgagagaggcgacaagggcacccccggcatgcagggcagaagaggcgagcccggcagatacggcccccccggcttccacagaggcgagcccggcgagaagggccagcccggcccccccggcccccccggcccccccggcagcaccggcctgagaggcttcatcggcttccccggcctgcccggcgaccagggcgagcccggcagccccggcccccccggcttcagcggcatcgacggcgccagaggccccaagggcaacaagggcgaccccgccagccacttcggcccccccggccccaagggcgagcccggcagccccggctgccccggccacttcggcgccagcggcgagcagggcctgcccggcatccagggccccagaggcagccccggcagacccggcccccccggcagcagcggcccccccggctgccccggcgaccacggcatgcccggcctgagaggccagcccggcgagatgggcgaccccggccccagaggcctgcagggcgaccccggcatccccggcccccccggcatcaagggccccagcggcagccccggcctgaacggcctgcacggcctgaagggccagaagggcaccaagggcgccagcggcctgcacgacgtgggcccccccggccccgtgggcatccccggcctgaagggcgagagaggcgaccccggcagccccggcatcagcccccccggccccagaggcaagaagggcccccccggcccccccggcagcagcggcccccccggccccgccggcgccaccggcagagcccccaaggacatccccgaccccggcccccccggcgaccagggcccccccggccccgacggccccagaggcgcccccggcccccccggcctgcccggcagcgtggacctgctgagaggcgagcccggcgactgcggcctgcccggcccccccggcccccccggcccccccggcccccccggctacaagggcttccccggctgcgacggcaaggacggccagaagggccccgtgggcttccccggcccccagggcccccacggcttccccggcccccccggcgagaagggcctgcccggcccccccggcagaaagggccccaccggcctgcccggcgagcccggcccccccgccgacgtggacgactgccccagaatccccggcctgcccggcgcccccggcatgagaggccccgagggcgccatgggcctgcccggcatgagaggccccagcggccccggctgcaagggcgagcccggcctggacggcagaagaggcgtggacggcgtgcccggcagccccggcccccccggcagaaagggcgacaccggcgaggacggctaccccggcggccccggcccccccggccccatcggcgaccccggccccaagggcttcggccccggctacctgggcggcttcctgctggtgctgcacagccagaccgaccaggagcccacctgccccctgggcatgcccagactgtggaccggctacagcctgctgtacctggagggccaggagaaggcccacaaccaggacctgggcctggccggcagctgcctgcccgtgttcagcaccctgcccttcgcctactgcaacatccaccaggtgtgccactacgcccagagaaacgacagaagctactggctggccagcgccgcccccctgcccatgatgcccctgagcgaggaggccatcagaccctacgtgagcagatgcgccgtgtgcgaggcccccgcccaggccgtggccgtgcacagccaggaccagagcatccccccctgcccccagacctggagaagcctgtggatcggctacagcttcctgatgcacaccggcgccggcgaccagggcggcggccaggccctgatgagccccggcagctgcctggaggacttcagagccgcccccttcctggagtgccagggcagacagggcacctgccacttcttcgccaacaagtacagcttctggctgaccaccgtgaaggccgacctgcagttcagcagcgcccccgcccccgacaccctgaaggagagccaggcccagagacagaagatcagcagatgccaggtgtgcgtgaagtacagctag

SEQ ID NO: 1772 - DNA, 5073 bp, Homo sapiens
atgtggagcctgcacatcgtgctgatgagatgcagcttcagactgaccaagagcctggccaccggcccctggagcctgatcctgatcctgttcagcgtgcagtacgtgtacggcagcggcaagaagtacatcggcccctgcggcggcagagactgcagcgtgtgccactgcgtgcccgagaagggcagcagaggcccccccggcccccccggcccccagggccccatcggccccctgggcgcccccggccccatcggcctgagcggcgagaagggcatgagaggcgacagaggcccccccggcgccgccggcgacaagggcgacaagggccccaccggcgtgcccggcttccccggcctggacggcatccccggccaccccggcccccccggccccagaggcaagcccggcatgagcggccacaacggcagcagaggcgaccccggcttccccggcggcagaggcgccctgggccccggcggccccctgggccaccccggcgagaagggcgagaagggcaacagcgtgttcatcctgggcgccgtgaagggcatccagggcgacagaggcgaccccggcctgcccggcctgcccggcagctggggcgccggcggccccgccggccccaccggctaccccggcgagcccggcctggtgggcccccccggccagcccggcagacccggcctgaagggcaaccccggcgtgggcgtgaagggccagatgggcgaccccggcgaggtgggccagcagggcagccccggccccaccctgctggtggagccccccgacttctgcctgtacaagggcgagaagggcatcaagggcatccccggcatggtgggcctgcccggcccccccggcagaaagggcgagagcggcatcggcgccaagggcgagaagggcatccccggcttccccggccccagaggcgaccccggcagctacggcagccccggcttccccggcctgaagggcgagctgggcctggtgggcgaccccggcctgttcggcctgatcggccccaagggcgaccccggcaacagaggccaccccggcccccccggcgtgctggtgaccccccccctgcccctgaagggcccccccggcgaccccggcttccccggcagatacggcgagaccggcgacgtgggcccccccggcccccccggcctgctgggcagacccggcgaggcctgcgccggcatgatcggcccccccggcccccagggcttccccggcctgcccggcctgcccggcgaggccggcatccccggcagacccgacagcgcccccggcaagcccggcaagcccggcagccccggcctgcccggcgcccccggcctgcagggcctgcccggcagcagcgtgatctactgcagcgtgggcaaccccggcccccagggcatcaagggcaaggtgggcccccccggcggcagaggccccaagggcgagaagggcaacgagggcctgtgcgcctgcgagcccggccccatgggcccccccggcccccccggcctgcccggcagacagggcagcaagggcgacctgggcctgcccggctggctgggcaccaagggcgaccccggcccccccggcgccgagggcccccccggcctgcccggcaagcacggcgccagcggcccccccggcaacaagggcgccaagggcgacatggtggtgagcagagtgaagggccacaagggcgagagaggccccgacggcccccccggcttccccggccagcccggcagccacggcagagacggccacgccggcgagaagggcgaccccggcccccccggcgaccacgaggacgccacccccggcggcaagggcttccccggccccctgggcccccccggcaaggccggccccgtgggcccccccggcctgggcttccccggcccccccggcgagagaggccaccccggcgtgcccggccaccccggcgtgagaggccccgacggcctgaagggccagaagggcgacaccatcagctgcaacgtgacctaccccggcagacacggcccccccggcttcgacggcccccccggccccaagggcttccccggcccccagggcgcccccggcctgagcggcagcgacggccacaagggcagacccggcacccccggcaccgccgagatccccggcccccccggcttcagaggcgacatgggcgaccccggcttcggcggcgagaagggcagcagccccgtgggcccccccggcccccccggcagccccggcgtgaacggccagaagggcatccccggcgaccccgccttcggccacctgggcccccccggcaagagaggcctgagcggcgtgcccggcatcaagggccccagaggcgaccccggctgccccggcgccgagggccccgccggcatccccggcttcctgggcctgaagggccccaagggcagagagggccacgccggcttccccggcgtgcccggcccccccggccacagctgcgagagaggcgcccccggcatccccggccagcccggcctgcccggctaccccggcagccccggcgcccccggcggcaagggccagcccggcgacgtgggcccccccggccccgccggcatgaagggcctgcccggcctgcccggcagacccggcgcccacggcccccccggcctgcccggcatccccggccccttcggcgacgacggcctgcccggcccccccggccccaagggccccagaggcctgcccggcttccccggcttccccggcgagagaggcaagcccggcgccgagggctgccccggcgccaagggcgagcccggcgagaagggcatgagcggcctgcccggcgacagaggcctgagaggcgccaagggcgccatcggcccccccggcgacgagggcgagatggccatcatcagccagaagggcacccccggcgagcccggcccccccggcgacgacggcttccccggcgagagaggcgacaagggcacccccggcatgcagggcagaagaggcgagcccggcagatacggcccccccggcttccacagaggcgagcccggcgagaagggccagcccggcccccccggcccccccggcccccccggcagcaccggcctgagaggcttcatcggcttccccggcctgcccggcgaccagggcgagcccggcagccccggcccccccggcttcagcggcatcgacggcgccagaggccccaagggcaacaagggcgaccccgccagccacttcggcccccccggccccaagggcgagcccggcagccccggctgccccggccacttcggcgccagcggcgagcagggcctgcccggcatccagggccccagaggcagccccggcagacccggcccccccggcagcagcggcccccccggctgccccggcgaccacggcatgcccggcctgagaggccagcccggcgagatgggcgaccccggccccagaggcctgcagggcgaccccggcatccccggcccccccggcatcaagggccccagcggcagccccggcctgaacggcctgcacggcctgaagggccagaagggcaccaagggcgccagcggcctgcacgacgtgggcccccccggccccgtgggcatccccggcctgaagggcgagagaggcgaccccggcagccccggcatcagcccccccggccccagaggcaagaagggcccccccggcccccccggcagcagcggcccccccggccccgccggcgccaccggcagagcccccaaggacatccccgaccccggcccccccggcgaccagggcccccccggccccgacggccccagaggcgcccccggcccccccggcctgcccggcagcgtggacctgctgagaggcgagcccggcgactgcggcctgcccggcccccccggcccccccggcccccccggcccccccggctacaagggcttccccggctgcgacggcaaggacggccagaagggccccgtgggcttccccggcccccagggcccccacggcttccccggcccccccggcgagaagggcctgcccggcccccccggcagaaagggccccaccggcctgcccggccccagaggcgagcccggcccccccgccgacgtggacgactgccccagaatccccggcctgcccggcgcccccggcatgagaggccccgagggcgccatgggcctgcccggcatgagaggccccagcggccccggctgcaagggcgagcccggcctggacggcagaagaggcgtggacggcgtgcccggcagccccggcccccccggcagaaagggcgacaccggcgaggacggctaccccggcggccccggcccccccggccccatcggcgaccccggccccaagggcttcggccccggctacctgggcggcttcctgctggtgctgcacagccagaccgaccaggagcccacctgccccctgggcatgcccagactgtggaccggctacagcctgctgtacctggagggccaggagaaggcccacaaccaggacctgggcctggccggcagctgcctgcccgtgttcagcaccctgcccttcgcctactgcaacatccaccaggtgtgccactacgcccagagaaacgacagaagctactggctggccagcgccgcccccctgcccatgatgcccctgagcgaggaggccatcagaccctacgtgagcagatgcgccgtgtgcgaggcccccgcccaggccgtggccgtgcacagccaggaccagagcatccccccctgcccccagacctggagaagcctgtggatcggctacagcttcctgatgcacaccggcgccggcgaccagggcggcggccaggccctgatgagccccggcagctgcctggaggacttcagagccgcccccttcctggagtgccagggcagacagggcacctgccacttcttcgccaacaagtacagcttctggctgaccaccgtgaaggccgacctgcagttcagcagcgcccccgcccccgacaccctgaaggagagccaggcccagagacagaagatcagcagatgccaggtgtgcgtgaagtacagctag

SEQ ID NO: 1773 - DNA, 5076 bp, Homo sapiens
atgaagctgagaggcgtgagcctggccgccggcctgttcctgctggccctgagcctgtggggccagcccgccgaggccgccgcctgctacggctgcagccccggcagcaagtgcgactgcagcggcatcaagggcgagaagggcgagagaggcttccccggcctggagggccaccccggcctgcccggcttccccggccccgagggcccccccggccccagaggccagaagggcgacgacggcatccccggcccccccggccccaagggcatcagaggcccccccggcctgcccggcttccccggcacccccggcctgcccggcatgcccggccacgacggcgcccccggcccccagggcatccccggctgcaacggcaccaagggcgagagaggcttccccggcagccccggcttccccggcctgcagggcccccccggcccccccggcatccccggcatgaagggcgagcccggcagcatcatcatgagcagcctgcccggccccaagggcaaccccggctaccccggcccccccggcatccagggcctgcccggccccaccggcatccccggccccatcggcccccccggcccccccggcctgatgggcccccccggcccccccggcctgcccggccccaagggcaacatgggcctgaacttccagggccccaagggcgagaagggcgagcagggcctgcagggcccccccggcccccccggccagatcagcgagcagaagagacccatcgacgtggagttccagaagggcgaccagggcctgcccggcgacagaggcccccccggcccccccggcatcagaggcccccccggcccccccggcggcgagaagggcgagaagggcgagcagggcgagcccggcaagagaggcaagcccggcaaggacggcgagaacggccagcccggcatccccggcctgcccggcgaccccggctaccccggcgagcccggcagagacggcgagaagggccagaagggcgacaccggcccccccggcccccccggcctggtgatccccagacccggcaccggcatcaccatcggcgagaagggcaacatcggcctgcccggcctgcccggcgagaagggcgagagaggcttccccggcatccagggcccccccggcctgcccggcccccccggcgccgccgtgatgggcccccccggcccccccggcttccccggcgagagaggccagaagggcgacgagggcccccccggcatcagcatccccggcccccccggcctggacggccagcccggcgcccccggcctgcccggcccccccggccccgccggcccccacatcccccccagcgacgagatctgcgagcccggcccccccggcccccccggcagccccggcgacaagggcctgcagggcgagcagggcgtgaagggcgacaagggcgacacctgcttcaactgcatcggcaccggcatcagcggcccccccggccagcccggcctgcccggcctgcccggcccccccggcagcctgggcttccccggccagaagggcgagaagggccaggccggcgccaccggccccaagggcctgcccggcatccccggcgcccccggcgcccccggcttccccggcagcaagggcgagcccggcgacatcctgaccttccccggcatgaagggcgacaagggcgagctgggcagccccggcgcccccggcctgcccggcctgcccggcacccccggccaggacggcctgcccggcctgcccggccccaagggcgagcccggcggcatcaccttcaagggcgagagaggcccccccggcaaccccggcctgcccggcctgcccggcaacatcggccccatgggcccccccggcttcggcccccccggccccgtgggcgagaagggcatccagggcgtggccggcaaccccggccagcccggcatccccggccccaagggcgaccccggccagaccatcacccagcccggcaagcccggcctgcccggcaaccccggcagagacggcgacgtgggcctgcccggcgaccccggcctgcccggccagcccggcctgcccggcatccccggcagcaagggcgagcccggcatccccggcatcggcctgcccggcccccccggccccaagggcttccccggcatccccggcccccccggcgcccccggcacccccggcagaatcggcctggagggcccccccggcccccccggcttccccggccccaagggcgagcccggcttcgccctgcccggcccccccggcccccccggcctgcccggcttcaagggcgccctgggccccaagggcgacagaggcttccccggcccccccggcccccccggcagaaccggcctggacggcctgcccggccccaagggcgacgtgggccccaacggccagcccggccccatgggcccccccggcctgcccggcatcggcgtgcagggcccccccggcccccccggcatccccggccccatcggccagcccggcctgcacggcatccccggcgagaagggcgaccccggcccccccggcctggacgtgcccggcccccccggcgagagaggcagccccggcatccccggcgcccccggccccatcggcccccccggcagccccggcctgcccggcaaggccggcgccagcggcttccccggcaccaagggcgagatgggcatgatgggcccccccggcccccccggccccctgggcatccccggcagaagcggcgtgcccggcctgaagggcgacgacggcctgcagggccagcccggcctgcccggccccaccggcgagaagggcagcaagggcgagcccggcctgcccggcccccccggccccatggaccccaacctgctgggcagcaagggcgagaagggcgagcccggcctgcccggcatccccggcgtgagcggccccaagggctaccagggcctgcccggcgaccccggccagcccggcctgagcggccagcccggcctgcccggcccccccggccccaagggcaaccccggcctgcccggccagcccggcctgatcggcccccccggcctgaagggcaccatcggcgacatgggcttccccggcccccagggcgtggagggcccccccggccccagcggcgtgcccggccagcccggcagccccggcctgcccggccagaagggcgacaagggcgaccccggcatcagcagcatcggcctgcccggcctgcccggccccaagggcgagcccggcctgcccggctaccccggcaaccccggcatcaagggcagcgtgggcgaccccggcctgcccggcctgcccggcacccccggcgccaagggccagcccggcctgcccggcttccccggcacccccggcccccccggccccaagggcatcagcggcccccccggcaaccccggcctgcccggcgagcccggccccgtgggcggcggcggccaccccggccagcccggcccccccggcgagaagggcaagcccggccaggacggcatccccggccccgccggccagaagggcgagcccggccagcccggcttcggcaaccccggcccccccggcctgcccggcctgagcggccagaagggcgacggcggcctgcccggcatccccggcaaccccggcctgcccggccccaagggcgagcccggcttccacggcttccccggcgtgcagggcccccccggcccccccggcagccccggccccgccctggagggccccaagggcaaccccggcccccagggcccccccggcagacccggccccaccggcttccagggcctgcccggccccgagggcccccccggcctgcccggcaacggcggcatcaagggcgagaagggcaaccccggccagcccggcctgcccggcctgcccggcctgaagggcgaccagggcccccccggcctgcagggcaaccccggcagacccggcctgaacggcatgaagggcgaccccggcctgcccggcgtgcccggcttccccggcatgaagggccccagcggcgtgcccggcagcgccggccccgagggcgagcccggcctgatcggcccccccggcccccccggcctgcccggccccagcggccagagcatcatcatcaagggcgacgccggcccccccggcatccccggccagcccggcctgaagggcctgcccggcccccagggcccccagggcctgcccggccccaccggcccccccggcgaccccggcagaaacggcctgcccggcttcgacggcgccggcggcagaaagggcgaccccggcctgcccggccagcccggcaccagaggcctggacggcccccccggccccgacggcctgcagggcccccccggcccccccggcaccagcagcgtggcccacggcttcctgatcaccagacacagccagaccaccgacgccccccagtgcccccagggcaccctgcaggtgtacgagggcttcagcctgctgtacgtgcagggcaacaagagagcccacggccaggacctgggcaccgccggcagctgcctgagaagattcagcaccatgcccttcatgttctgcaacatcaacaacgtgtgcaacttcgccagcagaaacgactacagctactggctgagcacccccgagcccatgcccatgagcatgcagcccctgaagggccagagcatccagcccttcatcagcagatgcgccgtgtgcgaggcccccgccgtggtgatcgccgtgcacagccagaccatccagatcccccactgcccccagggctgggacagcctgtggatcggctacagcttcatgatgcacaccagcgccggcgccgagggcagcggccaggccctggccagccccggcagctgcctggaggagttcagaagcgcccccttcatcgagtgccacggcagaggcacctgcaactactacgccaacagctacagcttctggctggccaccgtggacgtgagcgacatgttcagcaagccccagagcgagaccctgaaggccggcgacctgagaaccagaatcagcagatgccaggtgtgcatgaagagaacctag

SEQ ID NO: 1774 - DNA, 5058 bp, Homo sapiens
atgaagctgagaggcgtgagcctggccgccggcctgttcctgctggccctgagcctgtggggccagcccgccgaggccgccgcctgctacggctgcagccccggcagcaagtgcgactgcagcggcatcaagggcgagaagggcgagagaggcttccccggcctggagggccaccccggcctgcccggcttccccggccccgagggcccccccggccccagaggccagaagggcgacgacggcatccccggcccccccggccccaagggcatcagaggcccccccggcctgcccggcttccccggcacccccggcctgcccggcatgcccggccacgacggcgcccccggcccccagggcatccccggctgcaacggcaccaagggcgagagaggcttccccggcagccccggcttccccggcctgcagggcccccccggcccccccggcatccccggcatgaagggcgagcccggcagcatcatcatgagcagcctgcccggccccaagggcaaccccggctaccccggcccccccggcatccagggcctgcccggccccaccggcatccccggccccatcggcccccccggcccccccggcctgatgggcccccccggcccccccggcctgcccggccccaagggcaacatgggcctgaacttccagggccccaagggcgagaagggcgagcagggcctgcagggcccccccggcccccccggccagatcagcgagcagaagagacccatcgacgtggagttccagaagggcgaccagggcctgcccggcgacagaggcccccccggcccccccggcatcagaggcccccccggcccccccggcggcgagaagggcgagaagggcgagcagggcgagcccggcaagagaggcaagcccggcaaggacggcgagaacggccagcccggcatccccggcctgcccggcgaccccggctaccccggcgagcccggcagagacggcgagaagggccagaagggcgacaccggcccccccggcccccccggcctggtgatccccagacccggcaccggcatcaccatcggcgagaagggcaacatcggcctgcccggcctgcccggcgagaagggcgagagaggcttccccggcatccagggcccccccggcctgcccggcccccccggcgccgccgtgatgggcccccccggcccccccggcttccccggcgagagaggccagaagggcgacgagggcccccccggcatcagcatccccggcccccccggcctggacggccagcccggcgcccccggcctgcccggcccccccggccccgccggcccccacatcccccccagcgacgagatctgcgagcccggcccccccggcccccccggcagccccggcgacaagggcctgcagggcgagcagggcgtgaagggcgacaagggcgacacctgcttcaactgcatcggcaccggcatcagcggcccccccggccagcccggcctgcccggcctgcccggcccccccggcagcctgggcttccccggccagaagggcgagaagggccaggccggcgccaccggccccaagggcctgcccggcatccccggcgcccccggcgcccccggcttccccggcagcaagggcgagcccggcgacatcctgaccttccccggcatgaagggcgacaagggcgagctgggcagccccggcgcccccggcctgcccggcctgcccggcacccccggccaggacggcctgcccggcctgcccggccccaagggcgagcccggcggcatcaccttcaagggcgagagaggcccccccggcaaccccggcctgcccggcctgcccggcaacatcggccccatgggcccccccggcttcggcccccccggccccgtgggcgagaagggcatccagggcgtggccggcaaccccggccagcccggcatccccggccccaagggcgaccccggccagaccatcacccagcccggcaagcccggcctgcccggcaaccccggcagagacggcgacgtgggcctgcccggcgaccccggcctgcccggccagcccggcctgcccggcatccccggcagcaagggcgagcccggcatccccggcatcggcctgcccggcccccccggccccaagggcttccccggcatccccggcccccccggcgcccccggcacccccggcagaatcggcctggagggcccccccggcccccccggcttccccggccccaagggcgagcccggcttcgccctgcccggcccccccggcccccccggcctgcccggcttcaagggcgccctgggccccaagggcgacagaggcttccccggcccccccggcccccccggcagaaccggcctggacggcctgcccggccccaagggcgacgtgggccccaacggccagcccggccccatgggcccccccggcctgcccggcatcggcgtgcagggcccccccggcccccccggcatccccggccccatcggccagcccggcctgcacggcatccccggcgagaagggcgaccccggcccccccggcctggacgtgcccggcccccccggcgagagaggcagccccggcatccccggcgcccccggccccatcggcccccccggcagccccggcctgcccggcaaggccggcgccagcggcttccccggcaccaagggcgagatgggcatgatgggcccccccggcccccccggccccctgggcatccccggcagaagcggcgtgcccggcctgaagggcgacgacggcctgcagggccagcccggcctgcccggccccaccggcgagaagggcagcaagggcgagcccggcctgcccggcccccccggccccatggaccccaacctgctgggcagcaagggcgagaagggcgagcccggcctgcccggcatccccggcgtgagcggccccaagggctaccagggcctgcccggcgaccccggccagcccggcctgagcggccagcccggcctgcccggcccccccggccccaagggcaaccccggcctgcccggccagcccggcctgatcggcccccccggcctgaagggcaccatcggcgacatgggcttccccggcccccagggcgtggagggcccccccggccccagcggcgtgcccggccagcccggcagccccggcctgcccggccagaagggcgacaagggcgaccccggcatcagcagcatcggcctgcccggcctgcccggccccaagggcgagcccggcctgcccggctaccccggcaaccccggcatcaagggcagcgtgggcgaccccggcctgcccggcctgcccggcacccccggcgccaagggccagcccggcctgcccggcttccccggcacccccggcccccccggccccaagggcatcagcggcccccccggcaaccccggcctgcccggcgagcccggccccgtgggcggcggcggccaccccggccagcccggcccccccggcgagaagggcaagcccggccaggacggcatccccggccccgccggccagaagggcgagcccggccagcccggcttcggcaaccccggcccccccggcctgcccggcctgagcggccagaagggcgacggcggcctgcccggcatccccggcaaccccggcctgcccggccccaagggcgagcccggcttccacggcttccccggcgtgcagggcccccccggcccccccggcagccccggccccgccctggagggccccaagggcaaccccggcccccagggcccccccggcagacccggcctgcccggccccgagggcccccccggcctgcccggcaacggcggcatcaagggcgagaagggcaaccccggccagcccggcctgcccggcctgcccggcctgaagggcgaccagggcccccccggcctgcagggcaaccccggcagacccggcctgaacggcatgaagggcgaccccggcctgcccggcgtgcccggcttccccggcatgaagggccccagcggcgtgcccggcagcgccggccccgagggcgagcccggcctgatcggcccccccggcccccccggcctgcccggccccagcggccagagcatcatcatcaagggcgacgccggcccccccggcatccccggccagcccggcctgaagggcctgcccggcccccagggcccccagggcctgcccggccccaccggcccccccggcgaccccggcagaaacggcctgcccggcttcgacggcgccggcggcagaaagggcgaccccggcctgcccggccagcccggcaccagaggcctggacggcccccccggccccgacggcctgcagggcccccccggcccccccggcaccagcagcgtggcccacggcttcctgatcaccagacacagccagaccaccgacgccccccagtgcccccagggcaccctgcaggtgtacgagggcttcagcctgctgtacgtgcagggcaacaagagagcccacggccaggacctgggcaccgccggcagctgcctgagaagattcagcaccatgcccttcatgttctgcaacatcaacaacgtgtgcaacttcgccagcagaaacgactacagctactggctgagcacccccgagcccatgcccatgagcatgcagcccctgaagggccagagcatccagcccttcatcagcagatgcgccgtgtgcgaggcccccgccgtggtgatcgccgtgcacagccagaccatccagatcccccactgcccccagggctgggacagcctgtggatcggctacagcttcatgatgcacaccagcgccggcgccgagggcagcggccaggccctggccagccccggcagctgcctggaggagttcagaagcgcccccttcatcgagtgccacggcagaggcacctgcaactactacgccaacagctacagcttctggctggccaccgtggacgtgagcgacatgttcagcaagccccagagcgagaccctgaaggccggcgacctgagaaccagaatcagcagatgccaggtgtgcatgaagagaacctag

SEQ ID NO: 1775 - DNA, 5076 bp, Homo sapiens
atgaagctgagaggcgtgagcctggccgccggcctgttcctgctggccctgagcctgtggggccagcccgccgaggccgccgcctgctacggctgcagccccggcagcaagtgcgactgcagcggcatcaagggcgagaagggcgagagaggcttccccggcctggagggccaccccggcctgcccggcttccccggccccgagggcccccccggccccagaggccagaagggcgacgacggcatccccggcccccccggccccaagggcatcagaggcccccccggcctgcccggcttccccggcacccccggcctgcccggcatgcccggccacgacggcgcccccggcccccagggcatccccggctgcaacggcaccaagggcgagagaggcttccccggcagccccggcttccccggcctgcagggcccccccggcccccccggcatccccggcatgaagggcgagcccggcagcatcatcatgagcagcctgcccggccccaagggcaaccccggctaccccggcccccccggcatccagggcctgcccggccccaccggcatccccggccccatcggcccccccggcccccccggcctgatgggcccccccggcccccccggcctgcccggccccaagggcaacatgggcctgaacttccagggccccaagggcgagaagggcgagcagggcctgcagggcccccccggcccccccggccagatcagcgagcagaagagacccatcgacgtggagttccagaagggcgaccagggcctgcccggcgacagaggcccccccggcccccccggcatcagaggcccccccggcccccccggcggcgagaagggcgagaagggcgagcagggcgagcccggcaagagaggcaagcccggcaaggacggcgagaacggccagcccggcatccccggcctgcccggcgaccccggctaccccggcgagcccggcagagacggcgagaagggccagaagggcgacaccggcccccccggcccccccggcctggtgatccccagacccggcaccggcatcaccatcggcgagaagggcaacatcggcctgcccggcctgcccggcgagaagggcgagagaggcttccccggcatccagggcccccccggcctgcccggcccccccggcgccgccgtgatgggcccccccggcccccccggcttccccggcgagagaggccagaagggcgacgagggcccccccggcatcagcatccccggcccccccggcctggacggccagcccggcgcccccggcctgcccggcccccccggccccgccggcccccacatcccccccagcgacgagatctgcgagcccggcccccccggcccccccggcagccccggcgacaagggcctgcagggcgagcagggcgtgaagggcgacaagggcgacacctgcttcaactgcatcggcaccggcatcagcggcccccccggccagcccggcctgcccggcctgcccggcccccccggcagcctgggcttccccggccagaagggcgagaagggccaggccggcgccaccggccccaagggcctgcccggcatccccggcgcccccggcgcccccggcttccccggcagcaagggcgagcccggcgacatcctgaccttccccggcatgaagggcgacaagggcgagctgggcagccccggcgcccccggcctgcccggcctgcccggcacccccggccaggacggcctgcccggcctgcccggccccaagggcgagcccggcggcatcaccttcaagggcgagagaggcccccccggcaaccccggcctgcccggcctgcccggcaacatcggccccatgggcccccccggcttcggcccccccggccccgtgggcgagaagggcatccagggcgtggccggcaaccccggccagcccggcatccccggccccaagggcgaccccggccagaccatcacccagcccggcaagcccggcctgcccggcaaccccggcagagacggcgacgtgggcctgcccggcgaccccggcctgcccggccagcccggcctgcccggcatccccggcagcaagggcgagcccggcatccccggcatcggcctgcccggcccccccggccccaagggcttccccggcatccccggcccccccggcgcccccggcacccccggcagaatcggcctggagggcccccccggcccccccggcttccccggccccaagggcgagcccggcttcgccctgcccggcccccccggcccccccggcctgcccggcttcaagggcgccctgggccccaagggcgacagaggcttccccggcccccccggcccccccggcagaaccggcctggacggcctgcccggccccaagggcgacgtgggccccaacggccagcccggccccatgggcccccccggcctgcccggcatcggcgtgcagggcccccccggcccccccggcatccccggccccatcggccagcccggcctgcacggcatccccggcgagaagggcgaccccggcccccccggcctggacgtgcccggcccccccggcgagagaggcagccccggcatccccggcgcccccggccccatcggcccccccggcagccccggcctgcccggcaaggccggcgccagcggcttccccggcaccaagggcgagatgggcatgatgggcccccccggcccccccggccccctgggcatccccggcagaagcggcgtgcccggcctgaagggcgacgacggcctgcagggccagcccggcctgcccggccccaccggcgagaagggcagcaagggcgagcccggcctgcccggcccccccggccccatggaccccaacctgctgggcagcaagggcgagaagggcgagcccggcctgcccggcatccccggcgtgagcggccccaagggctaccagggcctgcccggcgaccccggccagcccggcctgagcggccagcccggcctgcccggcccccccggccccaagggcaaccccggcctgcccggccagcccggcctgatcggcccccccggcctgaagggcaccatcggcgacatgggcttccccggcccccagggcgtggagggcccccccggccccagcggcgtgcccggccagcccggcagccccggcctgcccggccagaagggcgacaagggcgaccccggcatcagcagcatcggcctgcccggcctgcccggccccaagggcgagcccggcctgcccggctaccccggcaaccccggcatcaagggcagcgtgggcgaccccggcctgcccggcctgcccggcacccccggcgccaagggccagcccggcctgcccggcttccccggcacccccggcccccccggccccaagggcatcagcggcccccccggcaaccccggcctgcccggcgagcccggccccgtgggcggcggcggccaccccggccagcccggcccccccggcgagaagggcaagcccggccaggacggcatccccggccccgccggccagaagggcgagcccggccagcccggcttcggcaaccccggcccccccggcctgcccggcctgagcggccagaagggcgacggcggcctgcccggcatccccggcaaccccggcctgcccggccccaagggcgagcccggcttccacggcttccccggcgtgcagggcccccccggcccccccggcagccccggccccgccctggagggccccaagggcaaccccggcccccagggcccccccggcagacccggccccaccggcttccagagcctgcccggccccgagggcccccccggcctgcccggcaacggcggcatcaagggcgagaagggcaaccccggccagcccggcctgcccggcctgcccggcctgaagggcgaccagggcccccccggcctgcagggcaaccccggcagacccggcctgaacggcatgaagggcgaccccggcctgcccggcgtgcccggcttccccggcatgaagggccccagcggcgtgcccggcagcgccggccccgagggcgagcccggcctgatcggcccccccggcccccccggcctgcccggccccagcggccagagcatcatcatcaagggcgacgccggcccccccggcatccccggccagcccggcctgaagggcctgcccggcccccagggcccccagggcctgcccggccccaccggcccccccggcgaccccggcagaaacggcctgcccggcttcgacggcgccggcggcagaaagggcgaccccggcctgcccggccagcccggcaccagaggcctggacggcccccccggccccgacggcctgcagggcccccccggcccccccggcaccagcagcgtggcccacggcttcctgatcaccagacacagccagaccaccgacgccccccagtgcccccagggcaccctgcaggtgtacgagggcttcagcctgctgtacgtgcagggcaacaagagagcccacggccaggacctgggcaccgccggcagctgcctgagaagattcagcaccatgcccttcatgttctgcaacatcaacaacgtgtgcaacttcgccagcagaaacgactacagctactggctgagcacccccgagcccatgcccatgagcatgcagcccctgaagggccagagcatccagcccttcatcagcagatgcgccgtgtgcgaggcccccgccgtggtgatcgccgtgcacagccagaccatccagatcccccactgcccccagggctgggacagcctgtggatcggctacagcttcatgatgcacaccagcgccggcgccgagggcagcggccaggccctggccagccccggcagctgcctggaggagttcagaagcgcccccttcatcgagtgccacggcagaggcacctgcaactactacgccaacagctacagcttctggctggccaccgtggacgtgagcgacatgttcagcaagccccagagcgagaccctgaaggccggcgacctgagaaccagaatcagcagatgccaggtgtgcatgaagagaacctag

SEQ ID NO: 1776 - DNA, 5073 bp, Homo sapiens
atgcaccccggcctgtggctgctgctggtgaccctgtgcctgaccgaggagctggccgccgccggcgagaagagctacggcaagccctgcggcggccaggactgcagcggcagctgccagtgcttccccgagaagggcgccagaggcagacccggccccatcggcatccagggccccaccggcccccagggcttcaccggcagcaccggcctgagcggcctgaagggcgagagaggcttccccggcctgctgggcccctacggccccaagggcgacaagggccccatgggcgtgcccggcttcctgggcatcaacggcatccccggccaccccggccagcccggccccagaggcccccccggcctggacggctgcaacggcacccagggcgccgtgggcttccccggccccgacggctaccccggcctgctgggcccccccggcctgcccggccagaagggcagcaagggcgaccccgtgctggcccccggcagcttcaagggcatgaagggcgaccccggcctgcccggcctggacggcatcaccggcccccagggcgcccccggcttccccggcgccgtgggccccgccggcccccccggcctgcagggcccccccggcccccccggccccctgggccccgacggcaacatgggcctgggcttccagggcgagaagggcgtgaagggcgacgtgggcctgcccggccccgccggccccccccccagcaccggcgagctggagttcatgggcttccccaagggcaagaagggcagcaagggcgagcccggccccaagggcttccccggcatcagcggcccccccggcttccccggcctgggcaccaccggcgagaagggcgagaagggcgagaagggcatccccggcctgcccggccccagaggccccatgggcagcgagggcgtgcagggcccccccggccagcagggcaagaagggcaccctgggcttccccggcctgaacggcttccagggcatcgagggccagaagggcgacatcggcctgcccggccccgacgtgttcatcgacatcgacggcgccgtgatcagcggcaaccccggcgaccccggcgtgcccggcctgcccggcctgaagggcgacgagggcatccagggcctgagaggccccagcggcgtgcccggcctgcccgccctgagcggcgtgcccggcgccctgggcccccagggcttccccggcctgaagggcgaccagggcaaccccggcagaaccaccatcggcgccgccggcctgcccggcagagacggcctgcccggcccccccggcccccccggcccccccagccccgagttcgagaccgagaccctgcacaacaaggagagcggcttccccggcctgagaggcgagcagggccccaagggcaacctgggcctgaagggcatcaagggcgacagcggcttctgcgcctgcgacggcggcgtgcccaacaccggcccccccggcgagcccggcccccccggcccctggggcctgatcggcctgcccggcctgaagggcgccagaggcgacagaggcagcggcggcgcccagggccccgccggcgcccccggcctggtgggccccctgggccccagcggccccaagggcaagaagggcgagcccatcctgagcaccatccagggcatgcccggcgacagaggcgacagcggcagccagggcttcagaggcgtgatcggcgagcccggcaaggacggcgtgcccggcctgcccggcctgcccggcctgcccggcgacggcggccagggcttccccggcgagaagggcctgcccggcctgcccggcgagaagggccaccccggcccccccggcctgcccggcaacggcctgcccggcctgcccggccccagaggcctgcccggcgacaagggcaaggacggcctgcccggccagcagggcctgcccggcagcaagggcatcaccctgccctgcatcatccccggcagctacggccccagcggcttccccggcacccccggcttccccggccccaagggcagcagaggcctgcccggcacccccggccagcccggcagcagcggcagcaagggcgagcccggcagccccggcctggtgcacctgcccgagctgcccggcttccccggccccagaggcgagaagggcctgcccggcttccccggcctgcccggcaaggacggcctgcccggcatgatcggcagccccggcctgcccggcagcaagggcgccaccggcgacatcttcggcgccgagaacggcgcccccggcgagcagggcctgcagggcctgaccggccacaagggcttcctgggcgacagcggcctgcccggcctgaagggcgtgcacggcaagcccggcctgctgggccccaagggcgagagaggcagccccggcacccccggccaggtgggccagcccggcacccccggcagcagcggcccctacggcatcaagggcaagagcggcctgcccggcgcccccggcttccccggcatcagcggccaccccggcaagaagggcaccagaggcaagaagggcccccccggcagcatcgtgaagaagggcctgcccggcctgaagggcctgcccggcaaccccggcctggtgggcctgaagggcagccccggcagccccggcgtggccggcctgcccgccctgagcggccccaagggcgagaagggcagcgtgggcttcgtgggcttccccggcatccccggcctgcccggcatccccggcaccagaggcctgaagggcatccccggcagcaccggcaagatgggccccagcggcagagccggcacccccggcgagaagggcgacagaggcaaccccggccccgtgggcatccccagccccagaagacccatgagcaacctgtggctgaagggcgacaagggcagccagggcagcgccggcagcaacggcttccccggccccagaggcgacaagggcgaggccggcagacccggcccccccggcctgcccggcgcccccggcctgcccggcatcatcaagggcgtgagcggcaagcccggcccccccggcttcatgggcatcagaggcctgcccggcctgaagggcagcagcggcatcaccggcttccccggcatgcccggcgagagcggcagccagggcatcagaggcagccccggcctgcccggcgccagcggcctgcccggcctgaagggcgacaacggccagaccgtggagatcagcggcagccccggccccaagggccagcccggcgagagcggcttcaagggcaccaagggcagagacggcctgatcggcaacatcggcttccccggcaacaagggcgaggacggcaaggtgggcgtgagcggcgacgtgggcctgcccggcgcccccggcttccccggcgtggccggcatgagaggcgagcccggcctgcccggcagcagcggccaccagggcgccatcggccccctgggcagccccggcctgatcggccccaagggcttccccggcttccccggcctgcacggcctgaacggcctgcccggcaccaagggcacccacggcacccccggccccagcatcaccggcgtgcccggccccgccggcctgcccggccccaagggcgagaagggctaccccggcatcggcatcggcgcccccggcaagcccggcctgagaggccagaagggcgacagaggcttccccggcctgcagggccccgccggcctgcccggcgcccccggcatcagcctgcccagcctgatcgccggccagcccggcgaccccggcagacccggcctggacggcgagagaggcagacccggccccgccggcccccccggcccccccggccccagcagcaaccagggcgacaccggcgaccccggcttccccggcatccccggccccaagggccccaagggcgaccagggcatccccggcttcagcggcctgcccggcgagctgggcctgaagggcatgagaggcgagcccggcttcatgggcacccccggcaaggtgggcccccccggcgaccccggcttccccggcatgaagggcaaggccggccccagaggcagcagcggcctgcagggcgaccccggccagacccccaccgccgaggccgtgcaggtgccccccggccccctgggcctgcccggcatcgacggcatccccggcctgaccggcgaccccggcgcccagggccccgtgggcctgcagggcagcaagggcctgcccggcatccccggcaaggacggccccagcggcctgcccggcccccccggcgccctgggcgaccccggcctgcccggcctgcagggcccccccggcttcgagggcgcccccggccagcagggccccttcggcatgcccggcatgcccggccagagcatgagagtgggctacaccctggtgaagcacagccagagcgagcaggtgcccccctgccccatcggcatgagccagctgtgggtgggctacagcctgctgttcgtggagggccaggagaaggcccacaaccaggacctgggcttcgccggcagctgcctgcccagattcagcaccatgcccttcatctactgcaacatcaacgaggtgtgccactacgccagaagaaacgacaagagctactggctgagcaccaccgcccccatccccatgatgcccgtgagccagacccagatcccccagtacatcagcagatgcagcgtgtgcgaggcccccagccaggccatcgccgtgcacagccaggacatcaccatcccccagtgccccctgggctggagaagcctgtggatcggctacagcttcctgatgcacaccgccgccggcgccgagggcggcggccagagcctggtgagccccggcagctgcctggaggacttcagagccacccccttcatcgagtgcagcggcgccagaggcacctgccactacttcgccaacaagtacagcttctggctgaccaccgtggaggagagacagcagttcggcgagctgcccgtgagcgagaccctgaaggccggccagctgcacaccagagtgagcagatgccaggtgtgcatgaagagcctgtag

SEQ ID NO: 1777 - DNA, 5076 bp, Homo sapiens
atgctgatcaacaagctgtggctgctgctggtgaccctgtgcctgaccgaggagctggccgccgccggcgagaagagctacggcaagccctgcggcggccaggactgcagcggcagctgccagtgcttccccgagaagggcgccagaggcagacccggccccatcggcatccagggccccaccggcccccagggcttcaccggcagcaccggcctgagcggcctgaagggcgagagaggcttccccggcctgctgggcccctacggccccaagggcgacaagggccccatgggcgtgcccggcttcctgggcatcaacggcatccccggccaccccggccagcccggccccagaggcccccccggcctggacggctgcaacggcacccagggcgccgtgggcttccccggccccgacggctaccccggcctgctgggcccccccggcctgcccggccagaagggcagcaagggcgaccccgtgctggcccccggcagcttcaagggcatgaagggcgaccccggcctgcccggcctggacggcatcaccggcccccagggcgcccccggcttccccggcgccgtgggccccgccggcccccccggcctgcagggcccccccggcccccccggccccctgggccccgacggcaacatgggcctgggcttccagggcgagaagggcgtgaagggcgacgtgggcctgcccggccccgccggccccccccccagcaccggcgagctggagttcatgggcttccccaagggcaagaagggcagcaagggcgagcccggccccaagggcttccccggcatcagcggcccccccggcttccccggcctgggcaccaccggcgagaagggcgagaagggcgagaagggcatccccggcctgcccggccccagaggccccatgggcagcgagggcgtgcagggcccccccggccagcagggcaagaagggcaccctgggcttccccggcctgaacggcttccagggcatcgagggccagaagggcgacatcggcctgcccggccccgacgtgttcatcgacatcgacggcgccgtgatcagcggcaaccccggcgaccccggcgtgcccggcctgcccggcctgaagggcgacgagggcatccagggcctgagaggccccagcggcgtgcccggcctgcccgccctgagcggcgtgcccggcgccctgggcccccagggcttccccggcctgaagggcgaccagggcaaccccggcagaaccaccatcggcgccgccggcctgcccggcagagacggcctgcccggcccccccggcccccccggcccccccagccccgagttcgagaccgagaccctgcacaacaaggagagcggcttccccggcctgagaggcgagcagggccccaagggcaacctgggcctgaagggcatcaagggcgacagcggcttctgcgcctgcgacggcggcgtgcccaacaccggcccccccggcgagcccggcccccccggcccctggggcctgatcggcctgcccggcctgaagggcgccagaggcgacagaggcagcggcggcgcccagggccccgccggcgcccccggcctggtgggccccctgggccccagcggccccaagggcaagaagggcgagcccatcctgagcaccatccagggcatgcccggcgacagaggcgacagcggcagccagggcttcagaggcgtgatcggcgagcccggcaaggacggcgtgcccggcctgcccggcctgcccggcctgcccggcgacggcggccagggcttccccggcgagaagggcctgcccggcctgcccggcgagaagggccaccccggcccccccggcctgcccggcaacggcctgcccggcctgcccggccccagaggcctgcccggcgacaagggcaaggacggcctgcccggccagcagggcctgcccggcagcaagggcatcaccctgccctgcatcatccccggcagctacggccccagcggcttccccggcacccccggcttccccggccccaagggcagcagaggcctgcccggcacccccggccagcccggcagcagcggcagcaagggcgagcccggcagccccggcctggtgcacctgcccgagctgcccggcttccccggccccagaggcgagaagggcctgcccggcttccccggcctgcccggcaaggacggcctgcccggcatgatcggcagccccggcctgcccggcagcaagggcgccaccggcgacatcttcggcgccgagaacggcgcccccggcgagcagggcctgcagggcctgaccggccacaagggcttcctgggcgacagcggcctgcccggcctgaagggcgtgcacggcaagcccggcctgctgggccccaagggcgagagaggcagccccggcacccccggccaggtgggccagcccggcacccccggcagcagcggcccctacggcatcaagggcaagagcggcctgcccggcgcccccggcttccccggcatcagcggccaccccggcaagaagggcaccagaggcaagaagggcccccccggcagcatcgtgaagaagggcctgcccggcctgaagggcctgcccggcaaccccggcctggtgggcctgaagggcagccccggcagccccggcgtggccggcctgcccgccctgagcggccccaagggcgagaagggcagcgtgggcttcgtgggcttccccggcatccccggcctgcccggcatccccggcaccagaggcctgaagggcatccccggcagcaccggcaagatgggccccagcggcagagccggcacccccggcgagaagggcgacagaggcaaccccggccccgtgggcatccccagccccagaagacccatgagcaacctgtggctgaagggcgacaagggcagccagggcagcgccggcagcaacggcttccccggccccagaggcgacaagggcgaggccggcagacccggcccccccggcctgcccggcgcccccggcctgcccggcatcatcaagggcgtgagcggcaagcccggcccccccggcttcatgggcatcagaggcctgcccggcctgaagggcagcagcggcatcaccggcttccccggcatgcccggcgagagcggcagccagggcatcagaggcagccccggcctgcccggcgccagcggcctgcccggcctgaagggcgacaacggccagaccgtggagatcagcggcagccccggccccaagggccagcccggcgagagcggcttcaagggcaccaagggcagagacggcctgatcggcaacatcggcttccccggcaacaagggcgaggacggcaaggtgggcgtgagcggcgacgtgggcctgcccggcgcccccggcttccccggcgtggccggcatgagaggcgagcccggcctgcccggcagcagcggccaccagggcgccatcggccccctgggcagccccggcctgatcggccccaagggcttccccggcttccccggcctgcacggcctgaacggcctgcccggcaccaagggcacccacggcacccccggccccagcatcaccggcgtgcccggccccgccggcctgcccggccccaagggcgagaagggctaccccggcatcggcatcggcgcccccggcaagcccggcctgagaggccagaagggcgacagaggcttccccggcctgcagggccccgccggcctgcccggcgcccccggcatcagcctgcccagcctgatcgccggccagcccggcgaccccggcagacccggcctggacggcgagagaggcagacccggccccgccggcccccccggcccccccggccccagcagcaaccagggcgacaccggcgaccccggcttccccggcatccccggccccaagggccccaagggcgaccagggcatccccggcttcagcggcctgcccggcgagctgggcctgaagggcatgagaggcgagcccggcttcatgggcacccccggcaaggtgggcccccccggcgaccccggcttccccggcatgaagggcaaggccggccccagaggcagcagcggcctgcagggcgaccccggccagacccccaccgccgaggccgtgcaggtgccccccggccccctgggcctgcccggcatcgacggcatccccggcctgaccggcgaccccggcgcccagggccccgtgggcctgcagggcagcaagggcctgcccggcatccccggcaaggacggccccagcggcctgcccggcccccccggcgccctgggcgaccccggcctgcccggcctgcagggcccccccggcttcgagggcgcccccggccagcagggccccttcggcatgcccggcatgcccggccagagcatgagagtgggctacaccctggtgaagcacagccagagcgagcaggtgcccccctgccccatcggcatgagccagctgtgggtgggctacagcctgctgttcgtggagggccaggagaaggcccacaaccaggacctgggcttcgccggcagctgcctgcccagattcagcaccatgcccttcatctactgcaacatcaacgaggtgtgccactacgccagaagaaacgacaagagctactggctgagcaccaccgcccccatccccatgatgcccgtgagccagacccagatcccccagtacatcagcagatgcagcgtgtgcgaggcccccagccaggccatcgccgtgcacagccaggacatcaccatcccccagtgccccctgggctggagaagcctgtggatcggctacagcttcctgatgcacaccgccgccggcgccgagggcggcggccagagcctggtgagccccggcagctgcctggaggacttcagagccacccccttcatcgagtgcagcggcgccagaggcacctgccactacttcgccaacaagtacagcttctggctgaccaccgtggaggagagacagcagttcggcgagctgcccgtgagcgagaccctgaaggccggccagctgcacaccagagtgagcagatgccaggtgtgcatgaagagcctgtag

SEQ ID NO: 1778 - DNA, 5076 bp, Homo sapiens
atgcaccccggcctgtggctgctgctggtgaccctgtgcctgaccgaggagctggccgccgccggcgagaagagctacggcaagccctgcggcggccaggactgcagcggcagctgccagtgcttccccgagaagggcgccagaggcagacccggccccatcggcatccagggccccaccggcccccagggcttcaccggcagcaccggcctgagcggcctgaagggcgagagaggcttccccggcctgctgggcccctacggccccaagggcgacaagaagttcagcatccccgtgctgctgatctacgacagcagacccggccaccccggccagcccggccccagaggcccccccggcctggacggctgcaacggcacccagggcgccgtgggcttccccggccccgacggctaccccggcctgctgggcccccccggcctgcccggccagaagggcagcaagggcgaccccgtgctggcccccggcagcttcaagggcatgaaggccttcatccccctgttcgagagcatcagaggcccccagggcgcccccggcttccccggcgccgtgggccccgccggcccccccggcctgcagcagggccagccccccttcctggaggtgctgttcccccactggcacgagggcgaggaggccaaggtgagagacagcctgttcggcgacgtgggcctgcccggccccgccggccccccccccagcaccggcgagctggagttcatgggcttccccaagggcaagaagggcagcaagggcgagcccggccccaagggcttccccggcatcagcggcccccccggcttccccggcctgggcaccaccggcgagaagggcgagaagggcgagaagggcatccccggcctgcccggccccagaaccctgctgtgcagccacaccttccacctggtggtgaccatgttcctgagccagggcaagaagggcaccctgggcttccccggcctgaacggcttccagggcatcgagggccagaagggcgacatcggcctgcccggccccgacgtgttcatcgacatcgacggcgccgtgatcagcggcaaccccggcgaccccggcgtgcccggcctgcccggcctgaagggcgacgagggcatccagggcctgagaggccccagcggcgtgcccggcctgcccgccctgagcggcgtgcccggcgccctgggcccccagggcttccccggcctgaagggcgaccagggcaaccccggcagaaccaccatcggcgccgccggcctgcccggcagagacggcctgcccggcccccccggcccccccggcccccccagccccgagttcgagaccgagaccctgcacaacaaggagagcggcttccccggcctgagaggcgagcagggccccaagggcaacctgggcctgaagggcatcaagggcgacagcggcttctgcgcctgcgacggcggcgtgcccaacaccggcccccccggcgagcccggcccccccggcccctggggcctgatcggcctgcccggcctgaagggcgccagaggcgacagaggcagcggcggcgcccagggccccgccggcgcccccggcctggtgggccccctgggccccagcggccccaagggcaagaagggcgagcccatcctgagcaccatccagggcatgcccggcgacagaggcgacagcggcagccagggcttcagaggcgtgatcggcgagcccggcaaggacggcgtgcccggcctgcccggcctgcccggcctgcccggcgacggcggccagggcttccccggcgagaagggcctgcccggcctgcccggcgagaagggccaccccggcccccccggcctgcccggcaacggcctgcccggcctgcccggccccagaggcctgcccggcgacaagggcaaggacggcctgcccggccagcagggcctgcccggcagcaagggcatcaccctgccctgcatcatccccggcagctacggccccagcggcttccccggcacccccggcttccccggccccaagggcagcagaggcctgcccggcacccccggccagcccggcagcagcggcagcaagggcgagcccggcagccccggcctggtgcacctgcccgagctgcccggcttccccggccccagaggcgagaagggcctgcccggcttccccggcctgcccggcaaggacggcctgcccggcatgatcggcagccccggcctgcccggcagcaagggcgccaccggcgacatcttcggcgccgagaacggcgcccccggcgagcagggcctgcagggcctgaccggccacaagggcttcctgggcgacagcggcctgcccggcctgaagggcgtgcacggcaagcccggcctgctgggccccaagggcgagagaggcagccccggcacccccggccaggtgggccagcccggcacccccggcagcagcggcccctacggcatcaagggcaagagcggcctgcccggcgcccccggcttccccggcatcagcggccaccccggcaagaagggcaccagaggcaagaagggcccccccggcagcatcgtgaagaagggcctgcccggcctgaagggcctgcccggcaaccccggcctggtgggcctgaagggcagccccggcagccccggcgtggccggcctgcccgccctgagcggccccaagggcgagaagggcagcgtgggcttcgtgggcttccccggcatccccggcctgcccggcatccccggcaccagaggcctgaagggcatccccggcagcaccggcaagatgggccccagcggcagagccggcacccccggcgagaagggcgacagaggcaaccccggccccgtgggcatccccagccccagaagacccatgagcaacctgtggctgaagggcgacaagggcagccagggcagcgccggcagcaacggcttccccggccccagaggcgacaagggcgaggccggcagacccggcccccccggcctgcccggcgcccccggcctgcccggcatcatcaagggcgtgagcggcaagcccggcccccccggcttcatgggcatcagaggcctgcccggcctgaagggcagcagcggcatcaccggcttccccggcatgcccggcgagagcggcagccagggcatcagaggcagccccggcctgcccggcgccagcggcctgcccggcctgaagggcgacaacggccagaccgtggagatcagcggcagccccggccccaagggccagcccggcgagagcggcttcaagggcaccaagggcagagacggcctgatcggcaacatcggcttccccggcaacaagggcgaggacggcaaggtgggcgtgagcggcgacgtgggcctgcccggcgcccccggcttccccggcgtggccggcatgagaggcgagcccggcctgcccggcagcagcggccaccagggcgccatcggccccctgggcagccccggcctgatcggccccaagggcttccccggcttccccggcctgcacggcctgaacggcctgcccggcaccaagggcacccacggcacccccggccccagcatcaccggcgtgcccggccccgccggcctgcccggccccaagggcgagaagggctaccccggcatcggcatcggcgcccccggcaagcccggcctgagaggccagaagggcgacagaggcttccccggcctgcagggccccgccggcctgcccggcgcccccggcatcagcctgcccagcctgatcgccggccagcccggcgaccccggcagacccggcctggacggcgagagaggcagacccggccccgccggcccccccggcccccccggccccagcagcaaccagggcgacaccggcgaccccggcttccccggcatccccggccccaagggccccaagggcgaccagggcatccccggcttcagcggcctgcccggcgagctgggcctgaagggcatgagaggcgagcccggcttcatgggcacccccggcaaggtgggcccccccggcgaccccggcttccccggcatgaagggcaaggccggccccagaggcagcagcggcctgcagggcgaccccggccagacccccaccgccgaggccgtgcaggtgccccccggccccctgggcctgcccggcatcgacggcatccccggcctgaccggcgaccccggcgcccagggccccgtgggcctgcagggcagcaagggcctgcccggcatccccggcaaggacggccccagcggcctgcccggcccccccggcgccctgggcgaccccggcctgcccggcctgcagggcccccccggcttcgagggcgcccccggccagcagggccccttcggcatgcccggcatgcccggccagagcatgagagtgggctacaccctggtgaagcacagccagagcgagcaggtgcccccctgccccatcggcatgagccagctgtgggtgggctacagcctgctgttcgtggagggccaggagaaggcccacaaccaggacctgggcttcgccggcagctgcctgcccagattcagcaccatgcccttcatctactgcaacatcaacgaggtgtgccactacgccagaagaaacgacaagagctactggctgagcaccaccgcccccatccccatgatgcccgtgagccagacccagatcccccagtacatcagcagatgcagcgtgtgcgaggcccccagccaggccatcgccgtgcacagccaggacatcaccatcccccagtgccccctgggctggagaagcctgtggatcggctacagcttcctgatgcacaccgccgccggcgccgagggcggcggccagagcctggtgagccccggcagctgcctggaggacttcagagccacccccttcatcgagtgcagcggcgccagaggcacctgccactacttcgccaacaagtacagcttctggctgaccaccgtggaggagagacagcagttcggcgagctgcccgtgagcgagaccctgaaggccggccagctgcacaccagagtgagcagatgccaggtgtgcatgaagagcctgtag

SEQ ID NO: 1779 - DNA, 783 bp, Homo sapiens
atgctgcaggactggaaggagagagccgccagcgtgtggtgcaagtggctggacgtgaaccccaaccaccacctggtgaaggccccccagcccgacctgccctgcccctgccccctgagcctgctgcccggcttcgccggcagctgcctgcccagattcagcaccatgcccttcatctactgcaacatcaacgaggtgtgccactacgccagaagaaacgacaagagctactggctgagcaccaccgcccccatccccatgatgcccgtgagccagacccagatcccccagtacatcagcagatgcagcgtgtgcgaggcccccagccaggccatcgccgtgcacagccaggacatcaccatcccccagtgccccctgggctggagaagcctgtggatcggctacagcttcctgatgcacaccgccgccggcgccgagggcggcggccagagcctggtgagccccggcagctgcctggaggacttcagagccacccccttcatcgagtgcagcggcgccagaggcacctgccactacttcgccaacaagtacagcttctggctgaccaccgtggaggagagacagcagttcggcgagctgcccgtgagcgagaccctgaaggccggccagctgcacaccagagtgagcagatgccagcccggcttcaccggccccggcatcaaggagtggaagtggaagtggcaccacagccccagcgcccccgtgatccaccagcagaacttctgcttcctgttccccagacactacgtgctgctggcctag

SEQ ID NO: 1780 - DNA, 4902 bp, Homo sapiens
atgcaccccggcctgtggctgctgctggtgaccctgtgcctgaccgaggagctggccgccgccggcgagaagagctacggcaagccctgcggcggccaggactgcagcggcagctgccagtgcttccccgagaagggcgccagaggcagacccggccccatcggcatccagggccccaccggcccccagggcttcaccggcagcaccggcctgagcggcctgaagggcgagagaggcttccccggcctgctgggcccctacggccccaagggcgacaagggccccatgggcgtgcccggcttcctgggcatcaacggcatccccggccaccccggccagcccggccccagaggcccccccggcctggacggctgcaacggcacccagggcgccgtgggcttccccggccccgacggctaccccggcctgctgggcccccccggcctgcccggccagaagggcagcaagggcgaccccgtgctggcccccggcagcttcaagggcatgaagggcgaccccggcctgcccggcctggacggcatcaccggcccccagggcgcccccggcttccccggcgccgtgggccccgccggcccccccggcctgcagggcccccccggcccccccggccccctgggccccgacggcaacatgggcctgggcttccagggcgagaagggcgtgaagggcgacgtgggcctgcccggccccgccggccccccccccagcaccggcgagctggagttcatgggcttccccaagggcaagaagggcagcaagggcgagcccggccccaagggcttccccggcatcagcggcccccccggcttccccggcctgggcaccaccggcgagaagggcgagaagggcgagaagggcatccccggcctgcccggccccagaggccccatgggcagcgagggcgtgcagggcccccccggccagcagggcaagaagggcaccctgggcttccccggcctgaacggcttccagggcatcgagggccagaagggcgacatcggcctgcccggccccgacgtgttcatcgacatcgacggcgccgtgatcagcggcaaccccggcgaccccggcgtgcccggcctgcccggcctgaagggcgacgagggcatccagggcctgagaggccccagcggcgtgcccggcctgcccgccctgagcggcgtgcccggcgccctgggcccccagggcttccccggcctgaagggcgaccagggcaaccccggcagaaccaccatcggcgccgccggcctgcccggcagagacggcctgcccggcccccccggcccccccggcccccccagccccgagttcgagaccgagaccctgcacaacaaggagagcggcttccccggcctgagaggcgagcagggccccaagggcaacctgggcctgaagggcatcaagggcgacagcggcttctgcgcctgcgacggcggcgtgcccaacaccggcccccccggcgagcccggcccccccggcccctggggcctgatcggcctgcccggcctgaagggcgccagaggcgacagaggcagcggcggcgcccagggccccgccggcgcccccggcctggtgggccccctgggccccagcggccccaagggcaagaagggcgagcccatcctgagcaccatccagggcatgcccggcgacagaggcgacagcggcagccagggcttcagaggcgtgatcggcgagcccggcaaggacggcgtgcccggcctgcccggcctgcccggcctgcccggcgacggcggccagggcttccccggcgagaagggcctgcccggcctgcccggcgagaagggccaccccggcccccccggcctgcccggcaacggcctgcccggcctgcccggccccagaggcctgcccggcgacaagggcaaggacggcctgcccggccagcagggcctgcccggcagcaagggcatcaccctgccctgcatcatccccggcagctacggccccagcggcttccccggcacccccggcttccccggccccaagggcagcagaggcctgcccggcacccccggccagcccggcagcagcggcagcaagggcgagcccggcagccccggcctggtgcacctgcccgagctgcccggcttccccggccccagaggcgagaagggcctgcccggcttccccggcctgcccggcaaggacggcctgcccggcatgatcggcagccccggcctgcccggcagcaagggcgccaccggcgacatcttcggcgccgagaacggcgcccccggcgagcagggcctgcagggcctgaccggccacaagggcttcctgggcgacagcggcctgcccggcctgaagggcgtgcacggcaagcccggcctgctgggccccaagggcgagagaggcagccccggcacccccggccaggtgggccagcccggcacccccggcagcagcggcccctacggcatcaagggcaagagcggcctgcccggcgcccccggcttccccggcatcagcggccaccccggcaagaagggcaccagaggcaagaagggcccccccggcagcatcgtgaagaagggcctgcccggcctgaagggcctgcccggcaaccccggcctggtgggcctgaagggcagccccggcagccccggcgtggccggcctgcccgccctgagcggccccaagggcgagaagggcagcgtgggcttcgtgggcttccccggcatccccggcctgcccggcatccccggcaccagaggcctgaagggcatccccggcagcaccggcaagatgggccccagcggcagagccggcacccccggcgagaagggcgacagaggcaaccccggccccgtgggcatccccagccccagaagacccatgagcaacctgtggctgaagggcgacaagggcagccagggcagcgccggcagcaacggcttccccggccccagaggcgacaagggcgaggccggcagacccggcccccccggcctgcccggcgcccccggcctgcccggcatcatcaagggcgtgagcggcaagcccggcccccccggcttcatgggcatcagaggcctgcccggcctgaagggcagcagcggcatcaccggcttccccggcatgcccggcgagagcggcagccagggcatcagaggcagccccggcctgcccggcgccagcggcctgcccggcctgaagggcgacaacggccagaccgtggagatcagcggcagccccggccccaagggccagcccggcgagagcggcttcaagggcaccaagggcagagacggcctgatcggcaacatcggcttccccggcaacaagggcgaggacggcaaggtgggcgtgagcggcgacgtgggcctgcccggcgcccccggcttccccggcgtggccggcatgagaggcgagcccggcctgcccggcagcagcggccaccagggcgccatcggccccctgggcagccccggcctgatcggccccaagggccccagcatcaccggcgtgcccggccccgccggcctgcccggccccaagggcgagaagggctaccccggcatcggcatcggcgcccccggcaagcccggcctgagaggccagaagggcgacagaggcttccccggcctgcagggccccgccggcctgcccggcgcccccggcatcagcctgcccagcctgatcgccggccagcccggcgaccccggcagacccggcctggacggcgagagaggcagacccggccccgccggcccccccggcccccccggccccagcagcaaccagggcgacaccggcgaccccggcttccccggcatccccggccccaagggccccaagggcgaccagggcatccccggcttcagcggcctgcccggcgagctgggcctgaagggcagcagcggcctgcagggcgaccccggccagacccccaccgccgaggccgtgcaggtgccccccggccccctgggcctgcccggcatcgacggcatccccggcctgaccggcgaccccggcgcccagggccccgtgggcctgcagggcagcaagggcctgcccggcatccccggcaaggacggccccagcggcctgcccggcccccccggcgccctgggcgaccccggcctgcccggcctgcagggcccccccggcttcgagggcgcccccggccagcagggccccttcggcatgcccggcatgcccggccagagcatgagagtgggctacaccctggtgaagcacagccagagcgagcaggtgcccccctgccccatcggcatgagccagctgtgggtgggctacagcctgctgttcgtggagggccaggagaaggcccacaaccaggacctgggcttcgccggcagctgcctgcccagattcagcaccatgcccttcatctactgcaacatcaacgaggtgtgccactacgccagaagaaacgacaagagctactggctgagcaccaccgcccccatccccatgatgcccgtgagccagacccagatcccccagtacatcagcagatgcagcgtgtgcgaggcccccagccaggccatcgccgtgcacagccaggacatcaccatcccccagtgccccctgggctggagaagcctgtggatcggctacagcttcctgatgcacaccgccgccggcgccgagggcggcggccagagcctggtgagccccggcagctgcctggaggacttcagagccacccccttcatcgagtgcagcggcgccagaggcacctgccactacttcgccaacaagtacagcttctggctgaccaccgtggaggagagacagcagttcggcgagctgcccgtgagcgagaccctgaaggccggccagctgcacaccagagtgagcagatgccaggtgtgcatgaagagcctgtag

SEQ ID NO: 1781 - DNA, 5001 bp, Homo sapiens
atgcaccccggcctgtggctgctgctggtgaccctgtgcctgaccgaggagctggccgccgccggcgagaagagctacggcaagccctgcggcggccaggactgcagcggcagctgccagtgcttccccgagaagggcgccagaggcagacccggccccatcggcatccagggccccaccggcccccagggcttcaccggcagcaccggcctgagcggcctgaagggcgagagaggcttccccggcctgctgggcccctacggccccaagggcgacaagggccccatgggcgtgcccggcttcctgggcatcaacggcatccccggccaccccggccagcccggccccagaggcccccccggcctggacggctgcaacggcacccagggcgccgtgggcttccccggccccgacggctaccccggcctgctgggcccccccggcctgcccggccagaagggcagcaagggcgaccccgtgctggcccccggcagcttcaagggcatgaagggcgaccccggcctgcccggcctggacggcatcaccggcccccagggcgcccccggcttccccggcgccgtgggccccgccggcccccccggcctgcagggcccccccggcccccccggccccctgggccccgacggcaacatgggcctgggcttccagggcgagaagggcgtgaagggcgacgtgggcctgcccggccccgccggccccccccccagcaccggcgagctggagttcatgggcttccccaagggcaagaagggcagcaagggcgagcccggccccaagggcttccccggcatcagcggcccccccggcttccccggcctgggcaccaccggcgagaagggcgagaagggcgagaagggcatccccggcctgcccggccccagaggccccatgggcagcgagggcgtgcagggcccccccggccagcagggcaagaagggcaccctgggcttccccggcctgaacggcttccagggcatcgagggccagaagggcgacatcggcctgcccggccccgacgtgttcatcgacatcgacggcgccgtgatcagcggcaaccccggcgaccccggcgtgcccggcctgcccggcctgaagggcgacgagggcatccagggcctgagaggccccagcggcgtgcccggcctgcccgccctgagcggcgtgcccggcgccctgggcccccagggcttccccggcctgaagggcgaccagggcaaccccggcagaaccaccatcggcgccgccggcctgcccggcagagacggcctgcccggcccccccggcccccccggcccccccagccccgagttcgagaccgagaccctgcacaacaaggagagcggcttccccggcctgagaggcgagcagggccccaagggcaacctgggcctgaagggcatcaagggcgacagcggcttctgcgcctgcgacggcggcgtgcccaacaccggcccccccggcgagcccggcccccccggcccctggggcctgatcggcctgcccggcctgaagggcgccagaggcgacagaggcagcggcggcgcccagggccccgccggcgcccccggcctggtgggccccctgggccccagcggccccaagggcaagaagggcgagcccatcctgagcaccatccagggcatgcccggcgacagaggcgacagcggcagccagggcttcagaggcgtgatcggcgagcccggcaaggacggcgtgcccggcctgcccggcctgcccggcctgcccggcgacggcggccagggcttccccggcgagaagggcctgcccggcctgcccggcgagaagggccaccccggcccccccggcctgcccggcaacggcctgcccggcctgcccggccccagaggcctgcccggcgacaagggcaaggacggcctgcccggccagcagggcctgcccggcagcaagggcatcaccctgccctgcatcatccccggcagctacggccccagcggcttccccggcacccccggcttccccggccccaagggcagcagaggcctgcccggcacccccggccagcccggcagcagcggcagcaagggcgagcccggcagccccggcctggtgcacctgcccgagctgcccggcttccccggccccagaggcgagaagggcctgcccggcttccccggcctgcccggcaaggacggcctgcccggcatgatcggcagccccggcctgcccggcagcaagggcgccaccggcgacatcttcggcgccgagaacggcgcccccggcgagcagggcctgcagggcctgaccggccacaagggcttcctgggcgacagcggcctgcccggcctgaagggcgtgcacggcaagcccggcctgctgggccccaagggcgagagaggcagccccggcacccccggccaggtgggccagcccggcacccccggcagcagcggcccctacggcatcaagggcaagagcggcctgcccggcgcccccggcttccccggcatcagcggccaccccggcaagaagggcaccagaggcaagaagggcccccccggcagcatcgtgaagaagggcctgcccggcctgaagggcctgcccggcaaccccggcctggtgggcctgaagggcagccccggcagccccggcgtggccggcctgcccgccctgagcggccccaagggcgagaagggcagcgtgggcttcgtgggcttccccggcatccccggcctgcccggcatccccggcaccagaggcctgaagggcatccccggcagcaccggcaagatgggccccagcggcagagccggcacccccggcgagaagggcgacagaggcaaccccggccccgtgggcatccccagccccagaagacccatgagcaacctgtggctgaagggcgacaagggcagccagggcagcgccggcagcaacggcttccccggccccagaggcgacaagggcgaggccggcagacccggcccccccggcctgcccggcgcccccggcctgcccggcatcatcaagggcgtgagcggcaagcccggcccccccggcttcatgggcatcagaggcctgcccggcctgaagggcagcagcggcatcaccggcttccccggcatgcccggcgagagcggcagccagggcatcagaggcagccccggcctgcccggcgccagcggcctgcccggcctgaagggcgacaacggccagaccgtggagatcagcggcagccccggccccaagggccagcccggcgagagcggcttcaagggcaccaagggcagagacggcctgatcggcaacatcggcttccccggcaacaagggcgaggacggcaaggtgggcgtgagcggcgacgtgggcctgcccggcgcccccggcttccccggcgtggccggcatgagaggcgagcccggcctgcccggcagcagcggccaccagggcgccatcggccccctgggcagccccggcctgatcggccccaagggccccagcatcaccggcgtgcccggccccgccggcctgcccggccccaagggcgagaagggctaccccggcatcggcatcggcgcccccggcaagcccggcctgagaggccagaagggcgacagaggcttccccggcctgcagggccccgccggcctgcccggcgcccccggcatcagcctgcccagcctgatcgccggccagcccggcgaccccggcagacccggcctggacggcgagagaggcagacccggccccgccggcccccccggcccccccggccccagcagcaaccagggcgacaccggcgaccccggcttccccggcatccccggccccaagggccccaagggcgaccagggcatccccggcttcagcggcctgcccggcgagctgggcctgaagggcatgagaggcgagcccggcttcatgggcacccccggcaaggtgggcccccccggcgaccccggcttccccggcatgaagggcaaggccggccccagaggcagcagcggcctgcagggcgaccccggccagacccccaccgccgaggccgtgcaggtgccccccggccccctgggcctgcccggcatcgacggcatccccggcctgaccggcgaccccggcgcccagggccccgtgggcctgcagggcagcaagggcctgcccggcatccccggcaaggacggccccagcggcctgcccggcccccccggcgccctgggcgaccccggcctgcccggcctgcagggcccccccggcttcgagggcgcccccggccagcagggccccttcggcatgcccggcatgcccggccagagcatgagagtgggctacaccctggtgaagcacagccagagcgagcaggtgcccccctgccccatcggcatgagccagctgtgggtgggctacagcctgctgttcgtggagggccaggagaaggcccacaaccaggacctgggcttcgccggcagctgcctgcccagattcagcaccatgcccttcatctactgcaacatcaacgaggtgtgccactacgccagaagaaacgacaagagctactggctgagcaccaccgcccccatccccatgatgcccgtgagccagacccagatcccccagtacatcagcagatgcagcgtgtgcgaggcccccagccaggccatcgccgtgcacagccaggacatcaccatcccccagtgccccctgggctggagaagcctgtggatcggctacagcttcctgatgcacaccgccgccggcgccgagggcggcggccagagcctggtgagccccggcagctgcctggaggacttcagagccacccccttcatcgagtgcagcggcgccagaggcacctgccactacttcgccaacaagtacagcttctggctgaccaccgtggaggagagacagcagttcggcgagctgcccgtgagcgagaccctgaaggccggccagctgcacaccagagtgagcagatgccaggtgtgcatgaagagcctgtag

SEQ ID NO: 1782 - DNA, 2037 bp, Homo sapiens
atggcctggaccgccagagacagaggcgccctgggcctgctgctgctgggcctgtgcctgtgcgccgcccagagaggcccccccggcgagcagggcccccccggcccccccggcccccccggcgtgcccggcatcgacggcatcgacggcgacagaggccccaagggcccccccggcccccccggccccgccggcgagcccggcaagcccggcgcccccggcaagcccggcacccccggcgccgacggcctgaccggccccgacggcagccccggcagcatcggcagcaagggccagaagggcgagcccggcgtgcccggcagcagaggcttccccggcagaggcatccccggcccccccggcccccccggcaccgccggcctgcccggcgagctgggcagagtgggccccgtgggcgaccccggcagaagaggcccccccggcccccccggcccccccggccccagaggcaccatcggcttccacgacggcgaccccctgtgccccaacgcctgcccccccggcagaagcggctaccccggcctgcccggcatgagaggccacaagggcgccaagggcgagatcggcgagcccggcagacagggccacaagggcgaggagggcgaccagggcgagctgggcgaggtgggcgcccagggcccccccggcgcccagggcctgagaggcatcaccggcatcgtgggcgacaagggcgagaagggcgccagaggcctggacggcgagcccggcccccagggcctgcccggcgcccccggcgaccagggccagagaggcccccccggcgaggccggccccaagggcgacagaggcgccgagggcgccagaggcatccccggcctgcccggccccaagggcgacaccggcctgcccggcgtggacggcagagacggcatccccggcatgcccggcaccaagggcgagcccggcaagcccggcccccccggcgacgccggcctgcagggcctgcccggcgtgcccggcatccccggcgccaagggcgtggccggcgagaagggcagcaccggcgcccccggcaagcccggccagatgggcaacagcggcaagcccggccagcagggcccccccggcgaggtgggccccagaggcccccagggcctgcccggcagcagaggcgagctgggccccgtgggcagccccggcctgcccggcaagctgggcagcctgggcagccccggcctgcccggcctgcccggcccccccggcctgcccggcatgaagggcgacagaggcgtggtgggcgagcccggccccaagggcgagcagggcgccagcggcgaggagggcgaggccggcgagagaggcgagctgggcgacatcggcctgcccggccccaagggcagcgccggcaaccccggcgagcccggcctgagaggccccgagggcagcagaggcctgcccggcgtggagggccccagaggcccccccggccccagaggcgtgcagggcgagcagggcgccaccggcctgcccggcgtgcagggcccccccggcagagcccccaccgaccagcacatcaagcaggtgtgcatgagagtgatccaggagcacttcgccgagatggccgccagcctgaagagacccgacagcggcgccaccggcctgcccggcagacccggcccccccggcccccccggcccccccggcgagaacggcttccccggccagatgggcatcagaggcctgcccggcatcaagggcccccccggcgccctgggcctgagaggccccaagggcgacctgggcgagaagggcgagagaggcccccccggcagaggccccaacggcctgcccggcgccatcggcctgcccggcgaccccggccccgccagctacggcagaaacggcagagacggcgagagaggcccccccggcgtggccggcatccccggcgtgcccggcccccccggcccccccggcctgcccggcttctgcgagcccgccagctgcaccatgcaggccggccagagagccttcaacaagggccccgacccctag

SEQ ID NO: 1783 - DNA, 2766 bp, Homo sapiens
atgaagacctgctggaagatccccgtgttcttcttcgtgtgcagcttcctggagccctgggccagcgccgccgtgaagagaagacccagattccccgtgaacagcaacagcaacggcggcaacgagctgtgccccaagatcagaatcggccaggacgacctgcccggcttcgacctgatcagccagttccaggtggacaaggccgccagcagaagagccatccagagagtggtgggcagcgccaccctgcaggtggcctacaagctgggcaacaacgtggacttcagaatccccaccagaaacctgtaccccagcggcctgcccgaggagtacagcttcctgaccaccttcagaatgaccggcagcaccctgaagaagaactggaacatctggcagatccaggacagcagcggcaaggagcaggtgggcatcaagatcaacggccagacccagagcgtggtgttcagctacaagggcctggacggcagcctgcagaccgccgccttcagcaacctgagcagcctgttcgacagccagtggcacaagatcatgatcggcgtggagagaagcagcgccaccctgttcgtggactgcaacagaatcgagagcctgcccatcaagcccagaggccccatcgacatcgacggcttcgccgtgctgggcaagctggccgacaacccccaggtgagcgtgcccttcgagctgcagtggatgctgatccactgcgaccccctgagacccagaagagagacctgccacgagctgcccgccagaatcacccccagccagaccaccgacgagagaggcccccccggcgagcagggcccccccggcccccccggcccccccggcgtgcccggcatcgacggcatcgacggcgacagaggccccaagggcccccccggcccccccggccccgccggcgagcccggcaagcccggcgcccccggcaagcccggcacccccggcgccgacggcctgaccggccccgacggcagccccggcagcatcggcagcaagggccagaagggcgagcccggcgtgcccggcagcagaggcttccccggcagaggcatccccggcccccccggcccccccggcaccgccggcctgcccggcgagctgggcagagtgggccccgtgggcgaccccggcagaagaggcccccccggcccccccggcccccccggccccagaggcaccatcggcttccacgacggcgaccccctgtgccccaacgcctgcccccccggcagaagcggctaccccggcctgcccggcatgagaggccacaagggcgccaagggcgagatcggcgagcccggcagacagggccacaagggcgaggagggcgaccagggcgagctgggcgaggtgggcgcccagggcccccccggcgcccagggcctgagaggcatcaccggcatcgtgggcgacaagggcgagaagggcgccagaggcctggacggcgagcccggcccccagggcctgcccggcgcccccggcgaccagggccagagaggcccccccggcgaggccggccccaagggcgacagaggcgccgagggcgccagaggcatccccggcctgcccggccccaagggcgacaccggcctgcccggcgtggacggcagagacggcatccccggcatgcccggcaccaagggcgagcccggcaagcccggcccccccggcgacgccggcctgcagggcctgcccggcgtgcccggcatccccggcgccaagggcgtggccggcgagaagggcagcaccggcgcccccggcaagcccggccagatgggcaacagcggcaagcccggccagcagggcccccccggcgaggtgggccccagaggcccccagggcctgcccggcagcagaggcgagctgggccccgtgggcagccccggcctgcccggcaagctgggcagcctgggcagccccggcctgcccggcctgcccggcccccccggcctgcccggcatgaagggcgacagaggcgtggtgggcgagcccggccccaagggcgagcagggcgccagcggcgaggagggcgaggccggcgagagaggcgagctgggcgacatcggcctgcccggccccaagggcagcgccggcaaccccggcgagcccggcctgagaggccccgagggcagcagaggcctgcccggcgtggagggccccagaggcccccccggccccagaggcgtgcagggcgagcagggcgccaccggcctgcccggcgtgcagggcccccccggcagagcccccaccgaccagcacatcaagcaggtgtgcatgagagtgatccaggagcacttcgccgagatggccgccagcctgaagagacccgacagcggcgccaccggcctgcccggcagacccggcccccccggcccccccggcccccccggcgagaacggcttccccggccagatgggcatcagaggcctgcccggcatcaagggcccccccggcgccctgggcctgagaggccccaagggcgacctgggcgagaagggcgagagaggcccccccggcagaggccccaacggcctgcccggcgccatcggcctgcccggcgaccccggccccgccagctacggcagaaacggcagagacggcgagagaggcccccccggcgtggccggcatccccggcgtgcccggcccccccggcccccccggcctgcccggcttctgcgagcccgccagctgcaccatgcaggccggccagagagccttcaacaagggccccgacccctag

SEQ ID NO: 1784 - DNA, 987 bp, Homo sapiens
atgaagacctgctggaagatccccgtgttcttcttcgtgtgcagcttcctggagccctgggccagcgccgccgtgaagagaagacccagattccccgtgaacagcaacagcaacggcggcaacgagctgtgccccaagatcagaatcggccaggacgacctgcccggcttcgacctgatcagccagttccaggtggacaaggccgccagcagaagagccatccagagagtggtgggcagcgccaccctgcaggtggcctacaagctgggcaacaacgtggacttcagaatccccaccagaaacctgtaccccagcggcctgcccgaggagtacagcttcctgaccaccttcagaatgaccggcagcaccctgaagaagaactggaacatctggcagatccaggacagcagcggcaaggagcaggtgggcatcaagatcaacggccagacccagagcgtggtgttcagctacaagggcctggacggcagcctgcagaccgccgccttcagcaacctgagcagcctgttcgacagccagtggcacaagatcatgatcggcgtggagagaagcagcgccaccctgttcgtggactgcaacagaatcgagagcctgcccatcaagcccagaggccccatcgacatcgacggcttcgccgtgctgggcaagctggccgacaacccccaggtgagcgtgcccttcgagctgcagtggatgctgatccactgcgaccccctgagacccagaagagagacctgccacgagctgcccgccagaatcacccccagccagaccaccgacgagagaggcccccccggcgagcagggcccccccggcccccccggcccccccggcgtgcccggcatcgacggcatcgacggcgacagaggccccaagggcccccccggcccccccggccccgccggcgagcccggcaagcccggcgcccccggcaagcccggcacccccggcgccgacaccagcccctag

SEQ ID NO: 1785 - DNA, 2037 bp, Homo sapiens
atggcctggaccgccagagacagaggcgccctgggcctgctgctgctgggcctgtgcctgtgcgccgcccagagaggcccccccggcgagcagggcccccccggcccccccggcccccccggcgtgcccggcatcgacggcatcgacggcgacagaggccccaagggcccccccggcccccccggccccgccggcgagcccggcaagcccggcgcccccggcaagcccggcacccccggcgccgacggcctgaccggccccgacggcagccccggcagcatcggcagcaagggccagaagggcgagcccggcgtgcccggcagcagaggcttccccggcaagatcctgcccctgctgcagggcccccccggcaccgccggcctgcccggcgagctgggcagagtgggccccgtgggcgaccccggcagaagaggcccccccggcccccccggcccccccggccccagaggcaccatcggcttccacgacggcgaccccctgtgccccaacgcctgcccccccggcagaagcggctaccccggcctgcccggcatgagaggccacaagggcgccaagggcgagatcggcgagcccggcagacagggccacaagggcgaggagggcgaccagggcgagctgggcgaggtgggcgcccagggcccccccggcgcccagggcctgagaggcatcaccggcatcgtgggcgacaagggcgagaagggcgccagaggcctggacggcgagcccggcccccagggcctgcccggcgcccccggcgaccagggccagagaggcccccccggcgaggccggccccaagggcgacagaggcgccgagggcgccagaggcatccccggcctgcccggccccaagggcgacaccggcctgcccggcgtggacggcagagacggcatccccggcatgcccggcaccaagggcgagcccggcaagcccggcccccccggcgacgccggcctgcagggcctgcccggcgtgcccggcatccccggcgccaagggcgtggccggcgagaagggcagcaccggcgcccccggcaagcccggccagatgggcaacagcggcaagcccggccagcagggcccccccggcgaggtgggccccagaggcccccagggcctgcccggcagcagaggcgagctgggccccgtgggcagccccggcctgcccggcaagctgggcagcctgggcagccccggcctgcccggcctgcccggcccccccggcctgcccggcatgaagggcgacagaggcgtggtgggcgagcccggccccaagggcgagcagggcgccagcggcgaggagggcgaggccggcgagagaggcgagctgggcgacatcggcctgcccggccccaagggcagcgccggcaaccccggcgagcccggcctgagaggccccgagggcagcagaggcctgcccggcgtggagggccccagaggcccccccggccccagaggcgtgcagggcgagcagggcgccaccggcctgcccggcgtgcagggcccccccggcagagcccccaccgaccagcacatcaagcaggtgtgcatgagagtgatccaggagcacttcgccgagatggccgccagcctgaagagacccgacagcggcgccaccggcctgcccggcagacccggcccccccggcccccccggcccccccggcgagaacggcttccccggccagatgggcatcagaggcctgcccggcatcaagggcccccccggcgccctgggcctgagaggccccaagggcgacctgggcgagaagggcgagagaggcccccccggcagaggccccaacggcctgcccggcgccatcggcctgcccggcgaccccggccccgccagctacggcagaaacggcagagacggcgagagaggcccccccggcgtggccggcatccccggcgtgcccggcccccccggcccccccggcctgcccggcttctgcgagcccgccagctgcaccatgcaggccggccagagagccttcaacaagggccccgacccctag

SEQ ID NO: 1786 - DNA, 252 bp, Homo sapiens
atggccgccgccaccgccagccccagaagcctgctggtgctgctgcaggtggtggtgctggccctggcccagatcagaggcccccccggcgagagaggcccccccggcccccccggcccccccggcgtgcccggcagcgacggcatcgacggcccccccggccccgtgggcctgcccggcgagatcggcatcagaggccccaagggcgaccccggccccgacggccccagcggcccccccggccccccctag

SEQ ID NO: 1787 - DNA, 2070 bp, Homo sapiens
atggccgccgccaccgccagccccagaagcctgctggtgctgctgcaggtggtggtgctggccctggcccagatcagaggcccccccggcgagagaggcccccccggcccccccggcccccccggcgtgcccggcagcgacggcatcgacggcgacaacggcccccccggcaaggccggcccccccggccccaagggcgagcccggcaaggccggccccgacggccccgacggcaagcccggcatcgacggcctgaccggcgccaagggcgagcccggccccatgggcatccccggcgtgaagggccagcccggcctgcccggcccccccggcctgcccggccccggcttcgccggcccccccggcccccccggccccgtgggcctgcccggcgagatcggcatcagaggccccaagggcgaccccggccccgacggccccagcggcccccccggcccccccggcaagcccggcagacccggcaccatccagggcctggagggcagcgccgacttcctgtgccccaccaactgcccccccggcatgaagggcccccccggcctgcagggcgtgaagggccacgccggcaagagaggcatcctgggcgaccccggccaccagggcaagcccggccccaagggcgacgtgggcgccagcggcgagcagggcatccccggcccccccggcccccagggcatcagaggctaccccggcatggccggccccaagggcgagaccggcccccacggctacaagggcatggtgggcgccatcggcgccaccggcccccccggcgaggagggccccagaggcccccccggcagagccggcgagaagggcgacgagggcagccccggcatcagaggcccccagggcatcaccggccccaagggcgccaccggcccccccggcatcaacggcaaggacggcacccccggcacccccggcatgaagggcagcgccggccaggccggccagcccggcagccccggccaccagggcctggccggcgtgcccggccagcccggcaccaagggcggccccggcgaccagggcgagcccggcccccagggcctgcccggcttcagcggcccccccggcaaggagggcgagcccggccccagaggcgagatcggcccccagggcatcatgggccagaagggcgaccagggcgagagaggccccgtgggccagcccggcccccagggcagacagggccccaagggcgagcagggcccccccggcatccccggcccccagggcctgcccggcgtgaagggcgacaagggcagccccggcaagaccggccccagaggcaaggtgggcgaccccggcgtggccggcctgcccggcgagaagggcgagaagggcgagagcggcgagcccggccccaagggccagcagggcgtgagaggcgagcccggctaccccggccccagcggcgacgccggcgcccccggcgtgcagggctaccccggcccccccggccccagaggcctggccggcaacagaggcgtgcccggccagcccggcagacagggcgtggagggcagagacgccaccgaccagcacatcgtggacgtggccctgaagatgctgcaggagcagctggccgaggtggccgtgagcgccaagagagaggccctgggcgccgtgggcatgatgggcccccccggcccccccggcccccccggctaccccggcaagcagggcccccacggccaccccggccccagaggcgtgcccggcatcgtgggcgccgtgggccagatcggcaacaccggccccaagggcaagagaggcgagaagggcgaccccggcgaggtgggcagaggccaccccggcatgcccggcccccccggcatccccggcctgcccggcagacccggccaggccatcaacggcaaggacggcgacagaggcagccccggcgcccccggcgaggccggcagacccggcctgcccggccccgtgggcctgcccggcttctgcgagcccgccgcctgcctgggcgccagcgcctacgccagcgccagactgaccgagcccggcagcatcaagggcccctag

SEQ ID NO: 1788 - DNA, 2055 bp, Homo sapiens
atggccggccccagagcctgcgcccccctgctgctgctgctgctgctgggcgagctgctggccgccgccggcgcccagagagtgggcctgcccggcccccccggcccccccggcccccccggcaagcccggccaggacggcatcgacggcgaggccggcccccccggcctgcccggcccccccggccccaagggcgcccccggcaagcccggcaagcccggcgaggccggcctgcccggcctgcccggcgtggacggcctgaccggcagagacggcccccccggccccaagggcgcccccggcgagagaggcagcctgggcccccccggcccccccggcctgggcggcaagggcctgcccggcccccccggcgaggccggcgtgagcggcccccccggcggcatcggcctgagaggcccccccggccccagcggcctgcccggcctgcccggcccccccggcccccccggcccccccggccaccccggcgtgctgcccgagggcgccaccgacctgcagtgccccagcatctgcccccccggcccccccggcccccccggcatgcccggcttcaagggccccaccggctacaagggcgagcagggcgaggtgggcaaggacggcgagaagggcgaccccggcccccccggccccgccggcctgcccggcagcgtgggcctgcagggccccagaggcctgagaggcctgcccggccccctgggcccccccggcgacagaggccccatcggcttcagaggcccccccggcatccccggcgcccccggcaaggccggcgacagaggcgagagaggccccgagggcttcagaggccccaagggcgacctgggcagacccggccccaagggcacccccggcgtggccggccccagcggcgagcccggcatgcccggcaaggacggccagaacggcgtgcccggcctggacggccagaagggcgaggccggcagaaacggcgcccccggcgagaagggccccaacggcctgcccggcctgcccggcagagccggcagcaagggcgagaagggcgagagaggcagagccggcgagctgggcgaggccggccccagcggcgagcccggcgtgcccggcgacgccggcatgcccggcgagagaggcgaggccggccacagaggcagcgccggcgccctgggcccccagggcccccccggcgcccccggcgtgagaggcttccagggccagaagggcagcatgggcgaccccggcctgcccggcccccagggcctgagaggcgacgtgggcgacagaggccccggcggcgccgccggccccaagggcgaccagggcatcgccggcagcgacggcctgcccggcgacaagggcgagctgggccccagcggcctggtgggccccaagggcgagagcggcagcagaggcgagctgggccccaagggcacccagggccccaacggcaccagcggcgtgcagggcgtgcccggcccccccggccccctgggcctgcagggcgtgcccggcgtgcccggcatcaccggcaagcccggcgtgcccggcaaggaggccagcgagcagagaatcagagagctgtgcggcggcatgatcagcgagcagatcgcccagctggccgcccacctgagaaagcccctggcccccggcagcatcggcagacccggccccgccggcccccccggcccccccggcccccccggcagcatcggccaccccggcgccagaggcccccccggctacagaggccccaccggcgagctgggcgaccccggccccagaggcaaccagggcgacagaggcgacaagggcgccgccggcgccggcctggacggccccgagggcgaccagggcccccagggcccccagggcgtgcccggcaccagcaaggacggccaggacggcgcccccggcgagcccggcccccccggcgaccccggcctgcccggcgccatcggcgcccagggcacccccggcatctgcgacaccagcgcctgccagggcgccgtgctgggcggcgtgggcgagaagagcggcagcagaagcagctag

SEQ ID NO: 1789 - DNA, 576 bp, Homo sapiens
atgtggtggagcagcacccagaacgccggcaccgagggcgaggccggcccccccggcctgcccggcccccccggccccaagggcgcccccggcaagcccggcaagcccggcgaggccggcctgcccggcctgcccggcgtggacggcctgaccggcagagacggcccccccggccccaagggcgcccccggcgagagaggcagcctgggcccccccggcccccccggcctgggcggcaagggcctgcccggcccccccggcgaggccggcgtgagcggcccccccggcggcatcggcctgagaggcccccccggccccagcggcctgcccggcctgcccggcccccccggcccccccggcccccccggccaccccggcgtgctgcccgagggcgccaccgacctgcagtgccccagcatctgcccccccggcccccccggcccccccggcatgcccggcttcaagggccccaccggctacaagggcgagcagggcgaggtgggcaaggacggcgagaagggcgaccccggcccccccggccccgccggcctgcccggcagcgtgggcctgcagtag

SEQ ID NO: 1790 - DNA, 576 bp, Homo sapiens; identical to SEQ ID NO: 1789

SEQ ID NO: 1791 - DNA, 1128 bp, Homo sapiens
atgggcccccccggcctgcccggcctgaagggcgacagcggccccaagggcgagaagggccaccccggcctgatcggcctgatcggcccccccggcgagcagggcgagaagggcgacagaggcctgcccggcccccagggcagcagcggccccaagggcgagcagggcatcaccggccccagcggccccatcggcccccccggcccccccggcctgcccggcccccccggccccaagggcgccaagggcagcagcggccccaccggccccaagggcgaggccggccaccccggcccccccggcccccccggcccccccggcgaggtgatccagcccctgcccatccaggccagcagaaccagaagaaacatcgacgccagccagctgctggacgacggcaacggcgagaactacgtggactacgccgacggcatggaggagatcttcggcagcctgaacagcctgaagctggagatcgagcagatgaagagacccctgggcacccagcagaaccccgccagaacctgcaaggacctgcagctgtgccaccccgacttccccgacggcgagtactgggtggaccccaaccagggctgcagcagagacagcttcaaggtgtactgcaacttcaccgccggcggcagcacctgcgtgttccccgacaagaagagcgagggcagcaagatggccagatggcccaaggagcagcccagcacctggtacagccagtacaagagaggcagcctgctgagctacgtggacgccgagggcaaccccgtgggcgtggtgcagatgaccttcctgagactgctgagcgccagcgcccaccagaacgtgacctaccactgctaccagagcgtggcctggcaggacgccgccaccggcagctacgacaaggccctgagattcctgggcagcaacgacgaggagatgagctacgacaacaacccctacatcagagccctggtggacggctgcgccaccaagaagggctaccagaagaccgtgctggagatcgacacccccaaggtggagcaggtgcccatcgtggacatcatgttcaacgacttcggcgaggccagccagaagttcggcttcgaggtgggccccgcctgcttcatgggctag

SEQ ID NO: 1792 - DNA, 5517 bp, Homo sapiens
atggacgtgcacaccagatggaaggccagaagcgccctgagacccggcgcccccctgctgccccccctgctgctgctgctgctgtgggcccccccccccagcagagccgcccagcccgccgacctgctgaaggtgctggacttccacaacctgcccgacggcatcaccaagaccaccggcttctgcgccaccagaagaagcagcaagggccccgacgtggcctacagagtgaccaaggacgcccagctgagcgcccccaccaagcagctgtaccccgccagcgccttccccgaggacttcagcatcctgaccaccgtgaaggccaagaagggcagccaggccttcctggtgagcatctacaacgagcagggcatccagcagatcggcctggagctgggcagaagccccgtgttcctgtacgaggaccacaccggcaagcccggccccgaggactaccccctgttcagaggcatcaacctgagcgacggcaagtggcacagaatcgccctgagcgtgcacaagaagaacgtgaccctgatcctggactgcaagaagaagaccaccaagttcctggacagaagcgaccaccccatgatcgacatcaacggcatcatcgtgttcggcaccagaatcctggacgaggaggtgttcgagggcgacatccagcagctgctgttcgtgagcgaccacagagccgcctacgactactgcgagcactacagccccgactgcgacaccgccgtgcccgacaccccccagagccaggaccccaaccccgacgagtactacaccgagggcgacggcgagggcgagacctactactacgagtacccctactacgaggaccccgaggacctgggcaaggagcccacccccagcaagaagcccgtggaggccgccaaggagaccaccgaggtgcccgaggagctgacccccacccccaccgaggccgcccccatgcccgagaccagcgagggcgccggcaaggaggaggacgtgggcatcggcgactacgactacgtgcccagcgaggactactacacccccagcccctacgacgacctgacctacggcgagggcgaggagaaccccgaccagcccaccgaccccggcgccggcgccgagatccccaccagcaccgccgacaccagcaacagcagcaaccccgcccccccccccggcgagggcgccgacgacctggagggcgagttcaccgaggagaccatcagaaacctggacgagaactactacgacccctactacgaccccaccagcagccccagcgagatcggccccggcatgcccgccaaccaggacaccatctacgagggcatcggcggccccagaggcgagaagggccagaagggcgagcccgccatcatcgagcccggcatgctgatcgagggcccccccggccccgagggccccgccggcctgcccggcccccccggcaccatgggccccaccggccaggtgggcgaccccggcgagagaggcccccccggcagacccggcctgcccggcgccgacggcctgcccggcccccccggcaccatgctgatgctgcccttcagattcggcggcggcggcgacgccggcagcaagggccccatggtgagcgcccaggagagccaggcccaggccatcctgcagcaggccagactggccctgagaggccccgccggccccatgggcctgaccggcagacccggccccgtgggcccccccggcagcggcggcctgaagggcgagcccggcgacgtgggcccccagggccccagaggcgtgcagggcccccccggccccgccggcaagcccggcagaagaggcagagccggcagcgacggcgccagaggcatgcccggccagaccggccccaagggcgacagaggcttcgacggcctggccggcctgcccggcgagaagggccacagaggcgaccccggccccagcggcccccccggcccccccggcgacgacggcgagagaggcgacgacggcgaggtgggccccagaggcctgcccggcgagcccggccccagaggcctgctgggccccaagggcccccccggcccccccggcccccccggcgtgaccggcatggacggccagcccggccccaagggcaacgtgggcccccagggcgagcccggcccccccggccagcagggcaaccccggcgcccagggcctgcccggcccccagggcgccatcggcccccccggcgagaagggccccctgggcaagcccggcctgcccggcatgcccggcgccgacggcccccccggccaccccggcaaggagggcccccccggcgagaagggcggccagggcccccccggcccccagggccccatcggctaccccggccccagaggcgtgaagggcgccgacggcatcagaggcctgaagggcaccaagggcgagaagggcgaggacggcttccccggcttcaagggcgacatgggcatcaagggcgacagaggcgagatcggcccccccggccccagaggcgaggacggccccgagggccccaagggcagaggcggccccaacggcgaccccggccccctgggcccccccggcgagaagggcaagctgggcgtgcccggcctgcccggctaccccggcagacagggccccaagggcagcatcggcttccccggcttccccggcgccaacggcgagaagggcggcagaggcacccccggcaagcccggccccagaggccagagaggccccaccggccccagaggcgagagaggccccagaggcatcaccggcaagcccggccccaagggcaacagcggcggcgacggccccgccggcccccccggcgagagaggccccaacggcccccagggccccaccggcttccccggccccaagggcccccccggcccccccggcaaggacggcctgcccggccaccccggccagagaggcgagaccggcttccagggcaagaccggcccccccggcccccccggcgtggtgggcccccagggccccaccggcgagaccggccccatgggcgagagaggccaccccggcccccccggcccccccggcgagcagggcctgcccggcctggccggcaaggagggcaccaagggcgaccccggccccgccggcctgcccggcaaggacggcccccccggcctgagaggcttccccggcgacagaggcctgcccggccccgtgggcgccctgggcctgaagggcaacgagggcccccccggcccccccggccccgccggcagccccggcgagagaggccccgccggcgccgccggccccatcggcatccccggcagacccggcccccagggcccccccggccccgccggcgagaagggcgcccccggcgagaagggcccccagggccccgccggcagagacggcctgcagggccccgtgggcctgcccggccccgccggccccgtgggcccccccggcgaggacggcgacaagggcgagatcggcgagcccggccagaagggcagcaagggcgacaagggcgagcagggcccccccggccccaccggcccccagggccccatcggccagcccggccccagcggcgccgacggcgagcccggccccagaggccagcagggcctgttcggccagaagggcgacgagggccccagaggcttccccggcccccccggccccgtgggcctgcagggcctgcccggcccccccggcgagaagggcgagaccggcgacgtgggccagatgggcccccccggcccccccggccccagaggccccagcggcgcccccggcgccgacggcccccagggcccccccggcggcatcggcaaccccggcgccgtgggcgagaagggcgagcccggcgaggccggcgagcccggcctgcccggcgagggcggcccccccggccccaagggcgagagaggcgagaagggcgagagcggccccagcggcgccgccggcccccccggccccaagggcccccccggcgacgacggccccaagggcagccccggccccgtgggcttccccggcgaccccggcccccccggcgagcccggccccgccggccaggacggcccccccggcgacaagggcgacgacggcgagcccggccagaccggcagccccggccccaccggcgagcccggccccagcggcccccccggcaagagaggcccccccggccccgccggccccgagggcagacagggcgagaagggcgccaagggcgaggccggcctggagggcccccccggcaagaccggccccatcggcccccagggcgcccccggcaagcccggccccgacggcctgagaggcatccccggccccgtgggcgagcagggcctgcccggcagccccggccccgacggcccccccggccccatgggcccccccggcctgcccggcctgaagggcgacagcggccccaagggcgagaagggccaccccggcctgatcggcctgatcggcccccccggcgagcagggcgagaagggcgacagaggcctgcccggcccccagggcagcagcggccccaagggcgagcagggcatcaccggccccagcggccccatcggcccccccggcccccccggcctgcccggcccccccggccccaagggcgccaagggcagcagcggccccaccggccccaagggcgaggccggccaccccggcccccccggcccccccggcccccccggcgaggtgatccagcccctgcccatccaggccagcagaaccagaagaaacatcgacgccagccagctgctggacgacggcaacggcgagaactacgtggactacgccgacggcatggaggagatcttcggcagcctgaacagcctgaagctggagatcgagcagatgaagagacccctgggcacccagcagaaccccgccagaacctgcaaggacctgcagctgtgccaccccgacttccccgacggcgagtactgggtggaccccaaccagggctgcagcagagacagcttcaaggtgtactgcaacttcaccgccggcggcagcacctgcgtgttccccgacaagaagagcgagggcgccagaatcaccagctggcccaaggagaaccccggcagctggttcagcgagttcaagagaggcaagctgctgagctacgtggacgccgagggcaaccccgtgggcgtggtgcagatgaccttcctgagactgctgagcgccagcgcccaccagaacgtgacctaccactgctaccagagcgtggcctggcaggacgccgccaccggcagctacgacaaggccctgagattcctgggcagcaacgacgaggagatgagctacgacaacaacccctacatcagagccctggtggacggctgcgccaccaagaagggctaccagaagaccgtgctggagatcgacacccccaaggtggagcaggtgcccatcgtggacatcatgttcaacgacttcggcgaggccagccagaagttcggcttcgaggtgggccccgcctgcttcatgggctag

SEQ ID NO: 1793 - DNA, 633 bp, Homo sapiens
tgaagaaccagaagaaacatcgacgccagccagctgctggacgacggcaacggcgagaactacgtggactacgccgacggcatggaggagatcttcggcagcctgaacagcctgaagctggagatcgagcagatgaagagacccctgggcacccagcagaaccccgccagaacctgcaaggacctgcagctgtgccaccccgacttccccgacggcgagtactgggtggaccccaaccagggctgcagcagagacagcttcaaggtgtactgcaacttcaccgccggcggcagcacctgcgtgttccccgacaagaagagcgagggcagcaagatggccagatggcccaaggagcagcccagcacctggtacagccagtacaagagaggcagcctgctgagctacgtggacgccgagggcaaccccgtgggcgtggtgcagatgaccttcctgagactgctgagcgccagcgcccaccagaacgtgacctaccactgctaccagagcgtggcctggcaggacgccgccaccggcagctacgacaaggccctgagattcctgggcagcaacgacgaggagatgagctacgacaacaacccctacatcagagccctggtggacggctgcgcctag

SEQ ID NO: 1794 - DNA, 5238 bp, Homo sapiens
atgggcaacagaagagacctgggccagcccagagccggcctgtgcctgctgctggccgccctgcagctgctgcccggcacccaggccgaccccgtggacgtgctgaaggccctgggcgtgcagggcggccaggccggcgtgcccgagggccccggcttctgcccccagagaacccccgagggcgacagagccttcagaatcggccaggccagcaccctgggcatccccacctgggagctgttccccgagggccacttccccgagaacttcagcctgctgatcaccctgagaggccagcccgccaaccagagcgtgctgctgagcatctacgacgagagaggcgccagacagctgggcctggccctgggccccgccctgggcctgctgggcgaccccttcagacccctgccccagcaggtgaacctgaccgacggcagatggcacagagtggccgtgagcatcgacggcgagatggtgaccctggtggccgactgcgaggcccagccccccgtgctgggccacggccccagattcatcagcatcgccggcctgaccgtgctgggcacccaggacctgggcgagaagaccttcgagggcgacatccaggagctgctgatcagccccgacccccaggccgccttccaggcctgcgagagatacctgcccgactgcgacaacctggcccccgccgccaccgtggccccccagggcgagcccgagacccccagacccagaagaaagggcaagggcaagggcagaaagaagggcagaggcagaaagggcaagggcagaaagaagaacaaggagatctggaccagcagccccccccccgacagcgccgagaaccagaccagcaccgacatccccaagaccgagacccccgcccccaacctgccccccacccccacccccctggtggtgaccagcaccgtgaccaccggcctgaacgccaccatcctggagagaagcctggaccccgacagcggcaccgagctgggcaccctggagaccaaggccgccagagaggacgaggagggcgacgacagcaccatgggccccgacttcagagccgccgagtaccccagcagaacccagttccagatcttccccggcgccggcgagaagggcgccaagggcgagcccgccgtgatcgagaagggccagcagttcgagggcccccccggcgcccccggcccccagggcgtggtgggccccagcggcccccccggcccccccggcttccccggcgaccccggcccccccggccccgccggcctgcccggcatccccggcatcgacggcatcagaggcccccccggcaccgtgatcatgatgcccttccagttcgccggcggcagcttcaagggcccccccgtgagcttccagcaggcccaggcccaggccgtgctgcagcagacccagctgagcatgaagggcccccccggccccgtgggcctgaccggcagacccggccccgtgggcctgcccggccaccccggcctgaagggcgaggagggcgccgagggcccccagggccccagaggcctgcagggcccccacggcccccccggcagagtgggcaagatgggcagacccggcgccgacggcgccagaggcctgcccggcgacaccggccccaagggcgacagaggcttcgacggcctgcccggcctgcccggcgagaagggccagagaggcgacttcggccacgtgggccagcccggcccccccggcgaggacggcgagagaggcgccgagggcccccccggccccaccggccaggccggcgagcccggccccagaggcctgctgggccccagaggcagccccggccccaccggcagacccggcgtgaccggcatcgacggcgcccccggcgccaagggcaacgtgggcccccccggcgagcccggcccccccggccagcagggcaaccacggcagccagggcctgcccggcccccagggcctgatcggcacccccggcgagaagggcccccccggcaaccccggcatccccggcctgcccggcagcgacggccccctgggccaccccggccacgagggccccaccggcgagaagggcgcccagggcccccccggcagcgccggcccccccggctaccccggccccagaggcgtgaagggcaccagcggcaacagaggcctgcagggcgagaagggcgagaagggcgaggacggcttccccggcttcaagggcgacgtgggcctgaagggcgaccagggcaagcccggcgcccccggccccagaggcgaggacggccccgagggccccaagggccaggccggccaggccggcgaggagggcccccccggcagcgccggcgagaagggcaagctgggcgtgcccggcctgcccggctaccccggcagacccggccccaagggcagcatcggcttccccggccccctgggccccatcggcgagaagggcaagagcggcaagaccggccagcccggcctggagggcgagagaggcccccccggcagcagaggcgagagaggccagcccggcgccaccggccagcccggccccaagggcgacgtgggccaggacggcgcccccggcatccccggcgagaagggcctgcccggcctgcagggcccccccggcttccccggccccaagggcccccccggccaccagggcaaggacggcagacccggccaccccggccagagaggcgagctgggcttccagggccagaccggcccccccggccccgccggcgtgctgggcccccagggcaagaccggcgaggtgggccccctgggcgagagaggcccccccggcccccccggcccccccggcgagcagggcctgcccggcctggagggcagagagggcgccaagggcgagctgggcccccccggccccctgggcaaggagggccccgccggcctgagaggcttccccggccccaagggcggccccggcgaccccggccccaccggcctgaagggcgacaagggcccccccggccccgtgggcgccaacggcagccccggcgagagaggccccctgggccccgccggcggcatcggcctgcccggccagagcggcagcgagggccccgtgggccccgccggcaagaagggcagcagaggcgagagaggcccccccggccccaccggcaaggacggcatccccggccccctgggccccctgggcccccccggcgccgccggccccagcggcgaggagggcgacaagggcgacgtgggcgcccccggccacaagggcagcaagggcgacaagggcgacgccggcccccccggccagcccggcatcagaggccccgccggccaccccggcccccccggcgccgacggcgcccagggcagaagaggcccccccggcctgttcggccagaagggcgacgacggcgtgagaggcttcgtgggcgtgatcggcccccccggcctgcagggcctgcccggcccccccggcgagaagggcgaggtgggcgacgtgggcagcatgggcccccacggcgcccccggccccagaggcccccagggccccaccggcagcgagggcacccccggcctgcccggcggcgtgggccagcccggcgccgtgggcgagaagggcgagagaggcgacgccggcgaccccggcccccccggcgcccccggcatccccggccccaagggcgacatcggcgagaagggcgacagcggccccagcggcgccgccggcccccccggcaagaagggcccccccggcgaggacggcgccaagggcagcgtgggccccaccggcctgcccggcgacctgggcccccccggcgaccccggcgtgagcggcatcgacggcagccccggcgagaagggcgaccccggcgacgtgggcggccccggcccccccggcgccagcggcgagcccggcgcccccggcccccccggcaagagaggccccagcggccacatgggcagagagggcagagagggcgagaagggcgccaagggcgagcccggccccgacggcccccccggcagaaccggccccatgggcgccagaggcccccccggcagagtgggccccgagggcctgagaggcatccccggccccgtgggcgagcccggcctgctgggcgcccccggccagatgggcccccccggccccctgggccccagcggcctgcccggcctgaagggcgacaccggccccaagggcgagaagggccacatcggcctgatcggcctgatcggcccccccggcgaggccggcgagaagggcgaccagggcctgcccggcgtgcagggcccccccggccccaagggcgaccccggcccccccggccccatcggcagcctgggccaccccggcccccccggcgtggccggccccctgggccagaagggcagcaagggcagccccggcagcatgggccccagaggcgacaccggccccgccggcccccccggcccccccggcgcccccgccgagctgcacggcctgagaagaagaagaagattcgtgcccgtgcccctgcccgtggtggagggcggcctggaggaggtgctggccagcctgaccagcctgagcctggagctggagcagctgagaagaccccccggcaccgccgagagacccggcctggtgtgccacgagctgcacagaaaccacccccacctgcccgacggcgagtactggatcgaccccaaccagggctgcgccagagacagcttcagagtgttctgcaacttcaccgccggcggcgagacctgcctgtaccccgacaagaagttcgagatcgtgaagctggccagctggagcaaggagaagcccggcggctggtacagcaccttcagaagaggcaagaagttcagctacgtggacgccgacggcagccccgtgaacgtggtgcagctgaacttcctgaagctgctgagcgccaccgccagacagaacttcacctacagctgccagaacgccgccgcctggctggacgaggccaccggcgactacagccacagcgccagattcctgggcaccaacggcgaggagctgagcttcaaccagaccaccgccgccaccgtgagcgtgccccaggacggctgcagactgagaaagggccagaccaagaccctgttcgagttcagcagcagcagagccggcttcctgcccctgtgggacgtggccgccaccgacttcggccagaccaaccagaagttcggcttcgagctgggccccgtgtgcttcagcagctag

SEQ ID NO: 1795 - DNA, 9534 bp, Homo sapiens
atgagaaagcacagacacctgcccctggtggccgtgttctgcctgttcctgagcggcttccccaccacccacgcccagcagcagcaggccgacgtgaagaacggcgccgccgccgacatcatcttcctggtggacagcagctggaccatcggcgaggagcacttccagctggtgagagagttcctgtacgacgtggtgaagagcctggccgtgggcgagaacgacttccacttcgccctggtgcagttcaacggcaacccccacaccgagttcctgctgaacacctacagaaccaagcaggaggtgctgagccacatcagcaacatgagctacatcggcggcaccaaccagaccggcaagggcctggagtacatcatgcagagccacctgaccaaggccgccggcagcagagccggcgacggcgtgccccaggtgatcgtggtgctgaccgacggccacagcaaggacggcctggccctgcccagcgccgagctgaagagcgccgacgtgaacgtgttcgccatcggcgtggaggacgccgacgagggcgccctgaaggagatcgccagcgagcccctgaacatgcacatgttcaacctggagaacttcaccagcctgcacgacatcgtgggcaacctggtgagctgcgtgcacagcagcgtgagccccgagagagccggcgacaccgagaccctgaaggacatcaccgcccaggacagcgccgacatcatcttcctgatcgacggcagcaacaacaccggcagcgtgaacttcgccgtgatcctggacttcctggtgaacctgctggagaagctgcccatcggcacccagcagatcagagtgggcgtggtgcagttcagcgacgagcccagaaccatgttcagcctggacacctacagcaccaaggcccaggtgctgggcgccgtgaaggccctgggcttcgccggcggcgagctggccaacatcggcctggccctggacttcgtggtggagaaccacttcaccagagccggcggcagcagagtggaggagggcgtgccccaggtgctggtgctgatcagcgccggccccagcagcgacgagatcagatacggcgtggtggccctgaagcaggccagcgtgttcagcttcggcctgggcgcccaggccgccagcagagccgagctgcagcacatcgccaccgacgacaacctggtgttcaccgtgcccgagttcagaagcttcggcgacctgcaggagaagctgctgccctacatcgtgggcgtggcccagagacacatcgtgctgaagccccccaccatcgtgacccaggtgatcgaggtgaacaagagagacatcgtgttcctggtggacggcagcagcgccctgggcctggccaacttcaacgccatcagagacttcatcgccaaggtgatccagagactggagatcggccaggacctgatccaggtggccgtggcccagtacgccgacaccgtgagacccgagttctacttcaacacccaccccaccaagagagaggtgatcaccgccgtgagaaagatgaagcccctggacggcagcgccctgtacaccggcagcgccctggacttcgtgagaaacaacctgttcaccagcagcgccggctacagagccgccgagggcatccccaagctgctggtgctgatcaccggcggcaagagcctggacgagatcagccagcccgcccaggagctgaagagaagcagcatcatggccttcgccatcggcaacaagggcgccgaccaggccgagctggaggagatcgccttcgacagcagcctggtgttcatccccgccgagttcagagccgcccccctgcagggcatgctgcccggcctgctggcccccctgagaaccctgagcggcacccccgaggtgcacagcaacaagagagacatcatcttcctgctggacggcagcgccaacgtgggcaagaccaacttcccctacgtgagagacttcgtgatgaacctggtgaacagcctggacatcggcaacgacaacatcagagtgggcctggtgcagttcagcgacacccccgtgaccgagttcagcctgaacacctaccagaccaagagcgacatcctgggccacctgagacagctgcagctgcagggcggcagcggcctgaacaccggcagcgccctgagctacgtgtacgccaaccacttcaccgaggccggcggcagcagaatcagagagcacgtgccccagctgctgctgctgctgaccgccggccagagcgaggacagctacctgcaggccgccaacgccctgaccagagccggcatcctgaccttctgcgtgggcgccagccaggccaacaaggccgagctggagcagatcgccttcaaccccagcctggtgtacctgatggacgacttcagcagcctgcccgccctgccccagcagctgatccagcccctgaccacctacgtgagcggcggcgtggaggaggtgcccctggcccagcccgagagcaagagagacatcctgttcctgttcgacggcagcgccaacctggtgggccagttccccgtggtgagagacttcctgtacaagatcatcgacgagctgaacgtgaagcccgagggcaccagaatcgccgtggcccagtacagcgacgacgtgaaggtggagagcagattcgacgagcaccagagcaagcccgagatcctgaacctggtgaagagaatgaagatcaagaccggcaaggccctgaacctgggctacgccctggactacgcccagagatacatcttcgtgaagagcgccggcagcagaatcgaggacggcgtgctgcagttcctggtgctgctggtggccggcagaagcagcgacagagtggacggccccgccagcaacctgaagcagagcggcgtggtgcccttcatcttccaggccaagaacgccgaccccgccgagctggagcagatcgtgctgagccccgccttcatcctggccgccgagagcctgcccaagatcggcgacctgcacccccagatcgtgaacctgctgaagagcgtgcacaacggcgcccccgcccccgtgagcggcgagaaggacgtggtgttcctgctggacggcagcgagggcgtgagaagcggcttccccctgctgaaggagttcgtgcagagagtggtggagagcctggacgtgggccaggacagagtgagagtggccgtggtgcagtacagcgacagaaccagacccgagttctacctgaacagctacatgaacaagcaggacgtggtgaacgccgtgagacagctgaccctgctgggcggccccacccccaacaccggcgccgccctggagttcgtgctgagaaacatcctggtgagcagcgccggcagcagaatcaccgagggcgtgccccagctgctgatcgtgctgaccgccgacagaagcggcgacgacgtgagaaaccccagcgtggtggtgaagagaggcggcgccgtgcccatcggcatcggcatcggcaacgccgacatcaccgagatgcagaccatcagcttcatccccgacttcgccgtggccatccccaccttcagacagctgggcaccgtgcagcaggtgatcagcgagagagtgacccagctgaccagagaggagctgagcagactgcagcccgtgctgcagcccctgcccagccccggcgtgggcggcaagagagacgtggtgttcctgatcgacggcagccagagcgccggccccgagttccagtacgtgagaaccctgatcgagagactggtggactacctggacgtgggcttcgacaccaccagagtggccgtgatccagttcagcgacgaccccaaggtggagttcctgctgaacgcccacagcagcaaggacgaggtgcagaacgccgtgcagagactgagacccaagggcggcagacagatcaacgtgggcaacgccctggagtacgtgagcagaaacatcttcaagagacccctgggcagcagaatcgaggagggcgtgccccagttcctggtgctgatcagcagcggcaagagcgacgacgaggtggacgaccccgccgtggagctgaagcagttcggcgtggcccccttcaccatcgccagaaacgccgaccaggaggagctggtgaagatcagcctgagccccgagtacgtgttcagcgtgagcaccttcagagagctgcccagcctggagcagaagctgctgacccccatcaccaccctgaccagcgagcagatccagaagctgctggccagcaccagataccccccccccgccgtggagagcgacgccgccgacatcgtgttcctgatcgacagcagcgagggcgtgagacccgacggcttcgcccacatcagagacttcgtgagcagaatcgtgagaagactgaacatcggccccagcaaggtgagagtgggcgtggtgcagttcagcaacgacgtgttccccgagttctacctgaagacctacagaagccaggcccccgtgctggacgccatcagaagactgagactgagaggcggcagccccctgaacaccggcaaggccctggagttcgtggccagaaacctgttcgtgaagagcgccggcagcagaatcgaggacggcgtgccccagcacctggtgctggtgctgggcggcaagagccaggacgacgtgagcagattcgcccaggtgatcagaagcagcggcatcgtgagcctgggcgtgggcgacagaaacatcgacagaaccgagctgcagaccatcaccaacgaccccagactggtgttcaccgtgagagagttcagagagctgcccaacatcgaggagagaatcatgaacagcttcggccccagcgccgccacccccgccccccccggcgtggacacccccccccccagcagacccgagaagaagaaggccgacatcgtgttcctgctggacggcagcatcaacttcagaagagacagcttccaggaggtgctgagattcgtgagcgagatcgtggacaccgtgtacgaggacggcgacagcatccaggtgggcctggtgcagtacaacagcgaccccaccgacgagttcttcctgaaggacttcagcaccaagagacagatcatcgacgccatcaacaaggtggtgtacaagggcggcagacacgccaacaccaaggtgggcctggagcacctgagagtgaaccacttcgtgcccgaggccggcagcagactggaccagagagtgccccagatcgccttcgtgatcaccggcggcaagagcgtggaggacgcccaggacgtgagcctggccctgacccagagaggcgtgaaggtgttcgccgtgggcgtgagaaacatcgacagcgaggaggtgggcaagatcgccagcaacagcgccaccgccttcagagtgggcaacgtgcaggagctgagcgagctgagcgagcaggtgctggagaccctgcacgacgccatgcacgagaccctgtgccccggcgtgaccgacgccgccaaggcctgcaacctggacgtgatcctgggcttcgacggcagcagagaccagaacgtgttcgtggcccagaagggcttcgagagcaaggtggacgccatcctgaacagaatcagccagatgcacagagtgagctgcagcggcggcagaagccccaccgtgagagtgagcgtggtggccaacacccccagcggccccgtggaggccttcgacttcgacgagtaccagcccgagatgctggagaagttcagaaacatgagaagccagcacccctacgtgctgaccgaggacaccctgaaggtgtacctgaacaagttcagacagagcagccccgacagcgtgaaggtggtgatccacttcaccgacggcgccgacggcgacctggccgacctgcacagagccagcgagaacctgagacaggagggcgtgagagccctgatcctggtgggcctggagagagtggtgaacctggagagactgatgcacctggagttcggcagaggcttcatgtacgacagacccctgagactgaacctgctggacctggactacgagctggccgagcagctggacaacatcgccgagaaggcctgctgcggcgtgccctgcaagtgcagcggccagagaggcgacagaggccccatcggcagcatcggccccaagggcatccccggcgaggacggctacagaggctaccccggcgacgagggcggccccggcgagagaggcccccccggcgtgaacggcacccagggcttccagggctgccccggccagagaggcgtgaagggcagcagaggcttccccggcgagaagggcgaggtgggcgagatcggcctggacggcctggacggcgaggacggcgacaagggcctgcccggcagcagcggcgagaagggcaaccccggcagaagaggcgacaagggccccagaggcgagaagggcgagagaggcgacgtgggcatcagaggcgaccccggcaaccccggccaggacagccaggagagaggccccaagggcgagaccggcgacctgggccccatgggcgtgcccggcagagacggcgtgcccggcggccccggcgagaccggcaagaacggcggcttcggcagaagaggcccccccggcgccaagggcaacaagggcggccccggccagcccggcttcgagggcgagcagggcaccagaggcgcccagggccccgccggccccgccggcccccccggcctgatcggcgagcagggcatcagcggccccagaggcagcggcggcgccgccggcgcccccggcgagagaggcagaaccggccccctgggcagaaagggcgagcccggcgagcccggccccaagggcggcatcggcaacagaggccccagaggcgagaccggcgacgacggcagagacggcgtgggcagcgagggcagaagaggcaagaagggcgagagaggcttccccggctaccccggccccaagggcaaccccggcgagcccggcctgaacggcaccaccggccccaagggcatcagaggcagaagaggcaacagcggcccccccggcatcgtgggccagaagggcgaccccggctaccccggccccgccggccccaagggcaacagaggcgacagcatcgaccagtgcgccctgatccagagcatcaaggacaagtgcccctgctgctacggccccctggagtgccccgtgttccccaccgagctggccttcgccctggacaccagcgagggcgtgaaccaggacaccttcggcagaatgagagacgtggtgctgagcatcgtgaacgacctgaccatcgccgagagcaactgccccagaggcgccagagtggccgtggtgacctacaacaacgaggtgaccaccgagatcagattcgccgacagcaagagaaagagcgtgctgctggacaagatcaagaacctgcaggtggccctgaccagcaagcagcagagcctggagaccgccatgagcttcgtggccagaaacaccttcaagagagtgagaaacggcttcctgatgagaaaggtggccgtgttcttcagcaacacccccaccagagccagcccccagctgagagaggccgtgctgaagctgagcgacgccggcatcacccccctgttcctgaccagacaggaggacagacagctgatcaacgccctgcagatcaacaacaccgccgtgggccacgccctggtgctgcccgccggcagagacctgaccgacttcctggagaacgtgctgacctgccacgtgtgcctggacatctgcaacatcgaccccagctgcggcttcggcagctggagacccagcttcagagacagaagagccgccggcagcgacgtggacatcgacatggccttcatcctggacagcgccgagaccaccaccctgttccagttcaacgagatgaagaagtacatcgcctacctggtgagacagctggacatgagccccgaccccaaggccagccagcacttcgccagagtggccgtggtgcagcacgcccccagcgagagcgtggacaacgccagcatgccccccgtgaaggtggagttcagcctgaccgactacggcagcaaggagaagctggtggacttcctgagcagaggcatgacccagctgcagggcaccagagccctgggcagcgccatcgagtacaccatcgagaacgtgttcgagagcgcccccaaccccagagacctgaagatcgtggtgctgatgctgaccggcgaggtgcccgagcagcagctggaggaggcccagagagtgatcctgcaggccaagtgcaagggctacttcttcgtggtgctgggcatcggcagaaaggtgaacatcaaggaggtgtacaccttcgccagcgagcccaacgacgtgttcttcaagctggtggacaagagcaccgagctgaacgaggagcccctgatgagattcggcagactgctgcccagcttcgtgagcagcgagaacgccttctacctgagccccgacatcagaaagcagtgcgactggttccagggcgaccagcccaccaagaacctggtgaagttcggccacaagcaggtgaacgtgcccaacaacgtgaccagcagccccaccagcaaccccgtgaccaccaccaagcccgtgaccaccaccaagcccgtgaccaccaccaccaagcccgtgaccaccaccaccaagcccgtgaccatcatcaaccagcccagcgtgaagcccgccgccgccaagcccgcccccgccaagcccgtggccgccaagcccgtggccaccaagatggccaccgtgagaccccccgtggccgtgaagcccgccaccgccgccaagcccgtggccgccaagcccgccgccgtgagaccccccgccgccgccgccgccaagcccgtggccaccaagcccgaggtgcccagaccccaggccgccaagcccgccgccaccaagcccgccaccaccaagcccatggtgaagatgagcagagaggtgcaggtgttcgagatcaccgagaacagcgccaagctgcactgggagagagccgagccccccggcccctacttctacgacctgaccgtgaccagcgcccacgaccagagcctggtgctgaagcagaacctgaccgtgaccgacagagtgatcggcggcctgctggccggccagacctaccacgtggccgtggtgtgctacctgagaagccaggtgagagccacctaccacggcagcttcagcaccaagaagagccagcccccccccccccagcccgccagaagcgccagcagcagcaccatcaacctgatggtgagcaccgagcccctggccctgaccgagaccgacatctgcaagctgcccaaggacgagggcacctgcagagacttcatcctgaagtggtactacgaccccaacaccaagagctgcgccagattctggtacggcggctgcggcggcaacgagaacaagttcggcagccagaaggagtgcgagaaggtgtgcgcccccgtgctggccaagcccggcgtgatcagcgtgatgggcacctag

SEQ ID NO: 1796 - DNA, 8934 bp, Homo sapiens
atgagaaagcacagacacctgcccctggtggccgtgttctgcctgttcctgagcggcttccccaccacccacgcccagcagcagcaggccgacgtgaagaacggcgccgccgccgacatcatcttcctggtggacagcagctggaccatcggcgaggagcacttccagctggtgagagagttcctgtacgacgtggtgaagagcctggccgtgggcgagaacgacttccacttcgccctggtgcagttcaacggcaacccccacaccgagttcctgctgaacacctacagaaccaagcaggaggtgctgagccacatcagcaacatgagctacatcggcggcaccaaccagaccggcaagggcctggagtacatcatgcagagccacctgaccaaggccgccggcagcagagccggcgacggcgtgccccaggtgatcgtggtgctgaccgacggccacagcaaggacggcctggccctgcccagcgccgagctgaagagcgccgacgtgaacgtgttcgccatcggcgtggaggacgccgacgagggcgccctgaaggagatcgccagcgagcccctgaacatgcacatgttcaacctggagaacttcaccagcctgcacgacatcgtgggcaacctggtgagctgcgtgcacagcagcgtgagccccgagagagccggcgacaccgagaccctgaaggacatcaccgcccaggacagcgccgacatcatcttcctgatcgacggcagcaacaacaccggcagcgtgaacttcgccgtgatcctggacttcctggtgaacctgctggagaagctgcccatcggcacccagcagatcagagtgggcgtggtgcagttcagcgacgagcccagaaccatgttcagcctggacacctacagcaccaaggcccaggtgctgggcgccgtgaaggccctgggcttcgccggcggcgagctggccaacatcggcctggccctggacttcgtggtggagaaccacttcaccagagccggcggcagcagagtggaggagggcgtgccccaggtgctggtgctgatcagcgccggccccagcagcgacgagatcagatacggcgtggtggccctgaagcaggccagcgtgttcagcttcggcctgggcgcccaggccgccagcagagccgagctgcagcacatcgccaccgacgacaacctggtgttcaccgtgcccgagttcagaagcttcggcgacctgcaggagaagctgctgccctacatcgtgggcgtggcccagagacacatcgtgctgaagccccccaccatcgtgacccaggtgatcgaggtgaacaagagagacatcgtgttcctggtggacggcagcagcgccctgggcctggccaacttcaacgccatcagagacttcatcgccaaggtgatccagagactggagatcggccaggacctgatccaggtggccgtggcccagtacgccgacaccgtgagacccgagttctacttcaacacccaccccaccaagagagaggtgatcaccgccgtgagaaagatgaagcccctggacggcagcgccctgtacaccggcagcgccctggacttcgtgagaaacaacctgttcaccagcagcgccggctacagagccgccgagggcatccccaagctgctggtgctgatcaccggcggcaagagcctggacgagatcagccagcccgcccaggagctgaagagaagcagcatcatggccttcgccatcggcaacaagggcgccgaccaggccgagctggaggagatcgccttcgacagcagcctggtgttcatccccgccgagttcagagccgcccccctgcagggcatgctgcccggcctgctggcccccctgagaaccctgagcggcacccccgaggagagcaagagagacatcctgttcctgttcgacggcagcgccaacctggtgggccagttccccgtggtgagagacttcctgtacaagatcatcgacgagctgaacgtgaagcccgagggcaccagaatcgccgtggcccagtacagcgacgacgtgaaggtggagagcagattcgacgagcaccagagcaagcccgagatcctgaacctggtgaagagaatgaagatcaagaccggcaaggccctgaacctgggctacgccctggactacgcccagagatacatcttcgtgaagagcgccggcagcagaatcgaggacggcgtgctgcagttcctggtgctgctggtggccggcagaagcagcgacagagtggacggccccgccagcaacctgaagcagagcggcgtggtgcccttcatcttccaggccaagaacgccgaccccgccgagctggagcagatcgtgctgagccccgccttcatcctggccgccgagagcctgcccaagatcggcgacctgcacccccagatcgtgaacctgctgaagagcgtgcacaacggcgcccccgcccccgtgagcggcgagaaggacgtggtgttcctgctggacggcagcgagggcgtgagaagcggcttccccctgctgaaggagttcgtgcagagagtggtggagagcctggacgtgggccaggacagagtgagagtggccgtggtgcagtacagcgacagaaccagacccgagttctacctgaacagctacatgaacaagcaggacgtggtgaacgccgtgagacagctgaccctgctgggcggccccacccccaacaccggcgccgccctggagttcgtgctgagaaacatcctggtgagcagcgccggcagcagaatcaccgagggcgtgccccagctgctgatcgtgctgaccgccgacagaagcggcgacgacgtgagaaaccccagcgtggtggtgaagagaggcggcgccgtgcccatcggcatcggcatcggcaacgccgacatcaccgagatgcagaccatcagcttcatccccgacttcgccgtggccatccccaccttcagacagctgggcaccgtgcagcaggtgatcagcgagagagtgacccagctgaccagagaggagctgagcagactgcagcccgtgctgcagcccctgcccagccccggcgtgggcggcaagagagacgtggtgttcctgatcgacggcagccagagcgccggccccgagttccagtacgtgagaaccctgatcgagagactggtggactacctggacgtgggcttcgacaccaccagagtggccgtgatccagttcagcgacgaccccaaggtggagttcctgctgaacgcccacagcagcaaggacgaggtgcagaacgccgtgcagagactgagacccaagggcggcagacagatcaacgtgggcaacgccctggagtacgtgagcagaaacatcttcaagagacccctgggcagcagaatcgaggagggcgtgccccagttcctggtgctgatcagcagcggcaagagcgacgacgaggtggacgaccccgccgtggagctgaagcagttcggcgtggcccccttcaccatcgccagaaacgccgaccaggaggagctggtgaagatcagcctgagccccgagtacgtgttcagcgtgagcaccttcagagagctgcccagcctggagcagaagctgctgacccccatcaccaccctgaccagcgagcagatccagaagctgctggccagcaccagataccccccccccgccgtggagagcgacgccgccgacatcgtgttcctgatcgacagcagcgagggcgtgagacccgacggcttcgcccacatcagagacttcgtgagcagaatcgtgagaagactgaacatcggccccagcaaggtgagagtgggcgtggtgcagttcagcaacgacgtgttccccgagttctacctgaagacctacagaagccaggcccccgtgctggacgccatcagaagactgagactgagaggcggcagccccctgaacaccggcaaggccctggagttcgtggccagaaacctgttcgtgaagagcgccggcagcagaatcgaggacggcgtgccccagcacctggtgctggtgctgggcggcaagagccaggacgacgtgagcagattcgcccaggtgatcagaagcagcggcatcgtgagcctgggcgtgggcgacagaaacatcgacagaaccgagctgcagaccatcaccaacgaccccagactggtgttcaccgtgagagagttcagagagctgcccaacatcgaggagagaatcatgaacagcttcggccccagcgccgccacccccgccccccccggcgtggacacccccccccccagcagacccgagaagaagaaggccgacatcgtgttcctgctggacggcagcatcaacttcagaagagacagcttccaggaggtgctgagattcgtgagcgagatcgtggacaccgtgtacgaggacggcgacagcatccaggtgggcctggtgcagtacaacagcgaccccaccgacgagttcttcctgaaggacttcagcaccaagagacagatcatcgacgccatcaacaaggtggtgtacaagggcggcagacacgccaacaccaaggtgggcctggagcacctgagagtgaaccacttcgtgcccgaggccggcagcagactggaccagagagtgccccagatcgccttcgtgatcaccggcggcaagagcgtggaggacgcccaggacgtgagcctggccctgacccagagaggcgtgaaggtgttcgccgtgggcgtgagaaacatcgacagcgaggaggtgggcaagatcgccagcaacagcgccaccgccttcagagtgggcaacgtgcaggagctgagcgagctgagcgagcaggtgctggagaccctgcacgacgccatgcacgagaccctgtgccccggcgtgaccgacgccgccaaggcctgcaacctggacgtgatcctgggcttcgacggcagcagagaccagaacgtgttcgtggcccagaagggcttcgagagcaaggtggacgccatcctgaacagaatcagccagatgcacagagtgagctgcagcggcggcagaagccccaccgtgagagtgagcgtggtggccaacacccccagcggccccgtggaggccttcgacttcgacgagtaccagcccgagatgctggagaagttcagaaacatgagaagccagcacccctacgtgctgaccgaggacaccctgaaggtgtacctgaacaagttcagacagagcagccccgacagcgtgaaggtggtgatccacttcaccgacggcgccgacggcgacctggccgacctgcacagagccagcgagaacctgagacaggagggcgtgagagccctgatcctggtgggcctggagagagtggtgaacctggagagactgatgcacctggagttcggcagaggcttcatgtacgacagacccctgagactgaacctgctggacctggactacgagctggccgagcagctggacaacatcgccgagaaggcctgctgcggcgtgccctgcaagtgcagcggccagagaggcgacagaggccccatcggcagcatcggccccaagggcatccccggcgaggacggctacagaggctaccccggcgacgagggcggccccggcgagagaggcccccccggcgtgaacggcacccagggcttccagggctgccccggccagagaggcgtgaagggcagcagaggcttccccggcgagaagggcgaggtgggcgagatcggcctggacggcctggacggcgaggacggcgacaagggcctgcccggcagcagcggcgagaagggcaaccccggcagaagaggcgacaagggccccagaggcgagaagggcgagagaggcgacgtgggcatcagaggcgaccccggcaaccccggccaggacagccaggagagaggccccaagggcgagaccggcgacctgggccccatgggcgtgcccggcagagacggcgtgcccggcggccccggcgagaccggcaagaacggcggcttcggcagaagaggcccccccggcgccaagggcaacaagggcggccccggccagcccggcttcgagggcgagcagggcaccagaggcgcccagggccccgccggccccgccggcccccccggcctgatcggcgagcagggcatcagcggccccagaggcagcggcggcgccgccggcgcccccggcgagagaggcagaaccggccccctgggcagaaagggcgagcccggcgagcccggccccaagggcggcatcggcaacagaggccccagaggcgagaccggcgacgacggcagagacggcgtgggcagcgagggcagaagaggcaagaagggcgagagaggcttccccggctaccccggccccaagggcaaccccggcgagcccggcctgaacggcaccaccggccccaagggcatcagaggcagaagaggcaacagcggcccccccggcatcgtgggccagaagggcgaccccggctaccccggccccgccggccccaagggcaacagaggcgacagcatcgaccagtgcgccctgatccagagcatcaaggacaagtgcccctgctgctacggccccctggagtgccccgtgttccccaccgagctggccttcgccctggacaccagcgagggcgtgaaccaggacaccttcggcagaatgagagacgtggtgctgagcatcgtgaacgacctgaccatcgccgagagcaactgccccagaggcgccagagtggccgtggtgacctacaacaacgaggtgaccaccgagatcagattcgccgacagcaagagaaagagcgtgctgctggacaagatcaagaacctgcaggtggccctgaccagcaagcagcagagcctggagaccgccatgagcttcgtggccagaaacaccttcaagagagtgagaaacggcttcctgatgagaaaggtggccgtgttcttcagcaacacccccaccagagccagcccccagctgagagaggccgtgctgaagctgagcgacgccggcatcacccccctgttcctgaccagacaggaggacagacagctgatcaacgccctgcagatcaacaacaccgccgtgggccacgccctggtgctgcccgccggcagagacctgaccgacttcctggagaacgtgctgacctgccacgtgtgcctggacatctgcaacatcgaccccagctgcggcttcggcagctggagacccagcttcagagacagaagagccgccggcagcgacgtggacatcgacatggccttcatcctggacagcgccgagaccaccaccctgttccagttcaacgagatgaagaagtacatcgcctacctggtgagacagctggacatgagccccgaccccaaggccagccagcacttcgccagagtggccgtggtgcagcacgcccccagcgagagcgtggacaacgccagcatgccccccgtgaaggtggagttcagcctgaccgactacggcagcaaggagaagctggtggacttcctgagcagaggcatgacccagctgcagggcaccagagccctgggcagcgccatcgagtacaccatcgagaacgtgttcgagagcgcccccaaccccagagacctgaagatcgtggtgctgatgctgaccggcgaggtgcccgagcagcagctggaggaggcccagagagtgatcctgcaggccaagtgcaagggctacttcttcgtggtgctgggcatcggcagaaaggtgaacatcaaggaggtgtacaccttcgccagcgagcccaacgacgtgttcttcaagctggtggacaagagcaccgagctgaacgaggagcccctgatgagattcggcagactgctgcccagcttcgtgagcagcgagaacgccttctacctgagccccgacatcagaaagcagtgcgactggttccagggcgaccagcccaccaagaacctggtgaagttcggccacaagcaggtgaacgtgcccaacaacgtgaccagcagccccaccagcaaccccgtgaccaccaccaagcccgtgaccaccaccaagcccgtgaccaccaccaccaagcccgtgaccaccaccaccaagcccgtgaccatcatcaaccagcccagcgtgaagcccgccgccgccaagcccgcccccgccaagcccgtggccgccaagcccgtggccaccaagatggccaccgtgagaccccccgtggccgtgaagcccgccaccgccgccaagcccgtggccgccaagcccgccgccgtgagaccccccgccgccgccgccgccaagcccgtggccaccaagcccgaggtgcccagaccccaggccgccaagcccgccgccaccaagcccgccaccaccaagcccatggtgaagatgagcagagaggtgcaggtgttcgagatcaccgagaacagcgccaagctgcactgggagagagccgagccccccggcccctacttctacgacctgaccgtgaccagcgcccacgaccagagcctggtgctgaagcagaacctgaccgtgaccgacagagtgatcggcggcctgctggccggccagacctaccacgtggccgtggtgtgctacctgagaagccaggtgagagccacctaccacggcagcttcagcaccaagaagagccagcccccccccccccagcccgccagaagcgccagcagcagcaccatcaacctgatggtgagcaccgagcccctggccctgaccgagaccgacatctgcaagctgcccaaggacgagggcacctgcagagacttcatcctgaagtggtactacgaccccaacaccaagagctgcgccagattctggtacggcggctgcggcggcaacgagaacaagttcggcagccagaaggagtgcgagaaggtgtgcgcccccgtgctggccaagcccggcgtgatcagcgtgatgggcacctag

SEQ ID NO: 1797 - DNA, 8931 bp, Homo sapiens
atgagaaagcacagacacctgcccctggtggccgtgttctgcctgttcctgagcggcttccccaccacccacgcccagcagcagcaggccgacgtgaagaacggcgccgccgccgacatcatcttcctggtggacagcagctggaccatcggcgaggagcacttccagctggtgagagagttcctgtacgacgtggtgaagagcctggccgtgggcgagaacgacttccacttcgccctggtgcagttcaacggcaacccccacaccgagttcctgctgaacacctacagaaccaagcaggaggtgctgagccacatcagcaacatgagctacatcggcggcaccaaccagaccggcaagggcctggagtacatcatgcagagccacctgaccaaggccgccggcagcagagccggcgacggcgtgccccaggtgatcgtggtgctgaccgacggccacagcaaggacggcctggccctgcccagcgccgagctgaagagcgccgacgtgaacgtgttcgccatcggcgtggaggacgccgacgagggcgccctgaaggagatcgccagcgagcccctgaacatgcacatgttcaacctggagaacttcaccagcctgcacgacatcgtgggcaacctggtgagctgcgtgcacagcagcgtgagccccgagagagccggcgacaccgagaccctgaaggacatcaccgtgatcgaggtgaacaagagagacatcgtgttcctggtggacggcagcagcgccctgggcctggccaacttcaacgccatcagagacttcatcgccaaggtgatccagagactggagatcggccaggacctgatccaggtggccgtggcccagtacgccgacaccgtgagacccgagttctacttcaacacccaccccaccaagagagaggtgatcaccgccgtgagaaagatgaagcccctggacggcagcgccctgtacaccggcagcgccctggacttcgtgagaaacaacctgttcaccagcagcgccggctacagagccgccgagggcatccccaagctgctggtgctgatcaccggcggcaagagcctggacgagatcagccagcccgcccaggagctgaagagaagcagcatcatggccttcgccatcggcaacaagggcgccgaccaggccgagctggaggagatcgccttcgacagcagcctggtgttcatccccgccgagttcagagccgcccccctgcagggcatgctgcccggcctgctggcccccctgagaaccctgagcggcacccccgaggtgcacagcaacaagagagacatcatcttcctgctggacggcagcgccaacgtgggcaagaccaacttcccctacgtgagagacttcgtgatgaacctggtgaacagcctggacatcggcaacgacaacatcagagtgggcctggtgcagttcagcgacacccccgtgaccgagttcagcctgaacacctaccagaccaagagcgacatcctgggccacctgagacagctgcagctgcagggcggcagcggcctgaacaccggcagcgccctgagctacgtgtacgccaaccacttcaccgaggccggcggcagcagaatcagagagcacgtgccccagctgctgctgctgctgaccgccggccagagcgaggacagctacctgcaggccgccaacgccctgaccagagccggcatcctgaccttctgcgtgggcgccagccaggccaacaaggccgagctggagcagatcgccttcaaccccagcctggtgtacctgatggacgacttcagcagcctgcccgccctgccccagcagctgatccagcccctgaccacctacgtgagcggcggcgtggaggaggtgcccctggcccagcccgagagcaagagagacatcctgttcctgttcgacggcagcgccaacctggtgggccagttccccgtggtgagagacttcctgtacaagatcatcgacgagctgaacgtgaagcccgagggcaccagaatcgccgtggcccagtacagcgacgacgtgaaggtggagagcagattcgacgagcaccagagcaagcccgagatcctgaacctggtgaagagaatgaagatcaagaccggcaaggccctgaacctgggctacgccctggactacgcccagagatacatcttcgtgaagagcgccggcagcagaatcgaggacggcgtgctgcagttcctggtgctgctggtggccggcagaagcagcgacagagtggacggccccgccagcaacctgaagcagagcggcgtggtgcccttcatcttccaggccaagaacgccgaccccgccgagctggagcagatcgtgctgagccccgccttcatcctggccgccgagagcctgcccaagatcggcgacctgcacccccagatcgtgaacctgctgaagagcgtgcacaacggcgcccccgcccccgtgagcggcgagaaggacgtggtgttcctgctggacggcagcgagggcgtgagaagcggcttccccctgctgaaggagttcgtgcagagagtggtggagagcctggacgtgggccaggacagagtgagagtggccgtggtgcagtacagcgacagaaccagacccgagttctacctgaacagctacatgaacaagcaggacgtggtgaacgccgtgagacagctgaccctgctgggcggccccacccccaacaccggcgccgccctggagttcgtgctgagaaacatcctggtgagcagcgccggcagcagaatcaccgagggcgtgccccagctgctgatcgtgctgaccgccgacagaagcggcgacgacgtgagaaaccccagcgtggtggtgaagagaggcggcgccgtgcccatcggcatcggcatcggcaacgccgacatcaccgagatgcagaccatcagcttcatccccgacttcgccgtggccatccccaccttcagacagctgggcaccgtgcagcaggtgatcagcgagagagtgacccagctgaccagagaggagctgagcagactgcagcccgtgctgcagcccctgcccagccccggcgtgggcggcaagagagacgtggtgttcctgatcgacggcagccagagcgccggccccgagttccagtacgtgagaaccctgatcgagagactggtggactacctggacgtgggcttcgacaccaccagagtggccgtgatccagttcagcgacgaccccaaggtggagttcctgctgaacgcccacagcagcaaggacgaggtgcagaacgccgtgcagagactgagacccaagggcggcagacagatcaacgtgggcaacgccctggagtacgtgagcagaaacatcttcaagagacccctgggcagcagaatcgaggagggcgtgccccagttcctggtgctgatcagcagcggcaagagcgacgacgaggtggacgaccccgccgtggagctgaagcagttcggcgtggcccccttcaccatcgccagaaacgccgaccaggaggagctggtgaagatcagcctgagccccgagtacgtgttcagcgtgagcaccttcagagagctgcccagcctggagcagaagctgctgacccccatcaccaccctgaccagcgagcagatccagaagctgctggccagcaccagataccccccccccgccgtggagagcgacgccgccgacatcgtgttcctgatcgacagcagcgagggcgtgagacccgacggcttcgcccacatcagagacttcgtgagcagaatcgtgagaagactgaacatcggccccagcaaggtgagagtgggcgtggtgcagttcagcaacgacgtgttccccgagttctacctgaagacctacagaagccaggcccccgtgctggacgccatcagaagactgagactgagaggcggcagccccctgaacaccggcaaggccctggagttcgtggccagaaacctgttcgtgaagagcgccggcagcagaatcgaggacggcgtgccccagcacctggtgctggtgctgggcggcaagagccaggacgacgtgagcagattcgcccaggtgatcagaagcagcggcatcgtgagcctgggcgtgggcgacagaaacatcgacagaaccgagctgcagaccatcaccaacgaccccagactggtgttcaccgtgagagagttcagagagctgcccaacatcgaggagagaatcatgaacagcttcggccccagcgccgccacccccgccccccccggcgtggacacccccccccccagcagacccgagaagaagaaggccgacatcgtgttcctgctggacggcagcatcaacttcagaagagacagcttccaggaggtgctgagattcgtgagcgagatcgtggacaccgtgtacgaggacggcgacagcatccaggtgggcctggtgcagtacaacagcgaccccaccgacgagttcttcctgaaggacttcagcaccaagagacagatcatcgacgccatcaacaaggtggtgtacaagggcggcagacacgccaacaccaaggtgggcctggagcacctgagagtgaaccacttcgtgcccgaggccggcagcagactggaccagagagtgccccagatcgccttcgtgatcaccggcggcaagagcgtggaggacgcccaggacgtgagcctggccctgacccagagaggcgtgaaggtgttcgccgtgggcgtgagaaacatcgacagcgaggaggtgggcaagatcgccagcaacagcgccaccgccttcagagtgggcaacgtgcaggagctgagcgagctgagcgagcaggtgctggagaccctgcacgacgccatgcacgagaccctgtgccccggcgtgaccgacgccgccaaggcctgcaacctggacgtgatcctgggcttcgacggcagcagagaccagaacgtgttcgtggcccagaagggcttcgagagcaaggtggacgccatcctgaacagaatcagccagatgcacagagtgagctgcagcggcggcagaagccccaccgtgagagtgagcgtggtggccaacacccccagcggccccgtggaggccttcgacttcgacgagtaccagcccgagatgctggagaagttcagaaacatgagaagccagcacccctacgtgctgaccgaggacaccctgaaggtgtacctgaacaagttcagacagagcagccccgacagcgtgaaggtggtgatccacttcaccgacggcgccgacggcgacctggccgacctgcacagagccagcgagaacctgagacaggagggcgtgagagccctgatcctggtgggcctggagagagtggtgaacctggagagactgatgcacctggagttcggcagaggcttcatgtacgacagacccctgagactgaacctgctggacctggactacgagctggccgagcagctggacaacatcgccgagaaggcctgctgcggcgtgccctgcaagtgcagcggccagagaggcgacagaggccccatcggcagcatcggccccaagggcatccccggcgaggacggctacagaggctaccccggcgacgagggcggccccggcgagagaggcccccccggcgtgaacggcacccagggcttccagggctgccccggccagagaggcgtgaagggcagcagaggcttccccggcgagaagggcgaggtgggcgagatcggcctggacggcctggacggcgaggacggcgacaagggcctgcccggcagcagcggcgagaagggcaaccccggcagaagaggcgacaagggccccagaggcgagaagggcgagagaggcgacgtgggcatcagaggcgaccccggcaaccccggccaggacagccaggagagaggccccaagggcgagaccggcgacctgggccccatgggcgtgcccggcagagacggcgtgcccggcggccccggcgagaccggcaagaacggcggcttcggcagaagaggcccccccggcgccaagggcaacaagggcggccccggccagcccggcttcgagggcgagcagggcaccagaggcgcccagggccccgccggccccgccggcccccccggcctgatcggcgagcagggcatcagcggccccagaggcagcggcggcgccgccggcgcccccggcgagagaggcagaaccggccccctgggcagaaagggcgagcccggcgagcccggccccaagggcggcatcggcaacagaggccccagaggcgagaccggcgacgacggcagagacggcgtgggcagcgagggcagaagaggcaagaagggcgagagaggcttccccggctaccccggccccaagggcaaccccggcgagcccggcctgaacggcaccaccggccccaagggcatcagaggcagaagaggcaacagcggcccccccggcatcgtgggccagaagggcgaccccggctaccccggccccgccggccccaagggcaacagaggcgacagcatcgaccagtgcgccctgatccagagcatcaaggacaagtgcccctgctgctacggccccctggagtgccccgtgttccccaccgagctggccttcgccctggacaccagcgagggcgtgaaccaggacaccttcggcagaatgagagacgtggtgctgagcatcgtgaacgacctgaccatcgccgagagcaactgccccagaggcgccagagtggccgtggtgacctacaacaacgaggtgaccaccgagatcagattcgccgacagcaagagaaagagcgtgctgctggacaagatcaagaacctgcaggtggccctgaccagcaagcagcagagcctggagaccgccatgagcttcgtggccagaaacaccttcaagagagtgagaaacggcttcctgatgagaaaggtggccgtgttcttcagcaacacccccaccagagccagcccccagctgagagaggccgtgctgaagctgagcgacgccggcatcacccccctgttcctgaccagacaggaggacagacagctgatcaacgccctgcagatcaacaacaccgccgtgggccacgccctggtgctgcccgccggcagagacctgaccgacttcctggagaacgtgctgacctgccacgtgtgcctggacatctgcaacatcgaccccagctgcggcttcggcagctggagacccagcttcagagacagaagagccgccggcagcgacgtggacatcgacatggccttcatcctggacagcgccgagaccaccaccctgttccagttcaacgagatgaagaagtacatcgcctacctggtgagacagctggacatgagccccgaccccaaggccagccagcacttcgccagagtggccgtggtgcagcacgcccccagcgagagcgtggacaacgccagcatgccccccgtgaaggtggagttcagcctgaccgactacggcagcaaggagaagctggtggacttcctgagcagaggcatgacccagctgcagggcaccagagccctgggcagcgccatcgagtacaccatcgagaacgtgttcgagagcgcccccaaccccagagacctgaagatcgtggtgctgatgctgaccggcgaggtgcccgagcagcagctggaggaggcccagagagtgatcctgcaggccaagtgcaagggctacttcttcgtggtgctgggcatcggcagaaaggtgaacatcaaggaggtgtacaccttcgccagcgagcccaacgacgtgttcttcaagctggtggacaagagcaccgagctgaacgaggagcccctgatgagattcggcagactgctgcccagcttcgtgagcagcgagaacgccttctacctgagccccgacatcagaaagcagtgcgactggttccagggcgaccagcccaccaagaacctggtgaagttcggccacaagcaggtgaacgtgcccaacaacgtgaccagcagccccaccagcaaccccgtgaccaccaccaagcccgtgaccaccaccaagcccgtgaccaccaccaccaagcccgtgaccaccaccaccaagcccgtgaccatcatcaaccagcccagcgtgaagcccgccgccgccaagcccgcccccgccaagcccgtggccgccaagcccgtggccaccaagatggccaccgtgagaccccccgtggccgtgaagcccgccaccgccgccaagcccgtggccgccaagcccgccgccgtgagaccccccgccgccgccgccgccaagcccgtggccaccaagcccgaggtgcccagaccccaggccgccaagcccgccgccaccaagcccgccaccaccaagcccatggtgaagatgagcagagaggtgcaggtgttcgagatcaccgagaacagcgccaagctgcactgggagagagccgagccccccggcccctacttctacgacctgaccgtgaccagcgcccacgaccagagcctggtgctgaagcagaacctgaccgtgaccgacagagtgatcggcggcctgctggccggccagacctaccacgtggccgtggtgtgctacctgagaagccaggtgagagccacctaccacggcagcttcagcaccaagaagagccagcccccccccccccagcccgccagaagcgccagcagcagcaccatcaacctgatggtgagcaccgagcccctggccctgaccgagaccgacatctgcaagctgcccaaggacgagggcacctgcagagacttcatcctgaagtggtactacgaccccaacaccaagagctgcgccagattctggtacggcggctgcggcggcaacgagaacaagttcggcagccagaaggagtgcgagaaggtgtgcgcccccgtgctggccaagcccggcgtgatcagcgtgatgggcacctag

SEQ ID NO: 1798 - DNA, 8916 bp, Homo sapiens
atgagaaagcacagacacctgcccctggtggccgtgttctgcctgttcctgagcggcttccccaccacccacgcccagcagcagcaggccgcccaggacagcgccgacatcatcttcctgatcgacggcagcaacaacaccggcagcgtgaacttcgccgtgatcctggacttcctggtgaacctgctggagaagctgcccatcggcacccagcagatcagagtgggcgtggtgcagttcagcgacgagcccagaaccatgttcagcctggacacctacagcaccaaggcccaggtgctgggcgccgtgaaggccctgggcttcgccggcggcgagctggccaacatcggcctggccctggacttcgtggtggagaaccacttcaccagagccggcggcagcagagtggaggagggcgtgccccaggtgctggtgctgatcagcgccggccccagcagcgacgagatcagatacggcgtggtggccctgaagcaggccagcgtgttcagcttcggcctgggcgcccaggccgccagcagagccgagctgcagcacatcgccaccgacgacaacctggtgttcaccgtgcccgagttcagaagcttcggcgacctgcaggagaagctgctgccctacatcgtgggcgtggcccagagacacatcgtgctgaagccccccaccatcgtgacccaggtgatcgaggtgaacaagagagacatcgtgttcctggtggacggcagcagcgccctgggcctggccaacttcaacgccatcagagacttcatcgccaaggtgatccagagactggagatcggccaggacctgatccaggtggccgtggcccagtacgccgacaccgtgagacccgagttctacttcaacacccaccccaccaagagagaggtgatcaccgccgtgagaaagatgaagcccctggacggcagcgccctgtacaccggcagcgccctggacttcgtgagaaacaacctgttcaccagcagcgccggctacagagccgccgagggcatccccaagctgctggtgctgatcaccggcggcaagagcctggacgagatcagccagcccgcccaggagctgaagagaagcagcatcatggccttcgccatcggcaacaagggcgccgaccaggccgagctggaggagatcgccttcgacagcagcctggtgttcatccccgccgagttcagagccgcccccctgcagggcatgctgcccggcctgctggcccccctgagaaccctgagcggcacccccgaggtgcacagcaacaagagagacatcatcttcctgctggacggcagcgccaacgtgggcaagaccaacttcccctacgtgagagacttcgtgatgaacctggtgaacagcctggacatcggcaacgacaacatcagagtgggcctggtgcagttcagcgacacccccgtgaccgagttcagcctgaacacctaccagaccaagagcgacatcctgggccacctgagacagctgcagctgcagggcggcagcggcctgaacaccggcagcgccctgagctacgtgtacgccaaccacttcaccgaggccggcggcagcagaatcagagagcacgtgccccagctgctgctgctgctgaccgccggccagagcgaggacagctacctgcaggccgccaacgccctgaccagagccggcatcctgaccttctgcgtgggcgccagccaggccaacaaggccgagctggagcagatcgccttcaaccccagcctggtgtacctgatggacgacttcagcagcctgcccgccctgccccagcagctgatccagcccctgaccacctacgtgagcggcggcgtggaggaggtgcccctggcccagcccgagagcaagagagacatcctgttcctgttcgacggcagcgccaacctggtgggccagttccccgtggtgagagacttcctgtacaagatcatcgacgagctgaacgtgaagcccgagggcaccagaatcgccgtggcccagtacagcgacgacgtgaaggtggagagcagattcgacgagcaccagagcaagcccgagatcctgaacctggtgaagagaatgaagatcaagaccggcaaggccctgaacctgggctacgccctggactacgcccagagatacatcttcgtgaagagcgccggcagcagaatcgaggacggcgtgctgcagttcctggtgctgctggtggccggcagaagcagcgacagagtggacggccccgccagcaacctgaagcagagcggcgtggtgcccttcatcttccaggccaagaacgccgaccccgccgagctggagcagatcgtgctgagccccgccttcatcctggccgccgagagcctgcccaagatcggcgacctgcacccccagatcgtgaacctgctgaagagcgtgcacaacggcgcccccgcccccgtgagcggcgagaaggacgtggtgttcctgctggacggcagcgagggcgtgagaagcggcttccccctgctgaaggagttcgtgcagagagtggtggagagcctggacgtgggccaggacagagtgagagtggccgtggtgcagtacagcgacagaaccagacccgagttctacctgaacagctacatgaacaagcaggacgtggtgaacgccgtgagacagctgaccctgctgggcggccccacccccaacaccggcgccgccctggagttcgtgctgagaaacatcctggtgagcagcgccggcagcagaatcaccgagggcgtgccccagctgctgatcgtgctgaccgccgacagaagcggcgacgacgtgagaaaccccagcgtggtggtgaagagaggcggcgccgtgcccatcggcatcggcatcggcaacgccgacatcaccgagatgcagaccatcagcttcatccccgacttcgccgtggccatccccaccttcagacagctgggcaccgtgcagcaggtgatcagcgagagagtgacccagctgaccagagaggagctgagcagactgcagcccgtgctgcagcccctgcccagccccggcgtgggcggcaagagagacgtggtgttcctgatcgacggcagccagagcgccggccccgagttccagtacgtgagaaccctgatcgagagactggtggactacctggacgtgggcttcgacaccaccagagtggccgtgatccagttcagcgacgaccccaaggtggagttcctgctgaacgcccacagcagcaaggacgaggtgcagaacgccgtgcagagactgagacccaagggcggcagacagatcaacgtgggcaacgccctggagtacgtgagcagaaacatcttcaagagacccctgggcagcagaatcgaggagggcgtgccccagttcctggtgctgatcagcagcggcaagagcgacgacgaggtggacgaccccgccgtggagctgaagcagttcggcgtggcccccttcaccatcgccagaaacgccgaccaggaggagctggtgaagatcagcctgagccccgagtacgtgttcagcgtgagcaccttcagagagctgcccagcctggagcagaagctgctgacccccatcaccaccctgaccagcgagcagatccagaagctgctggccagcaccagataccccccccccgccgtggagagcgacgccgccgacatcgtgttcctgatcgacagcagcgagggcgtgagacccgacggcttcgcccacatcagagacttcgtgagcagaatcgtgagaagactgaacatcggccccagcaaggtgagagtgggcgtggtgcagttcagcaacgacgtgttccccgagttctacctgaagacctacagaagccaggcccccgtgctggacgccatcagaagactgagactgagaggcggcagccccctgaacaccggcaaggccctggagttcgtggccagaaacctgttcgtgaagagcgccggcagcagaatcgaggacggcgtgccccagcacctggtgctggtgctgggcggcaagagccaggacgacgtgagcagattcgcccaggtgatcagaagcagcggcatcgtgagcctgggcgtgggcgacagaaacatcgacagaaccgagctgcagaccatcaccaacgaccccagactggtgttcaccgtgagagagttcagagagctgcccaacatcgaggagagaatcatgaacagcttcggccccagcgccgccacccccgccccccccggcgtggacacccccccccccagcagacccgagaagaagaaggccgacatcgtgttcctgctggacggcagcatcaacttcagaagagacagcttccaggaggtgctgagattcgtgagcgagatcgtggacaccgtgtacgaggacggcgacagcatccaggtgggcctggtgcagtacaacagcgaccccaccgacgagttcttcctgaaggacttcagcaccaagagacagatcatcgacgccatcaacaaggtggtgtacaagggcggcagacacgccaacaccaaggtgggcctggagcacctgagagtgaaccacttcgtgcccgaggccggcagcagactggaccagagagtgccccagatcgccttcgtgatcaccggcggcaagagcgtggaggacgcccaggacgtgagcctggccctgacccagagaggcgtgaaggtgttcgccgtgggcgtgagaaacatcgacagcgaggaggtgggcaagatcgccagcaacagcgccaccgccttcagagtgggcaacgtgcaggagctgagcgagctgagcgagcaggtgctggagaccctgcacgacgccatgcacgagaccctgtgccccggcgtgaccgacgccgccaaggcctgcaacctggacgtgatcctgggcttcgacggcagcagagaccagaacgtgttcgtggcccagaagggcttcgagagcaaggtggacgccatcctgaacagaatcagccagatgcacagagtgagctgcagcggcggcagaagccccaccgtgagagtgagcgtggtggccaacacccccagcggccccgtggaggccttcgacttcgacgagtaccagcccgagatgctggagaagttcagaaacatgagaagccagcacccctacgtgctgaccgaggacaccctgaaggtgtacctgaacaagttcagacagagcagccccgacagcgtgaaggtggtgatccacttcaccgacggcgccgacggcgacctggccgacctgcacagagccagcgagaacctgagacaggagggcgtgagagccctgatcctggtgggcctggagagagtggtgaacctggagagactgatgcacctggagttcggcagaggcttcatgtacgacagacccctgagactgaacctgctggacctggactacgagctggccgagcagctggacaacatcgccgagaaggcctgctgcggcgtgccctgcaagtgcagcggccagagaggcgacagaggccccatcggcagcatcggccccaagggcatccccggcgaggacggctacagaggctaccccggcgacgagggcggccccggcgagagaggcccccccggcgtgaacggcacccagggcttccagggctgccccggccagagaggcgtgaagggcagcagaggcttccccggcgagaagggcgaggtgggcgagatcggcctggacggcctggacggcgaggacggcgacaagggcctgcccggcagcagcggcgagaagggcaaccccggcagaagaggcgacaagggccccagaggcgagaagggcgagagaggcgacgtgggcatcagaggcgaccccggcaaccccggccaggacagccaggagagaggccccaagggcgagaccggcgacctgggccccatgggcgtgcccggcagagacggcgtgcccggcggccccggcgagaccggcaagaacggcggcttcggcagaagaggcccccccggcgccaagggcaacaagggcggccccggccagcccggcttcgagggcgagcagggcaccagaggcgcccagggccccgccggccccgccggcccccccggcctgatcggcgagcagggcatcagcggccccagaggcagcggcggcgccgccggcgcccccggcgagagaggcagaaccggccccctgggcagaaagggcgagcccggcgagcccggccccaagggcggcatcggcaacagaggccccagaggcgagaccggcgacgacggcagagacggcgtgggcagcgagggcagaagaggcaagaagggcgagagaggcttccccggctaccccggccccaagggcaaccccggcgagcccggcctgaacggcaccaccggccccaagggcatcagaggcagaagaggcaacagcggcccccccggcatcgtgggccagaagggcgaccccggctaccccggccccgccggccccaagggcaacagaggcgacagcatcgaccagtgcgccctgatccagagcatcaaggacaagtgcccctgctgctacggccccctggagtgccccgtgttccccaccgagctggccttcgccctggacaccagcgagggcgtgaaccaggacaccttcggcagaatgagagacgtggtgctgagcatcgtgaacgacctgaccatcgccgagagcaactgccccagaggcgccagagtggccgtggtgacctacaacaacgaggtgaccaccgagatcagattcgccgacagcaagagaaagagcgtgctgctggacaagatcaagaacctgcaggtggccctgaccagcaagcagcagagcctggagaccgccatgagcttcgtggccagaaacaccttcaagagagtgagaaacggcttcctgatgagaaaggtggccgtgttcttcagcaacacccccaccagagccagcccccagctgagagaggccgtgctgaagctgagcgacgccggcatcacccccctgttcctgaccagacaggaggacagacagctgatcaacgccctgcagatcaacaacaccgccgtgggccacgccctggtgctgcccgccggcagagacctgaccgacttcctggagaacgtgctgacctgccacgtgtgcctggacatctgcaacatcgaccccagctgcggcttcggcagctggagacccagcttcagagacagaagagccgccggcagcgacgtggacatcgacatggccttcatcctggacagcgccgagaccaccaccctgttccagttcaacgagatgaagaagtacatcgcctacctggtgagacagctggacatgagccccgaccccaaggccagccagcacttcgccagagtggccgtggtgcagcacgcccccagcgagagcgtggacaacgccagcatgccccccgtgaaggtggagttcagcctgaccgactacggcagcaaggagaagctggtggacttcctgagcagaggcatgacccagctgcagggcaccagagccctgggcagcgccatcgagtacaccatcgagaacgtgttcgagagcgcccccaaccccagagacctgaagatcgtggtgctgatgctgaccggcgaggtgcccgagcagcagctggaggaggcccagagagtgatcctgcaggccaagtgcaagggctacttcttcgtggtgctgggcatcggcagaaaggtgaacatcaaggaggtgtacaccttcgccagcgagcccaacgacgtgttcttcaagctggtggacaagagcaccgagctgaacgaggagcccctgatgagattcggcagactgctgcccagcttcgtgagcagcgagaacgccttctacctgagccccgacatcagaaagcagtgcgactggttccagggcgaccagcccaccaagaacctggtgaagttcggccacaagcaggtgaacgtgcccaacaacgtgaccagcagccccaccagcaaccccgtgaccaccaccaagcccgtgaccaccaccaagcccgtgaccaccaccaccaagcccgtgaccaccaccaccaagcccgtgaccatcatcaaccagcccagcgtgaagcccgccgccgccaagcccgcccccgccaagcccgtggccgccaagcccgtggccaccaagatggccaccgtgagaccccccgtggccgtgaagcccgccaccgccgccaagcccgtggccgccaagcccgccgccgtgagaccccccgccgccgccgccgccaagcccgtggccaccaagcccgaggtgcccagaccccaggccgccaagcccgccgccaccaagcccgccaccaccaagcccatggtgaagatgagcagagaggtgcaggtgttcgagatcaccgagaacagcgccaagctgcactgggagagagccgagccccccggcccctacttctacgacctgaccgtgaccagcgcccacgaccagagcctggtgctgaagcagaacctgaccgtgaccgacagagtgatcggcggcctgctggccggccagacctaccacgtggccgtggtgtgctacctgagaagccaggtgagagccacctaccacggcagcttcagcaccaagaagagccagcccccccccccccagcccgccagaagcgccagcagcagcaccatcaacctgatggtgagcaccgagcccctggccctgaccgagaccgacatctgcaagctgcccaaggacgagggcacctgcagagacttcatcctgaagtggtactacgaccccaacaccaagagctgcgccagattctggtacggcggctgcggcggcaacgagaacaagttcggcagccagaaggagtgcgagaaggtgtgcgcccccgtgctggccaagcccggcgtgatcagcgtgatgggcacctag

SEQ ID NO: 1799 - DNA, 3111 bp, Homo sapiens
atgagaaagcacagacacctgcccctggtggccgtgttctgcctgttcctgagcggcttccccaccacccacgcccagcagcagcaggccgtgatcgaggtgaacaagagagacatcgtgttcctggtggacggcagcagcgccctgggcctggccaacttcaacgccatcagagacttcatcgccaaggtgatccagagactggagatcggccaggacctgatccaggtggccgtggcccagtacgccgacaccgtgagacccgagttctacttcaacacccaccccaccaagagagaggtgatcaccgccgtgagaaagatgaagcccctggacggcagcgccctgtacaccggcagcgccctggacttcgtgagaaacaacctgttcaccagcagcgccggctacagagccgccgagggcatccccaagctgctggtgctgatcaccggcggcaagagcctggacgagatcagccagcccgcccaggagctgaagagaagcagcatcatggccttcgccatcggcaacaagggcgccgaccaggccgagctggaggagatcgccttcgacagcagcctggtgttcatccccgccgagttcagagccgcccccctgcagggcatgctgcccggcctgctggcccccctgagaaccctgagcggcacccccgaggtgcacagcaacaagagagacatcatcttcctgctggacggcagcgccaacgtgggcaagaccaacttcccctacgtgagagacttcgtgatgaacctggtgaacagcctggacatcggcaacgacaacatcagagtgggcctggtgcagttcagcgacacccccgtgaccgagttcagcctgaacacctaccagaccaagagcgacatcctgggccacctgagacagctgcagctgcagggcggcagcggcctgaacaccggcagcgccctgagctacgtgtacgccaaccacttcaccgaggccggcggcagcagaatcagagagcacgtgccccagctgctgctgctgctgaccgccggccagagcgaggacagctacctgcaggccgccaacgccctgaccagagccggcatcctgaccttctgcgtgggcgccagccaggccaacaaggccgagctggagcagatcgccttcaaccccagcctggtgtacctgatggacgacttcagcagcctgcccgccctgccccagcagctgatccagcccctgaccacctacgtgagcggcggcgtggaggaggtgcccctggcccagcccgagagcaagagagacatcctgttcctgttcgacggcagcgccaacctggtgggccagttccccgtggtgagagacttcctgtacaagatcatcgacgagctgaacgtgaagcccgagggcaccagaatcgccgtggcccagtacagcgacgacgtgaaggtggagagcagattcgacgagcaccagagcaagcccgagatcctgaacctggtgaagagaatgaagatcaagaccggcaaggccctgaacctgggctacgccctggactacgcccagagatacatcttcgtgaagagcgccggcagcagaatcgaggacggcgtgctgcagttcctggtgctgctggtggccggcagaagcagcgacagagtggacggccccgccagcaacctgaagcagagcggcgtggtgcccttcatcttccaggccaagaacgccgaccccgccgagctggagcagatcgtgctgagccccgccttcatcctggccgccgagagcctgcccaagatcggcgacctgcacccccagatcgtgaacctgctgaagagcgtgcacaacggcgcccccgcccccgtgagcggcgagaaggacgtggtgttcctgctggacggcagcgagggcgtgagaagcggcttccccctgctgaaggagttcgtgcagagagtggtggagagcctggacgtgggccaggacagagtgagagtggccgtggtgcagtacagcgacagaaccagacccgagttctacctgaacagctacatgaacaagcaggacgtggtgaacgccgtgagacagctgaccctgctgggcggccccacccccaacaccggcgccgccctggagttcgtgctgagaaacatcctggtgagcagcgccggcagcagaatcaccgagggcgtgccccagctgctgatcgtgctgaccgccgacagaagcggcgacgacgtgagaaaccccagcgtggtggtgaagagaggcggcgccgtgcccatcggcatcggcatcggcaacgccgacatcaccgagatgcagaccatcagcttcatccccgacttcgccgtggccatccccaccttcagacagctgggcaccgtgcagcaggtgatcagcgagagagtgacccagctgaccagagaggagctgagcagactgcagcccgtgctgcagcccctgcccagccccggcgtgggcggcaagagagacgtggtgttcctgatcgacggcagccagagcgccggccccgagttccagtacgtgagaaccctgatcgagagactggtggactacctggacgtgggcttcgacaccaccagagtggccgtgatccagttcagcgacgaccccaaggtggagttcctgctgaacgcccacagcagcaaggacgaggtgcagaacgccgtgcagagactgagacccaagggcggcagacagatcaacgtgggcaacgccctggagtacgtgagcagaaacatcttcaagagacccctgggcagcagaatcgaggagggcgtgccccagttcctggtgctgatcagcagcggcaagagcgacgacgaggtggacgaccccgccgtggagctgaagcagttcggcgtggcccccttcaccatcgccagaaacgccgaccaggaggagctggtgaagatcagcctgagccccgagtacgtgttcagcgtgagcaccttcagagagctgcccagcctggagcagaagctgctgacccccatcaccaccctgaccagcgagcagatccagaagctgctggccagcaccagataccccccccccggcgagatgggcgccagcgaggtgctgctgggcgccttcagcatctag

SEQ ID NO: 1800 - DNA, 8916 bp, Homo sapiens; identical to SEQ ID NO: 1798

SEQ ID NO: 1801 - DNA, 7848 bp, Homo sapiens
atgaagatcctgctgatcatcttcgtgctgatcatctggaccgagaccctggccgaccagagccccggccccggccccgtgtacgccgacgtggtgttcctggtggacagcagcgaccacctgggccccaagagcttccccttcgtgaagaccttcatcaacaagatgatcaacagcctgcccatcgaggccaacaagtacagagtggccctggcccagtacagcgacgagttccacagcgagttccacctgagcaccttcaagggcagaagccccatgctgaaccacctgaagaagaacttccagttcatcggcggcagcctgcagatcggcaaggccctgcaggaggcccacagaacctacttcagcgcccccatcaacggcagagacagaaagcagttcccccccatcctggtggtgctggccagcgccgagagcgaggacgaggtggaggaggccagcaaggccctgcagaaggacggcgtgaagatcatcagcgtgggcgtgcagaaggccagcgaggagaacctgaaggccatggccaccagccacttccacttcaacctgagaaccatcagagacctgagcaccttcagccagaacatgacccagatcatcaaggacgtgaccaagtacaaggagggcgccgtggacgccgacatgcaggtgcacttccccatcagctgccagaaggacagcctggccgacctggtgttcctggtggacgagagcctgggcaccggcggcaacctgagacacctgcagaccttcctggagaacatcaccagcagcatggacgtgaaggagaactgcatgagactgggcctgatgagctacagcaacagcgccaagaccatcagcttcctgaagagcagcaccacccagagcgagttccagcagcagatcaagaacctgagcatccaggtgggcaagagcaacaccggcgccgccatcgaccagatgagaagagacggcttcagcgagagctacggcagcagaagagcccagggcgtgccccagatcgccgtgctggtgacccacagacccagcgacgacgaggtgcacgacgccgccctgaacctgagactggaggacgtgaacgtgttcgccctgagcatccagggcgccaacaacacccagctggaggagatcgtgagctacccccccgagcagaccatcagcaccctgaagagctacgccgacctggagacctacagcaccaagttcctgaagaagctgcagaacgagatctggagccagatcagcacctacgccgagcagagaaacctggacaagaccggctgcgtggacaccaaggaggccgacatccacttcctgatcgacggcagcagcagcatccaggagaagcagttcgagcagatcaagagattcatgctggaggtgaccgagatgttcagcatcggccccgacaaggtgagagtgggcgtggtgcagtacagcgacgacaccgaggtggagttctacatcaccgactacagcaacgacatcgacctgagaaaggccatcttcaacatcaagcagctgaccggcggcacctacaccggcaaggccctggactacatcctgcagatcatcaagaacggcatgaaggacagaatgagcaaggtgccctgctacctgatcgtgctgaccgacggcatgagcaccgacagagtggtggagcccgccaagagactgagagccgagcagatcaccgtgcacgccgtgggcatcggcgccgccaacaagatcgagctgcaggagatcgccggcaaggaggagagagtgagcttcggccagaacttcgacgccctgaagagcatcaagaacgaggtggtgagagagatctgcgccgagaagggctgcgaggacatgaaggccgacatcatgttcctggtggacagcagctggagcatcggcaacgagaacttcagaaagatgaagatcttcatgaagaacctgctgaccaagatccagatcggcgccgacaagacccagatcggcgtggtgcagttcagcgacaagaccaaggaggagttccagctgaacagatacttcacccagcaggagatcagcgacgccatcgacagaatgagcctgatcaacgagggcaccctgaccggcaaggccctgaacttcgtgggccagtacttcacccacagcaagggcgccagactgggcgccaagaagttcctgatcctgatcaccgacggcgtggcccaggacgacgtgagagaccccgccagaatcctgagaggcaaggacgtgaccatcttcagcgtgggcgtgtacaacgccaacagaagccagctggaggagatcagcggcgacagcagcctggtgttccacgtggagaacttcgaccacctgaaggccctggagagaaagctgatcttcagagtgtgcgccctgcacgactgcaagagaatcaccctgctggacgtggtgttcgtgctggaccacagcggcagcatcaagaagcagtaccaggaccacatgatcaacctgaccatccacctggtgaagaaggccgacgtgggcagagacagagtgcagttcggcgccctgaagtacagcgaccagcccaacatcctgttctacctgaacacctacagcaacagaagcgccatcatcgagaacctgagaaagagaagagacaccggcggcaacacctacaccgccaaggccctgaagcacgccaacgccctgttcaccgaggagcacggcagcagaatcaagcagaacgtgaagcagatgctgatcgtgatcaccgacggcgagagccacgaccacgaccagctgaacgacaccgccctggagctgagaaacaagggcatcaccatcttcgccgtgggcgtgggcaaggccaaccagaaggagctggagggcatggccggcaacaagaacaacaccatctacgtggacaacttcgacaagctgaaggacgtgttcaccctggtgcaggagagaatgtgcaccgaggcccccgaggtgtgccacctgcaggaggccgacgtgatcttcctgtgcgacggcagcgacagagtgagcaacagcgacttcgtgaccatgaccaccttcctgagcgacctgatcgacaacttcgacatccagagccagagaatgaagatcggcatggcccagttcggcagcaactaccagagcatcatcgagctgaagaacagcctgaccaagacccagtggaagacccagatccagaacgtgagcaagagcggcggcttccccagaatcgacttcgccctgaagaaggtgagcaacatgttcaacctgcacgccggcggcagaagaaacgccggcgtgccccagaccctggtggtgatcaccagcggcgaccccagatacgacgtggccgacgccgtgaagaccctgaaggacctgggcatctgcgtgctggtgctgggcatcggcgacgtgtacaaggagcacctgctgcccatcaccggcaacagcgagaagatcatcaccttccaggacttcgacaagctgaagaacgtggacgtgaagaagagaatcatcagagagatctgccagagctgcggcaagaccaactgcttcatggacatcgtggtgggcttcgacatcagcacccacgtgcagggccagcccctgttccagggccacccccagctggagagctacctgcccggcatcctggaggacatcagcagcatcaagggcgtgagctgcggcgccggcaccgaggcccaggtgagcctggccttcaaggtgaacagcgaccagggcttccccgccaagttccagatctaccagaaggccgtgttcgacagcctgctgcaggtgaacgtgagcggccccacccacctgaacgcccagttcctgagaagcctgtgggacaccttcaaggacaagagcgccagcagaggccaggtgctgctgatcttcagcgacggcctgcagagcgagagcaacatcatgctggagaaccagagcgacagactgagagaggccggcctggacgccctgctggtggtgagcctgaacaccaccgcccaccacgagttcagcagcttcgagttcggcaagagattcgactacagaacccacctgaccatcggcatgagagagctgggcaagaagctgagccagtacctgggcaacatcgccgagagaacctgctgctgcaccttctgcaagtgccccggcatccccggcccccacggcaccagaggcctgcaggccatgaagggcagccagggcctgaagggcagcagaggccacagaggcgaggacggcaaccccggcgtgagaggcgacaccggcccccagggcgacaagggcatcgccggctgccccggcgcctggggccagaagggcctgaagggcttcagcggccccaagggcggccacggcgacgacggcatcgacggcctggacggcgaggagggctgccacggcttccccggcatcaagggcgagaagggcgaccccggcagccagggcagccccggcagcagaggcgcccccggccagtacggcgagaagggcttccccggcgaccccggcaaccccggccagaacaacaacatcaagggccagaagggcagcaagggcgagcagggcagacagggcagaagcggccagaagggcgtgcagggcagccccagcagcagaggcagcagaggcagagagggccagagaggcctgagaggcgtgagcggcgagcccggcaaccccggccccaccggcaccctgggcgccgagggcctgcagggcccccagggcagccagggcaaccccggcagaaagggcgagaagggcagccagggccagaagggcccccagggcagccccggcctgatgggcgccaagggcagcaccggcagacccggcctgctgggcaagaagggcgagcccggcctgcccggcgacctgggccccgtgggccagaccggccagagaggcagacagggcgacagcggcatccccggctacggccagatgggcagaaagggcgtgaagggccccagaggcttccccggcgacgccggccagaagggcgacatcggcaaccccggcatccccggcggccccggccccaagggcttcagaggcctggccctgaccgtgggcctgaagggcgaggagggcagcagaggcctgcccggcccccccggccagagaggcatcaagggcatggccggccagcccgtgtacagccagtgcgacctgatcagattcctgagagagcacagcctgtgcagcctggagaagtgccccgcctaccccaccgagctggtgttcgccctggacaacagctacgacgtgaccgaggagagcttcaacaagaccagagacatcatcaccagcatcgtgaacgacctgaacatcagagagaacaactgccccgtgggcgccagagtggccatggtgagctacaacagcggcaccagctacctgatcagatggagcgactacaacagaaagaagcagctgctgcagcagctgagccagatcaagtaccaggacaccaccgagcccagagacgtgggcaacgccatgagattcgtgaccagaaacgtgttcaagagaacctacgccggcgccaacgtgagaagagtggccgtgttcttcagcaacggccagaccgccagcagaagcagcatcatcaccgccaccatggagttcagcgccctggacatcagccccaccgtgttcgccttcgacgagagagtgttcctggaggccttcggcttcgacaacaccggcaccttccaggtgatccccgtgccccccaacggcgagaaccagaccctggagagactgagaagatgcgccctgtgctacgacaagtgcttccccaacgcctgcatcagagaggccttcctgcccgaggacagctacatggacgtggtgttcctgatcgacaacagcagaaacatcgccaaggacgagttcaaggccgtgaaggccctggtgagcagcgtgatcgacaacttcaacatcgccagcgaccccctgatcagcgacagcggcgacagaatcgccctgctgagctacagcccctgggagagcagcagaagaaagatgggcaccgtgaagaccgagttcgacttcatcacctacgacaaccagctgctgatgaagaaccacatccagaccagcttccagcagctgaacggcgaggccaccatcggcagagccctgctgtggaccaccgagaacctgttccccgagaccccctacctgagaaagcacaaggtgatcttcgtggtgagcgccggcgagaactacgagagaaaggagttcgtgaagatgatggccctgagagccaagtgccagggctacgtgatcttcgtgatcagcctgggcagcaccagaaaggacgacatggaggagctggccagctaccccctggaccagcacctgatccagctgggcagaatccacaagcccgacctgaactacatcgccaagttcctgaagcccttcctgtacagcgtgagaagaggcttcaaccagtaccccccccccatgctggaggacgcctgcagactgatcaacctgggcggcgagaacatccagaacgacggcttccagttcgtgaccgagctgcaggaggacttcctgggcggcaacggcttcatcggccaggagctgaacagcggcagagagagccccttcgtgaagaccgaggacaacggcagcgactacctggtgtacctgcccagccagatgttcgagccccagaagctgatgatcaactacgagaaggaccagaagagcgccgagatcgccagcctgaccagcggccacgagaactacggcagaaaggaggagcccgaccacacctacgagcccggcgacgtgagcctgcaggagtactacatggacgtggccttcctgatcgacgccagccagagagtgggcagcgacgagttcaaggaggtgaaggccttcatcaccagcgtgctggactacttccacatcgcccccacccccctgaccagcaccctgggcgacagagtggccgtgctgagctacagcccccccggctacatgcccaacaccgaggagtgccccgtgtacctggagttcgacctggtgacctacaacagcatccaccagatgaagcaccacctgcaggacagccagcagctgaacggcgacgtgttcatcggccacgccctgcagtggaccatcgacaacgtgttcgtgggcacccccaacctgagaaagaacaaggtgatcttcgtgatcagcgccggcgagaccaacagcctggacaaggacgtgctgagaaacgtgagcctgagagccaagtgccagggctacagcatcttcgtgttcagcttcggccccaagcacaacgacaaggagctggaggagctggccagccaccccctggaccaccacctggtgcagctgggcagaacccacaagcccgactggaactacatcatcaagttcgtgaagcccttcgtgcacctgatcagaagagccatcaacaagtaccccaccgaggacatgaaggccacctgcgtgaacatgaccagccccaaccccgagaacggcggcaccgagaacaccgtgctgctgctgcccggcatctacgagatcaagaccgagaacggcgacctgttcgacgagttcgacagccaggcccagcacctgctggtgctgggcaacaaccacagcagcggcagcgagaccgccaccgacctgatgcagaagctgtacctgctgttcagcaccgagaagctggccatgaaggacaaggagaaggcccacctggaggagatcagcgccctggtggtggacaagcagcaggagaaggaggacaaggagatggaggccaccgacatctag

SEQ ID NO: 1802 - DNA, 7848 bp, Homo sapiens
atgaagatcctgctgatcatcttcgtgctgatcatctggaccgagaccctggccgaccagagccccggccccggccccgtgtacgccgacgtggtgttcctggtggacagcagcgaccacctgggccccaagagcttccccttcgtgaagaccttcatcaacaagatgatcaacagcctgcccatcgaggccaacaagtacagagtggccctggcccagtacagcgacgagttccacagcgagttccacctgagcaccttcaagggcagaagccccatgctgaaccacctgaagaagaacttccagttcatcggcggcagcctgcagatcggcaaggccctgcaggaggcccacagaacctacttcagcgcccccatcaacggcagagacagaaagcagttcccccccatcctggtggtgctggccagcgccgagagcgaggacgaggtggaggaggccagcaaggccctgcagaaggacggcgtgaagatcatcagcgtgggcgtgcagaaggccagcgaggagaacctgaaggccatggccaccagccacttccacttcaacctgagaaccatcagagacctgagcaccttcagccagaacatgacccagatcatcaaggacgtgaccaagtacaaggagggcgccgtggacgccgacatgcaggtgcacttccccatcagctgccagaaggacagcctggccgacctggtgttcctggtggacgagagcctgggcaccggcggcaacctgagacacctgcagaccttcctggagaacatcaccagcagcatggacgtgaaggagaactgcatgagactgggcctgatgagctacagcaacagcgccaagaccatcagcttcctgaagagcagcaccacccagagcgagttccagcagcagatcaagaacctgagcatccaggtgggcaagagcaacaccggcgccgccatcgaccagatgagaagagacggcttcagcgagagctacggcagcagaagagcccagggcgtgccccagatcgccgtgctggtgacccacagacccagcgacgacgaggtgcacgacgccgccctgaacctgagactggaggacgtgaacgtgttcgccctgagcatccagggcgccaacaacacccagctggaggagatcgtgagctacccccccgagcagaccatcagcaccctgaagagctacgccgacctggagacctacagcaccaagttcctgaagaagctgcagaacgagatctggagccagatcagcacctacgccgagcagagaaacctggacaagaccggctgcgtggacaccaaggaggccgacatccacttcctgatcgacggcagcagcagcatccaggagaagcagttcgagcagatcaagagattcatgctggaggtgaccgagatgttcagcatcggccccgacaaggtgagagtgggcgtggtgcagtacagcgacgacaccgaggtggagttctacatcaccgactacagcaacgacatcgacctgagaaaggccatcttcaacatcaagcagctgaccggcggcacctacaccggcaaggccctggactacatcctgcagatcatcaagaacggcatgaaggacagaatgagcaaggtgccctgctacctgatcgtgctgaccgacggcatgagcaccgacagagtggtggagcccgccaagagactgagagccgagcagatcaccgtgcacgccgtgggcatcggcgccgccaacaagatcgagctgcaggagatcgccggcaaggaggagagagtgagcttcggccagaacttcgacgccctgaagagcatcaagaacgaggtggtgagagagatctgcgccgagaagggctgcgaggacatgaaggccgacatcatgttcctggtggacagcagctggagcatcggcaacgagaacttcagaaagatgaagatcttcatgaagaacctgctgaccaagatccagatcggcgccgacaagacccagatcggcgtggtgcagttcagcgacaagaccaaggaggagttccagctgaacagatacttcacccagcaggagatcagcgacgccatcgacagaatgagcctgatcaacgagggcaccctgaccggcaaggccctgaacttcgtgggccagtacttcacccacagcaagggcgccagactgggcgccaagaagttcctgatcctgatcaccgacggcgtggcccaggacgacgtgagagaccccgccagaatcctgagaggcaaggacgtgaccatcttcagcgtgggcgtgtacaacgccaacagaagccagctggaggagatcagcggcgacagcagcctggtgttccacgtggagaacttcgaccacctgaaggccctggagagaaagctgatcttcagagtgtgcgccctgcacgactgcaagagaatcaccctgctggacgtggtgttcgtgctggaccacagcggcagcatcaagaagcagtaccaggaccacatgatcaacctgaccatccacctggtgaagaaggccgacgtgggcagagacagagtgcagttcggcgccctgaagtacagcgaccagcccaacatcctgttctacctgaacacctacagcaacagaagcgccatcatcgagaacctgagaaagagaagagacaccggcggcaacacctacaccgccaaggccctgaagcacgccaacgccctgttcaccgaggagcacggcagcagaatcaagcagaacgtgaagcagatgctgatcgtgatcaccgacggcgagagccacgaccacgaccagctgaacgacaccgccctggagctgagaaacaagggcatcaccatcttcgccgtgggcgtgggcaaggccaaccagaaggagctggagggcatggccggcaacaagaacaacaccatctacgtggacaacttcgacaagctgaaggacgtgttcaccctggtgcaggagagaatgtgcaccgaggcccccgaggtgtgccacctgcaggaggccgacgtgatcttcctgtgcgacggcagcgacagagtgagcaacagcgacttcgtgaccatgaccaccttcctgagcgacctgatcgacaacttcgacatccagagccagagaatgaagatcggcatggcccagttcggcagcaactaccagagcatcatcgagctgaagaacagcctgaccaagacccagtggaagacccagatccagaacgtgagcaagagcggcggcttccccagaatcgacttcgccctgaagaaggtgagcaacatgttcaacctgcacgccggcggcagaagaaacgccggcgtgccccagaccctggtggtgatcaccagcggcgaccccagatacgacgtggccgacgccgtgaagaccctgaaggacctgggcatctgcgtgctggtgctgggcatcggcgacgtgtacaaggagcacctgctgcccatcaccggcaacagcgagaagatcatcaccttccaggacttcgacaagctgaagaacgtggacgtgaagaagagaatcatcagagagatctgccagagctgcggcaagaccaactgcttcatggacatcgtggtgggcttcgacatcagcacccacgtgcagggccagcccctgttccagggccacccccagctggagagctacctgcccggcatcctggaggacatcagcagcatcaagggcgtgagctgcggcgccggcaccgaggcccaggtgagcctggccttcaaggtgaacagcgaccagggcttccccgccaagttccagatctaccagaaggccgtgttcgacagcctgctgcaggtgaacgtgagcggccccacccacctgaacgcccagttcctgagaagcctgtgggacaccttcaaggacaagagcgccagcagaggccaggtgctgctgatcttcagcgacggcctgcagagcgagagcaacatcatgctggagaaccagagcgacagactgagagaggccggcctggacgccctgctggtggtgagcctgaacaccaccgcccaccacgagttcagcagcttcgagttcggcaagagattcgactacagaacccacctgaccatcggcatgagagagctgggcaagaagctgagccagtacctgggcaacatcgccgagagaacctgctgctgcaccttctgcaagtgccccggcatccccggcccccacggcaccagaggcctgcaggccatgaagggcagccagggcctgaagggcagcagaggccacagaggcgaggacggcaaccccggcgtgagaggcgacaccggcccccagggcgacaagggcatcgccggctgccccggcgcctggggccagaagggcctgaagggcttcagcggccccaagggcggccacggcgacgacggcatcgacggcctggacggcgaggagggctgccacggcttccccggcatcaagggcgagaagggcgaccccggcagccagggcagccccggcagcagaggcgcccccggccagtacggcgagaagggcttccccggcgaccccggcaaccccggccagaacaacaacatcaagggccagaagggcagcaagggcgagcagggcagacagggcagaagcggccagaagggcgtgcagggcagccccagcagcagaggcagcagaggcagagagggccagagaggcctgagaggcgtgagcggcgagcccggcaaccccggccccaccggcaccctgggcgccgagggcctgcagggcccccagggcagccagggcaaccccggcagaaagggcgagaagggcagccagggccagaagggcccccagggcagccccggcctgatgggcgccaagggcagcaccggcagacccggcctgctgggcaagaagggcgagcccggcctgcccggcgacctgggccccgtgggccagaccggccagagaggcagacagggcgacagcggcatccccggctacggccagatgggcagaaagggcgtgaagggccccagaggcttccccggcgacgccggccagaagggcgacatcggcaaccccggcatccccggcggccccggccccaagggcttcagaggcctggccctgaccgtgggcctgaagggcgaggagggcagcagaggcctgcccggcccccccggccagagaggcatcaagggcatggccggccagcccgtgtacagccagtgcgacctgatcagattcctgagagagcacagcccctgctggaaggagaagtgccccgcctaccccaccgagctggtgttcgccctggacaacagctacgacgtgaccgaggagagcttcaacaagaccagagacatcatcaccagcatcgtgaacgacctgaacatcagagagaacaactgccccgtgggcgccagagtggccatggtgagctacaacagcggcaccagctacctgatcagatggagcgactacaacagaaagaagcagctgctgcagcagctgagccagatcaagtaccaggacaccaccgagcccagagacgtgggcaacgccatgagattcgtgaccagaaacgtgttcaagagaacctacgccggcgccaacgtgagaagagtggccgtgttcttcagcaacggccagaccgccagcagaagcagcatcatcaccgccaccatggagttcagcgccctggacatcagccccaccgtgttcgccttcgacgagagagtgttcctggaggccttcggcttcgacaacaccggcaccttccaggtgatccccgtgccccccaacggcgagaaccagaccctggagagactgagaagatgcgccctgtgctacgacaagtgcttccccaacgcctgcatcagagaggccttcctgcccgaggacagctacatggacgtggtgttcctgatcgacaacagcagaaacatcgccaaggacgagttcaaggccgtgaaggccctggtgagcagcgtgatcgacaacttcaacatcgccagcgaccccctgatcagcgacagcggcgacagaatcgccctgctgagctacagcccctgggagagcagcagaagaaagatgggcaccgtgaagaccgagttcgacttcatcacctacgacaaccagctgctgatgaagaaccacatccagaccagcttccagcagctgaacggcgaggccaccatcggcagagccctgctgtggaccaccgagaacctgttccccgagaccccctacctgagaaagcacaaggtgatcttcgtggtgagcgccggcgagaactacgagagaaaggagttcgtgaagatgatggccctgagagccaagtgccagggctacgtgatcttcgtgatcagcctgggcagcaccagaaaggacgacatggaggagctggccagctaccccctggaccagcacctgatccagctgggcagaatccacaagcccgacctgaactacatcgccaagttcctgaagcccttcctgtacagcgtgagaagaggcttcaaccagtaccccccccccatgctggaggacgcctgcagactgatcaacctgggcggcgagaacatccagaacgacggcttccagttcgtgaccgagctgcaggaggacttcctgggcggcaacggcttcatcggccaggagctgaacagcggcagagagagccccttcgtgaagaccgaggacaacggcagcgactacctggtgtacctgcccagccagatgttcgagccccagaagctgatgatcaactacgagaaggaccagaagagcgccgagatcgccagcctgaccagcggccacgagaactacggcagaaaggaggagcccgaccacacctacgagcccggcgacgtgagcctgcaggagtactacatggacgtggccttcctgatcgacgccagccagagagtgggcagcgacgagttcaaggaggtgaaggccttcatcaccagcgtgctggactacttccacatcgcccccacccccctgaccagcaccctgggcgacagagtggccgtgctgagctacagcccccccggctacatgcccaacaccgaggagtgccccgtgtacctggagttcgacctggtgacctacaacagcatccaccagatgaagcaccacctgcaggacagccagcagctgaacggcgacgtgttcatcggccacgccctgcagtggaccatcgacaacgtgttcgtgggcacccccaacctgagaaagaacaaggtgatcttcgtgatcagcgccggcgagaccaacagcctggacaaggacgtgctgagaaacgtgagcctgagagccaagtgccagggctacagcatcttcgtgttcagcttcggccccaagcacaacgacaaggagctggaggagctggccagccaccccctggaccaccacctggtgcagctgggcagaacccacaagcccgactggaactacatcatcaagttcgtgaagcccttcgtgcacctgatcagaagagccatcaacaagtaccccaccgaggacatgaaggccacctgcgtgaacatgaccagccccaaccccgagaacggcggcaccgagaacaccgtgctgctgctgcccggcatctacgagatcaagaccgagaacggcgacctgttcgacgagttcgacagccaggcccagcacctgctggtgctgggcaacaaccacagcagcggcagcgagaccgccaccgacctgatgcagaagctgtacctgctgttcagcaccgagaagctggccatgaaggacaaggagaaggcccacctggaggagatcagcgccctggtggtggacaagcagcaggagaaggaggacaaggagatggaggccaccgacatctag

SEQ ID NO: 1803 - DNA, 1674 bp, Homo sapiens
atcggcagagccctgctgtggaccaccgagaacctgttccccgagaccccctacctgagaaagcacaaggtgatcttcgtggtgagcgccggcgagaactacgagagaaaggagttcgtgaagatgatggccctgagagccaagtgccagggctacgtgatcttcgtgatcagcctgggcagcaccagaaaggacgacatggaggagctggccagctaccccctggaccagcacctgatccagctgggcagaatccacaagcccgacctgaactacatcgccaagttcctgaagcccttcctgtacagcgtgagaagaggcttcaaccagtaccccccccccatgctggaggacgcctgcagactgatcaacctgggcggcgagaacatccagaacgacggcttccagttcgtgaccgagctgcaggaggacttcctgggcggcaacggcttcatcggccaggagctgaacagcggcagagagagccccttcgtgaagaccgaggacaacggcagcgactacctggtgtacctgcccagccagatgttcgagccccagaagctgatgatcaactacgagaaggaccagaagagcgccgagatcgccagcctgaccagcggccacgagaactacggcagaaaggaggagcccgaccacacctacgagcccggcgacgtgagcctgcaggagtactacatggacgtggccttcctgatcgacgccagccagagagtgggcagcgacgagttcaaggaggtgaaggccttcatcaccagcgtgctggactacttccacatcgcccccacccccctgaccagcaccctgggcgacagagtggccgtgctgagctacagcccccccggctacatgcccaacaccgaggagtgccccgtgtacctggagttcgacctggtgacctacaacagcatccaccagatgaagcaccacctgcaggacagccagcagctgaacggcgacgtgttcatcggccacgccctgcagtggaccatcgacaacgtgttcgtgggcacccccaacctgagaaagaacaaggtgatcttcgtgatcagcgccggcgagaccaacagcctggacaaggacgtgctgagaaacgtgagcctgagagccaagtgccagggctacagcatcttcgtgttcagcttcggccccaagcacaacgacaaggagctggaggagctggccagccaccccctggaccaccacctggtgcagctgggcagaacccacaagcccgactggaactacatcatcaagttcgtgaagcccttcgtgcacctgatcagaagagccatcaacaagtaccccaccgaggacatgaaggccacctgcgtgaacatgaccagccccaaccccgagaacggcggcaccgagaacaccgtgctgctgctgcccggcatctacgagatcaagaccgagaacggcgacctgttcgacgagttcgacagccaggcccagcacctgctggtgctgggcaacaaccacagcagcggcagcgagaccgccaccgacctgatgcagaagctgtacctgctgttcagcaccgagaagctggccatgaaggacaaggagaaggcccacctggaggagatcagcgccctggtggtggacaagcagcaggagaaggaggacggcgaggacaccagaagcagctag

SEQ ID NO: 1804 - DNA, 7581 bp, Homo sapiens
atgaagatcctgctgatcatcttcgtgctgatcatctggaccgagaccctggccgaccagagccccggccccggccccgtgtacgccgacgtggtgttcctggtggacagcagcgaccacctgggccccaagagcttccccttcgtgaagaccttcatcaacaagatgatcaacagcctgcccatcgaggccaacaagtacagagtggccctggcccagtacagcgacgagttccacagcgagttccacctgagcaccttcaagggcagaagccccatgctgaaccacctgaagaagaacttccagttcatcggcggcagcctgcagatcggcaaggccctgcaggaggcccacagaacctacttcagcgcccccatcaacggcagagacagaaagcagttcccccccatcctggtggtgctggccagcgccgagagcgaggacgaggtggaggaggccagcaaggccctgcagaaggacggcgtgaagatcatcagcgtgggcgtgcagaaggccagcgaggagaacctgaaggccatggccaccagccacttccacttcaacctgagaaccatcagagacctgagcaccttcagccagaacatgacccagatcatcaaggacgtgaccaagtacaaggagggcgccgtggacgccgacatgcaggtgcacttccccatcagctgccagaaggacagcctggccgacctggtgttcctggtggacgagagcctgggcaccggcggcaacctgagacacctgcagaccttcctggagaacatcaccagcagcatggacgtgaaggagaactgcatgagactgggcctgatgagctacagcaacagcgccaagaccatcagcttcctgaagagcagcaccacccagagcgagttccagcagcagatcaagaacctgagcatccaggtgggcaagagcaacaccggcgccgccatcgaccagatgagaagagacggcttcagcgagagctacggcagcagaagagcccagggcgtgccccagatcgccgtgctggtgacccacagacccagcgacgacgaggtgcacgacgccgccctgaacctgagactggaggacgtgaacgtgttcgccctgagcatccagggcgccaacaacacccagctggaggagatcgtgagctacccccccgagcagaccatcagcaccctgaagagctacgccgacctggagacctacagcaccaagttcctgaagaagctgcagaacgagatctggagccagatcagcacctacgccgagcagagaaacctggacaagaccggctgcgtggacaccaaggaggccgacatccacttcctgatcgacggcagcagcagcatccaggagaagcagttcgagcagatcaagagattcatgctggaggtgaccgagatgttcagcatcggccccgacaaggtgagagtgggcgtggtgcagtacagcgacgacaccgaggtggagttctacatcaccgactacagcaacgacatcgacctgagaaaggccatcttcaacatcaagcagctgaccggcggcacctacaccggcaaggccctggactacatcctgcagatcatcaagaacggcatgaaggacagaatgagcaaggtgccctgctacctgatcgtgctgaccgacggcatgagcaccgacagagtggtggagcccgccaagagactgagagccgagcagatcaccgtgcacgccgtgggcatcggcgccgccaacaagatcgagctgcaggagatcgccggcaaggaggagagagtgagcttcggccagaacttcgacgccctgaagagcatcaagaacgaggtggtgagagagatctgcgccgagaagggctgcgaggacatgaaggccgacatcatgttcctggtggacagcagctggagcatcggcaacgagaacttcagaaagatgaagatcttcatgaagaacctgctgaccaagatccagatcggcgccgacaagacccagatcggcgtggtgcagttcagcgacaagaccaaggaggagttccagctgaacagatacttcacccagcaggagatcagcgacgccatcgacagaatgagcctgatcaacgagggcaccctgaccggcaaggccctgaacttcgtgggccagtacttcacccacagcaagggcgccagactgggcgccaagaagttcctgatcctgatcaccgacggcgtggcccaggacgacgtgagagaccccgccagaatcctgagaggcaaggacgtgaccatcttcagcgtgggcgtgtacaacgccaacagaagccagctggaggagatcagcggcgacagcagcctggtgttccacgtggagaacttcgaccacctgaaggccctggagagaaagctgatcttcagagtgtgcgccctgcacgactgcaagagaatcaccctgctggacgtggtgttcgtgctggaccacagcggcagcatcaagaagcagtaccaggaccacatgatcaacctgaccatccacctggtgaagaaggccgacgtgggcagagacagagtgcagttcggcgccctgaagtacagcgaccagcccaacatcctgttctacctgaacacctacagcaacagaagcgccatcatcgagaacctgagaaagagaagagacaccggcggcaacacctacaccgccaaggccctgaagcacgccaacgccctgttcaccgaggagcacggcagcagaatcaagcagaacgtgaagcagatgctgatcgtgatcaccgacggcgagagccacgaccacgaccagctgaacgacaccgccctggagctgagaaacaagggcatcaccatcttcgccgtgggcgtgggcaaggccaaccagaaggagctggagggcatggccggcaacaagaacaacaccatctacgtggacaacttcgacaagctgaaggacgtgttcaccctggtgcaggagagaatgtgcaccgaggcccccgaggtgtgccacctgcaggaggccgacgtgatcttcctgtgcgacggcagcgacagagtgagcaacagcgacttcgtgaccatgaccaccttcctgagcgacctgatcgacaacttcgacatccagagccagagaatgaagatcggcatggcccagttcggcagcaactaccagagcatcatcgagctgaagaacagcctgaccaagacccagtggaagacccagatccagaacgtgagcaagagcggcggcttccccagaatcgacttcgccctgaagaaggtgagcaacatgttcaacctgcacgccggcggcagaagaaacgccggcgtgccccagaccctggtggtgatcaccagcggcgaccccagatacgacgtggccgacgccgtgaagaccctgaaggacctgggcatctgcgtgctggtgctgggcatcggcgacgtgtacaaggagcacctgctgcccatcaccggcaacagcgagaagatcatcaccttccaggacttcgacaagctgaagaacgtggacgtgaagaagagaatcatcagagagatctgccagagctgcggcaagaccaactgcttcatggacatcgtggtgggcttcgacatcagcacccacgtgcagggccagcccctgttccagggccacccccagctggagagctacctgcccggcatcctggaggacatcagcagcatcaagggcgtgagctgcggcgccggcaccgaggcccaggtgagcctggccttcaaggtgaacagcgaccagggcttccccgccaagttccagatctaccagaaggccgtgttcgacagcctgctgcaggtgaacgtgagcggccccacccacctgaacgcccagttcctgagaagcctgtgggacaccttcaaggacaagagcgccagcagaggccaggtgctgctgatcttcagcgacggcctgcagagcgagagcaacatcatgctggagaaccagagcgacagactgagagaggccggcctggacgccctgctggtggtgagcctgaacaccaccgcccaccacgagttcagcagcttcgagttcggcaagagattcgactacagaacccacctgaccatcggcatgagagagctgggcaagaagctgagccagtacctgggcaacatcgccgagagaacctgctgctgcaccttctgcaagtgccccggcatccccggcccccacggcaccagaggcctgcaggccatgaagggcagccagggcctgaagggcagcagaggccacagaggcgaggacggcaaccccggcgtgagaggcgacaccggcccccagggcgacaagggcatcgccggctgccccggcgcctggggccagaagggcctgaagggcttcagcggccccaagggcggccacggcgacgacggcatcgacggcctggacggcgaggagggctgccacggcttccccggcatcaagggcgagaagggcgaccccggcagccagggcagccccggcagcagaggcgcccccggccagtacggcgagaagggcttccccggcgaccccggcaaccccggccagaacaacaacatcaagggccagaagggcagcaagggcgagcagggcagacagggcagaagcggccagaagggcgtgcagggcagccccagcagcagaggcagcagaggcagagagggccagagaggcctgagaggcgtgagcggcgagcccggcaaccccggccccaccggcaccctgggcgccgagggcctgcagggcccccagggcagccagggcaaccccggcagaaagggcgagaagggcagccagggccagaagggcccccagggcagccccggcctgatgggcgccaagggcagcaccggcagacccggcctgctgggcaagaagggcgagcccggcctgcccggcgacctgggccccgtgggccagaccggccagagaggcagacagggcgacagcggcatccccggctacggccagatgggcagaaagggcgtgaagggccccagaggcttccccggcgacgccggccagaagggcgacatcggcaaccccggcatccccggcggccccggccccaagggcttcagaggcctggccctgaccgtgggcctgaagggcgaggagggcagcagaggcctgcccggcccccccggccagagaggcatcaagggcatggccggccagcccgtgtacagccagtgcgacctgatcagattcctgagagagcacagcctgtgcagcctggagaagtgccccgcctaccccaccgagctggtgttcgccctggacaacagctacgacgtgaccgaggagagcttcaacaagaccagagacatcatcaccagcatcgtgaacgacctgaacatcagagagaacaactgccccgtgggcgccagagtggccatggtgagctacaacagcggcaccagctacctgatcagatggagcgactacaacagaaagaagcagctgctgcagcagctgagccagatcaagtaccaggacaccaccgagcccagagacgtgggcaacgccatgagattcgtgaccagaaacgtgttcaagagaacctacgccggcgccaacgtgagaagagtggccgtgttcttcagcaacggccagaccgccagcagaagcagcatcatcaccgccaccatggagttcagcgccctggacatcagccccaccgtgttcgccttcgacgagagagtgttcctggaggccttcggcttcgacaacaccggcaccttccaggtgatccccgtgccccccaacggcgagaaccagaccctggagagactgagaagatgcgccctgtgctacgacaagtgcttccccaacgcctgcatcagagaggccttcctgcccgaggacagctacatggacgtggtgttcctgatcgacaacagcagaaacatcgccaaggacgagttcaaggccgtgaaggccctggtgagcagcgtgatcgacaacttcaacatcgccagcgaccccctgatcagcgacagcggcgacagaatcgccctgctgagctacagcccctgggagagcagcagaagaaagatgggcaccgtgaagaccgagttcgacttcatcacctacgacaaccagctgctgatgaagaaccacatccagaccagcttccagcagctgaacggcgaggccaccatcggcagagccctgctgtggaccaccgagaacctgttccccgagaccccctacctgagaaagcacaaggtgatcttcgtggtgagcgccggcgagaactacgagagaaaggagttcgtgaagatgatggccctgagagccaagtgccagggctacgtgatcttcgtgatcagcctgggcagcaccagaaaggacgacatggaggagctggccagctaccccctggaccagcacctgatccagctgggcagaatccacaagcccgacctgaactacatcgccaagttcctgaagcccttcctgtacagcgtgagaagaggcttcaaccagtaccccccccccatgctggaggacgcctgcagactgatcaacctgggcggcgagaacatccagaacgacggcttccagttcgtgaccgagctgcaggaggacttcctgggcggcaacggcttcatcggccaggagctgaacagcggcagagagagccccttcgtgaagaccgaggacaacggcagcgactacctggtgtacctgcccagccagatgttcgagccccagaagctgatgatcaactacgagaaggaccagaagagcgccgagatcgccagcctgaccagcggccacgagaactacggcagaaaggaggagcccgaccacacctacgagcccggcgacgtgagcctgcaggagtactacatggacgtggccttcctgatcgacgccagccagagagtgggcagcgacgagttcaaggaggtgaaggccttcatcaccagcgtgctggactacttccacatcgcccccacccccctgaccagcaccctgggcgacagagtggccgtgctgagctacagcccccccggctacatgcccaacaccgaggagtgccccgtgtacctggagttcgacctggtgacctacaacagcatccaccagatgaagcaccacctgcaggacagccagcagctgaacggcgacgtgttcatcggccacgccctgcagtggaccatcgacaacgtgttcgtgggcacccccaacctgagaaagaacaaggtgatcttcgtgatcagcgccggcgagaccaacagcctggacaaggacgtgctgagaaacgtgagcctgagagccaagtgccagggctacagcatcttcgtgttcagcttcggccccaagcacaacgacaaggagctggaggagctggccagccaccccctggaccaccacctggtgcagctgggcagaacccacaagcccgactggaactacatcatcaagttcgtgaagcccttcgtgcacctgatcagaagagccatcaacaagtaccccaccgaggacatgaaggccacctgcgtgaacatgaccagccccaaccccgagaacggcggcaccgagaacaccgtgctgtggtag

SEQ ID NO: 1805 - DNA, 1332 bp, Homo sapiens
aaccagtaccccccccccatgctggaggacgcctgcagactgatcaacctgggcggcgagaacatccagaacgacggcttccagttcgtgaccgagctgcaggaggacttcctgggcggcaacggcttcatcggccaggagctgaacagcggcagagagagccccttcgtgaagaccgaggacaacggcagcgactacctggtgtacctgcccagccagatgttcgagccccagaagctgatgatcaactacgagaaggaccagaagagcgccgagatcgccagcctgaccagcggccacgagaactacggcagaaaggaggagcccgaccacacctacgagcccggcgacgtgagcctgcaggagtactacatggacgtggccttcctgatcgacgccagccagagagtgggcagcgacgagttcaaggaggtgaaggccttcatcaccagcgtgctggactacttccacatcgcccccacccccctgaccagcaccctgggcgacagagtggccgtgctgagctacagcccccccggctacatgcccaacaccgaggagtgccccgtgtacctggagttcgacctggtgacctacaacagcatccaccagatgaagcaccacctgcaggacagccagcagctgaacggcgacgtgttcatcggccacgccctgcagtggaccatcgacaacgtgttcgtgggcacccccaacctgagaaagaacaaggtgatcttcgtgatcagcgccggcgagaccaacagcctggacaaggacgtgctgagaaacgtgagcctgagagccaagtgccagggctacagcatcttcgtgttcagcttcggccccaagcacaacgacaaggagctggaggagctggccagccaccccctggaccaccacctggtgcagctgggcagaacccacaagcccgactggaactacatcatcaagttcgtgaagcccttcgtgcacctgatcagaagagccatcaacaagtaccccaccgaggacatgaaggccacctgcgtgaacatgaccagccccaaccccgagaacggcggcaccgagaacaccgtgctgctgctgcccggcatctacgagatcaagaccgagaacggcgacctgttcgacgagttcgacagccaggcccagcacctgctggtgctgggcaacaaccacagcagcggcagcgagaccgccaccgacctgatgcagaagctgtacctgctgttcagcaccgagaagctggccatgaaggacaaggagaaggcccacctggaggagatcagcgccctggtggtggacaagcagcaggagaaggaggacctgtag

SEQ ID NO: 1806 - DNA, 6792 bp, Homo sapiens
atgatgctgctgatcctgttcctggtgatcatctgcagccacatcagcgtgaaccaggacagcggccccgagtacgccgacgtggtgttcctggtggacagcagcgacagactgggcagcaagagcttccccttcgtgaagatgttcatcaccaagatgatcagcagcctgcccatcgaggccgacaagtacagagtggccctggcccagtacagcgacaagctgcacagcgagttccacctgagcaccttcaagggcagaagccccatgctgaaccacctgagaaagaacttcggcttcatcggcggcagcctgcagatcggcaaggccctgcaggaggcccacagaacctacttcagcgcccccgccaacggcagagacaagaagcagttcccccccatcctggtggtgctggccagcagcgagagcgaggacaacgtggaggaggccagcaaggccctgagaaaggacggcgtgaagatcatcagcgtgggcgtgcagaaggccagcgaggagaacctgaaggccatggccaccagccagttccacttcaacctgagaaccgtgagagacctgagcatgttcagccagaacatgacccacatcatcaaggacgtgatcaagtacaaggagggcgccgtggacgacatcttcgtggaggcctgccagggccccagcatggccgacgtggtgttcctgctggacatgagcatcaacggcagcgaggagaacttcgactacctgaagggcttcctggaggagagcgtgagcgccctggacatcaaggagaactgcatgagagtgggcctggtggcctacagcaacgagaccaaggtgatcaacagcctgagcatgggcatcaacaagagcgaggtgctgcagcacatccagaacctgagccccagaaccggcaaggcctacaccggcgccgccatcaagaagctgagaaaggaggtgttcagcgccagaaacggcagcagaaagaaccagggcgtgccccagatcgccgtgctggtgacccacagagacagcgaggacaacgtgaccaaggccgccgtgaacctgagaagagagggcgtgaccatcttcaccctgggcatcgagggcgccagcgacacccagctggagaagatcgccagccaccccgccgagcagtacgtgagcaagctgaagaccttcgccgacctggccgcccacaaccagaccttcctgaagaagctgagaaaccagatcacccacaccgtgagcgtgttcagcgagagaaccgagaccctgaagagcggctgcgtggacaccgaggaggccgacatctacctgctgatcgacggcagcggcagcacccaggccaccgacttccacgagatgaagaccttcctgagcgaggtggtgggcatgttcaacatcgccccccacaaggtgagagtgggcgccgtgcagtacgccgacagctgggacctggagttcgagatcaacaagtacagcaacaagcaggacctgggcaaggccatcgagaacatcagacagatgggcggcaacaccaacaccggcgccgccctgaacttcaccctgagcctgctgcagaaggccaagaagcagagaggcaacaaggtgccctgccacctggtggtgctgaccaacggcatgagcaaggacagcatcctggagcccgccaacagactgagagaggagcacatcagagtgtacgccatcggcatcaaggaggccaaccagacccagctgagagagatcgccggcgaggagaagagagtgtactacgtgcacgacttcgacgccctgaaggacatcagaaaccaggtggtgcaggagatctgcaccgaggaggcctgcaaggagatgaaggccgacatcatgttcctggtggacagcagcggcagcatcggccccgagaacttcagcaagatgaagaccttcatgaagaacctggtgagcaagagccagatcggccccgacagagtgcagatcggcgtggtgcagttcagcgacatcaacaaggaggagttccagctgaacagattcatgagccagagcgacatcagcaacgccatcgaccagatggcccacatcggccagaccaccctgaccggcagcgccctgagcttcgtgagccagtacttcagccccaccaagggcgccagacccaacatcagaaagttcctgatcctgatcaccgacggcgaggcccaggacatcgtgaaggagcccgccgtggtgctgagacaggagggcgtgatcatctacagcgtgggcgtgttcggcagcaacgtgacccagctggaggagatcagcggcagacccgagatggtgttctacgtggagaacttcgacatcctgcagagaatcgaggacgacctggtgttcggcatctgcagccccagagaggagtgcaagagaatcgaggtgctggacgtggtgttcgtgatcgacagcagcggcagcatcgactacgacgagtacaacatcatgaaggacttcatgatcggcctggtgaagaaggccgacgtgggcaagaaccaggtgagattcggcgccctgaagtacgccgacgaccccgaggtgctgttctacctggacgacttcggcaccaagctggaggtgatcagcgtgctgcagaacgaccaggccatgggcggcagcacctacaccgccgaggccctgggcttcagcgaccacatgttcaccgaggccagaggcagcagactgaacaagggcgtgccccaggtgctgatcgtgatcaccgacggcgagagccacgacgccgacaagctgaacgccaccgccaaggccctgagagacaagggcatcctggtgctggccgtgggcatcgacggcgccaaccccgtggagctgctggccatggccggcagcagcgacaagtacttcttcgtggagaccttcggcggcctgaagggcatcttcagcgacgtgaccgccagcgtgtgcaacagcagcaaggtggactgcgagatcgacaaggtggacctggtgttcctgatggacggcagcaccagcatccagcccaacgacttcaagaagatgaaggagttcctggccagcgtggtgcaggacttcgacgtgagcctgaacagagtgagaatcggcgccgcccagttcagcgacacctaccaccccgagttccccctgggcaccttcatcggcgagaaggagatcagcttccagatcgagaacatcaagcagatcttcggcaacacccacatcggcgccgccctgagagaggtggagcactacttcagacccgacatgggcagcagaatcaacaccggcaccccccaggtgctgctggtgctgaccgacggccagagccaggacgaggtggcccaggccgccgaggccctgagacacagaggcatcgacatctacagcgtgggcatcggcgacgtggacgaccagcagctgatccagatcaccggcaccgccgagaagaagctgaccgtgcacaacttcgacgagctgaagaaggtgaacaagagaatcgtgagaaacatctgcaccaccgccggcgagagcaactgcttcgtggacgtggtggtgggcttcgacgtgagcacccaggagaagggccagaccctgctggagggccagccctggatggagacctacctgcaggacatcctgagagccatcagcagcctgaacggcgtgagctgcgaggtgggcaccgagacccaggtgagcgtggccttccaggtgaccaacgccatggagaagtacagccccaagttcgagatctacagcgagaacatcctgaacagcctgaaggacatcaccgtgaagggccccagcctgctgaacgccaacctgctggacagcctgtgggacaccttccagaacaagagcgccgccagaggcaaggtggtgctgctgttcagcgacggcctggacgacgacgtggagaagctggagcagaagagcgacgagctgagaaaggagggcctgaacgccctgatcaccgtggccctggacggccccgccgacagcagcgacctggccgacctgccctacatcgagttcggcaagggcttcgagtacagaacccagctgagcatcggcatgagagagctgggcagcagactgagcaagcagctggtgaacgtggccgagagaacctgctgctgcctgttctgcaagtgcatcggcggcgacggcaccatgggcgaccccggcccccccggcaagagaggcccccccggcttcaagggcagcgagggctacctgggcgaggagggcatcgccggcgagagaggcgcccccggccccgtgggcgagcagggcaccaagggctgctacggcaccaagggccccaagggcaacagaggcctgaacggccaggagggcgaggtgggcgagaacggcatcgacggcctgaacggcgagcagggcgacaacggcctgcccggcagaaagggcgagaagggcgacgagggcagccagggcagccccggcaagagaggcacccccggcgacagaggcgccaagggcctgagaggcgaccccggcgcccccggcgtggacagcagcatcgagggccccaccggcctgaagggcgagagaggcagacagggcagaagaggctggcccggcccccccggcacccccggcagcagaagaaagaccgccgcccacggcagaagaggccacaccggcccccagggcaccgccggcatccccggccccgacggcctggagggcagcctgggcctgaagggcccccagggccccagaggcgaggccggcgtgaagggcgagaagggcggcgtgggcagcaagggcccccagggcccccccggccccggcggcgaggccggcaaccagggcagactgggcagccagggcaacaagggcgagcccggcgacctgggcgagaagggcgccgtgggcttccccggccccagaggcctgcagggcaacgacggcagccccggctacggcagcgtgggcagaaagggcgccaagggccaggagggcttccccggcgagagcggccccaagggcgagatcggcgaccccggcggccccggcgagaccggcctgaagggcgccagaggcaagatgatcagcgccggcctgcccggcgagatgggcagccccggcgagcccggcccccccggcagaaagggcgtgaagggcgccaagggcctggccagcttcagcacctgcgagctgatccagtacgtgagagacagaagccccggcagacacggcaagcccgagtgccccgtgcaccccaccgagctggtgttcgccctggaccacagcagagacgtgaccgagcaggagttcgagagaatgaaggagatgatggccttcctggtgagagacatcaaggtgagagagaacagctgccccgtgggcgcccacatcgccatcctgagctacaacagccacgccagacacctggtgagattcagcgacgcctacaagaagagccagctgctgagagagatcgagaccatcccctacgagagaagcagcgccagcagagagatcggcagagccatgagattcatcagcagaaacgtgttcaagagaaccctgcccggcgcccacaccagaaagatcgccaccttcttcagcagcggccagagcgccgacgcccacagcatcaccaccgccgccatggagttcggcgccctggagatcatccccgtggtgatcaccttcagcaacgtgcccagcgtgagaagagccttcgccatcgacgacaccggcaccttccaggtgatcgtggtgcccagcggcgccgactacatccccgccctggagagactgcagagatgcaccttctgctacgacgtgtgcaagcccgacgccagctgcgaccaggccagacccccccccgtgcagagctacatggacgccgccttcctgctggacgccagcagaaacatgggcagcgccgagttcgaggacatcagagccttcctgggcgccctgctggaccacttcgagatcacccccgagcccgagaccagcgtgaccggcgacagagtggccctgctgagccacgccccccccgacttcctgcccaacacccagaagagccccgtgagagccgagttcaacctgaccacctacagaagcaagagactgatgaagagacacgtgcacgagagcgtgaagcagctgaacggcgacgccttcatcggccacgccctgcagtggaccctggacaacgtgttcctgagcacccccaacctgagaagaaacaaggtgatcttcgtgatcagcgccggcgagaccagccacctggacggcgagatcctgaagaaggagagcctgagagccaagtgccagggctacgccctgttcgtgttcagcctgggccccatctgggacgacaaggagctggaggacctggccagccaccccctggaccaccacctggtgcagctgggcagaatccacaagcccgaccacagctacggcgtgaagttcgtgaagagcttcatcaacagcatcagaagagccatcaacaagtacccccccatcaacctgaagatcaagtgcaacagactgaacagcatcgaccccaagcagccccccagacccttcagaagcttcgtgcccggccccctgaaggccaccctgaaggaggacgtgctgcagaaggccaagttcttccaggacaagaagtacctgagcagagtggccagaagcggcagagacgacgccatccagaacttcatgagaagcaccagccacaccttcaagaacggcagaatgatcgagagcgcccccaagcagcacgactag

SEQ ID NO: 1807 - DNA, 6792 bp, Homo sapiens
atgatgctgctgatcctgttcctggtgatcatctgcagccacatcagcgtgaaccaggacagcggccccgagtacgccgacgtggtgttcctggtggacagcagcgacagactgggcagcaagagcttccccttcgtgaagatgttcatcaccaagatgatcagcagcctgcccatcgaggccgacaagtacagagtggccctggcccagtacagcgacaagctgcacagcgagttccacctgagcaccttcaagggcagaagccccatgctgaaccacctgagaaagaacttcggcttcatcggcggcagcctgcagatcggcaaggccctgcaggaggcccacagaacctacttcagcgcccccgccaacggcagagacaagaagcagttcccccccatcctggtggtgctggccagcagcgagagcgaggacaacgtggaggaggccagcaaggccctgagaaaggacggcgtgaagatcatcagcgtgggcgtgcagaaggccagcgaggagaacctgaaggccatggccaccagccagttccacttcaacctgagaaccgtgagagacctgagcatgttcagccagaacatgacccacatcatcaaggacgtgatcaagtacaaggagggcgccgtggacgacatcttcgtggaggcctgccagggccccagcatggccgacgtggtgttcctgctggacatgagcatcaacggcagcgaggagaacttcgactacctgaagggcttcctggaggagagcgtgagcgccctggacatcaaggagaactgcatgagagtgggcctggtggcctacagcaacgagaccaaggtgatcaacagcctgagcatgggcatcaacaagagcgaggtgctgcagcacatccagaacctgagccccagaaccggcaaggcctacaccggcgccgccatcaagaagctgagaaaggaggtgttcagcgccagaaacggcagcagaaagaaccagggcgtgccccagatcgccgtgctggtgacccacagagacagcgaggacaacgtgaccaaggccgccgtgaacctgagaagagagggcgtgaccatcttcaccctgggcatcgagggcgccagcgacacccagctggagaagatcgccagccaccccgccgagcagtacgtgagcaagctgaagaccttcgccgacctggccgcccacaaccagaccttcctgaagaagctgagaaaccagatcacccacaccgtgagcgtgttcagcgagagaaccgagaccctgaagagcggctgcgtggacaccgaggaggccgacatctacctgctgatcgacggcagcggcagcacccaggccaccgacttccacgagatgaagaccttcctgagcgaggtggtgggcatgttcaacatcgccccccacaaggtgagagtgggcgccgtgcagtacgccgacagctgggacctggagttcgagatcaacaagtacagcaacaagcaggacctgggcaaggccatcgagaacatcagacagatgggcggcaacaccaacaccggcgccgccctgaacttcaccctgagcctgctgcagaaggccaagaagcagagaggcaacaaggtgccctgccacctggtggtgctgaccaacggcatgagcaaggacagcatcctggagcccgccaacagactgagagaggagcacatcagagtgtacgccatcggcatcaaggaggccaaccagacccagctgagagagatcgccggcgaggagaagagagtgtactacgtgcacgacttcgacgccctgaaggacatcagaaaccaggtggtgcaggagatctgcaccgaggaggcctgcaaggagatgaaggccgacatcatgttcctggtggacagcagcggcagcatcggccccgagaacttcagcaagatgaagaccttcatgaagaacctggtgagcaagagccagatcggccccgacagagtgcagatcggcgtggtgcagttcagcgacatcaacaaggaggagttccagctgaacagattcatgagccagagcgacatcagcaacgccatcgaccagatggcccacatcggccagaccaccctgaccggcagcgccctgagcttcgtgagccagtacttcagccccaccaagggcgccagacccaacatcagaaagttcctgatcctgatcaccgacggcgaggcccaggacatcgtgaaggagcccgccgtggtgctgagacaggagggcgtgatcatctacagcgtgggcgtgttcggcagcaacgtgacccagctggaggagatcagcggcagacccgagatggtgttctacgtggagaacttcgacatcctgcagagaatcgaggacgacctggtgttcggcatctgcagccccagagaggagtgcaagagaatcgaggtgctggacgtggtgttcgtgatcgacagcagcggcagcatcgactacgacgagtacaacatcatgaaggacttcatgatcggcctggtgaagaaggccgacgtgggcaagaaccaggtgagattcggcgccctgaagtacgccgacgaccccgaggtgctgttctacctggacgacttcggcaccaagctggaggtgatcagcgtgctgcagaacgaccaggccatgggcggcagcacctacaccgccgaggccctgggcttcagcgaccacatgttcaccgaggccagaggcagcagactgaacaagggcgtgccccaggtgctgatcgtgatcaccgacggcgagagccacgacgccgacaagctgaacgccaccgccaaggccctgagagacaagggcatcctggtgctggccgtgggcatcgacggcgccaaccccgtggagctgctggccatggccggcagcagcgacaagtacttcttcgtggagaccttcggcggcctgaagggcatcttcagcgacgtgaccgccagcgtgtgcaacagcagcaaggtggactgcgagatcgacaaggtggacctggtgttcctgatggacggcagcaccagcatccagcccaacgacttcaagaagatgaaggagttcctggccagcgtggtgcaggacttcgacgtgagcctgaacagagtgagaatcggcgccgcccagttcagcgacacctaccaccccgagttccccctgggcaccttcatcggcgagaaggagatcagcttccagatcgagaacatcaagcagatcttcggcaacacccacatcggcgccgccctgagagaggtggagcactacttcagacccgacatgggcagcagaatcaacaccggcaccccccaggtgctgctggtgctgaccgacggccagagccaggacgaggtggcccaggccgccgaggccctgagacacagaggcatcgacatctacagcgtgggcatcggcgacgtggacgaccagcagctgatccagatcaccggcaccgccgagaagaagctgaccgtgcacaacttcgacgagctgaagaaggtgaacaagagaatcgtgagaaacatctgcaccaccgccggcgagagcaactgcttcgtggacgtggtggtgggcttcgacgtgagcacccaggagaagggccagaccctgctggagggccagccctggatggagacctacctgcaggacatcctgagagccatcagcagcctgaacggcgtgagctgcgaggtgggcaccgagacccaggtgagcgtggccttccaggtgaccaacgccatggagaagtacagccccaagttcgagatctacagcgagaacatcctgaacagcctgaaggacatcaccgtgaagggccccagcctgctgaacgccaacctgctggacagcctgtgggacaccttccagaacaagagcgccgccagaggcaaggtggtgctgctgttcagcgacggcctggacgacgacgtggagaagctggagcagaagagcgacgagctgagaaaggagggcctgaacgccctgatcaccgtggccctggacggccccgccgacagcagcgacctggccgacctgccctacatcgagttcggcaagggcttcgagtacagaacccagctgagcatcggcatgagagagctgggcagcagactgagcaagcagctggtgaacgtggccgagagaacctgctgctgcctgttctgcaagtgcatcggcggcgacggcaccatgggcgaccccggcccccccggcaagagaggcccccccggcttcaagggcagcgagggctacctgggcgaggagggcatcgccggcgagagaggcgcccccggccccgtgggcgagcagggcaccaagggctgctacggcaccaagggccccaagggcaacagaggcctgaacggccaggagggcgaggtgggcgagaacggcatcgacggcctgaacggcgagcagggcgacaacggcctgcccggcagaaagggcgagaagggcgacgagggcagccagggcagccccggcaagagaggcacccccggcgacagaggcgccaagggcctgagaggcgaccccggcgcccccggcgtggacagcagcatcgagggccccaccggcctgaagggcgagagaggcagacagggcagaagaggctggcccggcccccccggcacccccggcagcagaagaaagaccgccgcccacggcagaagaggccacaccggcccccagggcaccgccggcatccccggccccgacggcctggagggcagcctgggcctgaagggcccccagggccccagaggcgaggccggcgtgaagggcgagaagggcggcgtgggcagcaagggcccccagggcccccccggccccggcggcgaggccggcaaccagggcagactgggcagccagggcaacaagggcgagcccggcgacctgggcgagaagggcgccgtgggcttccccggccccagaggcctgcagggcaacgacggcagccccggctacggcagcgtgggcagaaagggcgccaagggccaggagggcttccccggcgagagcggccccaagggcgagatcggcgaccccggcggccccggcgagaccggcctgaagggcgccagaggcaagatgatcagcgccggcctgcccggcgagatgggcagccccggcgagcccggcccccccggcagaaagggcgtgaagggcgccaagggcctggccagcttcagcacctgcgagctgatccagtacgtgagagacagaagccccggccagcacagaaagcccgagtgccccgtgcaccccaccgagctggtgttcgccctggaccacagcagagacgtgaccgagcaggagttcgagagaatgaaggagatgatggccttcctggtgagagacatcaaggtgagagagaacagctgccccgtgggcgcccacatcgccatcctgagctacaacagccacgccagacacctggtgagattcagcgacgcctacaagaagagccagctgctgagagagatcgagaccatcccctacgagagaagcagcgccagcagagagatcggcagagccatgagattcatcagcagaaacgtgttcaagagaaccctgcccggcgcccacaccagaaagatcgccaccttcttcagcagcggccagagcgccgacgcccacagcatcaccaccgccgccatggagttcggcgccctggagatcatccccgtggtgatcaccttcagcaacgtgcccagcgtgagaagagccttcgccatcgacgacaccggcaccttccaggtgatcgtggtgcccagcggcgccgactacatccccgccctggagagactgcagagatgcaccttctgctacgacgtgtgcaagcccgacgccagctgcgaccaggccagacccccccccgtgcagagctacatggacgccgccttcctgctggacgccagcagaaacatgggcagcgccgagttcgaggacatcagagccttcctgggcgccctgctggaccacttcgagatcacccccgagcccgagaccagcgtgaccggcgacagagtggccctgctgagccacgccccccccgacttcctgcccaacacccagaagagccccgtgagagccgagttcaacctgaccacctacagaagcaagagactgatgaagagacacgtgcacgagagcgtgaagcagctgaacggcgacgccttcatcggccacgccctgcagtggaccctggacaacgtgttcctgagcacccccaacctgagaagaaacaaggtgatcttcgtgatcagcgccggcgagaccagccacctggacggcgagatcctgaagaaggagagcctgagagccaagtgccagggctacgccctgttcgtgttcagcctgggccccatctgggacgacaaggagctggaggacctggccagccaccccctggaccaccacctggtgcagctgggcagaatccacaagcccgaccacagctacggcgtgaagttcgtgaagagcttcatcaacagcatcagaagagccatcaacaagtacccccccatcaacctgaagatcaagtgcaacagactgaacagcatcgaccccaagcagccccccagacccttcagaagcttcgtgcccggccccctgaaggccaccctgaaggaggacgtgctgcagaaggccaagttcttccaggacaagaagtacctgagcagagtggccagaagcggcagagacgacgccatccagaacttcatgagaagcaccagccacaccttcaagaacggcagaatgatcgagagcgcccccaagcagcacgactag

SEQ ID NO: 1808 - DNA, 2112 bp, Homo sapiens
atgctgggcaccctgacccccctgagcagcctgctgctgctgctgctggtgctggtgctgggctgcggccccagagccagcagcggcggcggcgccggcggcgccgccggctacgcccccgtgaagtacatccagcccatgcagaagggccccgtgggcccccccttcagagagggcaagggccagtacctggagatgcccctgcccctgctgcccatggacctgaagggcgagcccggcccccccggcaagcccggccccagaggcccccccggcccccccggcttccccggcaagcccggcatgggcaagcccggcctgcacggccagcccggccccgccggcccccccggcttcagcagaatgggcaaggccggcccccccggcctgcccggcaaggtgggcccccccggccagcccggcctgagaggcgagcccggcatcagaggcgaccagggcctgagaggcccccccggcccccccggcctgcccggccccagcggcatcaccatccccggcaagcccggcgcccagggcgtgcccggcccccccggcttccagggcgagcccggcccccagggcgagcccggcccccccggcgacagaggcctgaagggcgacaacggcgtgggccagcccggcctgcccggcgcccccggccagggcggcgcccccggcccccccggcctgcccggccccgccggcctgggcaagcccggcctggacggcctgcccggcgcccccggcgacaagggcgagagcggcccccccggcgtgcccggccccagaggcgagcccggcgccgtgggccccaagggcccccccggcgtggacggcgtgggcgtgcccggcgccgccggcctgcccggcccccagggccccagcggcgccaagggcgagcccggcaccagaggcccccccggcctgatcggccccaccggctacggcatgcccggcctgcccggccccaagggcgacagaggccccgccggcgtgcccggcctgctgggcgacagaggcgagcccggcgaggacggcgagcccggcgagcagggcccccagggcctgggcggcccccccggcctgcccggcagcgccggcctgcccggcagaagaggcccccccggccccaagggcgaggccggccccggcggcccccccggcgtgcccggcatcagaggcgaccagggccccagcggcctggccggcaagcccggcgtgcccggcgagagaggcctgcccggcgcccacggcccccccggccccaccggccccaagggcgagcccggcttcaccggcagacccggcggccccggcgtggccggcgccctgggccagaagggcgacctgggcctgcccggccagcccggcctgagaggccccagcggcatccccggcctgcagggccccgccggccccatcggcccccagggcctgcccggcctgaagggcgagcccggcctgcccggcccccccggcgagggcagagccggcgagcccggcaccgccggccccaccggcccccccggcgtgcccggcagccccggcatcaccggcccccccggcccccccggcccccccggcccccccggcgcccccggcgccttcgacgagaccggcatcgccggcctgcacctgcccaacggcggcgtggagggcgccgtgctgggcaagggcggcaagccccagttcggcctgggcgagctgagcgcccacgccacccccgccttcaccgccgtgctgaccagccccttccccgccagcggcatgcccgtgaagttcgacagaaccctgtacaacggccacagcggctacaaccccgccaccggcatcttcacctgccccgtgggcggcgtgtactacttcgcctaccacgtgcacgtgaagggcaccaacgtgtgggtggccctgtacaagaacaacgtgcccgccacctacacctacgacgagtacaagaagggctacctggaccaggccagcggcggcgccgtgctgcagctgagacccaacgaccaggtgtgggtgcagatgcccagcgaccaggccaacggcctgtacagcaccgagtacatccacagcagcttcagcggcttcctgctgtgccccacctag

SEQ ID NO: 1809 - DNA, 1284 bp, Homo sapiens
atgctgggcaccctgacccccctgagcagcctgctgctgctgctgctggtgctggtgctgggctgcggccccagagccagcagcggcggcggcgccggcggcgccgccggctacgcccccgtgaagtacatccagcccatgcagaagggccccgtgggcccccccttcagagagggcaagggccagtacctggagatgcccctgcccctgctgcccatggacctgaagggcgagcccggcccccccggcaagcccggccccagaggcccccccggcccccccggcttccccggcaagcccggcatgggcaagcccggcctgcacggccagcccggccccgccggcccccccggcttcagcagaatgggcaaggccggcccccccggcctgcccggcaaggtgggcccccccggccagcccggcctgagaggcgagcccggcatcagaggcgaccagggcctgagaggcccccccggcccccccggcctgcccggccccagcggcatcaccatccccggcaagcccggcgcccagggcgtgcccggcccccccggcttccagggcgagcccggcccccagggcgagcccggcccccccggcgacagaggcctgaagggcgacaacggcgtgggccagcccggcctgcccggcgcccccggccagggcggcgcccccggcccccccggcctgcccggccccgccggcctgggcaagcccggcctggacggcctgcccggcgcccccggcgacaagggcgagagcggcccccccggcgccttcgacgagaccggcatcgccggcctgcacctgcccaacggcggcgtggagggcgccgtgctgggcaagggcggcaagccccagttcggcctgggcgagctgagcgcccacgccacccccgccttcaccgccgtgctgaccagccccttccccgccagcggcatgcccgtgaagttcgacagaaccctgtacaacggccacagcggctacaaccccgccaccggcatcttcacctgccccgtgggcggcgtgtactacttcgcctaccacgtgcacgtgaagggcaccaacgtgtgggtggccctgtacaagaacaacgtgcccgccacctacacctacgacgagtacaagaagggctacctggaccaggccagcggcggcgccgtgctgcagctgagacccaacgaccaggtgtgggtgcagatgcccagcgaccaggccaacggcctgtacagcaccgagtacatccacagcagcttcagcggcttcctgctgtgccccacctag

SEQ ID NO: 1810 - DNA, 2112 bp, Homo sapiens; identical to SEQ ID NO: 1808

SEQ ID NO: 1811 - DNA, 1917 bp, Homo sapiens
atgcccctgcccctgctgcccatggacctgaagggcgagcccggcccccccggcaagcccggccccagaggcccccccggcccccccggcttccccggcaagcccggcatgggcaagcccggcctgcacggccagcccggccccgccggcccccccggcttcagcagaatgggcaaggccggcccccccggcctgcccggcaaggtgggcccccccggccagcccggcctgagaggcgagcccggcatcagaggcgaccagggcctgagaggcccccccggcccccccggcctgcccggccccagcggcatcaccatccccggcaagcccggcgcccagggcgtgcccggcccccccggcttccagggcgagcccggcccccagggcgagcccggcccccccggcgacagaggcctgaagggcgacaacggcgtgggccagcccggcctgcccggcgcccccggccagggcggcgcccccggcccccccggcctgcccggccccgccggcctgggcaagcccggcctggacggcctgcccggcgcccccggcgacaagggcgagagcggcccccccggcgtgcccggccccagaggcgagcccggcgccgtgggccccaagggcccccccggcgtggacggcgtgggcgtgcccggcgccgccggcctgcccggcccccagggccccagcggcgccaagggcgagcccggcaccagaggcccccccggcctgatcggccccaccggctacggcatgcccggcctgcccggccccaagggcgacagaggccccgccggcgtgcccggcctgctgggcgacagaggcgagcccggcgaggacggcgagcccggcgagcagggcccccagggcctgggcggcccccccggcctgcccggcagcgccggcctgcccggcagaagaggcccccccggccccaagggcgaggccggccccggcggcccccccggcgtgcccggcatcagaggcgaccagggccccagcggcctggccggcaagcccggcgtgcccggcgagagaggcctgcccggcgcccacggcccccccggccccaccggccccaagggcgagcccggcttcaccggcagacccggcggccccggcgtggccggcgccctgggccagaagggcgacctgggcctgcccggccagcccggcctgagaggccccagcggcatccccggcctgcagggccccgccggccccatcggcccccagggcctgcccggcctgaagggcgagcccggcctgcccggcccccccggcgagggcagagccggcgagcccggcaccgccggccccaccggcccccccggcgtgcccggcagccccggcatcaccggcccccccggcccccccggcccccccggcccccccggcgcccccggcgccttcgacgagaccggcatcgccggcctgcacctgcccaacggcggcgtggagggcgccgtgctgggcaagggcggcaagccccagttcggcctgggcgagctgagcgcccacgccacccccgccttcaccgccgtgctgaccagccccttccccgccagcggcatgcccgtgaagttcgacagaaccctgtacaacggccacagcggctacaaccccgccaccggcatcttcacctgccccgtgggcggcgtgtactacttcgcctaccacgtgcacgtgaagggcaccaacgtgtgggtggccctgtacaagaacaacgtgcccgccacctacacctacgacgagtacaagaagggctacctggaccaggccagcggcggcgccgtgctgcagctgagacccaacgaccaggtgtgggtgcagatgcccagcgaccaggccaacggcctgtacagcaccgagtacatccacagcagcttcagcggcttcctgctgtgccccacctag

SEQ ID NO: 1812 - DNA, 2043 bp, Homo sapiens
atgctgccccagatccccttcctgctgctggtgagcctgaacctggtgcacggcgtgttctacgccgagagataccagatgcccaccggcatcaagggccccctgcccaacaccaagacccagttcttcatcccctacaccatcaagagcaagggcatcgccgtgagaggcgagcagggcacccccggcccccccggccccgccggccccagaggccaccccggccccagcggcccccccggcaagcccggctacggcagccccggcctgcagggcgagcccggcctgcccggcccccccggccccagcgccgtgggcaagcccggcgtgcccggcctgcccggcaagcccggcgagagaggcccctacggccccaagggcgacgtgggccccgccggcctgcccggccccagaggcccccccggcccccccggcatccccggccccgccggcatcagcgtgcccggcaagcccggccagcagggccccaccggcgcccccggccccagaggcttccccggcgagaagggcgcccccggcgtgcccggcatgaacggccagaagggcgagatgggctacggcgcccccggcagacccggcgagagaggcctgcccggcccccagggccccaccggccccagcggcccccccggcgtgggcaagagaggcgagaacggcgtgcccggccagcccggcatcaagggcgacagaggcttccccggcgagatgggccccatcggcccccccggcccccagggcccccccggcgagagaggccccgagggcatcggcaagcccggcgccgccggcgcccccggccagcccggcatccccggcaccaagggcctgcccggcgcccccggcatcgccggcccccccggcccccccggcttcggcaagcccggcctgcccggcctgaagggcgagagaggccccgccggcctgcccggcggccccggcgccaagggcgagcagggccccgccggcctgcccggcaagcccggcctgaccggcccccccggcaacatgggcccccagggccccaagggcatccccggcagccacggcctgcccggccccaagggcgagaccggccccgccggccccgccggctaccccggcgccaagggcgagagaggcagccccggcagcgacggcaagcccggctaccccggcaagcccggcctggacggccccaagggcaaccccggcctgcccggccccaagggcgaccccggcgtgggcggcccccccggcctgcccggccccgtgggccccgccggcgccaagggcatgcccggccacaacggcgaggccggccccagaggcgcccccggcatccccggcaccagaggccccatcggcccccccggcatccccggcttccccggcagcaagggcgaccccggcagccccggcccccccggccccgccggcatcgccaccaagggcctgaacggccccaccggcccccccggcccccccggccccagaggccacagcggcgagcccggcctgcccggcccccccggcccccccggcccccccggccaggccgtgatgcccgagggcttcatcaaggccggccagagacccagcctgagcggcacccccctggtgagcgccaaccagggcgtgaccggcatgcccgtgagcgccttcaccgtgatcctgagcaaggcctaccccgccatcggcacccccatccccttcgacaagatcctgtacaacagacagcagcactacgaccccagaaccggcatcttcacctgccagatccccggcatctactacttcagctaccacgtgcacgtgaagggcacccacgtgtgggtgggcctgtacaagaacggcacccccgtgatgtacacctacgacgagtacaccaagggctacctggaccaggccagcggcagcgccatcatcgacctgaccgagaacgaccaggtgtggctgcagctgcccaacgccgagagcaacggcctgtacagcagcgagtacgtgcacagcagcttcagcggcttcctggtggcccccatgtag

SEQ ID NO: 1813 - DNA, 2043 bp, Homo sapiens; identical to SEQ ID NO: 1812

SEQ ID NO: 1814 - DNA, 156 bp, Homo sapiens
atgctgccccagatccccttcctgctgctggtgagcctgaacctggtgcacggcgtgttctacgccgagagataccagatgcccaccggcatcaagggccccctgcccaacaccaagacccagttcttcatcccctacaccatcaagagcaagtag

SEQ ID NO: 1815 - DNA, 651 bp, Homo sapiens
atgctgccccagatccccttcctgctgctggtgagcctgaacctggtgcacggcgtgttctacgccgagagataccagatgcccaccggcatcaagggccccctgcccaacaccaagacccagttcttcatcccctacaccatcaagagcaagggcatcgccgtgagaggcgagcagggcacccccggcccccccggccccgccggccccagaggccaccccggccccagcggcccccccggcaagcccggctacggcagccccggcctgcagggcgagcccggcctgcccggcccccccggccccagcgccgtgggcaagcccggcgtgcccggcctgcccggcaagcccggcgagagaggcccctacggccccaagggcgacgtgggccccgccggcctgcccggccccagaggcccccccggcccccccggcatccccggccccgccggcatcagcgtgcccggcaagcccggccagcagggccccaccggcgcccccggccccagaggcttccccggcgagaagggcgcccccggcgtgcccggcatgaacggccagaagggcgagatgggctacggcgcccccggcagacccggcgagagaggcctgcccggcccccagggccccaccggccccagcggcccctag

SEQ ID NO: 1816 - DNA, 5211 bp, Homo sapiens
atggagagatgcagcagatgccacagactgctgctgctgctgcccctggtgctgggcctgagcgccgcccccggctgggccggcgccccccccgtggacgtgctgagagccctgagattccccagcctgcccgacggcgtgagaagagccaagggcatctgccccgccgacgtggcctacagagtggccagacccgcccagctgagcgcccccaccagacagctgttccccggcggcttccccaaggacttcagcctgctgaccgtggtgagaaccagacccggcctgcaggcccccctgctgaccctgtacagcgcccagggcgtgagacagctgggcctggagctgggcagacccgtgagattcctgtacgaggaccagaccggcagaccccagccccccagccagcccgtgttcagaggcctgagcctggccgacggcaagtggcacagagtggccgtggccgtgaagggccagagcgtgaccctgatcgtggactgcaagaagagagtgaccagacccctgcccagaagcgccagacccgtgctggacacccacggcgtgatcatcttcggcgccagaatcctggacgaggaggtgttcgagggcgacgtgcaggagctggccatcgtgcccggcgtgcaggccgcctacgagagctgcgagcagaaggagctggagtgcgagggcggccagagagagagaccccagaaccagcagccccacagagcccagagaagcccccagcagcagcccagcagactgcacagaccccagaaccaggagccccagagccagcccaccgagagcctgtactacgactacgagcccccctactacgacgtgatgaccaccggcaccacccccgactaccaggaccccacccccggcgaggaggaggagatcctggagagcagcctgctgccccccctggaggaggagcagaccgacctgcaggtgccccccaccgccgacagattccaggccgaggagtacggcgagggcggcaccgacccccccgagggcccctacgactacacctacggctacggcgacgactacagagaggagaccgagctgggccccgccctgagcgccgagaccgcccacagcggcgccgccgcccacggccccagaggcctgaagggcgagaagggcgagcccgccgtgctggagcccggcatgctggtggagggcccccccggccccgagggccccgccggcctgatcggcccccccggcatccagggcaaccccggccccgtgggcgaccccggcgagagaggcccccccggcagagccggcctgcccggcagcgacggcgcccccggcccccccggcaccagcctgatgctgcccttcagattcggcagcggcggcggcgacaagggccccgtggtggccgcccaggaggcccaggcccaggccatcctgcagcaggccagactggccctgagaggcccccccggccccatgggctacaccggcagacccggccccctgggccagcccggcagccccggcctgaagggcgagagcggcgacctgggcccccagggccccagaggcccccagggcctgaccggcccccccggcaaggccggcagaagaggcagagccggcgccgacggcgccagaggcatgcccggcgaccccggcgtgaagggcgacagaggcttcgacggcctgcccggcctgcccggcgagaagggccacagaggcgacaccggcgcccagggcctgcccggcccccccggcgaggacggcgagagaggcgacgacggcgagatcggccccagaggcctgcccggcgagagcggccccagaggcctgctgggccccaagggcccccccggcatccccggcccccccggcgtgagaggcatggacggcccccagggccccaagggcagcctgggcccccagggcgagcccggcccccccggccagcagggcacccccggcacccagggcctgcccggcccccagggcgccatcggcccccacggcgagaagggcccccagggcaagcccggcctgcccggcatgcccggcagcgacggcccccccggccaccccggcaaggagggcccccccggcaccaagggcaaccagggccccagcggcccccagggccccctgggctaccccggccccagaggcgtgaagggcgtggacggcatcagaggcctgaagggccacaagggcgagaagggcgaggacggcttccccggcttcaagggcgacatcggcgtgaagggcgacagaggcgaggtgggcgtgcccggcagcagaggcgaggacggccccgagggccccaagggcagaaccggccccaccggcgaccccggcccccccggcctgatgggcgagaagggcaagctgggcgtgcccggcctgcccggctaccccggcagacagggccccaagggcagcctgggcttccccggcttccccggcgccagcggcgagaagggcgccagaggcctgagcggcaagagcggccccagaggcgagagaggccccaccggccccagaggccagagaggccccagaggcgccaccggcaagagcggcgccaagggcaccagcggcggcgacggcccccacggcccccccggcgagagaggcctgcccggcccccagggccccaacggcttccccggccccaagggcccccccggcccccccggcaaggacggcctgcccggccaccccggccagagaggcgaggtgggcttccagggcaagaccggcccccccggcccccccggcgtggtgggcccccagggcgccgccggcgagaccggccccatgggcgagagaggccaccccggcccccccggcccccccggcgagcagggcctgcccggcaccgccggcaaggagggcaccaagggcgaccccggcccccccggcgcccccggcaaggacggccccgccggcctgagaggcttccccggcgagagaggcctgcccggcaccgccggcggccccggcctgaagggcaacgagggccccagcggcccccccggccccgccggcagccccggcgagagaggcgccgccggcagcggcggccccatcggcccccccggcagacccggcccccagggcccccccggcgccgccggcgagaagggcgtgcccggcgagaagggccccatcggccccaccggcagagacggcgtgcagggccccgtgggcctgcccggccccgccggcccccccggcgtggccggcgaggacggcgacaagggcgaggtgggcgaccccggccagaagggcaccaagggcaacaagggcgagcacggcccccccggcccccccggccccatcggccccgtgggccagcccggcgccgccggcgccgacggcgagcccggcgccagaggcccccagggccacttcggcgccaagggcgacgagggcaccagaggcttcaacggcccccccggccccatcggcctgcagggcctgcccggccccagcggcgagaagggcgagaccggcgacgtgggccccatgggcccccccggcccccccggccccagaggccccgccggccccaacggcgccgacggcccccagggcccccccggcggcgtgggcaacctgggcccccccggcgagaagggcgagcccggcgagagcggcagccccggcatccagggcgagcccggcgtgaagggccccagaggcgagagaggcgagaagggcgagagcggccagcccggcgagcccggcccccccggccccaagggccccaccggcgacgacggccccaagggcaaccccggccccgtgggcttccccggcgaccccggcccccccggcgagggcggccccagaggccaggacggcgccaagggcgacagaggcgaggacggcgagcccggccagcccggcagccccggccccaccggcgagaacggcccccccggccccctgggcaagagaggccccgccggcagccccggcagcgagggcagacagggcggcaagggcgccaagggcgaccccggcgccatcggcgcccccggcaagaccggccccgtgggccccgccggccccgccggcaagcccggccccgacggcctgagaggcctgcccggcagcgtgggccagcagggcagacccggcgccaccggccaggccggcccccccggccccgtgggcccccccggcctgcccggcctgagaggcgacgccggcgccaagggcgagaagggccaccccggcctgatcggcctgatcggcccccccggcgagcagggcgagaagggcgacagaggcctgcccggcccccagggcagccccggccagaagggcgagatgggcatccccggcgccagcggccccatcggccccggcggcccccccggcctgcccggccccgccggccccaagggcgccaagggcgccaccggccccggcggccccaagggcgagaagggcgtgcagggcccccccggccaccccggcccccccggcgaggtgatccagcccctgcccatccagatgcccaagaagaccagaagaagcgtggacggcagcagactgatgcaggaggacgaggccatccccaccggcggcgcccccggcagccccggcggcctggaggagatcttcggcagcctggacagcctgagagaggagatcgagcagatgagaagacccaccggcacccaggacagccccgccagaacctgccaggacctgaagctgtgccaccccgagctgcccgacggcgagtactgggtggaccccaaccagggctgcgccagagacgccttcagagtgttctgcaacttcaccgccggcggcgagacctgcgtgacccccagagacgacgtgacccagttcagctacgtggacagcgagggcagccccgtgggcgtggtgcagctgaccttcctgagactgctgagcgtgagcgcccaccaggacgtgagctacccctgcagcggcgccgccagagacggccccctgagactgagaggcgccaacgaggacgagctgagccccgagaccagcccctacgtgaaggagttcagagacggctgccagacccagcagggcagaaccgtgctggaggtgagaacccccgtgctggagcagctgcccgtgctggacgccagcttcagcgacctgggcgccccccccagaagaggcggcgtgctgctgggccccgtgtgcttcatgggctag

SEQ ID NO: 1817 - DNA, 5148 bp, Homo sapiens
atggagagatgcagcagatgccacagactgctgctgctgctgcccctggtgctgggcctgagcgccgcccccggctgggccggcgccccccccgtggacgtgctgagagccctgagattccccagcctgcccgacggcgtgagaagagccaagggcatctgccccgccgacgtggcctacagagtggccagacccgcccagctgagcgcccccaccagacagctgttccccggcggcttccccaaggacttcagcctgctgaccgtggtgagaaccagacccggcctgcaggcccccctgctgaccctgtacagcgcccagggcgtgagacagctgggcctggagctgggcagacccgtgagattcctgtacgaggaccagaccggcagaccccagccccccagccagcccgtgttcagaggcctgagcctggccgacggcaagtggcacagagtggccgtggccgtgaagggccagagcgtgaccctgatcgtggactgcaagaagagagtgaccagacccctgcccagaagcgccagacccgtgctggacacccacggcgtgatcatcttcggcgccagaatcctggacgaggaggtgttcgagggcgacgtgcaggagctggccatcgtgcccggcgtgcaggccgcctacgagagctgcgagcagaaggagctggagtgcgagggcggccagagagagagaccccagaaccagcagccccacagagcccagagaagcccccagcagcagcccagcagactgcacagaccccagaaccaggagccccagagccagcccaccgagagcctgtactacgactacgagcccccctactacgacgtgatgaccaccggcaccacccccgactaccaggagcagaccgacctgcaggtgccccccaccgccgacagattccaggccgaggagtacggcgagggcggcaccgacccccccgagggcccctacgactacacctacggctacggcgacgactacagagaggagaccgagctgggccccgccctgagcgccgagaccgcccacagcggcgccgccgcccacggccccagaggcctgaagggcgagaagggcgagcccgccgtgctggagcccggcatgctggtggagggcccccccggccccgagggccccgccggcctgatcggcccccccggcatccagggcaaccccggccccgtgggcgaccccggcgagagaggcccccccggcagagccggcctgcccggcagcgacggcgcccccggcccccccggcaccagcctgatgctgcccttcagattcggcagcggcggcggcgacaagggccccgtggtggccgcccaggaggcccaggcccaggccatcctgcagcaggccagactggccctgagaggcccccccggccccatgggctacaccggcagacccggccccctgggccagcccggcagccccggcctgaagggcgagagcggcgacctgggcccccagggccccagaggcccccagggcctgaccggcccccccggcaaggccggcagaagaggcagagccggcgccgacggcgccagaggcatgcccggcgaccccggcgtgaagggcgacagaggcttcgacggcctgcccggcctgcccggcgagaagggccacagaggcgacaccggcgcccagggcctgcccggcccccccggcgaggacggcgagagaggcgacgacggcgagatcggccccagaggcctgcccggcgagagcggccccagaggcctgctgggccccaagggcccccccggcatccccggcccccccggcgtgagaggcatggacggcccccagggccccaagggcagcctgggcccccagggcgagcccggcccccccggccagcagggcacccccggcacccagggcctgcccggcccccagggcgccatcggcccccacggcgagaagggcccccagggcaagcccggcctgcccggcatgcccggcagcgacggcccccccggccaccccggcaaggagggcccccccggcaccaagggcaaccagggccccagcggcccccagggccccctgggctaccccggccccagaggcgtgaagggcgtggacggcatcagaggcctgaagggccacaagggcgagaagggcgaggacggcttccccggcttcaagggcgacatcggcgtgaagggcgacagaggcgaggtgggcgtgcccggcagcagaggcgaggacggccccgagggccccaagggcagaaccggccccaccggcgaccccggcccccccggcctgatgggcgagaagggcaagctgggcgtgcccggcctgcccggctaccccggcagacagggccccaagggcagcctgggcttccccggcttccccggcgccagcggcgagaagggcgccagaggcctgagcggcaagagcggccccagaggcgagagaggccccaccggccccagaggccagagaggccccagaggcgccaccggcaagagcggcgccaagggcaccagcggcggcgacggcccccacggcccccccggcgagagaggcctgcccggcccccagggccccaacggcttccccggccccaagggcccccccggcccccccggcaaggacggcctgcccggccaccccggccagagaggcgaggtgggcttccagggcaagaccggcccccccggcccccccggcgtggtgggcccccagggcgccgccggcgagaccggccccatgggcgagagaggccaccccggcccccccggcccccccggcgagcagggcctgcccggcaccgccggcaaggagggcaccaagggcgaccccggcccccccggcgcccccggcaaggacggccccgccggcctgagaggcttccccggcgagagaggcctgcccggcaccgccggcggccccggcctgaagggcaacgagggccccagcggcccccccggccccgccggcagccccggcgagagaggcgccgccggcagcggcggccccatcggcccccccggcagacccggcccccagggcccccccggcgccgccggcgagaagggcgtgcccggcgagaagggccccatcggccccaccggcagagacggcgtgcagggccccgtgggcctgcccggccccgccggcccccccggcgtggccggcgaggacggcgacaagggcgaggtgggcgaccccggccagaagggcaccaagggcaacaagggcgagcacggcccccccggcccccccggccccatcggccccgtgggccagcccggcgccgccggcgccgacggcgagcccggcgccagaggcccccagggccacttcggcgccaagggcgacgagggcaccagaggcttcaacggcccccccggccccatcggcctgcagggcctgcccggccccagcggcgagaagggcgagaccggcgacgtgggccccatgggcccccccggcccccccggccccagaggccccgccggccccaacggcgccgacggcccccagggcccccccggcggcgtgggcaacctgggcccccccggcgagaagggcgagcccggcgagagcggcagccccggcatccagggcgagcccggcgtgaagggccccagaggcgagagaggcgagaagggcgagagcggccagcccggcgagcccggcccccccggccccaagggccccaccggcgacgacggccccaagggcaaccccggccccgtgggcttccccggcgaccccggcccccccggcgagggcggccccagaggccaggacggcgccaagggcgacagaggcgaggacggcgagcccggccagcccggcagccccggccccaccggcgagaacggcccccccggccccctgggcaagagaggccccgccggcagccccggcagcgagggcagacagggcggcaagggcgccaagggcgaccccggcgccatcggcgcccccggcaagaccggccccgtgggccccgccggccccgccggcaagcccggccccgacggcctgagaggcctgcccggcagcgtgggccagcagggcagacccggcgccaccggccaggccggcccccccggccccgtgggcccccccggcctgcccggcctgagaggcgacgccggcgccaagggcgagaagggccaccccggcctgatcggcctgatcggcccccccggcgagcagggcgagaagggcgacagaggcctgcccggcccccagggcagccccggccagaagggcgagatgggcatccccggcgccagcggccccatcggccccggcggcccccccggcctgcccggccccgccggccccaagggcgccaagggcgccaccggccccggcggccccaagggcgagaagggcgtgcagggcccccccggccaccccggcccccccggcgaggtgatccagcccctgcccatccagatgcccaagaagaccagaagaagcgtggacggcagcagactgatgcaggaggacgaggccatccccaccggcggcgcccccggcagccccggcggcctggaggagatcttcggcagcctggacagcctgagagaggagatcgagcagatgagaagacccaccggcacccaggacagccccgccagaacctgccaggacctgaagctgtgccaccccgagctgcccgacggcgagtactgggtggaccccaaccagggctgcgccagagacgccttcagagtgttctgcaacttcaccgccggcggcgagacctgcgtgacccccagagacgacgtgacccagttcagctacgtggacagcgagggcagccccgtgggcgtggtgcagctgaccttcctgagactgctgagcgtgagcgcccaccaggacgtgagctacccctgcagcggcgccgccagagacggccccctgagactgagaggcgccaacgaggacgagctgagccccgagaccagcccctacgtgaaggagttcagagacggctgccagacccagcagggcagaaccgtgctggaggtgagaacccccgtgctggagcagctgcccgtgctggacgccagcttcagcgacctgggcgccccccccagaagaggcggcgtgctgctgggccccgtgtgcttcatgggctag

SEQ ID NO: 1818 - DNA, 4890 bp, Homo sapiens
atggagagatgcagcagatgccacagactgctgctgctgctgcccctggtgctgggcctgagcgccgcccccggctgggccggcgccccccccgtggacgtgctgagagccctgagattccccagcctgcccgacggcgtgagaagagccaagggcatctgccccgccgacgtggcctacagagtggccagacccgcccagctgagcgcccccaccagacagctgttccccggcggcttccccaaggacttcagcctgctgaccgtggtgagaaccagacccggcctgcaggcccccctgctgaccctgtacagcgcccagggcgtgagacagctgggcctggagctgggcagacccgtgagattcctgtacgaggaccagaccggcagaccccagccccccagccagcccgtgttcagaggcctgagcctggccgacggcaagtggcacagagtggccgtggccgtgaagggccagagcgtgaccctgatcgtggactgcaagaagagagtgaccagacccctgcccagaagcgccagacccgtgctggacacccacggcgtgatcatcttcggcgccagaatcctggacgaggaggtgttcgagggcgacgtgcaggagctggccatcgtgcccggcgtgcaggccgcctacgagagctgcgagcagaaggagctggagtgcgagggcggccagagagagagaccccagaaccagcagccccacagagcccagagaagcccccagcagcagcccagcagactgcacagaccccagaaccaggagccccagagccaggccgcccacggccccagaggcctgaagggcgagaagggcgagcccgccgtgctggagcccggcatgctggtggagggcccccccggccccgagggccccgccggcctgatcggcccccccggcatccagggcaaccccggccccgtgggcgaccccggcgagagaggcccccccggcagagccggcctgcccggcagcgacggcgcccccggcccccccggcaccagcctgatgctgcccttcagattcggcagcggcggcggcgacaagggccccgtggtggccgcccaggaggcccaggcccaggccatcctgcagcaggccagactggccctgagaggcccccccggccccatgggctacaccggcagacccggccccctgggccagcccggcagccccggcctgaagggcgagagcggcgacctgggcccccagggccccagaggcccccagggcctgaccggcccccccggcaaggccggcagaagaggcagagccggcgccgacggcgccagaggcatgcccggcgaccccggcgtgaagggcgacagaggcttcgacggcctgcccggcctgcccggcgagaagggccacagaggcgacaccggcgcccagggcctgcccggcccccccggcgaggacggcgagagaggcgacgacggcgagatcggccccagaggcctgcccggcgagagcggccccagaggcctgctgggccccaagggcccccccggcatccccggcccccccggcgtgagaggcatggacggcccccagggccccaagggcagcctgggcccccagggcgagcccggcccccccggccagcagggcacccccggcacccagggcctgcccggcccccagggcgccatcggcccccacggcgagaagggcccccagggcaagcccggcctgcccggcatgcccggcagcgacggcccccccggccaccccggcaaggagggcccccccggcaccaagggcaaccagggccccagcggcccccagggccccctgggctaccccggccccagaggcgtgaagggcgtggacggcatcagaggcctgaagggccacaagggcgagaagggcgaggacggcttccccggcttcaagggcgacatcggcgtgaagggcgacagaggcgaggtgggcgtgcccggcagcagaggcgaggacggccccgagggccccaagggcagaaccggccccaccggcgaccccggcccccccggcctgatgggcgagaagggcaagctgggcgtgcccggcctgcccggctaccccggcagacagggccccaagggcagcctgggcttccccggcttccccggcgccagcggcgagaagggcgccagaggcctgagcggcaagagcggccccagaggcgagagaggccccaccggccccagaggccagagaggccccagaggcgccaccggcaagagcggcgccaagggcaccagcggcggcgacggcccccacggcccccccggcgagagaggcctgcccggcccccagggccccaacggcttccccggccccaagggcccccccggcccccccggcaaggacggcctgcccggccaccccggccagagaggcgaggtgggcttccagggcaagaccggcccccccggcccccccggcgtggtgggcccccagggcgccgccggcgagaccggccccatgggcgagagaggccaccccggcccccccggcccccccggcgagcagggcctgcccggcaccgccggcaaggagggcaccaagggcgaccccggcccccccggcgcccccggcaaggacggccccgccggcctgagaggcttccccggcgagagaggcctgcccggcaccgccggcggccccggcctgaagggcaacgagggccccagcggcccccccggccccgccggcagccccggcgagagaggcgccgccggcagcggcggccccatcggcccccccggcagacccggcccccagggcccccccggcgccgccggcgagaagggcgtgcccggcgagaagggccccatcggccccaccggcagagacggcgtgcagggccccgtgggcctgcccggccccgccggcccccccggcgtggccggcgaggacggcgacaagggcgaggtgggcgaccccggccagaagggcaccaagggcaacaagggcgagcacggcccccccggcccccccggccccatcggccccgtgggccagcccggcgccgccggcgccgacggcgagcccggcgccagaggcccccagggccacttcggcgccaagggcgacgagggcaccagaggcttcaacggcccccccggccccatcggcctgcagggcctgcccggccccagcggcgagaagggcgagaccggcgacgtgggccccatgggcccccccggcccccccggccccagaggccccgccggccccaacggcgccgacggcccccagggcccccccggcggcgtgggcaacctgggcccccccggcgagaagggcgagcccggcgagagcggcagccccggcatccagggcgagcccggcgtgaagggccccagaggcgagagaggcgagaagggcgagagcggccagcccggcgagcccggcccccccggccccaagggccccaccggcgacgacggccccaagggcaaccccggccccgtgggcttccccggcgaccccggcccccccggcgagggcggccccagaggccaggacggcgccaagggcgacagaggcgaggacggcgagcccggccagcccggcagccccggccccaccggcgagaacggcccccccggccccctgggcaagagaggccccgccggcagccccggcagcgagggcagacagggcggcaagggcgccaagggcgaccccggcgccatcggcgcccccggcaagaccggccccgtgggccccgccggccccgccggcaagcccggccccgacggcctgagaggcctgcccggcagcgtgggccagcagggcagacccggcgccaccggccaggccggcccccccggccccgtgggcccccccggcctgcccggcctgagaggcgacgccggcgccaagggcgagaagggccaccccggcctgatcggcctgatcggcccccccggcgagcagggcgagaagggcgacagaggcctgcccggcccccagggcagccccggccagaagggcgagatgggcatccccggcgccagcggccccatcggccccggcggcccccccggcctgcccggccccgccggccccaagggcgccaagggcgccaccggccccggcggccccaagggcgagaagggcgtgcagggcccccccggccaccccggcccccccggcgaggtgatccagcccctgcccatccagatgcccaagaagaccagaagaagcgtggacggcagcagactgatgcaggaggacgaggccatccccaccggcggcgcccccggcagccccggcggcctggaggagatcttcggcagcctggacagcctgagagaggagatcgagcagatgagaagacccaccggcacccaggacagccccgccagaacctgccaggacctgaagctgtgccaccccgagctgcccgacggcgagtactgggtggaccccaaccagggctgcgccagagacgccttcagagtgttctgcaacttcaccgccggcggcgagacctgcgtgacccccagagacgacgtgacccagttcagctacgtggacagcgagggcagccccgtgggcgtggtgcagctgaccttcctgagactgctgagcgtgagcgcccaccaggacgtgagctacccctgcagcggcgccgccagagacggccccctgagactgagaggcgccaacgaggacgagctgagccccgagaccagcccctacgtgaaggagttcagagacggctgccagacccagcagggcagaaccgtgctggaggtgagaacccccgtgctggagcagctgcccgtgctggacgccagcttcagcgacctgggcgccccccccagaagaggcggcgtgctgctgggccccgtgtgcttcatgggctag

SEQ ID NO: 1819 - DNA, 4953 bp, Homo sapiens
atggagagatgcagcagatgccacagactgctgctgctgctgcccctggtgctgggcctgagcgccgcccccggctgggccggcgccccccccgtggacgtgctgagagccctgagattccccagcctgcccgacggcgtgagaagagccaagggcatctgccccgccgacgtggcctacagagtggccagacccgcccagctgagcgcccccaccagacagctgttccccggcggcttccccaaggacttcagcctgctgaccgtggtgagaaccagacccggcctgcaggcccccctgctgaccctgtacagcgcccagggcgtgagacagctgggcctggagctgggcagacccgtgagattcctgtacgaggaccagaccggcagaccccagccccccagccagcccgtgttcagaggcctgagcctggccgacggcaagtggcacagagtggccgtggccgtgaagggccagagcgtgaccctgatcgtggactgcaagaagagagtgaccagacccctgcccagaagcgccagacccgtgctggacacccacggcgtgatcatcttcggcgccagaatcctggacgaggaggtgttcgagggcgacgtgcaggagctggccatcgtgcccggcgtgcaggccgcctacgagagctgcgagcagaaggagctggagtgcgagggcggccagagagagagaccccagaaccagcagccccacagagcccagagaagcccccagcagcagcccagcagactgcacagaccccagaaccaggagccccagagccaggaccccacccccggcgaggaggaggagatcctggagagcagcctgctgccccccctggaggaggccgcccacggccccagaggcctgaagggcgagaagggcgagcccgccgtgctggagcccggcatgctggtggagggcccccccggccccgagggccccgccggcctgatcggcccccccggcatccagggcaaccccggccccgtgggcgaccccggcgagagaggcccccccggcagagccggcctgcccggcagcgacggcgcccccggcccccccggcaccagcctgatgctgcccttcagattcggcagcggcggcggcgacaagggccccgtggtggccgcccaggaggcccaggcccaggccatcctgcagcaggccagactggccctgagaggcccccccggccccatgggctacaccggcagacccggccccctgggccagcccggcagccccggcctgaagggcgagagcggcgacctgggcccccagggccccagaggcccccagggcctgaccggcccccccggcaaggccggcagaagaggcagagccggcgccgacggcgccagaggcatgcccggcgaccccggcgtgaagggcgacagaggcttcgacggcctgcccggcctgcccggcgagaagggccacagaggcgacaccggcgcccagggcctgcccggcccccccggcgaggacggcgagagaggcgacgacggcgagatcggccccagaggcctgcccggcgagagcggccccagaggcctgctgggccccaagggcccccccggcatccccggcccccccggcgtgagaggcatggacggcccccagggccccaagggcagcctgggcccccagggcgagcccggcccccccggccagcagggcacccccggcacccagggcctgcccggcccccagggcgccatcggcccccacggcgagaagggcccccagggcaagcccggcctgcccggcatgcccggcagcgacggcccccccggccaccccggcaaggagggcccccccggcaccaagggcaaccagggccccagcggcccccagggccccctgggctaccccggccccagaggcgtgaagggcgtggacggcatcagaggcctgaagggccacaagggcgagaagggcgaggacggcttccccggcttcaagggcgacatcggcgtgaagggcgacagaggcgaggtgggcgtgcccggcagcagaggcgaggacggccccgagggccccaagggcagaaccggccccaccggcgaccccggcccccccggcctgatgggcgagaagggcaagctgggcgtgcccggcctgcccggctaccccggcagacagggccccaagggcagcctgggcttccccggcttccccggcgccagcggcgagaagggcgccagaggcctgagcggcaagagcggccccagaggcgagagaggccccaccggccccagaggccagagaggccccagaggcgccaccggcaagagcggcgccaagggcaccagcggcggcgacggcccccacggcccccccggcgagagaggcctgcccggcccccagggccccaacggcttccccggccccaagggcccccccggcccccccggcaaggacggcctgcccggccaccccggccagagaggcgaggtgggcttccagggcaagaccggcccccccggcccccccggcgtggtgggcccccagggcgccgccggcgagaccggccccatgggcgagagaggccaccccggcccccccggcccccccggcgagcagggcctgcccggcaccgccggcaaggagggcaccaagggcgaccccggcccccccggcgcccccggcaaggacggccccgccggcctgagaggcttccccggcgagagaggcctgcccggcaccgccggcggccccggcctgaagggcaacgagggccccagcggcccccccggccccgccggcagccccggcgagagaggcgccgccggcagcggcggccccatcggcccccccggcagacccggcccccagggcccccccggcgccgccggcgagaagggcgtgcccggcgagaagggccccatcggccccaccggcagagacggcgtgcagggccccgtgggcctgcccggccccgccggcccccccggcgtggccggcgaggacggcgacaagggcgaggtgggcgaccccggccagaagggcaccaagggcaacaagggcgagcacggcccccccggcccccccggccccatcggccccgtgggccagcccggcgccgccggcgccgacggcgagcccggcgccagaggcccccagggccacttcggcgccaagggcgacgagggcaccagaggcttcaacggcccccccggccccatcggcctgcagggcctgcccggccccagcggcgagaagggcgagaccggcgacgtgggccccatgggcccccccggcccccccggccccagaggccccgccggccccaacggcgccgacggcccccagggcccccccggcggcgtgggcaacctgggcccccccggcgagaagggcgagcccggcgagagcggcagccccggcatccagggcgagcccggcgtgaagggccccagaggcgagagaggcgagaagggcgagagcggccagcccggcgagcccggcccccccggccccaagggccccaccggcgacgacggccccaagggcaaccccggccccgtgggcttccccggcgaccccggcccccccggcgagggcggccccagaggccaggacggcgccaagggcgacagaggcgaggacggcgagcccggccagcccggcagccccggccccaccggcgagaacggcccccccggccccctgggcaagagaggccccgccggcagccccggcagcgagggcagacagggcggcaagggcgccaagggcgaccccggcgccatcggcgcccccggcaagaccggccccgtgggccccgccggccccgccggcaagcccggccccgacggcctgagaggcctgcccggcagcgtgggccagcagggcagacccggcgccaccggccaggccggcccccccggccccgtgggcccccccggcctgcccggcctgagaggcgacgccggcgccaagggcgagaagggccaccccggcctgatcggcctgatcggcccccccggcgagcagggcgagaagggcgacagaggcctgcccggcccccagggcagccccggccagaagggcgagatgggcatccccggcgccagcggccccatcggccccggcggcccccccggcctgcccggccccgccggccccaagggcgccaagggcgccaccggccccggcggccccaagggcgagaagggcgtgcagggcccccccggccaccccggcccccccggcgaggtgatccagcccctgcccatccagatgcccaagaagaccagaagaagcgtggacggcagcagactgatgcaggaggacgaggccatccccaccggcggcgcccccggcagccccggcggcctggaggagatcttcggcagcctggacagcctgagagaggagatcgagcagatgagaagacccaccggcacccaggacagccccgccagaacctgccaggacctgaagctgtgccaccccgagctgcccgacggcgagtactgggtggaccccaaccagggctgcgccagagacgccttcagagtgttctgcaacttcaccgccggcggcgagacctgcgtgacccccagagacgacgtgacccagttcagctacgtggacagcgagggcagccccgtgggcgtggtgcagctgaccttcctgagactgctgagcgtgagcgcccaccaggacgtgagctacccctgcagcggcgccgccagagacggccccctgagactgagaggcgccaacgaggacgagctgagccccgagaccagcccctacgtgaaggagttcagagacggctgccagacccagcagggcagaaccgtgctggaggtgagaacccccgtgctggagcagctgcccgtgctggacgccagcttcagcgacctgggcgccccccccagaagaggcggcgtgctgctgggccccgtgtgcttcatgggctag

SEQ ID NO: 1820 - DNA, 4968 bp, Homo sapiens
atggagagatgcagcagatgccacagactgctgctgctgctgcccctggtgctgggcctgagcgccgcccccggctgggccggcgccccccccgtggacgtgctgagagccctgagattccccagcctgcccgacggcgtgagaagagccaagggcatctgccccgccgacgtggcctacagagtggccagacccgcccagctgagcgcccccaccagacagctgttccccggcggcttccccaaggacttcagcctgctgaccgtggtgagaaccagacccggcctgcaggcccccctgctgaccctgtacagcgcccagggcgtgagacagctgggcctggagctgggcagacccgtgagattcctgtacgaggaccagaccggcagaccccagccccccagccagcccgtgttcagaggcctgagcctggccgacggcaagtggcacagagtggccgtggccgtgaagggccagagcgtgaccctgatcgtggactgcaagaagagagtgaccagacccctgcccagaagcgccagacccgtgctggacacccacggcgtgatcatcttcggcgccagaatcctggacgaggaggtgttcgagggcgacgtgcaggagctggccatcgtgcccggcgtgcaggccgcctacgagagctgcgagcagaaggagctggagtgcgagggcggccagagagagagaccccagaaccagcagccccacagagcccagagaagcccccagcagcagcccagcagactgcacagaccccagaaccaggagccccagagccagcccaccgagagcctgtactacgactacgagcccccctactacgacgtgatgaccaccggcaccacccccgactaccaggccgcccacggccccagaggcctgaagggcgagaagggcgagcccgccgtgctggagcccggcatgctggtggagggcccccccggccccgagggccccgccggcctgatcggcccccccggcatccagggcaaccccggccccgtgggcgaccccggcgagagaggcccccccggcagagccggcctgcccggcagcgacggcgcccccggcccccccggcaccagcctgatgctgcccttcagattcggcagcggcggcggcgacaagggccccgtggtggccgcccaggaggcccaggcccaggccatcctgcagcaggccagactggccctgagaggcccccccggccccatgggctacaccggcagacccggccccctgggccagcccggcagccccggcctgaagggcgagagcggcgacctgggcccccagggccccagaggcccccagggcctgaccggcccccccggcaaggccggcagaagaggcagagccggcgccgacggcgccagaggcatgcccggcgaccccggcgtgaagggcgacagaggcttcgacggcctgcccggcctgcccggcgagaagggccacagaggcgacaccggcgcccagggcctgcccggcccccccggcgaggacggcgagagaggcgacgacggcgagatcggccccagaggcctgcccggcgagagcggccccagaggcctgctgggccccaagggcccccccggcatccccggcccccccggcgtgagaggcatggacggcccccagggccccaagggcagcctgggcccccagggcgagcccggcccccccggccagcagggcacccccggcacccagggcctgcccggcccccagggcgccatcggcccccacggcgagaagggcccccagggcaagcccggcctgcccggcatgcccggcagcgacggcccccccggccaccccggcaaggagggcccccccggcaccaagggcaaccagggccccagcggcccccagggccccctgggctaccccggccccagaggcgtgaagggcgtggacggcatcagaggcctgaagggccacaagggcgagaagggcgaggacggcttccccggcttcaagggcgacatcggcgtgaagggcgacagaggcgaggtgggcgtgcccggcagcagaggcgaggacggccccgagggccccaagggcagaaccggccccaccggcgaccccggcccccccggcctgatgggcgagaagggcaagctgggcgtgcccggcctgcccggctaccccggcagacagggccccaagggcagcctgggcttccccggcttccccggcgccagcggcgagaagggcgccagaggcctgagcggcaagagcggccccagaggcgagagaggccccaccggccccagaggccagagaggccccagaggcgccaccggcaagagcggcgccaagggcaccagcggcggcgacggcccccacggcccccccggcgagagaggcctgcccggcccccagggccccaacggcttccccggccccaagggcccccccggcccccccggcaaggacggcctgcccggccaccccggccagagaggcgaggtgggcttccagggcaagaccggcccccccggcccccccggcgtggtgggcccccagggcgccgccggcgagaccggccccatgggcgagagaggccaccccggcccccccggcccccccggcgagcagggcctgcccggcaccgccggcaaggagggcaccaagggcgaccccggcccccccggcgcccccggcaaggacggccccgccggcctgagaggcttccccggcgagagaggcctgcccggcaccgccggcggccccggcctgaagggcaacgagggccccagcggcccccccggccccgccggcagccccggcgagagaggcgccgccggcagcggcggccccatcggcccccccggcagacccggcccccagggcccccccggcgccgccggcgagaagggcgtgcccggcgagaagggccccatcggccccaccggcagagacggcgtgcagggccccgtgggcctgcccggccccgccggcccccccggcgtggccggcgaggacggcgacaagggcgaggtgggcgaccccggccagaagggcaccaagggcaacaagggcgagcacggcccccccggcccccccggccccatcggccccgtgggccagcccggcgccgccggcgccgacggcgagcccggcgccagaggcccccagggccacttcggcgccaagggcgacgagggcaccagaggcttcaacggcccccccggccccatcggcctgcagggcctgcccggccccagcggcgagaagggcgagaccggcgacgtgggccccatgggcccccccggcccccccggccccagaggccccgccggccccaacggcgccgacggcccccagggcccccccggcggcgtgggcaacctgggcccccccggcgagaagggcgagcccggcgagagcggcagccccggcatccagggcgagcccggcgtgaagggccccagaggcgagagaggcgagaagggcgagagcggccagcccggcgagcccggcccccccggccccaagggccccaccggcgacgacggccccaagggcaaccccggccccgtgggcttccccggcgaccccggcccccccggcgagggcggccccagaggccaggacggcgccaagggcgacagaggcgaggacggcgagcccggccagcccggcagccccggccccaccggcgagaacggcccccccggccccctgggcaagagaggccccgccggcagccccggcagcgagggcagacagggcggcaagggcgccaagggcgaccccggcgccatcggcgcccccggcaagaccggccccgtgggccccgccggccccgccggcaagcccggccccgacggcctgagaggcctgcccggcagcgtgggccagcagggcagacccggcgccaccggccaggccggcccccccggccccgtgggcccccccggcctgcccggcctgagaggcgacgccggcgccaagggcgagaagggccaccccggcctgatcggcctgatcggcccccccggcgagcagggcgagaagggcgacagaggcctgcccggcccccagggcagccccggccagaagggcgagatgggcatccccggcgccagcggccccatcggccccggcggcccccccggcctgcccggccccgccggccccaagggcgccaagggcgccaccggccccggcggccccaagggcgagaagggcgtgcagggcccccccggccaccccggcccccccggcgaggtgatccagcccctgcccatccagatgcccaagaagaccagaagaagcgtggacggcagcagactgatgcaggaggacgaggccatccccaccggcggcgcccccggcagccccggcggcctggaggagatcttcggcagcctggacagcctgagagaggagatcgagcagatgagaagacccaccggcacccaggacagccccgccagaacctgccaggacctgaagctgtgccaccccgagctgcccgacggcgagtactgggtggaccccaaccagggctgcgccagagacgccttcagagtgttctgcaacttcaccgccggcggcgagacctgcgtgacccccagagacgacgtgacccagttcagctacgtggacagcgagggcagccccgtgggcgtggtgcagctgaccttcctgagactgctgagcgtgagcgcccaccaggacgtgagctacccctgcagcggcgccgccagagacggccccctgagactgagaggcgccaacgaggacgagctgagccccgagaccagcccctacgtgaaggagttcagagacggctgccagacccagcagggcagaaccgtgctggaggtgagaacccccgtgctggagcagctgcccgtgctggacgccagcttcagcgacctgggcgccccccccagaagaggcggcgtgctgctgggccccgtgtgcttcatgggctag

SEQ ID NO: 1821 - DNA, 5070 bp, Homo sapiens
atggagagatgcagcagatgccacagactgctgctgctgctgcccctggtgctgggcctgagcgccgcccccggctgggccggcgccccccccgtggacgtgctgagagccctgagattccccagcctgcccgacggcgtgagaagagccaagggcatctgccccgccgacgtggcctacagagtggccagacccgcccagctgagcgcccccaccagacagctgttccccggcggcttccccaaggacttcagcctgctgaccgtggtgagaaccagacccggcctgcaggcccccctgctgaccctgtacagcgcccagggcgtgagacagctgggcctggagctgggcagacccgtgagattcctgtacgaggaccagaccggcagaccccagccccccagccagcccgtgttcagaggcctgagcctggccgacggcaagtggcacagagtggccgtggccgtgaagggccagagcgtgaccctgatcgtggactgcaagaagagagtgaccagacccctgcccagaagcgccagacccgtgctggacacccacggcgtgatcatcttcggcgccagaatcctggacgaggaggtgttcgagggcgacgtgcaggagctggccatcgtgcccggcgtgcaggccgcctacgagagctgcgagcagaaggagctggagtgcgagggcggccagagagagagaccccagaaccagcagccccacagagcccagagaagcccccagcagcagcccagcagactgcacagaccccagaaccaggagccccagagccaggagcagaccgacctgcaggtgccccccaccgccgacagattccaggccgaggagtacggcgagggcggcaccgacccccccgagggcccctacgactacacctacggctacggcgacgactacagagaggagaccgagctgggccccgccctgagcgccgagaccgcccacagcggcgccgccgcccacggccccagaggcctgaagggcgagaagggcgagcccgccgtgctggagcccggcatgctggtggagggcccccccggccccgagggccccgccggcctgatcggcccccccggcatccagggcaaccccggccccgtgggcgaccccggcgagagaggcccccccggcagagccggcctgcccggcagcgacggcgcccccggcccccccggcaccagcctgatgctgcccttcagattcggcagcggcggcggcgacaagggccccgtggtggccgcccaggaggcccaggcccaggccatcctgcagcaggccagactggccctgagaggcccccccggccccatgggctacaccggcagacccggccccctgggccagcccggcagccccggcctgaagggcgagagcggcgacctgggcccccagggccccagaggcccccagggcctgaccggcccccccggcaaggccggcagaagaggcagagccggcgccgacggcgccagaggcatgcccggcgaccccggcgtgaagggcgacagaggcttcgacggcctgcccggcctgcccggcgagaagggccacagaggcgacaccggcgcccagggcctgcccggcccccccggcgaggacggcgagagaggcgacgacggcgagatcggccccagaggcctgcccggcgagagcggccccagaggcctgctgggccccaagggcccccccggcatccccggcccccccggcgtgagaggcatggacggcccccagggccccaagggcagcctgggcccccagggcgagcccggcccccccggccagcagggcacccccggcacccagggcctgcccggcccccagggcgccatcggcccccacggcgagaagggcccccagggcaagcccggcctgcccggcatgcccggcagcgacggcccccccggccaccccggcaaggagggcccccccggcaccaagggcaaccagggccccagcggcccccagggccccctgggctaccccggccccagaggcgtgaagggcgtggacggcatcagaggcctgaagggccacaagggcgagaagggcgaggacggcttccccggcttcaagggcgacatcggcgtgaagggcgacagaggcgaggtgggcgtgcccggcagcagaggcgaggacggccccgagggccccaagggcagaaccggccccaccggcgaccccggcccccccggcctgatgggcgagaagggcaagctgggcgtgcccggcctgcccggctaccccggcagacagggccccaagggcagcctgggcttccccggcttccccggcgccagcggcgagaagggcgccagaggcctgagcggcaagagcggccccagaggcgagagaggccccaccggccccagaggccagagaggccccagaggcgccaccggcaagagcggcgccaagggcaccagcggcggcgacggcccccacggcccccccggcgagagaggcctgcccggcccccagggccccaacggcttccccggccccaagggcccccccggcccccccggcaaggacggcctgcccggccaccccggccagagaggcgaggtgggcttccagggcaagaccggcccccccggcccccccggcgtggtgggcccccagggcgccgccggcgagaccggccccatgggcgagagaggccaccccggcccccccggcccccccggcgagcagggcctgcccggcaccgccggcaaggagggcaccaagggcgaccccggcccccccggcgcccccggcaaggacggccccgccggcctgagaggcttccccggcgagagaggcctgcccggcaccgccggcggccccggcctgaagggcaacgagggccccagcggcccccccggccccgccggcagccccggcgagagaggcgccgccggcagcggcggccccatcggcccccccggcagacccggcccccagggcccccccggcgccgccggcgagaagggcgtgcccggcgagaagggccccatcggccccaccggcagagacggcgtgcagggccccgtgggcctgcccggccccgccggcccccccggcgtggccggcgaggacggcgacaagggcgaggtgggcgaccccggccagaagggcaccaagggcaacaagggcgagcacggcccccccggcccccccggccccatcggccccgtgggccagcccggcgccgccggcgccgacggcgagcccggcgccagaggcccccagggccacttcggcgccaagggcgacgagggcaccagaggcttcaacggcccccccggccccatcggcctgcagggcctgcccggccccagcggcgagaagggcgagaccggcgacgtgggccccatgggcccccccggcccccccggccccagaggccccgccggccccaacggcgccgacggcccccagggcccccccggcggcgtgggcaacctgggcccccccggcgagaagggcgagcccggcgagagcggcagccccggcatccagggcgagcccggcgtgaagggccccagaggcgagagaggcgagaagggcgagagcggccagcccggcgagcccggcccccccggccccaagggccccaccggcgacgacggccccaagggcaaccccggccccgtgggcttccccggcgaccccggcccccccggcgagggcggccccagaggccaggacggcgccaagggcgacagaggcgaggacggcgagcccggccagcccggcagccccggccccaccggcgagaacggcccccccggccccctgggcaagagaggccccgccggcagccccggcagcgagggcagacagggcggcaagggcgccaagggcgaccccggcgccatcggcgcccccggcaagaccggccccgtgggccccgccggccccgccggcaagcccggccccgacggcctgagaggcctgcccggcagcgtgggccagcagggcagacccggcgccaccggccaggccggcccccccggccccgtgggcccccccggcctgcccggcctgagaggcgacgccggcgccaagggcgagaagggccaccccggcctgatcggcctgatcggcccccccggcgagcagggcgagaagggcgacagaggcctgcccggcccccagggcagccccggccagaagggcgagatgggcatccccggcgccagcggccccatcggccccggcggcccccccggcctgcccggccccgccggccccaagggcgccaagggcgccaccggccccggcggccccaagggcgagaagggcgtgcagggcccccccggccaccccggcccccccggcgaggtgatccagcccctgcccatccagatgcccaagaagaccagaagaagcgtggacggcagcagactgatgcaggaggacgaggccatccccaccggcggcgcccccggcagccccggcggcctggaggagatcttcggcagcctggacagcctgagagaggagatcgagcagatgagaagacccaccggcacccaggacagccccgccagaacctgccaggacctgaagctgtgccaccccgagctgcccgacggcgagtactgggtggaccccaaccagggctgcgccagagacgccttcagagtgttctgcaacttcaccgccggcggcgagacctgcgtgacccccagagacgacgtgacccagttcagctacgtggacagcgagggcagccccgtgggcgtggtgcagctgaccttcctgagactgctgagcgtgagcgcccaccaggacgtgagctacccctgcagcggcgccgccagagacggccccctgagactgagaggcgccaacgaggacgagctgagccccgagaccagcccctacgtgaaggagttcagagacggctgccagacccagcagggcagaaccgtgctggaggtgagaacccccgtgctggagcagctgcccgtgctggacgccagcttcagcgacctgggcgccccccccagaagaggcggcgtgctgctgggccccgtgtgcttcatgggctag

SEQ ID NO: 1822 - DNA, 5133 bp, Homo sapiens
atggagagatgcagcagatgccacagactgctgctgctgctgcccctggtgctgggcctgagcgccgcccccggctgggccggcgccccccccgtggacgtgctgagagccctgagattccccagcctgcccgacggcgtgagaagagccaagggcatctgccccgccgacgtggcctacagagtggccagacccgcccagctgagcgcccccaccagacagctgttccccggcggcttccccaaggacttcagcctgctgaccgtggtgagaaccagacccggcctgcaggcccccctgctgaccctgtacagcgcccagggcgtgagacagctgggcctggagctgggcagacccgtgagattcctgtacgaggaccagaccggcagaccccagccccccagccagcccgtgttcagaggcctgagcctggccgacggcaagtggcacagagtggccgtggccgtgaagggccagagcgtgaccctgatcgtggactgcaagaagagagtgaccagacccctgcccagaagcgccagacccgtgctggacacccacggcgtgatcatcttcggcgccagaatcctggacgaggaggtgttcgagggcgacgtgcaggagctggccatcgtgcccggcgtgcaggccgcctacgagagctgcgagcagaaggagctggagtgcgagggcggccagagagagagaccccagaaccagcagccccacagagcccagagaagcccccagcagcagcccagcagactgcacagaccccagaaccaggagccccagagccaggaccccacccccggcgaggaggaggagatcctggagagcagcctgctgccccccctggaggaggagcagaccgacctgcaggtgccccccaccgccgacagattccaggccgaggagtacggcgagggcggcaccgacccccccgagggcccctacgactacacctacggctacggcgacgactacagagaggagaccgagctgggccccgccctgagcgccgagaccgcccacagcggcgccgccgcccacggccccagaggcctgaagggcgagaagggcgagcccgccgtgctggagcccggcatgctggtggagggcccccccggccccgagggccccgccggcctgatcggcccccccggcatccagggcaaccccggccccgtgggcgaccccggcgagagaggcccccccggcagagccggcctgcccggcagcgacggcgcccccggcccccccggcaccagcctgatgctgcccttcagattcggcagcggcggcggcgacaagggccccgtggtggccgcccaggaggcccaggcccaggccatcctgcagcaggccagactggccctgagaggcccccccggccccatgggctacaccggcagacccggccccctgggccagcccggcagccccggcctgaagggcgagagcggcgacctgggcccccagggccccagaggcccccagggcctgaccggcccccccggcaaggccggcagaagaggcagagccggcgccgacggcgccagaggcatgcccggcgaccccggcgtgaagggcgacagaggcttcgacggcctgcccggcctgcccggcgagaagggccacagaggcgacaccggcgcccagggcctgcccggcccccccggcgaggacggcgagagaggcgacgacggcgagatcggccccagaggcctgcccggcgagagcggccccagaggcctgctgggccccaagggcccccccggcatccccggcccccccggcgtgagaggcatggacggcccccagggccccaagggcagcctgggcccccagggcgagcccggcccccccggccagcagggcacccccggcacccagggcctgcccggcccccagggcgccatcggcccccacggcgagaagggcccccagggcaagcccggcctgcccggcatgcccggcagcgacggcccccccggccaccccggcaaggagggcccccccggcaccaagggcaaccagggccccagcggcccccagggccccctgggctaccccggccccagaggcgtgaagggcgtggacggcatcagaggcctgaagggccacaagggcgagaagggcgaggacggcttccccggcttcaagggcgacatcggcgtgaagggcgacagaggcgaggtgggcgtgcccggcagcagaggcgaggacggccccgagggccccaagggcagaaccggccccaccggcgaccccggcccccccggcctgatgggcgagaagggcaagctgggcgtgcccggcctgcccggctaccccggcagacagggccccaagggcagcctgggcttccccggcttccccggcgccagcggcgagaagggcgccagaggcctgagcggcaagagcggccccagaggcgagagaggccccaccggccccagaggccagagaggccccagaggcgccaccggcaagagcggcgccaagggcaccagcggcggcgacggcccccacggcccccccggcgagagaggcctgcccggcccccagggccccaacggcttccccggccccaagggcccccccggcccccccggcaaggacggcctgcccggccaccccggccagagaggcgaggtgggcttccagggcaagaccggcccccccggcccccccggcgtggtgggcccccagggcgccgccggcgagaccggccccatgggcgagagaggccaccccggcccccccggcccccccggcgagcagggcctgcccggcaccgccggcaaggagggcaccaagggcgaccccggcccccccggcgcccccggcaaggacggccccgccggcctgagaggcttccccggcgagagaggcctgcccggcaccgccggcggccccggcctgaagggcaacgagggccccagcggcccccccggccccgccggcagccccggcgagagaggcgccgccggcagcggcggccccatcggcccccccggcagacccggcccccagggcccccccggcgccgccggcgagaagggcgtgcccggcgagaagggccccatcggccccaccggcagagacggcgtgcagggccccgtgggcctgcccggccccgccggcccccccggcgtggccggcgaggacggcgacaagggcgaggtgggcgaccccggccagaagggcaccaagggcaacaagggcgagcacggcccccccggcccccccggccccatcggccccgtgggccagcccggcgccgccggcgccgacggcgagcccggcgccagaggcccccagggccacttcggcgccaagggcgacgagggcaccagaggcttcaacggcccccccggccccatcggcctgcagggcctgcccggccccagcggcgagaagggcgagaccggcgacgtgggccccatgggcccccccggcccccccggccccagaggccccgccggccccaacggcgccgacggcccccagggcccccccggcggcgtgggcaacctgggcccccccggcgagaagggcgagcccggcgagagcggcagccccggcatccagggcgagcccggcgtgaagggccccagaggcgagagaggcgagaagggcgagagcggccagcccggcgagcccggcccccccggccccaagggccccaccggcgacgacggccccaagggcaaccccggccccgtgggcttccccggcgaccccggcccccccggcgagggcggccccagaggccaggacggcgccaagggcgacagaggcgaggacggcgagcccggccagcccggcagccccggccccaccggcgagaacggcccccccggccccctgggcaagagaggccccgccggcagccccggcagcgagggcagacagggcggcaagggcgccaagggcgaccccggcgccatcggcgcccccggcaagaccggccccgtgggccccgccggccccgccggcaagcccggccccgacggcctgagaggcctgcccggcagcgtgggccagcagggcagacccggcgccaccggccaggccggcccccccggccccgtgggcccccccggcctgcccggcctgagaggcgacgccggcgccaagggcgagaagggccaccccggcctgatcggcctgatcggcccccccggcgagcagggcgagaagggcgacagaggcctgcccggcccccagggcagccccggccagaagggcgagatgggcatccccggcgccagcggccccatcggccccggcggcccccccggcctgcccggccccgccggccccaagggcgccaagggcgccaccggccccggcggccccaagggcgagaagggcgtgcagggcccccccggccaccccggcccccccggcgaggtgatccagcccctgcccatccagatgcccaagaagaccagaagaagcgtggacggcagcagactgatgcaggaggacgaggccatccccaccggcggcgcccccggcagccccggcggcctggaggagatcttcggcagcctggacagcctgagagaggagatcgagcagatgagaagacccaccggcacccaggacagccccgccagaacctgccaggacctgaagctgtgccaccccgagctgcccgacggcgagtactgggtggaccccaaccagggctgcgccagagacgccttcagagtgttctgcaacttcaccgccggcggcgagacctgcgtgacccccagagacgacgtgacccagttcagctacgtggacagcgagggcagccccgtgggcgtggtgcagctgaccttcctgagactgctgagcgtgagcgcccaccaggacgtgagctacccctgcagcggcgccgccagagacggccccctgagactgagaggcgccaacgaggacgagctgagccccgagaccagcccctacgtgaaggagttcagagacggctgccagacccagcagggcagaaccgtgctggaggtgagaacccccgtgctggagcagctgcccgtgctggacgccagcttcagcgacctgggcgccccccccagaagaggcggcgtgctgctgggccccgtgtgcttcatgggctag

SEQ ID NO: 1823 - DNA, 4953 bp, Homo sapiens
atggagagatgcagcagatgccacagactgctgctgctgctgcccctggtgctgggcctgagcgccgcccccggctgggccggcgccccccccgtggacgtgctgagagccctgagattccccagcctgcccgacggcgtgagaagagccaagggcatctgccccgccgacgtggcctacagagtggccagacccgcccagctgagcgcccccaccagacagctgttccccggcggcttccccaaggacttcagcctgctgaccgtggtgagaaccagacccggcctgcaggcccccctgctgaccctgtacagcgcccagggcgtgagacagctgggcctggagctgggcagacccgtgagattcctgtacgaggaccagaccggcagaccccagccccccagccagcccgtgttcagaggcctgagcctggccgacggcaagtggcacagagtggccgtggccgtgaagggccagagcgtgaccctgatcgtggactgcaagaagagagtgaccagacccctgcccagaagcgccagacccgtgctggacacccacggcgtgatcatcttcggcgccagaatcctggacgaggaggtgttcgagggcgacgtgcaggagctggccatcgtgcccggcgtgcaggccgcctacgagagctgcgagcagaaggagctggagtgcgagggcggccagagagagagaccccagaaccagcagccccacagagcccagagaagcccccagcagcagcccagcagactgcacagaccccagaaccaggagccccagagccaggaccccacccccggcgaggaggaggagatcctggagagcagcctgctgccccccctggaggaggccgcccacggccccagaggcctgaagggcgagaagggcgagcccgccgtgctggagcccggcatgctggtggagggcccccccggccccgagggccccgccggcctgatcggcccccccggcatccagggcaaccccggccccgtgggcgaccccggcgagagaggcccccccggcagagccggcctgcccggcagcgacggcgcccccggcccccccggcaccagcctgatgctgcccttcagattcggcagcggcggcggcgacaagggccccgtggtggccgcccaggaggcccaggcccaggccatcctgcagcaggccagactggccctgagaggcccccccggccccatgggctacaccggcagacccggccccctgggccagcccggcagccccggcctgaagggcgagagcggcgacctgggcccccagggccccagaggcccccagggcctgaccggcccccccggcaaggccggcagaagaggcagagccggcgccgacggcgccagaggcatgcccggcgaccccggcgtgaagggcgacagaggcttcgacggcctgcccggcctgcccggcgagaagggccacagaggcgacaccggcgcccagggcctgcccggcccccccggcgaggacggcgagagaggcgacgacggcgagatcggccccagaggcctgcccggcgagagcggccccagaggcctgctgggccccaagggcccccccggcatccccggcccccccggcgtgagaggcatggacggcccccagggccccaagggcagcctgggcccccagggcgagcccggcccccccggccagcagggcacccccggcacccagggcctgcccggcccccagggcgccatcggcccccacggcgagaagggcccccagggcaagcccggcctgcccggcatgcccggcagcgacggcccccccggccaccccggcaaggagggcccccccggcaccaagggcaaccagggccccagcggcccccagggccccctgggctaccccggccccagaggcgtgaagggcgtggacggcatcagaggcctgaagggccacaagggcgagaagggcgaggacggcttccccggcttcaagggcgacatcggcgtgaagggcgacagaggcgaggtgggcgtgcccggcagcagaggcgaggacggccccgagggccccaagggcagaaccggccccaccggcgaccccggcccccccggcctgatgggcgagaagggcaagctgggcgtgcccggcctgcccggctaccccggcagacagggccccaagggcagcctgggcttccccggcttccccggcgccagcggcgagaagggcgccagaggcctgagcggcaagagcggccccagaggcgagagaggccccaccggccccagaggccagagaggccccagaggcgccaccggcaagagcggcgccaagggcaccagcggcggcgacggcccccacggcccccccggcgagagaggcctgcccggcccccagggccccaacggcttccccggccccaagggccccctgggcccccccggcaaggacggcctgcccggccaccccggccagagaggcgaggtgggcttccagggcaagaccggcccccccggcccccccggcgtggtgggcccccagggcgccgccggcgagaccggccccatgggcgagagaggccaccccggcccccccggcccccccggcgagcagggcctgcccggcaccgccggcaaggagggcaccaagggcgaccccggcccccccggcgcccccggcaaggacggccccgccggcctgagaggcttccccggcgagagaggcctgcccggcaccgccggcggccccggcctgaagggcaacgagggccccagcggcccccccggccccgccggcagccccggcgagagaggcgccgccggcagcggcggccccatcggcccccccggcagacccggcccccagggcccccccggcgccgccggcgagaagggcgtgcccggcgagaagggccccatcggccccaccggcagagacggcgtgcagggccccgtgggcctgcccggccccgccggcccccccggcgtggccggcgaggacggcgacaagggcgaggtgggcgaccccggccagaagggcaccaagggcaacaagggcgagcacggcccccccggcccccccggccccatcggccccgtgggccagcccggcgccgccggcgccgacggcgagcccggcgccagaggcccccagggccacttcggcgccaagggcgacgagggcaccagaggcttcaacggcccccccggccccatcggcctgcagggcctgcccggccccagcggcgagaagggcgagaccggcgacgtgggccccatgggcccccccggcccccccggccccagaggccccgccggccccaacggcgccgacggcccccagggcccccccggcggcgtgggcaacctgggcccccccggcgagaagggcgagcccggcgagagcggcagccccggcatccagggcgagcccggcgtgaagggccccagaggcgagagaggcgagaagggcgagagcggccagcccggcgagcccggcccccccggccccaagggccccaccggcgacgacggccccaagggcaaccccggccccgtgggcttccccggcgaccccggcccccccggcgagggcggccccagaggccaggacggcgccaagggcgacagaggcgaggacggcgagcccggccagcccggcagccccggccccaccggcgagaacggcccccccggccccctgggcaagagaggccccgccggcagccccggcagcgagggcagacagggcggcaagggcgccaagggcgaccccggcgccatcggcgcccccggcaagaccggccccgtgggccccgccggccccgccggcaagcccggccccgacggcctgagaggcctgcccggcagcgtgggccagcagggcagacccggcgccaccggccaggccggcccccccggccccgtgggcccccccggcctgcccggcctgagaggcgacgccggcgccaagggcgagaagggccaccccggcctgatcggcctgatcggcccccccggcgagcagggcgagaagggcgacagaggcctgcccggcccccagggcagccccggccagaagggcgagatgggcatccccggcgccagcggccccatcggccccggcggcccccccggcctgcccggccccgccggccccaagggcgccaagggcgccaccggccccggcggccccaagggcgagaagggcgtgcagggcccccccggccaccccggcccccccggcgaggtgatccagcccctgcccatccagatgcccaagaagaccagaagaagcgtggacggcagcagactgatgcaggaggacgaggccatccccaccggcggcgcccccggcagccccggcggcctggaggagatcttcggcagcctggacagcctgagagaggagatcgagcagatgagaagacccaccggcacccaggacagccccgccagaacctgccaggacctgaagctgtgccaccccgagctgcccgacggcgagtactgggtggaccccaaccagggctgcgccagagacgccttcagagtgttctgcaacttcaccgccggcggcgagacctgcgtgacccccagagacgacgtgacccagttcagctacgtggacagcgagggcagccccgtgggcgtggtgcagctgaccttcctgagactgctgagcgtgagcgcccaccaggacgtgagctacccctgcagcggcgccgccagagacggccccctgagactgagaggcgccaacgaggacgagctgagccccgagaccagcccctacgtgaaggagttcagagacggctgccagacccagcagggcagaaccgtgctggaggtgagaacccccgtgctggagcagctgcccgtgctggacgccagcttcagcgacctgggcgccccccccagaagaggcggcgtgctgctgggccccgtgtgcttcatgggctag

SEQ ID NO: 1824 - DNA, 873 bp, Homo sapiens
atggagagatgcagcagatgccacagactgctgctgctgctgcccctggtgctgggcctgagcgccgcccccggctgggccggcgccccccccgtggacgtgctgagagccctgagattccccagcctgcccgacggcgtgagaagagccaagggcatctgccccgccgacgtggcctacagagtggccagacccgcccagctgagcgcccccaccagacagctgttccccggcggcttccccaaggacttcagcctgctgaccgtggtgagaaccagacccggcctgcaggcccccctgctgaccctgtacagcgcccagggcgtgagacagctgggcctggagctgggcagacccgtgagattcctgtacgaggaccagaccggcagaccccagccccccagccagcccgtgttcagaggcctgagcctggccgacggcaagtggcacagagtggccgtggccgtgaagggccagagcgtgaccctgatcgtggactgcaagaagagagtgaccagacccctgcccagaagcgccagacccgtgctggacacccacggcgtgatcatcttcggcgccagaatcctggacgaggaggtgttcgagggcgacgtgcaggagctggccatcgtgcccggcgtgcaggccgcctacgagagctgcgagcagaaggagctggagtgcgagggcggccagagagagagaccccagaaccagcagccccacagagcccagagaagcccccagcagcagcccagcagactgcacagaccccagaaccaggagccccagagccaggtgagagagctgggcgagccccccagcgccgcccaccccagagagggcagacaccccggcatcagccccccctag

SEQ ID NO: 1825 - DNA, 4953 bp, Homo sapiens; identical to SEQ ID NO: 1819

SEQ ID NO: 1826 - DNA, 873 bp, Homo sapiens; identical to SEQ ID NO: 1824

SEQ ID NO: 1827 - DNA, 921 bp, Homo sapiens
atggactggagagccagcgaggcctggatggtgcccagagcccccaagggcgcctgggaccccagagagagccaggacctgctggacaacagagcccccctgggccccagagtgttccccggccccagagtgcccagcgccctgatggagagaagagtgctgaagggcagccagggcagccccgcctgccccggcccccccggcgaggtgatccagcccctgcccatccagatgcccaagaagaccagaagaagcgtggacggcagcagactgatgcaggaggacgaggccatccccaccggcggcgcccccggcagccccggcggcctggaggagatcttcggcagcctggacagcctgagagaggagatcgagcagatgagaagacccaccggcacccaggacagccccgccagaacctgccaggacctgaagctgtgccaccccgagctgcccgacggcgagtactgggtggaccccaaccagggctgcgccagagacgccttcagagtgttctgcaacttcaccgccggcggcgagacctgcgtgacccccagagacgacgtgacccagttcagctacgtggacagcgagggcagccccgtgggcgtggtgcagctgaccttcctgagactgctgagcgtgagcgcccaccaggacgtgagctacccctgcagcggcgccgccagagacggccccctgagactgagaggcgccaacgaggacgagctgagccccgagaccagcccctacgtgaaggagttcagagacggctgccagacccagcagggcagaaccgtgctggaggtgagaacccccgtgctggagcagctgcccgtgctggacgccagcttcagcgacctgggcgccccccccagaagaggcggcgtgctgctgggccccgtgtgcttcatgggctag

SEQ ID NO: 1828 - DNA, 5031 bp, Homo sapiens
atggagagatgcagcagatgccacagactgctgctgctgctgcccctggtgctgggcctgagcgccgcccccggctgggccggcgccccccccgtggacgtgctgagagccctgagattccccagcctgcccgacggcgtgagaagagccaagggcatctgccccgccgacgtggcctacagagtggccagacccgcccagctgagcgcccccaccagacagctgttccccggcggcttccccaaggacttcagcctgctgaccgtggtgagaaccagacccggcctgcaggcccccctgctgaccctgtacagcgcccagggcgtgagacagctgggcctggagctgggcagacccgtgagattcctgtacgaggaccagaccggcagaccccagccccccagccagcccgtgttcagaggcctgagcctggccgacggcaagtggcacagagtggccgtggccgtgaagggccagagcgtgaccctgatcgtggactgcaagaagagagtgaccagacccctgcccagaagcgccagacccgtgctggacacccacggcgtgatcatcttcggcgccagaatcctggacgaggaggtgttcgagggcgacgtgcaggagctggccatcgtgcccggcgtgcaggccgcctacgagagctgcgagcagaaggagctggagtgcgagggcggccagagagagagaccccagaaccagcagccccacagagcccagagaagcccccagcagcagcccagcagactgcacagaccccagaaccaggagccccagagccagcccaccgagagcctgtactacgactacgagcccccctactacgacgtgatgaccaccggcaccacccccgactaccaggaccccacccccggcgaggaggaggagatcctggagagcagcctgctgccccccctggaggaggccgcccacggccccagaggcctgaagggcgagaagggcgagcccgccgtgctggagcccggcatgctggtggagggcccccccggccccgagggccccgccggcctgatcggcccccccggcatccagggcaaccccggccccgtgggcgaccccggcgagagaggcccccccggcagagccggcctgcccggcagcgacggcgcccccggcccccccggcaccagcctgatgctgcccttcagattcggcagcggcggcggcgacaagggccccgtggtggccgcccaggaggcccaggcccaggccatcctgcagcaggccagactggccctgagaggcccccccggccccatgggctacaccggcagacccggccccctgggccagcccggcagccccggcctgaagggcgagagcggcgacctgggcccccagggccccagaggcccccagggcctgaccggcccccccggcaaggccggcagaagaggcagagccggcgccgacggcgccagaggcatgcccggcgaccccggcgtgaagggcgacagaggcttcgacggcctgcccggcctgcccggcgagaagggccacagaggcgacaccggcgcccagggcctgcccggcccccccggcgaggacggcgagagaggcgacgacggcgagatcggccccagaggcctgcccggcgagagcggccccagaggcctgctgggccccaagggcccccccggcatccccggcccccccggcgtgagaggcatggacggcccccagggccccaagggcagcctgggcccccagggcgagcccggcccccccggccagcagggcacccccggcacccagggcctgcccggcccccagggcgccatcggcccccacggcgagaagggcccccagggcaagcccggcctgcccggcatgcccggcagcgacggcccccccggccaccccggcaaggagggcccccccggcaccaagggcaaccagggccccagcggcccccagggccccctgggctaccccggccccagaggcgtgaagggcgtggacggcatcagaggcctgaagggccacaagggcgagaagggcgaggacggcttccccggcttcaagggcgacatcggcgtgaagggcgacagaggcgaggtgggcgtgcccggcagcagaggcgaggacggccccgagggccccaagggcagaaccggccccaccggcgaccccggcccccccggcctgatgggcgagaagggcaagctgggcgtgcccggcctgcccggctaccccggcagacagggccccaagggcagcctgggcttccccggcttccccggcgccagcggcgagaagggcgccagaggcctgagcggcaagagcggccccagaggcgagagaggccccaccggccccagaggccagagaggccccagaggcgccaccggcaagagcggcgccaagggcaccagcggcggcgacggcccccacggcccccccggcgagagaggcctgcccggcccccagggccccaacggcttccccggccccaagggcccccccggcccccccggcaaggacggcctgcccggccaccccggccagagaggcgaggtgggcttccagggcaagaccggcccccccggcccccccggcgtggtgggcccccagggcgccgccggcgagaccggccccatgggcgagagaggccaccccggcccccccggcccccccggcgagcagggcctgcccggcaccgccggcaaggagggcaccaagggcgaccccggcccccccggcgcccccggcaaggacggccccgccggcctgagaggcttccccggcgagagaggcctgcccggcaccgccggcggccccggcctgaagggcaacgagggccccagcggcccccccggccccgccggcagccccggcgagagaggcgccgccggcagcggcggccccatcggcccccccggcagacccggcccccagggcccccccggcgccgccggcgagaagggcgtgcccggcgagaagggccccatcggccccaccggcagagacggcgtgcagggccccgtgggcctgcccggccccgccggcccccccggcgtggccggcgaggacggcgacaagggcgaggtgggcgaccccggccagaagggcaccaagggcaacaagggcgagcacggcccccccggcccccccggccccatcggccccgtgggccagcccggcgccgccggcgccgacggcgagcccggcgccagaggcccccagggccacttcggcgccaagggcgacgagggcaccagaggcttcaacggcccccccggccccatcggcctgcagggcctgcccggccccagcggcgagaagggcgagaccggcgacgtgggccccatgggcccccccggcccccccggccccagaggccccgccggccccaacggcgccgacggcccccagggcccccccggcggcgtgggcaacctgggcccccccggcgagaagggcgagcccggcgagagcggcagccccggcatccagggcgagcccggcgtgaagggccccagaggcgagagaggcgagaagggcgagagcggccagcccggcgagcccggcccccccggccccaagggccccaccggcgacgacggccccaagggcaaccccggccccgtgggcttccccggcgaccccggcccccccggcgagggcggccccagaggccaggacggcgccaagggcgacagaggcgaggacggcgagcccggccagcccggcagccccggccccaccggcgagaacggcccccccggccccctgggcaagagaggccccgccggcagccccggcagcgagggcagacagggcggcaagggcgccaagggcgaccccggcgccatcggcgcccccggcaagaccggccccgtgggccccgccggccccgccggcaagcccggccccgacggcctgagaggcctgcccggcagcgtgggccagcagggcagacccggcgccaccggccaggccggcccccccggccccgtgggcccccccggcctgcccggcctgagaggcgacgccggcgccaagggcgagaagggccaccccggcctgatcggcctgatcggcccccccggcgagcagggcgagaagggcgacagaggcctgcccggcccccagggcagccccggccagaagggcgagatgggcatccccggcgccagcggccccatcggccccggcggcccccccggcctgcccggccccgccggccccaagggcgccaagggcgccaccggccccggcggccccaagggcgagaagggcgtgcagggcccccccggccaccccggcccccccggcgaggtgatccagcccctgcccatccagatgcccaagaagaccagaagaagcgtggacggcagcagactgatgcaggaggacgaggccatccccaccggcggcgcccccggcagccccggcggcctggaggagatcttcggcagcctggacagcctgagagaggagatcgagcagatgagaagacccaccggcacccaggacagccccgccagaacctgccaggacctgaagctgtgccaccccgagctgcccgacggcgagtactgggtggaccccaaccagggctgcgccagagacgccttcagagtgttctgcaacttcaccgccggcggcgagacctgcgtgacccccagagacgacgtgacccagttcagctacgtggacagcgagggcagccccgtgggcgtggtgcagctgaccttcctgagactgctgagcgtgagcgcccaccaggacgtgagctacccctgcagcggcgccgccagagacggccccctgagactgagaggcgccaacgaggacgagctgagccccgagaccagcccctacgtgaaggagttcagagacggctgccagacccagcagggcagaaccgtgctggaggtgagaacccccgtgctggagcagctgcccgtgctggacgccagcttcagcgacctgggcgccccccccagaagaggcggcgtgctgctgggccccgtgtgcttcatgggctag

SEQ ID NO: 1829 - DNA, 1875 bp, Homo sapiens
atggagagatgcagcagatgccacagactgctgctgctgctgcccctggtgctgggcctgagcgccgcccccggctgggccggcgccccccccgtggacgtgctgagagccctgagattccccagcctgcccgacggcgtgagaagagccaagggcatctgccccgccgacgtggcctacagagtggccagacccgcccagctgagcgcccccaccagacagctgttccccggcggcttccccaaggacttcagcctgctgaccgtggtgagaaccagacccggcctgcaggcccccctgctgaccctgtacagcgcccagggcgtgagacagctgggcctggagctgggcagacccgtgagattcctgtacgaggaccagaccggcagaccccagccccccagccagcccgtgttcagaggcctgagcctggccgacggcaagtggcacagagtggccgtggccgtgaagggccagagcgtgaccctgatcgtggactgcaagaagagagtgaccagacccctgcccagaagcgccagacccgtgctggacacccacggcgtgatcatcttcggcgccagaatcctggacgaggaggtgttcgagggcgacgtgcaggagctggccatcgtgcccggcgtgcaggccgcctacgagagctgcgagcagaaggagctggagtgcgagggcggccagagagagagaccccagaaccagcagccccacagagcccagagaagcccccagcagcagcccagcagactgcacagaccccagaaccaggagccccagagccagcccaccgagagcctgtactacgactacaagcccccctactacgacgtgatgaccaccggcaccacccccgactaccaggaccccacccccggcgaggaggaggagatcctggagagcagcctgctgccccccctggaggaggagcagaccgacctgcaggtgccccccaccgccgacagattccaggccgaggagtacggcgagggcggcaccgacccccccgagggcccctacgactacacctacggctacggcgacgactacagagaggagaccgagctgggccccgccctgagcgccgagaccgcccacagcggcgccgccgcccacggccccagaggcctgaagggcgagaagggcgagcccgccgtgctggagcccggcatgctggtggagggcccccccggccccgagggccccgccggcctgatcggcccccccggcatccagggcaaccccggccccgtgggcgaccccggcgagagaggcccccccggcagagccggcctgcccggcagcgacggcgcccccggcccccccggcaccagcctgatgctgcccttcagattcggcagcggcggcggcgacaagggccccgtggtggccgcccaggaggcccaggcccaggccatcctgcagcaggccagactggccctgagaggcccccccggccccatgggctacaccggcagacccggccccctgggccagcccggcagccccggcctgaagggcgagagcggcgacctgggcccccagggccccagaggcccccagggcctgaccggcccccccggcaaggccggcagaagaggcagagccggcgccgacggcgccagaggcatgcccggcgaccccggcgtgaagggcgacagaggcttcgacggcctgcccggcctgcccggcgagaagggccacagaggcgacaccggcgcccagggcctgcccggcccccccggcgaggacggcgagagaggcgacgacggcgagatcggccccagaggcctgcccggcgagagcggccccagaggcctgctgggccccaagggcccccccggcatccccggccccccctag

SEQ ID NO: 1830 - DNA, 4953 bp, Homo sapiens
atggagagatgcagcagatgccacagactgctgctgctgctgcccctggtgctgggcctgagcgccgcccccggctgggccggcgccccccccgtggacgtgctgagagccctgagattccccagcctgcccgacggcgtgagaagagccaagggcatctgccccgccgacgtggcctacagagtggccagacccgcccagctgagcgcccccaccagacagctgttccccggcggcttccccaaggacttcagcctgctgaccgtggtgagaaccagacccggcctgcaggcccccctgctgaccctgtacagcgcccagggcgtgagacagctgggcctggagctgggcccccccgtgagattcctgtacgaggaccagaccggcagaccccagccccccagccagcccgtgttcagaggcctgagcctggccgacggcaagtggcacagagtggccgtggccgtgaagggccagagcgtgaccctgatcgtggactgcaagaagagagtgaccagacccctgcccagaagcgccagacccgtgctggacacccacggcgtgatcatcttcggcgccagaatcctggacgaggaggtgttcgagggcgacgtgcaggagctggccatcgtgcccggcgtgcaggccgcctacgagagctgcgagcagaaggagctggagtgcgagggcggccagagagagagaccccagaaccagcagccccacagagcccagagaagcccccagcagcagcccagcagactgcacagaccccagaaccaggagccccagagccaggaccccacccccggcgaggaggaggagatcctggagagcagcctgctgccccccctggaggaggccgcccacggccccagaggcctgaagggcgagaagggcgagcccgccgtgctggagcccggcatgctggtggagggcccccccggccccgagggccccgccggcctgatcggcccccccggcatccagggcaaccccggccccgtgggcgaccccggcgagagaggcccccccggcagagccggcctgcccggcagcgacggcgcccccggcccccccggcaccagcctgatgctgcccttcagattcggcagcggcggcggcgacaagggccccgtggtggccgcccaggaggcccaggcccaggccatcctgcagcaggccagactggccctgagaggcccccccggccccatgggctacaccggcagacccggccccctgggccagcccggcagccccggcctgaagggcgagagcggcgacctgggcccccagggccccagaggcccccagggcctgaccggcccccccggcaaggccggcagaagaggcagagccggcgccgacggcgccagaggcatgcccggcgaccccggcgtgaagggcgacagaggcttcgacggcctgcccggcctgcccggcgagaagggccacagaggcgacaccggcgcccagggcctgcccggcccccccggcgaggacggcgagagaggcgacgacggcgagatcggccccagaggcctgcccggcgagagcggccccagaggcctgctgggccccaagggcccccccggcatccccggcccccccggcgtgagaggcatggacggcccccagggccccaagggcagcctgggcccccagggcgagcccggcccccccggccagcagggcacccccggcacccagggcctgcccggcccccagggcgccatcggcccccacggcgagaagggcccccagggcaagcccggcctgcccggcatgcccggcagcgacggcccccccggccaccccggcaaggagggcccccccggcaccaagggcaaccagggccccagcggcccccagggccccctgggctaccccggccccagaggcgtgaagggcgtggacggcatcagaggcctgaagggccacaagggcgagaagggcgaggacggcttccccggcttcaagggcgacatcggcgtgaagggcgacagaggcgaggtgggcgtgcccggcagcagaggcgaggacggccccgagggccccaagggcagaaccggccccaccggcgaccccggcccccccggcctgatgggcgagaagggcaagctgggcgtgcccggcctgcccggctaccccggcagacagggccccaagggcagcctgggcttccccggcttccccggcgccagcggcgagaagggcgccagaggcctgagcggcaagagcggccccagaggcgagagaggccccaccggccccagaggccagagaggccccagaggcgccaccggcaagagcggcgccaagggcaccagcggcggcgacggcccccacggcccccccggcgagagaggcctgcccggcccccagggccccaacggcttccccggccccaagggcccccccggcccccccggcaaggacggcctgcccggccaccccggccagagaggcgaggtgggcttccagggcaagaccggcccccccggcccccccggcgtggtgggcccccagggcgccgccggcgagaccggccccatgggcgagagaggccaccccggcccccccggcccccccggcgagcagggcctgcccggcaccgccggcaaggagggcaccaagggcgaccccggcccccccggcgcccccggcaaggacggccccgccggcctgagaggcttccccggcgagagaggcctgcccggcaccgccggcggccccggcctgaagggcaacgagggccccagcggcccccccggccccgccggcagccccggcgagagaggcgccgccggcagcggcggccccatcggcccccccggcagacccggcccccagggcccccccggcgccgccggcgagaagggcgtgcccggcgagaagggccccatcggccccaccggcagagacggcgtgcagggccccgtgggcctgcccggccccgccggcccccccggcgtggccggcgaggacggcgacaagggcgaggtgggcgaccccggccagaagggcaccaagggcaacaagggcgagcacggcccccccggcccccccggccccatcggccccgtgggccagcccggcgccgccggcgccgacggcgagcccggcgccagaggcccccagggccacttcggcgccaagggcgacgagggcaccagaggcttcaacggcccccccggccccatcggcctgcagggcctgcccggccccagcggcgagaagggcgagaccggcgacgtgggccccatgggcccccccggcccccccggccccagaggccccgccggccccaacggcgccgacggcccccagggcccccccggcggcgtgggcaacctgggcccccccggcgagaagggcgagcccggcgagagcggcagccccggcatccagggcgagcccggcgtgaagggccccagaggcgagagaggcgagaagggcgagagcggccagcccggcgagcccggcccccccggccccaagggccccaccggcgacgacggccccaagggcaaccccggccccgtgggcttccccggcgaccccggcccccccggcgagggcggccccagaggccaggacggcgccaagggcgacagaggcgaggacggcgagcccggccagcccggcagccccggccccaccggcgagaacggcccccccggccccctgggcaagagaggccccgccggcagccccggcagcgagggcagacagggcggcaagggcgccaagggcgaccccggcgccatcggcgcccccggcaagaccggccccgtgggccccgccggccccgccggcaagcccggccccgacggcctgagaggcctgcccggcagcgtgggccagcagggcagacccggcgccaccggccaggccggcccccccggccccgtgggcccccccggcctgcccggcctgagaggcgacgccggcgccaagggcgagaagggccaccccggcctgatcggcctgatcggcccccccggcgagcagggcgagaagggcgacagaggcctgcccggcccccagggcagccccggccagaagggcgagatgggcatccccggcgccagcggccccatcggccccggcggcccccccggcctgcccggccccgccggccccaagggcgccaagggcgccaccggccccggcggccccaagggcgagaagggcgtgcagggcccccccggccaccccggcccccccggcgaggtgatccagcccctgcccatccagatgcccaagaagaccagaagaagcgtggacggcagcagactgatgcaggaggacgaggccatccccaccggcggcgcccccggcagccccggcggcctggaggagatcttcggcagcctggacagcctgagagaggagatcgagcagatgagaagacccaccggcacccaggacagccccgccagaacctgccaggacctgaagctgtgccaccccgagctgcccgacggcgagtactgggtggaccccaaccagggctgcgccagagacgccttcagagtgttctgcaacttcaccgccggcggcgagacctgcgtgacccccagagacgacgtgacccagttcagctacgtggacagcgagggcagccccgtgggcgtggtgcagctgaccttcctgagactgctgagcgtgagcgcccaccaggacgtgagctacccctgcagcggcgccgccagagacggccccctgagactgagaggcgccaacgaggacgagctgagccccgagaccagcccctacgtgaaggagttcagagacggctgccagacccagcagggcagaaccgtgctggaggtgagaacccccgtgctggagcagctgcccgtgctggacgccagcttcagcgacctgggcgccccccccagaagaggcggcgtgctgctgggccccgtgtgcttcatgggctag

SEQ ID NO: 1831 - DNA, 1002 bp, Homo sapiens
tgaaaccagagcccccaggcccacagaagcaccgtgccccacaccgccggcctgggccagctgtgcctgctgggcttcggcatggactggagagccagcgaggcctggatggtgcccagagcccccaagggcgcctgggaccccagagagagccaggacctgctggacaacagagcccccctgggccccagagtgttccccggccccagagtgcccagcgccctgatggagagaagagtgctgaagggcagccagggcagccccgcctgcctgggcccccccggcgaggtgatccagcccctgcccatccagatgcccaagaagaccagaagaagcgtggacggcagcagactgatgcaggaggacgaggccatccccaccggcggcgcccccggcagccccggcggcctggaggagatcttcggcagcctggacagcctgagagaggagatcgagcagatgagaagacccaccggcacccaggacagccccgccagaacctgccaggacctgaagctgtgccaccccgagctgcccgacggcgagtactgggtggaccccaaccagggctgcgccagagacgccttcagagtgttctgcaacttcaccgccggcggcgagacctgcgtgacccccagagacgacgtgacccagttcagctacgtggacagcgagggcagccccgtgggcgtggtgcagctgaccttcctgagactgctgagcgtgagcgcccaccaggacgtgagctacccctgcagcggcgccgccagagacggccccctgagactgagaggcgccaacgaggacgagctgagccccgagaccagcccctacgtgaaggagttcagagacggctgccagacccagcagggcagaaccgtgctggaggtgagaacccccgtgctggagcagctgcccgtgctggacgccagcttcagcgacctgggcgccccccccagaagaggcggcgtgctgctgggccccgtgtgcttcatgggctag

SEQ ID NO: 1832 - DNA, 792 bp, Homo sapiens
tgagccccccccgtggacgtgctgagagccctgagattccccagcctgcccgacggcgtgagaagagccaagggcatctgccccgccgacgtggcctacagagtggccagacccgcccagctgagcgcccccaccagacagctgttccccggcggcttccccaaggacttcagcctgctgaccgtggtgagaaccagacccggcctgcaggcccccctgctgaccctgtacagcgcccagggcgtgagacagctgggcctggagctgggcagacccgtgagattcctgtacgaggaccagaccggcagaccccagccccccagccagcccgtgttcagaggcctgagcctggccgacggcaagtggcacagagtggccgtggccgtgaagggccagagcgtgaccctgatcgtggactgcaagaagagagtgaccagacccctgcccagaagcgccagacccgtgctggacacccacggcgtgatcatcttcggcgccagaatcctggacgaggaggtgttcgagggcgacgtgcaggagctggccatcgtgcccggcgtgcaggccgcctacgagagctgcgagcagaaggagctggagtgcgagggcggccagagagagagaccccagaaccagcagccccacagagcccagagaagcccccagcagcagcccagcagactgcacagaccccagaaccaggagccccagagccaggtgagagagctgggcgagccccccagcgccgcccaccccagagagggcagacaccccggcatcagccccccctag

SEQ ID NO: 1833 - DNA, 873 bp, Homo sapiens
atggagagatgcagcagatgccacagactgctgctgctgctgcccctggtgctgggcctgagcgccgcccccggctgggccggcgccccccccgtggacgtgctgagagccctgagattccccagcctgcccgacggcgtgagaagagccaagggcatctgccccgccgacgtggcctacagagtggccagacccgcccagctgagcgcccccaccagacagctgttccccggcggcttccccaaggacttcagcctgctgaccgtggtgagaaccagacccggcctgcaggcccccctgctgaccctgtacagcgcccagggcgtgagacagctgggcctggagctgggcccccccgtgagattcctgtacgaggaccagaccggcagaccccagccccccagccagcccgtgttcagaggcctgagcctggccgacggcaagtggcacagagtggccgtggccgtgaagggccagagcgtgaccctgatcgtggactgcaagaagagagtgaccagacccctgcccagaagcgccagacccgtgctggacacccacggcgtgatcatcttcggcgccagaatcctggacgaggaggtgttcgagggcgacgtgcaggagctggccatcgtgcccggcgtgcaggccgcctacgagagctgcgagcagaaggagctggagtgcgagggcggccagagagagagaccccagaaccagcagccccacagagcccagagaagcccccagcagcagcccagcagactgcacagaccccagaaccaggagccccagagccaggtgagagagctgggcgagccccccagcgccgcccaccccagagagggcagacaccccggcatcagccccccctag

SEQ ID NO: 1834 - DNA, 1875 bp, Homo sapiens
atggagagatgcagcagatgccacagactgctgctgctgctgcccctggtgctgggcctgagcgccgcccccggctgggccggcgccccccccgtggacgtgctgagagccctgagattccccagcctgcccgacggcgtgagaagagccaagggcatctgccccgccgacgtggcctacagagtggccagacccgcccagctgagcgcccccaccagacagctgttccccggcggcttccccaaggacttcagcctgctgaccgtggtgagaaccagacccggcctgcaggcccccctgctgaccctgtacagcgcccagggcgtgagacagctgggcctggagctgggcagacccgtgagattcctgtacgaggaccagaccggcagaccccagccccccagccagcccgtgttcagaggcctgagcctggccgacggcaagtggcacagagtggccgtggccgtgaagggccagagcgtgaccctgatcgtggactgcaagaagagagtgaccagacccctgcccagaagcgccagacccgtgctggacacccacggcgtgatcatcttcggcgccagaatcctggacgaggaggtgttcgagggcgacgtgcaggagctggccatcgtgcccggcgtgcaggccgcctacgagagctgcgagcagaaggagctggagtgcgagggcggccagagagagagaccccagaaccagcagccccacagagcccagagaagcccccagcagcagcccagcagactgcacagaccccagaaccaggagccccagagccagcccaccgagagcctgtactacgactacgagcccccctactacgacgtgatgaccaccggcaccacccccgactaccaggaccccacccccggcgaggaggaggagatcctggagagcagcctgctgccccccctggaggaggagcagaccgacctgcaggtgccccccaccgccgacagattccaggccgaggagtacggcgagggcggcaccgacccccccgagggcccctacgactacacctacggctacggcgacgactacagagaggagaccgagctgggccccgccctgagcgccgagaccgcccacagcggcgccgccgcccacggccccagaggcctgaagggcgagaagggcgagcccgccgtgctggagcccggcatgctggtggagggcccccccggccccgagggccccgccggcctgatcggcccccccggcatccagggcaaccccggccccgtgggcgaccccggcgagagaggcccccccggcagagccggcctgcccggcagcgacggcgcccccggcccccccggcaccagcctgatgctgcccttcagattcggcagcggcggcggcgacaagggccccgtggtggccgcccaggaggcccaggcccaggccatcctgcagcaggccagactggccctgagaggcccccccggccccatgggctacaccggcagacccggccccctgggccagcccggcagccccggcctgaagggcgagagcggcgacctgggcccccagggccccagaggcccccagggcctgaccggcccccccggcaaggccggcagaagaggcagagccggcgccgacggcgccagaggcatgcccggcgaccccggcgtgaagggcgacagaggcttcgacggcctgcccggcctgcccggcgagaagggccacagaggcgacaccggcgcccagggcctgcccggcccccccggcgaggacggcgagagaggcgacgacggcgagatcggccccagaggcctgcccggcgagagcggccccagaggcctgctgggccccaagggcccccccggcatccccggccccccctag

SEQ ID NO: 1835 - DNA, 873 bp, Homo sapiens; identical to SEQ ID NO: 1824

SEQ ID NO: 1836 - DNA, 1002 bp, Homo sapiens; identical to SEQ ID NO: 1831

SEQ ID NO: 1837 - DNA, 4872 bp, Homo sapiens
tgagccccccccgtggacgtgctgagagccctgagattccccagcctgcccgacggcgtgagaagagccaagggcatctgccccgccgacgtggcctacagagtggccagacccgcccagctgagcgcccccaccagacagctgttccccggcggcttccccaaggacttcagcctgctgaccgtggtgagaaccagacccggcctgcaggcccccctgctgaccctgtacagcgcccagggcgtgagacagctgggcctggagctgggcagacccgtgagattcctgtacgaggaccagaccggcagaccccagccccccagccagcccgtgttcagaggcctgagcctggccgacggcaagtggcacagagtggccgtggccgtgaagggccagagcgtgaccctgatcgtggactgcaagaagagagtgaccagacccctgcccagaagcgccagacccgtgctggacacccacggcgtgatcatcttcggcgccagaatcctggacgaggaggtgttcgagggcgacgtgcaggagctggccatcgtgcccggcgtgcaggccgcctacgagagctgcgagcagaaggagctggagtgcgagggcggccagagagagagaccccagaaccagcagccccacagagcccagagaagcccccagcagcagcccagcagactgcacagaccccagaaccaggagccccagagccaggaccccacccccggcgaggaggaggagatcctggagagcagcctgctgccccccctggaggaggccgcccacggccccagaggcctgaagggcgagaagggcgagcccgccgtgctggagcccggcatgctggtggagggcccccccggccccgagggccccgccggcctgatcggcccccccggcatccagggcaaccccggccccgtgggcgaccccggcgagagaggcccccccggcagagccggcctgcccggcagcgacggcgcccccggcccccccggcaccagcctgatgctgcccttcagattcggcagcggcggcggcgacaagggccccgtggtggccgcccaggaggcccaggcccaggccatcctgcagcaggccagactggccctgagaggcccccccggccccatgggctacaccggcagacccggccccctgggccagcccggcagccccggcctgaagggcgagagcggcgacctgggcccccagggccccagaggcccccagggcctgaccggcccccccggcaaggccggcagaagaggcagagccggcgccgacggcgccagaggcatgcccggcgaccccggcgtgaagggcgacagaggcttcgacggcctgcccggcctgcccggcgagaagggccacagaggcgacaccggcgcccagggcctgcccggcccccccggcgaggacggcgagagaggcgacgacggcgagatcggccccagaggcctgcccggcgagagcggccccagaggcctgctgggccccaagggcccccccggcatccccggcccccccggcgtgagaggcatggacggcccccagggccccaagggcagcctgggcccccagggcgagcccggcccccccggccagcagggcacccccggcacccagggcctgcccggcccccagggcgccatcggcccccacggcgagaagggcccccagggcaagcccggcctgcccggcatgcccggcagcgacggcccccccggccaccccggcaaggagggcccccccggcaccaagggcaaccagggccccagcggcccccagggccccctgggctaccccggccccagaggcgtgaagggcgtggacggcatcagaggcctgaagggccacaagggcgagaagggcgaggacggcttccccggcttcaagggcgacatcggcgtgaagggcgacagaggcgaggtgggcgtgcccggcagcagaggcgaggacggccccgagggccccaagggcagaaccggccccaccggcgaccccggcccccccggcctgatgggcgagaagggcaagctgggcgtgcccggcctgcccggctaccccggcagacagggccccaagggcagcctgggcttccccggcttccccggcgccagcggcgagaagggcgccagaggcctgagcggcaagagcggccccagaggcgagagaggccccaccggccccagaggccagagaggccccagaggcgccaccggcaagagcggcgccaagggcaccagcggcggcgacggcccccacggcccccccggcgagagaggcctgcccggcccccagggccccaacggcttccccggccccaagggcccccccggcccccccggcaaggacggcctgcccggccaccccggccagagaggcgaggtgggcttccagggcaagaccggcccccccggcccccccggcgtggtgggcccccagggcgccgccggcgagaccggccccatgggcgagagaggccaccccggcccccccggcccccccggcgagcagggcctgcccggcaccgccggcaaggagggcaccaagggcgaccccggcccccccggcgcccccggcaaggacggccccgccggcctgagaggcttccccggcgagagaggcctgcccggcaccgccggcggccccggcctgaagggcaacgagggccccagcggcccccccggccccgccggcagccccggcgagagaggcgccgccggcagcggcggccccatcggcccccccggcagacccggcccccagggcccccccggcgccgccggcgagaagggcgtgcccggcgagaagggccccatcggccccaccggcagagacggcgtgcagggccccgtgggcctgcccggccccgccggcccccccggcgtggccggcgaggacggcgacaagggcgaggtgggcgaccccggccagaagggcaccaagggcaacaagggcgagcacggcccccccggcccccccggccccatcggccccgtgggccagcccggcgccgccggcgccgacggcgagcccggcgccagaggcccccagggccacttcggcgccaagggcgacgagggcaccagaggcttcaacggcccccccggccccatcggcctgcagggcctgcccggccccagcggcgagaagggcgagaccggcgacgtgggccccatgggcccccccggcccccccggccccagaggccccgccggccccaacggcgccgacggcccccagggcccccccggcggcgtgggcaacctgggcccccccggcgagaagggcgagcccggcgagagcggcagccccggcatccagggcgagcccggcgtgaagggccccagaggcgagagaggcgagaagggcgagagcggccagcccggcgagcccggcccccccggccccaagggccccaccggcgacgacggccccaagggcaaccccggccccgtgggcttccccggcgaccccggcccccccggcgagggcggccccagaggccaggacggcgccaagggcgacagaggcgaggacggcgagcccggccagcccggcagccccggccccaccggcgagaacggcccccccggccccctgggcaagagaggccccgccggcagccccggcagcgagggcagacagggcggcaagggcgccaagggcgaccccggcgccatcggcgcccccggcaagaccggccccgtgggccccgccggccccgccggcaagcccggccccgacggcctgagaggcctgcccggcagcgtgggccagcagggcagacccggcgccaccggccaggccggcccccccggccccgtgggcccccccggcctgcccggcctgagaggcgacgccggcgccaagggcgagaagggccaccccggcctgatcggcctgatcggcccccccggcgagcagggcgagaagggcgacagaggcctgcccggcccccagggcagccccggccagaagggcgagatgggcatccccggcgccagcggccccatcggccccggcggcccccccggcctgcccggccccgccggccccaagggcgccaagggcgccaccggccccggcggccccaagggcgagaagggcgtgcagggcccccccggccaccccggcccccccggcgaggtgatccagcccctgcccatccagatgcccaagaagaccagaagaagcgtggacggcagcagactgatgcaggaggacgaggccatccccaccggcggcgcccccggcagccccggcggcctggaggagatcttcggcagcctggacagcctgagagaggagatcgagcagatgagaagacccaccggcacccaggacagccccgccagaacctgccaggacctgaagctgtgccaccccgagctgcccgacggcgagtactgggtggaccccaaccagggctgcgccagagacgccttcagagtgttctgcaacttcaccgccggcggcgagacctgcgtgacccccagagacgacgtgacccagttcagctacgtggacagcgagggcagccccgtgggcgtggtgcagctgaccttcctgagactgctgagcgtgagcgcccaccaggacgtgagctacccctgcagcggcgccgccagagacggccccctgagactgagaggcgccaacgaggacgagctgagccccgagaccagcccctacgtgaaggagttcagagacggctgccagacccagcagggcagaaccgtgctggaggtgagaacccccgtgctggagcagctgcccgtgctggacgccagcttcagcgacctgggcgccccccccagaagaggcggcgtgctgctgggccccgtgtgcttcatgggctag

SEQ ID NO: 1838 - DNA, 4953 bp, Homo sapiens; identical to SEQ ID NO: 1819

SEQ ID NO: 1839 - DNA, 873 bp, Homo sapiens; identical to SEQ ID NO: 1824

SEQ ID NO: 1840 - DNA, 1794 bp, Homo sapiens
tgagccccccccgtggacgtgctgagagccctgagattccccagcctgcccgacggcgtgagaagagccaagggcatctgccccgccgacgtggcctacagagtggccagacccgcccagctgagcgcccccaccagacagctgttccccggcggcttccccaaggacttcagcctgctgaccgtggtgagaaccagacccggcctgcaggcccccctgctgaccctgtacagcgcccagggcgtgagacagctgggcctggagctgggcagacccgtgagattcctgtacgaggaccagaccggcagaccccagccccccagccagcccgtgttcagaggcctgagcctggccgacggcaagtggcacagagtggccgtggccgtgaagggccagagcgtgaccctgatcgtggactgcaagaagagagtgaccagacccctgcccagaagcgccagacccgtgctggacacccacggcgtgatcatcttcggcgccagaatcctggacgaggaggtgttcgagggcgacgtgcaggagctggccatcgtgcccggcgtgcaggccgcctacgagagctgcgagcagaaggagctggagtgcgagggcggccagagagagagaccccagaaccagcagccccacagagcccagagaagcccccagcagcagcccagcagactgcacagaccccagaaccaggagccccagagccagcccaccgagagcctgtactacgactacaagcccccctactacgacgtgatgaccaccggcaccacccccgactaccaggaccccacccccggcgaggaggaggagatcctggagagcagcctgctgccccccctggaggaggagcagaccgacctgcaggtgccccccaccgccgacagattccaggccgaggagtacggcgagggcggcaccgacccccccgagggcccctacgactacacctacggctacggcgacgactacagagaggagaccgagctgggccccgccctgagcgccgagaccgcccacagcggcgccgccgcccacggccccagaggcctgaagggcgagaagggcgagcccgccgtgctggagcccggcatgctggtggagggcccccccggccccgagggccccgccggcctgatcggcccccccggcatccagggcaaccccggccccgtgggcgaccccggcgagagaggcccccccggcagagccggcctgcccggcagcgacggcgcccccggcccccccggcaccagcctgatgctgcccttcagattcggcagcggcggcggcgacaagggccccgtggtggccgcccaggaggcccaggcccaggccatcctgcagcaggccagactggccctgagaggcccccccggccccatgggctacaccggcagacccggccccctgggccagcccggcagccccggcctgaagggcgagagcggcgacctgggcccccagggccccagaggcccccagggcctgaccggcccccccggcaaggccggcagaagaggcagagccggcgccgacggcgccagaggcatgcccggcgaccccggcgtgaagggcgacagaggcttcgacggcctgcccggcctgcccggcgagaagggccacagaggcgacaccggcgcccagggcctgcccggcccccccggcgaggacggcgagagaggcgacgacggcgagatcggccccagaggcctgcccggcgagagcggccccagaggcctgctgggccccaagggcccccccggcatccccggccccccctag

SEQ ID NO: 1841 - DNA, 4953 bp, Homo sapiens; identical to SEQ ID NO: 1819

SEQ ID NO: 1842 - DNA, 1875 bp, Homo sapiens; identical to SEQ ID NO: 1834

SEQ ID NO: 1843 - DNA, 1875 bp, Homo sapiens
atggagagatgcagcagatgccacagactgctgctgctgctgcccctggtgctgggcctgagcgccgcccccggctgggccggcgccccccccgtggacgtgctgagagccctgagattccccagcctgcccgacggcgtgagaagagccaagggcatctgccccgccgacgtggcctacagagtggccagacccgcccagctgagcgcccccaccagacagctgttccccggcggcttccccaaggacttcagcctgctgaccgtggtgagaaccagacccggcctgcaggcccccctgctgaccctgtacagcgcccagggcgtgagacagctgggcctggagctgggcccccccgtgagattcctgtacgaggaccagaccggcagaccccagccccccagccagcccgtgttcagaggcctgagcctggccgacggcaagtggcacagagtggccgtggccgtgaagggccagagcgtgaccctgatcgtggactgcaagaagagagtgaccagacccctgcccagaagcgccagacccgtgctggacacccacggcgtgatcatcttcggcgccagaatcctggacgaggaggtgttcgagggcgacgtgcaggagctggccatcgtgcccggcgtgcaggccgcctacgagagctgcgagcagaaggagctggagtgcgagggcggccagagagagagaccccagaaccagcagccccacagagcccagagaagcccccagcagcagcccagcagactgcacagaccccagaaccaggagccccagagccagcccaccgagagcctgtactacgactacaagcccccctactacgacgtgatgaccaccggcaccacccccgactaccaggaccccacccccggcgaggaggaggagatcctggagagcagcctgctgccccccctggaggaggagcagaccgacctgcaggtgccccccaccgccgacagattccaggccgaggagtacggcgagggcggcaccgacccccccgagggcccctacgactacacctacggctacggcgacgactacagagaggagaccgagctgggccccgccctgagcgccgagaccgcccacagcggcgccgccgcccacggccccagaggcctgaagggcgagaagggcgagcccgccgtgctggagcccggcatgctggtggagggcccccccggccccgagggccccgccggcctgatcggcccccccggcatccagggcaaccccggccccgtgggcgaccccggcgagagaggcccccccggcagagccggcctgcccggcagcgacggcgcccccggcccccccggcaccagcctgatgctgcccttcagattcggcagcggcggcggcgacaagggccccgtggtggccgcccaggaggcccaggcccaggccatcctgcagcaggccagactggccctgagaggcccccccggccccatgggctacaccggcagacccggccccctgggccagcccggcagccccggcctgaagggcgagagcggcgacctgggcccccagggccccagaggcccccagggcctgaccggcccccccggcaaggccggcagaagaggcagagccggcgccgacggcgccagaggcatgcccggcgaccccggcgtgaagggcgacagaggcttcgacggcctgcccggcctgcccggcgagaagggccacagaggcgacaccggcgcccagggcctgcccggcccccccggcgaggacggcgagagaggcgacgacggcgagatcggccccagaggcctgcccggcgagagcggccccagaggcctgctgggccccaagggcccccccggcatccccggccccccctag

SEQ ID NO: 1844 - DNA, 1875 bp, Homo sapiens; identical to SEQ ID NO: 1829

SEQ ID NO: 1845 - DNA, 873 bp, Homo sapiens; identical to SEQ ID NO: 1824

SEQ ID NO: 1846 - DNA, 1875 bp, Homo sapiens; identical to SEQ ID NO: 1834

SEQ ID NO: 1847 - DNA, 5070 bp, Homo sapiens
atggagagatgcagcagatgccacagactgctgctgctgctgcccctggtgctgggcctgagcgccgcccccggctgggccggcgccccccccgtggacgtgctgagagccctgagattccccagcctgcccgacggcgtgagaagagccaagggcatctgccccgccgacgtggcctacagagtggccagacccgcccagctgagcgcccccaccagacagctgttccccggcggcttccccaaggacttcagcctgctgaccgtggtgagaaccagacccggcctgcaggcccccctgctgaccctgtacagcgcccagggcgtgagacagctgggcctggagctgggcccccccgtgagattcctgtacgaggaccagaccggcagaccccagccccccagccagcccgtgttcagaggcctgagcctggccgacggcaagtggcacagagtggccgtggccgtgaagggccagagcgtgaccctgatcgtggactgcaagaagagagtgaccagacccctgcccagaagcgccagacccgtgctggacacccacggcgtgatcatcttcggcgccagaatcctggacgaggaggtgttcgagggcgacgtgcaggagctggccatcgtgcccggcgtgcaggccgcctacgagagctgcgagcagaaggagctggagtgcgagggcggccagagagagagaccccagaaccagcagccccacagagcccagagaagcccccagcagcagcccagcagactgcacagaccccagaaccaggagccccagagccaggagcagaccgacctgcaggtgccccccaccgccgacagattccaggccgaggagtacggcgagggcggcaccgacccccccgagggcccctacgactacacctacggctacggcgacgactacagagaggagaccgagctgggccccgccctgagcgccgagaccgcccacagcggcgccgccgcccacggccccagaggcctgaagggcgagaagggcgagcccgccgtgctggagcccggcatgctggtggagggcccccccggccccgagggccccgccggcctgatcggcccccccggcatccagggcaaccccggccccgtgggcgaccccggcgagagaggcccccccggcagagccggcctgcccggcagcgacggcgcccccggcccccccggcaccagcctgatgctgcccttcagattcggcagcggcggcggcgacaagggccccgtggtggccgcccaggaggcccaggcccaggccatcctgcagcaggccagactggccctgagaggcccccccggccccatgggctacaccggcagacccggccccctgggccagcccggcagccccggcctgaagggcgagagcggcgacctgggcccccagggccccagaggcccccagggcctgaccggcccccccggcaaggccggcagaagaggcagagccggcgccgacggcgccagaggcatgcccggcgaccccggcgtgaagggcgacagaggcttcgacggcctgcccggcctgcccggcgagaagggccacagaggcgacaccggcgcccagggcctgcccggcccccccggcgaggacggcgagagaggcgacgacggcgagatcggccccagaggcctgcccggcgagagcggccccagaggcctgctgggccccaagggcccccccggcatccccggcccccccggcgtgagaggcatggacggcccccagggccccaagggcagcctgggcccccagggcgagcccggcccccccggccagcagggcacccccggcacccagggcctgcccggcccccagggcgccatcggcccccacggcgagaagggcccccagggcaagcccggcctgcccggcatgcccggcagcgacggcccccccggccaccccggcaaggagggcccccccggcaccaagggcaaccagggccccagcggcccccagggccccctgggctaccccggccccagaggcgtgaagggcgtggacggcatcagaggcctgaagggccacaagggcgagaagggcgaggacggcttccccggcttcaagggcgacatcggcgtgaagggcgacagaggcgaggtgggcgtgcccggcagcagaggcgaggacggccccgagggccccaagggcagaaccggccccaccggcgaccccggcccccccggcctgatgggcgagaagggcaagctgggcgtgcccggcctgcccggctaccccggcagacagggccccaagggcagcctgggcttccccggcttccccggcgccagcggcgagaagggcgccagaggcctgagcggcaagagcggccccagaggcgagagaggccccaccggccccagaggccagagaggccccagaggcgccaccggcaagagcggcgccaagggcaccagcggcggcgacggcccccacggcccccccggcgagagaggcctgcccggcccccagggccccaacggcttccccggccccaagggcccccccggcccccccggcaaggacggcctgcccggccaccccggccagagaggcgaggtgggcttccagggcaagaccggcccccccggcccccccggcgtggtgggcccccagggcgccgccggcgagaccggccccatgggcgagagaggccaccccggcccccccggcccccccggcgagcagggcctgcccggcaccgccggcaaggagggcaccaagggcgaccccggcccccccggcgcccccggcaaggacggccccgccggcctgagaggcttccccggcgagagaggcctgcccggcaccgccggcggccccggcctgaagggcaacgagggccccagcggcccccccggccccgccggcagccccggcgagagaggcgccgccggcagcggcggccccatcggcccccccggcagacccggcccccagggcccccccggcgccgccggcgagaagggcgtgcccggcgagaagggccccatcggccccaccggcagagacggcgtgcagggccccgtgggcctgcccggccccgccggcccccccggcgtggccggcgaggacggcgacaagggcgaggtgggcgaccccggccagaagggcaccaagggcaacaagggcgagcacggcccccccggcccccccggccccatcggccccgtgggccagcccggcgccgccggcgccgacggcgagcccggcgccagaggcccccagggccacttcggcgccaagggcgacgagggcaccagaggcttcaacggcccccccggccccatcggcctgcagggcctgcccggccccagcggcgagaagggcgagaccggcgacgtgggccccatgggcccccccggcccccccggccccagaggccccgccggccccaacggcgccgacggcccccagggcccccccggcggcgtgggcaacctgggcccccccggcgagaagggcgagcccggcgagagcggcagccccggcatccagggcgagcccggcgtgaagggccccagaggcgagagaggcgagaagggcgagagcggccagcccggcgagcccggcccccccggccccaagggccccaccggcgacgacggccccaagggcaaccccggccccgtgggcttccccggcgaccccggcccccccggcgagggcggccccagaggccaggacggcgccaagggcgacagaggcgaggacggcgagcccggccagcccggcagccccggccccaccggcgagaacggcccccccggccccctgggcaagagaggccccgccggcagccccggcagcgagggcagacagggcggcaagggcgccaagggcgaccccggcgccatcggcgcccccggcaagaccggccccgtgggccccgccggccccgccggcaagcccggccccgacggcctgagaggcctgcccggcagcgtgggccagcagggcagacccggcgccaccggccaggccggcccccccggccccgtgggcccccccggcctgcccggcctgagaggcgacgccggcgccaagggcgagaagggccaccccggcctgatcggcctgatcggcccccccggcgagcagggcgagaagggcgacagaggcctgcccggcccccagggcagccccggccagaagggcgagatgggcatccccggcgccagcggccccatcggccccggcggcccccccggcctgcccggccccgccggccccaagggcgccaagggcgccaccggccccggcggccccaagggcgagaagggcgtgcagggcccccccggccaccccggcccccccggcgaggtgatccagcccctgcccatccagatgcccaagaagaccagaagaagcgtggacggcagcagactgatgcaggaggacgaggccatccccaccggcggcgcccccggcagccccggcggcctggaggagatcttcggcagcctggacagcctgagagaggagatcgagcagatgagaagacccaccggcacccaggacagccccgccagaacctgccaggacctgaagctgtgccaccccgagctgcccgacggcgagtactgggtggaccccaaccagggctgcgccagagacgccttcagagtgttctgcaacttcaccgccggcggcgagacctgcgtgacccccagagacgacgtgacccagttcagctacgtggacagcgagggcagccccgtgggcgtggtgcagctgaccttcctgagactgctgagcgtgagcgcccaccaggacgtgagctacccctgcagcggcgccgccagagacggccccctgagactgagaggcgccaacgaggacgagctgagccccgagaccagcccctacgtgaaggagttcagagacggctgccagacccagcagggcagaaccgtgctggaggtgagaacccccgtgctggagcagctgcccgtgctggacgccagcttcagcgacctgggcgccccccccagaagaggcggcgtgctgctgggccccgtgtgcttcatgggctag

SEQ ID NO: 1848 - DNA, 5133 bp, Homo sapiens
atggagagatgcagcagatgccacagactgctgctgctgctgcccctggtgctgggcctgagcgccgcccccggctgggccggcgccccccccgtggacgtgctgagagccctgagattccccagcctgcccgacggcgtgagaagagccaagggcatctgccccgccgacgtggcctacagagtggccagacccgcccagctgagcgcccccaccagacagctgttccccggcggcttccccaaggacttcagcctgctgaccgtggtgagaaccagacccggcctgcaggcccccctgctgaccctgtacagcgcccagggcgtgagacagctgggcctggagctgggcccccccgtgagattcctgtacgaggaccagaccggcagaccccagccccccagccagcccgtgttcagaggcctgagcctggccgacggcaagtggcacagagtggccgtggccgtgaagggccagagcgtgaccctgatcgtggactgcaagaagagagtgaccagacccctgcccagaagcgccagacccgtgctggacacccacggcgtgatcatcttcggcgccagaatcctggacgaggaggtgttcgagggcgacgtgcaggagctggccatcgtgcccggcgtgcaggccgcctacgagagctgcgagcagaaggagctggagtgcgagggcggccagagagagagaccccagaaccagcagccccacagagcccagagaagcccccagcagcagcccagcagactgcacagaccccagaaccaggagccccagagccaggaccccacccccggcgaggaggaggagatcctggagagcagcctgctgccccccctggaggaggagcagaccgacctgcaggtgccccccaccgccgacagattccaggccgaggagtacggcgagggcggcaccgacccccccgagggcccctacgactacacctacggctacggcgacgactacagagaggagaccgagctgggccccgccctgagcgccgagaccgcccacagcggcgccgccgcccacggccccagaggcctgaagggcgagaagggcgagcccgccgtgctggagcccggcatgctggtggagggcccccccggccccgagggccccgccggcctgatcggcccccccggcatccagggcaaccccggccccgtgggcgaccccggcgagagaggcccccccggcagagccggcctgcccggcagcgacggcgcccccggcccccccggcaccagcctgatgctgcccttcagattcggcagcggcggcggcgacaagggccccgtggtggccgcccaggaggcccaggcccaggccatcctgcagcaggccagactggccctgagaggcccccccggccccatgggctacaccggcagacccggccccctgggccagcccggcagccccggcctgaagggcgagagcggcgacctgggcccccagggccccagaggcccccagggcctgaccggcccccccggcaaggccggcagaagaggcagagccggcgccgacggcgccagaggcatgcccggcgaccccggcgtgaagggcgacagaggcttcgacggcctgcccggcctgcccggcgagaagggccacagaggcgacaccggcgcccagggcctgcccggcccccccggcgaggacggcgagagaggcgacgacggcgagatcggccccagaggcctgcccggcgagagcggccccagaggcctgctgggccccaagggcccccccggcatccccggcccccccggcgtgagaggcatggacggcccccagggccccaagggcagcctgggcccccagggcgagcccggcccccccggccagcagggcacccccggcacccagggcctgcccggcccccagggcgccatcggcccccacggcgagaagggcccccagggcaagcccggcctgcccggcatgcccggcagcgacggcccccccggccaccccggcaaggagggcccccccggcaccaagggcaaccagggccccagcggcccccagggccccctgggctaccccggccccagaggcgtgaagggcgtggacggcatcagaggcctgaagggccacaagggcgagaagggcgaggacggcttccccggcttcaagggcgacatcggcgtgaagggcgacagaggcgaggtgggcgtgcccggcagcagaggcgaggacggccccgagggccccaagggcagaaccggccccaccggcgaccccggcccccccggcctgatgggcgagaagggcaagctgggcgtgcccggcctgcccggctaccccggcagacagggccccaagggcagcctgggcttccccggcttccccggcgccagcggcgagaagggcgccagaggcctgagcggcaagagcggccccagaggcgagagaggccccaccggccccagaggccagagaggccccagaggcgccaccggcaagagcggcgccaagggcaccagcggcggcgacggcccccacggcccccccggcgagagaggcctgcccggcccccagggccccaacggcttccccggccccaagggcccccccggcccccccggcaaggacggcctgcccggccaccccggccagagaggcgaggtgggcttccagggcaagaccggcccccccggcccccccggcgtggtgggcccccagggcgccgccggcgagaccggccccatgggcgagagaggccaccccggcccccccggcccccccggcgagcagggcctgcccggcaccgccggcaaggagggcaccaagggcgaccccggcccccccggcgcccccggcaaggacggccccgccggcctgagaggcttccccggcgagagaggcctgcccggcaccgccggcggccccggcctgaagggcaacgagggccccagcggcccccccggccccgccggcagccccggcgagagaggcgccgccggcagcggcggccccatcggcccccccggcagacccggcccccagggcccccccggcgccgccggcgagaagggcgtgcccggcgagaagggccccatcggccccaccggcagagacggcgtgcagggccccgtgggcctgcccggccccgccggcccccccggcgtggccggcgaggacggcgacaagggcgaggtgggcgaccccggccagaagggcaccaagggcaacaagggcgagcacggcccccccggcccccccggccccatcggccccgtgggccagcccggcgccgccggcgccgacggcgagcccggcgccagaggcccccagggccacttcggcgccaagggcgacgagggcaccagaggcttcaacggcccccccggccccatcggcctgcagggcctgcccggccccagcggcgagaagggcgagaccggcgacgtgggccccatgggcccccccggcccccccggccccagaggccccgccggccccaacggcgccgacggcccccagggcccccccggcggcgtgggcaacctgggcccccccggcgagaagggcgagcccggcgagagcggcagccccggcatccagggcgagcccggcgtgaagggccccagaggcgagagaggcgagaagggcgagagcggccagcccggcgagcccggcccccccggccccaagggccccaccggcgacgacggccccaagggcaaccccggccccgtgggcttccccggcgaccccggcccccccggcgagggcggccccagaggccaggacggcgccaagggcgacagaggcgaggacggcgagcccggccagcccggcagccccggccccaccggcgagaacggcccccccggccccctgggcaagagaggccccgccggcagccccggcagcgagggcagacagggcggcaagggcgccaagggcgaccccggcgccatcggcgcccccggcaagaccggccccgtgggccccgccggccccgccggcaagcccggccccgacggcctgagaggcctgcccggcagcgtgggccagcagggcagacccggcgccaccggccaggccggcccccccggccccgtgggcccccccggcctgcccggcctgagaggcgacgccggcgccaagggcgagaagggccaccccggcctgatcggcctgatcggcccccccggcgagcagggcgagaagggcgacagaggcctgcccggcccccagggcagccccggccagaagggcgagatgggcatccccggcgccagcggccccatcggccccggcggcccccccggcctgcccggccccgccggccccaagggcgccaagggcgccaccggccccggcggccccaagggcgagaagggcgtgcagggcccccccggccaccccggcccccccggcgaggtgatccagcccctgcccatccagatgcccaagaagaccagaagaagcgtggacggcagcagactgatgcaggaggacgaggccatccccaccggcggcgcccccggcagccccggcggcctggaggagatcttcggcagcctggacagcctgagagaggagatcgagcagatgagaagacccaccggcacccaggacagccccgccagaacctgccaggacctgaagctgtgccaccccgagctgcccgacggcgagtactgggtggaccccaaccagggctgcgccagagacgccttcagagtgttctgcaacttcaccgccggcggcgagacctgcgtgacccccagagacgacgtgacccagttcagctacgtggacagcgagggcagccccgtgggcgtggtgcagctgaccttcctgagactgctgagcgtgagcgcccaccaggacgtgagctacccctgcagcggcgccgccagagacggccccctgagactgagaggcgccaacgaggacgagctgagccccgagaccagcccctacgtgaaggagttcagagacggctgccagacccagcagggcagaaccgtgctggaggtgagaacccccgtgctggagcagctgcccgtgctggacgccagcttcagcgacctgggcgccccccccagaagaggcggcgtgctgctgggccccgtgtgcttcatgggctag

SEQ ID NO: 1849 - DNA, 4968 bp, Homo sapiens
atggagagatgcagcagatgccacagactgctgctgctgctgcccctggtgctgggcctgagcgccgcccccggctgggccggcgccccccccgtggacgtgctgagagccctgagattccccagcctgcccgacggcgtgagaagagccaagggcatctgccccgccgacgtggcctacagagtggccagacccgcccagctgagcgcccccaccagacagctgttccccggcggcttccccaaggacttcagcctgctgaccgtggtgagaaccagacccggcctgcaggcccccctgctgaccctgtacagcgcccagggcgtgagacagctgggcctggagctgggcagacccgtgagattcctgtacgaggaccagaccggcagaccccagccccccagccagcccgtgttcagaggcctgagcctggccgacggcaagtggcacagagtggccgtggccgtgaagggccagagcgtgaccctgatcgtggactgcaagaagagagtgaccagacccctgcccagaagcgccagacccgtgctggacacccacggcgtgatcatcttcggcgccagaatcctggacgaggaggtgttcgagggcgacgtgcaggagctggccatcgtgcccggcgtgcaggccgcctacgagagctgcgagcagaaggagctggagtgcgagggcggccagagagagagaccccagaaccagcagccccacagagcccagagaagcccccagcagcagcccagcagactgcacagaccccagaaccaggagccccagagccagcccaccgagagcctgtactacgactacgagcccccctactacgacgtgatgaccaccggcaccacccccgactaccaggccgcccacggccccagaggcctgaagggcgagaagggcgagcccgccgtgctggagcccggcatgctggtggagggcccccccggccccgagggccccgccggcctgatcggcccccccggcatccagggcaaccccggccccgtgggcgaccccggcgagagaggcccccccggcagagccggcctgcccggcagcgacggcgcccccggcccccccggcaccagcctgatgctgcccttcagattcggcagcggcggcggcgacaagggccccgtggtggccgcccaggaggcccaggcccaggccatcctgcagcaggccagactggccctgagaggcccccccggccccatgggctacaccggcagacccggccccctgggccagcccggcagccccggcctgaagggcgagagcggcgacctgggcccccagggccccagaggcccccagggcctgaccggcccccccggcaaggccggcagaagaggcagagccggcgccgacggcgccagaggcatgcccggcgaccccggcgtgaagggcgacagaggcttcgacggcctgcccggcctgcccggcgagaagggccacagaggcgacaccggcgcccagggcctgcccggcccccccggcgaggacggcgagagaggcgacgacggcgagatcggccccagaggcctgcccggcgagagcggccccagaggcctgctgggccccaagggcccccccggcatccccggcccccccggcgtgagaggcatggacggcccccagggccccaagggcagcctgggcccccagggcgagcccggcccccccggccagcagggcacccccggcacccagggcctgcccggcccccagggcgccatcggcccccacggcgagaagggcccccagggcaagcccggcctgcccggcatgcccggcagcgacggcccccccggccaccccggcaaggagggcccccccggcaccaagggcaaccagggccccagcggcccccagggccccctgggctaccccggccccagaggcgtgaagggcgtggacggcatcagaggcctgaagggccacaagggcgagaagggcgaggacggcttccccggcttcaagggcgacatcggcgtgaagggcgacagaggcgaggtgggcgtgcccggcagcagaggcgaggacggccccgagggccccaagggcagaaccggccccaccggcgaccccggcccccccggcctgatgggcgagaagggcaagctgggcgtgcccggcctgcccggctaccccggcagacagggccccaagggcagcctgggcttccccggcttccccggcgccagcggcgagaagggcgccagaggcctgagcggcaagagcggccccagaggcgagagaggccccaccggccccagaggccagagaggccccagaggcgccaccggcaagagcggcgccaagggcaccagcggcggcgacggcccccacggcccccccggcgagagaggcctgcccggcccccagggccccaacggcttccccggccccaagggccccctgggcccccccggcaaggacggcctgcccggccaccccggccagagaggcgaggtgggcttccagggcaagaccggcccccccggcccccccggcgtggtgggcccccagggcgccgccggcgagaccggccccatgggcgagagaggccaccccggcccccccggcccccccggcgagcagggcctgcccggcaccgccggcaaggagggcaccaagggcgaccccggcccccccggcgcccccggcaaggacggccccgccggcctgagaggcttccccggcgagagaggcctgcccggcaccgccggcggccccggcctgaagggcaacgagggccccagcggcccccccggccccgccggcagccccggcgagagaggcgccgccggcagcggcggccccatcggcccccccggcagacccggcccccagggcccccccggcgccgccggcgagaagggcgtgcccggcgagaagggccccatcggccccaccggcagagacggcgtgcagggccccgtgggcctgcccggccccgccggcccccccggcgtggccggcgaggacggcgacaagggcgaggtgggcgaccccggccagaagggcaccaagggcaacaagggcgagcacggcccccccggcccccccggccccatcggccccgtgggccagcccggcgccgccggcgccgacggcgagcccggcgccagaggcccccagggccacttcggcgccaagggcgacgagggcaccagaggcttcaacggcccccccggccccatcggcctgcagggcctgcccggccccagcggcgagaagggcgagaccggcgacgtgggccccatgggcccccccggcccccccggccccagaggccccgccggccccaacggcgccgacggcccccagggcccccccggcggcgtgggcaacctgggcccccccggcgagaagggcgagcccggcgagagcggcagccccggcatccagggcgagcccggcgtgaagggccccagaggcgagagaggcgagaagggcgagagcggccagcccggcgagcccggcccccccggccccaagggccccaccggcgacgacggccccaagggcaaccccggccccgtgggcttccccggcgaccccggcccccccggcgagggcggccccagaggccaggacggcgccaagggcgacagaggcgaggacggcgagcccggccagcccggcagccccggccccaccggcgagaacggcccccccggccccctgggcaagagaggccccgccggcagccccggcagcgagggcagacagggcggcaagggcgccaagggcgaccccggcgccatcggcgcccccggcaagaccggccccgtgggccccgccggccccgccggcaagcccggccccgacggcctgagaggcctgcccggcagcgtgggccagcagggcagacccggcgccaccggccaggccggcccccccggccccgtgggcccccccggcctgcccggcctgagaggcgacgccggcgccaagggcgagaagggccaccccggcctgatcggcctgatcggcccccccggcgagcagggcgagaagggcgacagaggcctgcccggcccccagggcagccccggccagaagggcgagatgggcatccccggcgccagcggccccatcggccccggcggcccccccggcctgcccggccccgccggccccaagggcgccaagggcgccaccggccccggcggccccaagggcgagaagggcgtgcagggcccccccggccaccccggcccccccggcgaggtgatccagcccctgcccatccagatgcccaagaagaccagaagaagcgtggacggcagcagactgatgcaggaggacgaggccatccccaccggcggcgcccccggcagccccggcggcctggaggagatcttcggcagcctggacagcctgagagaggagatcgagcagatgagaagacccaccggcacccaggacagccccgccagaacctgccaggacctgaagctgtgccaccccgagctgcccgacggcgagtactgggtggaccccaaccagggctgcgccagagacgccttcagagtgttctgcaacttcaccgccggcggcgagacctgcgtgacccccagagacgacgtgacccagttcagctacgtggacagcgagggcagccccgtgggcgtggtgcagctgaccttcctgagactgctgagcgtgagcgcccaccaggacgtgagctacccctgcagcggcgccgccagagacggccccctgagactgagaggcgccaacgaggacgagctgagccccgagaccagcccctacgtgaaggagttcagagacggctgccagacccagcagggcagaaccgtgctggaggtgagaacccccgtgctggagcagctgcccgtgctggacgccagcttcagcgacctgggcgccccccccagaagaggcggcgtgctgctgggccccgtgtgcttcatgggctag

SEQ ID NO: 1850 - DNA, 4968 bp, Homo sapiens
atggagagatgcagcagatgccacagactgctgctgctgctgcccctggtgctgggcctgagcgccgcccccggctgggccggcgccccccccgtggacgtgctgagagccctgagattccccagcctgcccgacggcgtgagaagagccaagggcatctgccccgccgacgtggcctacagagtggccagacccgcccagctgagcgcccccaccagacagctgttccccggcggcttccccaaggacttcagcctgctgaccgtggtgagaaccagacccggcctgcaggcccccctgctgaccctgtacagcgcccagggcgtgagacagctgggcctggagctgggcagacccgtgagattcctgtacgaggaccagaccggcagaccccagccccccagccagcccgtgttcagaggcctgagcctggccgacggcaagtggcacagagtggccgtggccgtgaagggccagagcgtgaccctgatcgtggactgcaagaagagagtgaccagacccctgcccagaagcgccagacccgtgctggacacccacggcgtgatcatcttcggcgccagaatcctggacgaggaggtgttcgagggcgacgtgcaggagctggccatcgtgcccggcgtgcaggccgcctacgagagctgcgagcagaaggagctggagtgcgagggcggccagagagagagaccccagaaccagcagccccacagagcccagagaagcccccagcagcagcccagcagactgcacagaccccagaaccaggagccccagagccagcccaccgagagcctgtactacgactacaagcccccctactacgacgtgatgaccaccggcaccacccccgactaccaggccgcccacggccccagaggcctgaagggcgagaagggcgagcccgccgtgctggagcccggcatgctggtggagggcccccccggccccgagggccccgccggcctgatcggcccccccggcatccagggcaaccccggccccgtgggcgaccccggcgagagaggcccccccggcagagccggcctgcccggcagcgacggcgcccccggcccccccggcaccagcctgatgctgcccttcagattcggcagcggcggcggcgacaagggccccgtggtggccgcccaggaggcccaggcccaggccatcctgcagcaggccagactggccctgagaggcccccccggccccatgggctacaccggcagacccggccccctgggccagcccggcagccccggcctgaagggcgagagcggcgacctgggcccccagggccccagaggcccccagggcctgaccggcccccccggcaaggccggcagaagaggcagagccggcgccgacggcgccagaggcatgcccggcgaccccggcgtgaagggcgacagaggcttcgacggcctgcccggcctgcccggcgagaagggccacagaggcgacaccggcgcccagggcctgcccggcccccccggcgaggacggcgagagaggcgacgacggcgagatcggccccagaggcctgcccggcgagagcggccccagaggcctgctgggccccaagggcccccccggcatccccggcccccccggcgtgagaggcatggacggcccccagggccccaagggcagcctgggcccccagggcgagcccggcccccccggccagcagggcacccccggcacccagggcctgcccggcccccagggcgccatcggcccccacggcgagaagggcccccagggcaagcccggcctgcccggcatgcccggcagcgacggcccccccggccaccccggcaaggagggcccccccggcaccaagggcaaccagggccccagcggcccccagggccccctgggctaccccggccccagaggcgtgaagggcgtggacggcatcagaggcctgaagggccacaagggcgagaagggcgaggacggcttccccggcttcaagggcgacatcggcgtgaagggcgacagaggcgaggtgggcgtgcccggcagcagaggcgaggacggccccgagggccccaagggcagaaccggccccaccggcgaccccggcccccccggcctgatgggcgagaagggcaagctgggcgtgcccggcctgcccggctaccccggcagacagggccccaagggcagcctgggcttccccggcttccccggcgccagcggcgagaagggcgccagaggcctgagcggcaagagcggccccagaggcgagagaggccccaccggccccagaggccagagaggccccagaggcgccaccggcaagagcggcgccaagggcaccagcggcggcgacggcccccacggcccccccggcgagagaggcctgcccggcccccagggccccaacggcttccccggccccaagggcccccccggcccccccggcaaggacggcctgcccggccaccccggccagagaggcgaggtgggcttccagggcaagaccggcccccccggcccccccggcgtggtgggcccccagggcgccgccggcgagaccggccccatgggcgagagaggccaccccggcccccccggcccccccggcgagcagggcctgcccggcaccgccggcaaggagggcaccaagggcgaccccggcccccccggcgcccccggcaaggacggccccgccggcctgagaggcttccccggcgagagaggcctgcccggcaccgccggcggccccggcctgaagggcaacgagggccccagcggcccccccggccccgccggcagccccggcgagagaggcgccgccggcagcggcggccccatcggcccccccggcagacccggcccccagggcccccccggcgccgccggcgagaagggcgtgcccggcgagaagggccccatcggccccaccggcagagacggcgtgcagggccccgtgggcctgcccggccccgccggcccccccggcgtggccggcgaggacggcgacaagggcgaggtgggcgaccccggccagaagggcaccaagggcaacaagggcgagcacggcccccccggcccccccggccccatcggccccgtgggccagcccggcgccgccggcgccgacggcgagcccggcgccagaggcccccagggccacttcggcgccaagggcgacgagggcaccagaggcttcaacggcccccccggccccatcggcctgcagggcctgcccggccccagcggcgagaagggcgagaccggcgacgtgggccccatgggcccccccggcccccccggccccagaggccccgccggccccaacggcgccgacggcccccagggcccccccggcggcgtgggcaacctgggcccccccggcgagaagggcgagcccggcgagagcggcagccccggcatccagggcgagcccggcgtgaagggccccagaggcgagagaggcgagaagggcgagagcggccagcccggcgagcccggcccccccggccccaagggccccaccggcgacgacggccccaagggcaaccccggccccgtgggcttccccggcgaccccggcccccccggcgagggcggccccagaggccaggacggcgccaagggcgacagaggcgaggacggcgagcccggccagcccggcagccccggccccaccggcgagaacggcccccccggccccctgggcaagagaggccccgccggcagccccggcagcgagggcagacagggcggcaagggcgccaagggcgaccccggcgccatcggcgcccccggcaagaccggccccgtgggccccgccggccccgccggcaagcccggccccgacggcctgagaggcctgcccggcagcgtgggccagcagggcagacccggcgccaccggccaggccggcccccccggccccgtgggcccccccggcctgcccggcctgagaggcgacgccggcgccaagggcgagaagggccaccccggcctgatcggcctgatcggcccccccggcgagcagggcgagaagggcgacagaggcctgcccggcccccagggcagccccggccagaagggcgagatgggcatccccggcgccagcggccccatcggccccggcggcccccccggcctgcccggccccgccggccccaagggcgccaagggcgccaccggccccggcggccccaagggcgagaagggcgtgcagggcccccccggccaccccggcccccccggcgaggtgatccagcccctgcccatccagatgcccaagaagaccagaagaagcgtggacggcagcagactgatgcaggaggacgaggccatccccaccggcggcgcccccggcagccccggcggcctggaggagatcttcggcagcctggacagcctgagagaggagatcgagcagatgagaagacccaccggcacccaggacagccccgccagaacctgccaggacctgaagctgtgccaccccgagctgcccgacggcgagtactgggtggaccccaaccagggctgcgccagagacgccttcagagtgttctgcaacttcaccgccggcggcgagacctgcgtgacccccagagacgacgtgacccagttcagctacgtggacagcgagggcagccccgtgggcgtggtgcagctgaccttcctgagactgctgagcgtgagcgcccaccaggacgtgagctacccctgcagcggcgccgccagagacggccccctgagactgagaggcgccaacgaggacgagctgagccccgagaccagcccctacgtgaaggagttcagagacggctgccagacccagcagggcagaaccgtgctggaggtgagaacccccgtgctggagcagctgcccgtgctggacgccagcttcagcgacctgggcgccccccccagaagaggcggcgtgctgctgggccccgtgtgcttcatgggctag

SEQ ID NO: 1851 - DNA, 5031 bp, Homo sapiens
atggagagatgcagcagatgccacagactgctgctgctgctgcccctggtgctgggcctgagcgccgcccccggctgggccggcgccccccccgtggacgtgctgagagccctgagattccccagcctgcccgacggcgtgagaagagccaagggcatctgccccgccgacgtggcctacagagtggccagacccgcccagctgagcgcccccaccagacagctgttccccggcggcttccccaaggacttcagcctgctgaccgtggtgagaaccagacccggcctgcaggcccccctgctgaccctgtacagcgcccagggcgtgagacagctgggcctggagctgggcccccccgtgagattcctgtacgaggaccagaccggcagaccccagccccccagccagcccgtgttcagaggcctgagcctggccgacggcaagtggcacagagtggccgtggccgtgaagggccagagcgtgaccctgatcgtggactgcaagaagagagtgaccagacccctgcccagaagcgccagacccgtgctggacacccacggcgtgatcatcttcggcgccagaatcctggacgaggaggtgttcgagggcgacgtgcaggagctggccatcgtgcccggcgtgcaggccgcctacgagagctgcgagcagaaggagctggagtgcgagggcggccagagagagagaccccagaaccagcagccccacagagcccagagaagcccccagcagcagcccagcagactgcacagaccccagaaccaggagccccagagccagcccaccgagagcctgtactacgactacaagcccccctactacgacgtgatgaccaccggcaccacccccgactaccaggaccccacccccggcgaggaggaggagatcctggagagcagcctgctgccccccctggaggaggccgcccacggccccagaggcctgaagggcgagaagggcgagcccgccgtgctggagcccggcatgctggtggagggcccccccggccccgagggccccgccggcctgatcggcccccccggcatccagggcaaccccggccccgtgggcgaccccggcgagagaggcccccccggcagagccggcctgcccggcagcgacggcgcccccggcccccccggcaccagcctgatgctgcccttcagattcggcagcggcggcggcgacaagggccccgtggtggccgcccaggaggcccaggcccaggccatcctgcagcaggccagactggccctgagaggcccccccggccccatgggctacaccggcagacccggccccctgggccagcccggcagccccggcctgaagggcgagagcggcgacctgggcccccagggccccagaggcccccagggcctgaccggcccccccggcaaggccggcagaagaggcagagccggcgccgacggcgccagaggcatgcccggcgaccccggcgtgaagggcgacagaggcttcgacggcctgcccggcctgcccggcgagaagggccacagaggcgacaccggcgcccagggcctgcccggcccccccggcgaggacggcgagagaggcgacgacggcgagatcggccccagaggcctgcccggcgagagcggccccagaggcctgctgggccccaagggcccccccggcatccccggcccccccggcgtgagaggcatggacggcccccagggccccaagggcagcctgggcccccagggcgagcccggcccccccggccagcagggcacccccggcacccagggcctgcccggcccccagggcgccatcggcccccacggcgagaagggcccccagggcaagcccggcctgcccggcatgcccggcagcgacggcccccccggccaccccggcaaggagggcccccccggcaccaagggcaaccagggccccagcggcccccagggccccctgggctaccccggccccagaggcgtgaagggcgtggacggcatcagaggcctgaagggccacaagggcgagaagggcgaggacggcttccccggcttcaagggcgacatcggcgtgaagggcgacagaggcgaggtgggcgtgcccggcagcagaggcgaggacggccccgagggccccaagggcagaaccggccccaccggcgaccccggcccccccggcctgatgggcgagaagggcaagctgggcgtgcccggcctgcccggctaccccggcagacagggccccaagggcagcctgggcttccccggcttccccggcgccagcggcgagaagggcgccagaggcctgagcggcaagagcggccccagaggcgagagaggccccaccggccccagaggccagagaggccccagaggcgccaccggcaagagcggcgccaagggcaccagcggcggcgacggcccccacggcccccccggcgagagaggcctgcccggcccccagggccccaacggcttccccggccccaagggcccccccggcccccccggcaaggacggcctgcccggccaccccggccagagaggcgaggtgggcttccagggcaagaccggcccccccggcccccccggcgtggtgggcccccagggcgccgccggcgagaccggccccatgggcgagagaggccaccccggcccccccggcccccccggcgagcagggcctgcccggcaccgccggcaaggagggcaccaagggcgaccccggcccccccggcgcccccggcaaggacggccccgccggcctgagaggcttccccggcgagagaggcctgcccggcaccgccggcggccccggcctgaagggcaacgagggccccagcggcccccccggccccgccggcagccccggcgagagaggcgccgccggcagcggcggccccatcggcccccccggcagacccggcccccagggcccccccggcgccgccggcgagaagggcgtgcccggcgagaagggccccatcggccccaccggcagagacggcgtgcagggccccgtgggcctgcccggccccgccggcccccccggcgtggccggcgaggacggcgacaagggcgaggtgggcgaccccggccagaagggcaccaagggcaacaagggcgagcacggcccccccggcccccccggccccatcggccccgtgggccagcccggcgccgccggcgccgacggcgagcccggcgccagaggcccccagggccacttcggcgccaagggcgacgagggcaccagaggcttcaacggcccccccggccccatcggcctgcagggcctgcccggccccagcggcgagaagggcgagaccggcgacgtgggccccatgggcccccccggcccccccggccccagaggccccgccggccccaacggcgccgacggcccccagggcccccccggcggcgtgggcaacctgggcccccccggcgagaagggcgagcccggcgagagcggcagccccggcatccagggcgagcccggcgtgaagggccccagaggcgagagaggcgagaagggcgagagcggccagcccggcgagcccggcccccccggccccaagggccccaccggcgacgacggccccaagggcaaccccggccccgtgggcttccccggcgaccccggcccccccggcgagggcggccccagaggccaggacggcgccaagggcgacagaggcgaggacggcgagcccggccagcccggcagccccggccccaccggcgagaacggcccccccggccccctgggcaagagaggccccgccggcagccccggcagcgagggcagacagggcggcaagggcgccaagggcgaccccggcgccatcggcgcccccggcaagaccggccccgtgggccccgccggccccgccggcaagcccggccccgacggcctgagaggcctgcccggcagcgtgggccagcagggcagacccggcgccaccggccaggccggcccccccggccccgtgggcccccccggcctgcccggcctgagaggcgacgccggcgccaagggcgagaagggccaccccggcctgatcggcctgatcggcccccccggcgagcagggcgagaagggcgacagaggcctgcccggcccccagggcagccccggccagaagggcgagatgggcatccccggcgccagcggccccatcggccccggcggcccccccggcctgcccggccccgccggccccaagggcgccaagggcgccaccggccccggcggccccaagggcgagaagggcgtgcagggcccccccggccaccccggcccccccggcgaggtgatccagcccctgcccatccagatgcccaagaagaccagaagaagcgtggacggcagcagactgatgcaggaggacgaggccatccccaccggcggcgcccccggcagccccggcggcctggaggagatcttcggcagcctggacagcctgagagaggagatcgagcagatgagaagacccaccggcacccaggacagccccgccagaacctgccaggacctgaagctgtgccaccccgagctgcccgacggcgagtactgggtggaccccaaccagggctgcgccagagacgccttcagagtgttctgcaacttcaccgccggcggcgagacctgcgtgacccccagagacgacgtgacccagttcagctacgtggacagcgagggcagccccgtgggcgtggtgcagctgaccttcctgagactgctgagcgtgagcgcccaccaggacgtgagctacccctgcagcggcgccgccagagacggccccctgagactgagaggcgccaacgaggacgagctgagccccgagaccagcccctacgtgaaggagttcagagacggctgccagacccagcagggcagaaccgtgctggaggtgagaacccccgtgctggagcagctgcccgtgctggacgccagcttcagcgacctgggcgccccccccagaagaggcggcgtgctgctgggccccgtgtgcttcatgggctag

SEQ ID NO: 1852 - DNA, 5031 bp, Homo sapiens
atggagagatgcagcagatgccacagactgctgctgctgctgcccctggtgctgggcctgagcgccgcccccggctgggccggcgccccccccgtggacgtgctgagagccctgagattccccagcctgcccgacggcgtgagaagagccaagggcatctgccccgccgacgtggcctacagagtggccagacccgcccagctgagcgcccccaccagacagctgttccccggcggcttccccaaggacttcagcctgctgaccgtggtgagaaccagacccggcctgcaggcccccctgctgaccctgtacagcgcccagggcgtgagacagctgggcctggagctgggcagacccgtgagattcctgtacgaggaccagaccggcagaccccagccccccagccagcccgtgttcagaggcctgagcctggccgacggcaagtggcacagagtggccgtggccgtgaagggccagagcgtgaccctgatcgtggactgcaagaagagagtgaccagacccctgcccagaagcgccagacccgtgctggacacccacggcgtgatcatcttcggcgccagaatcctggacgaggaggtgttcgagggcgacgtgcaggagctggccatcgtgcccggcgtgcaggccgcctacgagagctgcgagcagaaggagctggagtgcgagggcggccagagagagagaccccagaaccagcagccccacagagcccagagaagcccccagcagcagcccagcagactgcacagaccccagaaccaggagccccagagccagcccaccgagagcctgtactacgactacaagcccccctactacgacgtgatgaccaccggcaccacccccgactaccaggaccccacccccggcgaggaggaggagatcctggagagcagcctgctgccccccctggaggaggccgcccacggccccagaggcctgaagggcgagaagggcgagcccgccgtgctggagcccggcatgctggtggagggcccccccggccccgagggccccgccggcctgatcggcccccccggcatccagggcaaccccggccccgtgggcgaccccggcgagagaggcccccccggcagagccggcctgcccggcagcgacggcgcccccggcccccccggcaccagcctgatgctgcccttcagattcggcagcggcggcggcgacaagggccccgtggtggccgcccaggaggcccaggcccaggccatcctgcagcaggccagactggccctgagaggcccccccggccccatgggctacaccggcagacccggccccctgggccagcccggcagccccggcctgaagggcgagagcggcgacctgggcccccagggccccagaggcccccagggcctgaccggcccccccggcaaggccggcagaagaggcagagccggcgccgacggcgccagaggcatgcccggcgaccccggcgtgaagggcgacagaggcttcgacggcctgcccggcctgcccggcgagaagggccacagaggcgacaccggcgcccagggcctgcccggcccccccggcgaggacggcgagagaggcgacgacggcgagatcggccccagaggcctgcccggcgagagcggccccagaggcctgctgggccccaagggcccccccggcatccccggcccccccggcgtgagaggcatggacggcccccagggccccaagggcagcctgggcccccagggcgagcccggcccccccggccagcagggcacccccggcacccagggcctgcccggcccccagggcgccatcggcccccacggcgagaagggcccccagggcaagcccggcctgcccggcatgcccggcagcgacggcccccccggccaccccggcaaggagggcccccccggcaccaagggcaaccagggccccagcggcccccagggccccctgggctaccccggccccagaggcgtgaagggcgtggacggcatcagaggcctgaagggccacaagggcgagaagggcgaggacggcttccccggcttcaagggcgacatcggcgtgaagggcgacagaggcgaggtgggcgtgcccggcagcagaggcgaggacggccccgagggccccaagggcagaaccggccccaccggcgaccccggcccccccggcctgatgggcgagaagggcaagctgggcgtgcccggcctgcccggctaccccggcagacagggccccaagggcagcctgggcttccccggcttccccggcgccagcggcgagaagggcgccagaggcctgagcggcaagagcggccccagaggcgagagaggccccaccggccccagaggccagagaggccccagaggcgccaccggcaagagcggcgccaagggcaccagcggcggcgacggcccccacggcccccccggcgagagaggcctgcccggcccccagggccccaacggcttccccggccccaagggcccccccggcccccccggcaaggacggcctgcccggccaccccggccagagaggcgaggtgggcttccagggcaagaccggcccccccggcccccccggcgtggtgggcccccagggcgccgccggcgagaccggccccatgggcgagagaggccaccccggcccccccggcccccccggcgagcagggcctgcccggcaccgccggcaaggagggcaccaagggcgaccccggcccccccggcgcccccggcaaggacggccccgccggcctgagaggcttccccggcgagagaggcctgcccggcaccgccggcggccccggcctgaagggcaacgagggccccagcggcccccccggccccgccggcagccccggcgagagaggcgccgccggcagcggcggccccatcggcccccccggcagacccggcccccagggcccccccggcgccgccggcgagaagggcgtgcccggcgagaagggccccatcggccccaccggcagagacggcgtgcagggccccgtgggcctgcccggccccgccggcccccccggcgtggccggcgaggacggcgacaagggcgaggtgggcgaccccggccagaagggcaccaagggcaacaagggcgagcacggcccccccggcccccccggccccatcggccccgtgggccagcccggcgccgccggcgccgacggcgagcccggcgccagaggcccccagggccacttcggcgccaagggcgacgagggcaccagaggcttcaacggcccccccggccccatcggcctgcagggcctgcccggccccagcggcgagaagggcgagaccggcgacgtgggccccatgggcccccccggcccccccggccccagaggccccgccggccccaacggcgccgacggcccccagggcccccccggcggcgtgggcaacctgggcccccccggcgagaagggcgagcccggcgagagcggcagccccggcatccagggcgagcccggcgtgaagggccccagaggcgagagaggcgagaagggcgagagcggccagcccggcgagcccggcccccccggccccaagggccccaccggcgacgacggccccaagggcaaccccggccccgtgggcttccccggcgaccccggcccccccggcgagggcggccccagaggccaggacggcgccaagggcgacagaggcgaggacggcgagcccggccagcccggcagccccggccccaccggcgagaacggcccccccggccccctgggcaagagaggccccgccggcagccccggcagcgagggcagacagggcggcaagggcgccaagggcgaccccggcgccatcggcgcccccggcaagaccggccccgtgggccccgccggccccgccggcaagcccggccccgacggcctgagaggcctgcccggcagcgtgggccagcagggcagacccggcgccaccggccaggccggcccccccggccccgtgggcccccccggcctgcccggcctgagaggcgacgccggcgccaagggcgagaagggccaccccggcctgatcggcctgatcggcccccccggcgagcagggcgagaagggcgacagaggcctgcccggcccccagggcagccccggccagaagggcgagatgggcatccccggcgccagcggccccatcggccccggcggcccccccggcctgcccggccccgccggccccaagggcgccaagggcgccaccggccccggcggccccaagggcgagaagggcgtgcagggcccccccggccaccccggcccccccggcgaggtgatccagcccctgcccatccagatgcccaagaagaccagaagaagcgtggacggcagcagactgatgcaggaggacgaggccatccccaccggcggcgcccccggcagccccggcggcctggaggagatcttcggcagcctggacagcctgagagaggagatcgagcagatgagaagacccaccggcacccaggacagccccgccagaacctgccaggacctgaagctgtgccaccccgagctgcccgacggcgagtactgggtggaccccaaccagggctgcgccagagacgccttcagagtgttctgcaacttcaccgccggcggcgagacctgcgtgacccccagagacgacgtgacccagttcagctacgtggacagcgagggcagccccgtgggcgtggtgcagctgaccttcctgagactgctgagcgtgagcgcccaccaggacgtgagctacccctgcagcggcgccgccagagacggccccctgagactgagaggcgccaacgaggacgagctgagccccgagaccagcccctacgtgaaggagttcagagacggctgccagacccagcagggcagaaccgtgctggaggtgagaacccccgtgctggagcagctgcccgtgctggacgccagcttcagcgacctgggcgccccccccagaagaggcggcgtgctgctgggccccgtgtgcttcatgggctag

SEQ ID NO: 1853 - DNA, 5031 bp, Homo sapiens; identical to SEQ ID NO: 1828

SEQ ID NO: 1854 - DNA, 5148 bp, Homo sapiens
atggagagatgcagcagatgccacagactgctgctgctgctgcccctggtgctgggcctgagcgccgcccccggctgggccggcgccccccccgtggacgtgctgagagccctgagattccccagcctgcccgacggcgtgagaagagccaagggcatctgccccgccgacgtggcctacagagtggccagacccgcccagctgagcgcccccaccagacagctgttccccggcggcttccccaaggacttcagcctgctgaccgtggtgagaaccagacccggcctgcaggcccccctgctgaccctgtacagcgcccagggcgtgagacagctgggcctggagctgggcagacccgtgagattcctgtacgaggaccagaccggcagaccccagccccccagccagcccgtgttcagaggcctgagcctggccgacggcaagtggcacagagtggccgtggccgtgaagggccagagcgtgaccctgatcgtggactgcaagaagagagtgaccagacccctgcccagaagcgccagacccgtgctggacacccacggcgtgatcatcttcggcgccagaatcctggacgaggaggtgttcgagggcgacgtgcaggagctggccatcgtgcccggcgtgcaggccgcctacgagagctgcgagcagaaggagctggagtgcgagggcggccagagagagagaccccagaaccagcagccccacagagcccagagaagcccccagcagcagcccagcagactgcacagaccccagaaccaggagccccagagccagcccaccgagagcctgtactacgactacgagcccccctactacgacgtgatgaccaccggcaccacccccgactaccaggagcagaccgacctgcaggtgccccccaccgccgacagattccaggccgaggagtacggcgagggcggcaccgacccccccgagggcccctacgactacacctacggctacggcgacgactacagagaggagaccgagctgggccccgccctgagcgccgagaccgcccacagcggcgccgccgcccacggccccagaggcctgaagggcgagaagggcgagcccgccgtgctggagcccggcatgctggtggagggcccccccggccccgagggccccgccggcctgatcggcccccccggcatccagggcaaccccggccccgtgggcgaccccggcgagagaggcccccccggcagagccggcctgcccggcagcgacggcgcccccggcccccccggcaccagcctgatgctgcccttcagattcggcagcggcggcggcgacaagggccccgtggtggccgcccaggaggcccaggcccaggccatcctgcagcaggccagactggccctgagaggcccccccggccccatgggctacaccggcagacccggccccctgggccagcccggcagccccggcctgaagggcgagagcggcgacctgggcccccagggccccagaggcccccagggcctgaccggcccccccggcaaggccggcagaagaggcagagccggcgccgacggcgccagaggcatgcccggcgaccccggcgtgaagggcgacagaggcttcgacggcctgcccggcctgcccggcgagaagggccacagaggcgacaccggcgcccagggcctgcccggcccccccggcgaggacggcgagagaggcgacgacggcgagatcggccccagaggcctgcccggcgagagcggccccagaggcctgctgggccccaagggcccccccggcatccccggcccccccggcgtgagaggcatggacggcccccagggccccaagggcagcctgggcccccagggcgagcccggcccccccggccagcagggcacccccggcacccagggcctgcccggcccccagggcgccatcggcccccacggcgagaagggcccccagggcaagcccggcctgcccggcatgcccggcagcgacggcccccccggccaccccggcaaggagggcccccccggcaccaagggcaaccagggccccagcggcccccagggccccctgggctaccccggccccagaggcgtgaagggcgtggacggcatcagaggcctgaagggccacaagggcgagaagggcgaggacggcttccccggcttcaagggcgacatcggcgtgaagggcgacagaggcgaggtgggcgtgcccggcagcagaggcgaggacggccccgagggccccaagggcagaaccggccccaccggcgaccccggcccccccggcctgatgggcgagaagggcaagctgggcgtgcccggcctgcccggctaccccggcagacagggccccaagggcagcctgggcttccccggcttccccggcgccagcggcgagaagggcgccagaggcctgagcggcaagagcggccccagaggcgagagaggccccaccggccccagaggccagagaggccccagaggcgccaccggcaagagcggcgccaagggcaccagcggcggcgacggcccccacggcccccccggcgagagaggcctgcccggcccccagggccccaacggcttccccggccccaagggccccctgggcccccccggcaaggacggcctgcccggccaccccggccagagaggcgaggtgggcttccagggcaagaccggcccccccggcccccccggcgtggtgggcccccagggcgccgccggcgagaccggccccatgggcgagagaggccaccccggcccccccggcccccccggcgagcagggcctgcccggcaccgccggcaaggagggcaccaagggcgaccccggcccccccggcgcccccggcaaggacggccccgccggcctgagaggcttccccggcgagagaggcctgcccggcaccgccggcggccccggcctgaagggcaacgagggccccagcggcccccccggccccgccggcagccccggcgagagaggcgccgccggcagcggcggccccatcggcccccccggcagacccggcccccagggcccccccggcgccgccggcgagaagggcgtgcccggcgagaagggccccatcggccccaccggcagagacggcgtgcagggccccgtgggcctgcccggccccgccggcccccccggcgtggccggcgaggacggcgacaagggcgaggtgggcgaccccggccagaagggcaccaagggcaacaagggcgagcacggcccccccggcccccccggccccatcggccccgtgggccagcccggcgccgccggcgccgacggcgagcccggcgccagaggcccccagggccacttcggcgccaagggcgacgagggcaccagaggcttcaacggcccccccggccccatcggcctgcagggcctgcccggccccagcggcgagaagggcgagaccggcgacgtgggccccatgggcccccccggcccccccggccccagaggccccgccggccccaacggcgccgacggcccccagggcccccccggcggcgtgggcaacctgggcccccccggcgagaagggcgagcccggcgagagcggcagccccggcatccagggcgagcccggcgtgaagggccccagaggcgagagaggcgagaagggcgagagcggccagcccggcgagcccggcccccccggccccaagggccccaccggcgacgacggccccaagggcaaccccggccccgtgggcttccccggcgaccccggcccccccggcgagggcggccccagaggccaggacggcgccaagggcgacagaggcgaggacggcgagcccggccagcccggcagccccggccccaccggcgagaacggcccccccggccccctgggcaagagaggccccgccggcagccccggcagcgagggcagacagggcggcaagggcgccaagggcgaccccggcgccatcggcgcccccggcaagaccggccccgtgggccccgccggccccgccggcaagcccggccccgacggcctgagaggcctgcccggcagcgtgggccagcagggcagacccggcgccaccggccaggccggcccccccggccccgtgggcccccccggcctgcccggcctgagaggcgacgccggcgccaagggcgagaagggccaccccggcctgatcggcctgatcggcccccccggcgagcagggcgagaagggcgacagaggcctgcccggcccccagggcagccccggccagaagggcgagatgggcatccccggcgccagcggccccatcggccccggcggcccccccggcctgcccggccccgccggccccaagggcgccaagggcgccaccggccccggcggccccaagggcgagaagggcgtgcagggcccccccggccaccccggcccccccggcgaggtgatccagcccctgcccatccagatgcccaagaagaccagaagaagcgtggacggcagcagactgatgcaggaggacgaggccatccccaccggcggcgcccccggcagccccggcggcctggaggagatcttcggcagcctggacagcctgagagaggagatcgagcagatgagaagacccaccggcacccaggacagccccgccagaacctgccaggacctgaagctgtgccaccccgagctgcccgacggcgagtactgggtggaccccaaccagggctgcgccagagacgccttcagagtgttctgcaacttcaccgccggcggcgagacctgcgtgacccccagagacgacgtgacccagttcagctacgtggacagcgagggcagccccgtgggcgtggtgcagctgaccttcctgagactgctgagcgtgagcgcccaccaggacgtgagctacccctgcagcggcgccgccagagacggccccctgagactgagaggcgccaacgaggacgagctgagccccgagaccagcccctacgtgaaggagttcagagacggctgccagacccagcagggcagaaccgtgctggaggtgagaacccccgtgctggagcagctgcccgtgctggacgccagcttcagcgacctgggcgccccccccagaagaggcggcgtgctgctgggccccgtgtgcttcatgggctag

SEQ ID NO: 1855 - DNA, 4809 bp, Homo sapiens
ggcgccccccccgtggacgtgctgagagccctgagattccccagcctgcccgacggcgtgagaagagccaagggcatctgccccgccgacgtggcctacagagtggccagacccgcccagctgagcgcccccaccagacagctgttccccggcggcttccccaaggacttcagcctgctgaccgtggtgagaaccagacccggcctgcaggcccccctgctgaccctgtacagcgcccagggcgtgagacagctgggcctggagctgggcagacccgtgagattcctgtacgaggaccagaccggcagaccccagccccccagccagcccgtgttcagaggcctgagcctggccgacggcaagtggcacagagtggccgtggccgtgaagggccagagcgtgaccctgatcgtggactgcaagaagagagtgaccagacccctgcccagaagcgccagacccgtgctggacacccacggcgtgatcatcttcggcgccagaatcctggacgaggaggtgttcgagggcgacgtgcaggagctggccatcgtgcccggcgtgcaggccgcctacgagagctgcgagcagaaggagctggagtgcgagggcggccagagagagagaccccagaaccagcagccccacagagcccagagaagcccccagcagcagcccagcagactgcacagaccccagaaccaggagccccagagccaggccgcccacggccccagaggcctgaagggcgagaagggcgagcccgccgtgctggagcccggcatgctggtggagggcccccccggccccgagggccccgccggcctgatcggcccccccggcatccagggcaaccccggccccgtgggcgaccccggcgagagaggcccccccggcagagccggcctgcccggcagcgacggcgcccccggcccccccggcaccagcctgatgctgcccttcagattcggcagcggcggcggcgacaagggccccgtggtggccgcccaggaggcccaggcccaggccatcctgcagcaggccagactggccctgagaggcccccccggccccatgggctacaccggcagacccggccccctgggccagcccggcagccccggcctgaagggcgagagcggcgacctgggcccccagggccccagaggcccccagggcctgaccggcccccccggcaaggccggcagaagaggcagagccggcgccgacggcgccagaggcatgcccggcgaccccggcgtgaagggcgacagaggcttcgacggcctgcccggcctgcccggcgagaagggccacagaggcgacaccggcgcccagggcctgcccggcccccccggcgaggacggcgagagaggcgacgacggcgagatcggccccagaggcctgcccggcgagagcggccccagaggcctgctgggccccaagggcccccccggcatccccggcccccccggcgtgagaggcatggacggcccccagggccccaagggcagcctgggcccccagggcgagcccggcccccccggccagcagggcacccccggcacccagggcctgcccggcccccagggcgccatcggcccccacggcgagaagggcccccagggcaagcccggcctgcccggcatgcccggcagcgacggcccccccggccaccccggcaaggagggcccccccggcaccaagggcaaccagggccccagcggcccccagggccccctgggctaccccggccccagaggcgtgaagggcgtggacggcatcagaggcctgaagggccacaagggcgagaagggcgaggacggcttccccggcttcaagggcgacatcggcgtgaagggcgacagaggcgaggtgggcgtgcccggcagcagaggcgaggacggccccgagggccccaagggcagaaccggccccaccggcgaccccggcccccccggcctgatgggcgagaagggcaagctgggcgtgcccggcctgcccggctaccccggcagacagggccccaagggcagcctgggcttccccggcttccccggcgccagcggcgagaagggcgccagaggcctgagcggcaagagcggccccagaggcgagagaggccccaccggccccagaggccagagaggccccagaggcgccaccggcaagagcggcgccaagggcaccagcggcggcgacggcccccacggcccccccggcgagagaggcctgcccggcccccagggccccaacggcttccccggccccaagggcccccccggcccccccggcaaggacggcctgcccggccaccccggccagagaggcgaggtgggcttccagggcaagaccggcccccccggcccccccggcgtggtgggcccccagggcgccgccggcgagaccggccccatgggcgagagaggccaccccggcccccccggcccccccggcgagcagggcctgcccggcaccgccggcaaggagggcaccaagggcgaccccggcccccccggcgcccccggcaaggacggccccgccggcctgagaggcttccccggcgagagaggcctgcccggcaccgccggcggccccggcctgaagggcaacgagggccccagcggcccccccggccccgccggcagccccggcgagagaggcgccgccggcagcggcggccccatcggcccccccggcagacccggcccccagggcccccccggcgccgccggcgagaagggcgtgcccggcgagaagggccccatcggccccaccggcagagacggcgtgcagggccccgtgggcctgcccggccccgccggcccccccggcgtggccggcgaggacggcgacaagggcgaggtgggcgaccccggccagaagggcaccaagggcaacaagggcgagcacggcccccccggcccccccggccccatcggccccgtgggccagcccggcgccgccggcgccgacggcgagcccggcgccagaggcccccagggccacttcggcgccaagggcgacgagggcaccagaggcttcaacggcccccccggccccatcggcctgcagggcctgcccggccccagcggcgagaagggcgagaccggcgacgtgggccccatgggcccccccggcccccccggccccagaggccccgccggccccaacggcgccgacggcccccagggcccccccggcggcgtgggcaacctgggcccccccggcgagaagggcgagcccggcgagagcggcagccccggcatccagggcgagcccggcgtgaagggccccagaggcgagagaggcgagaagggcgagagcggccagcccggcgagcccggcccccccggccccaagggccccaccggcgacgacggccccaagggcaaccccggccccgtgggcttccccggcgaccccggcccccccggcgagggcggccccagaggccaggacggcgccaagggcgacagaggcgaggacggcgagcccggccagcccggcagccccggccccaccggcgagaacggcccccccggccccctgggcaagagaggccccgccggcagccccggcagcgagggcagacagggcggcaagggcgccaagggcgaccccggcgccatcggcgcccccggcaagaccggccccgtgggccccgccggccccgccggcaagcccggccccgacggcctgagaggcctgcccggcagcgtgggccagcagggcagacccggcgccaccggccaggccggcccccccggccccgtgggcccccccggcctgcccggcctgagaggcgacgccggcgccaagggcgagaagggccaccccggcctgatcggcctgatcggcccccccggcgagcagggcgagaagggcgacagaggcctgcccggcccccagggcagccccggccagaagggcgagatgggcatccccggcgccagcggccccatcggccccggcggcccccccggcctgcccggccccgccggccccaagggcgccaagggcgccaccggccccggcggccccaagggcgagaagggcgtgcagggcccccccggccaccccggcccccccggcgaggtgatccagcccctgcccatccagatgcccaagaagaccagaagaagcgtggacggcagcagactgatgcaggaggacgaggccatccccaccggcggcgcccccggcagccccggcggcctggaggagatcttcggcagcctggacagcctgagagaggagatcgagcagatgagaagacccaccggcacccaggacagccccgccagaacctgccaggacctgaagctgtgccaccccgagctgcccgacggcgagtactgggtggaccccaaccagggctgcgccagagacgccttcagagtgttctgcaacttcaccgccggcggcgagacctgcgtgacccccagagacgacgtgacccagttcagctacgtggacagcgagggcagccccgtgggcgtggtgcagctgaccttcctgagactgctgagcgtgagcgcccaccaggacgtgagctacccctgcagcggcgccgccagagacggccccctgagactgagaggcgccaacgaggacgagctgagccccgagaccagcccctacgtgaaggagttcagagacggctgccagacccagcagggcagaaccgtgctggaggtgagaacccccgtgctggagcagctgcccgtgctggacgccagcttcagcgacctgggcgccccccccagaagaggcggcgtgctgctgggccccgtgtgcttcatgggctag

SEQ ID NO: 1856 - DNA, 5052 bp, Homo sapiens
ggcgccccccccgtggacgtgctgagagccctgagattccccagcctgcccgacggcgtgagaagagccaagggcatctgccccgccgacgtggcctacagagtggccagacccgcccagctgagcgcccccaccagacagctgttccccggcggcttccccaaggacttcagcctgctgaccgtggtgagaaccagacccggcctgcaggcccccctgctgaccctgtacagcgcccagggcgtgagacagctgggcctggagctgggcagacccgtgagattcctgtacgaggaccagaccggcagaccccagccccccagccagcccgtgttcagaggcctgagcctggccgacggcaagtggcacagagtggccgtggccgtgaagggccagagcgtgaccctgatcgtggactgcaagaagagagtgaccagacccctgcccagaagcgccagacccgtgctggacacccacggcgtgatcatcttcggcgccagaatcctggacgaggaggtgttcgagggcgacgtgcaggagctggccatcgtgcccggcgtgcaggccgcctacgagagctgcgagcagaaggagctggagtgcgagggcggccagagagagagaccccagaaccagcagccccacagagcccagagaagcccccagcagcagcccagcagactgcacagaccccagaaccaggagccccagagccaggaccccacccccggcgaggaggaggagatcctggagagcagcctgctgccccccctggaggaggagcagaccgacctgcaggtgccccccaccgccgacagattccaggccgaggagtacggcgagggcggcaccgacccccccgagggcccctacgactacacctacggctacggcgacgactacagagaggagaccgagctgggccccgccctgagcgccgagaccgcccacagcggcgccgccgcccacggccccagaggcctgaagggcgagaagggcgagcccgccgtgctggagcccggcatgctggtggagggcccccccggccccgagggccccgccggcctgatcggcccccccggcatccagggcaaccccggccccgtgggcgaccccggcgagagaggcccccccggcagagccggcctgcccggcagcgacggcgcccccggcccccccggcaccagcctgatgctgcccttcagattcggcagcggcggcggcgacaagggccccgtggtggccgcccaggaggcccaggcccaggccatcctgcagcaggccagactggccctgagaggcccccccggccccatgggctacaccggcagacccggccccctgggccagcccggcagccccggcctgaagggcgagagcggcgacctgggcccccagggccccagaggcccccagggcctgaccggcccccccggcaaggccggcagaagaggcagagccggcgccgacggcgccagaggcatgcccggcgaccccggcgtgaagggcgacagaggcttcgacggcctgcccggcctgcccggcgagaagggccacagaggcgacaccggcgcccagggcctgcccggcccccccggcgaggacggcgagagaggcgacgacggcgagatcggccccagaggcctgcccggcgagagcggccccagaggcctgctgggccccaagggcccccccggcatccccggcccccccggcgtgagaggcatggacggcccccagggccccaagggcagcctgggcccccagggcgagcccggcccccccggccagcagggcacccccggcacccagggcctgcccggcccccagggcgccatcggcccccacggcgagaagggcccccagggcaagcccggcctgcccggcatgcccggcagcgacggcccccccggccaccccggcaaggagggcccccccggcaccaagggcaaccagggccccagcggcccccagggccccctgggctaccccggccccagaggcgtgaagggcgtggacggcatcagaggcctgaagggccacaagggcgagaagggcgaggacggcttccccggcttcaagggcgacatcggcgtgaagggcgacagaggcgaggtgggcgtgcccggcagcagaggcgaggacggccccgagggccccaagggcagaaccggccccaccggcgaccccggcccccccggcctgatgggcgagaagggcaagctgggcgtgcccggcctgcccggctaccccggcagacagggccccaagggcagcctgggcttccccggcttccccggcgccagcggcgagaagggcgccagaggcctgagcggcaagagcggccccagaggcgagagaggccccaccggccccagaggccagagaggccccagaggcgccaccggcaagagcggcgccaagggcaccagcggcggcgacggcccccacggcccccccggcgagagaggcctgcccggcccccagggccccaacggcttccccggccccaagggcccccccggcccccccggcaaggacggcctgcccggccaccccggccagagaggcgaggtgggcttccagggcaagaccggcccccccggcccccccggcgtggtgggcccccagggcgccgccggcgagaccggccccatgggcgagagaggccaccccggcccccccggcccccccggcgagcagggcctgcccggcaccgccggcaaggagggcaccaagggcgaccccggcccccccggcgcccccggcaaggacggccccgccggcctgagaggcttccccggcgagagaggcctgcccggcaccgccggcggccccggcctgaagggcaacgagggccccagcggcccccccggccccgccggcagccccggcgagagaggcgccgccggcagcggcggccccatcggcccccccggcagacccggcccccagggcccccccggcgccgccggcgagaagggcgtgcccggcgagaagggccccatcggccccaccggcagagacggcgtgcagggccccgtgggcctgcccggccccgccggcccccccggcgtggccggcgaggacggcgacaagggcgaggtgggcgaccccggccagaagggcaccaagggcaacaagggcgagcacggcccccccggcccccccggccccatcggccccgtgggccagcccggcgccgccggcgccgacggcgagcccggcgccagaggcccccagggccacttcggcgccaagggcgacgagggcaccagaggcttcaacggcccccccggccccatcggcctgcagggcctgcccggccccagcggcgagaagggcgagaccggcgacgtgggccccatgggcccccccggcccccccggccccagaggccccgccggccccaacggcgccgacggcccccagggcccccccggcggcgtgggcaacctgggcccccccggcgagaagggcgagcccggcgagagcggcagccccggcatccagggcgagcccggcgtgaagggccccagaggcgagagaggcgagaagggcgagagcggccagcccggcgagcccggcccccccggccccaagggccccaccggcgacgacggccccaagggcaaccccggccccgtgggcttccccggcgaccccggcccccccggcgagggcggccccagaggccaggacggcgccaagggcgacagaggcgaggacggcgagcccggccagcccggcagccccggccccaccggcgagaacggcccccccggccccctgggcaagagaggccccgccggcagccccggcagcgagggcagacagggcggcaagggcgccaagggcgaccccggcgccatcggcgcccccggcaagaccggccccgtgggccccgccggccccgccggcaagcccggccccgacggcctgagaggcctgcccggcagcgtgggccagcagggcagacccggcgccaccggccaggccggcccccccggccccgtgggcccccccggcctgcccggcctgagaggcgacgccggcgccaagggcgagaagggccaccccggcctgatcggcctgatcggcccccccggcgagcagggcgagaagggcgacagaggcctgcccggcccccagggcagccccggccagaagggcgagatgggcatccccggcgccagcggccccatcggccccggcggcccccccggcctgcccggccccgccggccccaagggcgccaagggcgccaccggccccggcggccccaagggcgagaagggcgtgcagggcccccccggccaccccggcccccccggcgaggtgatccagcccctgcccatccagatgcccaagaagaccagaagaagcgtggacggcagcagactgatgcaggaggacgaggccatccccaccggcggcgcccccggcagccccggcggcctggaggagatcttcggcagcctggacagcctgagagaggagatcgagcagatgagaagacccaccggcacccaggacagccccgccagaacctgccaggacctgaagctgtgccaccccgagctgcccgacggcgagtactgggtggaccccaaccagggctgcgccagagacgccttcagagtgttctgcaacttcaccgccggcggcgagacctgcgtgacccccagagacgacgtgacccagttcagctacgtggacagcgagggcagccccgtgggcgtggtgcagctgaccttcctgagactgctgagcgtgagcgcccaccaggacgtgagctacccctgcagcggcgccgccagagacggccccctgagactgagaggcgccaacgaggacgagctgagccccgagaccagcccctacgtgaaggagttcagagacggctgccagacccagcagggcagaaccgtgctggaggtgagaacccccgtgctggagcagctgcccgtgctggacgccagcttcagcgacctgggcgccccccccagaagaggcggcgtgctgctgggccccgtgtgcttcatgggctag

SEQ ID NO: 1857 - DNA, 5133 bp, Homo sapiens; identical to SEQ ID NO: 1822

SEQ ID NO: 1858 - DNA, 5133 bp, Homo sapiens; identical to SEQ ID NO: 1822

SEQ ID NO: 1859 - DNA, 5031 bp, Homo sapiens
atggagagatgcagcagatgccacagactgctgctgctgctgcccctggtgctgggcctgagcgccgcccccggctgggccggcgccccccccgtggacgtgctgagagccctgagattccccagcctgcccgacggcgtgagaagagccaagggcatctgccccgccgacgtggcctacagagtggccagacccgcccagctgagcgcccccaccagacagctgttccccggcggcttccccaaggacttcagcctgctgaccgtggtgagaaccagacccggcctgcaggcccccctgctgaccctgtacagcgcccagggcgtgagacagctgggcctggagctgggcagacccgtgagattcctgtacgaggaccagaccggcagaccccagccccccagccagcccgtgttcagaggcctgagcctggccgacggcaagtggcacagagtggccgtggccgtgaagggccagagcgtgaccctgatcgtggactgcaagaagagagtgaccagacccctgcccagaagcgccagacccgtgctggacacccacggcgtgatcatcttcggcgccagaatcctggacgaggaggtgttcgagggcgacgtgcaggagctggccatcgtgcccggcgtgcaggccgcctacgagagctgcgagcagaaggagctggagtgcgagggcggccagagagagagaccccagaaccagcagccccacagagcccagagaagcccccagcagcagcccagcagactgcacagaccccagaaccaggagccccagagccagcccaccgagagcctgtactacgactacgagcccccctactacgacgtgatgaccaccggcaccacccccgactaccaggaccccacccccggcgaggaggaggagatcctggagagcagcctgctgccccccctggaggaggccgcccacggccccagaggcctgaagggcgagaagggcgagcccgccgtgctggagcccggcatgctggtggagggcccccccggccccgagggccccgccggcctgatcggcccccccggcatccagggcaaccccggccccgtgggcgaccccggcgagagaggcccccccggcagagccggcctgcccggcagcgacggcgcccccggcccccccggcaccagcctgatgctgcccttcagattcggcagcggcggcggcgacaagggccccgtggtggccgcccaggaggcccaggcccaggccatcctgcagcaggccagactggccctgagaggcccccccggccccatgggctacaccggcagacccggccccctgggccagcccggcagccccggcctgaagggcgagagcggcgacctgggcccccagggccccagaggcccccagggcctgaccggcccccccggcaaggccggcagaagaggcagagccggcgccgacggcgccagaggcatgcccggcgaccccggcgtgaagggcgacagaggcttcgacggcctgcccggcctgcccggcgagaagggccacagaggcgacaccggcgcccagggcctgcccggcccccccggcgaggacggcgagagaggcgacgacggcgagatcggccccagaggcctgcccggcgagagcggccccagaggcctgctgggccccaagggcccccccggcatccccggcccccccggcgtgagaggcatggacggcccccagggccccaagggcagcctgggcccccagggcgagcccggcccccccggccagcagggcacccccggcacccagggcctgcccggcccccagggcgccatcggcccccacggcgagaagggcccccagggcaagcccggcctgcccggcatgcccggcagcgacggcccccccggccaccccggcaaggagggcccccccggcaccaagggcaaccagggccccagcggcccccagggccccctgggctaccccggccccagaggcgtgaagggcgtggacggcatcagaggcctgaagggccacaagggcgagaagggcgaggacggcttccccggcttcaagggcgacatcggcgtgaagggcgacagaggcgaggtgggcgtgcccggcagcagaggcgaggacggccccgagggccccaagggcagaaccggccccaccggcgaccccggcccccccggcctgatgggcgagaagggcaagctgggcgtgcccggcctgcccggctaccccggcagacagggccccaagggcagcctgggcttccccggcttccccggcgccagcggcgagaagggcgccagaggcctgagcggcaagagcggccccagaggcgagagaggccccaccggccccagaggccagagaggccccagaggcgccaccggcaagagcggcgccaagggcaccagcggcggcgacggcccccacggcccccccggcgagagaggcctgcccggcccccagggccccaacggcttccccggccccaagggccccctgggcccccccggcaaggacggcctgcccggccaccccggccagagaggcgaggtgggcttccagggcaagaccggcccccccggcccccccggcgtggtgggcccccagggcgccgccggcgagaccggccccatgggcgagagaggccaccccggcccccccggcccccccggcgagcagggcctgcccggcaccgccggcaaggagggcaccaagggcgaccccggcccccccggcgcccccggcaaggacggccccgccggcctgagaggcttccccggcgagagaggcctgcccggcaccgccggcggccccggcctgaagggcaacgagggccccagcggcccccccggccccgccggcagccccggcgagagaggcgccgccggcagcggcggccccatcggcccccccggcagacccggcccccagggcccccccggcgccgccggcgagaagggcgtgcccggcgagaagggccccatcggccccaccggcagagacggcgtgcagggccccgtgggcctgcccggccccgccggcccccccggcgtggccggcgaggacggcgacaagggcgaggtgggcgaccccggccagaagggcaccaagggcaacaagggcgagcacggcccccccggcccccccggccccatcggccccgtgggccagcccggcgccgccggcgccgacggcgagcccggcgccagaggcccccagggccacttcggcgccaagggcgacgagggcaccagaggcttcaacggcccccccggccccatcggcctgcagggcctgcccggccccagcggcgagaagggcgagaccggcgacgtgggccccatgggcccccccggcccccccggccccagaggccccgccggccccaacggcgccgacggcccccagggcccccccggcggcgtgggcaacctgggcccccccggcgagaagggcgagcccggcgagagcggcagccccggcatccagggcgagcccggcgtgaagggccccagaggcgagagaggcgagaagggcgagagcggccagcccggcgagcccggcccccccggccccaagggccccaccggcgacgacggccccaagggcaaccccggccccgtgggcttccccggcgaccccggcccccccggcgagggcggccccagaggccaggacggcgccaagggcgacagaggcgaggacggcgagcccggccagcccggcagccccggccccaccggcgagaacggcccccccggccccctgggcaagagaggccccgccggcagccccggcagcgagggcagacagggcggcaagggcgccaagggcgaccccggcgccatcggcgcccccggcaagaccggccccgtgggccccgccggccccgccggcaagcccggccccgacggcctgagaggcctgcccggcagcgtgggccagcagggcagacccggcgccaccggccaggccggcccccccggccccgtgggcccccccggcctgcccggcctgagaggcgacgccggcgccaagggcgagaagggccaccccggcctgatcggcctgatcggcccccccggcgagcagggcgagaagggcgacagaggcctgcccggcccccagggcagccccggccagaagggcgagatgggcatccccggcgccagcggccccatcggccccggcggcccccccggcctgcccggccccgccggccccaagggcgccaagggcgccaccggccccggcggccccaagggcgagaagggcgtgcagggcccccccggccaccccggcccccccggcgaggtgatccagcccctgcccatccagatgcccaagaagaccagaagaagcgtggacggcagcagactgatgcaggaggacgaggccatccccaccggcggcgcccccggcagccccggcggcctggaggagatcttcggcagcctggacagcctgagagaggagatcgagcagatgagaagacccaccggcacccaggacagccccgccagaacctgccaggacctgaagctgtgccaccccgagctgcccgacggcgagtactgggtggaccccaaccagggctgcgccagagacgccttcagagtgttctgcaacttcaccgccggcggcgagacctgcgtgacccccagagacgacgtgacccagttcagctacgtggacagcgagggcagccccgtgggcgtggtgcagctgaccttcctgagactgctgagcgtgagcgcccaccaggacgtgagctacccctgcagcggcgccgccagagacggccccctgagactgagaggcgccaacgaggacgagctgagccccgagaccagcccctacgtgaaggagttcagagacggctgccagacccagcagggcagaaccgtgctggaggtgagaacccccgtgctggagcagctgcccgtgctggacgccagcttcagcgacctgggcgccccccccagaagaggcggcgtgctgctgggccccgtgtgcttcatgggctag

SEQ ID NO: 1860 - DNA, 921 bp, Homo sapiens; identical to SEQ ID NO: 1827

SEQ ID NO: 1861 - DNA, 5070 bp, Homo sapiens
atggagagatgcagcagatgccacagactgctgctgctgctgcccctggtgctgggcctgagcgccgcccccggctgggccggcgccccccccgtggacgtgctgagagccctgagattccccagcctgcccgacggcgtgagaagagccaagggcatctgccccgccgacgtggcctacagagtggccagacccgcccagctgagcgcccccaccagacagctgttccccggcggcttccccaaggacttcagcctgctgaccgtggtgagaaccagacccggcctgcaggcccccctgctgaccctgtacagcgcccagggcgtgagacagctgggcctggagctgggcagacccgtgagattcctgtacgaggaccagaccggcagaccccagccccccagccagcccgtgttcagaggcctgagcctggccgacggcaagtggcacagagtggccgtggccgtgaagggccagagcgtgaccctgatcgtggactgcaagaagagagtgaccagacccctgcccagaagcgccagacccgtgctggacacccacggcgtgatcatcttcggcgccagaatcctggacgaggaggtgttcgagggcgacgtgcaggagctggccatcgtgcccggcgtgcaggccgcctacgagagctgcgagcagaaggagctggagtgcgagggcggccagagagagagaccccagaaccagcagccccacagagcccagagaagcccccagcagcagcccagcagactgcacagaccccagaaccaggagccccagagccaggagcagaccgacctgcaggtgccccccaccgccgacagattccaggccgaggagtacggcgagggcggcaccgacccccccgagggcccctacgactacacctacggctacggcgacgactacagagaggagaccgagctgggccccgccctgagcgccgagaccgcccacagcggcgccgccgcccacggccccagaggcctgaagggcgagaagggcgagcccgccgtgctggagcccggcatgctggtggagggcccccccggccccgagggccccgccggcctgatcggcccccccggcatccagggcaaccccggccccgtgggcgaccccggcgagagaggcccccccggcagagccggcctgcccggcagcgacggcgcccccggcccccccggcaccagcctgatgctgcccttcagattcggcagcggcggcggcgacaagggccccgtggtggccgcccaggaggcccaggcccaggccatcctgcagcaggccagactggccctgagaggcccccccggccccatgggctacaccggcagacccggccccctgggccagcccggcagccccggcctgaagggcgagagcggcgacctgggcccccagggccccagaggcccccagggcctgaccggcccccccggcaaggccggcagaagaggcagagccggcgccgacggcgccagaggcatgcccggcgaccccggcgtgaagggcgacagaggcttcgacggcctgcccggcctgcccggcgagaagggccacagaggcgacaccggcgcccagggcctgcccggcccccccggcgaggacggcgagagaggcgacgacggcgagatcggccccagaggcctgcccggcgagagcggccccagaggcctgctgggccccaagggcccccccggcatccccggcccccccggcgtgagaggcatggacggcccccagggccccaagggcagcctgggcccccagggcgagcccggcccccccggccagcagggcacccccggcacccagggcctgcccggcccccagggcgccatcggcccccacggcgagaagggcccccagggcaagcccggcctgcccggcatgcccggcagcgacggcccccccggccaccccggcaaggagggcccccccggcaccaagggcaaccagggccccagcggcccccagggccccctgggctaccccggccccagaggcgtgaagggcgtggacggcatcagaggcctgaagggccacaagggcgagaagggcgaggacggcttccccggcttcaagggcgacatcggcgtgaagggcgacagaggcgaggtgggcgtgcccggcagcagaggcgaggacggccccgagggccccaagggcagaaccggccccaccggcgaccccggcccccccggcctgatgggcgagaagggcaagctgggcgtgcccggcctgcccggctaccccggcagacagggccccaagggcagcctgggcttccccggcttccccggcgccagcggcgagaagggcgccagaggcctgagcggcaagagcggccccagaggcgagagaggccccaccggccccagaggccagagaggccccagaggcgccaccggcaagagcggcgccaagggcaccagcggcggcgacggcccccacggcccccccggcgagagaggcctgcccggcccccagggccccaacggcttccccggccccaagggccccctgggcccccccggcaaggacggcctgcccggccaccccggccagagaggcgaggtgggcttccagggcaagaccggcccccccggcccccccggcgtggtgggcccccagggcgccgccggcgagaccggccccatgggcgagagaggccaccccggcccccccggcccccccggcgagcagggcctgcccggcaccgccggcaaggagggcaccaagggcgaccccggcccccccggcgcccccggcaaggacggccccgccggcctgagaggcttccccggcgagagaggcctgcccggcaccgccggcggccccggcctgaagggcaacgagggccccagcggcccccccggccccgccggcagccccggcgagagaggcgccgccggcagcggcggccccatcggcccccccggcagacccggcccccagggcccccccggcgccgccggcgagaagggcgtgcccggcgagaagggccccatcggccccaccggcagagacggcgtgcagggccccgtgggcctgcccggccccgccggcccccccggcgtggccggcgaggacggcgacaagggcgaggtgggcgaccccggccagaagggcaccaagggcaacaagggcgagcacggcccccccggcccccccggccccatcggccccgtgggccagcccggcgccgccggcgccgacggcgagcccggcgccagaggcccccagggccacttcggcgccaagggcgacgagggcaccagaggcttcaacggcccccccggccccatcggcctgcagggcctgcccggccccagcggcgagaagggcgagaccggcgacgtgggccccatgggcccccccggcccccccggccccagaggccccgccggccccaacggcgccgacggcccccagggcccccccggcggcgtgggcaacctgggcccccccggcgagaagggcgagcccggcgagagcggcagccccggcatccagggcgagcccggcgtgaagggccccagaggcgagagaggcgagaagggcgagagcggccagcccggcgagcccggcccccccggccccaagggccccaccggcgacgacggccccaagggcaaccccggccccgtgggcttccccggcgaccccggcccccccggcgagggcggccccagaggccaggacggcgccaagggcgacagaggcgaggacggcgagcccggccagcccggcagccccggccccaccggcgagaacggcccccccggccccctgggcaagagaggccccgccggcagccccggcagcgagggcagacagggcggcaagggcgccaagggcgaccccggcgccatcggcgcccccggcaagaccggccccgtgggccccgccggccccgccggcaagcccggccccgacggcctgagaggcctgcccggcagcgtgggccagcagggcagacccggcgccaccggccaggccggcccccccggccccgtgggcccccccggcctgcccggcctgagaggcgacgccggcgccaagggcgagaagggccaccccggcctgatcggcctgatcggcccccccggcgagcagggcgagaagggcgacagaggcctgcccggcccccagggcagccccggccagaagggcgagatgggcatccccggcgccagcggccccatcggccccggcggcccccccggcctgcccggccccgccggccccaagggcgccaagggcgccaccggccccggcggccccaagggcgagaagggcgtgcagggcccccccggccaccccggcccccccggcgaggtgatccagcccctgcccatccagatgcccaagaagaccagaagaagcgtggacggcagcagactgatgcaggaggacgaggccatccccaccggcggcgcccccggcagccccggcggcctggaggagatcttcggcagcctggacagcctgagagaggagatcgagcagatgagaagacccaccggcacccaggacagccccgccagaacctgccaggacctgaagctgtgccaccccgagctgcccgacggcgagtactgggtggaccccaaccagggctgcgccagagacgccttcagagtgttctgcaacttcaccgccggcggcgagacctgcgtgacccccagagacgacgtgacccagttcagctacgtggacagcgagggcagccccgtgggcgtggtgcagctgaccttcctgagactgctgagcgtgagcgcccaccaggacgtgagctacccctgcagcggcgccgccagagacggccccctgagactgagaggcgccaacgaggacgagctgagccccgagaccagcccctacgtgaaggagttcagagacggctgccagacccagcagggcagaaccgtgctggaggtgagaacccccgtgctggagcagctgcccgtgctggacgccagcttcagcgacctgggcgccccccccagaagaggcggcgtgctgctgggccccgtgtgcttcatgggctag

SEQ ID NO: 1862 - DNA, 4890 bp, Homo sapiens; identical to SEQ ID NO: 1818

SEQ ID NO: 1863 - DNA, 5211 bp, Homo sapiens
atggagagatgcagcagatgccacagactgctgctgctgctgcccctggtgctgggcctgagcgccgcccccggctgggccggcgccccccccgtggacgtgctgagagccctgagattccccagcctgcccgacggcgtgagaagagccaagggcatctgccccgccgacgtggcctacagagtggccagacccgcccagctgagcgcccccaccagacagctgttccccggcggcttccccaaggacttcagcctgctgaccgtggtgagaaccagacccggcctgcaggcccccctgctgaccctgtacagcgcccagggcgtgagacagctgggcctggagctgggcagacccgtgagattcctgtacgaggaccagaccggcagaccccagccccccagccagcccgtgttcagaggcctgagcctggccgacggcaagtggcacagagtggccgtggccgtgaagggccagagcgtgaccctgatcgtggactgcaagaagagagtgaccagacccctgcccagaagcgccagacccgtgctggacacccacggcgtgatcatcttcggcgccagaatcctggacgaggaggtgttcgagggcgacgtgcaggagctggccatcgtgcccggcgtgcaggccgcctacgagagctgcgagcagaaggagctggagtgcgagggcggccagagagagagaccccagaaccagcagccccacagagcccagagaagcccccagcagcagcccagcagactgcacagaccccagaaccaggagccccagagccagcccaccgagagcctgtactacgactacgagcccccctactacgacgtgatgaccaccggcaccacccccgactaccaggaccccacccccggcgaggaggaggagatcctggagagcagcctgctgccccccctggaggaggagcagaccgacctgcaggtgccccccaccgccgacagattccaggccgaggagtacggcgagggcggcaccgacccccccgagggcccctacgactacacctacggctacggcgacgactacagagaggagaccgagctgggccccgccctgagcgccgagaccgcccacagcggcgccgccgcccacggccccagaggcctgaagggcgagaagggcgagcccgccgtgctggagcccggcatgctggtggagggcccccccggccccgagggccccgccggcctgatcggcccccccggcatccagggcaaccccggccccgtgggcgaccccggcgagagaggcccccccggcagagccggcctgcccggcagcgacggcgcccccggcccccccggcaccagcctgatgctgcccttcagattcggcagcggcggcggcgacaagggccccgtggtggccgcccaggaggcccaggcccaggccatcctgcagcaggccagactggccctgagaggcccccccggccccatgggctacaccggcagacccggccccctgggccagcccggcagccccggcctgaagggcgagagcggcgacctgggcccccagggccccagaggcccccagggcctgaccggcccccccggcaaggccggcagaagaggcagagccggcgccgacggcgccagaggcatgcccggcgaccccggcgtgaagggcgacagaggcttcgacggcctgcccggcctgcccggcgagaagggccacagaggcgacaccggcgcccagggcctgcccggcccccccggcgaggacggcgagagaggcgacgacggcgagatcggccccagaggcctgcccggcgagagcggccccagaggcctgctgggccccaagggcccccccggcatccccggcccccccggcgtgagaggcatggacggcccccagggccccaagggcagcctgggcccccagggcgagcccggcccccccggccagcagggcacccccggcacccagggcctgcccggcccccagggcgccatcggcccccacggcgagaagggcccccagggcaagcccggcctgcccggcatgcccggcagcgacggcccccccggccaccccggcaaggagggcccccccggcaccaagggcaaccagggccccagcggcccccagggccccctgggctaccccggccccagaggcgtgaagggcgtggacggcatcagaggcctgaagggccacaagggcgagaagggcgaggacggcttccccggcttcaagggcgacatcggcgtgaagggcgacagaggcgaggtgggcgtgcccggcagcagaggcgaggacggccccgagggccccaagggcagaaccggccccaccggcgaccccggcccccccggcctgatgggcgagaagggcaagctgggcgtgcccggcctgcccggctaccccggcagacagggccccaagggcagcctgggcttccccggcttccccggcgccagcggcgagaagggcgccagaggcctgagcggcaagagcggccccagaggcgagagaggccccaccggccccagaggccagagaggccccagaggcgccaccggcaagagcggcgccaagggcaccagcggcggcgacggcccccacggcccccccggcgagagaggcctgcccggcccccagggccccaacggcttccccggccccaagggccccctgggcccccccggcaaggacggcctgcccggccaccccggccagagaggcgaggtgggcttccagggcaagaccggcccccccggcccccccggcgtggtgggcccccagggcgccgccggcgagaccggccccatgggcgagagaggccaccccggcccccccggcccccccggcgagcagggcctgcccggcaccgccggcaaggagggcaccaagggcgaccccggcccccccggcgcccccggcaaggacggccccgccggcctgagaggcttccccggcgagagaggcctgcccggcaccgccggcggccccggcctgaagggcaacgagggccccagcggcccccccggccccgccggcagccccggcgagagaggcgccgccggcagcggcggccccatcggcccccccggcagacccggcccccagggcccccccggcgccgccggcgagaagggcgtgcccggcgagaagggccccatcggccccaccggcagagacggcgtgcagggccccgtgggcctgcccggccccgccggcccccccggcgtggccggcgaggacggcgacaagggcgaggtgggcgaccccggccagaagggcaccaagggcaacaagggcgagcacggcccccccggcccccccggccccatcggccccgtgggccagcccggcgccgccggcgccgacggcgagcccggcgccagaggcccccagggccacttcggcgccaagggcgacgagggcaccagaggcttcaacggcccccccggccccatcggcctgcagggcctgcccggccccagcggcgagaagggcgagaccggcgacgtgggccccatgggcccccccggcccccccggccccagaggccccgccggccccaacggcgccgacggcccccagggcccccccggcggcgtgggcaacctgggcccccccggcgagaagggcgagcccggcgagagcggcagccccggcatccagggcgagcccggcgtgaagggccccagaggcgagagaggcgagaagggcgagagcggccagcccggcgagcccggcccccccggccccaagggccccaccggcgacgacggccccaagggcaaccccggccccgtgggcttccccggcgaccccggcccccccggcgagggcggccccagaggccaggacggcgccaagggcgacagaggcgaggacggcgagcccggccagcccggcagccccggccccaccggcgagaacggcccccccggccccctgggcaagagaggccccgccggcagccccggcagcgagggcagacagggcggcaagggcgccaagggcgaccccggcgccatcggcgcccccggcaagaccggccccgtgggccccgccggccccgccggcaagcccggccccgacggcctgagaggcctgcccggcagcgtgggccagcagggcagacccggcgccaccggccaggccggcccccccggccccgtgggcccccccggcctgcccggcctgagaggcgacgccggcgccaagggcgagaagggccaccccggcctgatcggcctgatcggcccccccggcgagcagggcgagaagggcgacagaggcctgcccggcccccagggcagccccggccagaagggcgagatgggcatccccggcgccagcggccccatcggccccggcggcccccccggcctgcccggccccgccggccccaagggcgccaagggcgccaccggccccggcggccccaagggcgagaagggcgtgcagggcccccccggccaccccggcccccccggcgaggtgatccagcccctgcccatccagatgcccaagaagaccagaagaagcgtggacggcagcagactgatgcaggaggacgaggccatccccaccggcggcgcccccggcagccccggcggcctggaggagatcttcggcagcctggacagcctgagagaggagatcgagcagatgagaagacccaccggcacccaggacagccccgccagaacctgccaggacctgaagctgtgccaccccgagctgcccgacggcgagtactgggtggaccccaaccagggctgcgccagagacgccttcagagtgttctgcaacttcaccgccggcggcgagacctgcgtgacccccagagacgacgtgacccagttcagctacgtggacagcgagggcagccccgtgggcgtggtgcagctgaccttcctgagactgctgagcgtgagcgcccaccaggacgtgagctacccctgcagcggcgccgccagagacggccccctgagactgagaggcgccaacgaggacgagctgagccccgagaccagcccctacgtgaaggagttcagagacggctgccagacccagcagggcagaaccgtgctggaggtgagaacccccgtgctggagcagctgcccgtgctggacgccagcttcagcgacctgggcgccccccccagaagaggcggcgtgctgctgggccccgtgtgcttcatgggctag

SEQ ID NO: 1864 - DNA, 5211 bp, Homo sapiens
atggagagatgcagcagatgccacagactgctgctgctgctgcccctggtgctgggcctgagcgccgcccccggctgggccggcgccccccccgtggacgtgctgagagccctgagattccccagcctgcccgacggcgtgagaagagccaagggcatctgccccgccgacgtggcctacagagtggccagacccgcccagctgagcgcccccaccagacagctgttccccggcggcttccccaaggacttcagcctgctgaccgtggtgagaaccagacccggcctgcaggcccccctgctgaccctgtacagcgcccagggcgtgagacagctgggcctggagctgggcagacccgtgagattcctgtacgaggaccagaccggcagaccccagccccccagccagcccgtgttcagaggcctgagcctggccgacggcaagtggcacagagtggccgtggccgtgaagggccagagcgtgaccctgatcgtggactgcaagaagagagtgaccagacccctgcccagaagcgccagacccgtgctggacacccacggcgtgatcatcttcggcgccagaatcctggacgaggaggtgttcgagggcgacgtgcaggagctggccatcgtgcccggcgtgcaggccgcctacgagagctgcgagcagaaggagctggagtgcgagggcggccagagagagagaccccagaaccagcagccccacagagcccagagaagcccccagcagcagcccagcagactgcacagaccccagaaccaggagccccagagccagcccaccgagagcctgtactacgactacaagcccccctactacgacgtgatgaccaccggcaccacccccgactaccaggaccccacccccggcgaggaggaggagatcctggagagcagcctgctgccccccctggaggaggagcagaccgacctgcaggtgccccccaccgccgacagattccaggccgaggagtacggcgagggcggcaccgacccccccgagggcccctacgactacacctacggctacggcgacgactacagagaggagaccgagctgggccccgccctgagcgccgagaccgcccacagcggcgccgccgcccacggccccagaggcctgaagggcgagaagggcgagcccgccgtgctggagcccggcatgctggtggagggcccccccggccccgagggccccgccggcctgatcggcccccccggcatccagggcaaccccggccccgtgggcgaccccggcgagagaggcccccccggcagagccggcctgcccggcagcgacggcgcccccggcccccccggcaccagcctgatgctgcccttcagattcggcagcggcggcggcgacaagggccccgtggtggccgcccaggaggcccaggcccaggccatcctgcagcaggccagactggccctgagaggcccccccggccccatgggctacaccggcagacccggccccctgggccagcccggcagccccggcctgaagggcgagagcggcgacctgggcccccagggccccagaggcccccagggcctgaccggcccccccggcaaggccggcagaagaggcagagccggcgccgacggcgccagaggcatgcccggcgaccccggcgtgaagggcgacagaggcttcgacggcctgcccggcctgcccggcgagaagggccacagaggcgacaccggcgcccagggcctgcccggcccccccggcgaggacggcgagagaggcgacgacggcgagatcggccccagaggcctgcccggcgagagcggccccagaggcctgctgggccccaagggcccccccggcatccccggcccccccggcgtgagaggcatggacggcccccagggccccaagggcagcctgggcccccagggcgagcccggcccccccggccagcagggcacccccggcacccagggcctgcccggcccccagggcgccatcggcccccacggcgagaagggcccccagggcaagcccggcctgcccggcatgcccggcagcgacggcccccccggccaccccggcaaggagggcccccccggcaccaagggcaaccagggccccagcggcccccagggccccctgggctaccccggccccagaggcgtgaagggcgtggacggcatcagaggcctgaagggccacaagggcgagaagggcgaggacggcttccccggcttcaagggcgacatcggcgtgaagggcgacagaggcgaggtgggcgtgcccggcagcagaggcgaggacggccccgagggccccaagggcagaaccggccccaccggcgaccccggcccccccggcctgatgggcgagaagggcaagctgggcgtgcccggcctgcccggctaccccggcagacagggccccaagggcagcctgggcttccccggcttccccggcgccagcggcgagaagggcgccagaggcctgagcggcaagagcggccccagaggcgagagaggccccaccggccccagaggccagagaggccccagaggcgccaccggcaagagcggcgccaagggcaccagcggcggcgacggcccccacggcccccccggcgagagaggcctgcccggcccccagggccccaacggcttccccggccccaagggcccccccggcccccccggcaaggacggcctgcccggccaccccggccagagaggcgaggtgggcttccagggcaagaccggcccccccggcccccccggcgtggtgggcccccagggcgccgccggcgagaccggccccatgggcgagagaggccaccccggcccccccggcccccccggcgagcagggcctgcccggcaccgccggcaaggagggcaccaagggcgaccccggcccccccggcgcccccggcaaggacggccccgccggcctgagaggcttccccggcgagagaggcctgcccggcaccgccggcggccccggcctgaagggcaacgagggccccagcggcccccccggccccgccggcagccccggcgagagaggcgccgccggcagcggcggccccatcggcccccccggcagacccggcccccagggcccccccggcgccgccggcgagaagggcgtgcccggcgagaagggccccatcggccccaccggcagagacggcgtgcagggccccgtgggcctgcccggccccgccggcccccccggcgtggccggcgaggacggcgacaagggcgaggtgggcgaccccggccagaagggcaccaagggcaacaagggcgagcacggcccccccggcccccccggccccatcggccccgtgggccagcccggcgccgccggcgccgacggcgagcccggcgccagaggcccccagggccacttcggcgccaagggcgacgagggcaccagaggcttcaacggcccccccggccccatcggcctgcagggcctgcccggccccagcggcgagaagggcgagaccggcgacgtgggccccatgggcccccccggcccccccggccccagaggccccgccggccccaacggcgccgacggcccccagggcccccccggcggcgtgggcaacctgggcccccccggcgagaagggcgagcccggcgagagcggcagccccggcatccagggcgagcccggcgtgaagggccccagaggcgagagaggcgagaagggcgagagcggccagcccggcgagcccggcccccccggccccaagggccccaccggcgacgacggccccaagggcaaccccggccccgtgggcttccccggcgaccccggcccccccggcgagggcggccccagaggccaggacggcgccaagggcgacagaggcgaggacggcgagcccggccagcccggcagccccggccccaccggcgagaacggcccccccggccccctgggcaagagaggccccgccggcagccccggcagcgagggcagacagggcggcaagggcgccaagggcgaccccggcgccatcggcgcccccggcaagaccggccccgtgggccccgccggccccgccggcaagcccggccccgacggcctgagaggcctgcccggcagcgtgggccagcagggcagacccggcgccaccggccaggccggcccccccggccccgtgggcccccccggcctgcccggcctgagaggcgacgccggcgccaagggcgagaagggccaccccggcctgatcggcctgatcggcccccccggcgagcagggcgagaagggcgacagaggcctgcccggcccccagggcagccccggccagaagggcgagatgggcatccccggcgccagcggccccatcggccccggcggcccccccggcctgcccggccccgccggccccaagggcgccaagggcgccaccggccccggcggccccaagggcgagaagggcgtgcagggcccccccggccaccccggcccccccggcgaggtgatccagcccctgcccatccagatgcccaagaagaccagaagaagcgtggacggcagcagactgatgcaggaggacgaggccatccccaccggcggcgcccccggcagccccggcggcctggaggagatcttcggcagcctggacagcctgagagaggagatcgagcagatgagaagacccaccggcacccaggacagccccgccagaacctgccaggacctgaagctgtgccaccccgagctgcccgacggcgagtactgggtggaccccaaccagggctgcgccagagacgccttcagagtgttctgcaacttcaccgccggcggcgagacctgcgtgacccccagagacgacgtgacccagttcagctacgtggacagcgagggcagccccgtgggcgtggtgcagctgaccttcctgagactgctgagcgtgagcgcccaccaggacgtgagctacccctgcagcggcgccgccagagacggccccctgagactgagaggcgccaacgaggacgagctgagccccgagaccagcccctacgtgaaggagttcagagacggctgccagacccagcagggcagaaccgtgctggaggtgagaacccccgtgctggagcagctgcccgtgctggacgccagcttcagcgacctgggcgccccccccagaagaggcggcgtgctgctgggccccgtgtgcttcatgggctag

SEQ ID NO: 1865 - DNA, 5211 bp, Homo sapiens; identical to SEQ ID NO: 1864

SEQ ID NO: 1866 - DNA, 5070 bp, Homo sapiens; identical to SEQ ID NO: 1821

SEQ ID NO: 1867 - DNA, 921 bp, Homo sapiens; identical to SEQ ID NO: 1827

SEQ ID NO: 1868 - DNA, 5133 bp, Homo sapiens
atggagagatgcagcagatgccacagactgctgctgctgctgcccctggtgctgggcctgagcgccgcccccggctgggccggcgccccccccgtggacgtgctgagagccctgagattccccagcctgcccgacggcgtgagaagagccaagggcatctgccccgccgacgtggcctacagagtggccagacccgcccagctgagcgcccccaccagacagctgttccccggcggcttccccaaggacttcagcctgctgaccgtggtgagaaccagacccggcctgcaggcccccctgctgaccctgtacagcgcccagggcgtgagacagctgggcctggagctgggcagacccgtgagattcctgtacgaggaccagaccggcagaccccagccccccagccagcccgtgttcagaggcctgagcctggccgacggcaagtggcacagagtggccgtggccgtgaagggccagagcgtgaccctgatcgtggactgcaagaagagagtgaccagacccctgcccagaagcgccagacccgtgctggacacccacggcgtgatcatcttcggcgccagaatcctggacgaggaggtgttcgagggcgacgtgcaggagctggccatcgtgcccggcgtgcaggccgcctacgagagctgcgagcagaaggagctggagtgcgagggcggccagagagagagaccccagaaccagcagccccacagagcccagagaagcccccagcagcagcccagcagactgcacagaccccagaaccaggagccccagagccaggaccccacccccggcgaggaggaggagatcctggagagcagcctgctgccccccctggaggaggagcagaccgacctgcaggtgccccccaccgccgacagattccaggccgaggagtacggcgagggcggcaccgacccccccgagggcccctacgactacacctacggctacggcgacgactacagagaggagaccgagctgggccccgccctgagcgccgagaccgcccacagcggcgccgccgcccacggccccagaggcctgaagggcgagaagggcgagcccgccgtgctggagcccggcatgctggtggagggcccccccggccccgagggccccgccggcctgatcggcccccccggcatccagggcaaccccggccccgtgggcgaccccggcgagagaggcccccccggcagagccggcctgcccggcagcgacggcgcccccggcccccccggcaccagcctgatgctgcccttcagattcggcagcggcggcggcgacaagggccccgtggtggccgcccaggaggcccaggcccaggccatcctgcagcaggccagactggccctgagaggcccccccggccccatgggctacaccggcagacccggccccctgggccagcccggcagccccggcctgaagggcgagagcggcgacctgggcccccagggccccagaggcccccagggcctgaccggcccccccggcaaggccggcagaagaggcagagccggcgccgacggcgccagaggcatgcccggcgaccccggcgtgaagggcgacagaggcttcgacggcctgcccggcctgcccggcgagaagggccacagaggcgacaccggcgcccagggcctgcccggcccccccggcgaggacggcgagagaggcgacgacggcgagatcggccccagaggcctgcccggcgagagcggccccagaggcctgctgggccccaagggcccccccggcatccccggcccccccggcgtgagaggcatggacggcccccagggccccaagggcagcctgggcccccagggcgagcccggcccccccggccagcagggcacccccggcacccagggcctgcccggcccccagggcgccatcggcccccacggcgagaagggcccccagggcaagcccggcctgcccggcatgcccggcagcgacggcccccccggccaccccggcaaggagggcccccccggcaccaagggcaaccagggccccagcggcccccagggccccctgggctaccccggccccagaggcgtgaagggcgtggacggcatcagaggcctgaagggccacaagggcgagaagggcgaggacggcttccccggcttcaagggcgacatcggcgtgaagggcgacagaggcgaggtgggcgtgcccggcagcagaggcgaggacggccccgagggccccaagggcagaaccggccccaccggcgaccccggcccccccggcctgatgggcgagaagggcaagctgggcgtgcccggcctgcccggctaccccggcagacagggccccaagggcagcctgggcttccccggcttccccggcgccagcggcgagaagggcgccagaggcctgagcggcaagagcggccccagaggcgagagaggccccaccggccccagaggccagagaggccccagaggcgccaccggcaagagcggcgccaagggcaccagcggcggcgacggcccccacggcccccccggcgagagaggcctgcccggcccccagggccccaacggcttccccggccccaagggccccctgggcccccccggcaaggacggcctgcccggccaccccggccagagaggcgaggtgggcttccagggcaagaccggcccccccggcccccccggcgtggtgggcccccagggcgccgccggcgagaccggccccatgggcgagagaggccaccccggcccccccggcccccccggcgagcagggcctgcccggcaccgccggcaaggagggcaccaagggcgaccccggcccccccggcgcccccggcaaggacggccccgccggcctgagaggcttccccggcgagagaggcctgcccggcaccgccggcggccccggcctgaagggcaacgagggccccagcggcccccccggccccgccggcagccccggcgagagaggcgccgccggcagcggcggccccatcggcccccccggcagacccggcccccagggcccccccggcgccgccggcgagaagggcgtgcccggcgagaagggccccatcggccccaccggcagagacggcgtgcagggccccgtgggcctgcccggccccgccggcccccccggcgtggccggcgaggacggcgacaagggcgaggtgggcgaccccggccagaagggcaccaagggcaacaagggcgagcacggcccccccggcccccccggccccatcggccccgtgggccagcccggcgccgccggcgccgacggcgagcccggcgccagaggcccccagggccacttcggcgccaagggcgacgagggcaccagaggcttcaacggcccccccggccccatcggcctgcagggcctgcccggccccagcggcgagaagggcgagaccggcgacgtgggccccatgggcccccccggcccccccggccccagaggccccgccggccccaacggcgccgacggcccccagggcccccccggcggcgtgggcaacctgggcccccccggcgagaagggcgagcccggcgagagcggcagccccggcatccagggcgagcccggcgtgaagggccccagaggcgagagaggcgagaagggcgagagcggccagcccggcgagcccggcccccccggccccaagggccccaccggcgacgacggccccaagggcaaccccggccccgtgggcttccccggcgaccccggcccccccggcgagggcggccccagaggccaggacggcgccaagggcgacagaggcgaggacggcgagcccggccagcccggcagccccggccccaccggcgagaacggcccccccggccccctgggcaagagaggccccgccggcagccccggcagcgagggcagacagggcggcaagggcgccaagggcgaccccggcgccatcggcgcccccggcaagaccggccccgtgggccccgccggccccgccggcaagcccggccccgacggcctgagaggcctgcccggcagcgtgggccagcagggcagacccggcgccaccggccaggccggcccccccggccccgtgggcccccccggcctgcccggcctgagaggcgacgccggcgccaagggcgagaagggccaccccggcctgatcggcctgatcggcccccccggcgagcagggcgagaagggcgacagaggcctgcccggcccccagggcagccccggccagaagggcgagatgggcatccccggcgccagcggccccatcggccccggcggcccccccggcctgcccggccccgccggccccaagggcgccaagggcgccaccggccccggcggccccaagggcgagaagggcgtgcagggcccccccggccaccccggcccccccggcgaggtgatccagcccctgcccatccagatgcccaagaagaccagaagaagcgtggacggcagcagactgatgcaggaggacgaggccatccccaccggcggcgcccccggcagccccggcggcctggaggagatcttcggcagcctggacagcctgagagaggagatcgagcagatgagaagacccaccggcacccaggacagccccgccagaacctgccaggacctgaagctgtgccaccccgagctgcccgacggcgagtactgggtggaccccaaccagggctgcgccagagacgccttcagagtgttctgcaacttcaccgccggcggcgagacctgcgtgacccccagagacgacgtgacccagttcagctacgtggacagcgagggcagccccgtgggcgtggtgcagctgaccttcctgagactgctgagcgtgagcgcccaccaggacgtgagctacccctgcagcggcgccgccagagacggccccctgagactgagaggcgccaacgaggacgagctgagccccgagaccagcccctacgtgaaggagttcagagacggctgccagacccagcagggcagaaccgtgctggaggtgagaacccccgtgctggagcagctgcccgtgctggacgccagcttcagcgacctgggcgccccccccagaagaggcggcgtgctgctgggccccgtgtgcttcatgggctag

SEQ ID NO: 1869 - DNA, 5070 bp, Homo sapiens; identical to SEQ ID NO: 1821

SEQ ID NO: 1870 - DNA, 4890 bp, Homo sapiens; identical to SEQ ID NO: 1818

SEQ ID NO: 1871 - DNA, 921 bp, Homo sapiens; identical to SEQ ID NO: 1827

SEQ ID NO: 1872 - DNA, 4968 bp, Homo sapiens
atggagagatgcagcagatgccacagactgctgctgctgctgcccctggtgctgggcctgagcgccgcccccggctgggccggcgccccccccgtggacgtgctgagagccctgagattccccagcctgcccgacggcgtgagaagagccaagggcatctgccccgccgacgtggcctacagagtggccagacccgcccagctgagcgcccccaccagacagctgttccccggcggcttccccaaggacttcagcctgctgaccgtggtgagaaccagacccggcctgcaggcccccctgctgaccctgtacagcgcccagggcgtgagacagctgggcctggagctgggcccccccgtgagattcctgtacgaggaccagaccggcagaccccagccccccagccagcccgtgttcagaggcctgagcctggccgacggcaagtggcacagagtggccgtggccgtgaagggccagagcgtgaccctgatcgtggactgcaagaagagagtgaccagacccctgcccagaagcgccagacccgtgctggacacccacggcgtgatcatcttcggcgccagaatcctggacgaggaggtgttcgagggcgacgtgcaggagctggccatcgtgcccggcgtgcaggccgcctacgagagctgcgagcagaaggagctggagtgcgagggcggccagagagagagaccccagaaccagcagccccacagagcccagagaagcccccagcagcagcccagcagactgcacagaccccagaaccaggagccccagagccagcccaccgagagcctgtactacgactacaagcccccctactacgacgtgatgaccaccggcaccacccccgactaccaggccgcccacggccccagaggcctgaagggcgagaagggcgagcccgccgtgctggagcccggcatgctggtggagggcccccccggccccgagggccccgccggcctgatcggcccccccggcatccagggcaaccccggccccgtgggcgaccccggcgagagaggcccccccggcagagccggcctgcccggcagcgacggcgcccccggcccccccggcaccagcctgatgctgcccttcagattcggcagcggcggcggcgacaagggccccgtggtggccgcccaggaggcccaggcccaggccatcctgcagcaggccagactggccctgagaggcccccccggccccatgggctacaccggcagacccggccccctgggccagcccggcagccccggcctgaagggcgagagcggcgacctgggcccccagggccccagaggcccccagggcctgaccggcccccccggcaaggccggcagaagaggcagagccggcgccgacggcgccagaggcatgcccggcgaccccggcgtgaagggcgacagaggcttcgacggcctgcccggcctgcccggcgagaagggccacagaggcgacaccggcgcccagggcctgcccggcccccccggcgaggacggcgagagaggcgacgacggcgagatcggccccagaggcctgcccggcgagagcggccccagaggcctgctgggccccaagggcccccccggcatccccggcccccccggcgtgagaggcatggacggcccccagggccccaagggcagcctgggcccccagggcgagcccggcccccccggccagcagggcacccccggcacccagggcctgcccggcccccagggcgccatcggcccccacggcgagaagggcccccagggcaagcccggcctgcccggcatgcccggcagcgacggcccccccggccaccccggcaaggagggcccccccggcaccaagggcaaccagggccccagcggcccccagggccccctgggctaccccggccccagaggcgtgaagggcgtggacggcatcagaggcctgaagggccacaagggcgagaagggcgaggacggcttccccggcttcaagggcgacatcggcgtgaagggcgacagaggcgaggtgggcgtgcccggcagcagaggcgaggacggccccgagggccccaagggcagaaccggccccaccggcgaccccggcccccccggcctgatgggcgagaagggcaagctgggcgtgcccggcctgcccggctaccccggcagacagggccccaagggcagcctgggcttccccggcttccccggcgccagcggcgagaagggcgccagaggcctgagcggcaagagcggccccagaggcgagagaggccccaccggccccagaggccagagaggccccagaggcgccaccggcaagagcggcgccaagggcaccagcggcggcgacggcccccacggcccccccggcgagagaggcctgcccggcccccagggccccaacggcttccccggccccaagggcccccccggcccccccggcaaggacggcctgcccggccaccccggccagagaggcgaggtgggcttccagggcaagaccggcccccccggcccccccggcgtggtgggcccccagggcgccgccggcgagaccggccccatgggcgagagaggccaccccggcccccccggcccccccggcgagcagggcctgcccggcaccgccggcaaggagggcaccaagggcgaccccggcccccccggcgcccccggcaaggacggccccgccggcctgagaggcttccccggcgagagaggcctgcccggcaccgccggcggccccggcctgaagggcaacgagggccccagcggcccccccggccccgccggcagccccggcgagagaggcgccgccggcagcggcggccccatcggcccccccggcagacccggcccccagggcccccccggcgccgccggcgagaagggcgtgcccggcgagaagggccccatcggccccaccggcagagacggcgtgcagggccccgtgggcctgcccggccccgccggcccccccggcgtggccggcgaggacggcgacaagggcgaggtgggcgaccccggccagaagggcaccaagggcaacaagggcgagcacggcccccccggcccccccggccccatcggccccgtgggccagcccggcgccgccggcgccgacggcgagcccggcgccagaggcccccagggccacttcggcgccaagggcgacgagggcaccagaggcttcaacggcccccccggccccatcggcctgcagggcctgcccggccccagcggcgagaagggcgagaccggcgacgtgggccccatgggcccccccggcccccccggccccagaggccccgccggccccaacggcgccgacggcccccagggcccccccggcggcgtgggcaacctgggcccccccggcgagaagggcgagcccggcgagagcggcagccccggcatccagggcgagcccggcgtgaagggccccagaggcgagagaggcgagaagggcgagagcggccagcccggcgagcccggcccccccggccccaagggccccaccggcgacgacggccccaagggcaaccccggccccgtgggcttccccggcgaccccggcccccccggcgagggcggccccagaggccaggacggcgccaagggcgacagaggcgaggacggcgagcccggccagcccggcagccccggccccaccggcgagaacggcccccccggccccctgggcaagagaggccccgccggcagccccggcagcgagggcagacagggcggcaagggcgccaagggcgaccccggcgccatcggcgcccccggcaagaccggccccgtgggccccgccggccccgccggcaagcccggccccgacggcctgagaggcctgcccggcagcgtgggccagcagggcagacccggcgccaccggccaggccggcccccccggccccgtgggcccccccggcctgcccggcctgagaggcgacgccggcgccaagggcgagaagggccaccccggcctgatcggcctgatcggcccccccggcgagcagggcgagaagggcgacagaggcctgcccggcccccagggcagccccggccagaagggcgagatgggcatccccggcgccagcggccccatcggccccggcggcccccccggcctgcccggccccgccggccccaagggcgccaagggcgccaccggccccggcggccccaagggcgagaagggcgtgcagggcccccccggccaccccggcccccccggcgaggtgatccagcccctgcccatccagatgcccaagaagaccagaagaagcgtggacggcagcagactgatgcaggaggacgaggccatccccaccggcggcgcccccggcagccccggcggcctggaggagatcttcggcagcctggacagcctgagagaggagatcgagcagatgagaagacccaccggcacccaggacagccccgccagaacctgccaggacctgaagctgtgccaccccgagctgcccgacggcgagtactgggtggaccccaaccagggctgcgccagagacgccttcagagtgttctgcaacttcaccgccggcggcgagacctgcgtgacccccagagacgacgtgacccagttcagctacgtggacagcgagggcagccccgtgggcgtggtgcagctgaccttcctgagactgctgagcgtgagcgcccaccaggacgtgagctacccctgcagcggcgccgccagagacggccccctgagactgagaggcgccaacgaggacgagctgagccccgagaccagcccctacgtgaaggagttcagagacggctgccagacccagcagggcagaaccgtgctggaggtgagaacccccgtgctggagcagctgcccgtgctggacgccagcttcagcgacctgggcgccccccccagaagaggcggcgtgctgctgggccccgtgtgcttcatgggctag

SEQ ID NO: 1873 - DNA, 5211 bp, Homo sapiens
atggagagatgcagcagatgccacagactgctgctgctgctgcccctggtgctgggcctgagcgccgcccccggctgggccggcgccccccccgtggacgtgctgagagccctgagattccccagcctgcccgacggcgtgagaagagccaagggcatctgccccgccgacgtggcctacagagtggccagacccgcccagctgagcgcccccaccagacagctgttccccggcggcttccccaaggacttcagcctgctgaccgtggtgagaaccagacccggcctgcaggcccccctgctgaccctgtacagcgcccagggcgtgagacagctgggcctggagctgggcccccccgtgagattcctgtacgaggaccagaccggcagaccccagccccccagccagcccgtgttcagaggcctgagcctggccgacggcaagtggcacagagtggccgtggccgtgaagggccagagcgtgaccctgatcgtggactgcaagaagagagtgaccagacccctgcccagaagcgccagacccgtgctggacacccacggcgtgatcatcttcggcgccagaatcctggacgaggaggtgttcgagggcgacgtgcaggagctggccatcgtgcccggcgtgcaggccgcctacgagagctgcgagcagaaggagctggagtgcgagggcggccagagagagagaccccagaaccagcagccccacagagcccagagaagcccccagcagcagcccagcagactgcacagaccccagaaccaggagccccagagccagcccaccgagagcctgtactacgactacaagcccccctactacgacgtgatgaccaccggcaccacccccgactaccaggaccccacccccggcgaggaggaggagatcctggagagcagcctgctgccccccctggaggaggagcagaccgacctgcaggtgccccccaccgccgacagattccaggccgaggagtacggcgagggcggcaccgacccccccgagggcccctacgactacacctacggctacggcgacgactacagagaggagaccgagctgggccccgccctgagcgccgagaccgcccacagcggcgccgccgcccacggccccagaggcctgaagggcgagaagggcgagcccgccgtgctggagcccggcatgctggtggagggcccccccggccccgagggccccgccggcctgatcggcccccccggcatccagggcaaccccggccccgtgggcgaccccggcgagagaggcccccccggcagagccggcctgcccggcagcgacggcgcccccggcccccccggcaccagcctgatgctgcccttcagattcggcagcggcggcggcgacaagggccccgtggtggccgcccaggaggcccaggcccaggccatcctgcagcaggccagactggccctgagaggcccccccggccccatgggctacaccggcagacccggccccctgggccagcccggcagccccggcctgaagggcgagagcggcgacctgggcccccagggccccagaggcccccagggcctgaccggcccccccggcaaggccggcagaagaggcagagccggcgccgacggcgccagaggcatgcccggcgaccccggcgtgaagggcgacagaggcttcgacggcctgcccggcctgcccggcgagaagggccacagaggcgacaccggcgcccagggcctgcccggcccccccggcgaggacggcgagagaggcgacgacggcgagatcggccccagaggcctgcccggcgagagcggccccagaggcctgctgggccccaagggcccccccggcatccccggcccccccggcgtgagaggcatggacggcccccagggccccaagggcagcctgggcccccagggcgagcccggcccccccggccagcagggcacccccggcacccagggcctgcccggcccccagggcgccatcggcccccacggcgagaagggcccccagggcaagcccggcctgcccggcatgcccggcagcgacggcccccccggccaccccggcaaggagggcccccccggcaccaagggcaaccagggccccagcggcccccagggccccctgggctaccccggccccagaggcgtgaagggcgtggacggcatcagaggcctgaagggccacaagggcgagaagggcgaggacggcttccccggcttcaagggcgacatcggcgtgaagggcgacagaggcgaggtgggcgtgcccggcagcagaggcgaggacggccccgagggccccaagggcagaaccggccccaccggcgaccccggcccccccggcctgatgggcgagaagggcaagctgggcgtgcccggcctgcccggctaccccggcagacagggccccaagggcagcctgggcttccccggcttccccggcgccagcggcgagaagggcgccagaggcctgagcggcaagagcggccccagaggcgagagaggccccaccggccccagaggccagagaggccccagaggcgccaccggcaagagcggcgccaagggcaccagcggcggcgacggcccccacggcccccccggcgagagaggcctgcccggcccccagggccccaacggcttccccggccccaagggcccccccggcccccccggcaaggacggcctgcccggccaccccggccagagaggcgaggtgggcttccagggcaagaccggcccccccggcccccccggcgtggtgggcccccagggcgccgccggcgagaccggccccatgggcgagagaggccaccccggcccccccggcccccccggcgagcagggcctgcccggcaccgccggcaaggagggcaccaagggcgaccccggcccccccggcgcccccggcaaggacggccccgccggcctgagaggcttccccggcgagagaggcctgcccggcaccgccggcggccccggcctgaagggcaacgagggccccagcggcccccccggccccgccggcagccccggcgagagaggcgccgccggcagcggcggccccatcggcccccccggcagacccggcccccagggcccccccggcgccgccggcgagaagggcgtgcccggcgagaagggccccatcggccccaccggcagagacggcgtgcagggccccgtgggcctgcccggccccgccggcccccccggcgtggccggcgaggacggcgacaagggcgaggtgggcgaccccggccagaagggcaccaagggcaacaagggcgagcacggcccccccggcccccccggccccatcggccccgtgggccagcccggcgccgccggcgccgacggcgagcccggcgccagaggcccccagggccacttcggcgccaagggcgacgagggcaccagaggcttcaacggcccccccggccccatcggcctgcagggcctgcccggccccagcggcgagaagggcgagaccggcgacgtgggccccatgggcccccccggcccccccggccccagaggccccgccggccccaacggcgccgacggcccccagggcccccccggcggcgtgggcaacctgggcccccccggcgagaagggcgagcccggcgagagcggcagccccggcatccagggcgagcccggcgtgaagggccccagaggcgagagaggcgagaagggcgagagcggccagcccggcgagcccggcccccccggccccaagggccccaccggcgacgacggccccaagggcaaccccggccccgtgggcttccccggcgaccccggcccccccggcgagggcggccccagaggccaggacggcgccaagggcgacagaggcgaggacggcgagcccggccagcccggcagccccggccccaccggcgagaacggcccccccggccccctgggcaagagaggccccgccggcagccccggcagcgagggcagacagggcggcaagggcgccaagggcgaccccggcgccatcggcgcccccggcaagaccggccccgtgggccccgccggccccgccggcaagcccggccccgacggcctgagaggcctgcccggcagcgtgggccagcagggcagacccggcgccaccggccaggccggcccccccggccccgtgggcccccccggcctgcccggcctgagaggcgacgccggcgccaagggcgagaagggccaccccggcctgatcggcctgatcggcccccccggcgagcagggcgagaagggcgacagaggcctgcccggcccccagggcagccccggccagaagggcgagatgggcatccccggcgccagcggccccatcggccccggcggcccccccggcctgcccggccccgccggccccaagggcgccaagggcgccaccggccccggcggccccaagggcgagaagggcgtgcagggcccccccggccaccccggcccccccggcgaggtgatccagcccctgcccatccagatgcccaagaagaccagaagaagcgtggacggcagcagactgatgcaggaggacgaggccatccccaccggcggcgcccccggcagccccggcggcctggaggagatcttcggcagcctggacagcctgagagaggagatcgagcagatgagaagacccaccggcacccaggacagccccgccagaacctgccaggacctgaagctgtgccaccccgagctgcccgacggcgagtactgggtggaccccaaccagggctgcgccagagacgccttcagagtgttctgcaacttcaccgccggcggcgagacctgcgtgacccccagagacgacgtgacccagttcagctacgtggacagcgagggcagccccgtgggcgtggtgcagctgaccttcctgagactgctgagcgtgagcgcccaccaggacgtgagctacccctgcagcggcgccgccagagacggccccctgagactgagaggcgccaacgaggacgagctgagccccgagaccagcccctacgtgaaggagttcagagacggctgccagacccagcagggcagaaccgtgctggaggtgagaacccccgtgctggagcagctgcccgtgctggacgccagcttcagcgacctgggcgccccccccagaagaggcggcgtgctgctgggccccgtgtgcttcatgggctag

SEQ ID NO: 1874 - DNA, 5148 bp, Homo sapiens; identical to SEQ ID NO: 1817

SEQ ID NO: 1875 - DNA, 4890 bp, Homo sapiens
atggagagatgcagcagatgccacagactgctgctgctgctgcccctggtgctgggcctgagcgccgcccccggctgggccggcgccccccccgtggacgtgctgagagccctgagattccccagcctgcccgacggcgtgagaagagccaagggcatctgccccgccgacgtggcctacagagtggccagacccgcccagctgagcgcccccaccagacagctgttccccggcggcttccccaaggacttcagcctgctgaccgtggtgagaaccagacccggcctgcaggcccccctgctgaccctgtacagcgcccagggcgtgagacagctgggcctggagctgggcagacccgtgagattcctgtacgaggaccagaccggcagaccccagccccccagccagcccgtgttcagaggcctgagcctggccgacggcaagtggcacagagtggccgtggccgtgaagggccagagcgtgaccctgatcgtggactgcaagaagagagtgaccagacccctgcccagaagcgccagacccgtgctggacacccacggcgtgatcatcttcggcgccagaatcctggacgaggaggtgttcgagggcgacgtgcaggagctggccatcgtgcccggcgtgcaggccgcctacgagagctgcgagcagaaggagctggagtgcgagggcggccagagagagagaccccagaaccagcagccccacagagcccagagaagcccccagcagcagcccagcagactgcacagaccccagaaccaggagccccagagccaggccgcccacggccccagaggcctgaagggcgagaagggcgagcccgccgtgctggagcccggcatgctggtggagggcccccccggccccgagggccccgccggcctgatcggcccccccggcatccagggcaaccccggccccgtgggcgaccccggcgagagaggcccccccggcagagccggcctgcccggcagcgacggcgcccccggcccccccggcaccagcctgatgctgcccttcagattcggcagcggcggcggcgacaagggccccgtggtggccgcccaggaggcccaggcccaggccatcctgcagcaggccagactggccctgagaggcccccccggccccatgggctacaccggcagacccggccccctgggccagcccggcagccccggcctgaagggcgagagcggcgacctgggcccccagggccccagaggcccccagggcctgaccggcccccccggcaaggccggcagaagaggcagagccggcgccgacggcgccagaggcatgcccggcgaccccggcgtgaagggcgacagaggcttcgacggcctgcccggcctgcccggcgagaagggccacagaggcgacaccggcgcccagggcctgcccggcccccccggcgaggacggcgagagaggcgacgacggcgagatcggccccagaggcctgcccggcgagagcggccccagaggcctgctgggccccaagggcccccccggcatccccggcccccccggcgtgagaggcatggacggcccccagggccccaagggcagcctgggcccccagggcgagcccggcccccccggccagcagggcacccccggcacccagggcctgcccggcccccagggcgccatcggcccccacggcgagaagggcccccagggcaagcccggcctgcccggcatgcccggcagcgacggcccccccggccaccccggcaaggagggcccccccggcaccaagggcaaccagggccccagcggcccccagggccccctgggctaccccggccccagaggcgtgaagggcgtggacggcatcagaggcctgaagggccacaagggcgagaagggcgaggacggcttccccggcttcaagggcgacatcggcgtgaagggcgacagaggcgaggtgggcgtgcccggcagcagaggcgaggacggccccgagggccccaagggcagaaccggccccaccggcgaccccggcccccccggcctgatgggcgagaagggcaagctgggcgtgcccggcctgcccggctaccccggcagacagggccccaagggcagcctgggcttccccggcttccccggcgccagcggcgagaagggcgccagaggcctgagcggcaagagcggccccagaggcgagagaggccccaccggccccagaggccagagaggccccagaggcgccaccggcaagagcggcgccaagggcaccagcggcggcgacggcccccacggcccccccggcgagagaggcctgcccggcccccagggccccaacggcttccccggccccaagggccccctgggcccccccggcaaggacggcctgcccggccaccccggccagagaggcgaggtgggcttccagggcaagaccggcccccccggcccccccggcgtggtgggcccccagggcgccgccggcgagaccggccccatgggcgagagaggccaccccggcccccccggcccccccggcgagcagggcctgcccggcaccgccggcaaggagggcaccaagggcgaccccggcccccccggcgcccccggcaaggacggccccgccggcctgagaggcttccccggcgagagaggcctgcccggcaccgccggcggccccggcctgaagggcaacgagggccccagcggcccccccggccccgccggcagccccggcgagagaggcgccgccggcagcggcggccccatcggcccccccggcagacccggcccccagggcccccccggcgccgccggcgagaagggcgtgcccggcgagaagggccccatcggccccaccggcagagacggcgtgcagggccccgtgggcctgcccggccccgccggcccccccggcgtggccggcgaggacggcgacaagggcgaggtgggcgaccccggccagaagggcaccaagggcaacaagggcgagcacggcccccccggcccccccggccccatcggccccgtgggccagcccggcgccgccggcgccgacggcgagcccggcgccagaggcccccagggccacttcggcgccaagggcgacgagggcaccagaggcttcaacggcccccccggccccatcggcctgcagggcctgcccggccccagcggcgagaagggcgagaccggcgacgtgggccccatgggcccccccggcccccccggccccagaggccccgccggccccaacggcgccgacggcccccagggcccccccggcggcgtgggcaacctgggcccccccggcgagaagggcgagcccggcgagagcggcagccccggcatccagggcgagcccggcgtgaagggccccagaggcgagagaggcgagaagggcgagagcggccagcccggcgagcccggcccccccggccccaagggccccaccggcgacgacggccccaagggcaaccccggccccgtgggcttccccggcgaccccggcccccccggcgagggcggccccagaggccaggacggcgccaagggcgacagaggcgaggacggcgagcccggccagcccggcagccccggccccaccggcgagaacggcccccccggccccctgggcaagagaggccccgccggcagccccggcagcgagggcagacagggcggcaagggcgccaagggcgaccccggcgccatcggcgcccccggcaagaccggccccgtgggccccgccggccccgccggcaagcccggccccgacggcctgagaggcctgcccggcagcgtgggccagcagggcagacccggcgccaccggccaggccggcccccccggccccgtgggcccccccggcctgcccggcctgagaggcgacgccggcgccaagggcgagaagggccaccccggcctgatcggcctgatcggcccccccggcgagcagggcgagaagggcgacagaggcctgcccggcccccagggcagccccggccagaagggcgagatgggcatccccggcgccagcggccccatcggccccggcggcccccccggcctgcccggccccgccggccccaagggcgccaagggcgccaccggccccggcggccccaagggcgagaagggcgtgcagggcccccccggccaccccggcccccccggcgaggtgatccagcccctgcccatccagatgcccaagaagaccagaagaagcgtggacggcagcagactgatgcaggaggacgaggccatccccaccggcggcgcccccggcagccccggcggcctggaggagatcttcggcagcctggacagcctgagagaggagatcgagcagatgagaagacccaccggcacccaggacagccccgccagaacctgccaggacctgaagctgtgccaccccgagctgcccgacggcgagtactgggtggaccccaaccagggctgcgccagagacgccttcagagtgttctgcaacttcaccgccggcggcgagacctgcgtgacccccagagacgacgtgacccagttcagctacgtggacagcgagggcagccccgtgggcgtggtgcagctgaccttcctgagactgctgagcgtgagcgcccaccaggacgtgagctacccctgcagcggcgccgccagagacggccccctgagactgagaggcgccaacgaggacgagctgagccccgagaccagcccctacgtgaaggagttcagagacggctgccagacccagcagggcagaaccgtgctggaggtgagaacccccgtgctggagcagctgcccgtgctggacgccagcttcagcgacctgggcgccccccccagaagaggcggcgtgctgctgggccccgtgtgcttcatgggctag

SEQ ID NO: 1876 - DNA, 921 bp, Homo sapiens; identical to SEQ ID NO: 1827

SEQ ID NO: 1877 - DNA, 4968 bp, Homo sapiens; identical to SEQ ID NO: 1820

SEQ ID NO: 1878 - DNA, 921 bp, Homo sapiens; identical to SEQ ID NO: 1827

SEQ ID NO: 1879 - DNA, 5211 bp, Homo sapiens; identical to SEQ ID NO: 1816

SEQ ID NO: 1880 - DNA, 921 bp, Homo sapiens; identical to SEQ ID NO: 1827

SEQ ID NO: 1881 - DNA, 5070 bp, Homo sapiens; identical to SEQ ID NO: 1821

SEQ ID NO: 1882 - DNA, 4890 bp, Homo sapiens
atggagagatgcagcagatgccacagactgctgctgctgctgcccctggtgctgggcctgagcgccgcccccggctgggccggcgccccccccgtggacgtgctgagagccctgagattccccagcctgcccgacggcgtgagaagagccaagggcatctgccccgccgacgtggcctacagagtggccagacccgcccagctgagcgcccccaccagacagctgttccccggcggcttccccaaggacttcagcctgctgaccgtggtgagaaccagacccggcctgcaggcccccctgctgaccctgtacagcgcccagggcgtgagacagctgggcctggagctgggcccccccgtgagattcctgtacgaggaccagaccggcagaccccagccccccagccagcccgtgttcagaggcctgagcctggccgacggcaagtggcacagagtggccgtggccgtgaagggccagagcgtgaccctgatcgtggactgcaagaagagagtgaccagacccctgcccagaagcgccagacccgtgctggacacccacggcgtgatcatcttcggcgccagaatcctggacgaggaggtgttcgagggcgacgtgcaggagctggccatcgtgcccggcgtgcaggccgcctacgagagctgcgagcagaaggagctggagtgcgagggcggccagagagagagaccccagaaccagcagccccacagagcccagagaagcccccagcagcagcccagcagactgcacagaccccagaaccaggagccccagagccaggccgcccacggccccagaggcctgaagggcgagaagggcgagcccgccgtgctggagcccggcatgctggtggagggcccccccggccccgagggccccgccggcctgatcggcccccccggcatccagggcaaccccggccccgtgggcgaccccggcgagagaggcccccccggcagagccggcctgcccggcagcgacggcgcccccggcccccccggcaccagcctgatgctgcccttcagattcggcagcggcggcggcgacaagggccccgtggtggccgcccaggaggcccaggcccaggccatcctgcagcaggccagactggccctgagaggcccccccggccccatgggctacaccggcagacccggccccctgggccagcccggcagccccggcctgaagggcgagagcggcgacctgggcccccagggccccagaggcccccagggcctgaccggcccccccggcaaggccggcagaagaggcagagccggcgccgacggcgccagaggcatgcccggcgaccccggcgtgaagggcgacagaggcttcgacggcctgcccggcctgcccggcgagaagggccacagaggcgacaccggcgcccagggcctgcccggcccccccggcgaggacggcgagagaggcgacgacggcgagatcggccccagaggcctgcccggcgagagcggccccagaggcctgctgggccccaagggcccccccggcatccccggcccccccggcgtgagaggcatggacggcccccagggccccaagggcagcctgggcccccagggcgagcccggcccccccggccagcagggcacccccggcacccagggcctgcccggcccccagggcgccatcggcccccacggcgagaagggcccccagggcaagcccggcctgcccggcatgcccggcagcgacggcccccccggccaccccggcaaggagggcccccccggcaccaagggcaaccagggccccagcggcccccagggccccctgggctaccccggccccagaggcgtgaagggcgtggacggcatcagaggcctgaagggccacaagggcgagaagggcgaggacggcttccccggcttcaagggcgacatcggcgtgaagggcgacagaggcgaggtgggcgtgcccggcagcagaggcgaggacggccccgagggccccaagggcagaaccggccccaccggcgaccccggcccccccggcctgatgggcgagaagggcaagctgggcgtgcccggcctgcccggctaccccggcagacagggccccaagggcagcctgggcttccccggcttccccggcgccagcggcgagaagggcgccagaggcctgagcggcaagagcggccccagaggcgagagaggccccaccggccccagaggccagagaggccccagaggcgccaccggcaagagcggcgccaagggcaccagcggcggcgacggcccccacggcccccccggcgagagaggcctgcccggcccccagggccccaacggcttccccggccccaagggcccccccggcccccccggcaaggacggcctgcccggccaccccggccagagaggcgaggtgggcttccagggcaagaccggcccccccggcccccccggcgtggtgggcccccagggcgccgccggcgagaccggccccatgggcgagagaggccaccccggcccccccggcccccccggcgagcagggcctgcccggcaccgccggcaaggagggcaccaagggcgaccccggcccccccggcgcccccggcaaggacggccccgccggcctgagaggcttccccggcgagagaggcctgcccggcaccgccggcggccccggcctgaagggcaacgagggccccagcggcccccccggccccgccggcagccccggcgagagaggcgccgccggcagcggcggccccatcggcccccccggcagacccggcccccagggcccccccggcgccgccggcgagaagggcgtgcccggcgagaagggccccatcggccccaccggcagagacggcgtgcagggccccgtgggcctgcccggccccgccggcccccccggcgtggccggcgaggacggcgacaagggcgaggtgggcgaccccggccagaagggcaccaagggcaacaagggcgagcacggcccccccggcccccccggccccatcggccccgtgggccagcccggcgccgccggcgccgacggcgagcccggcgccagaggcccccagggccacttcggcgccaagggcgacgagggcaccagaggcttcaacggcccccccggccccatcggcctgcagggcctgcccggccccagcggcgagaagggcgagaccggcgacgtgggccccatgggcccccccggcccccccggccccagaggccccgccggccccaacggcgccgacggcccccagggcccccccggcggcgtgggcaacctgggcccccccggcgagaagggcgagcccggcgagagcggcagccccggcatccagggcgagcccggcgtgaagggccccagaggcgagagaggcgagaagggcgagagcggccagcccggcgagcccggcccccccggccccaagggccccaccggcgacgacggccccaagggcaaccccggccccgtgggcttccccggcgaccccggcccccccggcgagggcggccccagaggccaggacggcgccaagggcgacagaggcgaggacggcgagcccggccagcccggcagccccggccccaccggcgagaacggcccccccggccccctgggcaagagaggccccgccggcagccccggcagcgagggcagacagggcggcaagggcgccaagggcgaccccggcgccatcggcgcccccggcaagaccggccccgtgggccccgccggccccgccggcaagcccggccccgacggcctgagaggcctgcccggcagcgtgggccagcagggcagacccggcgccaccggccaggccggcccccccggccccgtgggcccccccggcctgcccggcctgagaggcgacgccggcgccaagggcgagaagggccaccccggcctgatcggcctgatcggcccccccggcgagcagggcgagaagggcgacagaggcctgcccggcccccagggcagccccggccagaagggcgagatgggcatccccggcgccagcggccccatcggccccggcggcccccccggcctgcccggccccgccggccccaagggcgccaagggcgccaccggccccggcggccccaagggcgagaagggcgtgcagggcccccccggccaccccggcccccccggcgaggtgatccagcccctgcccatccagatgcccaagaagaccagaagaagcgtggacggcagcagactgatgcaggaggacgaggccatccccaccggcggcgcccccggcagccccggcggcctggaggagatcttcggcagcctggacagcctgagagaggagatcgagcagatgagaagacccaccggcacccaggacagccccgccagaacctgccaggacctgaagctgtgccaccccgagctgcccgacggcgagtactgggtggaccccaaccagggctgcgccagagacgccttcagagtgttctgcaacttcaccgccggcggcgagacctgcgtgacccccagagacgacgtgacccagttcagctacgtggacagcgagggcagccccgtgggcgtggtgcagctgaccttcctgagactgctgagcgtgagcgcccaccaggacgtgagctacccctgcagcggcgccgccagagacggccccctgagactgagaggcgccaacgaggacgagctgagccccgagaccagcccctacgtgaaggagttcagagacggctgccagacccagcagggcagaaccgtgctggaggtgagaacccccgtgctggagcagctgcccgtgctggacgccagcttcagcgacctgggcgccccccccagaagaggcggcgtgctgctgggccccgtgtgcttcatgggctag

SEQ ID NO: 1883 - DNA, 4890 bp, Homo sapiens; identical to SEQ ID NO: 1818

SEQ ID NO: 1884 - DNA, 5133 bp, Homo sapiens; identical to SEQ ID NO: 1822

SEQ ID NO: 1885 - DNA, 5148 bp, Homo sapiens
atggagagatgcagcagatgccacagactgctgctgctgctgcccctggtgctgggcctgagcgccgcccccggctgggccggcgccccccccgtggacgtgctgagagccctgagattccccagcctgcccgacggcgtgagaagagccaagggcatctgccccgccgacgtggcctacagagtggccagacccgcccagctgagcgcccccaccagacagctgttccccggcggcttccccaaggacttcagcctgctgaccgtggtgagaaccagacccggcctgcaggcccccctgctgaccctgtacagcgcccagggcgtgagacagctgggcctggagctgggcagacccgtgagattcctgtacgaggaccagaccggcagaccccagccccccagccagcccgtgttcagaggcctgagcctggccgacggcaagtggcacagagtggccgtggccgtgaagggccagagcgtgaccctgatcgtggactgcaagaagagagtgaccagacccctgcccagaagcgccagacccgtgctggacacccacggcgtgatcatcttcggcgccagaatcctggacgaggaggtgttcgagggcgacgtgcaggagctggccatcgtgcccggcgtgcaggccgcctacgagagctgcgagcagaaggagctggagtgcgagggcggccagagagagagaccccagaaccagcagccccacagagcccagagaagcccccagcagcagcccagcagactgcacagaccccagaaccaggagccccagagccagcccaccgagagcctgtactacgactacaagcccccctactacgacgtgatgaccaccggcaccacccccgactaccaggagcagaccgacctgcaggtgccccccaccgccgacagattccaggccgaggagtacggcgagggcggcaccgacccccccgagggcccctacgactacacctacggctacggcgacgactacagagaggagaccgagctgggccccgccctgagcgccgagaccgcccacagcggcgccgccgcccacggccccagaggcctgaagggcgagaagggcgagcccgccgtgctggagcccggcatgctggtggagggcccccccggccccgagggccccgccggcctgatcggcccccccggcatccagggcaaccccggccccgtgggcgaccccggcgagagaggcccccccggcagagccggcctgcccggcagcgacggcgcccccggcccccccggcaccagcctgatgctgcccttcagattcggcagcggcggcggcgacaagggccccgtggtggccgcccaggaggcccaggcccaggccatcctgcagcaggccagactggccctgagaggcccccccggccccatgggctacaccggcagacccggccccctgggccagcccggcagccccggcctgaagggcgagagcggcgacctgggcccccagggccccagaggcccccagggcctgaccggcccccccggcaaggccggcagaagaggcagagccggcgccgacggcgccagaggcatgcccggcgaccccggcgtgaagggcgacagaggcttcgacggcctgcccggcctgcccggcgagaagggccacagaggcgacaccggcgcccagggcctgcccggcccccccggcgaggacggcgagagaggcgacgacggcgagatcggccccagaggcctgcccggcgagagcggccccagaggcctgctgggccccaagggcccccccggcatccccggcccccccggcgtgagaggcatggacggcccccagggccccaagggcagcctgggcccccagggcgagcccggcccccccggccagcagggcacccccggcacccagggcctgcccggcccccagggcgccatcggcccccacggcgagaagggcccccagggcaagcccggcctgcccggcatgcccggcagcgacggcccccccggccaccccggcaaggagggcccccccggcaccaagggcaaccagggccccagcggcccccagggccccctgggctaccccggccccagaggcgtgaagggcgtggacggcatcagaggcctgaagggccacaagggcgagaagggcgaggacggcttccccggcttcaagggcgacatcggcgtgaagggcgacagaggcgaggtgggcgtgcccggcagcagaggcgaggacggccccgagggccccaagggcagaaccggccccaccggcgaccccggcccccccggcctgatgggcgagaagggcaagctgggcgtgcccggcctgcccggctaccccggcagacagggccccaagggcagcctgggcttccccggcttccccggcgccagcggcgagaagggcgccagaggcctgagcggcaagagcggccccagaggcgagagaggccccaccggccccagaggccagagaggccccagaggcgccaccggcaagagcggcgccaagggcaccagcggcggcgacggcccccacggcccccccggcgagagaggcctgcccggcccccagggccccaacggcttccccggccccaagggcccccccggcccccccggcaaggacggcctgcccggccaccccggccagagaggcgaggtgggcttccagggcaagaccggcccccccggcccccccggcgtggtgggcccccagggcgccgccggcgagaccggccccatgggcgagagaggccaccccggcccccccggcccccccggcgagcagggcctgcccggcaccgccggcaaggagggcaccaagggcgaccccggcccccccggcgcccccggcaaggacggccccgccggcctgagaggcttccccggcgagagaggcctgcccggcaccgccggcggccccggcctgaagggcaacgagggccccagcggcccccccggccccgccggcagccccggcgagagaggcgccgccggcagcggcggccccatcggcccccccggcagacccggcccccagggcccccccggcgccgccggcgagaagggcgtgcccggcgagaagggccccatcggccccaccggcagagacggcgtgcagggccccgtgggcctgcccggccccgccggcccccccggcgtggccggcgaggacggcgacaagggcgaggtgggcgaccccggccagaagggcaccaagggcaacaagggcgagcacggcccccccggcccccccggccccatcggccccgtgggccagcccggcgccgccggcgccgacggcgagcccggcgccagaggcccccagggccacttcggcgccaagggcgacgagggcaccagaggcttcaacggcccccccggccccatcggcctgcagggcctgcccggccccagcggcgagaagggcgagaccggcgacgtgggccccatgggcccccccggcccccccggccccagaggccccgccggccccaacggcgccgacggcccccagggcccccccggcggcgtgggcaacctgggcccccccggcgagaagggcgagcccggcgagagcggcagccccggcatccagggcgagcccggcgtgaagggccccagaggcgagagaggcgagaagggcgagagcggccagcccggcgagcccggcccccccggccccaagggccccaccggcgacgacggccccaagggcaaccccggccccgtgggcttccccggcgaccccggcccccccggcgagggcggccccagaggccaggacggcgccaagggcgacagaggcgaggacggcgagcccggccagcccggcagccccggccccaccggcgagaacggcccccccggccccctgggcaagagaggccccgccggcagccccggcagcgagggcagacagggcggcaagggcgccaagggcgaccccggcgccatcggcgcccccggcaagaccggccccgtgggccccgccggccccgccggcaagcccggccccgacggcctgagaggcctgcccggcagcgtgggccagcagggcagacccggcgccaccggccaggccggcccccccggccccgtgggcccccccggcctgcccggcctgagaggcgacgccggcgccaagggcgagaagggccaccccggcctgatcggcctgatcggcccccccggcgagcagggcgagaagggcgacagaggcctgcccggcccccagggcagccccggccagaagggcgagatgggcatccccggcgccagcggccccatcggccccggcggcccccccggcctgcccggccccgccggccccaagggcgccaagggcgccaccggccccggcggccccaagggcgagaagggcgtgcagggcccccccggccaccccggcccccccggcgaggtgatccagcccctgcccatccagatgcccaagaagaccagaagaagcgtggacggcagcagactgatgcaggaggacgaggccatccccaccggcggcgcccccggcagccccggcggcctggaggagatcttcggcagcctggacagcctgagagaggagatcgagcagatgagaagacccaccggcacccaggacagccccgccagaacctgccaggacctgaagctgtgccaccccgagctgcccgacggcgagtactgggtggaccccaaccagggctgcgccagagacgccttcagagtgttctgcaacttcaccgccggcggcgagacctgcgtgacccccagagacgacgtgacccagttcagctacgtggacagcgagggcagccccgtgggcgtggtgcagctgaccttcctgagactgctgagcgtgagcgcccaccaggacgtgagctacccctgcagcggcgccgccagagacggccccctgagactgagaggcgccaacgaggacgagctgagccccgagaccagcccctacgtgaaggagttcagagacggctgccagacccagcagggcagaaccgtgctggaggtgagaacccccgtgctggagcagctgcccgtgctggacgccagcttcagcgacctgggcgccccccccagaagaggcggcgtgctgctgggccccgtgtgcttcatgggctag

SEQ ID NO: 1886 - DNA, 5148 bp, Homo sapiens
atggagagatgcagcagatgccacagactgctgctgctgctgcccctggtgctgggcctgagcgccgcccccggctgggccggcgccccccccgtggacgtgctgagagccctgagattccccagcctgcccgacggcgtgagaagagccaagggcatctgccccgccgacgtggcctacagagtggccagacccgcccagctgagcgcccccaccagacagctgttccccggcggcttccccaaggacttcagcctgctgaccgtggtgagaaccagacccggcctgcaggcccccctgctgaccctgtacagcgcccagggcgtgagacagctgggcctggagctgggcccccccgtgagattcctgtacgaggaccagaccggcagaccccagccccccagccagcccgtgttcagaggcctgagcctggccgacggcaagtggcacagagtggccgtggccgtgaagggccagagcgtgaccctgatcgtggactgcaagaagagagtgaccagacccctgcccagaagcgccagacccgtgctggacacccacggcgtgatcatcttcggcgccagaatcctggacgaggaggtgttcgagggcgacgtgcaggagctggccatcgtgcccggcgtgcaggccgcctacgagagctgcgagcagaaggagctggagtgcgagggcggccagagagagagaccccagaaccagcagccccacagagcccagagaagcccccagcagcagcccagcagactgcacagaccccagaaccaggagccccagagccagcccaccgagagcctgtactacgactacaagcccccctactacgacgtgatgaccaccggcaccacccccgactaccaggagcagaccgacctgcaggtgccccccaccgccgacagattccaggccgaggagtacggcgagggcggcaccgacccccccgagggcccctacgactacacctacggctacggcgacgactacagagaggagaccgagctgggccccgccctgagcgccgagaccgcccacagcggcgccgccgcccacggccccagaggcctgaagggcgagaagggcgagcccgccgtgctggagcccggcatgctggtggagggcccccccggccccgagggccccgccggcctgatcggcccccccggcatccagggcaaccccggccccgtgggcgaccccggcgagagaggcccccccggcagagccggcctgcccggcagcgacggcgcccccggcccccccggcaccagcctgatgctgcccttcagattcggcagcggcggcggcgacaagggccccgtggtggccgcccaggaggcccaggcccaggccatcctgcagcaggccagactggccctgagaggcccccccggccccatgggctacaccggcagacccggccccctgggccagcccggcagccccggcctgaagggcgagagcggcgacctgggcccccagggccccagaggcccccagggcctgaccggcccccccggcaaggccggcagaagaggcagagccggcgccgacggcgccagaggcatgcccggcgaccccggcgtgaagggcgacagaggcttcgacggcctgcccggcctgcccggcgagaagggccacagaggcgacaccggcgcccagggcctgcccggcccccccggcgaggacggcgagagaggcgacgacggcgagatcggccccagaggcctgcccggcgagagcggccccagaggcctgctgggccccaagggcccccccggcatccccggcccccccggcgtgagaggcatggacggcccccagggccccaagggcagcctgggcccccagggcgagcccggcccccccggccagcagggcacccccggcacccagggcctgcccggcccccagggcgccatcggcccccacggcgagaagggcccccagggcaagcccggcctgcccggcatgcccggcagcgacggcccccccggccaccccggcaaggagggcccccccggcaccaagggcaaccagggccccagcggcccccagggccccctgggctaccccggccccagaggcgtgaagggcgtggacggcatcagaggcctgaagggccacaagggcgagaagggcgaggacggcttccccggcttcaagggcgacatcggcgtgaagggcgacagaggcgaggtgggcgtgcccggcagcagaggcgaggacggccccgagggccccaagggcagaaccggccccaccggcgaccccggcccccccggcctgatgggcgagaagggcaagctgggcgtgcccggcctgcccggctaccccggcagacagggccccaagggcagcctgggcttccccggcttccccggcgccagcggcgagaagggcgccagaggcctgagcggcaagagcggccccagaggcgagagaggccccaccggccccagaggccagagaggccccagaggcgccaccggcaagagcggcgccaagggcaccagcggcggcgacggcccccacggcccccccggcgagagaggcctgcccggcccccagggccccaacggcttccccggccccaagggcccccccggcccccccggcaaggacggcctgcccggccaccccggccagagaggcgaggtgggcttccagggcaagaccggcccccccggcccccccggcgtggtgggcccccagggcgccgccggcgagaccggccccatgggcgagagaggccaccccggcccccccggcccccccggcgagcagggcctgcccggcaccgccggcaaggagggcaccaagggcgaccccggcccccccggcgcccccggcaaggacggccccgccggcctgagaggcttccccggcgagagaggcctgcccggcaccgccggcggccccggcctgaagggcaacgagggccccagcggcccccccggccccgccggcagccccggcgagagaggcgccgccggcagcggcggccccatcggcccccccggcagacccggcccccagggcccccccggcgccgccggcgagaagggcgtgcccggcgagaagggccccatcggccccaccggcagagacggcgtgcagggccccgtgggcctgcccggccccgccggcccccccggcgtggccggcgaggacggcgacaagggcgaggtgggcgaccccggccagaagggcaccaagggcaacaagggcgagcacggcccccccggcccccccggccccatcggccccgtgggccagcccggcgccgccggcgccgacggcgagcccggcgccagaggcccccagggccacttcggcgccaagggcgacgagggcaccagaggcttcaacggcccccccggccccatcggcctgcagggcctgcccggccccagcggcgagaagggcgagaccggcgacgtgggccccatgggcccccccggcccccccggccccagaggccccgccggccccaacggcgccgacggcccccagggcccccccggcggcgtgggcaacctgggcccccccggcgagaagggcgagcccggcgagagcggcagccccggcatccagggcgagcccggcgtgaagggccccagaggcgagagaggcgagaagggcgagagcggccagcccggcgagcccggcccccccggccccaagggccccaccggcgacgacggccccaagggcaaccccggccccgtgggcttccccggcgaccccggcccccccggcgagggcggccccagaggccaggacggcgccaagggcgacagaggcgaggacggcgagcccggccagcccggcagccccggccccaccggcgagaacggcccccccggccccctgggcaagagaggccccgccggcagccccggcagcgagggcagacagggcggcaagggcgccaagggcgaccccggcgccatcggcgcccccggcaagaccggccccgtgggccccgccggccccgccggcaagcccggccccgacggcctgagaggcctgcccggcagcgtgggccagcagggcagacccggcgccaccggccaggccggcccccccggccccgtgggcccccccggcctgcccggcctgagaggcgacgccggcgccaagggcgagaagggccaccccggcctgatcggcctgatcggcccccccggcgagcagggcgagaagggcgacagaggcctgcccggcccccagggcagccccggccagaagggcgagatgggcatccccggcgccagcggccccatcggccccggcggcccccccggcctgcccggccccgccggccccaagggcgccaagggcgccaccggccccggcggccccaagggcgagaagggcgtgcagggcccccccggccaccccggcccccccggcgaggtgatccagcccctgcccatccagatgcccaagaagaccagaagaagcgtggacggcagcagactgatgcaggaggacgaggccatccccaccggcggcgcccccggcagccccggcggcctggaggagatcttcggcagcctggacagcctgagagaggagatcgagcagatgagaagacccaccggcacccaggacagccccgccagaacctgccaggacctgaagctgtgccaccccgagctgcccgacggcgagtactgggtggaccccaaccagggctgcgccagagacgccttcagagtgttctgcaacttcaccgccggcggcgagacctgcgtgacccccagagacgacgtgacccagttcagctacgtggacagcgagggcagccccgtgggcgtggtgcagctgaccttcctgagactgctgagcgtgagcgcccaccaggacgtgagctacccctgcagcggcgccgccagagacggccccctgagactgagaggcgccaacgaggacgagctgagccccgagaccagcccctacgtgaaggagttcagagacggctgccagacccagcagggcagaaccgtgctggaggtgagaacccccgtgctggagcagctgcccgtgctggacgccagcttcagcgacctgggcgccccccccagaagaggcggcgtgctgctgggccccgtgtgcttcatgggctag

SEQ ID NO: 1887 - DNA, 5031 bp, Homo sapiens; identical to SEQ ID NO: 1852

SEQ ID NO: 1888 - DNA, 4968 bp, Homo sapiens; identical to SEQ ID NO: 1850

SEQ ID NO: 1889 - DNA, 5148 bp, Homo sapiens; identical to SEQ ID NO: 1885

SEQ ID NO: 1890 - DNA, 9192 bp, Homo sapiens
atgagaagcagactgccccccgccctggccgccctgggcgccgccctgctgctgagcagcatcgaggccgaggtggacccccccagcgacctgaacttcaagatcatcgacgagaacaccgtgcacatgagctgggccaagcccgtggaccccatcgtgggctacagaatcaccgtggaccccaccaccgacggccccaccaaggagttcaccctgagcgccagcaccaccgagaccctgctgagcgagctggtgcccgagaccgagtacgtggtgaccatcaccagctacgacgaggtggaggagagcgtgcccgtgatcggccagctgaccatccagaccggcagcagcaccaagcccgtggagaagaagcccggcaagaccgagatccagaagtgcagcgtgagcgcctggaccgacctggtgttcctggtggacggcagctggagcgtgggcagaaacaacttcaagtacatcctggacttcatcgccgccctggtgagcgccttcgacatcggcgaggagaagaccagagtgggcgtggtgcagtacagcagcgacaccagaaccgagttcaacctgaaccagtactaccagagagacgagctgctggccgccatcaagaagatcccctacaagggcggcaacaccatgaccggcgacgccatcgactacctggtgaagaacaccttcaccgagagcgccggcgccagagtgggcttccccaaggtggccatcatcatcaccgacggcaagagccaggacgaggtggagatccccgccagagagctgagaaacgtgggcgtggaggtgttcagcctgggcatcaaggccgccgacgccaaggagctgaagcagatcgccagcacccccagcctgaaccacgtgttcaacgtggccaacttcgacgccatcgtggacatccagaacgagatcatcagccaggtgtgcagcggcgtggacgagcagctgggcgagctggtgagcggcgaggaggtggtggagccccccagcaacctgatcgccatggaggtgagcagcaagtacgtgaagctgaactggaaccccagccccagccccgtgaccggctacaaggtgatcctgacccccatgaccgccggcagcagacagcacgccctgagcgtgggcccccagaccaccaccctgagcgtgagagacctgagcgccgacaccgagtaccagatcagcgtgagcgccatgaagggcatgaccagcagcgagcccatcagcatcatggagaagacccagcccatgaaggtgcaggtggagtgcagcagaggcgtggacatcaaggccgacatcgtgttcctggtggacggcagctacagcatcggcatcgccaacttcgtgaaggtgagagccttcctggaggtgctggtgaagagcttcgagatcagccccaacagagtgcagatcagcctggtgcagtacagcagagacccccacaccgagttcaccctgaagaagttcaccaaggtggaggacatcatcgaggccatcaacaccttcccctacagaggcggcagcaccaacaccggcaaggccatgacctacgtgagagagaagatcttcgtgcccagcaagggcagcagaagcaacgtgcccaaggtgatgatcctgatcaccgacggcaagagcagcgacgccttcagagaccccgccatcaagctgagaaacagcgacgtggagatcttcgccgtgggcgtgaaggacgccgtgagaagcgagctggaggccatcgccagcccccccgccgagacccacgtgttcaccgtggaggacttcgacgccttccagagaatcagcttcgagctgacccagagcatctgcctgagaatcgagcaggagctggccgccatcaagaagaaggcctacgtgccccccaaggacctgagcttcagcgaggtgaccagctacggcttcaagaccaactggagccccgccggcgagaacgtgttcagctaccacatcacctacaaggaggccgccggcgacgacgaggtgaccgtggtggagcccgccagcagcaccagcgtggtgctgagcagcctgaagcccgagaccctgtacctggtgaacgtgaccgccgagtacgaggacggcttcagcatccccctggccggcgaggagaccaccgaggaggtgaagggcgcccccagaaacctgaaggtgaccgacgagaccaccgacagcttcaagatcacctggacccaggcccccggcagagtgctgagatacagaatcatctacagacccgtggccggcggcgagagcagagaggtgaccaccccccccaaccagagaagaagaaccctggagaacctgatccccgacaccaagtacgaggtgagcgtgatccccgagtacttcagcggccccggcacccccctgaccggcaacgccgccaccgaggaggtgagaggcaaccccagagacctgagagtgagcgaccccaccaccagcaccatgaagctgagctggagcggcgcccccggcaaggtgaagcagtacctggtgacctacacccccgtggccggcggcgagacccaggaggtgaccgtgagaggcgacaccaccaacaccgtgctgcagggcctgaaggagggcacccagtacgccctgagcgtgaccgccctgtacgccagcggcgccggcgacgccctgttcggcgagggcaccaccctggaggagagaggcagcccccaggacctggtgaccaaggacatcaccgacaccagcatcggcgcctactggaccagcgcccccggcatggtgagaggctacagagtgagctggaagagcctgtacgacgacgtggacaccggcgagaagaacctgcccgaggacgccatccacaccatgatcgagaacctgcagcccgagaccaagtacagaatcagcgtgttcgccacctacagcagcggcgagggcgagcccctgaccggcgacgccaccaccgagctgagccaggacagcaagaccctgaaggtggacgaggagaccgagaacaccatgagagtgacctggaagcccgcccccggcaaggtggtgaactacagagtggtgtacagaccccacggcagaggcaagcagatggtggccaaggtgccccccaccgtgaccagcaccgtgctgaagagactgcagccccagaccacctacgacatcaccgtgctgcccatctacaagatgggcgagggcaagctgagacagggcagcggcaccaccgccagcagattcaagagccccagaaacctgaagaccagcgaccccaccatgagcagcttcagagtgacctgggagcccgcccccggcgaggtgaagggctacaaggtgaccttccaccccaccggcgacgacagaagactgggcgagctggtggtgggcccctacgacaacaccgtggtgctggaggagctgagagccggcaccacctacaaggtgaacgtgttcggcatgttcgacggcggcgagagcagccccctggtgggccaggagatgaccaccctgagcgacaccaccgtgatgcccatcctgagcagcggcatggagtgcctgaccagagccgaggccgacatcgtgctgctggtggacggcagctggagcatcggcagagccaacttcagaaccgtgagaagcttcatcagcagaatcgtggaggtgttcgacatcggccccaagagagtgcagatcgccctggcccagtacagcggcgaccccagaaccgagtggcagctgaacgcccacagagacaagaagagcctgctgcaggccgtggccaacctgccctacaagggcggcaacaccctgaccggcatggccctgaacttcatcagacagcagaacttcagaacccaggccggcatgagacccagagccagaaagatcggcgtgctgatcaccgacggcaagagccaggacgacgtggaggcccccagcaagaagctgaaggacgagggcgtggagctgttcgccatcggcatcaagaacgccgacgaggtggagctgaagatgatcgccaccgaccccgacgacacccacgcctacaacgtggccgacttcgagagcctgagcagaatcgtggacgacctgaccatcaacctgtgcaacagcgtgaagggccccggcgacctggaggcccccagcaacctggtgatcagcgagagaacccacagaagcttcagagtgagctggaccccccccagcgacagcgtggacagatacaaggtggagtactaccccgtgagcggcggcaagagacaggagttctacgtgagcagaatggagaccagcaccgtgctgaaggacctgaagcccgagaccgagtacgtggtgaacgtgtacagcgtggtggaggacgagtacagcgagcccctgaagggcaccgagaagaccctgcccgtgcccgtggtgagcctgaacatctacgacgtgggccccaccaccatgcacgtgcagtggcagcccgtgggcggcgccaccggctacatcctgagctacaagcccgtgaaggacaccgagcccaccagacccaaggaggtgagactgggccccaccgtgaacgacatgcagctgaccgacctggtgcccaacaccgagtacgccgtgaccgtgcaggccgtgctgcacgacctgaccagcgagcccgtgaccgtgagagaggtgaccctgcccctgcccagaccccaggacctgaagctgagagacgtgacccacagcaccatgaacgtgttctgggagcccgtgcccggcaaggtgagaaagtacatcgtgagatacaagacccccgaggaggacgtgaaggaggtggaggtggacagaagcgagaccagcaccagcctgaaggacctgttcagccagaccctgtacaccgtgagcgtgagcgccgtgcacgacgagggcgagagcccccccgtgaccgcccaggagaccaccagacccgtgcccgcccccaccaacctgaagatcaccgaggtgaccagcgagggcttcagaggcacctgggaccacggcgccagcgacgtgagcctgtacagaatcacctgggcccccttcggcagcagcgacaagatggagaccatcctgaacggcgacgagaacaccctggtgttcgagaacctgaaccccaacaccatctacgaggtgagcatcaccgccatctaccccgacgagagcgagagcgacgacctgatcggcagcgagagaaccctgcccatcctgaccacccaggcccccaagagcggccccagaaacctgcaggtgtacaacgccaccagcaacagcctgaccgtgaagtgggaccccgccagcggcagagtgcagaagtacagaatcacctaccagcccagcaccggcgagggcaacgagcagaccaccaccatcggcggcagacagaacagcgtggtgctgcagaagctgaagcccgacaccccctacaccatcaccgtgagcagcctgtaccccgacggcgagggcggcagaatgaccggcagaggcaagaccaagcccctgaacaccgtgagaaacctgagagtgtacgaccccagcaccagcaccctgaacgtgagatgggaccacgccgagggcaaccccagacagtacaagctgttctacgcccccgccgccggcggccccgaggagctggtgcccatccccggcaacaccaactacgccatcctgagaaacctgcagcccgacaccagctacaccgtgaccgtggtgcccgtgtacaccgagggcgacggcggcagaaccagcgacaccggcagaaccctgatgagaggcctggccagaaacgtgcaggtgtacaaccccacccccaacagcctggacgtgagatgggaccccgcccccggccccgtgctgcagtacagagtggtgtacagccccgtggacggcaccagacccagcgagagcatcgtggtgcccggcaacaccagaatggtgcacctggagagactgatccccgacaccctgtacagcgtgaacctggtggccctgtacagcgacggcgagggcaaccccagccccgcccagggcagaaccctgcccagaagcggccccagaaacctgagagtgttcggcgagaccaccaacagcctgagcgtggcctgggaccacgccgacggccccgtgcagcagtacagaatcatctacagccccaccgtgggcgaccccatcgacgagtacaccaccgtgcccggcagaagaaacaacgtgatcctgcagcccctgcagcccgacaccccctacaagatcaccgtgatcgccgtgtacgaggacggcgacggcggccacctgaccggcaacggcagaaccgtgggcctgctgcccccccagaacatccacatcagcgacgagtggtacaccagattcagagtgagctgggaccccagccccagccccgtgctgggctacaagatcgtgtacaagcccgtgggcagcaacgagcccatggaggccttcgtgggcgagatgaccagctacaccctgcacaacctgaaccccagcaccacctacgacgtgaacgtgtacgcccagtacgacagcggcctgagcgtgcccctgaccgaccagggcaccaccctgtacctgaacgtgaccgacctgaagacctaccagatcggctgggacaccttctgcgtgaagtggagcccccacagagccgccaccagctacagactgaagctgagccccgccgacggcaccagaggccaggagatcaccgtgagaggcagcgagaccagccactgcttcaccggcctgagccccgacaccgactacggcgtgaccgtgttcgtgcagacccccaacctggagggccccggcgtgagcgtgaaggagcacaccaccgtgaagcccaccgaggcccccaccgagccccccacccccccccccccccccaccatcccccccgccagagacgtgtgcaagggcgccaaggccgacatcgtgttcctgaccgacgccagctggagcatcggcgacgacaacttcaacaaggtggtgaagttcatcttcaacaccgtgggcggcttcgacgagatcagccccgccggcatccaggtgagcttcgtgcagtacagcgacgaggtgaagagcgagttcaagctgaacacctacaacgacaaggccctggccctgggcgccctgcagaacatcagatacagaggcggcaacaccagaaccggcaaggccctgaccttcatcaaggagaaggtgctgacctgggagagcggcatgagaaagaacgtgcccaaggtgctggtggtggtgaccgacggcagaagccaggacgaggtgaagaaggccgccctggtgatccagcagagcggcttcagcgtgttcgtggtgggcgtggccgacgtggactacaacgagctggccaacatcgccagcaagcccagcgagagacacgtgttcatcgtggacgacttcgagagcttcgagaagatcgaggacaacctgatcaccttcgtgtgcgagaccgccaccagcagctgccccctgatctacctggacggctacaccagccccggcttcaagatgctggaggcctacaacctgaccgagaagaacttcgccagcgtgcagggcgtgagcctggagagcggcagcttccccagctacagcgcctacagaatccagaagaacgccttcgtgaaccagcccaccgccgacctgcaccccaacggcctgccccccagctacaccatcatcctgctgttcagactgctgcccgagacccccagcgaccccttcgccatctggcagatcaccgacagagactacaagccccaggtgggcgtgatcgccgaccccagcagcaagaccctgagcttcttcaacaaggacaccagaggcgaggtgcagaccgtgaccttcgacaccgaggaggtgaagaccctgttctacggcagcttccacaaggtgcacatcgtggtgaccagcaagagcgtgaagatctacatcgactgctacgagatcatcgagaaggacatcaaggaggccggcaacatcaccaccgacggctacgagatcctgggcaagctgctgaagggcgagagaaagagcgccgccttccagatccagagcttcgacatcgtgtgcagccccgtgtggaccagcagagacagatgctgcgacatccccagcagaagagacgagggcaagtgccccgccttccccaacagctgcacctgcacccaggacagcgtgggcccccccggcccccccggccccgccggcggccccggcgccaagggccccagaggcgagagaggcatcagcggcgccatcggcccccccggccccagaggcgacatcggcccccccggcccccagggcccccccggcccccagggccccaacggcctgagcatccccggcgagcagggcagacagggcatgaagggcgacgccggcgagcccggcctgcccggcagaaccggcacccccggcctgcccggcccccccggccccatgggcccccccggcgacagaggcttcaccggcaaggacggcgccatgggccccagaggcccccccggcccccccggcagccccggcagccccggcgtgaccggccccagcggcaagcccggcaagcccggcgaccacggcagacccggccccagcggcctgaagggcgagaagggcgacagaggcgacatcgccagccagaacatgatgagagccgtggccagacaggtgtgcgagcagctgatcagcggccagatgaacagattcaaccagatgctgaaccagatccccaacgactaccagagcagcagaaaccagcccggcccccccggcccccccggcccccccggcagcgccggcgccagaggcgagcccggccccggcggcagacccggcttccccggcacccccggcatgcagggcccccccggcgagagaggcctgcccggcgagaagggcgagagaggcaccggcagcagcggccccagaggcctgcccggcccccccggcccccagggcgagagcagaaccggcccccccggcagcaccggcagcagaggcccccccggcccccccggcagacccggcaacagcggcatcagaggcccccccggcccccccggctactgcgacagcagccagtgcgccagcatcccctacaacggccagggctaccccggcagcggctag

SEQ ID NO: 1891 - DNA, 5700 bp, Homo sapiens
atgagaagcagactgccccccgccctggccgccctgggcgccgccctgctgctgagcagcatcgaggccgagggcatggagtgcctgaccagagccgaggccgacatcgtgctgctggtggacggcagctggagcatcggcagagccaacttcagaaccgtgagaagcttcatcagcagaatcgtggaggtgttcgacatcggccccaagagagtgcagatcgccctggcccagtacagcggcgaccccagaaccgagtggcagctgaacgcccacagagacaagaagagcctgctgcaggccgtggccaacctgccctacaagggcggcaacaccctgaccggcatggccctgaacttcatcagacagcagaacttcagaacccaggccggcatgagacccagagccagaaagatcggcgtgctgatcaccgacggcaagagccaggacgacgtggaggcccccagcaagaagctgaaggacgagggcgtggagctgttcgccatcggcatcaagaacgccgacgaggtggagctgaagatgatcgccaccgaccccgacgacacccacgcctacaacgtggccgacttcgagagcctgagcagaatcgtggacgacctgaccatcaacctgtgcaacagcgtgaagggccccggcgacctggaggcccccagcaacctggtgatcagcgagagaacccacagaagcttcagagtgagctggaccccccccagcgacagcgtggacagatacaaggtggagtactaccccgtgagcggcggcaagagacaggagttctacgtgagcagaatggagaccagcaccgtgctgaaggacctgaagcccgagaccgagtacgtggtgaacgtgtacagcgtggtggaggacgagtacagcgagcccctgaagggcaccgagaagaccctgcccgtgcccgtggtgagcctgaacatctacgacgtgggccccaccaccatgcacgtgcagtggcagcccgtgggcggcgccaccggctacatcctgagctacaagcccgtgaaggacaccgagcccaccagacccaaggaggtgagactgggccccaccgtgaacgacatgcagctgaccgacctggtgcccaacaccgagtacgccgtgaccgtgcaggccgtgctgcacgacctgaccagcgagcccgtgaccgtgagagaggtgaccctgcccctgcccagaccccaggacctgaagctgagagacgtgacccacagcaccatgaacgtgttctgggagcccgtgcccggcaaggtgagaaagtacatcgtgagatacaagacccccgaggaggacgtgaaggaggtggaggtggacagaagcgagaccagcaccagcctgaaggacctgttcagccagaccctgtacaccgtgagcgtgagcgccgtgcacgacgagggcgagagcccccccgtgaccgcccaggagaccaccagacccgtgcccgcccccaccaacctgaagatcaccgaggtgaccagcgagggcttcagaggcacctgggaccacggcgccagcgacgtgagcctgtacagaatcacctgggcccccttcggcagcagcgacaagatggagaccatcctgaacggcgacgagaacaccctggtgttcgagaacctgaaccccaacaccatctacgaggtgagcatcaccgccatctaccccgacgagagcgagagcgacgacctgatcggcagcgagagaaccctgcccatcctgaccacccaggcccccaagagcggccccagaaacctgcaggtgtacaacgccaccagcaacagcctgaccgtgaagtgggaccccgccagcggcagagtgcagaagtacagaatcacctaccagcccagcaccggcgagggcaacgagcagaccaccaccatcggcggcagacagaacagcgtggtgctgcagaagctgaagcccgacaccccctacaccatcaccgtgagcagcctgtaccccgacggcgagggcggcagaatgaccggcagaggcaagaccaagcccctgaacaccgtgagaaacctgagagtgtacgaccccagcaccagcaccctgaacgtgagatgggaccacgccgagggcaaccccagacagtacaagctgttctacgcccccgccgccggcggccccgaggagctggtgcccatccccggcaacaccaactacgccatcctgagaaacctgcagcccgacaccagctacaccgtgaccgtggtgcccgtgtacaccgagggcgacggcggcagaaccagcgacaccggcagaaccctgatgagaggcctggccagaaacgtgcaggtgtacaaccccacccccaacagcctggacgtgagatgggaccccgcccccggccccgtgctgcagtacagagtggtgtacagccccgtggacggcaccagacccagcgagagcatcgtggtgcccggcaacaccagaatggtgcacctggagagactgatccccgacaccctgtacagcgtgaacctggtggccctgtacagcgacggcgagggcaaccccagccccgcccagggcagaaccctgcccagaagcggccccagaaacctgagagtgttcggcgagaccaccaacagcctgagcgtggcctgggaccacgccgacggccccgtgcagcagtacagaatcatctacagccccaccgtgggcgaccccatcgacgagtacaccaccgtgcccggcagaagaaacaacgtgatcctgcagcccctgcagcccgacaccccctacaagatcaccgtgatcgccgtgtacgaggacggcgacggcggccacctgaccggcaacggcagaaccgtgggcctgctgcccccccagaacatccacatcagcgacgagtggtacaccagattcagagtgagctgggaccccagccccagccccgtgctgggctacaagatcgtgtacaagcccgtgggcagcaacgagcccatggaggccttcgtgggcgagatgaccagctacaccctgcacaacctgaaccccagcaccacctacgacgtgaacgtgtacgcccagtacgacagcggcctgagcgtgcccctgaccgaccagggcaccaccctgtacctgaacgtgaccgacctgaagacctaccagatcggctgggacaccttctgcgtgaagtggagcccccacagagccgccaccagctacagactgaagctgagccccgccgacggcaccagaggccaggagatcaccgtgagaggcagcgagaccagccactgcttcaccggcctgagccccgacaccgactacggcgtgaccgtgttcgtgcagacccccaacctggagggccccggcgtgagcgtgaaggagcacaccaccgtgaagcccaccgaggcccccaccgagccccccacccccccccccccccccaccatcccccccgccagagacgtgtgcaagggcgccaaggccgacatcgtgttcctgaccgacgccagctggagcatcggcgacgacaacttcaacaaggtggtgaagttcatcttcaacaccgtgggcggcttcgacgagatcagccccgccggcatccaggtgagcttcgtgcagtacagcgacgaggtgaagagcgagttcaagctgaacacctacaacgacaaggccctggccctgggcgccctgcagaacatcagatacagaggcggcaacaccagaaccggcaaggccctgaccttcatcaaggagaaggtgctgacctgggagagcggcatgagaaagaacgtgcccaaggtgctggtggtggtgaccgacggcagaagccaggacgaggtgaagaaggccgccctggtgatccagcagagcggcttcagcgtgttcgtggtgggcgtggccgacgtggactacaacgagctggccaacatcgccagcaagcccagcgagagacacgtgttcatcgtggacgacttcgagagcttcgagaagatcgaggacaacctgatcaccttcgtgtgcgagaccgccaccagcagctgccccctgatctacctggacggctacaccagccccggcttcaagatgctggaggcctacaacctgaccgagaagaacttcgccagcgtgcagggcgtgagcctggagagcggcagcttccccagctacagcgcctacagaatccagaagaacgccttcgtgaaccagcccaccgccgacctgcaccccaacggcctgccccccagctacaccatcatcctgctgttcagactgctgcccgagacccccagcgaccccttcgccatctggcagatcaccgacagagactacaagccccaggtgggcgtgatcgccgaccccagcagcaagaccctgagcttcttcaacaaggacaccagaggcgaggtgcagaccgtgaccttcgacaccgaggaggtgaagaccctgttctacggcagcttccacaaggtgcacatcgtggtgaccagcaagagcgtgaagatctacatcgactgctacgagatcatcgagaaggacatcaaggaggccggcaacatcaccaccgacggctacgagatcctgggcaagctgctgaagggcgagagaaagagcgccgccttccagatccagagcttcgacatcgtgtgcagccccgtgtggaccagcagagacagatgctgcgacatccccagcagaagagacgagggcaagtgccccgccttccccaacagctgcacctgcacccaggacagcgtgggcccccccggcccccccggccccgccggcggccccggcgccaagggccccagaggcgagagaggcatcagcggcgccatcggcccccccggccccagaggcgacatcggcccccccggcccccagggcccccccggcccccagggccccaacggcctgagcatccccggcgagcagggcagacagggcatgaagggcgacgccggcgagcccggcctgcccggcagaaccggcacccccggcctgcccggcccccccggccccatgggcccccccggcgacagaggcttcaccggcaaggacggcgccatgggccccagaggcccccccggcccccccggcagccccggcagccccggcgtgaccggccccagcggcaagcccggcaagcccggcgaccacggcagacccggccccagcggcctgaagggcgagaagggcgacagaggcgacatcgccagccagaacatgatgagagccgtggccagacaggtgtgcgagcagctgatcagcggccagatgaacagattcaaccagatgctgaaccagatccccaacgactaccagagcagcagaaaccagcccggcccccccggcccccccggcccccccggcagcgccggcgccagaggcgagcccggccccggcggcagacccggcttccccggcacccccggcatgcagggcccccccggcgagagaggcctgcccggcgagaagggcgagagaggcaccggcagcagcggccccagaggcctgcccggcccccccggcccccagggcgagagcagaaccggcccccccggcagcaccggcagcagaggcccccccggcccccccggcagacccggcaacagcggcatcagaggcccccccggcccccccggctactgcgacagcagccagtgcgccagcatcccctacaacggccagggctaccccggcagcggctag

SEQ ID NO: 1892 - DNA, 8964 bp, Homo sapiens
atgagaagcagactgccccccgccctggccgccctgggcgccgccctgctgctgagcagcatcgaggccgaggtggacccccccagcgacctgaacttcaagatcatcgacgagaacaccgtgcacatgagctgggccaagcccgtggaccccatcgtgggctacagaatcaccgtggaccccaccaccgacggccccaccaaggagttcaccctgagcgccagcaccaccgagaccctgctgagcgagctggtgcccgagaccgagtacgtggtgaccatcaccagctacgacgaggtggaggagagcgtgcccgtgatcggccagctgaccatccagaccggcagcagcaccaagcccgtggagaagaagcccggcaagaccgagatccagaagtgcagcgtgagcgcctggaccgacctggtgttcctggtggacggcagctggagcgtgggcagaaacaacttcaagtacatcctggacttcatcgccgccctggtgagcgccttcgacatcggcgaggagaagaccagagtgggcgtggtgcagtacagcagcgacaccagaaccgagttcaacctgaaccagtactaccagagagacgagctgctggccgccatcaagaagatcccctacaagggcggcaacaccatgaccggcgacgccatcgactacctggtgaagaacaccttcaccgagagcgccggcgccagagtgggcttccccaaggtggccatcatcatcaccgacggcaagagccaggacgaggtggagatccccgccagagagctgagaaacgtgggcgtggaggtgttcagcctgggcatcaaggccgccgacgccaaggagctgaagcagatcgccagcacccccagcctgaaccacgtgttcaacgtggccaacttcgacgccatcgtggacatccagaacgagatcatcagccaggtgtgcagcggcgtggacgagcagctgggcgagctggtgagcggcgaggaggtggtggagccccccagcaacctgatcgccatggaggtgagcagcaagtacgtgaagctgaactggaaccccagccccagccccgtgaccggctacaaggtgatcctgacccccatgaccgccggcagcagacagcacgccctgagcgtgggcccccagaccaccaccctgagcgtgagagacctgagcgccgacaccgagtaccagatcagcgtgagcgccatgaagggcatgaccagcagcgagcccatcagcatcatggagaagacccagcccatgaaggtgcaggtggagtgcagcagaggcgtggacatcaaggccgacatcgtgttcctggtggacggcagctacagcatcggcatcgccaacttcgtgaaggtgagagccttcctggaggtgctggtgaagagcttcgagatcagccccaacagagtgcagatcagcctggtgcagtacagcagagacccccacaccgagttcaccctgaagaagttcaccaaggtggaggacatcatcgaggccatcaacaccttcccctacagaggcggcagcaccaacaccggcaaggccatgacctacgtgagagagaagatcttcgtgcccagcaagggcagcagaagcaacgtgcccaaggtgatgatcctgatcaccgacggcaagagcagcgacgccttcagagaccccgccatcaagctgagaaacagcgacgtggagatcttcgccgtgggcgtgaaggacgccgtgagaagcgagctggaggccatcgccagcccccccgccgagacccacgtgttcaccgtggaggacttcgacgccttccagagaatcagcttcgagctgacccagagcatctgcctgagaatcgagcaggagctggccgccatcaagaagaaggcctacgtgccccccaaggacctgagcttcagcgaggtgaccagctacggcttcaagaccaactggagccccgccggcgagaacgtgttcagctaccacatcacctacaaggaggccgccggcgacgacgaggtgaccgtggtggagcccgccagcagcaccagcgtggtgctgagcagcctgaagcccgagaccctgtacctggtgaacgtgaccgccgagtacgaggacggcttcagcatccccctggccggcgaggagaccaccgaggaggtgaagggcgcccccagaaacctgaaggtgaccgacgagaccaccgacagcttcaagatcacctggacccaggcccccggcagagtgctgagatacagaatcatctacagacccgtggccggcggcgagagcagagaggtgaccaccccccccaaccagagaagaagaaccctggagaacctgatccccgacaccaagtacgaggtgagcgtgatccccgagtacttcagcggccccggcacccccctgaccggcaacgccgccaccgaggaggtgagaggcaaccccagagacctgagagtgagcgaccccaccaccagcaccatgaagctgagctggagcggcgcccccggcaaggtgaagcagtacctggtgacctacacccccgtggccggcggcgagacccaggaggtgaccgtgagaggcgacaccaccaacaccgtgctgcagggcctgaaggagggcacccagtacgccctgagcgtgaccgccctgtacgccagcggcgccggcgacgccctgttcggcgagggcaccaccctggaggagagaggcagcccccaggacctggtgaccaaggacatcaccgacaccagcatcggcgcctactggaccagcgcccccggcatggtgagaggctacagagtgagctggaagagcctgtacgacgacgtggacaccggcgagaagaacctgcccgaggacgccatccacaccatgatcgagaacctgcagcccgagaccaagtacagaatcagcgtgttcgccacctacagcagcggcgagggcgagcccctgaccggcgacgccaccaccgagctgagccaggacagcaagaccctgaaggtggacgaggagaccgagaacaccatgagagtgacctggaagcccgcccccggcaaggtggtgaactacagagtggtgtacagaccccacggcagaggcaagcagatggtggccaaggtgccccccaccgtgaccagcaccgtgctgaagagactgcagccccagaccacctacgacatcaccgtgctgcccatctacaagatgggcgagggcaagctgagacagggcagcggcaccaccgccagcagattcaagagccccagaaacctgaagaccagcgaccccaccatgagcagcttcagagtgacctgggagcccgcccccggcgaggtgaagggctacaaggtgaccttccaccccaccggcgacgacagaagactgggcgagctggtggtgggcccctacgacaacaccgtggtgctggaggagctgagagccggcaccacctacaaggtgaacgtgttcggcatgttcgacggcggcgagagcagccccctggtgggccaggagatgaccaccctgagcgacaccaccgtgatgcccatcctgagcagcggcatggagtgcctgaccagagccgaggccgacatcgtgctgctggtggacggcagctggagcatcggcagagccaacttcagaaccgtgagaagcttcatcagcagaatcgtggaggtgttcgacatcggccccaagagagtgcagatcgccctggcccagtacagcggcgaccccagaaccgagtggcagctgaacgcccacagagacaagaagagcctgctgcaggccgtggccaacctgccctacaagggcggcaacaccctgaccggcatggccctgaacttcatcagacagcagaacttcagaacccaggccggcatgagacccagagccagaaagatcggcgtgctgatcaccgacggcaagagccaggacgacgtggaggcccccagcaagaagctgaaggacgagggcgtggagctgttcgccatcggcatcaagaacgccgacgaggtggagctgaagatgatcgccaccgaccccgacgacacccacgcctacaacgtggccgacttcgagagcctgagcagaatcgtggacgacctgaccatcaacctgtgcaacagcgtgaagggccccggcgacctggaggcccccagcaacctggtgatcagcgagagaacccacagaagcttcagagtgagctggaccccccccagcgacagcgtggacagatacaaggtggagtactaccccgtgagcggcggcaagagacaggagttctacgtgagcagaatggagaccagcaccgtgctgaaggacctgaagcccgagaccgagtacgtggtgaacgtgtacagcgtggtggaggacgagtacagcgagcccctgaagggcaccgagaagaccctgcccgtgcccgtggtgagcctgaacatctacgacgtgggccccaccaccatgcacgtgcagtggcagcccgtgggcggcgccaccggctacatcctgagctacaagcccgtgaaggacaccgagcccaccagacccaaggaggtgagactgggccccaccgtgaacgacatgcagctgaccgacctggtgcccaacaccgagtacgccgtgaccgtgcaggccgtgctgcacgacctgaccagcgagcccgtgaccgtgagagaggtgaccctgcccctgcccagaccccaggacctgaagctgagagacgtgacccacagcaccatgaacgtgttctgggagcccgtgcccggcaaggtgagaaagtacatcgtgagatacaagacccccgaggaggacgtgaaggaggtggaggtggacagaagcgagaccagcaccagcctgaaggacctgttcagccagaccctgtacaccgtgagcgtgagcgccgtgcacgacgagggcgagagcccccccgtgaccgcccaggagaccaccagacccgtgcccgcccccaccaacctgaagatcaccgaggtgaccagcgagggcttcagaggcacctgggaccacggcgccagcgacgtgagcctgtacagaatcacctgggcccccttcggcagcagcgacaagatggagaccatcctgaacggcgacgagaacaccctggtgttcgagaacctgaaccccaacaccatctacgaggtgagcatcaccgccatctaccccgacgagagcgagagcgacgacctgatcggcagcgagagaaccctgcccatcctgaccacccaggcccccaagagcggccccagaaacctgcaggtgtacaacgccaccagcaacagcctgaccgtgaagtgggaccccgccagcggcagagtgcagaagtacagaatcacctaccagcccagcaccggcgagggcaacgagcagaccaccaccatcggcggcagacagaacagcgtggtgctgcagaagctgaagcccgacaccccctacaccatcaccgtgagcagcctgtaccccgacggcgagggcggcagaatgaccggcagaggcaagaccaagcccctgaacaccgtgagaaacctgagagtgtacgaccccagcaccagcaccctgaacgtgagatgggaccacgccgagggcaaccccagacagtacaagctgttctacgcccccgccgccggcggccccgaggagctggtgcccatccccggcaacaccaactacgccatcctgagaaacctgcagcccgacaccagctacaccgtgaccgtggtgcccgtgtacaccgagggcgacggcggcagaaccagcgacaccggcagaaccctgatgagaggcctggccagaaacgtgcaggtgtacaaccccacccccaacagcctggacgtgagatgggaccccgcccccggccccgtgctgcagtacagagtggtgtacagccccgtggacggcaccagacccagcgagagcatcgtggtgcccggcaacaccagaatggtgcacctggagagactgatccccgacaccctgtacagcgtgaacctggtggccctgtacagcgacggcgagggcaaccccagccccgcccagggcagaaccctgcccagaagcggccccagaaacctgagagtgttcggcgagaccaccaacagcctgagcgtggcctgggaccacgccgacggccccgtgcagcagtacagaatcatctacagccccaccgtgggcgaccccatcgacgagtacaccaccgtgcccggcagaagaaacaacgtgatcctgcagcccctgcagcccgacaccccctacaagatcaccgtgatcgccgtgtacgaggacggcgacggcggccacctgaccggcaacggcagaaccgtgggcctgctgcccccccagaacatccacatcagcgacgagtggtacaccagattcagagtgagctgggaccccagccccagccccgtgctgggctacaagatcgtgtacaagcccgtgggcagcaacgagcccatggaggccttcgtgggcgagatgaccagctacaccctgcacaacctgaaccccagcaccacctacgacgtgaacgtgtacgcccagtacgacagcggcctgagcgtgcccctgaccgaccagggcaccaccctgtacctgaacgtgaccgacctgaagacctaccagatcggctgggacaccttctgcgtgaagtggagcccccacagagccgccaccagctacagactgaagctgagccccgccgacggcaccagaggccaggagatcaccgtgagaggcagcgagaccagccactgcttcaccggcctgagccccgacaccgactacggcgtgaccgtgttcgtgcagacccccaacctggagggccccggcgtgagcgtgaaggagcacaccaccgtgaagcccaccgaggcccccaccgagccccccacccccccccccccccccaccatcccccccgccagagacgtgtgcaagggcgccaaggccgacatcgtgttcctgaccgacgccagctggagcatcggcgacgacaacttcaacaaggtggtgaagttcatcttcaacaccgtgggcggcttcgacgagatcagccccgccggcatccaggtgagcttcgtgcagtacagcgacgaggtgaagagcgagttcaagctgaacacctacaacgacaaggccctggccctgggcgccctgcagaacatcagatacagaggcggcaacaccagaaccggcaaggccctgaccttcatcaaggagaaggtgctgacctgggagagcggcatgagaaagaacgtgcccaaggtgctggtggtggtgaccgacggcagaagccaggacgaggtgaagaaggccgccctggtgatccagcagagcggcttcagcgtgttcgtggtgggcgtggccgacgtggactacaacgagctggccaacatcgccagcaagcccagcgagagacacgtgttcatcgtggacgacttcgagagcttcgagaagatcgaggacaacctgatcaccttcgtgtgcgagaccgccaccagcagctgccccctgatctacctggacggctacaccagccccggcttcaagatgctggaggcctacaacctgaccgagaagaacttcgccagcgtgcagggcgtgagcctggagagcggcagcttccccagctacagcgcctacagaatccagaagaacgccttcgtgaaccagcccaccgccgacctgcaccccaacggcctgccccccagctacaccatcatcctgctgttcagactgctgcccgagacccccagcgaccccttcgccatctggcagatcaccgacagagactacaagccccaggtgggcgtgatcgccgaccccagcagcaagaccctgagcttcttcaacaaggacaccagaggcgaggtgcagaccgtgaccttcgacaccgaggaggtgaagaccctgttctacggcagcttccacaagagagacgagggcaagtgccccgccttccccaacagctgcacctgcacccaggacagcgtgggcccccccggcccccccggccccgccggcggccccggcgccaagggccccagaggcgagagaggcatcagcggcgccatcggcccccccggccccagaggcgacatcggcccccccggcccccagggcccccccggcccccagggccccaacggcctgagcatccccggcgagcagggcagacagggcatgaagggcgacgccggcgagcccggcctgcccggcagaaccggcacccccggcctgcccggcccccccggccccatgggcccccccggcgacagaggcttcaccggcaaggacggcgccatgggccccagaggcccccccggcccccccggcagccccggcagccccggcgtgaccggccccagcggcaagcccggcaagcccggcgaccacggcagacccggccccagcggcctgaagggcgagaagggcgacagaggcgacatcgccagccagaacatgatgagagccgtggccagacaggtgtgcgagcagctgatcagcggccagatgaacagattcaaccagatgctgaaccagatccccaacgactaccagagcagcagaaaccagcccggcccccccggcccccccggcccccccggcagcgccggcgccagaggcgagcccggccccggcggcagacccggcttccccggcacccccggcatgcagggcccccccggcgagagaggcctgcccggcgagaagggcgagagaggcaccggcagcagcggccccagaggcctgcccggcccccccggcccccagggcgagagcagaaccggcccccccggcagcaccggcagcagaggcccccccggcccccccggcagacccggcaacagcggcatcagaggcccccccggcccccccggctactgcgacagcagccagtgcgccagcatcccctacaacggccagggctaccccggcagcggctag

SEQ ID NO: 1893 - DNA, 2088 bp, Homo sapiens
atggtggccgagagaacccacaaggccgccgccaccggcgccagaggccccggcgagctgggcgcccccggcaccgtggccctggtggccgccagagccgagagaggcgccagactgcccagccccggcagctgcggcctgctgaccctggccctgtgcagcctggccctgagcctgctggcccacttcagaaccgccgagctgcaggccagagtgctgagactggaggccgagagaggcgagcagcagatggagaccgccatcctgggcagagtgaaccagctgctggacgagaagtggaagctgcacagcagaagaagaagagaggcccccaagaccagccccggctgcaactgcccccccggcccccccggccccaccggcagacccggcctgcccggcgacaagggcgccatcggcatgcccggcagagtgggcagccccggcgacgccggcctgagcatcatcggccccagaggcccccccggccagcccggcaccagaggcttccccggcttccccggccccatcggcctggacggcaagcccggccaccccggccccaagggcgacatgggcctgaccggcccccccggccagcccggcccccagggccagaagggcgagaagggccagtgcggcgagtacccccacagagagtgcctgagcagcatgcccgccgccctgagaagcagccagatcatcgccctgaagggcgagcagagccaggccagcatccagggcccccccggcccccccggcccccccggccccagcggccccctgggccaccccggcctgcccggccccatgggcccccccggcctgcccggcccccccggccccaagggcgaccccggcatccagggctaccacggcagaaagggcgagagaggcatgcccggcatgcccggcaagcacggcgccaagggcgcccccggcatcgccgtggccggcatgaagggcgagcccggcatccccggcaccaagggcgagaagggcgccgagggcagccccggcctgcccggcctgctgggccagaagggcgagaagggcgacgccggcaacagcatcggcggcggcagaggcgagcccggcccccccggcctgcccggcccccccggccccaagggcgaggccggcgtggacggccaggtgggcccccccggccagcccggcgacaagggcgagagaggcgccgccggcgagcagggccccgacggccccaagggcagcaagggcgagcccggcaagggcgagatggtggactacaacggcaacatcaacgaggccctgcaggagatcagaaccctggccctgatgggcccccccggcctgcccggccagatcggcccccccggcgcccccggcatccccggccagaagggcgagatcggcctgcccggcccccccggccacgacggcgagaagggccccagaggcaagcccggcgacatgggcccccccggcccccagggcccccccggcaaggacggcccccccggcgtgaagggcgagaacggccaccccggcagccccggcgagaagggcgagaagggcgagaccggccaggccggcagccccggcgagaagggcgaggccggcgagaagggcaaccccggcgccgaggtgcccggcctgcccggccccgagggcccccccggcccccccggcctgcagggcgtgcccggccccaagggcgaggccggcctggacggcgccaagggcgagaagggcttccagggcgagaagggcgacagaggccccctgggcctgcccggcgccagcggcctggacggcagacccggcccccccggcacccccggccccatcggcgtgcccggccccgccggccccaagggcgagagaggcagcaagggcgaccccggcatgaccggccccaccggcgccgccggcctgcccggcctgcacggcccccccggcgacaagggcaacagaggcgagagaggcaagaagggcagcagaggccccaagggcgacaagggcgaccagggcgcccccggcctggacgccccctgccccctgggcgaggacggcctgcccgtgcagggctgctggaacaagtag

SEQ ID NO: 1894 - DNA, 2154 bp, Homo sapiens
atggtggccgagagaacccacaaggccgccgccaccggcgccagaggccccggcgagctgggcgcccccggcaccgtggccctggtggccgccagagccgagagaggcgccagactgcccagccccggcagctgcggcctgctgaccctggccctgtgcagcctggccctgagcctgctggcccacttcagaaccgccgagctgcaggccagagtgctgagactggaggccgagagaggcgagcagcagatggagaccgccatcctgggcagagtgaaccagctgctggacgagaagtggaagctgcacagcagaagaagaagagaggcccccaagaccagccccggctgcaactgcccccccgccttccagggccccaccggcagacccggcctgcccggcgacaagggcgccatcggcatgcccggcagagtgggcagccccggcgacgccggcctgagcatcatcggccccagaggcccccccggccagcccggcaccagaggcttccccggcttccccggccccatcggcctggacggcaagcccggccaccccggccccaagggcgacatgggcctgaccggcccccccggccagcccggcccccagggccagaagggcgagaagggccagtgcggcgagtacccccacagagagtgcctgagcagcatgcccgccgccctgagaagcagccagatcatcgccctgaagctgctgcccctgctgaacagcgtgagactggcccccccccccgtgatcaagagaagaaccttccagggcgagcagagccaggccagcatccagggcccccccggcccccccggcccccccggccccagcggccccctgggccaccccggcctgcccggccccatgggcccccccggcctgcccggcccccccggccccaagggcgaccccggcatccagggctaccacggcagaaagggcgagagaggcatgcccggcatgcccggcaagcacggcgccaagggcgcccccggcatcgccgtggccggcatgaagggcgagcccggcatccccggcaccaagggcgagaagggcgccgagggcagccccggcctgcccggcctgctgggccagaagggcgagaagggcgacgccggcaacagcatcggcggcggcagaggcgagcccggcccccccggcctgcccggcccccccggccccaagggcgaggccggcgtggacggccaggtgggcccccccggccagcccggcgacaagggcgagagaggcgccgccggcgagcagggccccgacggccccaagggcagcaagggcgagcccggcaagggcgagatggtggactacaacggcaacatcaacgaggccctgcaggagatcagaaccctggccctgatgggcccccccggcctgcccggccagatcggcccccccggcgcccccggcatccccggccagaagggcgagatcggcctgcccggcccccccggccacgacggcgagaagggccccagaggcaagcccggcgacatgggcccccccggcccccagggcccccccggcaaggacggcccccccggcgtgaagggcgagaacggccaccccggcagccccggcgagaagggcgagaagggcgagaccggccaggccggcagccccggcgagaagggcgaggccggcgagaagggcaaccccggcgccgaggtgcccggcctgcccggccccgagggcccccccggcccccccggcctgcagggcgtgcccggccccaagggcgaggccggcctggacggcgccaagggcgagaagggcttccagggcgagaagggcgacagaggccccctgggcctgcccggcgccagcggcctggacggcagacccggcccccccggcacccccggccccatcggcgtgcccggccccgccggccccaagggcgagagaggcagcaagggcgaccccggcatgaccggccccaccggcgccgccggcctgcccggcctgcacggcccccccggcgacaagggcaacagaggcgagagaggcaagaagggcagcagaggccccaagggcgacaagggcgaccagggcgcccccggcctggacgccccctgccccctgggcgaggacggcctgcccgtgcagggctgctggaacaagtag

SEQ ID NO: 1895 - DNA, 2052 bp, Homo sapiens
atggtggccgagagaacccacaaggccgccgccaccggcgccagaggccccggcgagctgggcgcccccggcaccgtggccctggtggccgccagagccgagagaggcgccagactgcccagccccggcagctgcggcctgctgaccctggccctgtgcagcctggccctgagcctgctggcccacttcagaaccgccgagctgcaggccagagtgctgagactggaggccgagagaggcgagcagcagatggagaccgccatcctgggcagagtgaaccagctgctggacgagaagtggaagctgcacagcagaagaagaagagaggcccccaagaccagccccggctgcaactgcccccccggcccccccggccccaccggcagacccggcctgcccggcgacaagggcgccatcggcatgcccggcagagtgggcagccccggcgacgccggcctgagcatcatcggccccagaggcccccccggccagcccggcaccagaggcttccccggcttccccggccccatcggcctggacggcaagcccggccaccccggccccaagggcgacatgggcctgaccggcccccccggccagcccggcccccagggccagaagggcgagaagggccagtgcggcgagtacccccacagagagtgcctgagcagcatgcccgccgccctgagaagcagccagatcatcgccctgaagggcgagcagagccaggccagcatccagggcccccccggcccccccggcccccccggccccagcggccccctgggccaccccggcctgcccggccccatgggcccccccggcctgcccggcccccccggccccaagggcgaccccggcatccagggctaccacggcagaaagggcgagagaggcatgcccggcatgcccggcaagcacggcgccaagggcgcccccggcatcgccgtggccggcatgaagggcgagcccggcatccccggcaccaagggcgagaagggcgccgagggcagccccggcctgcccggcctgctgggccagaagggcgagaagggcgacgccggcaacagcatcggcggcggcagaggcgagcccggcccccccggcctgcccggcccccccggccccaagggcgaggccggcgtggacggccaggtgggcccccccggccagcccggcgacaagggcgagagaggcgccgccggcgagcagggccccgacggccccaagggcagcaagggcgagcccggcaagggcgagatggtggactacaacggcaacatcaacgaggccctgcaggagatcagaaccctggccctgatgggcccccccggcctgcccggccagatcggcccccccggcgcccccggcatccccggccagaagggcgagatcggcctgcccggcccccccggccacgacggcgagaagggccccagaggcaagcccggcgacatgggcccccccggcccccagggcccccccggcaaggacggcccccccggcgtgaagggcgagaacggccaccccggcagccccggcgagaagggcgagaagggcgagaccggccaggccggcagccccggcgagaagggcgaggccggcgagaagggcaaccccggcgccgaggtgcccggcctgcccggccccgagggcccccccggcccccccggcctgcagggcgtgcccggccccaagggcgaggccggcctggacggcgccaagggcgagaagggcttccagggcgagaagggcgacagaggccccctgggcctgcccggcacccccggccccatcggcgtgcccggccccgccggccccaagggcgagagaggcagcaagggcgaccccggcatgaccggccccaccggcgccgccggcctgcccggcctgcacggcccccccggcgacaagggcaacagaggcgagagaggcaagaagggcagcagaggccccaagggcgacaagggcgaccagggcgcccccggcctggacgccccctgccccctgggcgaggacggcctgcccgtgcagggctgctggaacaagtag

SEQ ID NO: 1896 - DNA, 2067 bp, Homo sapiens
atggtggccgagagaacccacaaggccgccgccaccggcgccagaggccccggcgagctgggcgcccccggcaccgtggccctggtggccgccagagccgagagaggcgccagactgcccagccccggcagctgcggcctgctgaccctggccctgtgcagcctggccctgagcctgctggcccacttcagaaccgccgagctgcaggccagagtgctgagactggaggccgagagaggcgagcagcagatggagaccgccatcctgggcagagtgaaccagctgctggacgagaagtggaagctgcacagcagaagaagaagagaggcccccaagaccagccccggctgcaactgcccccccgccttccagggccccaccggcagacccggcctgcccggccagcccggcaccagaggcttccccggcttccccggccccatcggcctggacggcaagcccggccaccccggccccaagggcgacatgggcctgaccggcccccccggccagcccggcccccagggccagaagggcgagaagggccagtgcggcgagtacccccacagagagtgcctgagcagcatgcccgccgccctgagaagcagccagatcatcgccctgaagctgctgcccctgctgaacagcgtgagactggcccccccccccgtgatcaagagaagaaccttccagggcgagcagagccaggccagcatccagggcccccccggcccccccggcccccccggccccagcggccccctgggccaccccggcctgcccggccccatgggcccccccggcctgcccggcccccccggccccaagggcgaccccggcatccagggctaccacggcagaaagggcgagagaggcatgcccggcatgcccggcaagcacggcgccaagggcgcccccggcatcgccgtggccggcatgaagggcgagcccggcatccccggcaccaagggcgagaagggcgccgagggcagccccggcctgcccggcctgctgggccagaagggcgagaagggcgacgccggcaacagcatcggcggcggcagaggcgagcccggcccccccggcctgcccggcccccccggccccaagggcgaggccggcgtggacggccaggtgggcccccccggccagcccggcgacaagggcgagagaggcgccgccggcgagcagggccccgacggccccaagggcagcaagggcgagcccggcaagggcgagatggtggactacaacggcaacatcaacgaggccctgcaggagatcagaaccctggccctgatgggcccccccggcctgcccggccagatcggcccccccggcgcccccggcatccccggccagaagggcgagatcggcctgcccggcccccccggccacgacggcgagaagggccccagaggcaagcccggcgacatgggcccccccggcccccagggcccccccggcaaggacggcccccccggcgtgaagggcgagaacggccaccccggcagccccggcgagaagggcgagaagggcgagaccggccaggccggcagccccggcgagaagggcgaggccggcgagaagggcaaccccggcgccgaggtgcccggcctgcccggccccgagggcccccccggcccccccggcctgcagggcgtgcccggccccaagggcgaggccggcctggacggcgccaagggcgagaagggcttccagggcgagaagggcgacagaggccccctgggcctgcccggcgccagcggcctggacggcagacccggcccccccggcacccccggccccatcggcgtgcccggccccgccggccccaagggcgagagaggcagcaagggcgaccccggcatgaccggccccaccggcgccgccggcctgcccggcctgcacggcccccccggcgacaagggcaacagaggcgagagaggcaagaagggcagcagaggccccaagggcgacaagggcgaccagggcgcccccggcctggacgccccctgccccctgggcgaggacggcctgcccgtgcagggctgctggaacaagtag

SEQ ID NO: 1897 - DNA, 2088 bp, Homo sapiens
atggtggccgagagaacccacaaggccgccgccaccggcgccagaggccccggcgagctgggcgcccccggcaccgtggccctggtggccgccagagccgagagaggcgccagactgcccagccccggcagctgcggcctgctgaccctggccctgtgcagcctggccctgagcctgctggcccacttcagaaccgccgagctgcaggccagagtgctgagactggaggccgagagaggcgagcagcagatggagaccgccatcctgggcagagtgaaccagctgctggacgagaagtggaagctgcacagcagaagaagaagagaggcccccaagaccagccccggctgcaactgcccccccgccttccagggccccaccggcagacccggcctgcccggcgacaagggcgccatcggcatgcccggcagagtgggcagccccggcgacgccggcctgagcatcatcggccccagaggcccccccggccagcccggcaccagaggcttccccggcttccccggccccatcggcctggacggcaagcccggccaccccggccccaagggcgacatgggcctgaccggcccccccggccagcccggcccccagggccagaagggcgagaagggccagtgcggcgagtacccccacagagagtgcctgagcagcatgcccgccgccctgagaagcagccagatcatcgccctgaagggcgagcagagccaggccagcatccagggcccccccggcccccccggcccccccggccccagcggccccctgggccaccccggcctgcccggccccatgggcccccccggcctgcccggcccccccggccccaagggcgaccccggcatccagggctaccacggcagaaagggcgagagaggcatgcccggcatgcccggcaagcacggcgccaagggcgcccccggcatcgccgtggccggcatgaagggcgagcccggcatccccggcaccaagggcgagaagggcgccgagggcagccccggcctgcccggcctgctgggccagaagggcgagaagggcgacgccggcaacagcatcggcggcggcagaggcgagcccggcccccccggcctgcccggcccccccggccccaagggcgaggccggcgtggacggccaggtgggcccccccggccagcccggcgacaagggcgagagaggcgccgccggcgagcagggccccgacggccccaagggcagcaagggcgagcccggcaagggcgagatggtggactacaacggcaacatcaacgaggccctgcaggagatcagaaccctggccctgatgggcccccccggcctgcccggccagatcggcccccccggcgcccccggcatccccggccagaagggcgagatcggcctgcccggcccccccggccacgacggcgagaagggccccagaggcaagcccggcgacatgggcccccccggcccccagggcccccccggcaaggacggcccccccggcgtgaagggcgagaacggccaccccggcagccccggcgagaagggcgagaagggcgagaccggccaggccggcagccccggcgagaagggcgaggccggcgagaagggcaaccccggcgccgaggtgcccggcctgcccggccccgagggcccccccggcccccccggcctgcagggcgtgcccggccccaagggcgaggccggcctggacggcgccaagggcgagaagggcttccagggcgagaagggcgacagaggccccctgggcctgcccggcgccagcggcctggacggcagacccggcccccccggcacccccggccccatcggcgtgcccggccccgccggccccaagggcgagagaggcagcaagggcgaccccggcatgaccggccccaccggcgccgccggcctgcccggcctgcacggcccccccggcgacaagggcaacagaggcgagagaggcaagaagggcagcagaggccccaagggcgacaagggcgaccagggcgcccccggcctggacgccccctgccccctgggcgaggacggcctgcccgtgcagggctgctggaacaagtag

SEQ ID NO: 1898 - DNA, 2097 bp, Homo sapiens
atggtggccgagagaacccacaaggccgccgccaccggcgccagaggccccggcgagctgggcgcccccggcaccgtggccctggtggccgccagagccgagagaggcgccagactgcccagccccggcagctgcggcctgctgaccctggccctgtgcagcctggccctgagcctgctggcccacttcagaaccgccgagctgcaggccagagtgctgagactggaggccgagagaggcgagcagcagatggagaccgccatcctgggcagagtgaaccagctgctggacgagaagtggaagctgcacagcagaagaagaagagaggcccccaagaccagccccggctgcaactgcccccccgccttccagggccccaccggcagacccggcctgcccggcgacaagggcgccatcggcatgcccggcagagtgggcagccccggcgacgccggcctgagcatcatcggccccagaggcccccccggccagcccggcaccagaggcttccccggcttccccggccccatcggcctggacggcaagcccggccaccccggccccaagggcgacatgggcctgaccggcccccccggccagcccggcccccagggccagaagggcgagaagggccagtgcggcgagtacccccacagactgctgcccctgctgaacagcgtgagactggcccccccccccgtgatcaagagaagaaccttccagggcgagcagagccaggccagcatccagggcccccccggcccccccggcccccccggccccagcggccccctgggccaccccggcctgcccggccccatgggcccccccggcctgcccggcccccccggccccaagggcgaccccggcatccagggctaccacggcagaaagggcgagagaggcatgcccggcatgcccggcaagcacggcgccaagggcgcccccggcatcgccgtggccggcatgaagggcgagcccggcatccccggcaccaagggcgagaagggcgccgagggcagccccggcctgcccggcctgctgggccagaagggcgagaagggcgacgccggcaacagcatcggcggcggcagaggcgagcccggcccccccggcctgcccggcccccccggccccaagggcgaggccggcgtggacggccaggtgggcccccccggccagcccggcgacaagggcgagagaggcgccgccggcgagcagggccccgacggccccaagggcagcaagggcgagcccggcaagggcgagatggtggactacaacggcaacatcaacgaggccctgcaggagatcagaaccctggccctgatgggcccccccggcctgcccggccagatcggcccccccggcgcccccggcatccccggccagaagggcgagatcggcctgcccggcccccccggccacgacggcgagaagggccccagaggcaagcccggcgacatgggcccccccggcccccagggcccccccggcaaggacggcccccccggcgtgaagggcgagaacggccaccccggcagccccggcgagaagggcgagaagggcgagaccggccaggccggcagccccggcgagaagggcgaggccggcgagaagggcaaccccggcgccgaggtgcccggcctgcccggccccgagggcccccccggcccccccggcctgcagggcgtgcccggccccaagggcgaggccggcctggacggcgccaagggcgagaagggcttccagggcgagaagggcgacagaggccccctgggcctgcccggcgccagcggcctggacggcagacccggcccccccggcacccccggccccatcggcgtgcccggccccgccggccccaagggcgagagaggcagcaagggcgaccccggcatgaccggccccaccggcgccgccggcctgcccggcctgcacggcccccccggcgacaagggcaacagaggcgagagaggcaagaagggcagcagaggccccaagggcgacaagggcgaccagggcgcccccggcctggacgccccctgccccctgggcgaggacggcctgcccgtgcagggctgctggaacaagtag

SEQ ID NO: 1899 - DNA, 1938 bp, Homo sapiens
atggtggccgagagaacccacaaggccgccgccaccggcgccagaggccccggcgagctgggcgcccccggcaccgtggccctggtggccgccagagccgagagaggcgccagactgcccagccccggcagctgcggcctgctgaccctggccctgtgcagcctggccctgagcctgctggcccacttcagaaccgccgagctgcaggccagagtgctgagactggaggccgagagaggcgagcagcagatggagaccgccatcctgggcagagtgaaccagctgctggacgagaagtggaagctgcacagcagaagaagaagagaggcccccaagaccagccccggctgcaactgcccccccggcccccccggccagcccggcaccagaggcttccccggcttccccggccccatcggcctggacggcaagcccggccaccccggccccaagggcgacatgggcctgaccggcccccccggccagcccggcccccagggccagaagggcgagaagggccagtgcggcgagtacccccacagactgctgcccctgctgaacagcgtgagactggcccccccccccgtgatcaagagaagaaccttccagggcgagcagagccaggccagcatccagggcccccccggcccccccggcccccccggccccagcggccccctgggccaccccggcctgcccggccccatgggcccccccggcctgcccggcccccccggccccaagggcgaccccggcatccagggctaccacggcagaaagggcgagagaggcatgcccggcatgcccggcaagcacggcgccaagggcgcccccggcatcgccgtggccggcatgaagggcgagcccggcatccccggcaccaagggcgagaagggcgccgagggcagccccggcctgcccggcctgctgggccagaagggcgagaagggcgacgccggcaacagcatcggcggcggcagaggcgagcccggcccccccggcctgcccggcccccccggccccaagggcgaggccggcgtggacggccaggtgggcccccccggccagcccggcgacaagggcgagagaggcgccgccggcgagcagggccccgacggccccaagggcagcaagggcgagcccggcaagggcgagatggtggactacaacggcaacatcaacgaggccctgcagcccagcagaggccccgccctgagaggcccccccggcctgcccggccagatcggcccccccggcgcccccggcatccccggccagaagggcgagatcggcctgcccggcccccccggccacgacggcgagaagggccccagaggcaagcccggcgacatgggcccccccggcccccagggcccccccggcaaggacggcccccccggcgtgaagggcgagaacggccaccccggcagccccggcgagaagggcgagaagggcgagaccggccaggccggcagccccgtgcccggcctgcccggccccgagggcccccccggcccccccggcctgcagggcgtgcccggccccaagggcgaggccggcctggacggcgccaagggcgagaagggcttccagggcgagaagggcgacagaggccccctgggcctgcccggcgccagcggcctggacggcagacccggcccccccggcacccccggccccatcggcgtgcccggccccgccggccccaagggcgagagaggcagcaagggcgaccccggcatgaccggccccaccggcgccgccggcctgcccggcctgcacggcccccccggcgacaagggcaacagaggcgagagaggcaagaagggcagcagaggccccaagggcgacaagggcgaccagggcgcccccggcctggacgccccctgccccctgggcgaggacggcctgcccgtgcagggctgctggaacaagtag

SEQ ID NO: 1900 - DNA, 2109 bp, Homo sapiens
atggtggccgagagaacccacaaggccgccgccaccggcgccagaggccccggcgagctgggcgcccccggcaccgtggccctggtggccgccagagccgagagaggcgccagactgcccagccccggcagctgcggcctgctgaccctggccctgtgcagcctggccctgagcctgctggcccacttcagaaccgccgagctgcaggccagagtgctgagactggaggccgagagaggcgagcagcagatggagaccgccatcctgggcagagtgaaccagctgctggacgagaagtggaagctgcacagcagaagaagaagagaggcccccaagaccagccccggctgcaactgcccccccgccttccagggccccaccggcagacccggcctgcccggcgacaagggcgccatcggcatgcccggcagagtgggcagccccggcgacgccggcctgagcatcatcggccccagaggcccccccggccagcccggcaccagaggcttccccggcttccccggccccatcggcctggacggcaagcccggccaccccggccccaagggcgacatgggcctgaccggcccccccggccagcccggcccccagggccagaagggcgagaagggccagtgcggcgagtacccccacagagagtgcctgagcagcatgcccgccgccctgagaagcagccagatcatcgccctgaagctgctgcccctgctgaacagcgtgagactggcccccccccccgtgatcaagagaagaaccttccagggcgagcagagccaggccagcatccagggcccccccggcccccccggcccccccggccccagcggccccctgggccaccccggcctgcccggccccatgggcccccccggcctgcccggcccccccggccccaagggcgaccccggcatccagggctaccacggcagaaagggcgagagaggcatgcccggcatgcccggcaagcacggcgccaagggcgcccccggcatcgccgtggccggcatgaagggcgagcccggcatccccggcaccaagggcgagaagggcgccgagggcagccccggcctgcccggcctgctgggccagaagggcgagaagggcgacgccggcaacagcatcggcggcggcagaggcgagcccggcccccccggcctgcccggcccccccggccccaagggcgaggccggcgtggacggccaggtgggcccccccggccagcccggcgacaagggcgagagaggcgccgccggcgagcagggccccgacggccccaagggcagcaagggcgagcccggcaagggcgagatggtggactacaacggcaacatcaacgaggccctgcaggagatcagaaccctggccctgatgggcccccccggcctgcccggccagatcggcccccccggcgcccccggcatccccggccagaagggcgagatcggcctgcccggcccccccggccacgacggcgagaagggccccagaggcaagcccggcgacatgggcccccccggcccccagggcccccccggcaaggacggcccccccggcgtgaagggcgagaacggccaccccggcagccccggcgagaagggcgagaagggcgagaccggccaggccggcagccccgtgcccggcctgcccggccccgagggcccccccggcccccccggcctgcagggcgtgcccggccccaagggcgaggccggcctggacggcgccaagggcgagaagggcttccagggcgagaagggcgacagaggccccctgggcctgcccggcgccagcggcctggacggcagacccggcccccccggcacccccggccccatcggcgtgcccggccccgccggccccaagggcgagagaggcagcaagggcgaccccggcatgaccggccccaccggcgccgccggcctgcccggcctgcacggcccccccggcgacaagggcaacagaggcgagagaggcaagaagggcagcagaggccccaagggcgacaagggcgaccagggcgcccccggcctggacgccccctgccccctgggcgaggacggcctgcccgtgcagggctgctggaacaagtag

SEQ ID NO: 1901 - DNA, 2112 bp, Homo sapiens
atggtggccgagagaacccacaaggccgccgccaccggcgccagaggccccggcgagctgggcgcccccggcaccgtggccctggtggccgccagagccgagagaggcgccagactgcccagccccggcagctgcggcctgctgaccctggccctgtgcagcctggccctgagcctgctggcccacttcagaaccgccgagctgcaggccagagtgctgagactggaggccgagagaggcgagcagcagatggagaccgccatcctgggcagagtgaaccagctgctggacgagaagtggaagctgcacagcagaagaagaagagaggcccccaagaccagccccggctgcaactgcccccccggcccccccggccccaccggcagacccggcctgcccggcgacaagggcgccatcggcatgcccggcagagtgggcagccccggcgacgccggcctgagcatcatcggccccagaggcccccccggccagcccggcaccagaggcttccccggcttccccggccccatcggcctggacggcaagcccggccaccccggccccaagggcgacatgggcctgaccggcccccccggccagcccggcccccagggccagaagggcgagaagggccagtgcggcgagtacccccacagagagtgcctgagcagcatgcccgccgccctgagaagcagccagatcatcgccctgaagctgctgcccctgctgaacagcgtgagactggcccccccccccgtgatcaagagaagaaccttccagggcgagcagagccaggccagcatccagggcccccccggcccccccggcccccccggccccagcggccccctgggccaccccggcctgcccggccccatgggcccccccggcctgcccggcccccccggccccaagggcgaccccggcatccagggctaccacggcagaaagggcgagagaggcatgcccggcatgcccggcaagcacggcgccaagggcgcccccggcatcgccgtggccggcatgaagggcgagcccggcatccccggcaccaagggcgagaagggcgccgagggcagccccggcctgcccggcctgctgggccagaagggcgagaagggcgacgccggcaacagcatcggcggcggcagaggcgagcccggcccccccggcctgcccggcccccccggccccaagggcgaggccggcgtggacggccaggtgggcccccccggccagcccggcgacaagggcgagagaggcgccgccggcgagcagggccccgacggccccaagggcagcaagggcgagcccggcaagggcgagatggtggactacaacggcaacatcaacgaggccctgcagcccagcagaggccccgccctgagaggcccccccggcctgcccggccagatcggcccccccggcgcccccggcatccccggccagaagggcgagatcggcctgcccggcccccccggccacgacggcgagaagggccccagaggcaagcccggcgacatgggcccccccggcccccagggcccccccggcaaggacggcccccccggcgtgaagggcgagaacggccaccccggcagccccggcgagaagggcgagaagggcgagaccggccaggccggcagccccggcgagaagggcgaggccggcgagaagggcaaccccggcgccgagggcctgcagggcgtgcccggccccaagggcgaggccggcctggacggcgccaagggcgagaagggcttccagggcgagaagggcgacagaggccccctgggcctgcccggcgccagcggcctggacggcagacccggcccccccggcacccccggccccatcggcgtgcccggccccgccggccccaagggcgagagaggcagcaagggcgaccccggcatgaccggccccaccggcgccgccggcctgcccggcctgcacggcccccccggcgacaagggcaacagaggcgagagaggcaagaagggcagcagaggccccaagggcgacaagggcgaccagggcgcccccggcctggacgccccctgccccctgggcgaggacggcctgcccgtgcagggctgctggaacaagtag

SEQ ID NO: 1902 - DNA, 2076 bp, Homo sapiens
atggtggccgagagaacccacaaggccgccgccaccggcgccagaggccccggcgagctgggcgcccccggcaccgtggccctggtggccgccagagccgagagaggcgccagactgcccagccccggcagctgcggcctgctgaccctggccctgtgcagcctggccctgagcctgctggcccacttcagaaccgccgagctgcaggccagagtgctgagactggaggccgagagaggcgagcagcagatggagaccgccatcctgggcagagtgaaccagctgctggacgagaagtggaagctgcacagcagaagaagaagagaggcccccaagaccagccccggctgcaactgcccccccggcccccccggccccaccggcagacccggcctgcccggcgacaagggcgccatcggcatgcccggcagagtgggcagccccggcgacgccggcctgagcatcatcggccccagaggcccccccggccagcccggcaccagaggcttccccggcttccccggccccatcggcctggacggcaagcccggccaccccggccccaagggcgacatgggcctgaccggcccccccggccagcccggcccccagggccagaagggcgagaagggccagtgcggcgagtacccccacagagagtgcctgagcagcatgcccgccgccctgagaagcagccagatcatcgccctgaagctgctgcccctgctgaacagcgtgagactggcccccccccccgtgatcaagagaagaaccttccagggcgagcagagccaggccagcatccagggcccccccggcccccccggcccccccggccccagcggccccctgggccaccccggcctgcccggccccatgggcccccccggcctgcccggcccccccggccccaagggcgaccccggcatccagggctaccacggcagaaagggcgagagaggcatgcccggcatgcccggcaagcacggcgccaagggcgcccccggcatcgccgtggccggcatgaagggcgagcccggcatccccggcaccaagggcgagaagggcgccgagggcagccccggcctgcccggcctgctgggccagaagggcgagaagggcgacgccggcaacagcatcggcggcggcagaggcgagcccggcccccccggcctgcccggcccccccggccccaagggcgaggccggcgtggacggccaggtgggcccccccggccagcccggcgacaagggcgagagaggcgccgccggcgagcagggccccgacggccccaagggcagcaagggcgagcccggcaagggcgagatggtggactacaacggcaacatcaacgaggccctgcagcccagcagaggccccgccctgagaggcccccccggcctgcccggccagatcggcccccccggcgcccccggcatccccggccagaagggcgagatcggcctgcccggcccccccggccacgacggcgagaagggccccagaggcaagcccggcgacatgggcccccccggcccccagggcccccccggcaaggacggcccccccggcgtgaagggcgagaacggccaccccggcagccccggcgagaagggcgagaagggcgagaccggccaggccggcagccccggcgagaagggcgaggccggcgagaagggcaaccccggcgccgagggcctgcagggcgtgcccggccccaagggcgaggccggcctggacggcgccaagggcgagaagggcttccagggcgagaagggcgacagaggccccctgggcctgcccggcacccccggccccatcggcgtgcccggccccgccggccccaagggcgagagaggcagcaagggcgaccccggcatgaccggccccaccggcgccgccggcctgcccggcctgcacggcccccccggcgacaagggcaacagaggcgagagaggcaagaagggcagcagaggccccaagggcgacaagggcgaccagggcgcccccggcctggacgccccctgccccctgggcgaggacggcctgcccgtgcagggctgctggaacaagtag

SEQ ID NO: 1903 - DNA, 2118 bp, Homo sapiens
atggtggccgagagaacccacaaggccgccgccaccggcgccagaggccccggcgagctgggcgcccccggcaccgtggccctggtggccgccagagccgagagaggcgccagactgcccagccccggcagctgcggcctgctgaccctggccctgtgcagcctggccctgagcctgctggcccacttcagaaccgccgagctgcaggccagagtgctgagactggaggccgagagaggcgagcagcagatggagaccgccatcctgggcagagtgaaccagctgctggacgagaagtggaagctgcacagcagaagaagaagagaggcccccaagaccagccccggctgcaactgcccccccgccttccagggccccaccggcagacccggcctgcccggcagccccggcgacgccggcctgagcatcatcggccccagaggcccccccggccagcccggcaccagaggcttccccggcttccccggccccatcggcctggacggcaagcccggccaccccggccccaagggcgacatgggcctgaccggcccccccggccagcccggcccccagggccagaagggcgagaagggccagtgcggcgagtacccccacagagagtgcctgagcagcatgcccgccgccctgagaagcagccagatcatcgccctgaagctgctgcccctgctgaacagcgtgagactggcccccccccccgtgatcaagagaagaaccttccagggcgagcagagccaggccagcatccagggcccccccggcccccccggcccccccggccccagcggccccctgggccaccccggcctgcccggccccatgggcccccccggcctgcccggcccccccggccccaagggcgaccccggcatccagggctaccacggcagaaagggcgagagaggcatgcccggcatgcccggcaagcacggcgccaagggcgcccccggcatcgccgtggccggcatgaagggcgagcccggcatccccggcaccaagggcgagaagggcgccgagggcagccccggcctgcccggcctgctgggccagaagggcgagaagggcgacgccggcaacagcatcggcggcggcagaggcgagcccggcccccccggcctgcccggcccccccggccccaagggcgaggccggcgtggacggccaggtgggcccccccggccagcccggcgacaagggcgagagaggcgccgccggcgagcagggccccgacggccccaagggcagcaagggcgagcccggcaagggcgagatggtggactacaacggcaacatcaacgaggccctgcaggagatcagaaccctggccctgatgggcccccccggcctgcccggccagatcggcccccccggcgcccccggcatccccggccagaagggcgagatcggcctgcccggcccccccggccacgacggcgagaagggccccagaggcaagcccggcgacatgggcccccccggcccccagggcccccccggcaaggacggcccccccggcgtgaagggcgagaacggccaccccggcagccccggcgagaagggcgagaagggcgagaccggccaggccggcagccccggcgagaagggcgaggccggcgagaagggcaaccccggcgccgaggtgcccggcctgcccggccccgagggcccccccggcccccccggcctgcagggcgtgcccggccccaagggcgaggccggcctggacggcgccaagggcgagaagggcttccagggcgagaagggcgacagaggccccctgggcctgcccggcgccagcggcctggacggcagacccggcccccccggcacccccggccccatcggcgtgcccggccccgccggccccaagggcgagagaggcagcaagggcgaccccggcatgaccggccccaccggcgccgccggcctgcccggcctgcacggcccccccggcgacaagggcaacagaggcgagagaggcaagaagggcagcagaggccccaagggcgacaagggcgaccagggcgcccccggcctggacgccccctgccccctgggcgaggacggcctgcccgtgcagggctgctggaacaagtag

SEQ ID NO: 1904 - DNA, 2154 bp, Homo sapiens
atggtggccgagagaacccacaaggccgccgccaccggcgccagaggccccggcgagctgggcgcccccggcaccgtggccctggtggccgccagagccgagagaggcgccagactgcccagccccggcagctgcggcctgctgaccctggccctgtgcagcctggccctgagcctgctggcccacttcagaaccgccgagctgcaggccagagtgctgagactggaggccgagagaggcgagcagcagatggagaccgccatcctgggcagagtgaaccagctgctggacgagaagtggaagctgcacagcagaagaagaagagaggcccccaagaccagccccggctgcaactgcccccccggcccccccggccccaccggcagacccggcctgcccggcgacaagggcgccatcggcatgcccggcagagtgggcagccccggcgacgccggcctgagcatcatcggccccagaggcccccccggccagcccggcaccagaggcttccccggcttccccggccccatcggcctggacggcaagcccggccaccccggccccaagggcgacatgggcctgaccggcccccccggccagcccggcccccagggccagaagggcgagaagggccagtgcggcgagtacccccacagagagtgcctgagcagcatgcccgccgccctgagaagcagccagatcatcgccctgaagctgctgcccctgctgaacagcgtgagactggcccccccccccgtgatcaagagaagaaccttccagggcgagcagagccaggccagcatccagggcccccccggcccccccggcccccccggccccagcggccccctgggccaccccggcctgcccggccccatgggcccccccggcctgcccggcccccccggccccaagggcgaccccggcatccagggctaccacggcagaaagggcgagagaggcatgcccggcatgcccggcaagcacggcgccaagggcgcccccggcatcgccgtggccggcatgaagggcgagcccggcatccccggcaccaagggcgagaagggcgccgagggcagccccggcctgcccggcctgctgggccagaagggcgagaagggcgacgccggcaacagcatcggcggcggcagaggcgagcccggcccccccggcctgcccggcccccccggccccaagggcgaggccggcgtggacggccaggtgggcccccccggccagcccggcgacaagggcgagagaggcgccgccggcgagcagggccccgacggccccaagggcagcaagggcgagcccggcaagggcgagatggtggactacaacggcaacatcaacgaggccctgcaggagatcagaaccctggccctgatgggcccccccggcctgcccggccagatcggcccccccggcgcccccggcatccccggccagaagggcgagatcggcctgcccggcccccccggccacgacggcgagaagggccccagaggcaagcccggcgacatgggcccccccggcccccagggcccccccggcaaggacggcccccccggcgtgaagggcgagaacggccaccccggcagccccggcgagaagggcgagaagggcgagaccggccaggccggcagccccggcgagaagggcgaggccggcgagaagggcaaccccggcgccgaggtgcccggcctgcccggccccgagggcccccccggcccccccggcctgcagggcgtgcccggccccaagggcgaggccggcctggacggcgccaagggcgagaagggcttccagggcgagaagggcgacagaggccccctgggcctgcccggcgccagcggcctggacggcagacccggcccccccggcacccccggccccatcggcgtgcccggccccgccggccccaagggcgagagaggcagcaagggcgaccccggcatgaccggccccaccggcgccgccggcctgcccggcctgcacggcccccccggcgacaagggcaacagaggcgagagaggcaagaagggcagcagaggccccaagggcgacaagggcgaccagggcgcccccggcctggacgccccctgccccctgggcgaggacggcctgcccgtgcagggctgctggaacaagtag

SEQ ID NO: 1905 - DNA, 2007 bp, Homo sapiens
atggtggccgagagaacccacaaggccgccgccaccggcgccagaggccccggcgagctgggcgcccccggcaccgtggccctggtggccgccagagccgagagaggcgccagactgcccagccccggcagctgcggcctgctgaccctggccctgtgcagcctggccctgagcctgctggcccacttcagaaccgccgagctgcaggccagagtgctgagactggaggccgagagaggcgagcagcagatggagaccgccatcctgggcagagtgaaccagctgctggacgagaagtggaagctgcacagcagaagaagaagagaggcccccaagaccagccccggctgcaactgcccccccggcccccccggccccaccggcagacccggcctgcccggcgacaagggcgccatcggcatgcccggcagagtgggcagccccggcgacgccggcctgagcatcatcggccccagaggcccccccggccagcccggcaccagaggcttccccggcttccccggccccatcggcctggacggcaagcccggccaccccggccccaagggcgacatgggcctgaccggcccccccggccagcccggcccccagggccagaagggcgagaagggccagtgcggcgagtacccccacagagagtgcctgagcagcatgcccgccgccctgagaagcagccagatcatcgccctgaagggcgagcagagccaggccagcatccagggcccccccggcccccccggcccccccggccccagcggccccctgggccaccccggcctgcccggccccatgggcccccccggcctgcccggcccccccggccccaagggcgaccccggcatccagggctaccacggcagaaagggcgagagaggcatgcccggcatgcccggcaagcacggcgccaagggcgcccccggcatcgccgtggccggcatgaagggcgagcccggcatccccggcaccaagggcgagaagggcgccgagggcagccccggcctgcccggcctgctgggccagaagggcgagaagggcgacgccggcaacagcatcggcggcggcagaggcgagcccggcccccccggcctgcccggcccccccggccccaagggcgaggccggcgtggacggccaggtgggcccccccggccagcccggcgacaagggcgagagaggcgccgccggcgagcagggccccgacggccccaagggcagcaagggcgagcccggcaagggcgagatggtggactacaacggcaacatcaacgaggccctgcaggagatcagaaccctggccctgatgggcccccccggcctgcccggccagatcggcccccccggcgcccccggcatccccggccagaagggcgagatcggcctgcccggcccccccggccacgacggcgagaagggccccagaggcaagcccggcgacatgggcccccccggcccccagggcccccccggcaaggacggcccccccggcgtgaagggcgagaacggccaccccggcagccccggcgagaagggcgagaagggcgagaccggccaggccggcagccccgtgcccggcctgcccggccccgagggcccccccggcccccccggcctgcagggcgtgcccggccccaagggcgaggccggcctggacggcgccaagggcgagaagggcttccagggcgagaagggcgacagaggccccctgggcctgcccggcacccccggccccatcggcgtgcccggccccgccggccccaagggcgagagaggcagcaagggcgaccccggcatgaccggccccaccggcgccgccggcctgcccggcctgcacggcccccccggcgacaagggcaacagaggcgagagaggcaagaagggcagcagaggccccaagggcgacaagggcgaccagggcgcccccggcctggacgccccctgccccctgggcgaggacggcctgcccgtgcagggctgctggaacaagtag

SEQ ID NO: 1906 - DNA, 1833 bp, Homo sapiens
atggtggccgagagaacccacaaggccgccgccaccggcgccagaggccccggcgagctgggcgcccccggcaccgtggccctggtggccgccagagccgagagaggcgccagactgcccagccccggcagctgcggcctgctgaccctggccctgtgcagcctggccctgagcctgctggcccacttcagaaccgccgagctgcaggccagagtgctgagactggaggccgagagaggcgagcagcagatggagaccgccatcctgggcagagtgaaccagctgctggacgagaagtggaagctgcacagcagaagaagaagagaggcccccaagaccagccccggctgcaactgcccccccggcccccccggccccaccggcagacccggcctgcccggccagcccggcaccagaggcttccccggcttccccggccccatcggcctggacggcaagcccggccaccccggccccaagggcgacatgggcctgaccggcccccccggccagcccggcccccagggccagaagggcgagaagggccagtgcggcgagtacccccacagagagtgcctgagcagcatgcccgccgccctgagaagcagccagatcatcgccctgaagggcgagcagagccaggccagcatccagggcccccccggcccccccggcccccccggccccagcggccccctgggccaccccggcctgcccggccccatgggcccccccggcctgcccggcccccccggccccaagggcgaccccggcatccagggctaccacggcagaaagggcgagagaggcatgcccggcatgcccggcaagcacggcgccaagggcgcccccggcatcgccgtggccggcatgaagggcgagcccggcatccccggcaccaagggcgagaagggcgccgagggcagccccggcctgcccggcctgctgggccagaagggcgagaagggcgacgccggcaacagcatcggcggcggcagaggcgagcccggcccccccggcctgcccggcccccccggccccaagggcgaggccggcgtggacggccaggtgggcccccccggccagcccggcgacaagggcgagagaggcgccgccggcgagcagggccccgacggccccaagggcagcaagggcgagcccggcaagggcgagatggtggactacaacggcaacatcaacgaggccctgcaggagatcagaaccctggccctgatgggcccccccggcctgcccggccagatcggcccccccggcgcccccggcatccccggccagaagggcgagatcggcctgcccggcccccccggccacgacggcgagaagggccccagaggcaagcccggcgacatgggcccccccggcccccagggcccccccggcaaggacggcccccccggcgtgaagggcgagaacggccaccccggcagccccggcgagaagggcgagaagggcgagaccggccaggccggcagccccgtgcccggcctgcccggccccgagggcccccccggcccccccggcctgcagggcgtgcccggccccaagggcgaggccggcctggacggcgccaagggcgagaagggcttccagggcgagaagggcgacagaggccccctgggcctgcccggcacccccggccccatcggcgtgcccggccccgccggccccaagggcgagagaggcagcaagggcgaccccggcatgaccggccccaccggcgccgccggcctgcccggcctgcacggcccccccggcgacaagggcaacagaggcgaggacggcctgcccgtgcagggctgctggaacaagtag

SEQ ID NO: 1907 - DNA, 1938 bp, Homo sapiens
atggtggccgagagaacccacaaggccgccgccaccggcgccagaggccccggcgagctgggcgcccccggcaccgtggccctggtggccgccagagccgagagaggcgccagactgcccagccccggcagctgcggcctgctgaccctggccctgtgcagcctggccctgagcctgctggcccacttcagaaccgccgagctgcaggccagagtgctgagactggaggccgagagaggcgagcagcagatggagaccgccatcctgggcagagtgaaccagctgctggacgagaagtggaagctgcacagcagaagaagaagagaggcccccaagaccagccccggctgcaactgcccccccggcccccccggccagcccggcaccagaggcttccccggcttccccggccccatcggcctggacggcaagcccggccaccccggccccaagggcgacatgggcctgaccggcccccccggccagcccggcccccagggccagaagggcgagaagggccagtgcggcgagtacccccacagactgctgcccctgctgaacagcgtgagactggcccccccccccgtgatcaagagaagaaccttccagggcgagcagagccaggccagcatccagggcccccccggcccccccggcccccccggccccagcggccccctgggccaccccggcctgcccggccccatgggcccccccggcctgcccggcccccccggccccaagggcgaccccggcatccagggctaccacggcagaaagggcgagagaggcatgcccggcatgcccggcaagcacggcgccaagggcgcccccggcatcgccgtggccggcatgaagggcgagcccggcatccccggcaccaagggcgagaagggcgccgagggcagccccggcctgcccggcctgctgggccagaagggcgagaagggcgacgccggcaacagcatcggcggcggcagaggcgagcccggcccccccggcctgcccggcccccccggccccaagggcgaggccggcgtggacggccaggtgggcccccccggccagcccggcgacaagggcgagagaggcgccgccggcgagcagggccccgacggccccaagggcagcaagggcgagcccggcaagggcgagatggtggactacaacggcaacatcaacgaggccctgcaggagatcagaaccctggccctgatgggcccccccggcctgcccggccagatcggcccccccggcgcccccggcatccccggccagaagggcgagatcggcctgcccggcccccccggccacgacggcgagaagggccccagaggcaagcccggcgacatgggcccccccggcccccagggcccccccggcaaggacggcccccccggcgtgaagggcgagaacggccaccccggcagccccggcgagaagggcgagaagggcgagaccggccaggccggcagccccgtgcccggcctgcccggccccgagggcccccccggcccccccggcctgcagggcgtgcccggccccaagggcgaggccggcctggacggcgccaagggcgagaagggcttccagggcgagaagggcgacagaggccccctgggcctgcccggcgccagcggcctggacggcagacccggcccccccggcacccccggccccatcggcgtgcccggccccgccggccccaagggcgagagaggcagcaagggcgaccccggcatgaccggccccaccggcgccgccggcctgcccggcctgcacggcccccccggcgacaagggcaacagaggcgagagaggcaagaagggcagcagaggccccaagggcgacaagggcgaccagggcgcccccggcctggacgccccctgccccctgggcgaggacggcctgcccgtgcagggctgctggaacaagtag

SEQ ID NO: 1908 - DNA, 5106 bp, Homo sapiens
atgaagatcttccagagaaagatgagatactggctgctgccccccttcctggccatcgtgtacttctgcaccatcgtgcagggccaggtggccccccccaccagactgagatacaacgtgatcagccacgacagcatccagatcagctggaaggcccccagaggcaagttcggcggctacaagctgctggtgacccccaccagcggcggcaagaccaaccagctgaacctgcagaacaccgccaccaaggccatcatccagggcctgatgcccgaccagaactacaccgtgcagatcatcgcctacaacaaggacaaggagagcaagcccgcccagggccagttcagaatcaaggacctggagaagagaaaggaccccaagcccagagtgaaggtggtggacagaggcaacggcagcagacccagcagccccgaggaggtgaagttcgtgtgccagacccccgccatcgccgacatcgtgatcctggtggacggcagctggagcatcggcagattcaacttcagactggtgagacacttcctggagaacctggtgaccgccttcgacgtgggcagcgagaagaccagaatcggcgtgaagaacgccgacgtgaacgagctgcaggagatcgccagcgagcccgacagcacccacgtgtacaacgtggccgagttcgacctgatgcacaccgtggtggagagcctgaccagaaccctgtgcagcagagtggaggagcaggacagagagatcaaggccagcgcccacgccatcaccggcccccccaccgagctgatcaccagcgaggtgaccgccagaagcttcatggtgaactggacccacgcccccggcaacgtggagaagtacagagtggtgtactaccccaccagaggcggcaagcccgacgaggtggtggtggacggcaccgtgagcagcaccgtgctgaagaacctgatgagcctgaccgagtaccagatcgccgtgttcgccatctacgcccacaccgccagcgagggcctgagaggcaccgagaccaccctggccctgcccatggccagcgacctgctgctgtacgacgtgaccgagaacagcatgagagtgaagtgggacgccgtgcccggcgccagcggctacctgatcctgtacgcccccctgaccgagggcctggccggcgacgagaaggagatgaagatcggcgagacccacaccgacatcgagctgagcggcctgctgcccaacaccgagtacaccgtgaccgtgtacgccatgttcggcgaggaggccagcgaccccgtgaccggccaggagaccaccctggccctgagcccccccagaaacctgagaatcagcaacgtgggcagcaacagcgccagactgacctgggaccccaccagcagacagatcaacggctacagaatcgtgtacaacaacgccgacggcaccgagatcaacgaggtggaggtggaccccatcaccaccttccccctgaagggcctgacccccctgaccgagtacaccatcgccatcttcagcatctacgacgagggccagagcgagcccctgaccggcgtgttcaccaccgaggaggtgcccgcccagcagtacctggagatcgacgaggtgaccaccgacagcttcagagtgacctggcaccccctgagcgccgacgagggcctgcacaagctgatgtggatccccgtgtacggcggcaagaccgaggaggtggtgctgaaggaggagcaggacagccacgtgatcgagggcctggagcccggcaccgagtacgaggtgagcctgctggccgtgctggacgacggcagcgagagcgaggtggtgaccgccgtgggcaccaccctggacagcttctggaccgagcccgccaccaccatcgtgcccaccaccagcgtgaccagcgtgttccagaccggcatcagaaacctggtggtgggcgacgagaccaccagcagcctgagagtgaagtgggacatcagcgacagcgacgtgcagcagttcagagtgacctacatgaccgcccagggcgaccccgaggaggaggtgatcggcaccgtgatggtgcccggcagccagaacaacctgctgctgaagcccctgctgcccgacaccgagtacaaggtgaccgtgacccccatctacaccgacggcgagggcgtgagcgtgagcgcccccggcaagaccctgcccagcagcggcccccagaacctgagagtgagcgaggagtggtacaacagactgagaatcacctgggacccccccagcagccccgtgaagggctacagaatcgtgtacaagcccgtgagcgtgcccggccccaccctggagaccttcgtgggcgccgacatcaacaccatcctgatcaccaacctgctgagcggcatggactacaacgtgaagatcttcgccagccaggccagcggcttcagcgacgccctgaccggcatggtgaagaccctgttcctgggcgtgaccaacctgcaggccaagcacgtggagatgaccagcctgtgcgcccactggcaggtgcacagacacgccaccgcctacagagtggtgatcgagagcctgcaggacagacagaagcaggagagcaccgtgggcggcggcaccaccagacactgcttctacggcctgcagcccgacagcgagtacaagatcagcgtgtacaccaagctgcaggagatcgagggccccagcgtgagcatcatggagaagacccagagcctgcccaccagaccccccaccttcccccccaccatcccccccgccaaggaggtgtgcaaggccgccaaggccgacctggtgttcatggtggacggcagctggagcatcggcgacgagaacttcaacaagatcatcagcttcctgtacagcaccgtgggcgccctgaacaagatcggcaccgacggcacccaggtggccatggtgcagttcaccgacgaccccagaaccgagttcaagctgaacgcctacaagaccaaggagaccctgctggacgccatcaagcacatcagctacaagggcggcaacaccaagaccggcaaggccatcaagtacgtgagagacaccctgttcaccgccgagagcggcaccagaagaggcatccccaaggtgatcgtggtgatcaccgacggcagaagccaggacgacgtgaacaagatcagcagagagatgcagctggacggctacagcatcttcgccatcggcgtggccgacgccgactacagcgagctggtgagcatcggcagcaagcccagcgccagacacgtgttcttcgtggacgacttcgacgccttcaagaagatcgaggacgagctgatcaccttcgtgtgcgagaccgccagcgccacctgccccgtggtgcacaaggacggcatcgacctggccggcttcaagatgatggagatgttcggcctggtggagaaggacttcagcagcgtggagggcgtgagcatggagcccggcaccttcaacgtgttcccctgctaccagctgcacaaggacgccctggtgagccagcccaccagatacctgcaccccgagggcctgcccagcgactacaccatcagcttcctgttcagaatcctgcccgacaccccccaggagcccttcgccctgtgggagatcctgaacaagaacagcgaccccctggtgggcgtgatcctggacaacggcggcaagaccctgacctacttcaactacgaccagagcggcgacttccagaccgtgaccttcgagggccccgagatcagaaagatcttctacggcagcttccacaagctgcacatcgtggtgagcgagaccctggtgaaggtggtgatcgactgcaagcaggtgggcgagaaggccatgaacgccagcgccaacatcaccagcgacggcgtggaggtgctgggcaagatggtgagaagcagaggccccggcggcaacagcgcccccttccagctgcagatgttcgacatcgtgtgcagcaccagctgggccaacaccgacaagtgctgcgagctgcccggcctgagagacgacgagagctgccccgacctgccccacagctgcagctgcagcgagaccaacgaggtggccctgggccccgccggcccccccggcggccccggcctgagaggccccaagggccagcagggcgagcccggccccaagggccccgacggccccagaggcgagatcggcctgcccggcccccagggcccccccggcccccagggccccagcggcctgagcatccagggcatgcccggcatgcccggcgagaagggcgagaagggcgacaccggcctgcccggcccccagggcatccccggcggcgtgggcagccccggcagagacggcagccccggccagagaggcctgcccggcaaggacggcagcagcggcccccccggcccccccggccccatcggcatccccggcacccccggcgtgcccggcatcaccggcagcatgggcccccagggcgccctgggcccccccggcgtgcccggcgccaagggcgagagaggcgagagaggcgacctgcagagccaggccatggtgagaagcgtggccagacaggtgtgcgagcagctgatccagagccacatggccagatacaccgccatcctgaaccagatccccagccacagcagcagcatcagaaccgtgcagggcccccccggcgagcccggcagacccggcagccccggcgcccccggcgagcagggcccccccggcacccccggcttccccggcaacgccggcgtgcccggcacccccggcgagagaggcctgaccggcatcaagggcgagaagggcaaccccggcgtgggcacccagggccccagaggcccccccggccccgccggccccagcggcgagagcagacccggcagccccggcccccccggcagccccggccccagaggcccccccggccacctgggcgtgcccggcccccagggccccagcggccagcccggctactgcgaccccagcagctgcagcgcctacggcgtgagagccccccaccccgaccagcccgagttcacccccgtgcaggacgagctggaggccatggagctgtggggccccggcgtgtag

SEQ ID NO: 1909 - DNA, 5391 bp, Homo sapiens
atgaagatcttccagagaaagatgagatactggctgctgccccccttcctggccatcgtgtacttctgcaccatcgtgcagggccaggtggccccccccaccagactgagatacaacgtgatcagccacgacagcatccagatcagctggaaggcccccagaggcaagttcggcggctacaagctgctggtgacccccaccagcggcggcaagaccaaccagctgaacctgcagaacaccgccaccaaggccatcatccagggcctgatgcccgaccagaactacaccgtgcagatcatcgcctacaacaaggacaaggagagcaagcccgcccagggccagttcagaatcaaggacctggagaagagaaaggaccccaagcccagagtgaaggtggtggacagaggcaacggcagcagacccagcagccccgaggaggtgaagttcgtgtgccagacccccgccatcgccgacatcgtgatcctggtggacggcagctggagcatcggcagattcaacttcagactggtgagacacttcctggagaacctggtgaccgccttcgacgtgggcagcgagaagaccagaatcggcctggcccagtacagcggcgaccccagaatcgagtggcacctgaacgccttcagcaccaaggacgaggtgatcgaggccgtgagaaacctgccctacaagggcggcaacaccctgaccggcctggccctgaactacatcttcgagaacagcttcaagcccgaggccggcagcagaaccggcgtgagcaagatcggcatcctgatcaccgacggcaagagccaggacgacatcatcccccccagcagaaacctgagagagagcggcgtggagctgttcgccatcggcgtgaagaacgccgacgtgaacgagctgcaggagatcgccagcgagcccgacagcacccacgtgtacaacgtggccgagttcgacctgatgcacaccgtggtggagagcctgaccagaaccctgtgcagcagagtggaggagcaggacagagagatcaaggccagcgcccacgccatcaccggcccccccaccgagctgatcaccagcgaggtgaccgccagaagcttcatggtgaactggacccacgcccccggcaacgtggagaagtacagagtggtgtactaccccaccagaggcggcaagcccgacgaggtggtggtggacggcaccgtgagcagcaccgtgctgaagaacctgatgagcctgaccgagtaccagatcgccgtgttcgccatctacgcccacaccgccagcgagggcctgagaggcaccgagaccaccctggccctgcccatggccagcgacctgctgctgtacgacgtgaccgagaacagcatgagagtgaagtgggacgccgtgcccggcgccagcggctacctgatcctgtacgcccccctgaccgagggcctggccggcgacgagaaggagatgaagatcggcgagacccacaccgacatcgagctgagcggcctgctgcccaacaccgagtacaccgtgaccgtgtacgccatgttcggcgaggaggccagcgaccccgtgaccggccaggagaccaccctggccctgagcccccccagaaacctgagaatcagcaacgtgggcagcaacagcgccagactgacctgggaccccaccagcagacagatcaacggctacagaatcgtgtacaacaacgccgacggcaccgagatcaacgaggtggaggtggaccccatcaccaccttccccctgaagggcctgacccccctgaccgagtacaccatcgccatcttcagcatctacgacgagggccagagcgagcccctgaccggcgtgttcaccaccgaggaggtgcccgcccagcagtacctggagatcgacgaggtgaccaccgacagcttcagagtgacctggcaccccctgagcgccgacgagggcctgcacaagctgatgtggatccccgtgtacggcggcaagaccgaggaggtggtgctgaaggaggagcaggacagccacgtgatcgagggcctggagcccggcaccgagtacgaggtgagcctgctggccgtgctggacgacggcagcgagagcgaggtggtgaccgccgtgggcaccaccctggacagcttctggaccgagcccgccaccaccatcgtgcccaccaccagcgtgaccagcgtgttccagaccggcatcagaaacctggtggtgggcgacgagaccaccagcagcctgagagtgaagtgggacatcagcgacagcgacgtgcagcagttcagagtgacctacatgaccgcccagggcgaccccgaggaggaggtgatcggcaccgtgatggtgcccggcagccagaacaacctgctgctgaagcccctgctgcccgacaccgagtacaaggtgaccgtgacccccatctacaccgacggcgagggcgtgagcgtgagcgcccccggcaagaccctgcccagcagcggcccccagaacctgagagtgagcgaggagtggtacaacagactgagaatcacctgggacccccccagcagccccgtgaagggctacagaatcgtgtacaagcccgtgagcgtgcccggccccaccctggagaccttcgtgggcgccgacatcaacaccatcctgatcaccaacctgctgagcggcatggactacaacgtgaagatcttcgccagccaggccagcggcttcagcgacgccctgaccggcatggtgaagaccctgttcctgggcgtgaccaacctgcaggccaagcacgtggagatgaccagcctgtgcgcccactggcaggtgcacagacacgccaccgcctacagagtggtgatcgagagcctgcaggacagacagaagcaggagagcaccgtgggcggcggcaccaccagacactgcttctacggcctgcagcccgacagcgagtacaagatcagcgtgtacaccaagctgcaggagatcgagggccccagcgtgagcatcatggagaagacccagagcctgcccaccagaccccccaccttcccccccaccatcccccccgccaaggaggtgtgcaaggccgccaaggccgacctggtgttcatggtggacggcagctggagcatcggcgacgagaacttcaacaagatcatcagcttcctgtacagcaccgtgggcgccctgaacaagatcggcaccgacggcacccaggtggccatggtgcagttcaccgacgaccccagaaccgagttcaagctgaacgcctacaagaccaaggagaccctgctggacgccatcaagcacatcagctacaagggcggcaacaccaagaccggcaaggccatcaagtacgtgagagacaccctgttcaccgccgagagcggcaccagaagaggcatccccaaggtgatcgtggtgatcaccgacggcagaagccaggacgacgtgaacaagatcagcagagagatgcagctggacggctacagcatcttcgccatcggcgtggccgacgccgactacagcgagctggtgagcatcggcagcaagcccagcgccagacacgtgttcttcgtggacgacttcgacgccttcaagaagatcgaggacgagctgatcaccttcgtgtgcgagaccgccagcgccacctgccccgtggtgcacaaggacggcatcgacctggccggcttcaagatgatggagatgttcggcctggtggagaaggacttcagcagcgtggagggcgtgagcatggagcccggcaccttcaacgtgttcccctgctaccagctgcacaaggacgccctggtgagccagcccaccagatacctgcaccccgagggcctgcccagcgactacaccatcagcttcctgttcagaatcctgcccgacaccccccaggagcccttcgccctgtgggagatcctgaacaagaacagcgaccccctggtgggcgtgatcctggacaacggcggcaagaccctgacctacttcaactacgaccagagcggcgacttccagaccgtgaccttcgagggccccgagatcagaaagatcttctacggcagcttccacaagctgcacatcgtggtgagcgagaccctggtgaaggtggtgatcgactgcaagcaggtgggcgagaaggccatgaacgccagcgccaacatcaccagcgacggcgtggaggtgctgggcaagatggtgagaagcagaggccccggcggcaacagcgcccccttccagctgcagatgttcgacatcgtgtgcagcaccagctgggccaacaccgacaagtgctgcgagctgcccggcctgagagacgacgagagctgccccgacctgccccacagctgcagctgcagcgagaccaacgaggtggccctgggccccgccggcccccccggcggccccggcctgagaggccccaagggccagcagggcgagcccggccccaagggccccgacggccccagaggcgagatcggcctgcccggcccccagggcccccccggcccccagggccccagcggcctgagcatccagggcatgcccggcatgcccggcgagaagggcgagaagggcgacaccggcctgcccggcccccagggcatccccggcggcgtgggcagccccggcagagacggcagccccggccagagaggcctgcccggcaaggacggcagcagcggcccccccggcccccccggccccatcggcatccccggcacccccggcgtgcccggcatcaccggcagcatgggcccccagggcgccctgggcccccccggcgtgcccggcgccaagggcgagagaggcgagagaggcgacctgcagagccaggccatggtgagaagcgtggccagacaggtgtgcgagcagctgatccagagccacatggccagatacaccgccatcctgaaccagatccccagccacagcagcagcatcagaaccgtgcagggcccccccggcgagcccggcagacccggcagccccggcgcccccggcgagcagggcccccccggcacccccggcttccccggcaacgccggcgtgcccggcacccccggcgagagaggcctgaccggcatcaagggcgagaagggcaaccccggcgtgggcacccagggccccagaggcccccccggccccgccggccccagcggcgagagcagacccggcagccccggcccccccggcagccccggccccagaggcccccccggccacctgggcgtgcccggcccccagggccccagcggccagcccggctactgcgaccccagcagctgcagcgcctacggcgtgagagccccccaccccgaccagcccgagttcacccccgtgcaggacgagctggaggccatggagctgtggggccccggcgtgtag

SEQ ID NO: 1910 - DNA, 5343 bp, Homo sapiens
atgaagatcttccagagaaagatgagatactggctgctgccccccttcctggccatcgtgtacttctgcaccatcgtgcagggccaggtggccccccccaccagactgagatacaacgtgatcagccacgacagcatccagatcagctggaaggcccccagaggcaagttcggcggctacaagctgctggtgacccccaccagcggcggcaagaccaaccagctgaacctgcagaacaccgccaccaaggccatcatccagggcctgatgcccgaccagaactacaccgtgcagatcatcgcctacaacaaggacaaggagagcaagcccgcccagggccagttcagaatcaaggacctggagaagagaaaggaccccaagcccagagtgaaggtggtggacagaggcaacggcagcagacccagcagccccgaggaggtgaagttcgtgtgccagacccccgccatcgccgacatcgtgatcctggtggacggcagctggagcatcggcagattcaacttcagactggtgagacacttcctggagaacctggtgaccgccttcgacgtgggcagcgagaagaccagaatcggcctggcccagtacagcggcgaccccagaatcgagtggcacctgaacgccttcagcaccaaggacgaggtgatcgaggccgtgagaaacctgccctacaagggcggcaacaccctgaccggcctggccctgaactacatcttcgagaacagcttcaagcccgaggccggcagcagaaccggcgtgagcaagatcggcatcctgatcaccgacggcaagagccaggacgacatcatcccccccagcagaaacctgagagagagcggcgtggagctgttcgccatcggcgtgaagaacgccgacgtgaacgagctgcaggagatcgccagcgagcccgacagcacccacgtgtacaacgtggccgagttcgacctgatgcacaccgtggtggagagcctgaccagaaccctgtgcagcagagtggaggagcaggacagagagatcaaggccagcgcccacgccatcaccggcccccccaccgagctgatcaccagcgaggtgaccgccagaagcttcatggtgaactggacccacgcccccggcaacgtggagaagtacagagtggtgtactaccccaccagaggcggcaagcccgacgaggtggtggtggacggcaccgtgagcagcaccgtgctgaagaacctgatgagcctgaccgagtaccagatcgccgtgttcgccatctacgcccacaccgccagcgagggcctgagaggcaccgagaccaccctggccctgcccatggccagcgacctgctgctgtacgacgtgaccgagaacagcatgagagtgaagtgggacgccgtgcccggcgccagcggctacctgatcctgtacgcccccctgaccgagggcctggccggcgacgagaaggagatgaagatcggcgagacccacaccgacatcgagctgagcggcctgctgcccaacaccgagtacaccgtgaccgtgtacgccatgttcggcgaggaggccagcgaccccgtgaccggccaggagaccaccctggccctgagcccccccagaaacctgagaatcagcaacgtgggcagcaacagcgccagactgacctgggaccccaccagcagacagatcaacggctacagaatcgtgtacaacaacgccgacggcaccgagatcaacgaggtggaggtggaccccatcaccaccttccccctgaagggcctgacccccctgaccgagtacaccatcgccatcttcagcatctacgacgagggccagagcgagcccctgaccggcgtgttcaccaccgaggaggtgcccgcccagcagtacctggagatcgacgaggtgaccaccgacagcttcagagtgacctggcaccccctgagcgccgacgagggcctgcacaagctgatgtggatccccgtgtacggcggcaagaccgaggaggtggtgctgaaggaggagcaggacagccacgtgatcgagggcctggagcccggcaccgagtacgaggtgagcctgctggccgtgctggacgacggcagcgagagcgaggtggtgaccgccgtgggcaccaccctggacagcttctggaccgagcccgccaccaccatcgtgcccaccaccagcgtgaccagcgtgttccagaccggcatcagaaacctggtggtgggcgacgagaccaccagcagcctgagagtgaagtgggacatcagcgacagcgacgtgcagcagttcagagtgacctacatgaccgcccagggcgaccccgaggaggaggtgatcggcaccgtgatggtgcccggcagccagaacaacctgctgctgaagcccctgctgcccgacaccgagtacaaggtgaccgtgacccccatctacaccgacggcgagggcgtgagcgtgagcgcccccggcaagaccctgcccagcagcggcccccagaacctgagagtgagcgaggagtggtacaacagactgagaatcacctgggacccccccagcagccccgtgaagggctacagaatcgtgtacaagcccgtgagcgtgcccggccccaccctggagaccttcgtgggcgccgacatcaacaccatcctgatcaccaacctgctgagcggcatggactacaacgtgaagatcttcgccagccaggccagcggcttcagcgacgccctgaccggcatggtgaagaccctgttcctgggcgtgaccaacctgcaggccaagcacgtggagatgaccagcctgtgcgcccactggcaggtgcacagacacgccaccgcctacagagtggtgatcgagagcctgcaggacagacagaagcaggagagcaccgtgggcggcggcaccaccagacactgcttctacggcctgcagcccgacagcgagtacaagatcagcgtgtacaccaagctgcaggagatcgagggccccagcgtgagcatcatggagaagacccagagcctgcccaccagaccccccaccttcccccccaccatcccccccgccaaggaggtgtgcaaggccgccaaggccgacctggtgttcatggtggacggcagctggagcatcggcgacgagaacttcaacaagatcatcagcttcctgtacagcaccgtgggcgccctgaacaagatcggcaccgacggcacccaggtggccatggtgcagttcaccgacgaccccagaaccgagttcaagctgaacgcctacaagaccaaggagaccctgctggacgccatcaagcacatcagctacaagggcggcaacaccaagaccggcaaggccatcaagtacgtgagagacaccctgttcaccgccgagagcggcaccagaagaggcatccccaaggtgatcgtggtgatcaccgacggcagaagccaggacgacgtgaacaagatcagcagagagatgcagctggacggctacagcatcttcgccatcggcgtggccgacgccgactacagcgagctggtgagcatcggcagcaagcccagcgccagacacgtgttcttcgtggacgacttcgacgccttcaagaagatcgaggacgagctgatcaccttcgtgtgcgagaccgccagcgccacctgccccgtggtgcacaaggacggcatcgacctggccggcttcaagatgatggagatgttcggcctggtggagaaggacttcagcagcgtggagggcgtgagcatggagcccggcaccttcaacgtgttcccctgctaccagctgcacaaggacgccctggtgagccagcccaccagatacctgcaccccgagggcctgcccagcgactacaccatcagcttcctgttcagaatcctgcccgacaccccccaggagcccttcgccctgtgggagatcctgaacaagaacagcgaccccctggtgggcgtgatcctggacaacggcggcaagaccctgacctacttcaactacgaccagagcggcgacttccagaccgtgaccttcgagggccccgagatcagaaagatcttctacggcagcttccacaagctgcacatcgtggtgagcgagaccctggtgaaggtggtgatcgactgcaagcaggtgggcgagaaggccatgaacgccagcgccaacatcaccagcgacggcgtggaggtgctgggcaagatggtgagaagcagaggccccggcggcaacagcgcccccttccagctgcagatgttcgacatcgtgtgcagcaccagctgggccaacaccgacaagtgctgcgagctgcccggcctgagagacgacgagagctgccccgacctgccccacagctgcagctgcagcgagaccaacgaggtggccctgggccccgccggcccccccggcggccccggcctgagaggccccaagggccagcagggcgagcccggccccaagggccccgacggccccagaggcgagatcggcctgcccggcccccagggcccccccggcccccagggccccagcggcctgagcatccagggcatgcccggcatgcccggcgagaagggcgagaagggcgacaccggcctgcccggcccccagggcatccccggcggcgtgggcagccccggcagagacggcagccccggccagagaggcctgcccggcaaggacggcagcagcggcccccccggcccccccggccccatcggcatccccggcacccccggcgtgcccggcatcaccggcagcatgggcccccagggcgccctgggcccccccggcgtgcccggcgccaagggcgagagaggcgagagaggcgacctgcagagccaggccatggtgagaagcgtggccagacaggtgtgcgagcagctgatccagagccacatggccagatacaccgccatcctgaaccagatccccagccacagcagcagcatcagaaccgtgcagggcccccccggcgagcccggcagacccggcagccccggcgcccccggcgagcagggcccccccggcacccccggcttccccggcaacgccggcgtgcccggcacccccggcgagagaggcctgaccggcatcaagggcgagaagggcaaccccggcgtgggcacccagggccccagaggcccccccggccccgccggccccagcggcgagagcagacccggcagccccggcccccccggcagccccggccccagaggcccccccggccacctgggcgtgcccggcccccagggccccagcggccagcccggctactgcgaccccagcagctgcagcgcctacggcgtgagagacctgatcccctacaacgactaccagcactag

SEQ ID NO: 1911 - DNA, 1605 bp, Homo sapiens
atgaagatcttccagagaaagatgagatactggctgctgccccccttcctggccatcgtgtacttctgcaccatcgtgcagggccaggtggccccccccaccagactgagatacaacgtgatcagccacgacagcatccagatcagctggaaggcccccagaggcaagttcggcggctacaagctgctggtgacccccaccagcggcggcaagaccaaccagctgaacctgcagaacaccgccaccaaggccatcatccagggcctgatgcccgaccagaactacaccgtgcagatcatcgcctacaacaaggacaaggagagcaagcccgcccagggccagttcagaatcaaggacctggagaagagaaaggaccccaagcccagagtgaaggtggtggacagaggcaacggcagcagacccagcagccccgaggaggtgaagttcgtgtgccagacccccgccatcgccgacatcgtgatcctggtggacggcagctggagcatcggcagattcaacttcagactggtgagacacttcctggagaacctggtgaccgccttcgacgtgggcagcgagaagaccagaatcggcctggcccagtacagcggcgaccccagaatcgagtggcacctgaacgccttcagcaccaaggacgaggtgatcgaggccgtgagaaacctgccctacaagggcggcaacaccctgaccggcctggccctgaactacatcttcgagaacagcttcaagcccgaggccggcagcagaaccggcgtgagcaagatcggcatcctgatcaccgacggcaagagccaggacgacatcatcccccccagcagaaacctgagagagagcggcgtggagctgttcgccatcggcgtgaagaacgccgacgtgaacgagctgcaggagatcgccagcgagcccgacagcacccacgtgtacaacgtggccgagttcgacctgatgcacaccgtggtggagagcctgaccagaaccctgtgcagcagagtggaggagcaggacagagagatcaaggccagcgcccacgccatcaccggcccccccaccgagctgatcaccagcgaggtgaccgccagaagcttcatggtgaactggacccacgcccccggcaacgtggagaagtacagagtggtgtactaccccaccagaggcggcaagcccgacgaggtggtggtggacggcaccgtgagcagcaccgtgctgaagaacctgatgagcctgaccgagtaccagatcgccgtgttcgccatctacgcccacaccgccagcgagggcctgagaggcaccgagaccaccctggccctgcccatggccagcgacctgctgctgtacgacgtgaccgagaacagcatgagagtgaagtgggacgccgtgcccggcgccagcggctacctgatcctgtacgcccccctgaccgagggcctggccggcgacgagaaggagatgaagatcggcgagacccacaccgacatcgagctgagcggcctgctgcccaacaccgagtacaccgtgaccgtgtacgccatgttcggcgaggaggccagcgaccccgtgaccggccaggagaccaccagcccctag

SEQ ID NO: 1912 - DNA, 3429 bp, Homo sapiens
atgagactgaccggcccctggaagctgtggctgtggatgagcatcttcctgctgcccgccagcaccagcgtgaccgtgagagacaagaccgaggagagctgccccatcctgagaatcgagggccaccagctgacctacgacaacatcaacaagctggaggtgagcggcttcgacctgggcgacagcttcagcctgagaagagccttctgcgagagcgacaagacctgcttcaagctgggcagcgccctgctgatcagagacaccatcaagatcttccccaagggcctgcccgaggagtacagcgtggccgccatgttcagagtgagaagaaacgccaagaaggagagatggttcctgtggcaggtgctgaaccagcagaacatcccccagatcagcatcgtggtggacggcggcaagaaggtggtggagttcatgttccaggccaccgagggcgacgtgctgaactacatcttcagaaacagagagctgagacccctgttcgacagacagtggcacaagctgggcatcagcatccagagccaggtgatcagcctgtacatggactgcaacctgatcgccagaagacagaccgacgagaaggacaccgtggacttccacggcagaaccgtgatcgccaccagagccagcgacggcaagcccgtggacatcgagctgcaccagctgaagatctactgcagcgccaacctgatcgcccaggagacctgctgcgagatcagcgacaccaagtgccccgagcaggacggcttcggcaacatcgccagcagctgggtgaccgcccacgccagcaagatgagcagctacctgcccgccaagcaggagctgaaggaccagtgccagtgcatccccaacaagggcgaggccggcctgcccggcgcccccggcagccccggccagaagggccacaagggcgagcccggcgagaacggcctgcacggcgcccccggcttccccggccagaagggcgagcagggcttcgagggcagcaagggcgagaccggcgagaagggcgagcagggcgagaagggcgaccccgccctggccggcctgaacggcgagaacggcctgaagggcgacctgggcccccacggcccccccggccccaagggcgagaagggcgacaccggcccccccggcccccccgccctgcccggcagcctgggcatccagggcccccagggcccccccggcaaggagggccagagaggcagaagaggcaagaccggcccccccggcaagcccggcccccccggcccccccggcccccccggcatccagggcatccaccagaccctgggcggctactacaacaaggacaacaagggcaacgacgagcacgaggccggcggcctgaagggcgacaagggcgagaccggcctgcccggcttccccggcagcgtgggccccaagggccagaagggcgagcccggcgagcccttcaccaagggcgagaagggcgacagaggcgagcccggcgtgatcggcagccagggcgtgaagggcgagcccggcgaccccggcccccccggcctgatcggcagccccggcctgaagggccagcagggcagcgccggcagcatgggccccagaggcccccccggcgacgtgggcctgcccggcgagcacggcatccccggcaagcagggcatcaagggcgagaagggcgaccccggcggcatcatcggcccccccggcctgcccggccccaagggcgaggccggcccccccggcaagagcctgcccggcgagcccggcctggacggcaaccccggcgcccccggccccagaggccccaagggcgagagaggcctgcccggcgtgcacggcagccccggcgacatcggcccccagggcatcggcatccccggcagaaccggcgcccagggccccgccggcgagcccggcatccagggccccagaggcctgcccggcctgcccggcacccccggcacccccggcaacgacggcgtgcccggcagagacggcaagcccggcctgcccggcccccccggcgaccccatcgccctgcccctgctgggcgacatcggcgccctgctgaagaacttctgcggcaactgccaggccagcgtgcccggcctgaagagcaacaagggcgaggagggcggcgccggcgagcccggcaagtacgacagcatggccagaaagggcgacatcggccccagaggcccccccggcatccccggcagagagggccccaagggcagcaagggcgagagaggctaccccggcatccccggcgagaagggcgacgagggcctgcagggcatccccggcatccccggcgcccccggccccaccggcccccccggcctgatgggcagaaccggccaccccggccccaccggcgccaagggcgagaagggcagcgacggcccccccggcaagcccggcccccccggcccccccggcatccccttcaacgagagaaacggcatgagcagcctgtacaagatcaagggcggcgtgaacgtgcccagctaccccggcccccccggcccccccggccccaagggcgaccccggccccgtgggcgagcccggcgccatgggcctgcccggcctggagggcttccccggcgtgaagggcgacagaggccccgccggcccccccggcatcgccggcatgagcggcaagcccggcgcccccggcccccccggcgtgcccggcgagcccggcgagagaggccccgtgggcgacatcggcttccccggccccgagggccccagcggcaagcccggcatcaacggcaaggacggcatccccggcgcccagggcatcatgggcaagcccggcgacagaggccccaagggcgagagaggcgaccagggcatccccggcgacagaggcagccagggcgagagaggcaagcccggcctgaccggcatgaagggcgccatcggccccatgggcccccccggcaacaagggcagcatgggcagccccggccaccagggcccccccggcagccccggcatccccggcatccccgccgacgccgtgagcttcgaggagatcaagaagtacatcaaccaggaggtgctgagaatcttcgaggagagaatggccgtgttcctgagccagctgaagctgcccgccgccatgctggccgcccaggcctacggcagacccggcccccccggcaaggacggcctgcccggcccccccggcgaccccggcccccagggctacagaggccagaagggcgagagaggcgagcccggcatcggcctgcccggcagccccggcctgcccggcaccagcgccctgggcctgcccggcagccccggcgcccccggcccccagggcccccccggccccagcggcagatgcaaccccgaggactgcctgtaccccgtgagccacgcccaccagagaaccggcggcaactag

SEQ ID NO: 1913 - DNA, 462 bp, Homo sapiens
ggcatcaacggcaaggacggcatccccggcgcccagggcatcatgggcaagcccggcgacagaggccccaagggcgagagaggcgaccagggcatccccggcgacagaggcagccagggcgagagaggcaagcccggcctgaccggcatgaagggcgccatcggccccatgggcccccccggcaacaagggcagcatgggcagccccggccaccagggcccccccggcagccccggcatccccggcatccccgccgacgccgtgagcttcgaggagatcaagaagtacatcaaccaggaggtgctgagaatcttcgaggagagaatggccgtgttcctgagccagctgaagctgcccgccgccatgctggccgcccaggcctacggcagacccggcccccccggcaaggacggcctgcccggcccccccggcgaccccggcccccaggaggtggacgtgtag

SEQ ID NO: 1914 - DNA, 4167 bp, Homo sapiens
atggcccccagaagaaacaacggccagtgctggtgcctgctgatgctgctgagcgtgagcacccccctgcccgccgtgacccagaccagaggcgccaccgagaccgccagccagggccacctggacctgacccagctgatcggcgtgcccctgcccagcagcgtgagcttcgtgaccggctacggcggcttccccgcctacagcttcggccccggcgccaacgtgggcagacccgccagaaccctgatccccagcaccttcttcagagacttcgccatcagcgtggtggtgaagcccagcagcaccagaggcggcgtgctgttcgccatcaccgacgccttccagaaggtgatctacctgggcctgagactgagcggcgtggaggacggccaccagagaatcatcctgtactacaccgagcccggcagccacgtgagccaggaggccgccgccttcagcgtgcccgtgatgacccacagatggaacagattcgccatgatcgtgcagggcgaggaggtgaccctgctggtgaactgcgaggagcacagcagaatccccttccagagaagcagccaggccctggccttcgagagcagcgccggcatcttcatgggcaacgccggcgccaccggcctggagagattcaccggcagcctgcagcagctgaccgtgcaccccgaccccagaacccccgaggagctgtgcgaccccgaggagagcagcgccagcggcgagaccagcggcctgcaggaggccgacggcgtggccgagatcctggaggccgtgacctacacccaggccagccccaaggaggccaaggtggagcccatcaacaccccccccacccccagcagccccttcgaggacatggagctgagcggcgagcccgtgcccgagggcaccctggagaccaccaacatgagcatcatccagcacagcagccccaagcagggcagcggcgagatcctgaacgacaccctggagggcgtgcacagcgtggacggcgaccccatcaccgacagcggcagcggcgccggcgccttcctggacatcgccgaggagaagaacctggccgccaccgccgccggcctggccgaggtgcccatcagcaccgccggcgaggccgaggccagcagcgtgcccaccggcggccccaccctgagcatgagcaccgagaaccccgaggagggcgtgacccccggccccgacaacgaggagagactggccgccaccgccgccggcgaggccgaggccctggccagcatgcccggcgaggtggaggccagcggcgtggcccccggcgagctggacctgagcatgagcgcccagagcctgggcgaggaggccaccgtgggccccagcagcgaggacagcctgaccaccgccgccgccgccaccgaggtgagcctgagcaccttcgaggacgaggaggccagcggcgtgcccaccgacggcctggcccccctgaccgccaccatggcccccgagagagccgtgaccagcggccccggcgacgaggaggacctggccgccgccaccaccgaggagcccctgatcaccgccggcggcgaggagagcggcagccccccccccgacggcccccccctgcccctgcccaccgtggcccccgagagatggatcacccccgcccagagagagcacgtgggcatgaagggccaggccggccccaagggcgagaagggcgacgccggcgaggagctgcccggcccccccgagcccagcggccccgtgggccccaccgccggcgccgaggccgagggcagcggcctgggctggggcagcgacgtgggcagcggcagcggcgacctggtgggcagcgagcagctgctgagaggcccccccggcccccccggcccccccggcctgcccggcatccccggcaagcccggcaccgacgtgttcatgggcccccccggcagccccggcgaggacggccccgccggcgagcccggcccccccggccccgagggccagcccggcgtggacggcgccaccggcctgcccggcatgaagggcgagaagggcgccagaggccccaacggcagcgtgggcgagaagggcgaccccggcaacagaggcctgcccggcccccccggcaagaagggccaggccggcccccccggcgtgatgggcccccccggcccccccggcccccccggcccccccggccccggctgcaccatgggcctgggcttcgaggacaccgagggcagcggcagcacccagctgctgaacgagcccaagctgagcagacccaccgccgccatcggcctgaagggcgagaagggcgacagaggccccaagggcgagagaggcatggacggcgccagcatcgtgggcccccccggccccagaggcccccccggccacatcaaggtgctgagcaacagcctgatcaacatcacccacggcttcatgaacttcagcgacatccccgagctggtgggcccccccggccccgacggcctgcccggcctgcccggcttccccggccccagaggccccaagggcgacaccggcctgcccggcttccccggcctgaagggcgagcagggcgagaagggcgagcccggcgccatcctgaccgaggacatccccctggagagactgatgggcaagaagggcgagcccggcatgcacggcgcccccggccccatgggccccaagggcccccccggccacaagggcgagttcggcctgcccggcagacccggcagacccggcctgaacggcctgaagggcaccaagggcgaccccggcgtgatcatgcagggcccccccggcctgcccggcccccccggcccccccggcccccccggcgccgtgatcaacatcaagggcgccatcttccccatccccgtgagaccccactgcaagatgcccgtggacaccgcccaccccggcagccccgagctgatcaccttccacggcgtgaagggcgagaagggcagctggggcctgcccggcagcaagggcgagaagggcgaccagggcgcccagggcccccccggcccccccctggacctggcctacctgagacacttcctgaacaacctgaagggcgagaacggcgacaagggcttcaagggcgagaagggcgagaagggcgacatcaacggcagcttcctgatgagcggcccccccggcctgcccggcaaccccggccccgccggccagaagggcgagaccgtggtgggcccccagggcccccccggcgcccccggcctgcccggcccccccggcttcggcagacccggcgaccccggcccccccggcccccccggcccccccggcccccccgccatcctgggcgccgccgtggccctgcccggcccccccggcccccccggccagcccggcctgcccggcagcagaaacctggtgaccgccttcagcaacatggacgacatgctgcagaaggcccacctggtgatcgagggcaccttcatctacctgagagacagcaccgagttcttcatcagagtgagagacggctggaagaagctgcagctgggcgagctgatccccatccccgccgacagcccccccccccccgccctgagcagcaacccccaccagctgctgcccccccccaaccccatcagcagcgccaactacgagaagcccgccctgcacctggccgccctgaacatgcccttcagcggcgacatcagagccgacttccagtgcttcaagcaggccagagccgccggcctgctgagcacctacagagccttcctgagcagccacctgcaggacctgagcaccatcgtgagaaaggccgagagatacagcctgcccatcgtgaacctgaagggccaggtgctgttcaacaactgggacagcatcttcagcggccacggcggccagttcaacatgcacatccccatctacagcttcgacggcagagacatcatgaccgaccccagctggccccagaaggtgatctggcacggcagcagcccccacggcgtgagactggtggacaactactgcgaggcctggagaaccgccgacaccgccgtgaccggcctggccagccccctgagcaccggcaagatcctggaccagaaggcctacagctgcgccaacagactgatcgtgctgtgcatcgagaacagcttcatgaccgacgccagaaagtag

SEQ ID NO: 1915 - DNA, 2238 bp, Homo sapiens
atggcccccagaagaaacaacggccagtgctggtgcctgctgatgctgctgagcgtgcccctgcccagcagcgtgagcttcgtgaccggctacggcggcttccccgcctacagcttcggccccggcgccaacgtgggcagacccgccagaaccctgatccccagcaccttcttcagagacttcgccatcagcgtggtggtgaagcccagcagcaccagaggcggcgtgctgttcgccatcaccgacgccttccagaaggtgatctacctgggcctgagactgagcggcgtggaggacggccaccagagaatcatcctgtactacaccgagcccggcagccacgtgagccaggaggccgccgccttcagcgtgcccgtgatgacccacagatggaacagattcgccatgatcgtgcagggcgaggaggtgaccctgctggtgaactgcgaggagcacagcagaatccccttccagagaagcagccaggccctggccttcgagagcagcgccggcatcttcatgggcaacgccggcgccaccggcctggagagattcaccggcagcctgcagcagctgaccgtgcaccccgaccccagaacccccgaggagctgtgcgaccccgaggagagcagcgccagcggcgagaccagcggcctgcaggaggccgacggcgtggccgagatcctggaggccgtgacctacacccaggccagccccaaggaggccaaggtggagcccatcaacaccccccccacccccagcagccccttcgaggacatggagctgagcggcgagcccgtgcccgagggcaccctggagaccaccaacatgagcatcatccagcacagcagccccaagcagggcagcggcgagatcctgaacgacaccctggagggcgtgcacagcgtggacggcgaccccatcaccgacagcggcagcggcgccggcgccttcctggacatcgccgaggagaagaacctggccgccaccgccgccggcctggccgaggtgcccatcagcaccgccggcgaggccgaggccagcagcgtgcccaccggcggccccaccctgagcatgagcaccgagaaccccgaggagggcgtgacccccggccccgacaacgaggagagactggccgccaccgccgccggcgaggccgaggccctggccagcatgcccggcgaggtggaggccagcggcgtggcccccggcgagctggacctgagcatgagcgcccagagcctgggcgaggaggccaccgtgggccccagcagcgaggacagcctgaccaccgccgccgccgccaccgaggtgagcctgagcaccttcgaggacgaggaggccagcggcgtgcccaccgacggcctggcccccctgaccgccaccatggcccccgagagagccgtgaccagcggccccggcgacgaggaggacctggccgccgccaccaccgaggagcccctgatcaccgccggcggcgaggagagcggcagccccccccccgacggcccccccctgcccctgcccaccgtggcccccgagagatggatcacccccgcccagagagagcacgtgggcatgaagggccaggccggccccaagggcgagaagggcgacgccggcgaggagctgcccggcccccccgagcccagcggccccgtgggccccaccgccggcgccgaggccgagggcagcggcctgggctggggcagcgacgtgggcagcggcagcggcgacctggtgggcagcgagcagctgctgagaggcccccccggcccccccggcccccccggcctgcccggcatccccggcaagcccggcaccgacgtgttcatgggcccccccggcagccccggcgaggacggccccgccggcgagcccggcccccccggccccgagggccagcccggcgtggacggcgccaccggcctgcccggcatgaagggcgagaagggcgccagaggccccaacggcagcgtgggcgagaagggcgaccccggcaacagaggcctgcccggcccccccggcaagaagggccaggccggcccccccggcgtgatgggcccccccggcccccccggcccccccggcccccccggccccggctgcaccatgggcctgggcttcgaggacaccgagggcagcggcagcacccagctgctgaacgagcccaagctgagcagccccacccccaccccccagttctacgacttccacctggccatcgtggagctgtag

SEQ ID NO: 1916 - DNA, 4815 bp, Homo sapiens
atgtgggtgagctgggcccccggcctgtggctgctgggcctgtgggccaccttcggccacggcgccaacaccggcgcccagtgcccccccagccagcaggagggcctgaagctggagcacagcagcagcctgcccgccaacgtgaccggcttcaacctgatccacagactgagcctgatgaagaccagcgccatcaagaagatcagaaaccccaagggccccctgatcctgagactgggcgccgcccccgtgacccagcccaccagaagagtgttccccagaggcctgcccgaggagttcgccctggtgctgaccctgctgctgaagaagcacacccaccagaagacctggtacctgttccaggtgaccgacgccaacggctacccccagatcagcctggaggtgaacagccaggagagaagcctggagctgagagcccagggccaggacggcgacttcgtgagctgcatcttccccgtgccccagctgttcgacctgagatggcacaagctgatgctgagcgtggccggcagagtggccagcgtgcacgtggactgcagcagcgccagcagccagcccctgggccccagaagacccatgagacccgtgggccacgtgttcctgggcctggacgccgagcagggcaagcccgtgagcttcgacctgcagcaggtgcacatctactgcgaccccgagctggtgctggaggagggctgctgcgagatcctgcccgccggctgcccccccgagaccagcaaggccagaagagacacccagagcaacgagctgatcgagatcaacccccagagcgagggcaaggtgtacaccagatgcttctgcctggaggagccccagaacagcgaggtggacgcccagctgaccggcagaatcagccagaaggccgagagaggcgccaaggtgcaccaggagaccgccgccgacgagtgccccccctgcgtgcacggcgccagagacagcaacgtgagcgagtggagagtgggccccgagggcggcaagggcgagagaggcctgcccggcccccccggcagcaagggcgagaagggcgccagaggcaacgactgcgtgagaatcagccccgacgcccccctgcagtgcgccgagggccccaagggcgagaagggcgagagcggcgccctgggccccagcggcctgcccggcagcaccggcgagaagggccagaagggcgagaagggcgacggcggcatcaagggcgtgcccggcaagcccggcagagacggcagacccggcgagatctgcgtgatcggccccaagggccagaagggcgaccccggcttcgtgggccccgagggcctggccggcgagcccggcccccccggcctgcccggcccccccggcatcggcctgcccggcacccccggcgaccccggcggcccccccggccccaagggcgacaagggcagcagcggcatccccggcaaggagggccccggcggcaagcccggcaagcccggcgtgaagggcgagaagggcgacccctgcgaggtgtgccccaccctgcccgagggcttccagaacttcgtgggcctgcccggcaagcccggccccaagggcgagcccggcgaccccgtgcccgccagaggcgaccccggcatccagggcatcaagggcgagaagggcgagccctgcctgagctgcagcagcgtggtgggcgcccagcacctggtgagcagcaccggcgccagcggcgacgtgggcagccccggcttcggcctgcccggcctgcccgtgaaggccggcgtgcccggcctgagccccggcggcaacttcggcgaggccggccccgccggcagccccggcccccccggccccgtgggccccgccggcatcaagggcgccaagggcgagccctgcgagccctgccccgccctgagcaacctgcaggacggcgacgtgagagtggtggccctgcccggccccagcggcgagaagggcgagcccggcccccccggcttcggcctgcccggcaagcagggcaaggccggcgagagaggcctgaagggccagaagggcgacgccggcaaccccggcgaccccggcacccccggcaccaccggcagacccggcctgagcggcgagcccggcgtgcagggccccgccggccccaagggcgagaagggcgacggctgcaccgcctgccccagcctgcagggcaccgtgaccgacatggccggcagacccggccagcccggccccaagggcgagcagggccccgagggcgtgggcagacccggcaagcccggccagcccggcctgcccggcgtgcagggcccccccggcctgaagggcgtgcagggcgagcccggcccccccggcagaggcgtgcagggcccccagggcgagcccggcgcccccggcctgcccggcatccagggcctgcccggccccagaggcccccccggccccaccggcgagaagggcgcccagggcagccccggcgtgaagggcgccaccggccccgtgggcccccccggcgccagcgtgagcggcccccccggcagagacggccagcagggccagaccggcctgagaggcacccccggcgagaagggccccagaggcgagaagggcgagcccggcgagtgcagctgccccagccagggcgacctgatcttcagcggcatgcccggcgcccccggcctgtggatgggcagcagctggcagcccggcccccagggcccccccggcatccccggcccccccggcccccccggcgtgcccggcctgcagggcgtgcccggcaacaacggcctgcccggccagcccggcctgaccgccgagctgggcgccctggccctgggcagccactggggcagccccagcatctgcggcgactgcgtgcagggccagagagcccaccccggctacctggtggagaagggcgagaagggcgaccagggcatccccggcgtgcccggcctggacaactgcgcccagtgcttcctgagcctggagagacccagagccgaggaggccagaggcgacaacagcgagggcgaccccggctgcgtgggcagccccggcctgcccggcccccccggcctgcccggccagagaggcgaggagggcccccccggcatgagaggcagccccggcccccccggccccatcggcccccccggcttccccggcgccgtgggcagccccggcctgcccggcctgcagggcgagagaggcctgaccggcctgaccggcgacaagggcgagcccggcccccccggccagcccggctaccccggcgccaccggcccccccggcctgcccggcatcaagggcgagagaggctacaccggcagcgccggcgagaagggcgagcccggcccccccggcagcgagggcctgcccggcccccccggccccgccggccccagaggcgagagaggcccccagggcaacagcggcgagaagggcgaccagggcttccagggccagcccggcttccccggcccccccggcccccccggcttccccggcaaggtgggcagccccggcccccccggcccccaggccgagaagggcagcgagggcatcagaggccccagcggcctgcccggcagccccggcccccccggcccccccggcatccagggccccgccggcctggacggcctggacggcaaggacggcaagcccggcctgagaggcgaccccggccccgccggcccccccggcctgatgggcccccccggcttcaagggcaagaccggccaccccggcctgcccggccccaagggcgactgcggcaagcccggcccccccggcagcaccggcagacccggcgccgagggcgagcccggcgccatgggcccccagggcagacccggcccccccggccacgtgggcccccccggcccccccggccagcccggccccgccggcatcagcgccgtgggcctgaagggcgacagaggcgccaccggcgagagaggcctggccggcctgcccggccagcccggcccccccggccaccccggcccccccggcgagcccggcaccgacggcgccgccggcaaggagggcccccccggcaagcagggcttctacggcccccccggccccaagggcgaccccggcgccgccggccagaagggccaggccggcgagaagggcagagccggcatgcccggcggccccggcaagagcggcagcatgggccccgtgggcccccccggccccgccggcgagagaggccaccccggcgcccccggccccagcggcagccccggcctgcccggcgtgcccggcagcatgggcgacatggtgaactacgacgagatcaagagattcatcagacaggagatcatcaagatgttcgacgagagaatggcctactacaccagcagaatgcagttccccatggagatggccgccgcccccggcagacccggcccccccggcaaggacggcgcccccggcagacccggcgcccccggcagccccggcctgcccggccagatcggcagagagggcagacagggcctgcccggcgtgagaggcctgcccggcaccaagggcgagaagggcgacatcggcatcggcatcgccggcgagaacggcctgcccggcccccccggcccccagggcccccccggctacggcaagatgggcgccaccggccccatgggccagcagggcatccccggcatccccggcccccccggccccatgggccagcccggcaaggccggccactgcaaccccagcgactgcttcggcgccatgcccatggagcagcagtacccccccatgaagaccatgaagggccccttcggctag

SEQ ID NO: 1917 - DNA, 4815 bp, Homo sapiens
atgtgggtgagctgggcccccggcctgtggctgctgggcctgtgggccaccttcggccacggcgccaacaccggcgcccagtgcccccccagccagcaggagggcctgaagctggagcacagcagcagcctgcccgccaacgtgaccggcttcaacctgatccacagactgagcctgatgaagaccagcgccatcaagaagatcagaaaccccaagggccccctgatcctgagactgggcgccgcccccgtgacccagcccaccagaagagtgttccccagaggcctgcccgaggagttcgccctggtgctgaccctgctgctgaagaagcacacccaccagaagacctggtacctgttccaggtgaccgacgccaacggctacccccagatcagcctggaggtgaacagccaggagagaagcctggagctgagagcccagggccaggacggcgacttcgtgagctgcatcttccccgtgccccagctgttcgacctgagatggcacaagctgatgctgagcgtggccggcagagtggccagcgtgcacgtggactgcagcagcgccagcagccagcccctgggccccagaagacccatgagacccgtgggccacgtgttcctgggcctggacgccgagcagggcaagcccgtgagcttcgacctgcagcaggtgcacatctactgcgaccccgagctggtgctggaggagggctgctgcgagatcctgcccgccggctgcccccccgagaccagcaaggccagaagagacacccagagcaacgagctgatcgagatcaacccccagagcgagggcaaggtgtacaccagatgcttctgcctggaggagccccagaacagcgaggtggacgcccagctgaccggcagaatcagccagaaggccgagagaggcgccaaggtgcaccaggagaccgccgccgacgagtgccccccctgcgtgcacggcgccagagacagcaacgtgaccctggcccccagcggccccaagggcggcaagggcgagagaggcctgcccggcccccccggcagcaagggcgagaagggcgccagaggcaacgactgcgtgagaatcagccccgacgcccccctgcagtgcgccgagggccccaagggcgagaagggcgagagcggcgccctgggccccagcggcctgcccggcagcaccggcgagaagggccagaagggcgagaagggcgacggcggcatcaagggcgtgcccggcaagcccggcagagacggcagacccggcgagatctgcgtgatcggccccaagggccagaagggcgaccccggcttcgtgggccccgagggcctggccggcgagcccggcccccccggcctgcccggcccccccggcatcggcctgcccggcacccccggcgaccccggcggcccccccggccccaagggcgacaagggcagcagcggcatccccggcaaggagggccccggcggcaagcccggcaagcccggcgtgaagggcgagaagggcgacccctgcgaggtgtgccccaccctgcccgagggcttccagaacttcgtgggcctgcccggcaagcccggccccaagggcgagcccggcgaccccgtgcccgccagaggcgaccccggcatccagggcatcaagggcgagaagggcgagccctgcctgagctgcagcagcgtggtgggcgcccagcacctggtgagcagcaccggcgccagcggcgacgtgggcagccccggcttcggcctgcccggcctgcccggcagagccggcgtgcccggcctgaagggcgagaagggcaacttcggcgaggccggccccgccggcagccccggcccccccggccccgtgggccccgccggcatcaagggcgccaagggcgagccctgcgagccctgccccgccctgagcaacctgcaggacggcgacgtgagagtggtggccctgcccggccccagcggcgagaagggcgagcccggcccccccggcttcggcctgcccggcaagcagggcaaggccggcgagagaggcctgaagggccagaagggcgacgccggcaaccccggcgaccccggcacccccggcaccaccggcagacccggcctgagcggcgagcccggcgtgcagggccccgccggccccaagggcgagaagggcgacggctgcaccgcctgccccagcctgcagggcaccgtgaccgacatggccggcagacccggccagcccggccccaagggcgagcagggccccgagggcgtgggcagacccggcaagcccggccagcccggcctgcccggcgtgcagggcccccccggcctgaagggcgtgcagggcgagcccggcccccccggcagaggcgtgcagggcccccagggcgagcccggcgcccccggcctgcccggcatccagggcctgcccggccccagaggcccccccggccccaccggcgagaagggcgcccagggcagccccggcgtgaagggcgccaccggccccgtgggcccccccggcgccagcgtgagcggcccccccggcagagacggccagcagggccagaccggcctgagaggcacccccggcgagaagggccccagaggcgagaagggcgagcccggcgagtgcagctgccccagccagggcgacctgatcttcagcggcatgcccggcgcccccggcctgtggatgggcagcagctggcagcccggcccccagggcccccccggcatccccggcccccccggcccccccggcgtgcccggcctgcagggcgtgcccggcaacaacggcctgcccggccagcccggcctgaccgccgagctgggcagcctgcccatcgagcagcacctgctgaagagcatctgcggcgactgcgtgcagggccagagagcccaccccggctacctggtggagaagggcgagaagggcgaccagggcatccccggcgtgcccggcctggacaactgcgcccagtgcttcctgagcctggagagacccagagccgaggaggccagaggcgacaacagcgagggcgaccccggctgcgtgggcagccccggcctgcccggcccccccggcctgcccggccagagaggcgaggagggcccccccggcatgagaggcagccccggcccccccggccccatcggcccccccggcttccccggcgccgtgggcagccccggcctgcccggcctgcagggcgagagaggcctgaccggcctgaccggcgacaagggcgagcccggcccccccggccagcccggctaccccggcgccaccggcccccccggcctgcccggcatcaagggcgagagaggctacaccggcagcgccggcgagaagggcgagcccggcccccccggcagcgagggcctgcccggcccccccggccccgccggccccagaggcgagagaggcccccagggcaacagcggcgagaagggcgaccagggcttccagggccagcccggcttccccggcccccccggcccccccggcttccccggcaaggtgggcagccccggcccccccggcccccaggccgagaagggcagcgagggcatcagaggccccagcggcctgcccggcagccccggcccccccggcccccccggcatccagggccccgccggcctggacggcctggacggcaaggacggcaagcccggcctgagaggcgaccccggccccgccggcccccccggcctgatgggcccccccggcttcaagggcaagaccggccaccccggcctgcccggccccaagggcgactgcggcaagcccggcccccccggcagcaccggcagacccggcgccgagggcgagcccggcgccatgggcccccagggcagacccggcccccccggccacgtgggcccccccggcccccccggccagcccggccccgccggcatcagcgccgtgggcctgaagggcgacagaggcgccaccggcgagagaggcctggccggcctgcccggccagcccggcccccccggccaccccggcccccccggcgagcccggcaccgacggcgccgccggcaaggagggcccccccggcaagcagggcttctacggcccccccggccccaagggcgaccccggcgccgccggccagaagggccaggccggcgagaagggcagagccggcatgcccggcggccccggcaagagcggcagcatgggccccgtgggcccccccggccccgccggcgagagaggccaccccggcgcccccggccccagcggcagccccggcctgcccggcgtgcccggcagcatgggcgacatggtgaactacgacgagatcaagagattcatcagacaggagatcatcaagatgttcgacgagagaatggcctactacaccagcagaatgcagttccccatggagatggccgccgcccccggcagacccggcccccccggcaaggacggcgcccccggcagacccggcgcccccggcagccccggcctgcccggccagatcggcagagagggcagacagggcctgcccggcgtgagaggcctgcccggcaccaagggcgagaagggcgacatcggcatcggcatcgccggcgagaacggcctgcccggcccccccggcccccagggcccccccggctacggcaagatgggcgccaccggccccatgggccagcagggcatccccggcatccccggcccccccggccccatgggccagcccggcaaggccggccactgcaaccccagcgactgcttcggcgccatgcccatggagcagcagtacccccccatgaagaccatgaagggccccttcggctag

SEQ ID NO: 1918 - DNA, 4494 bp, Homo sapiens
atggacgtgaccaagaagaacaagagagacggcaccgaggtgaccgagagaatcgtgaccgagaccgtgaccaccagactgaccagcctgccccccaagggcggcaccagcaacggctacgccaagaccgccagcctgggcggcggcagcagactggagaagcagagcctgacccacggcagcagcggctacatcaacagcaccggcagcaccagaggccacgccagcaccagcagctacagaagagcccacagccccgccagcaccctgcccaacagccccggcagcaccttcgagagaaagacccacgtgaccagacacgcctacgagggcagcagcagcggcaacagcagccccgagtaccccagaaaggagttcgccagcagcagcaccagaggcagaagccagaccagagagagcgagatcagagtgagactgcagagcgccagccccagcaccagatggaccgagctggacgacgtgaagagactgctgaagggcagcagaagcgccagcgtgagccccaccagaaacagcagcaacaccctgcccatccccaagaagggcaccgtggagaccaagatcgtgaccgccagcagccagagcgtgagcggcacctacgacgccaccatcctggacgccaacctgcccagccacgtgtggagcagcaccctgcccgccggcagcagcatgggcacctaccacaacaacatgaccacccagagcagcagcctgctgaacaccaacgcctacagcgccggcagcgtgttcggcgtgcccaacaacatggccagctgcagccccaccctgcaccccggcctgagcaccagcagcagcgtgttcggcatgcagaacaacctggcccccagcctgaccaccctgagccacggcaccaccaccaccagcaccgcctacggcgtgaagaagaacatgccccagagccccgccgccgtgaacaccggcgtgagcaccagcgccgcctgcaccaccagcgtgcagagcgacgacctgctgcacaaggactgcaagttcctgatcctggagaaggacaacacccccgccaagaaggagatggagctgctgatcatgaccaaggacagcggcaaggtgttcaccgccagccccgccagcatcgccgccaccagcttcagcgaggacaccctgaagaaggagaagcaggccgcctacaacgccgacagcggcctgaaggccgaggccaacggcgacctgaagaccgtgagcaccaagggcaagaccaccaccgccgacatccacagctacggcagcagcggcggcggcggcagcggcggcggcggcggcgtgggcggcgccggcggcggcccctggggccccgcccccgcctggtgcccctgcggcagctgctgcagctggtggaagtggctgctgggcctgctgctgacctggctgctgctgctgggcctgctgttcggcctgatcgccctggccgaggaggtgagaaagctgaaggccagagtggacgagctggagagaatcagaagaagcatcctgccctacggcgacagcatggacagaatcgagaaggacagactgcagggcatggcccccgccgccggcgccgacctggacaagatcggcctgcacagcgacagccaggaggagctgtggatgttcgtgagaaagaagctgatgatggagcaggagaacggcaacctgagaggcagccccggccccaagggcgacatgggcagccccggccccaagggcgacagaggcttccccggcacccccggcatccccggccccctgggccaccccggcccccagggccccaagggccagaagggcagcgtgggcgaccccggcatggagggccccatgggccagagaggcagagagggccccatgggccccagaggcgaggccggcccccccggcagcggcgagaagggcgagagaggcgccgccggcgagcccggcccccacggcccccccggcgtgcccggcagcgtgggccccaagggcagcagcggcagccccggcccccagggcccccccggccccgtgggcctgcagggcctgagaggcgaggtgggcctgcccggcgtgaagggcgacaagggccccatgggcccccccggccccaagggcgaccagggcgagaagggccccagaggcctgaccggcgagcccggcatgagaggcctgcccggcgccgtgggcgagcccggcgccaagggcgccatgggccccgccggccccgacggccaccagggccccagaggcgagcagggcctgaccggcatgcccggcatcagaggcccccccggccccagcggcgaccccggcaagcccggcctgaccggcccccagggcccccagggcctgcccggcacccccggcagacccggcatcaagggcgagcccggcgcccccggcaagatcgtgaccagcgagggcagcagcatgctgaccgtgcccggcccccccggcccccccggcgccatgggcccccccggcccccccggcgcccccggccccgccggccccgccggcctgcccggccaccaggaggtgctgaacctgcagggcccccccggcccccccggccccagaggcccccccggccccagcatccccggcccccccggccccagaggcccccccggcgagggcctgcccggcccccccggcccccccggcagcttcctgagcaacagcgagaccttcctgagcggcccccccggcccccccggcccccccggccccaagggcgaccagggcccccccggccccagaggccaccagggcgagcagggcctgcccggcttcagcaccagcggcagcagcagcttcggcctgaacctgcagggcccccccggcccccccggcccccagggccccaagggcgacaagggcgaccccggcgtgcccggcgccctgggcatccccagcggccccagcgagggcggcagcagcagcaccatgtacgtgagcggcccccccggcccccccggcccccccggcccccccggcagcatcagcagcagcggccaggagatccagcagtacatcagcgagtacatgcagagcgacagcatcagaagctacctgagcggcgtgcagggcccccccggcccccccggcccccccggccccgtgaccaccatcaccggcgagaccttcgactacagcgagctggccagccacgtggtgagctacctgagaaccagcggctacggcgtgagcctgttcagcagcagcatcagcagcgaggacatcctggccgtgctgcagagagacgacgtgagacagtacctgagacagtacctgatgggccccagaggcccccccggcccccccggcgccagcggcgacggcagcctgctgagcctggactacgccgagctgagcagcagaatcctgagctacatgagcagcagcggcatcagcatcggcctgcccggcccccccggcccccccggcctgcccggcaccagctacgaggagctgctgagcctgctgagaggcagcgagttcagaggcatcgtgggcccccccggcccccccggcccccccggcatccccggcaacgtgtggagcagcatcagcgtggaggacctgagcagctacctgcacaccgccggcctgagcttcatccccggcccccccggcccccccggcccccccggccccagaggcccccccggcgtgagcggcgccctggccacctacgccgccgagaacagcgacagcttcagaagcgagctgatcagctacctgaccagccccgacgtgagaagcttcatcgtgggcccccccggcccccccggcccccagggcccccccggcgacagcagactgctgagcaccgacgccagccacagcagaggcagcagcagcagcagccacagcagcagcgtgagaagaggcagcagctacagcagcagcatgagcaccggcggcggcggcgccggcagcctgggcgccggcggcgccttcggcgaggccgccggcgacagaggcccctacggcaccgacatcggccccggcggcggctacggcgccgccgccgagggcggcatgtacgccggcaacggcggcctgctgggcgccgacttcgccggcgacctggactacaacgagctggccgtgagagtgagcgagagcatgcagagacagggcctgctgcagggcatggcctacaccgtgcagggcccccccggccagcccggcccccagggcccccccggcatcagcaaggtgttcagcgcctacagcaacgtgaccgccgacctgatggacttcttccagacctacggcgccatccagggcccccccggccagaagggcgagatgggcacccccggccccaagggcgacagaggccccgccggcccccccggccaccccggcccccccggccccagaggccacaagggcgagaagggcgacaagggcgaccaggtgtacgccggcagaagaagaagaagaagcatcgccgtgaagccctag

SEQ ID NO: 1919 - DNA, 1254 bp, Homo sapiens
atggacgtgaccaagaagaacaagagagacggcaccgaggtgaccgagagaatcgtgaccgagaccgtgaccaccagactgaccagcctgccccccaagggcggcaccagcaacggctacgccaagaccgccagcctgggcggcggcagcagactggagaagcagagcctgacccacggcagcagcggctacatcaacagcaccggcagcaccagaggccacgccagcaccagcagctacagaagagcccacagccccgccagcaccctgcccaacagccccggcagcaccttcgagagaaagacccacgtgaccagacacgcctacgagggcagcagcagcggcaacagcagccccgagtaccccagaaaggagttcgccagcagcagcaccagaggcagaagccagaccagagagagcgagatcagagtgagactgcagagcgccagccccagcaccagatggaccgagctggacgacgtgaagagactgctgaagggcagcagaagcgccagcgtgagccccaccagaaacagcagcaacaccctgcccatccccaagaagggcaccgtggagaccaagatcgtgaccgccagcagccagagcgtgagcggcacctacgacgccaccatcctggacgccaacctgcccagccacgtgtggagcagcaccctgcccgccggcagcagcatgggcacctaccacaacaacatgaccacccagagcagcagcctgctgaacaccaacgcctacagcgccggcagcgtgttcggcgtgcccaacaacatggccagctgcagccccaccctgcaccccggcctgagcaccagcagcagcgtgttcggcatgcagaacaacctggcccccagcctgaccaccctgagccacggcaccaccaccaccagcaccgcctacggcgtgaagaagaacatgccccagagccccgccgccgtgaacaccggcgtgagcaccagcgccgcctgcaccaccagcgtgcagagcgacgacctgctgcacaaggactgcaagttcctgatcctggagaaggacaacacccccgccaagaaggagatggagctgctgatcatgaccaaggacagcggcaaggtgttcaccgccagccccgccagcatcgccgccaccagcttcagcgaggacaccctgaagaaggagaagcaggccgcctacaacgccgacagcggcctgaaggccgaggccaacggcaagaacaagtacgactgctgccccccctag

SEQ ID NO: 1920 - DNA, 201 bp, Homo sapiens
tgatacggcgccatccagggcccccccggccagaagggcgagatgggcacccccggccccaagggcgacagaggccccgccggcccccccggccaccccggcccccccggccccagaggccacaagggcgagaagggcgacaagggcgaccaggtgtacgccggcagaagaagaagaagaagcatcgccgtgaagccctag

SEQ ID NO: 1921 - DNA, 1815 bp, Homo sapiens
atggacgtgaccaagaagaacaagagagacggcaccgaggtgaccgagagaatcgtgaccgagaccgtgaccaccagactgaccagcctgccccccaagggcggcaccagcaacggctacgccaagaccgccagcctgggcggcggcagcagactggagaagcagagcctgacccacggcagcagcggctacatcaacagcaccggcagcaccagaggccacgccagcaccagcagctacagaagagcccacagccccgccagcaccctgcccaacagccccggcagcaccttcgagagaaagacccacgtgaccagacacgcctacgaggccagcagcagcaccagaggcagaagccagaccagagagagcgagatcagagtgagactgcagagcgccagccccagcaccagatggaccgagctggacgacgtgaagagactgctgaagggcagcagaagcgccagcgtgagccccaccagaaacagcagcaacaccctgcccatccccaagaagggcaccgtggagaccaagatcgtgaccgccagcagccagagcgtgagcggcacctacgacgccaccatcctggacgccaacctgcccagccacgtgtggagcagcaccctgcccgccggcagcagcatgggcacctaccacaacaacatgaccacccagagcagcagcctgctgaacaccaacgcctacagcgccggcagcgtgttcggcgtgcccaacaacatggccagctgcagccccaccctgcaccccggcctgagcaccagcagcagcgtgttcggcatgcagaacaacctggcccccagcctgaccaccctgagccacggcaccaccaccaccagcaccgcctacggcgtgaagaagaacatgccccagagccccgccgccgtgaacaccggcgtgagcaccagcgccgcctgcaccaccagcgtgcagagcgacgacctgctgcacaaggactgcaagttcctgatcctggagaaggacaacacccccgccaagaaggagatggagctgctgatcatgaccaaggacagcggcaaggtgttcaccgccagccccgccagcatcgccgccaccagcttcagcgaggacaccctgaagaaggagaagcaggccgcctacaacgccgacagcggcctgaaggccgaggccaacggcgacctgaagaccgtgagcaccaagggcaagaccaccaccgccgacatccacagctacggcagcagcggcggcggcggcagcggcggcggcggcggcgtgggcggcgccggcggcggcccctggggccccgcccccgcctggtgcccctgcggcagctgctgcagctggtggaagtggctgctgggcctgctgctgacctggctgctgctgctgggcctgctgttcggcctgatcgccctggccgaggaggtgagaaagctgaaggccagagtggacgagctggagagaatcagaagaagcatcctgccctacggcgacagcatggacagaatcgagaaggacagactgcagggcatggcccccgccgccggcgccgacctggacaagatcggcctgcacagcgacagccaggaggagctgtggatgttcgtgagaaagaagctgatgatggagcaggagaacggcaacctgagaggcagccccggccccaagggcgacatgggcagccccggccccaagggcgacagaggcttccccggcacccccggcatccccggccccctgggccaccccggcccccagggccccaagggccagaagggcagcgtgggcgaccccggcatggagggccccatgtag

SEQ ID NO: 1922 - DNA, 3951 bp, Homo sapiens
atgagcagcggcgaccccgcccacctgggcctgtgcctgtggctgtggctgggcgccaccctgggcagagagcaggtgcaggccagcggcctgctgagactggccgtgctgcccgaggacagactgcagatgaagtggagagagagcgagggcagcggcctgggctacctggtgcaggtgaagcccatggccggcgacagcgagcaggaggtgatcctgaccaccaagacccccaaggccaccgtgggcggcctgagccccagcaagggctacaccctgcagatcttcgagctgaccggcagcggcagattcctgctggccagaagagagttcgtgatcgaggacctgaagagcagcagcctggacagaagcagccagagacccctgggcagcggcgcccccgagcccacccccagccacaccggcagccccgaccccgagcaggccagcgagccccaggtggccttcacccccagccaggaccccagaacccccgccggcccccagttcagatgcctgccccccgtgcccgccgacatggtgttcctggtggacggcagctggagcatcggccacagccacttccagcaggtgaaggacttcctggccagcgtgatcgcccccttcgagatcggccccgacaaggtgcaggtgggcctgacccagtacagcggcgacgcccagaccgagtgggacctgaacagcctgagcaccaaggagcaggtgctggccgccgtgagaagactgagatacaagggcggcaacaccttcaccggcctggccctgacccacgtgctgggccagaacctgcagcccgccgccggcctgagacccgaggccgccaaggtggtgatcctggtgaccgacggcaagagccaggacgacgtgcacaccgccgccagagtgctgaaggacctgggcgtgaacgtgttcgccgtgggcgtgaagaacgccgacgaggccgagctgagactgctggccagcccccccagagacatcaccgtgcacagcgtgctggacttcctgcagctgggcgccctggccggcctgctgagcagactgatctgccagagactgcagggcggcagccccagacagggccccgccgccgcccccgccctggacaccctgcccgcccccaccagcctggtgctgagccaggtgaccagcagcagcatcagactgagctggacccccgcccccagacaccccctgaagtacctgatcgtgtggagagccagcagaggcggcacccccagagaggtggtggtggagggccccgccgccagcaccgagctgcacaacctggccagcagaaccgagtacctggtgagcgtgttccccatctacgagggcggcgtgggcgagggcctgagaggcctggtgaccaccgcccccctgcccccccccagagccctgaccctggccgccgtgacccccagaaccgtgcacctgacctggcagcccagcgccggcgccacccactacctggtgagatgcagccccgccagccccaagggcgaggaggaggagagagaggtgcaggtgggcagacccgaggtgctgctggacggcctggagcccggcagagactacgaggtgagcgtgcagagcctgagaggccccgagggcagcgaggccagaggcatcagagccagaacccccaccctggccccccccagacacctgggcttcagcgacgtgagccacgacgccgccagagtgttctgggagggcgcccccagacccgtgagactggtgagagtgacctacgtgagcagcgagggcggccacagcggccagaccgaggcccccggcaacgccaccagcgccaccctgggccccctgagcagcagcaccacctacaccgtgagagtgacctgcctgtaccccggcggcggcagcagcaccctgaccggcagagtgaccaccaagaaggcccccagccccagccagctgagcatgaccgagctgcccggcgacgccgtgcagctggcctgggtggccgccgcccccagcggcgtgctggtgtaccagatcacctggacccccctgggcgagggcaaggcccacgagatcagcgtgcccggcaacctgggcaccgccgtgctgcccggcctgggcagacacaccgagtacgacgtgaccatcctggcctactacagagacggcgccagaagcgaccccgtgagcctgagatacacccccagcaccgtgagcagaagcccccccagcaacctggccctggccagcgagacccccgacagcctgcaggtgagctggaccccccccctgggcagagtgctgcactactggctgacctacgcccccgccagcggcctgggccccgagaagagcgtgagcgtgcccggcgccagaagccacgtgaccctgcccgacctgcaggccgccaccaagtacagagtgctggtgagcgccatctacgccgccggcagaagcgaggccgtgagcgccaccggccagaccgcctgccccgccctgagacccgacggcagcctgcccggcttcgacctgatggtggccttcagcctggtggagaaggcctacgccagcatcagaggcgtggccatggagcccagcgccttcggcggcacccccaccttcaccctgttcaaggacgcccagctgaccagaagagtgagcgacgtgtaccccgcccccctgccccccgagcacaccatcgtgttcctggtgagactgctgcccgagacccccagagaggccttcgccctgtggcagatgaccgccgaggacttccagcccctgctgggcgtgctgctggacgccggcaagaagagcctgacctacttccacagagaccccagagccgccctgcaggaggccaccttcgacccccaggaggtgagaaagatcttcttcggcagcttccacaaggtgcacgtggccgtgggcagaagcaaggtgagactgtacgtggactgcagaaaggtggccgagagacccctgggcgagatgggcagcccccccgccgccggcttcgtgaccctgggcagactggccaaggccagaggccccagaagcagcagcgccgccttccagctgcagatgctgcagatcgtgtgcagcgacacctgggccgacgaggacagatgctgcgagctgcccgccagcagagacggcgagacctgccccgccttcgtgagcgcctgcagctgcagcagcgagacccccggcccccccggcccccagggcccccccggcctgcccggcagaaacggcacccccggcgagcagggcttccccggccccagaggcgagcccggcccccccggccagatgggccccgagggccccggcggccagcagggcagccccggcacccagggcagagccgtgcagggccccgtgggcccccccggcgtgaagggcgagaagggcgaccacggcctgcccggcctgcagggccaccccggccaccagggcatccccggcagagtgggcctgcagggccccaagggcatgagaggcctggagggcaccgccggcctgcccggcccccccggccccagaggcttccagggcatggccggcgccagaggcaccagcggcgagagaggcccccccggcaccgtgggccccaccggcctgcccggccccaagggcgagagaggcgagaagggcgagccccagagcctggccaccctgtaccagctggtgagccaggccagccacgtgagcaagttcgacagcttccacgagaacaccagaccccccatgcccatcctggagcagaagctggagcccggcaccgagcccctgggcagccccggcaccagaagcaaggccctggtgcccggcgagtggggcagaggcggcagacacctggagggcagaggcgagcccggcgccgtgggccagatgggcagccccggccagcagggcgccagcacccagggcctgtgggagtag

SEQ ID NO: 1923 - DNA, 3855 bp, Homo sapiens
atgagcagcggcgaccccgcccacctgggcctgtgcctgtggctgtggctgggcgccaccctgggcagagagcaggtgcaggccagcggcctgctgagactggccgtgctgcccgaggacagactgcagatgaagtggagagagagcgagggcagcggcctgggctacctggtgcaggtgaagcccatggccggcgacagcgagcaggaggtgatcctgaccaccaagacccccaaggccaccgtgggcggcctgagccccagcaagggctacaccctgcagatcttcgagctgaccggcagcggcagattcctgctggccagaagagagttcgtgatcgaggacctgaagagcagcagcctggacagaagcagccagagacccctgggcagcggcgcccccgagcccacccccagccacaccggcagccccgaccccgagcaggccagcgagccccaggtggccttcacccccagccaggaccccagaacccccgccggcccccagttcagatgcctgccccccgtgcccgccgacatggtgttcctggtggacggcagctggagcatcggccacagccacttccagcaggtgaaggacttcctggccagcgtgatcgcccccttcgagatcggccccgacaaggtgcaggtgggcctgacccagtacagcggcgacgcccagaccgagtgggacctgaacagcctgagcaccaaggagcaggtgctggccgccgtgagaagactgagatacaagggcggcaacaccttcaccggcctggccctgacccacgtgctgggccagaacctgcagcccgccgccggcctgagacccgaggccgccaaggtggtgatcctggtgaccgacggcaagagccaggacgacgtgcacaccgccgccagagtgctgaaggacctgggcgtgaacgtgttcgccgtgggcgtgaagaacgccgacgaggccgagctgagactgctggccagcccccccagagacatcaccgtgcacagcgtgctggacttcctgcagctgggcgccctggccggcctgctgagcagactgatctgccagagactgcagggcggcagccccagacagggccccgccgccgcccccgccctggacaccctgcccgcccccaccagcctggtgctgagccaggtgaccagcagcagcatcagactgagctggacccccgcccccagacaccccctgaagtacctgatcgtgtggagagccagcagaggcggcacccccagagaggtggtggtggagggccccgccgccagcaccgagctgcacaacctggccagcagaaccgagtacctggtgagcgtgttccccatctacgagggcggcgtgggcgagggcctgagaggcctggtgaccaccgcccccctgcccccccccagagccctgaccctggccgccgtgacccccagaaccgtgcacctgacctggcagcccagcgccggcgccacccactacctggtgagatgcagccccgccagccccaagggcgaggaggaggagagagaggtgcaggtgggcagacccgaggtgctgctggacggcctggagcccggcagagactacgaggtgagcgtgcagagcctgagaggccccgagggcagcgaggccagaggcatcagagccagaacccccaccctggccccccccagacacctgggcttcagcgacgtgagccacgacgccgccagagtgttctgggagggcgcccccagacccgtgagactggtgagagtgacctacgtgagcagcgagggcggccacagcggccagaccgaggcccccggcaacgccaccagcgccaccctgggccccctgagcagcagcaccacctacaccgtgagagtgacctgcctgtaccccggcggcggcagcagcaccctgaccggcagagtgaccaccaagaaggcccccagccccagccagctgagcatgaccgagctgcccggcgacgccgtgcagctggcctgggtggccgccgcccccagcggcgtgctggtgtaccagatcacctggacccccctgggcgagggcaaggcccacgagatcagcgtgcccggcaacctgggcaccgccgtgctgcccggcctgggcagacacaccgagtacgacgtgaccatcctggcctactacagagacggcgccagaagcgaccccgtgagcctgagatacacccccagcaccgtgagcagaagcccccccagcaacctggccctggccagcgagacccccgacagcctgcaggtgagctggaccccccccctgggcagagtgctgcactactggctgacctacgcccccgccagcggcctgggccccgagaagagcgtgagcgtgcccggcgccagaagccacgtgaccctgcccgacctgcaggccgccaccaagtacagagtgctggtgagcgccatctacgccgccggcagaagcgaggccgtgagcgccaccggccagaccgcctgccccgccctgagacccgacggcagcctgcccggcttcgacctgatggtggccttcagcctggtggagaaggcctacgccagcatcagaggcgtggccatggagcccagcgccttcggcggcacccccaccttcaccctgttcaaggacgcccagctgaccagaagagtgagcgacgtgtaccccgcccccctgccccccgagcacaccatcgtgttcctggtgagactgctgcccgagacccccagagaggccttcgccctgtggcagatgaccgccgaggacttccagcccctgctgggcgtgctgctggacgccggcaagaagagcctgacctacttccacagagaccccagagccgccctgcaggaggccaccttcgacccccaggaggtgagaaagatcttcttcggcagcttccacaaggtgcacgtggccgtgggcagaagcaaggtgagactgtacgtggactgcagaaaggtggccgagagacccctgggcgagatgggcagcccccccgccgccggcttcgtgaccctgggcagactggccaaggccagaggccccagaagcagcagcgccgccttccagctgcagatgctgcagatcgtgtgcagcgacacctgggccgacgaggacagatgctgcgagctgcccgccagcagagacggcgagacctgccccgccttcgtgagcgcctgcagctgcagcagcgagacccccggcccccccggcccccagggcccccccggcctgcccggcagaaacggcacccccggcgagcagggcttccccggccccagaggcccccccggcgtgaagggcgagaagggcgaccacggcctgcccggcctgcagggccaccccggccaccagggcatccccggcagagtgggcctgcagggccccaagggcatgagaggcctggagggcaccgccggcctgcccggcccccccggccccagaggcttccagggcatggccggcgccagaggcaccagcggcgagagaggcccccccggcaccgtgggccccaccggcctgcccggccccaagggcgagagaggcgagaagggcgagccccagagcctggccaccctgtaccagctggtgagccaggccagccacgtgagcaagttcgacagcttccacgagaacaccagaccccccatgcccatcctggagcagaagctggagcccggcaccgagcccctgggcagccccggcaccagaagcaaggccctggtgcccggcgagtggggcagaggcggcagacacctggagggcagaggcgagcccggcgccgtgggccagatgggcagccccggccagcagggcgccagcacccagggcctgtgggagtag

SEQ ID NO: 1924 - DNA, 3894 bp, Homo sapiens
atgagcagcggcgaccccgcccacctgggcctgtgcctgtggctgtggctgggcgccaccctgggcagagagcaggtgcaggccagcggcctgctgagactggccgtgctgcccgaggacagactgcagatgaagtggagagagagcgagggcagcggcctgggctacctggtgcaggtgaagcccatggccggcgacagcgagcaggaggtgatcctgaccaccaagacccccaaggccaccgtgggcggcctgagccccagcaagggctacaccctgcagatcttcgagctgaccggcagcggcagattcctgctggccagaagagagttcgtgatcgaggacctgaagagcagcagcctggacagaagcagccagagacccctgggcagcggcgcccccgagcccacccccagccacaccggcagccccgaccccgagcaggccagcgagccccaggtggccttcacccccagccaggaccccagaacccccggcggcagcgagtggagagagaccggcccccagttcagatgcctgccccccgtgcccgccgacatggtgttcctggtggacggcagctggagcatcggccacagccacttccagcaggtgaaggacttcctggccagcgtgatcgcccccttcgagatcggccccgacaaggtgcaggtgggcctgacccagtacagcggcgacgcccagaccgagtgggacctgaacagcctgagcaccaaggagcaggtgctggccgccgtgagaagactgagatacaagggcggcaacaccttcaccggcctggccctgacccacgtgctgggccagaacctgcagcccgccgccggcctgagacccgaggccgccaaggtggtgatcctggtgaccgacggcaagagccaggacgacgtgcacaccgccgccagagtgctgaaggacctgggcgtgaacgtgttcgccgtgggcgtgaagaacgccgacgaggccgagctgagactgctggccagcccccccagagacatcaccgtgcacagcgtgctggacttcctgcagctgggcgccctggccggcctgctgagcagactgatctgccagagactgcagggcggcagccccagacagggccccgccgccgcccccgccctggacaccctgcccgcccccaccagcctggtgctgagccaggtgaccagcagcagcatcagactgagctggacccccgcccccagacaccccctgaagtacctgatcgtgtggagagccagcagaggcggcacccccagagaggtggtggtggagggccccgccgccagcaccgagctgcacaacctggccagcagaaccgagtacctggtgagcgtgttccccatctacgagggcggcgtgggcgagggcctgagaggcctggtgaccaccgcccccctgcccccccccagagccctgaccctggccgccgtgacccccagaaccgtgcacctgacctggcagcccagcgccggcgccacccactacctggtgagatgcagccccgccagccccaagggcgaggaggaggagagagaggtgcaggtgggcagacccgaggtgctgctggacggcctggagcccggcagagactacgaggtgagcgtgcagagcctgagaggccccgagggcagcgaggccagaggcatcagagccagaacccccaccctggccccccccagacacctgggcttcagcgacgtgagccacgacgccgccagagtgttctgggagggcgcccccagacccgtgagactggtgagagtgacctacgtgagcagcgagggcggccacagcggccagaccgaggcccccggcaacgccaccagcgccaccctgggccccctgagcagcagcaccacctacaccgtgagagtgacctgcctgtaccccggcggcggcagcagcaccctgaccggcagagtgaccaccaagaaggcccccagccccagccagctgagcatgaccgagctgcccggcgacgccgtgcagctggcctgggtggccgccgcccccagcggcgtgctggtgtaccagatcacctggacccccctgggcgagggcaaggcccacgagatcagcgtgcccggcaacctgggcaccgccgtgctgcccggcctgggcagacacaccgagtacgacgtgaccatcctggcctactacagagacggcgccagaagcgaccccgtgagcctgagatacacccccagcaccgtgagcagaagcccccccagcaacctggccctggccagcgagacccccgacagcctgcaggtgagctggaccccccccctgggcagagtgctgcactactggctgacctacgcccccgccagcggcctgggccccgagaagagcgtgagcgtgcccggcgccagaagccacgtgaccctgcccgacctgcaggccgccaccaagtacagagtgctggtgagcgccatctacgccgccggcagaagcgaggccgtgagcgccaccggccagaccgcctgccccgccctgagacccgacggcagcctgcccggcttcgacctgatggtggccttcagcctggtggagaaggcctacgccagcatcagaggcgtggccatggagcccagcgccttcggcggcacccccaccttcaccctgttcaaggacgcccagctgaccagaagagtgagcgacgtgtaccccgcccccctgccccccgagcacaccatcgtgttcctggtgagactgctgcccgagacccccagagaggccttcgccctgtggcagatgaccgccgaggacttccagcccctgctgggcgtgctgctggacgccggcaagaagagcctgacctacttccacagagaccccagagccgccctgcaggaggccaccttcgacccccaggaggtgagaaagatcttcttcggcagcttccacaaggtgcacgtggccgtgggcagaagcaaggtgagactgtacgtggactgcagaaaggtggccgagagacccctgggcgagatgggcagcccccccgccgccggcttcgtgaccctgggcagactggccaaggccagaggccccagaagcagcagcgccgccttccagctgcagatgctgcagatcgtgtgcagcgacacctgggccgacgaggacagatgctgcgagctgcccgccagcagagacggcgagacctgccccgccttcgtgagcgcctgcagctgcagcagcgagacccccggcccccccggcccccagggcccccccggcctgcccggcagaaacggcacccccggcgagcagggcttccccggccccagaggcccccccggcgtgaagggcgagaagggcgaccacggcctgcccggcctgcagggccaccccggccaccagggcatccccggcagagtgggcctgcagggccccaagggcatgagaggcctggagggcaccgccggcctgcccggcccccccggccccagaggcttccagggcatggccggcgccagaggcaccagcggcgagagaggcccccccggcaccgtgggccccaccggcctgcccggccccaagggcgagagaggcgagaagggcgagccccagagcctggccaccctgtaccagctggtgagccaggcctgcgagagcgccatccagacccacgtgagcaagttcgacagcttccacgagaacaccagaccccccatgcccatcctggagcagaagctggagcccggcaccgagcccctgggcagccccggcaccagaagcaaggccctggtgcccggcgagtggggcagaggcggcagacacctggagggcagaggcgagcccggcgccgtgggccagatgggcagccccggccagcagggcgccagcacccagggcctgtgggagtag

SEQ ID NO: 1925 - DNA, 3894 bp, Homo sapiens; identical to SEQ ID NO: 1924

SEQ ID NO: 1926 - DNA, 2874 bp, Homo sapiens
atggcccactacatcaccttcctgtgcatggtgctggtgctgctgctgcagaacagcgtgctggccgaggacggcgaggtgagaagcagctgcagaaccgcccccaccgacctggtgttcatcctggacggcagctacagcgtgggccccgagaacttcgagatcgtgaagaagtggctggtgaacatcaccaagaacttcgacatcggccccaagttcatccaggtgggcgtggtgcagtacagcgactaccccgtgctggagatccccctgggcagctacgacagcggcgagcacctgaccgccgccgtggagagcatcctgtacctgggcggcaacaccaagaccggcaaggccatccagttcgccctggactacctgttcgccaagagcagcagattcctgaccaagatcgccgtggtgctgaccgacggcaagagccaggacgacgtgaaggacgccgcccaggccgccagagacagcaagatcaccctgttcgccatcggcgtgggcagcgagaccgaggacgccgagctgagagccatcgccaacaagcccagcagcacctacgtgttctacgtggaggactacatcgccatcagcaagatcagagaggtgatgaagcagaagctgtgcgaggagagcgtgtgccccaccagaatccccgtggccgccagagacgagagaggcttcgacatcctgctgggcctggacgtgaacaagaaggtgaagaagagaatccagctgagccccaagaagatcaagggctacgaggtgaccagcaaggtggacctgagcgagctgaccagcaacgtgttccccgagggcctgccccccagctacgtgttcgtgagcacccagagattcaaggtgaagaagatctgggacctgtggagaatcctgaccatcgacggcagaccccagatcgccgtgaccctgaacggcgtggacaagatcctgctgttcaccaccaccagcgtgatcaacggcagccaggtggtgaccttcgccaacccccaggtgaagaccctgttcgacgagggctggcaccagatcagactgctggtgaccgagcaggacgtgaccctgtacatcgacgaccagcagatcgagaacaagcccctgcaccccgtgctgggcatcctgatcaacggccagacccagatcggcaagtacagcggcaaggaggagaccgtgcagttcgacgtgcagaagctgagaatctactgcgaccccgagcagaacaacagagagaccgcctgcgagatccccggcttcaacggcgagtgcctgaacggccccagcgacgtgggcagcacccccgccccctgcatctgcccccccggcaagcccggcctgcagggccccaagggcgaccccggcctgcccggcaaccccggctaccccggccagcccggccaggacggcaagcccggctaccagggcatcgccggcacccccggcgtgcccggcagccccggcatccagggcgccagaggcctgcccggctacaagggcgagcccggcagagacggcgacaagggcgacagaggcctgcccggcttccccggcctgcacggcatgcccggcagcaagggcgagatgggcgccaagggcgacaagggcagccccggcttctacggcaagaagggcgccaagggcgagaagggcaacgccggcttccccggcctgcccggccccgccggcgagcccggcagacacggcaaggacggcctgatgggcagccccggcttcaagggcgaggccggcagccccggcgcccccggccaggacggcaccagaggcgagcccggcatccccggcttccccggcaacagaggcctgatgggccagaagggcgagatcggcccccccggccagcagggcaagaagggcgcccccggcatgcccggcctgatgggcagcaacggcagccccggccagcccggcacccccggcagcaagggcagcaagggcgagcccggcatccagggcatgcccggcgccagcggcctgaagggcgagcccggcgccaccggcagccccggcgagcccggctacatgggcctgcccggcatccagggcaagaagggcgacaagggcaaccagggcgagaagggcatccagggccagaagggcgagaacggcagacagggcatccccggccagcagggcatccagggccaccacggcgccaagggcgagagaggcgagaagggcgagcccggcgtgagaggcgccatcggcagcaagggcgagagcggcgtggacggcctgatgggccccgccggccccaagggccagcccggcgaccccggcccccagggcccccccggcctggacggcaagcccggcagagagttcagcgagcagttcatcagacaggtgtgcaccgacgtgatcagagcccagctgcccgtgctgctgcagagcggcagaatcagaaactgcgaccactgcctgagccagcacggcagccccggcatccccggcccccccggccccatcggccccgagggccccagaggcctgcccggcctgcccggcagagacggcgtgcccggcctggtgggcgtgcccggcagacccggcgtgagaggcctgaagggcctgcccggcagaaacggcgagaagggcagccagggcttcggctaccccggcgagcagggcccccccggcccccccggccccgagggcccccccggcatcagcaaggagggcccccccggcgaccccggcctgcccggcaaggacggcgaccacggcaagcccggcatccagggccagcccggcccccccggcatctgcgaccccagcctgtgcttcagcgtgatcgccagaagagaccccttcagaaagggccccaactactag

SEQ ID NO: 1927 - DNA, 972 bp, Homo sapiens
atgatcgccagcggcatccccggcttccccggcaacagaggcctgatgggccagaagggcgagatcggcccccccggccagcagggcaagaagggcgcccccggcatgcccggcctgatgggcagcaacggcagccccggccagcccggcacccccggcagcaagggcagcaagggcgagcccggcatccagggcatgcccggcgccagcggcctgaagggcgagcccggcgccaccggcagccccggcgagcccggctacatgggcctgcccggcatccagggcaagaagggcgacaagggcaaccagggcgagaagggcatccagggccagaagggcgagaacggcagacagggcatccccggccagcagggcatccagggccaccacggcgccaagggcgagagaggcgagaagggcgagcccggcgtgagaggcgccatcggcagcaagggcgagagcggcgtggacggcctgatgggccccgccggccccaagggccagcccggcgaccccggcccccagggcccccccggcctggacggcaagcccggcagagagttcagcgagcagttcatcagacaggtgtgcaccgacgtgatcagaggccccgagggccccagaggcctgcccggcctgcccggcagagacggcgtgcccggcctggtgggcgtgcccggcagacccggcgtgagaggcctgaagggcctgcccggcagaaacggcgagaagggcagccagggcttcggctaccccggcgagcagggcccccccggcccccccggccccgagggcccccccggcatcagcaaggagggcccccccggcgaccccggcctgcccggcaaggacggcgaccacggcaagcccggcatccagggccagcccggcccccccggcatctgcgaccccagcctgtgcttcagcgtgatcgccagaagagaccccttcagaaagggccccaactactag

SEQ ID NO: 1928 - DNA, 2865 bp, Homo sapiens
atggcccactacatcaccttcctgtgcatggtgctggtgctgctgctgcagaacagcgtgctggccgaggacggcgaggtgagaagcagctgcagaaccgcccccaccgacctggtgttcatcctggacggcagctacagcgtgggccccgagaacttcgagatcgtgaagaagtggctggtgaacatcaccaagaacttcgacatcggccccaagttcatccaggtgggcgtggtgcagtacagcgactaccccgtgctggagatccccctgggcagctacgacagcggcgagcacctgaccgccgccgtggagagcatcctgtacctgggcggcaacaccaagaccggcaaggccatccagttcgccctggactacctgttcgccaagagcagcagattcctgaccaagatcgccgtggtgctgaccgacggcaagagccaggacgacgtgaaggacgccgcccaggccgccagagacagcaagatcaccctgttcgccatcggcgtgggcagcgagaccgaggacgccgagctgagagccatcgccaacaagcccagcagcacctacgtgttctacgtggaggactacatcgccatcagcaagatcagagaggtgatgaagcagaagctgtgcgaggagagcgtgtgccccaccagaatccccgtggccgccagagacgagagaggcttcgacatcctgctgggcctggacgtgaacaagaaggtgaagaagagaatccagctgagccccaagaagatcaagggctacgaggtgaccagcaaggtggacctgagcgagctgaccagcaacgtgttccccgagggcctgccccccagctacgtgttcgtgagcacccagagattcaaggtgaagaagatctgggacctgtggagaatcctgaccatcgacggcagaccccagatcgccgtgaccctgaacggcgtggacaagatcctgctgttcaccaccaccagcgtgatcaacggcagccaggtggtgaccttcgccaacccccaggtgaagaccctgttcgacgagggctggcaccagatcagactgctggtgaccgagcaggacgtgaccctgtacatcgacgaccagcagatcgagaacaagcccctgcaccccgtgctgggcatcctgatcaacggccagacccagatcggcaagtacagcggcaaggaggagaccgtgcagttcgacgtgcagaagctgagaatctactgcgaccccgagcagaacaacagagagaccgcctgcgagatccccggcttctgcctgaacggccccagcgacgtgggcagcacccccgccccctgcatctgcccccccggcaagcccggcctgcagggccccaagggcgaccccggcctgcccggcaaccccggctaccccggccagcccggccaggacggcaagcccggctaccagggcatcgccggcacccccggcgtgcccggcagccccggcatccagggcgccagaggcctgcccggctacaagggcgagcccggcagagacggcgacaagggcgacagaggcctgcccggcttccccggcctgcacggcatgcccggcagcaagggcgagatgggcgccaagggcgacaagggcagccccggcttctacggcaagaagggcgccaagggcgagaagggcaacgccggcttccccggcctgcccggccccgccggcgagcccggcagacacggcaaggacggcctgatgggcagccccggcttcaagggcgaggccggcagccccggcgcccccggccaggacggcaccagaggcgagcccggcatccccggcttccccggcaacagaggcctgatgggccagaagggcgagatcggcccccccggccagcagggcaagaagggcgcccccggcatgcccggcctgatgggcagcaacggcagccccggccagcccggcacccccggcagcaagggcagcaagggcgagcccggcatccagggcatgcccggcgccagcggcctgaagggcgagcccggcgccaccggcagccccggcgagcccggctacatgggcctgcccggcatccagggcaagaagggcgacaagggcaaccagggcgagaagggcatccagggccagaagggcgagaacggcagacagggcatccccggccagcagggcatccagggccaccacggcgccaagggcgagagaggcgagaagggcgagcccggcgtgagaggcgccatcggcagcaagggcgagagcggcgtggacggcctgatgggccccgccggccccaagggccagcccggcgaccccggcccccagggcccccccggcctggacggcaagcccggcagagagttcagcgagcagttcatcagacaggtgtgcaccgacgtgatcagagcccagctgcccgtgctgctgcagagcggcagaatcagaaactgcgaccactgcctgagccagcacggcagccccggcatccccggcccccccggccccatcggccccgagggccccagaggcctgcccggcctgcccggcagagacggcgtgcccggcctggtgggcgtgcccggcagacccggcgtgagaggcctgaagggcctgcccggcagaaacggcgagaagggcagccagggcttcggctaccccggcgagcagggcccccccggcccccccggccccgagggcccccccggcatcagcaaggagggcccccccggcgaccccggcctgcccggcaaggacggcgaccacggcaagcccggcatccagggccagcccggcccccccggcatctgcgaccccagcctgtgcttcagcgtgatcgccagaagagaccccttcagaaagggccccaactactag

SEQ ID NO: 1929 - DNA, 411 bp, Homo sapiens
atggcccactacatcaccttcctgtgcatggtgctggtgctgctgctgcagaacagcgtgctggccgaggacggcgaggtgagaagcagctgcagaaccgcccccaccgacctggtgttcatcctggacggcagctacagcgtgggccccgagaacttcgagatcgtgaagaagtggctggtgaacatcaccaagaacttcgacatcggccccaagttcatccaggtgggcgtggtgcagtacagcgactaccccgtgctggagatccccctgggcagctacgacagcggcgagcacctgaccgccgccgtggagagcatcctgtacctgggcggcaacaccaagaccggcaaggccatccagttcgccctggactacctgttcgccaagagcagcagattcctgacctag

SEQ ID NO: 1930 - DNA, 2865 bp, Homo sapiens; identical to SEQ ID NO: 1928

SEQ ID NO: 1931 - DNA, 2874 bp, Homo sapiens
atggcccactacatcaccttcctgtgcatggtgctggtgctgctgctgcagaacagcgtgctggccgaggacggcgaggtgagaagcagctgcagaaccgcccccaccgacctggtgttcatcctggacggcagctacagcgtgggccccgagaacttcgagatcgtgaagaagtggctggtgaacatcaccaagaacttcgacatcggccccaagttcatccaggtgggcgtggtgcagtacagcgactaccccgtgctggagatccccctgggcagctacgacagcggcgagcacctgaccgccgccgtggagagcatcctgtacctgggcggcaacaccaagaccggcaaggccatccagttcgccctggactacctgttcgccaagagcagcagattcctgaccaagatcgccgtggtgctgaccgacggcaagagccaggacgacgtgaaggacgccgcccaggccgccagagacagcaagatcaccctgttcgccatcggcgtgggcagcgagaccgaggacgccgagctgagagccatcgccaacaagcccagcagcacctacgtgttctacgtggaggactacatcgccatcagcaagatcagagaggtgatgaagcagaagctgtgcgaggagagcgtgtgccccaccagaatccccgtggccgccagagacgagagaggcttcgacatcctgctgggcctggacgtgaacaagaaggtgaagaagagaatccagctgagccccaagaagatcaagggctacgaggtgaccagcaaggtggacctgagcgagctgaccagcaacgtgttccccgagggcctgccccccagctacgtgttcgtgagcacccagagattcaaggtgaagaagatctgggacctgtggagaatcctgaccatcgacggcagaccccagatcgccgtgaccctgaacggcgtggacaagatcctgctgttcaccaccaccagcgtgatcaacggcagccaggtggtgaccttcgccaacccccaggtgaagaccctgttcgacgagggctggcaccagatcagactgctggtgaccgagcaggacgtgaccctgtacatcgacgaccagcagatcgagaacaagcccctgcaccccgtgctgggcatcctgatcaacggccagacccagatcggcaagtacagcggcaaggaggagaccgtgcagttcgacgtgcagaagctgagaatctactgcgaccccgagcagaacaacagagagaccgcctgcgagatccccggcttcgtgatggagtgcctgaacggccccagcgacgtgggcagcacccccgccccctgcatctgcccccccggcaagcccggcctgcagggccccaagggcgaccccggcctgcccggcaaccccggctaccccggccagcccggccaggacggcaagcccggctaccagggcatcgccggcacccccggcgtgcccggcagccccggcatccagggcgccagaggcctgcccggctacaagggcgagcccggcagagacggcgacaagggcgacagaggcctgcccggcttccccggcctgcacggcatgcccggcagcaagggcgagatgggcgccaagggcgacaagggcagccccggcttctacggcaagaagggcgccaagggcgagaagggcaacgccggcttccccggcctgcccggccccgccggcgagcccggcagacacggcaaggacggcctgatgggcagccccggcttcaagggcgaggccggcagccccggcgcccccggccaggacggcaccagaggcgagcccggcatccccggcttccccggcaacagaggcctgatgggccagaagggcgagatcggcccccccggccagcagggcaagaagggcgcccccggcatgcccggcctgatgggcagcaacggcagccccggccagcccggcacccccggcagcaagggcagcaagggcgagcccggcatccagggcatgcccggcgccagcggcctgaagggcgagcccggcgccaccggcagccccggcgagcccggctacatgggcctgcccggcatccagggcaagaagggcgacaagggcaaccagggcgagaagggcatccagggccagaagggcgagaacggcagacagggcatccccggccagcagggcatccagggccaccacggcgccaagggcgagagaggcgagaagggcgagcccggcgtgagaggcgccatcggcagcaagggcgagagcggcgtggacggcctgatgggccccgccggccccaagggccagcccggcgaccccggcccccagggcccccccggcctggacggcaagcccggcagagagttcagcgagcagttcatcagacaggtgtgcaccgacgtgatcagagcccagctgcccgtgctgctgcagagcggcagaatcagaaactgcgaccactgcctgagccagcacggcagccccggcatccccggcccccccggccccatcggccccgagggccccagaggcctgcccggcctgcccggcagagacggcgtgcccggcctggtgggcgtgcccggcagacccggcgtgagaggcctgaagggcctgcccggcagaaacggcgagaagggcagccagggcttcggctaccccggcgagcagggcccccccggcccccccggccccgagggcccccccggcatcagcaaggagggcccccccggcgaccccggcctgcccggcaaggacggcgaccacggcaagcccggcatccagggccagcccggcccccccggcatctgcgaccccagcctgtgcttcagcgtgatcgccagaagagaccccttcagaaagggccccaactactag

SEQ ID NO: 1932 - DNA, 4881 bp, Homo sapiens
atggccggcctgagaggcaacgccgtggccggcctgctgtggatgctgctgctgtggagcggcggcggcggctgccaggcccagagagccggctgcaagagcgtgcactacgacctggtgttcctgctggacaccagcagcagcgtgggcaaggaggacttcgagaaggtgagacagtgggtggccaacctggtggacaccttcgaggtgggccccgacagaaccagagtgggcgtggtgagatacagcgacagacccaccaccgccttcgagctgggcctgttcggcagccaggaggaggtgaaggccgccgccagaagactggcctaccacggcggcaacaccaacaccggcgacgccctgagatacatcaccgccagaagcttcagcccccacgccggcggcagacccagagacagagcctacaagcaggtggccatcctgctgaccgacggcagaagccaggacctggtgctggacgccgccgccgccgcccacagagccggcatcagaatcttcgccgtgggcgtgggcgaggccctgaaggaggagctggaggagatcgccagcgagcccaagagcgcccacgtgttccacgtgagcgacttcaacgccatcgacaagatcagaggcaagctgagaagaagactgtgcgagaacgtgctgtgccccagcgtgagagtggagggcgacagattcaagcacaccaacggcggcaccaaggagatcaccggcttcgacctgatggacctgttcagcgtgaaggagatcctgggcaagagagagaacggcgcccagagcagctacgtgagaatgggcagcttccccgtggtgcagagcaccgaggacgtgttcccccagggcctgcccgacgagtacgccttcgtgaccaccttcagattcagaaagaccagcagaaaggaggactggtacatctggcaggtgatcgaccagtacagcatcccccaggtgagcatcagactggacggcgagaacaaggccgtggagtacaacgccgtgggcgccatgaaggacgccgtgagagtggtgttcagaggcagcagagtgaacgacctgttcgacagagactggcacaagatggccctgagcatccaggcccagaacgtgagcctgcacatcgactgcgccctggtgcagaccctgcccatcgaggagagagagaacatcgacatccagggcaagaccgtgatcggcaagagactgtacgacagcgtgcccatcgacttcgacctgcagagaatcgtgatctactgcgacagcagacacgccgagctggagacctgctgcgacatccccagcggcccctgccaggtgaccgtggtgaccgagccccccccccccccccccccccagagaccccccacccccggcagcgagcagatcggcttcctgaagaccatcaactgcagctgccccgccggcgagaagggcgagatgggcgtggccggccccatgggcctgcccggccccaagggcgacatcggcgccatcggccccgtgggcgcccccggccccaagggcgagaagggcgacgtgggcatcggccccttcggccagggcgagaagggcgagaagggcagcctgggcctgcccggcccccccggcagagacggcagcaagggcatgagaggcgagcccggcgagctgggcgagcccggcctgcccggcgaggtgggcatgagaggcccccagggcccccccggcctgcccggcccccccggcagagtgggcgcccccggcctgcagggcgagagaggcgagaagggcaccagaggcgagaagggcgagagaggcctggacggcttccccggcaagcccggcgacaccggccagcagggcagacccggccccagcggcgtggccggcccccagggcgagaagggcgacgtgggccccgccggcccccccggcgtgcccggcagcgtggtgcagcaggagggcctgaagggcgagcagggcgcccccggccccagaggccaccagggcgcccccggcccccccggcgccagaggccccatcggccccgagggcagagacggcccccccggcctgcagggcctgagaggcaagaagggcgacatgggcccccccggcatccccggcctgctgggcctgcagggcccccccggcccccccggcgtgcccggcccccccggccccggcggcagccccggcctgcccggcgagatcggcttccccggcaagcccggcccccccggccccaccggcccccccggcaaggacggccccaacggcccccccggcccccccggcaccaagggcgagcccggcgagagaggcgaggacggcctgcccggcaagcccggcctgagaggcgagatcggcgagcagggcctggccggcagacccggcgagaagggcgaggccggcctgcccggcgcccccggcttccccggcgtgagaggcgagaagggcgaccagggcgagaagggcgagctgggcctgcccggcctgaagggcgacagaggcgagaagggcgaggccggccccgccggcccccccggcctgcccggcaccaccagcctgttcaccccccaccccagaatgcccggcgagcagggccccaagggcgagaagggcgaccccggcctgcccggcgagcccggcctgcagggcagacccggcgagctgggcccccagggccccaccggcccccccggcgccaagggccaggagggcgcccacggcgcccccggcgccgccggcaaccccggcgcccccggccacgtgggcgcccccggccccagcggcccccccggcagcgtgggcgcccccggcctgagaggcacccccggcaaggacggcgagagaggcgagaagggcgccgccggcgaggagggcagccccggccccgtgggccccagaggcgaccccggcgcccccggcctgcccggcccccccggcaagggcaaggacggcgagcccggcctgagaggcagccccggcctgcccggccccctgggcaccaaggccgcctgcggcaaggtgagaggcagcgagaactgcgccctgggcggccagtgcgtgaagggcgacagaggcgcccccggcatccccggcagccccggcagcagaggcgaccccggcatcggcgtggccggcccccccggccccagcggcccccccggcgacaagggcagccccggcagcagaggcctgcccggcttccccggcccccagggccccgccggcagagacggcgcccccggcaaccccggcgagagaggcccccccggcaagcccggcctgagcagcctgctgagccccggcgacatcaacctgctggccaaggacgtgtgcaacgactgcccccccggcccccccggcctgcccggcctgcccggcttcaagggcgacaagggcgtgcccggcaagcccggcagagagggcaccgagggcaagaagggcgaggccggcccccccggcctgcccggcccccccggcatcgccggcccccagggcagccagggcgagagaggcgccgacggcgaggtgggccagaagggcgaccagggccaccccggcgtgcccggcttcatgggcccccccggcaaccccggcccccccggcgccgacggcatcgccggcgccgccggcccccccggcatccagggcagccccggcaaggagggcccccccggcccccagggccccagcggcctgcccggcatccccggcgaggagggcaaggagggcagagacggcaagcccggcccccccggcgagcccggcaaggccggcgagcccggcctgcccggccccgagggcgccagaggcccccccggcttcaagggccacaccggcgacagcggcgcccccggccccagaggcgagagcggcgccatgggcctgcccggccaggagggcctgcccggcaaggacggcgacaccggccccaccggcccccagggcccccagggccccagaggcccccccggcaagaacggcagccccggcagccccggcgagcccggccccagcggcacccccggccagaagggcagcaagggcgagaacggcagccccggcctgcccggcttcctgggccccagaggcccccccggcgagcccggcgagaagggcgtgcccggcaaggagggcgtgcccggcaagcccggcgagcccggcttcaagggcgagagaggcgaccccggcatcaagggcgacaagggcccccccggcggcaagggccagcccggcgaccccggcatccccggccacaagggccacaccggcctgatgggcccccagggcctgcccggcgagaacggccccgtgggcccccccggcccccccggccagcccggcttccccggcctgagaggcgagagccccagcatggagaccctgagaagactgatccaggaggagctgggcaagcagctggagaccagactggcctacctgctggcccagatgccccccgcctacatgaagagcagccagggcagacccggcccccccggcccccccggcaaggacggcctgcccggcagagccggccccatgggcgagcccggcagacccggccagggcggcctggagggccccagcggccccatcggccccaagggcgagagaggcgccaagggcgaccccggcgcccccggcgtgggcctgagaggcgagatgggcccccccggcatccccggccagcccggcgagcccggctacgccaaggacggcctgcccggcatccccggcccccagggcgagaccggccccgccggccaccccggcctgcccggcccccccggcccccccggccagtgcgaccccagccagtgcgcctacttcgccagcctggccgccagacccggcaacgtgaagggcccctag

SEQ ID NO: 1933 - DNA, 4821 bp, Homo sapiens
atggccggcctgagaggcaacgccgtggccggcctgctgtggatgctgctgctgtggagcggcggcggcggctgccaggcccagagagccggctgcaagagcgtgcactacgacctggtgttcctgctggacaccagcagcagcgtgggcaaggaggacttcgagaaggtgagacagtgggtggccaacctggtggacaccttcgaggtgggccccgacagaaccagagtgggcgtggtgagatacagcgacagacccaccaccgccttcgagctgggcctgttcggcagccaggaggaggtgaaggccgccgccagaagactggcctaccacggcggcaacaccaacaccggcgacgccctgagatacatcaccgccagaagcttcagcccccacgccggcggcagacccagagacagagcctacaagcaggtggccatcctgctgaccgacggcagaagccaggacctggtgctggacgccgccgccgccgcccacagagccggcatcagaatcttcgccgtgggcgtgggcgaggccctgaaggaggagctggaggagatcgccagcgagcccaagagcgcccacgtgttccacgtgagcgacttcaacgccatcgacaagatcagaggcaagctgagaagaagactgtgcgagaacgtgctgtgccccagcgtgagagtggagggcgacagattcaagcacaccaacggcggcaccaaggagatcaccggcttcgacctgatggacctgttcagcgtgaaggagatcctgggcaagagagagaacggcgcccagagcagctacgtgagaatgggcagcttccccgtggtgcagagcaccgaggacgtgttcccccagggcctgcccgacgagtacgccttcgtgaccaccttcagattcagaaagaccagcagaaaggaggactggtacatctggcaggtgatcgaccagtacagcatcccccaggtgagcatcagactggacggcgagaacaaggccgtggagtacaacgccgtgggcgccatgaaggacgccgtgagagtggtgttcagaggcagcagagtgaacgacctgttcgacagagactggcacaagatggccctgagcatccaggcccagaacgtgagcctgcacatcgactgcgccctggtgcagaccctgcccatcgaggagagagagaacatcgacatccagggcaagaccgtgatcggcaagagactgtacgacagcgtgcccatcgacttcgacctgcagagaatcgtgatctactgcgacagcagacacgccgagctggagacctgctgcgacatccccagcggcccctgccaggtgaccgtggtgaccgagccccccccccccccccccccccagagaccccccacccccggcagcgagcagatcggcttcctgaagaccatcaactgcagctgccccgccggcgagaagggcgagatgggcgtggccggccccatgggcctgcccggccccaagggcgacatcggcgccatcggccccgtgggcgcccccggccccaagggcgagaagggcgacgtgggcatcggccccttcggccagggcgagaagggcgagaagggcagcctgggcctgcccggcccccccggcagagacggcagcaagggcatgagaggcgagcccggcgagctgggcgagcccggcctgcccggcgaggtgggcatgagaggcccccagggcccccccggcctgcccggcccccccggcagagtgggcgcccccggcctgcagggcgagagaggcgagaagggcaccagaggcgagaagggcgagagaggcctggacggcttccccggcaagcccggcgacaccggccagcagggcagacccggccccagcggcgtggccggcccccagggcgagaagggcgacgtgggccccgccggcccccccggcgtgcccggcagcgtggtgcagcaggagggcctgaagggcgagcagggcgcccccggccccagaggccaccagggcgcccccggcccccccggcgccagaggccccatcggccccgagggcagagacggcccccccggcctgcagggcctgagaggcaagaagggcgacatgggcccccccggcatccccggcctgctgggcctgcagggcccccccggcccccccggcgtgcccggcccccccggccccggcggcagccccggcctgcccggcgagatcggcttccccggcaagcccggcccccccggccccaccggcccccccggcaaggacggccccaacggcccccccggcccccccggcaccaagggcgagcccggcgagagaggcgaggacggcctgcccggcaagcccggcctgagaggcgagatcggcgagcagggcctggccggcagacccggcgagaagggcgaggccggcctgcccggcgcccccggcttccccggcgtgagaggcgagaagggcgaccagggcgagaagggcgagctgggcctgcccggcctgaagggcgacagaggcgagaagggcgaggccggccccgccggcccccccggcctgcccggcaccaccagcctgttcaccccccaccccagaatgcccggcgagcagggccccaagggcgagaagggcgaccccggcctgcccggcgagcccggcctgcagggcagacccggcgagctgggcccccagggccccaccggcccccccggcgccaagggccaggagggcgcccacggcgcccccggcgccgccggcaaccccggcgcccccggccacgtgggcgcccccggccccagcggcccccccggcagcgtgggcgcccccggcctgagaggcacccccggcaaggacggcgagagaggcgagaagggcgccgccggcgaggagggcagccccggccccgtgggccccagaggcgaccccggcgcccccggcctgcccggcccccccggcaagggcaaggacggcgagcccggcctgagaggcagccccggcctgcccggccccctgggcaccaagggcgacagaggcgcccccggcatccccggcagccccggcagcagaggcgaccccggcatcggcgtggccggcccccccggccccagcggcccccccggcgacaagggcagccccggcagcagaggcctgcccggcttccccggcccccagggccccgccggcagagacggcgcccccggcaaccccggcgagagaggcccccccggcaagcccggcctgagcagcctgctgagccccggcgacatcaacctgctggccaaggacgtgtgcaacgactgcccccccggcccccccggcctgcccggcctgcccggcttcaagggcgacaagggcgtgcccggcaagcccggcagagagggcaccgagggcaagaagggcgaggccggcccccccggcctgcccggcccccccggcatcgccggcccccagggcagccagggcgagagaggcgccgacggcgaggtgggccagaagggcgaccagggccaccccggcgtgcccggcttcatgggcccccccggcaaccccggcccccccggcgccgacggcatcgccggcgccgccggcccccccggcatccagggcagccccggcaaggagggcccccccggcccccagggccccagcggcctgcccggcatccccggcgaggagggcaaggagggcagagacggcaagcccggcccccccggcgagcccggcaaggccggcgagcccggcctgcccggccccgagggcgccagaggcccccccggcttcaagggccacaccggcgacagcggcgcccccggccccagaggcgagagcggcgccatgggcctgcccggccaggagggcctgcccggcaaggacggcgacaccggccccaccggcccccagggcccccagggccccagaggcccccccggcaagaacggcagccccggcagccccggcgagcccggccccagcggcacccccggccagaagggcagcaagggcgagaacggcagccccggcctgcccggcttcctgggccccagaggcccccccggcgagcccggcgagaagggcgtgcccggcaaggagggcgtgcccggcaagcccggcgagcccggcttcaagggcgagagaggcgaccccggcatcaagggcgacaagggcccccccggcggcaagggccagcccggcgaccccggcatccccggccacaagggccacaccggcctgatgggcccccagggcctgcccggcgagaacggccccgtgggcccccccggcccccccggccagcccggcttccccggcctgagaggcgagagccccagcatggagaccctgagaagactgatccaggaggagctgggcaagcagctggagaccagactggcctacctgctggcccagatgccccccgcctacatgaagagcagccagggcagacccggcccccccggcccccccggcaaggacggcctgcccggcagagccggccccatgggcgagcccggcagacccggccagggcggcctggagggccccagcggccccatcggccccaagggcgagagaggcgccaagggcgaccccggcgcccccggcgtgggcctgagaggcgagatgggcccccccggcatccccggccagcccggcgagcccggctacgccaaggacggcctgcccggcatccccggcccccagggcgagaccggccccgccggccaccccggcctgcccggcccccccggcccccccggccagtgcgaccccagccagtgcgcctacttcgccagcctggccgccagacccggcaacgtgaagggcccctag

SEQ ID NO: 1934 - DNA, 3960 bp, Homo sapiens
atggccggcctgagaggcaacgccgtggccggcctgctgtggatgctgctgctgtggagcggcggcggcggctgccaggcccagagagccggctgcaagagcgtgcactacgacctggtgttcctgctggacaccagcagcagcgtgggcaaggaggacttcgagaaggtgagacagtgggtggccaacctggtggacaccttcgaggtgggccccgacagaaccagagtgggcgtggtgagatacagcgacagacccaccaccgccttcgagctgggcctgttcggcagccaggaggaggtgaaggccgccgccagaagactggcctaccacggcggcaacaccaacaccggcgacgccctgagatacatcaccgccagaagcttcagcccccacgccggcggcagacccagagacagagcctacaagcaggtggccatcctgctgaccgacggcagaagccaggacctggtgctggacgccgccgccgccgcccacagagccggcatcagaatcttcgccgtgggcgtgggcgaggccctgaaggaggagctggaggagatcgccagcgagcccaagagcgcccacgtgttccacgtgagcgacttcaacgccatcgacaagatcagaggcaagctgagaagaagactgtgcgagaacgtgctgtgccccagcgtgagagtggagggcgacagattcaagcacaccaacggcggcaccaaggagatcaccggcttcgacctgatggacctgttcagcgtgaaggagatcctgggcaagagagagaacggcgcccagagcagctacgtgagaatgggcagcttccccgtggtgcagagcaccgaggacgtgttcccccagggcctgcccgacgagtacgccttcgtgaccaccttcagattcagaaagaccagcagaaaggaggactggtacatctggcaggtgatcgaccagtacagcatcccccaggtgagcatcagactggacggcgagaacaaggccgtggagtacaacgccgtggccggcccccagggcgagaagggcgacgtgggccccgccggcccccccggcgtgcccggcagcgtggtgcagcaggagggcctgaagggcgagcagggcgcccccggccccagaggccaccagggcgcccccggcccccccggcgccagaggccccatcggccccgagggcagagacggcccccccggcctgcagggcctgagaggcaagaagggcgacatgggcccccccggcatccccggcctgctgggcctgcagggcccccccggcccccccggcgtgcccggcccccccggccccggcggcagccccggcctgcccggcgagatcggcttccccggcaagcccggcccccccggccccaccggcccccccggcaaggacggccccaacggcccccccggcccccccggcaccaagggcgagcccggcgagagaggcgaggacggcctgcccggcaagcccggcctgagaggcgagatcggcgagcagggcctggccggcagacccggcgagaagggcgaggccggcctgcccggcgcccccggcttccccggcgtgagaggcgagaagggcgaccagggcgagaagggcgagctgggcctgcccggcctgaagggcgacagaggcgagaagggcgaggccggccccgccggcccccccggcctgcccggcaccaccagcctgttcaccccccaccccagaatgcccggcgagcagggccccaagggcgagaagggcgaccccggcctgcccggcgagcccggcctgcagggcagacccggcgagctgggcccccagggccccaccggcccccccggcgccaagggccaggagggcgcccacggcgcccccggcgccgccggcaaccccggcgcccccggccacgtgggcgcccccggccccagcggcccccccggcagcgtgggcgcccccggcctgagaggcacccccggcaaggacggcgagagaggcgagaagggcgccgccggcgaggagggcagccccggccccgtgggccccagaggcgaccccggcgcccccggcctgcccggcccccccggcaagggcaaggacggcgagcccggcctgagaggcagccccggcctgcccggccccctgggcaccaagggcgacagaggcgcccccggcatccccggcagccccggcagcagaggcgaccccggcatcggcgtggccggcccccccggccccagcggcccccccggcgacaagggcagccccggcagcagaggcctgcccggcttccccggcccccagggccccgccggcagagacggcgcccccggcaaccccggcgagagaggcccccccggcaagcccggcctgagcagcctgctgagccccggcgacatcaacctgctggccaaggacgtgtgcaacgactgcccccccggcccccccggcctgcccggcctgcccggcttcaagggcgacaagggcgtgcccggcaagcccggcagagagggcaccgagggcaagaagggcgaggccggcccccccggcctgcccggcccccccggcatcgccggcccccagggcagccagggcgagagaggcgccgacggcgaggtgggccagaagggcgaccagggccaccccggcgtgcccggcttcatgggcccccccggcaaccccggcccccccggcgccgacggcatcgccggcgccgccggcccccccggcatccagggcagccccggcaaggagggcccccccggcccccagggccccagcggcctgcccggcatccccggcgaggagggcaaggagggcagagacggcaagcccggcccccccggcgagcccggcaaggccggcgagcccggcctgcccggccccgagggcgccagaggcccccccggcttcaagggccacaccggcgacagcggcgcccccggccccagaggcgagagcggcgccatgggcctgcccggccaggagggcctgcccggcaaggacggcgacaccggccccaccggcccccagggcccccagggccccagaggcccccccggcaagaacggcagccccggcagccccggcgagcccggccccagcggcacccccggccagaagggcagcaagggcgagaacggcagccccggcctgcccggcttcctgggccccagaggcccccccggcgagcccggcgagaagggcgtgcccggcaaggagggcgtgcccggcaagcccggcgagcccggcttcaagggcgagagaggcgaccccggcatcaagggcgacaagggcccccccggcggcaagggccagcccggcgaccccggcatccccggccacaagggccacaccggcctgatgggcccccagggcctgcccggcgagaacggccccgtgggcccccccggcccccccggccagcccggcttccccggcctgagaggcgagagccccagcatggagaccctgagaagactgatccaggaggagctgggcaagcagctggagaccagactggcctacctgctggcccagatgccccccgcctacatgaagagcagccagggcagacccggcccccccggcccccccggcaaggacggcctgcccggcagagccggccccatgggcgagcccggcagacccggccagggcggcctggagggccccagcggccccatcggccccaagggcgagagaggcgccaagggcgaccccggcgcccccggcgtgggcctgagaggcgagatgggcccccccggcatccccggccagcccggcgagcccggctacgccaaggacggcctgcccggcatccccggcccccagggcgagaccggccccgccggccaccccggcctgcccggcccccccggcccccccggccagtgcgaccccagccagtgcgcctacttcgccagcctggccgccagacccggcaacgtgaagggcccctag

SEQ ID NO: 1935 - DNA, 5145 bp, Homo sapiens
atgcacctgagagcccacagaaccagaagaggcaaggtgagccccaccgccaagaccaagagcctgctgcacttcatcgtgctgtgcgtggccggcgtggtggtgcacgcccaggagcagggcatcgacatcctgcaccagctgggcctgggcggcaaggacgtgagacacagcagccccgccaccgccgtgcccagcgccagcacccccctgccccagggcgtgcacctgaccgagagcggcgtgatcttcaagaacgacgcctacatcgagacccccttcgtgaagatcctgcccgtgaacctgggccagcccttcaccatcctgaccggcctgcagagccacagagtgaacaacgccttcctgttcagcatcagaaacaagaacagactgcagctgggcgtgcagctgctgcccaagaagctggtggtgcacatcagaggcaagcagcccgccgtgttcaactacagcgtgcacgacgagcagtggcacagcttcgccatcaccatcagaaaccagagcgtgagcatgttcgtggagtgcggcaagaagtacttcagcaccgagaccatccccgaggtgcagaccttcgacagcaacagcgtgttcaccctgggcagcatgaacaacaacagcatccacttcgagggcatcgtgtgccagctggacatcatccccagcgccgaggccagcgccgactactgcagatacgtgaagcagcagtgcagacaggccgacaagtaccagcccgagaccagcatcccctgcaccaccctgatccccaccaagatccccgagcacagccccccccccaagctgttcgccgagaaggtgctgagcgaggacaccttcaccgagggcaagagcatccccaacatcatcaagaacgacagcgagaccgtgtacaagagacaggagcaccagatcagcagaagccagctgagcagcctgcagagcggcaacgtgagcgccgtggacctgaccaaccacggcatccaggccaaggagatgatcaccgaggaggacacccagaccaacttcagcctgagcgtgaccacccacagaatcagcgaggccaagatgaacaccaaggagaagttcagcagcctgctgaacatgagcgacaacatcacccagcacgacgacagagtgaccggcctgagcctgttcaagaagatgcccagcatcctgccccagatcaagcaggacaccatcaccaacctgaagaaggccatcaccgccaacctgcacaccaacgagctgatggagatgcagcccatcctgaacaccagcctgcacagagtgaccaacgagcccagcgtggacaaccacctggacctgagaaaggagggcgagttctaccccgacgccacctaccccatcgagaacagctacgagaccgagctgtacgactactactactacgaggacctgaacaccatgctggagatggagtacctgagaggccccaagggcgacaccggcccccccggcccccccggccccgccggcatccccggccccagcggcaagagaggccccagaggcatccccggcccccacggcaaccccggcctgcccggcctgcccggccccaagggccccaagggcgaccccggcttcagccccggccagcccgtgcccggcgagaagggcgaccagggcctgagcggcctgatgggcccccccggcatgcagggcgacaagggcctgaagggccaccccggcctgcccggcctgcccggcgagcagggcatccccggcttcgccggcaacatcggcagccccggctaccccggcagacagggcctggccggccccgagggcaaccccggccccaagggcgcccagggcttcatcggcagccccggcgaggccggccagctgggccccgagggcgagagaggcatccccggcatcagaggcaagaagggcttcaagggcagacagggcttccccggcgacttcggcgacagaggccccgccggcctggacggcagccccggcctggtgggcggcaccggcccccccggcttccccggcctgagaggcagcgtgggccccgtgggccccatcggccccgccggcatccccggccccatgggcctgagcggcaacaagggcctgcccggcatcaagggcgacaagggcgagcagggcaccgccggcgagctgggcgagcccggctaccccggcgacaagggcgccgtgggcctgcccggcccccccggcatgagaggcaagagcggccccagcggccagaccggcgaccccggcctgcagggccccagcggcccccccggccccgagggcttccccggcgacatcggcatccccggccagaacggccccgagggccccaagggcctgctgggcaacagaggcccccccggcccccccggcctgaagggcacccagggcgaggagggccccatcggcgccttcggcgagctgggccccagaggcaagcccggccagaagggctacgccggcgagcccggccccgagggcctgaagggcgaggtgggcgaccagggcaacatcggcaagatcggcgagaccggccccgtgggcctgcccggcgaggtgggcatgaccggcagcatcggcgagaagggcgagagaggcagccccggccccctgggcccccagggcgagaagggcgtgatgggctaccccggcccccccggcgtgcccggccccatcggccccctgggcctgcccggccacgtgggcgccagaggcccccccggcagccagggccccaagggccagagaggcagcagaggccccgacggcctgctgggcgagcagggcatccagggcgccaagggcgagaagggcgaccagggcaagagaggcccccacggcctgatcggcaagaccggcaaccccggcgagagaggcttccagggcaagcccggcctgcagggcctgcccggcagcaccggcgacagaggcctgcccggcgagcccggcctgagaggcctgcagggcgacgtgggcccccccggcgagatgggcatggagggcccccccggcaccgagggcgagagcggcctgcagggcgagcccggcgccaagggcgacgtgggcaccgccggcagcgtgggcggcaccggcgagcccggcctgagaggcgagcccggcgcccccggcgaggagggcctgcagggcaaggacggcctgaagggcgtgcccggcggcagaggcctgcccggcgaggacggcgagaagggcgagatgggcctgcccggcatcatcggccccctgggcagaagcggccagaccggcctgcccggccccgagggcatcgtgggcatccccggccagagaggcagacccggcaagaagggcgacaagggccagatcggccccaccggcgaggtgggcagcagaggcccccccggcaagatcggcaagagcggccccaagggcgccagaggcaccagaggcgccgtgggccacctgggcctgatgggccccgacggcgagcccggcatccccggctacagaggccaccagggccagcccggccccagcggcctgcccggccccaagggcgagaagggctaccccggcgaggacagcaccgtgctgggcccccccggccccagaggcgagcccggccccgtgggcgaccagggcgagagaggcgagcccggcgccgagggctacaagggccacgtgggcgtgcccggcctgagaggcgccaccggccagcagggcccccccggcgagcccggcgaccagggcgagcagggcctgaagggcgagagaggcagcgagggcaacaagggcaagaagggcgcccccggccccagcggcaagcccggcatccccggcctgcagggcctgctgggccccaagggcatccagggctaccacggcgccgacggcatcagcggcaaccccggcaagatcggcccccccggcaagcagggcctgcccggcatcagaggcggccccggcagaaccggcctggccggcgcccccggcccccccggcgtgaagggcagcagcggcctgcccggcagccccggcatccagggccccaagggcgagcagggcctgcccggccagcccggcatccagggcaagagaggccacagaggcgcccagggcgaccagggcccctgcggcgaccccggcctgaagggccagcccggcgagtacggcgtgcagggcctgaccggcttccagggcttccccggccccaagggccccgagggcgacgccggcatcgtgggcatcagcggccccaagggccccatcggccacagaggcaacaccggccccctgggcagagagggcatcatcggccccaccggcagaaccggccccagaggcgagaagggcttcagaggcgagaccggcccccagggccccagaggccagcccggcccccccggcccccccggcgcccccggccccagaaagcagatggacatcaacgccgccatccaggccctgatcgagagcaacaccgccctgcagatggagagctaccagaacaccgaggtgaccctgatcgaccacagcgaggagatcttcaagaccctgaactacctgagcaacctgctgcacagcatcaagaaccccctgggcaccagagacaaccccgccagaatctgcaaggacctgctgaactgcgagcagaaggtgagcgacggcaagtactggatcgaccccaacctgggctgccccagcgacgccatcgaggtgttctgcaacttcagcgccggcggccagacctgcctgccccccgtgagcgtgaccaagctggagttcggcgtgggcaaggtgcagatgaacttcctgcacctgctgagcagcgaggccacccacatcatcaccatccactgcctgaacacccccagatggaccagcacccagaccagcggccccggcctgcccatcggcttcaagggctggaacggccagatcttcaaggtgaacaccctgctggagcccaaggtgctgagcgacgactgcaagatccaggacggcagctggcacaaggccaccttcctgttccacacccaggagcccaaccagctgcccgtgatcgaggtgcagaagctgccccacctgaagaccgagagaaagtactacatcgacagcagcagcgtgtgcttcctgtag

SEQ ID NO: 1936 - DNA, 5082 bp, Homo sapiens
atgcacctgagagcccacagaaccagaagaggcaaggtgagccccaccgccaagaccaagagcctgctgcacttcatcgtgctgtgcgtggccggcgtggtggtgcacgcccaggagcagggcatcgacatcctgcaccagctgggcctgggcggcaaggacgtgagacacagcagccccgccaccgccgtgcccagcgccagcacccccctgccccagggcgtgcacctgaccgagagcggcgtgatcttcaagaacgacgcctacatcgagacccccttcgtgaagatcctgcccgtgaacctgggccagcccttcaccatcctgaccggcctgcagagccacagagtgaacaacgccttcctgttcagcatcagaaacaagaacagactgcagctgggcgtgcagctgctgcccaagaagctggtggtgcacatcagaggcaagcagcccgccgtgttcaactacagcgtgcacgacgagcagtggcacagcttcgccatcaccatcagaaaccagagcgtgagcatgttcgtggagtgcggcaagaagtacttcagcaccgagaccatccccgaggtgcagaccttcgacagcaacagcgtgttcaccctgggcagcatgaacaacaacagcatccacttcgagggcatcgtgtgccagctggacatcatccccagcgccgaggccagcgccgactactgcagatacgtgaagcagcagtgcagacaggccgacaagtaccagcccgagaccagcatcccctgcaccaccctgatccccaccaagatccccgagcacagccccccccccaagctgttcgccgagaaggtgctgagcgaggacaccttcaccgagggcaagagcatccccaacatcatcaagaacgacagcgagaccgtgtacaagagacaggagcaccagatcagcagaagccagctgagcagcctgcagagcggcaacgtgagcgccgtggacctgaccaaccacggcatccaggccaaggagatgatcaccgaggaggacacccagaccaacttcagcctgagcgtgaccacccacagaatcagcgaggccaagatgaacaccaaggagaagttcagcagcctgctgaacatgagcgacaacatcacccagcacgacgacagagtgaccggcctgagcctgttcaagaagatgcccagcatcctgccccagatcaagcaggacaccatcaccaacctgaagaaggccatcaccgccaacctgcacaccaacgagctgatggagatgcagcccatcctgaacaccagcctgcacagagtgaccaacgagcccagcgtggacaaccacctggacctgagaaaggagggcgagttctaccccgacgccacctaccccatcgagaacagctacgagaccgagctgtacgactactactactacgaggacctgaacaccatgctggagatggagtacctgagaggccccaagggcgacaccggcccccccggcccccccggccccgccggcatccccggccccagcggcaagagaggccccagaggcatccccggcccccacggcaaccccggcctgcccggcctgcccggccccaagggccccaagggcgaccccggcttcagccccggccagcccgtgcccggcgagaagggcgaccagggcctgagcggcctgatgggcccccccggcatgcagggcgacaagggcctgaagggccaccccggcctgcccggcctgcccggcgagcagggcatccccggcttcgccggcaacatcggcagccccggctaccccggcagacagggcctggccggccccgagggcaaccccggccccaagggcgcccagggcttcatcggcagccccggcgaggccggccagctgggccccgagggcgagagaggcatccccggcatcagaggcaagaagggcttcaagggcagacagggcttccccggcgacttcggcgacagaggccccgccggcctggacggcagccccggcctggtgggcggcaccggcccccccggcttccccggcctgagaggcagcgtgggccccgtgggccccatcggccccgccggcatccccggccccatgggcctgagcggcaacaagggcctgcccggcatcaagggcgacaagggcgagcagggcaccgccggcgagctgggcgagcccggctaccccggcgacaagggcgccgtgggcctgcccggcccccccggcatgagaggcaagagcggccccagcggccagaccggcgaccccggcctgcagggccccagcggcccccccggccccgagggcttccccggcgacatcggcatccccggccagaacggccccgagggccccaagggcctgctgggcaacagaggcccccccggcccccccggcctgaagggcacccagggcgaggagggccccatcggcgccttcggcgagctgggccccagaggcaagcccggccagaagggctacgccggcgagcccggccccgagggcctgaagggcgaggtgggcgaccagggcaacatcggcaagatcggcgagaccggccccgtgggcctgcccggcgaggtgggcatgaccggcagcatcggcgagaagggcgagagaggcagccccggccccctgggcccccagggcgagaagggcgtgatgggctaccccggcccccccggcgtgcccggccccatcggccccctgggcctgcccggccacgtgggcgccagaggcccccccggcagccagggccccaagggccagagaggcagcagaggccccgacggcctgctgggcgagcagggcatccagggcgccaagggcgagaagggcgaccagggcaagagaggcccccacggcctgatcggcaagaccggcaaccccggcgagagaggcttccagggcaagcccggcctgcagggcctgcccggcagcaccggcgacagaggcctgcccggcgagcccggcctgagaggcctgcagggcgacgtgggcccccccggcgagatgggcatggagggcccccccggcaccgagggcgagagcggcctgcagggcgagcccggcgccaagggcgacgtgggcaccgccggcagcgtgggcggcaccggcgagcccggcctgagaggcgagcccggcgcccccggcgaggagggcctgcagggcaaggacggcctgaagggcgtgcccggcggcagaggcctgcccggcgaggacggcgagaagggcgagatgggcctgcccggcatcatcggccccctgggcagaagcggccagaccggcctgcccggccccgagggcatcgtgggcatccccggccagagaggcagacccggcaagaagggcgacaagggccagatcggccccaccggcgaggtgggcagcagaggcccccccggcaagatcggcaagagcggccccaagggcgccagaggcaccagaggcgccgtgggccacctgggcctgatgggccccgacggcgagcccggcatccccggctacagaggccaccagggccagcccggccccagcggcctgcccggccccaagggcgagaagggctaccccggcgaggacagcaccgtgctgggcccccccggccccagaggcgagcccggccccgtgggcgaccagggcgagagaggcgagcccggcgccgagggctacaagggccacgtgggcgtgcccggcctgagaggcgccaccggccagcagggcccccccggcgagcccggcgaccagggcgagcagggcctgaagggcgagagaggcagcgagggcaacaagggcaagaagggcgcccccggccccagcggcaagcccggcatccccggcctgcagggcctgctgggccccaagggcatccagggctaccacggcgccgacggcatcagcggcaaccccggcaagatcggcccccccggcaagcagggcctgcccggcatcagaggcggccccggcagaaccggcctggccggcgcccccggcccccccggcgtgaagggcagcagcggcctgcccggcagccccggcatccagggccccaagggcgagcagggcctgcccggccagcccggcatccagggcaagagaggccacagaggcgcccagggcgaccagggcccctgcggcgaccccggcctgaagggccagcccggcgagtacggcgtgcagggcctgaccggcttccagggcttccccggccccaagggccccgagggcgacgccggcatcgtgggcatcagcggccccaagggccccatcggccacagaggcaacaccggccccctgggcagagagggcatcatcggccccaccggcagaaccggccccagaggcgagaagggcttcagaggcgagaccaagcagatggacatcaacgccgccatccaggccctgatcgagagcaacaccgccctgcagatggagagctaccagaacaccgaggtgaccctgatcgaccacagcgaggagatcttcaagaccctgaactacctgagcaacctgctgcacagcatcaagaaccccctgggcaccagagacaaccccgccagaatctgcaaggacctgctgaactgcgagcagaaggtgagcgacggcaagtactggatcgaccccaacctgggctgccccagcgacgccatcgaggtgttctgcaacttcagcgccggcggccagacctgcctgccccccgtgagcgtgaccaagctggagttcggcgtgggcaaggtgcagatgaacttcctgcacctgctgagcagcgaggccacccacatcatcaccatccactgcctgaacacccccagatggaccagcacccagaccagcggccccggcctgcccatcggcttcaagggctggaacggccagatcttcaaggtgaacaccctgctggagcccaaggtgctgagcgacgactgcaagatccaggacggcagctggcacaaggccaccttcctgttccacacccaggagcccaaccagctgcccgtgatcgaggtgcagaagctgccccacctgaagaccgagagaaagtactacatcgacagcagcagcgtgtgcttcctgtag

SEQ ID NO: 1937 - DNA, 246 bp, Homo sapiens
atgcacctgagagcccacagaaccagaagaggcaaggtgagccccaccgccaagaccaagagcctgctgcacttcatcgtgctgtgcgtggccggcgtggtggtgcacgcccaggagcagggcatcgacatcctgcaccagctgggcctgggcggcaaggacgtgagacacagcagccccgccaccgccgtgcccagcgccagcacccccctgccccagggcgtgcacctgaccgagagcggctag

SEQ ID NO: 1938 - DNA, 1971 bp, Homo sapiens
atgctgctgaagaagcacgccggcaagggcggcggcagagagcccagaagcgaggaccccacccccgccgagcagcactgcgccagaaccatgcccccctgcgccgtgctggccgccctgctgagcgtggtggccgtggtgagctgcctgtacctgggcgtgaagaccaacgacctgcaggccagaatcgccgccctggagagcgccaagggcgcccccagcatccacctgctgcccgacaccctggaccacctgaagaccatggtgcaggagaaggtggagagactgctggcccagaagagctacgagcacatggccaagatcagaatcgccagagaggcccccagcgagtgcaactgccccgccggcccccccggcaagagaggcaagagaggcagaagaggcgagagcgccggcccccccggcgcccccgcccccagccagggcccccccggccccaagggcgacaagggcgagcagggcgaccagggccccagaatggtgttccccaagatcaaccacggcttcctgagcgccgaccagcagctgatcaagagaagactgatcaagggcgaccagggccaggccggcccccccggcccccccggcccccccggccccagaggcccccccggcgacaccggcaaggacggccccagaggcatgcccggcgtgcccggcgagcccggcaagcccggcgagcagggcctgatgggccccctgggcccccccggccagaagggcagcatcggcgcccccggcatccccggcatgaacggccagaagggcgagcccggcctgcccggcgccgtgggccagaacggcatccccggccccaagggcgagcccggcgagcagggcgagaagggcgacgccggcgagaacggccccaagggcgacaccggcgagaagggcgaccccggcagcagcgccgccggcatcaagggcgagcccggcgagagcggcagacccggccagaagggcgagcccggcctgcccggcctgcccggcctgcccggcatcaagggcgagcccggcttcatcggcccccagggcgagcccggcctgcccggcctgcccggcaccaagggcgagagaggcgaggccggcccccccggcagaggcgagagaggcgagcccggcgcccccggccccaagggcaagcagggcgagagcggcaccagaggccccaagggcagcaagggcgacagaggcgagaagggcgacagcggcgcccagggccccagaggcccccccggccagaagggcgaccagggcgccaccgagatcatcgactacaacggcaacctgcacgaggccctgcagagaatcaccaccctgaccgtgaccggcccccccggcccccccggcccccagggcctgcagggccccaagggcgagcagggcagccccggcatccccggcatggacggcgagcagggcctgaagggcagcaagggcgacatgggcgaccccggcatgaccggcgagaagggcggcatcggcctgcccggcctgcccggcgccaacggcatgaagggcgagaagggcgacagcggcatgcccggcccccagggccccagcatcatcggcccccccggcccccccggcccccacggcccccccggccccatgggcccccacggcctgcccggccccaagggcaccgacggccccatgggcccccacggccccgccggccccaagggcgagagaggcgagaagggcgccatgggcgagcccggccccagaggcccctacggcctgcccggcaaggacggcgagcccggcctggacggcttccccggccccagaggcgagaagggcgacctgggcgagaagggcgagaagggcttcagaggcgtgaagggcgagaagggcgagcccggccagcccggcctggacggcctggacgccccctgccagctgggccccgacggcctgcccatgcccggctgctggcagaagtag

SEQ ID NO: 1939 - DNA, 1929 bp, Homo sapiens
atgctgctgaagaagcacgccggcaagggcggcggcagagagcccagaagcgaggaccccacccccgccgagcagcactgcgccagaaccatgcccccctgcgccgtgctggccgccctgctgagcgtggtggccgtggtgagctgcctgtacctgggcgtgaagaccaacgacctgcaggccagaatcgccgccctggagagcgccaagggcgcccccagcatccacctgctgcccgacaccctggaccacctgaagaccatggtgcaggagaaggtggagagactgctggcccagaagagctacgagcacatggccaagatcagaatcgccagagaggcccccagcgagtgcaactgccccgccggcccccccggcaagagaggcaagagaggcagaagaggcgagagcggcccccccggccagcccggcccccagggcccccccggccccaagggcgacaagggcgagcagggcgaccagggccccagaatggtgttccccaagatcaaccacggcttcctgagcgccgaccagcagctgatcaagagaagactgatcaagggcgaccagggccaggccggcccccccggcccccccggcccccccggccccagaggcccccccggcgacaccggcaaggacggccccagaggcatgcccggcgtgcccggcgagcccggcaagcccggcgagcagggcctgatgggccccctgggcccccccggccagaagggcagcatcggcgcccccggcatccccggcatgaacggccagaagggcgagcccggcctgcccggcgccgtgggccagaacggcatccccggccccaagggcgagcccggcgagcagggcgagaagggcgacgccggcgagaacggccccaagggcgacaccggcgagaagggcgaccccggcagcagcgccgccggcatcaagggcgagcccggcgagagcggcagacccggccagaagggcgagcccggcctgcccggcctgcccggcctgcccggcatcaagggcgagcccggcttcatcggcccccagggcgagcccggcctgcccggcctgcccggcaccaagggcgagagaggcgaggccggcccccccggcagaggcgagagaggcgagcccggcgcccccggccccaagggcaagcagggcgagagcggcaccagaggccccaagggcagcaagggcgacagaggcgagaagggcgacagcggcgcccagggccccagaggcccccccggccagaagggcgaccagggcgccaccgagatcatcgactacaacggcaacctgcacgaggccctgcagagaatcaccaccctgaccgtgaccggcccccccggcccccccggcccccagggcctgcagggccccaagggcgagcagggcagccccggcatccccggcatggacggcgagcagggcctgaagggcagcaagggcgacatgggcgaccccggcatgaccggcgagaagggcggcatcggcctgcccggcctgcccggcgccaacggcatgaagggcgagaagggcgacagcggcatgcccggcccccagggccccagcatcatcggcccccccggcccccccggcccccacggcccccccggccccatgggcccccacggcctgcccggccccaagggcaccgacggccccatgggcccccacggccccgccggccccaagggcgagagaggcgagaagggcgccatgggcgagcccggccccagaggcccctacggcctgcccggcaaggacggcgagcccggcctggacggcttccccggccccagaggcgagaagggcgacctgggcgagaagggcgagaaggtgaccagccccagccagcacgtgccctgcctgatcctgctgctgctgagcgccctgctgttcagcctgtgcgacagcatctag

SEQ ID NO: 1940 - DNA, 1965 bp, Homo sapiens
atgctgctgaagaagcacgccggcaagggcggcggcagagagcccagaagcgaggaccccacccccgccgagcagcactgcgccagaaccatgcccccctgcgccgtgctggccgccctgctgagcgtggtggccgtggtgagctgcctgtacctgggcgtgaagaccaacgacctgcaggccagaatcgccgccctggagagcgccaagggcgcccccagcatccacctgctgcccgacaccctggaccacctgaagaccatggtgcaggagaaggtggagagactgctggcccagaagagctacgagcacatggccaagatcagaatcgccagagaggcccccagcgagtgcaactgccccgccggcccccccggcaagagaggcaagagaggcagaagaggcgagagcggcccccccggccagcccggcccccagggcccccccggccccaagggcgacaagggcgagcagggcgaccagggccccagaatggtgttccccaagatcaaccacggcttcctgagcgccgaccagcagctgatcaagagaagactgatcaagggcgaccagggccaggccggcccccccggcccccccggcccccccggccccagaggcccccccggcgacaccggcaaggacggccccagaggcatgcccggcgtgcccggcgagcccggcaagcccggcgagcagggcctgatgggccccctgggcccccccggccagaagggcagcatcggcgcccccggcatccccggcatgaacggccagaagggcgagcccggcctgcccggcgccgtgggccagaacggcatccccggccccaagggcgagcccggcgagcagggcgagaagggcgacgccggcgagaacggccccaagggcgacaccggcgagaagggcgaccccggcagcagcgccgccggcatcaagggcgagcccggcgagagcggcagacccggccagaagggcgagcccggcctgcccggcctgcccggcctgcccggcatcaagggcgagcccggcttcatcggcccccagggcgagcccggcctgcccggcctgcccggcaccaagggcgagagaggcgaggccggcccccccggcagaggcgagagaggcgagcccggcgcccccggccccaagggcaagcagggcgagagcggcaccagaggccccaagggcagcaagggcgacagaggcgagaagggcgacagcggcgcccagggccccagaggcccccccggccagaagggcgaccagggcgccaccgagatcatcgactacaacggcaacctgcacgaggccctgcagagaatcaccaccctgaccgtgaccggcccccccggcccccccggcccccagggcctgcagggccccaagggcgagcagggcagccccggcatccccggcatggacggcgagcagggcctgaagggcagcaagggcgacatgggcgaccccggcatgaccggcgagaagggcggcatcggcctgcccggcctgcccggcgccaacggcatgaagggcgagaagggcgacagcggcatgcccggcccccagggccccagcatcatcggcccccccggcccccccggcccccacggcccccccggccccatgggcccccacggcctgcccggccccaagggcaccgacggccccatgggcccccacggccccgccggccccaagggcgagagaggcgagaagggcgccatgggcgagcccggccccagaggcccctacggcctgcccggcaaggacggcgagcccggcctggacggcttccccggccccagaggcgagaagggcgacctgggcgagaagggcgagaagggcttcagaggcgtgaagggcgagaagggcgagcccggccagcccggcctggacggcctggacgccccctgccagctgggccccgacggcctgcccatgcccggctgctggcagaagtag

SEQ ID NO: 1941 - DNA, 1752 bp, Homo sapiens
atgctgctgaagaagcacgccggcaagggcggcggcagagagcccagaagcgaggaccccacccccgccgagcagcactgcgccagaaccatgcccccctgcgccgtgctggccgccctgctgagcgtggtggccgtggtgagctgcctgtacctgggcgtgaagaccaacgacctgcaggccagaatcgccgccctggagagcgccaagggcgcccccagcatccacctgctgcccgacaccctggaccacctgaagaccatggtgcaggagaaggtggagagactgctggcccagaagagctacgagcacatggccaagatcagaatcgccagagaggcccccagcgagtgcaactgccccgccggcccccccggcaagagaggcaagagaggcagaagaggcgagagcgccggcccccccggcggcccccccggccccaagggcgacaagggcgagcagggcgaccagggccccagaatggtgttccccaagatcaaccacggcttcctgagcgccgaccagcagctgatcaagagaagactgatcaagggcgaccagggccaggccggcccccccggcccccccggcccccccggccccagaggcccccccggcgacaccggcaaggacggccccagaggcatgcccggcgtgcccggcgagcccggcaagcccggcgagcagggcctgatgggccccctgggcccccccggccagaagggcagcatcggcgcccccggcatccccggcatgaacggccagaagggcgagcccggcctgcccggcgccgtgggccagaacggcatccccggccccaagggcgagcccggcgagcagggcgagaagggcgacgccggcgagaacggccccaagggcgacaccggcgagaagggcgaccccggcagcagcgccgccggcatcaagggcgagcccggcgagagcggcagacccggccagaagggcgagcccggcttcatcggcccccagggcgagcccggcctgcccggcctgcccggcaccaagggcgagagaggcgaggccggcccccccggcagaggcgagagaggcgagcccggcgcccccggccccaagggcaagcagggcgagagcggcaccagaggccccaagggcagcaagggcgacagaggcgagaagggcgacagcggcgcccagggccccagaggcccccccggccagaagggcgaccagggcgccaccgagatcatcgactacaacggcaacctgcacgaggccctgcagagaatcaccaccctgaccgtgaccggcccccccggcccccccggcccccagggcctgcagggccccaagggcgagcagggcagccccggcatccccggcatggacggcgagcagggcctgaagggcagcaagggcgacatgggcgaccccggcatgaccggcgagaagggcggcatcggcctgcccggcctgcccggcgccaacggcatgaagggcgagaagggcgacagcggcatgcccggcccccagggccccagcatcatcggcccccccggcccccccggcccccacggcccccccggccccatgggcccccacggcctgcccggccccaagggcaccgacggccccatgggcccccacggccccgccggccccaagggcgagagaggcgagaagggcgccatgggcgagcccggccccagaggcccctacggcctgccccagggccccgacggcctgcccatgcccggctgctggcagaagtag

SEQ ID NO: 1942 - DNA, 1497 bp, Homo sapiens
atgctgctgaagaagcacgccggcaagggcggcggcagagagcccagaagcgaggaccccacccccgccgagcagcactgcgccagaaccatgcccccctgcgccgtgctggccgccctgctgagcgtggtggccgtggtgagctgcctgtacctgggcgtgaagaccaacgacctgcaggccagaatcgccgccctggagagcgccaagggcgcccccagcatccacctgctgcccgacaccctggaccacctgaagaccatggtgcaggagaaggtggagagactgctggcccagaagagctacgagcacatggccaagatcagaatcgccagagaggcccccagcgagtgcaactgccccgccggcccccccggcaagagaggcaagagaggcagaagaggcgagagcgccggcccccccggcgcccccgcccccagccagggcccccccggccccaagggcgacaagggcgagcagggcgaccagggccccagaggccccctgggcccccccggccagaagggcagcatcggcgcccccggcatccccggcatgaacggccagaagggcgagcccggcctgcccggcgccgtgggccagaacggcatccccggccccaagggcgagcccggcgagcagggcgagaagggcgacgccggcgagaacggccccaagggcgacaccggcgagaagggcgaccccggcagcagcgccgccggcatcaagggcgagcccggcgagagcggcagacccggccagaagggcgagcccggcctgcccggcctgcccggcctgcccggcatcaagggcgagcccggcttcatcggcccccagggcgagcccggcctgcccggcctgcccggcaccaagggcgagagaggcgaggccggcccccccggcagaggcgagagaggcgagcccggcgcccccggccccaagggcaagcagggcgagagcggcaccagaggccccaagggcagcaagggcgacagaggcgagaagggcgacagcggcgcccagggccccagaggcccccccggccagaagggcgaccagggcgccaccgagatcatcgactacaacggcaacctgcacgaggccctgcagagaatcaccaccctgaccgtgaccggcccccccggcccccccggcccccagggcctgcagggccccaagggcgagcagggcagccccggcatccccggcatggacggcgagcagggcctgaagggcagcaagggcgacatgggcgaccccggcagccagtggaacgagagaagaaagagaagattctggaacgccggcagcaccggcagcttctaccacagacccaccagacccaccagaagcccctggcccacctggccccacggcaccagctggaccagctggaccaagggcagcatctggctgagaagaaaggccagaatccccggctacagatggagctacggcaccccctggccctgcagaagccagagaagaaagagctag

SEQ ID NO: 1943 - DNA, 213 bp, Homo sapiens
atgctgctgaagaagcacgccggcaagggcggcggcagagagcccagaagcgaggaccccacccccgccgagcagcactgcgccagaaccatgcccccctgcgccgtgctggccgccctgctgagcgtggtggccgtggtgagctgcctgtacctgggcgtgaagaccaacgacctgcaggccagaatcgccgccctggagagcgccaagtag

SEQ ID NO: 1944 - DNA, 90 bp, Homo sapiens
tgaggccccagaggcgagaagggcgacctgggcgagaagggcgagaagggccccgacggcctgcccatgcccggctgctggcagaagtag

SEQ ID NO: 1945 - DNA, 5583 bp, Homo sapiens
atgggcgccggcagcgccagaggcgccagaggcaccgccgccgccgccgccgccagaggcggcggcttcctgttcagctggatcctggtgagcttcgcctgccacctggccagcacccagggcgcccccgaggacgtggacatcctgcagagactgggcctgagctggaccaaggccggcagccccgccccccccggcgtgatccccttccagagcggcttcatcttcacccagagagccagactgcaggcccccaccggcaccgtgatccccgccgccctgggcaccgagctggccctggtgctgagcctgtgcagccacagagtgaaccacgccttcctgttcgccgtgagaagccagaagagaaagctgcagctgggcctgcagttcctgcccggcaagaccgtggtgcacctgggcagcagaagaagcgtggccttcgacctggacatgcacgacggcagatggcaccacctggccctggagctgagaggcagaaccgtgaccctggtgaccgcctgcggccagagaagagtgcccgtgctgctgcccttccacagagaccccgccctggaccccggcggcagcttcctgttcggcaagatgaacccccacgccgtgcagttcgagggcgccctgtgccagttcagcatctaccccgtgacccaggtggcccacaactactgcacccacctgagaaagcagtgcggccaggccgacacctaccagagccccctgggccccctgttcagccaggacagcggcagacccttcaccttccagagcgacctggccctgctgggcctggagaacctgaccaccgccacccccgccctgggcagcctgcccgccggcagaggccccagaggcaccgtggcccccgccacccccaccaagccccagagaaccagccccaccaacccccaccagcacatggccgtgggcggccccgcccagacccccctgctgcccgccaagctgagcgccagcaacgccctggaccccatgctgcccgccagcgtgggcggcagcaccagaacccccagacccgccgccgcccagcccagccagaagatcaccgccaccaagatccccaagagcctgcccaccaagcccagcgcccccagcaccagcatcgtgcccatcaagagcccccaccccacccagaagaccgcccccagcagcttcaccaagagcgccctgcccacccagaagcaggtgccccccaccagcagacccgtgcccgccagagtgagcagacccgccgagaagcccatccagagaaaccccggcatgcccagaccccccccccccagcaccagacccctgccccccaccaccagcagcagcaagaagcccatccccaccctggccagaaccgaggccaagatcaccagccacgccagcaagcccgccagcgccagaaccagcacccacaagcccccccccttcaccgccctgagcagcagccccgcccccacccccggcagcaccagaagcaccagaccccccgccaccatggtgccccccaccagcggcaccagcacccccagaaccgcccccgccgtgcccacccccggcagcgcccccaccggcagcaagaagcccatcggcagcgaggccagcaagaaggccggccccaagagcagccccagaaagcccgtgcccctgagacccggcaaggccgccagagacgtgcccctgagcgacctgaccaccagacccagccccagacagccccagcccagccagcagaccacccccgccctggtgctggcccccgcccagttcctgagcagcagccccagacccaccagcagcggctacagcatcttccacctggccggcagcacccccttccccctgctgatgggcccccccggccccaagggcgactgcggcctgcccggcccccccggcctgcccggcctgcccggcatccccggcgccagaggccccagaggcccccccggcccctacggcaaccccggcctgcccggcccccccggcgccaagggccagaagggcgaccccggcctgagccccggcaaggcccacgacggcgccaagggcgacatgggcctgcccggcctgagcggcaaccccggcccccccggcagaaagggccacaagggctaccccggccccgccggccaccccggcgagcagggccagcccggccccgagggcagccccggcgccaagggctaccccggcagacagggcctgcccggccccgtgggcgaccccggccccaagggcagcagaggctacatcggcctgcccggcctgttcggcctgcccggcagcgacggcgagagaggcctgcccggcgtgcccggcaagagaggcaagatgggcatgcccggcttccccggcgtgttcggcgagagaggcccccccggcctggacggcaaccccggcgagctgggcctgcccggcccccccggcgtgcccggcctgatcggcgacctgggcgtgctgggccccatcggctaccccggccccaagggcatgaagggcctgatgggcagcgtgggcgagcccggcctgaagggcgacaagggcgagcagggcgtgcccggcgtgagcggcgaccccggcttccagggcgacaagggcagccagggcctgcccggcttccccggcgccagaggcaagcccggccccctgggcaaggtgggcgacaagggcagcatcggcttccccggcccccccggccccgagggcttccccggcgacatcggcccccccggcgacaacggccccgagggcatgaagggcaagcccggcgccagaggcctgcccggccccagaggccagctgggccccgagggcgacgagggccccatgggcccccccggcgcccccggcctggagggccagcccggcagaaagggcttccccggcagacccggcctggacggcgtgaagggcgagcccggcgaccccggcagacccggccccgtgggcgagcagggcttcatgggcttcatcggcctggtgggcgagcccggcatcgtgggcgagaagggcgacagaggcatgatgggcccccccggcgtgcccggccccaagggcagcatgggccaccccggcatgcccggcggcatgggcacccccggcgagcccggcccccagggcccccccggcagcagaggcccccccggcatgagaggcgccaagggcagaagaggccccagaggccccgacggccccgccggcgagcagggcagcagaggcctgaagggcccccccggcccccagggcagacccggcagacccggccagcagggcgtggccggcgagagaggccacctgggcagcagaggcttccccggcatccccggccccagcggcccccccggcaccaagggcctgcccggcgagcccggcccccagggcccccagggccccatcggcccccccggcgagatgggccccaagggcccccccggcgccgtgggcgagcccggcctgcccggcgaggccggcatgaagggcgacctgggccccctgggcacccccggcgagcagggcctgatcggccagagaggcgagcccggcctggagggcgacagcggccccatgggccccgacggcctgaagggcgacagaggcgaccccggccccgacggcgagcacggcgagaagggccaggagggcctgatgggcgaggacggcccccccggcccccccggcgtgaccggcgtgagaggccccgagggcaagagcggcaagcagggcgagaagggcagaaccggcgccaagggcgccaagggctaccagggccagctgggcgagatgggcgtgcccggcgaccccggcccccccggcacccccggccccaagggcagcagaggcagcctgggccccaccggcgcccccggcagaatgggcgcccagggcgagcccggcctggccggctacgacggccacaagggcatcgtgggccccctgggcccccccggccccaagggcgagaagggcgagcagggcgaggacggcaaggccgagggcccccccggcccccccggcgacagaggccccgtgggcgacagaggcgacagaggcgagcccggcgaccccggctaccccggccaggagggcgtgcagggcctgagaggcaagcccggccagcagggccagcccggccaccccggccccagaggctggcccggccccaagggcagcaagggcgccgagggccccaagggcaagcagggcaaggccggcgcccccggcagaagaggcgtgcagggcctgcagggcctgcccggccccagaggcgtggtgggcagacagggcctggagggcatcgccggccccgacggcctgcccggcagagacggccaggccggccagcagggcgagcagggcgacgacggcgaccccggccccatgggccccgccggcaagagaggcaaccccggcgtggccggcctgcccggcgcccagggcccccccggcttcaagggcgagagcggcctgcccggccagctgggcccccccggcaagagaggcaccgagggcagaaccggcctgcccggcaaccagggcgagcccggcagcaagggccagcccggcgacagcggcgagatgggcttccccggcatggccggcctgttcggccccaagggcccccccggcgacatcggcttcaagggcatccagggccccagaggcccccccggcctgatgggcaaggagggcatcgtgggccccctgggcatcctgggccccagcggcctgcccggccccaagggcgacaagggcagcagaggcgactggggcctgcagggccccagaggcccccccggccccagaggcagacccggcccccccggcccccccggcggccccatccagctgcagcaggacgacctgggcgccgccttccagacctggatggacaccagcggcgccctgagacccgagagctacagctaccccgacagactggtgctggaccagggcggcgagatcttcaagaccctgcactacctgagcaacctgatccagagcatcaagacccccctgggcaccaaggagaaccccgccagagtgtgcagagacctgatggactgcgagcagaagatggtggacggcacctactgggtggaccccaacctgggctgcagcagcgacaccatcgaggtgagctgcaacttcacccacggcggccagacctgcctgaagcccatcaccgccagcaaggtggagttcgccatcagcagagtgcagatgaacttcctgcacctgctgagcagcgaggtgacccagcacatcaccatccactgcctgaacatgaccgtgtggcaggagggcaccggccagacccccgccaagcaggccgtgagattcagagcctggaacggccagatcttcgaggccggcggccagttcagacccgaggtgagcatggacggctgcaaggtgcaggacggcagatggcaccagaccctgttcaccttcagaacccaggacccccagcagctgcccatcatcagcgtggacaacctgccccccgccagcagcggcaagcagtacagactggaggtgggccccgcctgcttcctgtag

SEQ ID NO: 1946 - DNA, 5604 bp, Homo sapiens
atgggcgccggcagcgccagaggcgccagaggcaccgccgccgccgccgccgccagaggcggcggcttcctgttcagctggatcctggtgagcttcgcctgccacctggccagcacccagggcgcccccgaggacgtggacatcctgcagagactgggcctgagctggaccaaggccggcagccccgccccccccggcgtgatccccttccagagcggcttcatcttcacccagagagccagactgcaggcccccaccggcaccgtgatccccgccgccctgggcaccgagctggccctggtgctgagcctgtgcagccacagagtgaaccacgccttcctgttcgccgtgagaagccagaagagaaagctgcagctgggcctgcagttcctgcccggcaagaccgtggtgcacctgggcagcagaagaagcgtggccttcgacctggacatgcacgacggcagatggcaccacctggccctggagctgagaggcagaaccgtgaccctggtgaccgcctgcggccagagaagagtgcccgtgctgctgcccttccacagagaccccgccctggaccccggcggcagcttcctgttcggcaagatgaacccccacgccgtgcagttcgagggcgccctgtgccagttcagcatctaccccgtgacccaggtggcccacaactactgcacccacctgagaaagcagtgcggccaggccgacacctaccagagccccctgggccccctgttcagccaggacagcggcagacccttcaccttccagagcgacctggccctgctgggcctggagaacctgaccaccgccacccccgccctgggcagcctgcccgccggcagaggccccagaggcaccgtggcccccgccacccccaccaagccccagagaaccagccccaccaacccccaccagcacatggccgtgggcggccccgcccagacccccctgctgcccgccaagctgagcgccagcaacgccctggaccccatgctgcccgccagcgtgggcggcagcaccagaacccccagacccgccgccgcccagcccagccagaagatcaccgccaccaagatccccaagagcctgcccaccaagcccagcgcccccagcaccagcatcgtgcccatcaagagcccccaccccacccagaagaccgcccccagcagcttcaccaagagcgccctgcccacccagaagcaggtgccccccaccagcagacccgtgcccgccagagtgagcagacccgccgagaagcccatccagagaaaccccggcatgcccagaccccccccccccagcaccagacccctgccccccaccaccagcagcagcaagaagcccatccccaccctggccagaaccgaggccaagatcaccagccacgccagcaagcccgccagcgccagaaccagcacccacaagcccccccccttcaccgccctgagcagcagccccgcccccacccccggcagcaccagaagcaccagaccccccgccaccatggtgccccccaccagcggcaccagcacccccagaaccgcccccgccgtgcccacccccggcagcgcccccaccggcagcaagaagcccatcggcagcgaggccagcaagaaggccggccccaagagcagccccagaaagcccgtgcccctgagacccggcaaggccgccagagacgtgcccctgagcgacctgaccaccagacccagccccagacagccccagcccagccagcagaccacccccgccctggtgctggcccccgcccagttcctgagcagcagccccagacccaccagcagcggctacagcatcttccacctggccggcagcacccccttccccctgctgatgggcccccccggccccaagggcgactgcggcctgcccggcccccccggcctgcccggcctgcccggcatccccggcgccagaggccccagaggcccccccggcccctacggcaaccccggcctgcccggcccccccggcgccaagggccagaagggcgaccccggcctgagccccggcaaggcccacgacggcgccaagggcgacatgggcctgcccggcctgagcggcaaccccggcccccccggcagaaagggccacaagggctaccccggccccgccggccaccccggcgagcagggccagcccggccccgagggcagccccggcgccaagggctaccccggcagacagggcctgcccggccccgtgggcgaccccggccccaagggcagcagaggctacatcggcctgcccggcctgttcggcctgcccggcagcgacggcgagagaggcctgcccggcgtgcccggcaagagaggcaagatgggcatgcccggcttccccggcgtgttcggcgagagaggcccccccggcctggacggcaaccccggcgagctgggcctgcccggcccccccggcgtgcccggcctgatcggcgacctgggcgtgctgggccccatcggctaccccggccccaagggcatgaagggcctgatgggcagcgtgggcgagcccggcctgaagggcgacaagggcgagcagggcgtgcccggcgtgagcggcgaccccggcttccagggcgacaagggcagccagggcctgcccggcttccccggcgccagaggcaagcccggccccctgggcaaggtgggcgacaagggcagcatcggcttccccggcccccccggccccgagggcttccccggcgacatcggcccccccggcgacaacggccccgagggcatgaagggcaagcccggcgccagaggcctgcccggccccagaggccagctgggccccgagggcgacgagggccccatgggcccccccggcgcccccggcctggagggccagcccggcagaaagggcttccccggcagacccggcctggacggcgtgaagggcgagcccggcgaccccggcagacccggccccgtgggcgagcagggcttcatgggcttcatcggcctggtgggcgagcccggcatcgtgggcgagaagggcgacagaggcatgatgggcccccccggcgtgcccggccccaagggcagcatgggccaccccggcatgcccggcggcatgggcacccccggcgagcccggcccccagggcccccccggcagcagaggcccccccggcatgagaggcgccaagggcagaagaggccccagaggccccgacggccccgccggcgagcagggcagcagaggcctgaagggcccccccggcccccagggcagacccggcagacccggccagcagggcgtggccggcgagagaggccacctgggcagcagaggcttccccggcatccccggccccagcggcccccccggcaccaagggcctgcccggcgagcccggcccccagggcccccagggccccatcggcccccccggcgagatgggccccaagggcccccccggcgccgtgggcgagcccggcctgcccggcgaggccggcatgaagggcgacctgggccccctgggcacccccggcgagcagggcctgatcggccagagaggcgagcccggcctggagggcgacagcggccccatgggccccgacggcctgaagggcgacagaggcgaccccggccccgacggcgagcacggcgagaagggccaggagggcctgatgggcgaggacggcccccccggcccccccggcgtgaccggcgtgagaggccccgagggcaagagcggcaagcagggcgagaagggcagaaccggcgccaagggcgccaagggctaccagggccagctgggcgagatgggcgtgcccggcgaccccggcccccccggcacccccggccccaagggcagcagaggcagcctgggccccaccggcgcccccggcagaatgggcgcccagggcgagcccggcctggccggctacgacggccacaagggcatcgtgggccccctgggcccccccggccccaagggcgagaagggcgagcagggcgaggacggcaaggccgagggcccccccggcccccccggcgacagaggccccgtgggcgacagaggcgacagaggcgagcccggcgaccccggctaccccggccaggagggcgtgcagggcctgagaggcaagcccggccagcagggccagcccggccaccccggccccagaggctggcccggccccaagggcagcaagggcgccgagggccccaagggcaagcagggcaaggccggcgcccccggcagaagaggcgtgcagggcctgcagggcctgcccggccccagaggcgtggtgggcagacagggcctggagggcatcgccggccccgacggcctgcccggcagagacggccaggccggccagcagggcgagcagggcgacgacggcgaccccggccccatgggccccgccggcaagagaggcaaccccggcgtggccggcctgcccggcgcccagggcccccccggcttcaagggcgagagcggcctgcccggccagctgggcccccccggcaagagaggcaccgagggcagaaccggcctgcccggcaaccagggcgagcccggcagcaagggccagcccggcgacagcggcgagatgggcttccccggcatggccggcctgttcggccccaagggcccccccggcgacatcggcttcaagggcatccagggccccagaggcccccccggcctgatgggcaaggagggcatcgtgggccccctgggcatcctgggccccagcggcctgcccggccccaagggcgacaagggcagcagaggcgactggggcctgcagggccccagaggcccccccggccccagaggcagacccggcccccccgtggaccccggcggccccagatacatcccctgcctgttcctggcccagcagcaggacgacctgggcgccgccttccagacctggatggacaccagcggcgccctgagacccgagagctacagctaccccgacagactggtgctggaccagggcggcgagatcttcaagaccctgcactacctgagcaacctgatccagagcatcaagacccccctgggcaccaaggagaaccccgccagagtgtgcagagacctgatggactgcgagcagaagatggtggacggcacctactgggtggaccccaacctgggctgcagcagcgacaccatcgaggtgagctgcaacttcacccacggcggccagacctgcctgaagcccatcaccgccagcaaggtggagttcgccatcagcagagtgcagatgaacttcctgcacctgctgagcagcgaggtgacccagcacatcaccatccactgcctgaacatgaccgtgtggcaggagggcaccggccagacccccgccaagcaggccgtgagattcagagcctggaacggccagatcttcgaggccggcggccagttcagacccgaggtgagcatggacggctgcaaggtgcaggacggcagatggcaccagaccctgttcaccttcagaacccaggacccccagcagctgcccatcatcagcgtggacaacctgccccccgccagcagcggcaagcagtacagactggaggtgggccccgcctgcttcctgtag

SEQ ID NO: 1947 - DNA, 2145 bp, Homo sapiens
ctgagctggaccaaggccggcagccccgccccccccggcgtgatccccttccagagcggcttcatcttcacccagagagccagactgcaggcccccaccggcaccgtgatccccgccgccctgggcaccgagctggccctggtgctgagcctgtgcagccacagagtgaaccacgccttcctgttcgccgtgagaagccagaagagaaagctgcagctgggcctgcagttcctgcccggcaagaccgtggtgcacctgggcagcagaagaagcgtggccttcgacctggacatgcacgacggcagatggcaccacctggccctggagctgagaggcagaaccgtgaccctggtgaccgcctgcggccagagaagagtgcccgtgctgctgcccttccacagagaccccgccctggaccccggcggcagcttcctgttcggcaagatgaacccccacgccgtgcagttcgagggcgccctgtgccagttcagcatctaccccgtgacccaggtggcccacaactactgcacccacctgagaaagcagtgcggccaggccgacacctaccagagccccctgggccccctgttcagccaggacagcggcagacccttcaccttccagagcgacctggccctgctgggcctggagaacctgaccaccgccacccccgccctgggcagcctgcccgccggcagaggccccagaggcaccgtggcccccgccacccccaccaagccccagagaaccagccccaccaacccccaccagcacatggccgtgggcggccccgcccagacccccctgctgcccgccaagctgagcgccagcaacgccctggaccccatgctgcccgccagcgtgggcggcagcaccagaacccccagacccgccgccgcccagcccagccagaagatcaccgccaccaagatccccaagagcctgcccaccaagcccagcgcccccagcaccagcatcgtgcccatcaagagcccccaccccacccagaagaccgcccccagcagcttcaccaagagcgccctgcccacccagaagcaggtgccccccaccagcagacccgtgcccgccagagtgagcagacccgccgagaagcccatccagagaaaccccggcatgcccagaccccccccccccagcaccagacccctgccccccaccaccagcagcagcaagaagcccatccccaccctggccagaaccgaggccaagatcaccagccacgccagcaagcccgccagcgccagaaccagcacccacaagcccccccccttcaccgccctgagcagcagccccgcccccacccccggcagcaccagaagcaccagaccccccgccaccatggtgccccccaccagcggcaccagcacccccagaaccgcccccgccgtgcccacccccggcagcgcccccaccggcagcaagaagcccatcggcagcgaggccagcaagaaggccggccccaagagcagccccagaaagcccgtgcccctgagacccggcaaggccgccagagacgtgcccctgagcgacctgaccaccagacccagccccagacagccccagcccagccagcagaccacccccgccctggtgctggcccccgcccagttcctgagcagcagccccagacccaccagcagcggctacagcatcttccacctggccggcagcacccccttccccctgctgatgggcccccccggccccaagggcgactgcggcctgcccggcccccccggcctgcccggcctgcccggcatccccggcgccagaggccccagaggcccccccggcccctacggcaaccccggcctgcccggcccccccggcgccaagggcgacatgggcctgcccggcctgagcggcaaccccggcccccccggcagaaagggcctgcccggccccgtgggcgaccccggccccaagggcagcagaggctacatcggcctgcccggcctgttcggcctgcccggcagcgacggcgagagaggcctgcccggcgtgcccggcaagagaggcaagatgggcatgcccgtgctgctgccccagagcagcgaggccagaggcggcaacagcatgcccagcgagggcgccctggccggcagacacggcagccacctgtag

SEQ ID NO: 1948 - DNA, 2142 bp, Homo sapiens
atgtggaacagatacttcgtgttctacctgctgctgctgagcgccttcaccagccagaccgtgagcggccagagaaagaagggccccaagagcaacctgctggccagaaagagcgacgtgcagggcagcatctgcttcatcgacatcgtgttcatcgtggacagcagcgagagcagcaagatcgccctgttcgacaagcagaaggacttcgtggacagcctgagcgacaagatcttccagctgacccccggcagaagcctggagtacgacatcaagctggccgccctgcagttcagcagcagcgtgcagatcgacccccccttcagcagctggaaggacctgcagaccttcaagcagaaggtgaagagcatgaacctgatcggccagggcaccttcagctactacgccatcagcaacgccaccagactgctgaagagagagggcagaaaggacggcgtgaaggtggtgctgctgatgaccgacggcatcgaccaccccaagaaccccgacgtgcagagcatcagcgaggacgccagaatcagcggcatcagcttcatcaccatcgccctgagcaccgtggtgaacgaggccaagctgagactgatcagcggcgacagcagcagcgagcccaccctgctgctgagcgaccccaccctggtggacaagatccaggacagactggagatgctgttcgagatccagtgcgagagaaagatctgcgagtgcgagaagggcgaccccggcgaccccggcccccccggcacccacggcaaccccggcatcaagggcgagagaggccccaagggcaaccccggcaacgcccagaagggcgaggccggcgagagaggccccggcggcatccccggctacaagggcgacaagggcgagagaggcgagtgcggcaagcccggcatcaagggcgacaagggcagccccggcccctacggccccaagggccccagaggcatccagggcatcaccggcccccccggcgaccccggccccaagggcttccagggcaacaagggcgagcccggcccccccggcccctacggcagccccggcgcccccggcatcggccagcagggcatcaagggcgagagaggccaggagggcagacccggcgcccccggccccatcggcgtgggcgagcccggccagcccggccccagaggccccgagggcgtgcccggcgagagaggcctgcccggcgagggcttccccggccccaagggcgagaagggcagcgagggccccaccggcccccagggcctgcagggcctgagcatcaagggcgagaagggcgacatcggccccgtgggcccccagggccccatgggcatccccggcatcggcagccagggcgagcagggcatccagggccccatcggcccccccggcccccagggccccgccggccagggcctgcccggcagcaagggcgaggtgggccagatgggccccaccggccccagaggccccgtgggcatcggcgtgcagggccccaagggcgagcccggcagcatcggcctgcccggccagcccggcgtgcccggcgaggacggcgccgccggcaagaagggcgaggccggcctgcccggcgccagaggccccgagggcccccccggcaagggccagcccggccccaagggcgacgagggcaagaagggcagcaagggcaaccagggccagagaggcctgcccggccccgagggccccaagggcgagcccggcatcatgggccccttcggcatgcccggcaccagcatccccggcccccccggccccaagggcgacagaggcggccccggcatccccggcttcaagggcgagcccggcctgagcatcagaggccccaagggcgtgcagggccccagaggccccgtgggcgcccccggcctgaagggcgacggctaccccggcgtgcccggccccagaggcctgcccggcccccccggccccatgggcctgagaggcgtgggcgacaccggcgccaagaccctgaacaccagccacggcctggaggaccccagctgccccgactgcagcttctgccacttcagcctggccgccgacatccagcccaagtggcccgccctgctgcagctgatccccgccagcggcaccagacaggacggctag

SEQ ID NO: 1949 - DNA, 3378 bp, Homo sapiens
atgtggaacagatacttcgtgttctacctgctgctgctgagcgccttcaccagccagaccgtgagcggccagagaaagaagggccccaagagcaacctgctggccagaaagagcgacgtgcagggcagcatctgcttcatcgacatcgtgttcatcgtggacagcagcgagagcagcaagatcgccctgttcgacaagcagaaggacttcgtggacagcctgagcgacaagatcttccagctgacccccggcagaagcctggagtacgacatcaagctggccgccctgcagttcagcagcagcgtgcagatcgacccccccttcagcagctggaaggacctgcagaccttcaagcagaaggtgaagagcatgaacctgatcggccagggcaccttcagctactacgccatcagcaacgccaccagactgctgaagagagagggcagaaaggacggcgtgaaggtggtgctgctgatgaccgacggcatcgaccaccccaagaaccccgacgtgcagagcatcagcgaggacgccagaatcagcggcatcagcttcatcaccatcgccctgagcaccgtggtgaacgaggccaagctgagactgatcagcggcgacagcagcagcgagcccaccctgctgctgagcgaccccaccctggtggacaagatccaggacagactggacatcctgttcgagaagaagtgcgagagaaagatctgcgagtgcgagaagggcgaccccggcgaccccggcccccccggcacccacggcaaccccggcatcaagggcgagagaggccccaagggcaaccccggcaacgcccagaagggcgaggccggcgagagaggccccggcggcatccccggctacaagggcgacaagggcgagagaggcgagtgcggcaagcccggcatcaagggcgacaagggcagccccggcccctacggccccaagggccccagaggcatccagggcatcaccggcccccccggcgaccccggccccaagggcttccagggcaacaagggcgagcccggcccccccggcccctacggcagccccggcgcccccggcatcggccagcagggcatcaagggcgagagaggccaggagggcagacccggcgcccccggccccatcggcgtgggcgagcccggccagcccggccccagaggccccgagggcgtgcccggcgagagaggcctgcccggcgagggcttccccggccccaagggcgagaagggcagcgagggccccaccggcccccagggcctgcagggcctgagcatcaagggcgagaagggcgacatcggccccgtgggcccccagggccccatgggcatccccggcatcggcagccagggcgagcagggcatccagggccccatcggcccccccggcccccagggccccgccggccagggcctgcccggcagcaagggcgaggtgggccagatgggccccaccggccccagaggccccgtgggcatcggcgtgcagggccccaagggcgagcccggcagcatcggcctgcccggccagcccggcgtgcccggcgaggacggcgccgccggcaagaagggcgaggccggcctgcccggcgccagaggccccgagggcccccccggcaagggccagcccggccccaagggcgacgagggcaagaagggcagcaagggcaaccagggccagagaggcctgcccggccccgagggccccaagggcgagcccggcatcatgggccccttcggcatgcccggcaccagcatccccggcccccccggccccaagggcgacagaggcggccccggcatccccggcttcaagggcgagcccggcctgagcatcagaggccccaagggcgtgcagggccccagaggccccgtgggcgcccccggcctgaagggcgacggctaccccggcgtgcccggccccagaggcctgcccggcccccccggccccatgggcctgagaggcgtgggcgacaccggcgccaagggcgagcccggcgtgagaggcccccccggccccagcggccccagaggcgtgggcacccagggccccaagggcgacaccggccagaagggcctgcccggcccccccggcccccccggctacggcagccagggcatcaagggcgagcagggcccccagggcttccccggccccaagggcaccatgggccacggcctgcccggccagaagggcgagcacggcgagagaggcgacgtgggcaagaagggcgacaagggcgagatcggcgagcccggcagccccggcaagcagggcctgcagggccccaagggcgacctgggcctgaccaaggaggagatcatcaagctgatcaccgagatctgcggctgcggccccaagtgcaaggagacccccctggagctggtgttcgtgatcgacagcagcgagagcgtgggccccgagaacttccagatcatcaagaacttcgtgaagaccatggccgacagagtggccctggacctggccaccgccagaatcggcatcatcaactacagccacaaggtggagaaggtggccaacctgaagcagttcagcagcaaggacgacttcaagctggccgtggacaacatgcagtacctgggcgagggcacctacaccgccaccgccctgcaggccgccaacgacatgttcgaggacgccagacccggcgtgaagaaggtggccctggtgatcaccgacggccagaccgacagcagagacaaggagaagctgaccgaggtggtgaagaacgccagcgacaccaacgtggagatcttcgtgatcggcgtggtgaagaagaacgaccccaacttcgagatcttccacaaggagatgaacctgatcgccaccgaccccgagcacgtgtaccagttcgacgacttcttcaccctgcaggacaccctgaagcagaagctgttccagaagatctgcgaggacttcgacagctacctggtgcagatcttcggcagcagcagcccccagcccggcttcggcatgagcggcgaggagctgagcgagagcacccccgagccccagaaggagatcagcgagagcctgagcgtgaccagagaccaggacgaggacgacaaggcccccgagcccacctgggccgacgacctgcccgccaccaccagcagcgaggccaccaccacccccagacccctgctgagcacccccgtggacggcgccgaggaccccagatgcctggaggccctgaagcccggcaactgcggcgagtacgtggtgagatggtactacgacaagcaggtgaacagctgcgccagattctggttcagcggctgcaacggcagcggcaacagattcaacagcgagaaggagtgccaggagacctgcatccagggctag

SEQ ID NO: 1950 - DNA, 1005 bp, Homo sapiens
atgtggaacagatacttcgtgttctacctgctgctgctgagcgccttcaccagccagaccgtgagcggccagagaaagaagggccccaagagcaacctgctggccagaaagagcgacgtgcagggcagcatctgcttcatcgacatcgtgttcatcgtggacagcagcgagagcagcaagatcgccctgttcgacaagcagaaggacttcgtggacagcctgagcgacaagatcttccagctgacccccggcagaagcctggagtacgacatcaagctggccgccctgcagttcagcagcagcgtgcagatcgacccccccttcagcagctggaaggacctgcagaccttcaagcagaaggtgaagagcatgaacctgatcggccagggcaccttcagctactacgccatcagcaacgccaccagactgctgaagagagagggcagaaaggacggcgtgaaggtggtgctgctgatgaccgacggcatcgaccaccccaagaaccccgacgtgcagagcatcagcgaggacgccagaatcagcggcatcagcttcatcaccatcgccctgagcaccgtggtgaacgaggccaagctgagactgatcagcggcgacagcagcagcgagcccaccctgctgctgagcgaccccaccctggtggacaagatccaggacagactggagatgctgttcgagatccagtgcgagagaaagatctgcgagtgcgagaagggcgaccccggcgaccccggcccccccggcacccacggcaaccccggcatcaagggcgagagaggccccaagggcaaccccggcaacgcccagaagggcgaggccggcgagagaggccccggcggcatccccggctacaagggcgacaagcagtacagcagagaggacagagaggtggagcacaacaacgagaagtacgtggcctgcctgctgcccagccccgccctgctgcagcagagcagcctgacccaccacggcacctgcagccactag

SEQ ID NO: 1951 - DNA, 243 bp, Homo sapiens
gccaccaccagcagcgaggccaccaccacccccagacccctgctgagcacccccgtggacggcgccgaggaccccagatgcctggaggccctgaagcccggcaactgcggcgagtacgtggtgagatggtactacgacaagcaggtgaacagctgcgccagattctggttcagcggctgcaacggcagcggcaacagattcaacagcgagaaggagtgccaggagacctgcatccagggctag

SEQ ID NO: 1952 - DNA, 1587 bp, Homo sapiens
atgggcagcagcagagccccctggatgggcagagtgggcggccacggcatgctggccctgctgctggccggcctgctgctgcccggcaccctggccaagagcatcggcaccttcagcgacccctgcaaggaccccaccagaatcaccagccccaacgacccctgcctgaccggcaagggcgacagcagcggcttcagcagctacagcggcagcagcagcagcggcagcagcatcagcagcgccagaagcagcggcggcggcagcagcggcagcagcagcggcagcagcatcgcccagggcggcagcgccggcagcttcaagcccggcaccggctacagccaggtgagctacagcagcggcagcggcagcagcctgcagggcgccagcggcagcagccagctgggcagcagcagcagccacagcggcagcagcggcagccacagcggcagcagcagccacagcagcagcagcagcagcttccagttcagcagcagcagcttccaggtgggcaacggcagcgccctgcccaccaacgacaacagctacagaggcatcctgaaccccagccagcccggccagagcagcagcagcagccagaccttcggcgtgagcagcagcggccagagcgtgagcagcaaccagagaccctgcagcagcgacatccccgacagcccctgcagcggcggccccatcgtgagccacagcggcccctacatccccagcagccacagcgtgagcggcggccagagacccgtggtggtggtggtggaccagcacggcagcggcgcccccggcgtggtgcagggccccccctgcagcaacggcggcctgcccggcaagccctgcccccccatcaccagcgtggacaagagctacggcggctacgaggtggtgggcggcagcagcgacagctacctggtgcccggcatgacctacagcaagggcaagatctaccccgtgggctacttcaccaaggagaaccccgtgaagggcagccccggcgtgcccagcttcgccgccggcccccccatcagcgagggcaagtacttcagcagcaaccccatcatccccagccagagcgccgccagcagcgccatcgccttccagcccgtgggcaccggcggcgtgcagctgtgcggcggcggcagcaccggcagcaagggcccctgcagccccagcagcagcagagtgcccagcagcagcagcatcagcagcagcagcggcctgccctaccacccctgcggcagcgccagccagagcccctgcagcccccccggcaccggcagcttcagcagcagcagcagcagccagagcagcggcaagatcatcctgcagccctgcggcagcaagagcagcagcagcggccacccctgcatgagcgtgagcagcctgaccctgaccggcggccccgacggcagcccccaccccgaccccagcgccggcgccaagccctgcggcagcagcagcgccggcaagatcccctgcagaagcatcagagacatcctggcccaggtgaagcccctgggcccccagctggccgaccccgaggtgttcctgccccagggcgagctgctggacagcccctag

SEQ ID NO: 1953 - DNA, 1590 bp, Homo sapiens
atgggcagcagcagagccccctggatgggcagagtgggcggccacggcatgatggccctgctgctggccggcctgctgctgcccggcaccctggccaagagcatcggcaccttcagcgacccctgcaaggaccccaccagaatcaccagccccaacgacccctgcctgaccggcaagggcgacagcagcggcttcagcagctacagcggcagcagcagcagcggcagcagcatcagcagcgccagaagcagcggcggcggcagcagcggcagcagcagcggcagcagcatcgcccagggcggcagcgccggcagcttcaagcccggcaccggctacagccaggtgagctacagcagcggcagcggcagcagcctgcagggcgccagcggcagcagccagctgggcagcagcagcagccacagcggcaacagcggcagccacagcggcagcagcagcagccacagcagcagcagcagcagcttccagttcagcagcagcagcttccaggtgggcaacggcagcgccctgcccaccaacgacaacagctacagaggcatcctgaaccccagccagcccggccagagcagcagcagcagccagaccttcggcgtgagcagcagcggccagagcgtgagcagcaaccagagaccctgcagcagcgacatccccgacagcccctgcagcggcggccccatcgtgagccacagcggcccctacatccccagcagccacagcgtgagcggcggccagagacccgtggtggtggtggtggaccagcacggcagcggcgcccccggcgtggtgcagggccccccctgcagcaacggcggcctgcccggcaagccctgcccccccatcaccagcgtggacaagagctacggcggctacgaggtggtgggcggcagcagcgacagctacctggtgcccggcatgacctacagcaagggcaagatctaccccgtgggctacttcaccaaggagaaccccgtgaagggcagccccggcgtgcccagcttcgccgccggcccccccatcagcgagggcaagtacttcagcagcaaccccatcatccccagccagagcgccgccagcagcgccatcgccttccagcccgtgggcaccggcggcgtgcagctgtgcggcggcggcagcaccggcagcaagggcccctgcagccccagcagcagcagagtgcccagcagcagcagcatcagcagcagcagcggcctgccctaccacccctgcggcagcgccagccagagcccctgcagcccccccggcaccggcagcttcagcagcagcagcagcagccagagcagcggcaagatcatcctgcagccctgcggcagcaagagcagcagcagcggccacccctgcatgagcgtgagcagcctgaccctgaccggcggccccgacggcagcccccaccccgaccccagcgccggcgccaagccctgcggcagcagcagcgccggcaagatcccctgcagaagcatcagagacatcctggcccaggtgaagcccctgggcccccagctggccgaccccgaggtgttcctgccccagggcgagctgctgaacagcccctag

SEQ ID NO: 1954 - DNA, 1590 bp, Homo sapiens
atgggcagcagcagagccccctggatgggcagagtgggcggccacggcatgatggccctgctgctggccggcctgctgctgcccggcaccctggccaagagcatcggcaccttcagcgacccctgcaaggaccccaccagaatcaccagccccaacgacccctgcctgaccggcaagggcgacagcagcggcttcagcagctacagcggcagcagcagcagcggcagcagcatcagcagcgccagaagcagcggcggcggcagcagcggcagcagcagcggcagcagcatcgcccagggcggcagcgccggcagcttcaagcccggcaccggctacagccaggtgagctacagcagcggcagcggcagcagcctgcagggcgccagcggcagcagccagctgggcagcagcagcagccacagcggcagcagcggcagccacagcggcagcagcagcagccacagcagcagcagcagcagcttccagttcagcagcagcagcttccaggtgggcaacggcagcgccctgcccaccaacgacaacagctacagaggcatcctgaaccccagccagcccggccagagcagcagcagcagccagaccttcggcgtgagcagcagcggccagagcgtgagcagcaaccagagaccctgcagcagcgacatccccgacagcccctgcagcggcggccccatcgtgagccacagcggcccctacatccccagcagccacagcgtgagcggcggccagagacccgtggtggtggtggtggaccagcacggcagcggcgcccccggcgtggtgcagggccccccctgcagcaacggcggcctgcccggcaagccctgcccccccatcaccagcgtggacaagagctacggcggctacgaggtggtgggcggcagcagcgacagctacctggtgcccggcatgacctacagcaagggcaagatctaccccgtgggctacttcaccaaggagaaccccgtgaagggcagccccggcgtgcccagcttcgccgccggcccccccatcagcgagggcaagtacttcagcagcaaccccatcatccccagccagagcgccgccagcagcgccatcgccttccagcccgtgggcaccggcggcgtgcagctgtgcggcggcggcagcaccggcagcaagggcccctgcagccccagcagcagcagagtgcccagcagcagcagcatcagcagcagcgccggcagcccctaccacccctgcggcagcgccagccagagcccctgcagcccccccggcaccggcagcttcagcagcagcagcagcagccagagcagcggcaagatcatcctgcagccctgcggcagcaagagcagcagcagcggccacccctgcatgagcgtgagcagcctgaccctgaccggcggccccgacggcagcccccaccccgaccccagcgccggcgccaagccctgcggcagcagcagcgccggcaagatcccctgcagaagcatcagagacatcctggcccaggtgaagcccctgggcccccagctggccgaccccgaggtgttcctgccccagggcgagctgctggacagcccctag

SEQ ID NO: 1955 - DNA, 1590 bp, Homo sapiens
atgggcagcagcagagccccctggatgggcagagtgggcggccacggcatgatggccctgctgctggccggcctgctgctgcccggcaccctggccaagagcatcggcaccttcagcgacccctgcaaggaccccaccagaatcaccagccccaacgacccctgcctgaccggcaagggcgacagcagcggcttcagcagctacagcggcagcagcagcagcggcagcagcatcagcagcgccagaagcagcggcggcggcagcagcggcagcagcagcggcagcagcatcgcccagggcggcagcgccggcagcttcaagcccggcaccggctacagccaggtgagctacagcagcggcagcggcagcagcctgcagggcgccagcggcagcagccagctgggcagcagcagcagccacagcggcagcagcggcagccacagcggcagcagcagcagccacagcagcagcagcagcagcttccagttcagcagcagcagcttccaggtgggcaacggcagcgccctgcccaccaacgacaacagctacagaggcatcctgaaccccagccagcccggccagagcagcagcagcagccagaccttcggcgtgagcagcagcggccagagcgtgagcagcaaccagagaccctgcagcagcgacatccccgacagcccctgcagcggcggccccatcgtgagccacagcggcccctacatccccagcagccacagcgtgagcggcggccagagacccgtggtggtggtggtggaccagcacggcagcggcgcccccggcgtggtgcagggccccccctgcagcaacggcggcctgcccggcaagccctgcccccccatcaccagcgtggacaagagctacggcggctacgaggtggtgggcggcagcagcgacagctacctggtgcccggcatgacctacagcaagggcaagatctaccccgtgggctacttcaccaaggagaaccccgtgaagggcagccccggcgtgcccagcttcgccgccggcccccccatcagcgagggcaagtacttcagcagcaaccccatcatccccagccagagcgccgccagcagcgccatcgccttccagcccgtgggcaccggcggcgtgcagctgtgcggcggcggcagcaccggcagcaagggcccctgcagccccagcagcagcagagtgcccagcagcagcagcatcagcagcagcagcggcagcccctaccacccctgcggcagcgccagccagagcccctgcagcccccccggcaccggcagcttcagcagcagcagcagcagccagagcagcggcaagatcatcctgcagccctgcggcagcaagagcagcagcagcggccacccctgcatgagcgtgagcagcctgaccctgaccggcggccccgacggcagcccccaccccgaccccagcgccggcgccaagccctgcggcagcagcagcgccggcaagatcccctgcagaagcatcagagacatcctggcccaggtgaagcccctgggcccccagctggccgaccccgaggtgttcctgccccagggcgagctgctggacagcccctag

SEQ ID NO: 1956 - DNA, 1590 bp, Homo sapiens
atgggcagcagcagagccccctggatgggcagagtgggcggccacggcatgatggccctgctgctggccggcctgctgctgcccggcaccctggccaagagcatcggcaccttcagcgacccctgcaaggaccccaccagaatcaccagccccaacgacccctgcctgaccggcaagggcgacagcagcggcttcagcagctacagcggcagcagcagcagcggcagcagcatcagcagcgccagaagcagcggcggcggcagcagcggcagcagcagcggcagcagcatcgcccagggcggcagcgccggcagcttcaagcccggcaccggctacagccaggtgagctacagcagcggcagcggcagcagcctgcagggcgccagcggcagcagccagctgggcagcagcagcagccacagcggcagcagcggcagccacagcggcagcagcagcagccacagcagcagcagcagcagcttccagttcagcagcagcagcttccaggtgggcaacggcagcgccctgcccaccaacgacaacagctacagaggcatcctgaaccccagccagcccggccagagcagcagcagcagccagaccagcggcgtgagcagcagcggccagagcgtgagcagcaaccagagaccctgcagcagcgacatccccgacagcccctgcagcggcggccccatcgtgagccacagcggcccctacatccccagcagccacagcgtgagcggcggccagagacccgtggtggtggtggtggaccagcacggcagcggcgcccccggcgtggtgcagggccccccctgcagcaacggcggcctgcccggcaagccctgcccccccatcaccagcgtggacaagagctacggcggctacgaggtggtgggcggcagcagcgacagctacctggtgcccggcatgacctacagcaagggcaagatctaccccgtgggctacttcaccaaggagaaccccgtgaagggcagccccggcgtgcccagcttcgccgccggcccccccatcagcgagggcaagtacttcagcagcaaccccatcatccccagccagagcgccgccagcagcgccatcgccttccagcccgtgggcaccggcggcgtgcagctgtgcggcggcggcagcaccggcagcaagggcccctgcagccccagcagcagcagagtgcccagcagcagcagcatcagcagcagcagcggcagcccctaccacccctgcggcagcgccagccagagcccctgcagcccccccggcaccggcagcttcagcagcagcagcagcagccagagcagcggcaagatcatcctgcagccctgcggcagcaagagcagcagcagcggccacccctgcatgagcgtgagcagcctgaccctgaccggcggccccgacggcagcccccaccccgaccccagcgccggcgccaagccctgcggcagcagcagcgccggcaagatcccctgcagaagcatcagagacatcctggcccaggtgaagcccctgggcccccagctggccgaccccgaggtgttcctgccccagggcgagctgctggacagcccctag

SEQ ID NO: 1957 - DNA, 1590 bp, Homo sapiens; identical to SEQ ID NO: 1956

SEQ ID NO: 1958 - DNA, 255 bp, Homo sapiens
gtgctgcacagcttcaccgacgccatcttcgacgagtggatgaagagattcaacccccccgccgacgcctggccccaggagctggcccccatcggccacaacagaatgtacaacatggtgcccttcttcccccccgtgaccaacgaggagctgttcctgaccagcgaccagctgggctacagctacgccatcgacctgcccgacttccaggccaacttcatctgcagctacctggtgagcgtgcaccaggagtag

SEQ ID NO: 1959 - DNA, 1560 bp, Homo sapiens
atgagccccctgtggtggggcttcctgctgagctgcctgggctgcaagatcctgcccggcgcccagggccagttccccagagtgtgcatgaccgtggacagcctggtgaacaaggagtgctgccccagactgggcgccgagagcgccaacgtgtgcggcagccagcagggcagaggccagtgcaccgaggtgagagccgacaccagaccctggagcggcccctacatcctgagaaaccaggacgacagagagctgtggcccagaaagttcttccacagaacctgcaagtgcaccggcaacttcgccggctacaactgcggcgactgcaagttcggctggaccggccccaactgcgagagaaagaagccccccgtgatcagacagaacatccacagcctgagcccccaggagagagagcagttcctgggcgccctggacctggccaagaagagagtgcaccccgactacgtgatcaccacccagcactggctgggcctgctgggccccaacggcacccagccccagttcgccaactgcagcgtgtacgacttcttcgtgtggctgcactactacagcgtgagagacaccctgctgggccccggcagaccctacagagccatcgacttcagccaccagggccccgccttcgtgacctggcacagataccacctgctgtgcctggagagagacctgcagagactgatcggcaacgagagcttcgccctgccctactggaacttcgccaccggcagaaacgagtgcgacgtgtgcaccgaccagctgttcggcgccgccagacccgacgaccccaccctgatcagcagaaacagcagattcagcagctgggagaccgtgtgcgacagcctggacgactacaaccacctggtgaccctgtgcaacggcacctacgagggcctgctgagaagaaaccagatgggcagaaacagcatgaagctgcccaccctgaaggacatcagagactgcctgagcctgcagaagttcgacaacccccccttcttccagaacagcaccttcagcttcagaaacgccctggagggcttcgacaaggccgacggcaccctggacagccaggtgatgagcctgcacaacctggtgcacagcttcctgaacggcaccaacgccctgccccacagcgccgccaacgaccccatcttcgtggtgctgcacagcttcaccgacgccatcttcgacgagtggatgaagagattcaacccccccgccgacgcctggccccaggagctggcccccatcggccacaacagaatgtacaacatggtgcccttcttcccccccgtgaccaacgaggagctgttcctgaccagcgaccagctgggctacagctacgccatcgacctgcccgtgagcgtggaggagacccccggctggcccaccaccctgctggtggtgatgggcaccctggtggccctggtgggcctgttcgtgctgctggccttcctgcagtacagaagactgagaaagggctacacccccctgatggagacccacctgagcagcaagagatacaccgaggaggcctag

SEQ ID NO: 1960 - DNA, 1659 bp, Homo sapiens
atgagccccctgtggtggggcttcctgctgagctgcctgggctgcaagatcctgcccggcgcccagggccagttccccagagtgtgcatgaccgtggacagcctggtgaacaaggagtgctgccccagactgggcgccgagagcgccaacgtgtgcggcagccagcagggcagaggccagtgcaccgaggtgagagccgacaccagaccctggagcggcccctacatcctgagaaaccaggacgacagagagctgtggcccagaaagttcttccacagaacctgcaagtgcaccggcaacttcgccggctacaactgcggcgactgcaagttcggctggaccggccccaactgcgagagaaagaagccccccgtgatcagacagaacatccacagcctgagcccccaggagagagagcagttcctgggcgccctggacctggccaagaagagagtgcaccccgactacgtgatcaccacccagcactggctgggcctgctgggccccaacggcacccagccccagttcgccaactgcagcgtgtacgacttcttcgtgtggctgcactactacagcgtgagagacaccctgctgggccccggcagaccctacagagccatcgacttcagccaccagggccccgccttcgtgacctggcacagataccacctgctgtgcctggagagagacctgcagagactgatcggcaacgagagcttcgccctgccctactggaacttcgccaccggcagaaacgagtgcgacgtgtgcaccgaccagctgttcggcgccgccagacccgacgaccccaccctgatcagcagaaacagcagattcagcagctgggagaccgtgtgcgacagcctggacgactacaaccacctggtgaccctgtgcaacggcacctacgagggcctgctgagaagaaaccagatgggcagaaacagcatgaagctgcccaccctgaaggacatcagagactgcctgagcctgcagaagttcgacaacccccccttcttccagaacagcaccttcagcttcagaaacgccctggagggcttcgacaaggccgacggcaccctggacagccaggtgatgagcctgcacaacctggtgcacagcttcctgaacggcaccaacgccctgccccacagcgccgccaacgaccccatcttcgtggtgatcagcaacagactgctgtacaacgccaccaccaacatcctggagcacgtgagaaaggagaaggccaccaaggagctgcccagcctgcacgtgctggtgctgcacagcttcaccgacgccatcttcgacgagtggatgaagagattcaacccccccgccgacgcctggccccaggagctggcccccatcggccacaacagaatgtacaacatggtgcccttcttcccccccgtgaccaacgaggagctgttcctgaccagcgaccagctgggctacagctacgccatcgacctgcccgtgagcgtggaggagacccccggctggcccaccaccctgctggtggtgatgggcaccctggtggccctggtgggcctgttcgtgctgctggccttcctgcagtacagaagactgagaaagggctacacccccctgatggagacccacctgagcagcaagagatacaccgaggaggcctag

SEQ ID NO: 1961 - DNA, 1347 bp, Homo sapiens
atggcccacgtgggcgactgcacccagaccccctggctgcccgtgctggtggtgagcctgatgtgcagcgccagagccgagtacagcaactgcggcgagaacgagtactacaaccagaccaccggcctgtgccaggagtgccccccctgcggccccggcgaggagccctacctgagctgcggctacggcaccaaggacgaggactacggctgcgtgccctgccccgccgagaagttcagcaagggcggctaccagatctgcagaagacacaaggactgcgagggcttcttcagagccaccgtgctgacccccggcgacatggagaacgacgccgagtgcggcccctgcctgcccggctactacatgctggagaacagacccagaaacatctacggcatggtgtgctacagctgcctgctggccccccccaacaccaaggagtgcgtgggcgccaccagcggcgccagcgccaacttccccggcaccagcggcagcagcaccctgagccccttccagcacgcccacaaggagctgagcggccagggccacctggccaccgccctgatcatcgccatgagcaccatcttcatcatggccatcgccatcgtgctgatcatcatgttctacatcctgaagaccaagcccagcgcccccgcctgctgcaccagccaccccggcaagagcgtggaggcccaggtgagcaaggacgaggagaagaaggaggcccccgacaacgtggtgatgttcagcgagaaggacgagttcgagaagctgaccgccacccccgccaagcccaccaagagcgagaacgacgccagcagcgagaacgagcagctgctgagcagaagcgtggacagcgacgaggagcccgcccccgacaagcagggcagccccgagctgtgcctgctgagcctggtgcacctggccagagagaagagcgccaccagcaacaagagcgccggcatccagagcagaagaaagaagatcctggacgtgtacgccaacgtgtgcggcgtggtggagggcctgagccccaccgagctgcccttcgactgcctggagaagaccagcagaatgctgagcagcacctacaacagcgagaaggccgtggtgaagacctggagacacctggccgagagcttcggcctgaagagagacgagatcggcggcatgaccgacggcatgcagctgttcgacagaatcagcaccgccggctacagcatccccgagctgctgaccaagctggtgcagatcgagagactggacgccgtggagagcctgtgcgccgacatcctggagtgggccggcgtggtgccccccgccagccagccccacgccgccagctag

SEQ ID NO: 1962 - DNA, 1443 bp, Homo sapiens
atggcccacgtgggcgactgcacccagaccccctggctgcccgtgctggtggtgagcctgatgtgcagcgccagagccgagtacagcaactgcggcgagaacgagtactacaaccagaccaccggcctgtgccaggagtgccccccctgcggccccggcgaggagccctacctgagctgcggctacggcaccaaggacgaggactacggctgcgtgccctgccccgccgagaagttcagcaagggcggctaccagatctgcagaagacacaaggactgcgagggcttcttcagagccaccgtgctgacccccggcgacatggagaacgacgccgagtgcggcccctgcctgcccggctactacatgctggagaacagacccagaaacatctacggcatggtgtgctacagctgcctgctggccccccccaacaccaaggagtgcgtgggcgccaccagcggcgccagcgccaacttccccggcaccagcggcagcagcaccctgagccccttccagcacgcccacaaggagctgagcggccagggccacctggccaccgccctgatcatcgccatgagcaccatcttcatcatggccatcgccatcgtgctgatcatcatgttctacatcctgaagaccaagcccagcgcccccggcgacggcccccacgcccccgtgccctgcttcctggacagccccagcaccccccccgtgggcgagcccggctgcagcctgccccccctgagccccgcctgctgcaccagccaccccggcaagagcgtggaggcccaggtgagcaaggacgaggagaagaaggaggcccccgacaacgtggtgatgttcagcgagaaggacgagttcgagaagctgaccgccacccccgccaagcccaccaagagcgagaacgacgccagcagcgagaacgagcagctgctgagcagaagcgtggacagcgacgaggagcccgcccccgacaagcagggcagccccgagctgtgcctgctgagcctggtgcacctggccagagagaagagcgccaccagcaacaagagcgccggcatccagagcagaagaaagaagatcctggacgtgtacgccaacgtgtgcggcgtggtggagggcctgagccccaccgagctgcccttcgactgcctggagaagaccagcagaatgctgagcagcacctacaacagcgagaaggccgtggtgaagacctggagacacctggccgagagcttcggcctgaagagagacgagatcggcggcatgaccgacggcatgcagctgttcgacagaatcagcaccgccggctacagcatccccgagctgctgaccaagctggtgcagatcgagagactggacgccgtggagagcctgtgcgccgacatcctggagtgggccggcgtggtgccccccgccagccagccccacgccgccagctag

SEQ ID NO: 1963 - DNA, 1443 bp, Homo sapiens; identical to SEQ ID NO: 1962

SEQ ID NO: 1964 - DNA, 957 bp, Homo sapiens
atggactgccaggagaacgagtactgggaccagtggggcagatgcgtgacctgccagagatgcggccccggccaggagctgagcaaggactgcggctacggcgagggcggcgacgcctactgcaccgcctgcccccccagaagatacaagagcagctggggccaccacagatgccagagctgcatcacctgcgccgtgatcaacagagtgcagaaggtgaactgcaccgccaccagcaacgccgtgtgcggcgactgcctgcccagattctacagaaagaccagaatcggcggcctgcaggaccaggagtgcatcccctgcaccaagcagacccccaccagcgaggtgcagtgcgccttccagctgagcctggtggaggccgacacccccaccgtgcccccccaggaggccaccctggtggccctggtgagcagcctgctggtggtgttcaccctggccttcctgggcctgttcttcctgtactgcaagcagttcttcaacagacactgccagagagagaagctgatcatcttcagcgaccccgtgcccgccagcctgaacctgatccccgagttcgccggcggcctgctgcagttcgaggccgacaagaccgccaaggaggagagcctgttccccgtgccccccagcaaggagaccagcgccgagagccaggtgagcgagaacatcttccagacccagcccctgaaccccatcctggaggacgactgcagcagcaccagcggcttccccacccaggagagcttcaccatggccagctgcaccagcgagagccacagccactgggtgcacagccccatcgagtgcaccgagctggacctgcagaagttcagcagcagcgccagctacaccggcgccgagaccctgggcggcaacaccgtggagagcaccggcgacagactggagctgaacgtgcccttcgaggtgcccagcccctag

SEQ ID NO: 1965 - DNA, 894 bp, Homo sapiens
atggactgccaggagaacgagtactgggaccagtggggcagatgcgtgacctgccagagatgcggccccggccaggagctgagcaaggactgcggctacggcgagggcggcgacgcctactgcaccgcctgcccccccagaagatacaagagcagctggggccaccacagatgccagagctgcatcacctgcgccgtgatcaacagagtgcagaaggtgaactgcaccgccaccagcaacgccgtgtgcggcgactgcctgcccagattctacagaaagaccagaatcggcggcctgcaggaccaggagtgcatcccctgcaccaagcagacccccaccagcgaggtgcagtgcgccttccagctgagcctggtggaggccgacacccccaccgtgcccccccaggaggccaccctggtggccctggtgagcagcctgctggtggtgttcaccctggccttcctgggcctgttcttcctgtactgcaagcagttcttcaacagacactgccagagaggcggcctgctgcagttcgaggccgacaagaccgccaaggaggagagcctgttccccgtgccccccagcaaggagaccagcgccgagagccaggtgagcgagaacatcttccagacccagcccctgaaccccatcctggaggacgactgcagcagcaccagcggcttccccacccaggagagcttcaccatggccagctgcaccagcgagagccacagccactgggtgcacagccccatcgagtgcaccgagctggacctgcagaagttcagcagcagcgccagctacaccggcgccgagaccctgggcggcaacaccgtggagagcaccggcgacagactggagctgaacgtgcccttcgaggtgcccagcccctag

SEQ ID NO: 1966 - DNA, 894 bp, Homo sapiens; identical to SEQ ID NO: 1965

SEQ ID NO: 1967 - DNA, 957 bp, Homo sapiens; identical to SEQ ID NO: 1964

SEQ ID NO: 1968 - DNA, 522 bp, Homo sapiens
atgagcaccggcaccaacggcgacggcgtgagccccgccaacggcgtggtgctggacagaagctaccccagatgcctgcccgtggagctgagcggcggcagatacacccacagcgcccccagcggcggccacacctgctgcaccggcggcctgctgcagttcgaggccgacaagaccgccaaggaggagagcctgttccccgtgccccccagcaaggagaccagcgccgagagccaggtgagcgagaacatcttccagacccagcccctgaaccccatcctggaggacgactgcagcagcaccagcggcttccccacccaggagagcttcaccatggccagctgcaccagcgagagccacagccactgggtgcacagccccatcgagtgcaccgagctggacctgcagaagttcagcagcagcgccagctacaccggcgccgagaccctgggcggcaacaccgtggagagcaccggcgacagactggagctgaacgtgcccttcgaggtgcccagcccctag

SEQ ID NO: 1969 - DNA, 894 bp, Homo sapiens; identical to SEQ ID NO: 1965

SEQ ID NO: 1970 - DNA, 648 bp, Homo sapiens
atgggcctgagaaccaccaagcagatgggcagaggcaccaaggcccccggccaccaggaggaccacatggtgaaggagcccgtggaggacaccgaccccagcaccctgagcttcaacatgagcgacaagtaccccatccaggacaccgagctgcccaaggccgaggagtgcgacaccatcaccctgaactgccccagaaacagcgacatgaagaaccagggcgaggagaacggcttccccgacagcaccggcgaccccctgcccgagatcagcaaggacaacagctgcaaggagaactgcacctgcagcagctgcctgctgagagcccccaccatcagcgacctgctgaacgaccaggacctgctggacgtgatcagaatcaagctggacccctgccaccccaccgtgaagaactggagaaacttcgccagcaagtggggcatgagctacgacgagctgtgcttcctggagcagagaccccagagccccaccctggagttcctgctgagaaacagccagagaaccgtgggccagctgatggagctgtgcagactgtaccacagagccgacgtggagaaggtgctgagaagatgggtggacgaggagtggcccaagagagagagaggcgaccccagcagacacttctag

SEQ ID NO: 1971 - DNA, 618 bp, Homo sapiens
atggccagccccgacgaccccctgagagccgaccacatggtgaaggagcccgtggaggacaccgaccccagcaccctgagcttcaacatgagcgacaagtaccccatccaggacaccgagctgcccaaggccgaggagtgcgacaccatcaccctgaactgccccagaaacagcgacatgaagaaccagggcgaggagaacggcttccccgacagcaccggcgaccccctgcccgagatcagcaaggacaacagctgcaaggagaactgcacctgcagcagctgcctgctgagagcccccaccatcagcgacctgctgaacgaccaggacctgctggacgtgatcagaatcaagctggacccctgccaccccaccgtgaagaactggagaaacttcgccagcaagtggggcatgagctacgacgagctgtgcttcctggagcagagaccccagagccccaccctggagttcctgctgagaaacagccagagaaccgtgggccagctgatggagctgtgcagactgtaccacagagccgacgtggagaaggtgctgagaagatgggtggacgaggagtggcccaagagagagagaggcgaccccagcagacacttctag

SEQ ID NO: 1972 - DNA, 255 bp, Homo sapiens
atggtgaaggagcccgtggaggacaccgaccccagcaccctgagcttcaacatgagcgacaagtaccccatccaggacaccgagctgcccaaggccgaggagtgcgacaccatcaccctgaactgccccagaaacagcgacatgaagaaccagggcgaggagaacggcttccccgacagcaccggcgaccccctgcccgagatcagcaaggacaacagctgcaaggagaactgcacctgcagcagctgcctgtag

SEQ ID NO: 1973 - DNA, 2175 bp, Homo sapiens
atggccggcctgaccgccgccgcccccagacccggcgtgctgctgctgctgctgagcatcctgcaccccagcagacccggcggcgtgcccggcgccatccccggcggcgtgcccggcggcgtgttctaccccggcgccggcctgggcgccctgggcggcggcgccctgggccccggcggcaagcccctgaagcccgtgcccggcggcctggccggcgccggcctgggcgccggcctgggcgccttccccgccgtgaccttccccggcgccctggtgcccggcggcgtggccgacgccgccgccgcctacaaggccgccaaggccggcgccggcctgggcggcgtgcccggcgtgggcggcctgggcgtgagcgccggcgccgtggtgccccagcccggcgccggcgtgaagcccggcaaggtgcccggcgtgggcctgcccggcgtgtaccccggcggcgtgctgcccggcgccagattccccggcgtgggcgtgctgcccggcgtgcccaccggcgccggcgtgaagcccaaggcccccggcgtgggcggcgccttcgccggcatccccggcgtgggccccttcggcggcccccagcccggcgtgcccctgggctaccccatcaaggcccccaagctgcccggcggctacggcctgccctacaccaccggcaagctgccctacggctacggccccggcggcgtggccggcgccgccggcaaggccggctaccccaccggcaccggcgtgggcccccaggccgccgccgccgccgccgccaaggccgccgccaagttcggcgccggcgccgccggcgtgctgcccggcgtgggcggcgccggcgtgcccggcgtgcccggcgccatccccggcatcggcggcatcgccggcgtgggcacccccgccgccgccgccgccgccgccgccgccgccaaggccgccaagtacggcgccgccgccggcctggtgcccggcggccccggcttcggccccggcgtggtgggcgtgcccggcgccggcgtgcccggcgtgggcgtgcccggcgccggcatccccgtggtgcccggcgccggcatccccggcgccgccgtgcccggcgtggtgagccccgaggccgccgccaaggccgccgccaaggccgccaagtacggcgccagacccggcgtgggcgtgggcggcatccccacctacggcgtgggcgccggcggcttccccggcttcggcgtgggcgtgggcggcatccccggcgtggccggcgtgcccggcgtgggcggcgtgcccggcgtgggcggcgtgcccggcgtgggcatcagccccgaggcccaggccgccgccgccgccaaggccgccaagtacggcgtgggcacccccgccgccgccgccgccaaggccgccgccaaggccgcccagttcggcctggtgcccggcgtgggcgtggcccccggcgtgggcgtggcccccggcgtgggcgtggcccccggcgtgggcctggcccccggcgtgggcgtggcccccggcgtgggcgtggcccccggcgtgggcgtggcccccggcatcggccccggcggcgtggccgccgccgccaagagcgccgccaaggtggccgccaaggcccagctgagagccgccgccggcctgggcgccggcatccccggcctgggcgtgggcgtgggcgtgcccggcctgggcgtgggcgccggcgtgcccggcctgggcgtgggcgccggcgtgcccggcttcggcgccgtgcccggcgccctggccgccgccaaggccgccaagtacggcgccgccgtgcccggcgtgctgggcggcctgggcgccctgggcggcgtgggcatccccggcggcgtggtgggcgccggccccgccgccgccgccgccgccgccaaggccgccgccaaggccgcccagttcggcctggtgggcgccgccggcctgggcggcctgggcgtgggcggcctgggcgtgcccggcgtgggcggcctgggcggcatcccccccgccgccgccgccaaggccgccaagtacggcgccgccggcctgggcggcgtgctgggcggcgccggccagttccccctgggcggcgtggccgccagacccggcttcggcctgagccccatcttccccggcggcgcctgcctgggcaaggcctgcggcagaaagagaaagtag

SEQ ID NO: 1974 - DNA, 2274 bp, Homo sapiens
atggccggcctgaccgccgccgcccccagacccggcgtgctgctgctgctgctgagcatcctgcaccccagcagacccggcggcgtgcccggcgccatccccggcggcgtgcccggcggcgtgttctaccccggcgccggcctgggcgccctgggcggcggcgccctgggccccggcggcaagcccctgaagcccgtgcccggcggcctggccggcgccggcctgggcgccggcctgggcgccttccccgccgtgaccttccccggcgccctggtgcccggcggcgtggccgacgccgccgccgcctacaaggccgccaaggccggcgccggcctgggcggcgtgcccggcgtgggcggcctgggcgtgagcgccggcgccgtggtgccccagcccggcgccggcgtgaagcccggcaaggtgcccggcgtgggcctgcccggcgtgtaccccggcggcgtgctgcccggcgccagattccccggcgtgggcgtgctgcccggcgtgcccaccggcgccggcgtgaagcccaaggcccccggcgtgggcggcgccttcgccggcatccccggcgtgggccccttcggcggcccccagcccggcgtgcccctgggctaccccatcaaggcccccaagctgcccggcggctacggcctgccctacaccaccggcaagctgccctacggctacggccccggcggcgtggccggcgccgccggcaaggccggctaccccaccggcaccggcgtgggcccccaggccgccgccgccgccgccgccaaggccgccgccaagttcggcgccggcgccgccggcgtgctgcccggcgtgggcggcgccggcgtgcccggcgtgcccggcgccatccccggcatcggcggcatcgccggcgtgggcacccccgccgccgccgccgccgccgccgccgccgccaaggccgccaagtacggcgccgccgccggcctggtgcccggcggccccggcttcggccccggcgtggtgggcgtgcccggcgccggcgtgcccggcgtgggcgtgcccggcgccggcatccccgtggtgcccggcgccggcatccccggcgccgccgtgcccggcgtggtgagccccgaggccgccgccaaggccgccgccaaggccgccaagtacggcgccagacccggcgtgggcgtgggcggcatccccacctacggcgtgggcgccggcggcttccccggcttcggcgtgggcgtgggcggcatccccggcgtggccggcgtgcccggcgtgggcggcgtgcccggcgtgggcggcgtgcccggcgtgggcatcagccccgaggcccaggccgccgccgccgccaaggccgccaagtacggcgtgggcacccccgccgccgccgccgccaaggccgccgccaaggccgcccagttcggcctggtgcccggcgtgggcgtggcccccggcgtgggcgtggcccccggcgtgggcgtggcccccggcgtgggcctggcccccggcgtgggcgtggcccccggcgtgggcgtggcccccggcgtgggcgtggcccccggcatcggccccggcggcgtggccgccgccgccaagagcgccgccaaggtggccgccaaggcccagctgagagccgccgccggcctgggcgccggcatccccggcctgggcgtgggcgtgggcgtgcccggcctgggcgtgggcgccggcgtgcccggcctgggcgtgggcgccggcgtgcccggcttcggcgccggcgccgacgagggcgtgagaagaagcctgagccccgagctgagagagggcgaccccagcagcagccagcacctgcccagcacccccagcagccccagagtgcccggcgccctggccgccgccaaggccgccaagtacggcgccgccgtgcccggcgtgctgggcggcctgggcgccctgggcggcgtgggcatccccggcggcgtggtgggcgccggccccgccgccgccgccgccgccgccaaggccgccgccaaggccgcccagttcggcctggtgggcgccgccggcctgggcggcctgggcgtgggcggcctgggcgtgcccggcgtgggcggcctgggcggcatcccccccgccgccgccgccaaggccgccaagtacggcgccgccggcctgggcggcgtgctgggcggcgccggccagttccccctgggcggcgtggccgccagacccggcttcggcctgagccccatcttccccggcggcgcctgcctgggcaaggcctgcggcagaaagagaaagtag

SEQ ID NO: 1975 - DNA, 2136 bp, Homo sapiens
atggccggcctgaccgccgccgcccccagacccggcgtgctgctgctgctgctgagcatcctgcaccccagcagacccggcggcgtgcccggcgccatccccggcggcgtgcccggcggcgtgttctaccccggcgccggcctgggcgccctgggcggcggcgccctgggccccggcggcaagcccctgaagcccgtgcccggcggcctggccggcgccggcctgggcgccggcctgggcgccttccccgccgtgaccttccccggcgccctggtgcccggcggcgtggccgacgccgccgccgcctacaaggccgccaaggccggcgccggcctgggcggcgtgcccggcgtgggcggcctgggcgtgagcgccgcccccagcgtgcccggcgccgtggtgccccagcccggcgccggcgtgaagcccggcaaggtgcccggcgtgggcctgcccggcgtgtaccccggcggcgtgctgcccggcgccagattccccggcgtgggcgtgctgcccggcgtgcccaccggcgccggcgtgaagcccaaggcccccggcgtgggcggcgccttcgccggcatccccggcgtgggccccttcggcggcccccagcccggcgtgcccctgggctaccccatcaaggcccccaagctgcccggcggctacggcctgccctacaccaccggcaagctgccctacggctacggccccggcggcgtggccggcgccgccggcaaggccggctaccccaccggcaccggcgtgggcccccaggccgccgccgccgccgccgccaaggccgccgccaagttcggcgccggcgccgccggcgtgctgcccggcgtgggcggcgccggcgtgcccggcgtgcccggcgccatccccggcatcggcggcatcgccggcgtgggcacccccgccgccgccgccgccgccgccgccgccgccaaggccgccaagtacggcgccgccgccggcctggtgcccggcggccccggcttcggccccggcgtggtgggcgtgcccggcgccggcgtgcccggcgtgggcgtgcccggcgccggcatccccgtggtgcccggcgccggcatccccggcgccgccgtgcccggcgtggtgagccccgaggccgccgccaaggccgccgccaaggccgccaagtacggcgccagacccggcgtgggcgtgggcggcatccccacctacggcgtgggcgccggcggcttccccggcttcggcgtgggcgtgggcggcatccccggcgtggccggcgtgcccggcgtgggcggcgtgcccggcgtgggcggcgtgcccggcgtgggcatcagccccgaggcccaggccgccgccgccgccaaggccgccaagtacggcgtgggcacccccgccgccgccgccgccaaggccgccgccaaggccgcccagttcggcctggtgcccggcgtgggcgtggcccccggcgtgggcgtggcccccggcgtgggcgtggcccccggcgtgggcctggcccccggcgtgggcgtggcccccggcgtgggcgtggcccccggcgtgggcgtggcccccggcatcggccccggcggcgtggccgccgccgccaagagcgccgccaaggtggccgccaaggcccagctgagagccgccgccggcctgggcgccggcatccccggcctgggcgtgggcgtgggcgtgcccggcctgggcgtgggcgccggcgtgcccggcctgggcgtgggcgccggcgtgcccggcttcggcgccgtgcccggcgccctggccgccgccaaggccgccaagtacggcgccgccgtgcccggcgtgctgggcggcctgggcgccctgggcggcgtgggcatccccggcggcgtggtgggcgccggccccgccgccgccgccgccgccgccaaggccgccgccaaggccgcccagttcggcctggtgggcgccgccggcctgggcggcctgggcgtgggcggcctgggcgtgcccggcgtgggcggcctgggcggcatcccccccgccgccgccgccaaggccgccaagtacggcgtggccgccagacccggcttcggcctgagccccatcttccccggcggcgcctgcctgggcaaggcctgcggcagaaagagaaagtag

SEQ ID NO: 1976 - DNA, 2379 bp, Homo sapiens
atggccggcctgaccgccgccgcccccagacccggcgtgctgctgctgctgctgagcatcctgcaccccagcagacccggcggcgtgcccggcgccatccccggcggcgtgcccggcggcgtgttctaccccggcgccggcctgggcgccctgggcggcggcgccctgggccccggcggcaagcccctgaagcccgtgcccggcggcctggccggcgccggcctgggcgccggcctgggcgccttccccgccgtgaccttccccggcgccctggtgcccggcggcgtggccgacgccgccgccgcctacaaggccgccaaggccggcgccggcctgggcggcgtgcccggcgtgggcggcctgggcgtgagcgccggcgccgtggtgccccagcccggcgccggcgtgaagcccggcaaggtgcccggcgtgggcctgcccggcgtgtaccccggcggcgtgctgcccggcgccagattccccggcgtgggcgtgctgcccggcgtgcccaccggcgccggcgtgaagcccaaggcccccggcgtgggcggcgccttcgccggcatccccggcgtgggccccttcggcggcccccagcccggcgtgcccctgggctaccccatcaaggcccccaagctgcccggcggctacggcctgccctacaccaccggcaagctgccctacggctacggccccggcggcgtggccggcgccgccggcaaggccggctaccccaccggcaccggcgtgggcccccaggccgccgccgccgccgccgccaaggccgccgccaagttcggcgccggcgccgccggcgtgctgcccggcgtgggcggcgccggcgtgcccggcgtgcccggcgccatccccggcatcggcggcatcgccggcgtgggcacccccgccgccgccgccgccgccgccgccgccgccaaggccgccaagtacggcgccgccgccggcctggtgcccggcggccccggcttcggccccggcgtggtgggcgtgcccggcgccggcgtgcccggcgtgggcgtgcccggcgccggcatccccgtggtgcccggcgccggcatccccggcgccgccgtgcccggcgtggtgagccccgaggccgccgccaaggccgccgccaaggccgccaagtacggcgccagacccggcgtgggcgtgggcggcatccccacctacggcgtgggcgccggcggcttccccggcttcggcgtgggcgtgggcggcatccccggcgtggccggcgtgcccggcgtgggcggcgtgcccggcgtgggcggcgtgcccggcgtgggcatcagccccgaggcccaggccgccgccgccgccaaggccgccaagtacggcgccgccggcgccggcgtgctgggcggcctggtgcccggcgcccccggcgccgtgcccggcgtgcccggcaccggcggcgtgcccggcgtgggcacccccgccgccgccgccgccaaggccgccgccaaggccgcccagttcgccctgctgaacctggccggcctggtgcccggcgtgggcgtggcccccggcgtgggcgtggcccccggcgtgggcgtggcccccggcgtgggcctggcccccggcgtgggcgtggcccccggcgtgggcgtggcccccggcgtgggcgtggcccccggcatcggccccggcggcgtggccgccgccgccaagagcgccgccaaggtggccgccaaggcccagctgagagccgccgccggcctgggcgccggcatccccggcctgggcgtgggcgtgggcgtgcccggcctgggcgtgggcgccggcgtgcccggcctgggcgtgggcgccggcgtgcccggcttcggcgccggcgccgacgagggcgtgagaagaagcctgagccccgagctgagagagggcgaccccagcagcagccagcacctgcccagcacccccagcagccccagagtgcccggcgccctggccgccgccaaggccgccaagtacggcgccgccgtgcccggcgtgctgggcggcctgggcgccctgggcggcgtgggcatccccggcggcgtggtgggcgccggccccgccgccgccgccgccgccgccaaggccgccgccaaggccgcccagttcggcctggtgggcgccgccggcctgggcggcctgggcgtgggcggcctgggcgtgcccggcgtgggcggcctgggcggcatcccccccgccgccgccgccaaggccgccaagtacggcgccgccggcctgggcggcgtgctgggcggcgccggccagttccccctgggcggcgtggccgccagacccggcttcggcctgagccccatcttccccggcggcgcctgcctgggcaaggcctgcggcagaaagagaaagtag

SEQ ID NO: 1977 - DNA, 2034 bp, Homo sapiens
atggccggcctgaccgccgccgcccccagacccggcgtgctgctgctgctgctgagcatcctgcaccccagcagacccggcggcgtgcccggcgccatccccggcggcgtgcccggcggcgtgttctaccccgccctgggccccggcggcaagcccctgaagcccgtgcccggcggcctggccggcgccggcctgggcgccggcctgggcgccttccccgccgtgaccttccccggcgccctggtgcccggcggcgtggccgacgccgccgccgcctacaaggccgccaaggccggcgccggcctgggcggcgtgcccggcgtgggcggcctgggcgtgagcgccggcgccgtggtgccccagcccggcgccggcgtgaagcccggcaaggtgcccggcgtgggcctgcccggcgtgtaccccggcggcgtgctgcccggcgccagattccccggcgtgggcgtgctgcccggcgtgcccaccggcgccggcgtgaagcccaaggcccccggcgtgggcggcgccttcgccggcatccccggcgtgggccccttcggcggcccccagcccggcgtgcccctgggctaccccatcaaggcccccaagctgcccggcggctacggcctgccctacaccaccggcaagctgccctacggctacggccccggcggcgtggccggcgccgccggcaaggccggctaccccaccggcaccggcgtgggcccccaggccgccgccgccgccgccgccaaggccgccgccaagttcggcgccggcgccgccggcgtgctgcccggcgtgggcggcgccggcgtgcccggcgtgcccggcgccatccccggcatcggcggcatcgccggcgtgggcacccccgccgccgccgccgccgccgccgccgccgccaaggccgccaagtacggcgccgccgccggcctggtgcccggcggccccggcttcggccccggcgtggtgggcgtgcccggcgccggcgtgcccggcgtgggcgtgcccggcgccggcatccccgtggtgcccggcgccggcatccccggcgccgccgtgcccggcgtggtgagccccgaggccgccgccaaggccgccgccaaggccgccaagtacggcgccagacccggcgtgggcgtgggcggcatccccacctacggcgtgggcgccggcggcttccccggcttcggcgtgggcgtgggcggcatccccggcgtggccggcgtgcccggcgtgggcggcgtgcccggcgtgggcggcgtgcccggcgtgggcatcagccccgaggcccaggccgccgccgccgccaaggccgccaagtacggcctggtgcccggcgtgggcgtggcccccggcgtgggcgtggcccccggcgtgggcgtggcccccggcgtgggcctggcccccggcgtgggcgtggcccccggcgtgggcgtggcccccggcgtgggcgtggcccccggcatcggccccggcggcgtggccgccgccgccaagagcgccgccaaggtggccgccaaggcccagctgagagccgccgccggcctgggcgccggcatccccggcctgggcgtgggcgtgggcgtgcccggcctgggcgtgggcgccggcgtgcccggcctgggcgtgggcgccggcgtgcccggcttcggcgccgtgcccggcgccctggccgccgccaaggccgccaagtacggcgccgccgtgcccggcgtgctgggcggcctgggcgccctgggcggcgtgggcatccccggcggcgtggtgggcgccggccccgccgccgccgccgccgccgccaaggccgccgccaaggccgcccagttcggcctggtgggcgccgccggcctgggcggcctgggcgtgggcggcctgggcgtgcccggcgtgggcggcctgggcggcatcccccccgccgccgccgccaaggccgccaagtacggcgtggccgccagacccggcttcggcctgagccccatcttccccggcggcgcctgcctgggcaaggcctgcggcagaaagagaaagtag

SEQ ID NO: 1978 - DNA, 2118 bp, Homo sapiens
atggccggcctgaccgccgccgcccccagacccggcgtgctgctgctgctgctgagcatcctgcaccccagcagacccggcggcgtgcccggcgccatccccggcggcgtgcccggcggcgtgttctaccccggcgccggcctgggcgccctgggcggcggcgccctgggccccggcggcaagcccctgaagcccgtgcccggcggcctggccggcgccggcctgggcgccggcctgggcgccttccccgccgtgaccttccccggcgccctggtgcccggcggcgtggccgacgccgccgccgcctacaaggccgccaaggccggcgccggcctgggcggcgtgcccggcgtgggcggcctgggcgtgagcgccggcgccgtggtgccccagcccggcgccggcgtgaagcccggcaaggtgcccggcgtgggcctgcccggcgtgtaccccggcggcgtgctgcccggcgccagattccccggcgtgggcgtgctgcccggcgtgcccaccggcgccggcgtgaagcccaaggcccccggcgtgggcggcgccttcgccggcatccccggcgtgggccccttcggcggcccccagcccggcgtgcccctgggctaccccatcaaggcccccaagctgcccggcggctacggcctgccctacaccaccggcaagctgccctacggctacggccccggcggcgtggccggcgccgccggcaaggccggctaccccaccggcaccggcgtgggcccccaggccgccgccgccgccgccgccaaggccgccgccaagttcggcgccggcgccgccggcgtgctgcccggcgtgggcggcgccggcgtgcccggcgtgcccggcgccatccccggcatcggcggcatcgccggcgtgggcacccccgccgccgccgccgccgccgccgccgccgccaaggccgccaagtacggcgccgccgccggcctggtgcccggcggccccggcttcggccccggcgtggtgggcgtgcccggcgccggcgtgcccggcgtgggcgtgcccggcgccggcatccccgtggtgcccggcgccggcatccccggcgccgccgtgcccggcgtggtgagccccgaggccgccgccaaggccgccgccaaggccgccaagtacggcgccagacccggcgtgggcgtgggcggcatccccacctacggcgtgggcgccggcggcttccccggcttcggcgtgggcgtgggcggcatccccggcgtggccggcgtgcccggcgtgggcggcgtgcccggcgtgggcggcgtgcccggcgtgggcatcagccccgaggcccaggccgccgccgccgccaaggccgccaagtacggcctggtgcccggcgtgggcgtggcccccggcgtgggcgtggcccccggcgtgggcgtggcccccggcgtgggcctggcccccggcgtgggcgtggcccccggcgtgggcgtggcccccggcgtgggcgtggcccccggcatcggccccggcggcgtggccgccgccgccaagagcgccgccaaggtggccgccaaggcccagctgagagccgccgccggcctgggcgccggcatccccggcctgggcgtgggcgtgggcgtgcccggcctgggcgtgggcgccggcgtgcccggcctgggcgtgggcgccggcgtgcccggcttcggcgccgtgcccggcgccctggccgccgccaaggccgccaagtacggcgccgccgtgcccggcgtgctgggcggcctgggcgccctgggcggcgtgggcatccccggcggcgtggtgggcgccggccccgccgccgccgccgccgccgccaaggccgccgccaaggccgcccagttcggcctggtgggcgccgccggcctgggcggcctgggcgtgggcggcctgggcgtgcccggcgtgggcggcctgggcggcatcccccccgccgccgccgccaaggccgccaagtacggcgccgccggcctgggcggcgtgctgggcggcgccggccagttccccctgggcggcgtggccgccagacccggcttcggcctgagccccatcttccccggcggcgcctgcctgggcaaggcctgcggcagaaagagaaagtag

SEQ ID NO: 1979 - DNA, 645 bp, Homo sapiens
atggccggcctgaccgccgccgcccccagacccggcgtgctgctgctgctgctgagcatcctgcaccccagcagacccggcggcgtgcccggcgccatccccggcggcgtgcccggcggcgtgttctaccccggcgccggcctgggcgccctgggcggcggcgccctgggccccggcggcaagcccctgaagcccgtgcccggcggcctggccggcgccggcctgggcgccggcctgggcgccttccccgccgtgaccttccccggcgccctggtgcccggcggcgtggccgacgccgccgccgcctacaaggccgccaaggccggcgccggcctgggcggcgtgcccggcgtgggcggcctgggcgtgagcgccggcgccgtggtgccccagcccggcgccggcgtgaagcccggcaaggtgcccggcgtgggcctgcccggcgtgtaccccggcggcgtgctgcccggcgtgggccccttcggcggcccccagcccggcgtgcccctgggctaccccatcaaggcccccaagctgcccggcggctacggcctgccctacaccaccggcaagctgccctacggctacggccccggcggcgtggccggcgccgccggcaaggccggctaccccaccggcacctag

SEQ ID NO: 1980 - DNA, 504 bp, Homo sapiens
atggccggcctgaccgccgccgcccccagacccggcgtgctgctgctgctgctgagcatcctgcaccccagcagacccggcggcgtgcccggcgccatccccggcggcgtgcccggcggcgtgttctaccccggcgccggcctgggcgccctgggcggcggcgccctgggccccggcggcaagcccctgaagcccgtgcccggcggcctggccggcgccggcctgggcgccggcctgggcgccttccccgccgtgaccttccccggcgccctggtgcccggcggcgtggccgacgccgccgccgcctacaaggccgccaaggccggcgtgggccccttcggcggcccccagcccggcgtgcccctgggctaccccatcaaggcccccaagctgcccggcggctacggcctgccctacaccaccggcaagctgccctacggctacggccccggcggcgtggccggcgccgccggcaaggccggctaccccaccggcaccggctag

SEQ ID NO: 1981 - DNA, 2079 bp, Homo sapiens
atggccggcctgaccgccgccgcccccagacccggcgtgctgctgctgctgctgagcatcctgcaccccagcagacccggcggcgtgcccggcgccatccccggcggcgtgcccggcggcgtgttctaccccggcgccggcctgggcgccctgggcggcggcgccctgggccccggcggcaagcccctgaagcccgtgcccggcggcctggccggcgccggcctgggcgccggcctgggcgccttccccgccgtgaccttccccggcgccctggtgcccggcggcgtggccgacgccgccgccgcctacaaggccgccaaggccggcgccggcctgggcggcgtgcccggcgtgggcggcctgggcgtgagcgccgcccccagcgtgcccggcgccgtggtgccccagcccggcgccggcgtgaagcccggcaaggtgcccggcgtgggcctgcccggcgtgtaccccggcggcgtgctgcccggcgccagattccccggcgtgggcgtgctgcccggcgtgcccaccggcgccggcgtgaagcccaaggcccccggcgtgggcggcgccttcgccggcatccccggcgtgggccccttcggcggcccccagcccggcgtgcccctgggctaccccatcaaggcccccaagctgcccggcggctacggcctgccctacaccaccggcaagctgccctacggctacggccccggcggcgtggccggcgccgccggcaaggccggctaccccaccggcaccggcgtgggcccccaggccgccgccgccgccgccgccaaggccgccgccaagttcggcgccggcgccgccggcgtgctgcccggcgtgggcggcgccggcgtgcccggcgtgcccggcgccatccccggcatcggcggcatcgccggcgtgggcacccccgccgccgccgccgccgccgccgccgccgccaaggccgccaagtacggcgccgccgccggcctggtgcccggcggccccggcttcggccccggcgtggtgggcgtgcccggcgccggcgtgcccggcgtgggcgtgcccggcgccggcatccccgtggtgcccggcgccggcatccccggcgccgccgtgcccggcgtggtgagccccgaggccgccgccaaggccgccgccaaggccgccaagtacggcgccagacccggcgtgggcgtgggcggcatccccacctacggcgtgggcgccggcggcttccccggcttcggcgtgggcgtgggcggcatccccggcgtggccggcgtgcccggcgtgggcggcgtgcccggcgtgggcggcgtgcccggcgtgggcatcagccccgaggcccaggccgccgccgccgccaaggccgccaagtacggcctggtgcccggcgtgggcgtggcccccggcgtgggcgtggcccccggcgtgggcgtggcccccggcgtgggcctggcccccggcgtgggcgtggcccccggcgtgggcgtggcccccggcgtgggcgtggcccccggcatcggccccggcggcgtggccgccgccgccaagagcgccgccaaggtggccgccaaggcccagctgagagccgccgccggcctgggcgccggcatccccggcctgggcgtgggcgtgggcgtgcccggcctgggcgtgggcgccggcgtgcccggcctgggcgtgggcgccggcgtgcccggcttcggcgccgtgcccggcgccctggccgccgccaaggccgccaagtacggcgccgccgtgcccggcgtgctgggcggcctgggcgccctgggcggcgtgggcatccccggcggcgtggtgggcgccggccccgccgccgccgccgccgccgccaaggccgccgccaaggccgcccagttcggcctggtgggcgccgccggcctgggcggcctgggcgtgggcggcctgggcgtgcccggcgtgggcggcctgggcggcatcccccccgccgccgccgccaaggccgccaagtacggcgtggccgccagacccggcttcggcctgagccccatcttccccggcggcgcctgcctgggcaaggcctgcggcagaaagagaaagtag

SEQ ID NO: 1982 - DNA, 507 bp, Homo sapiens
atggccggcctgaccgccgccgcccccagacccggcgtgctgctgctgctgctgagcatcctgcaccccagcagacccggcggcgtgcccggcgccatccccggcggcgtgcccggcggcgtgttctaccccggcgccggcctgggcgccctgggcggcggcgccctgggccccggcggcaagcccctgaagcccggcgtgggccccttcggcggcccccagcccggcgtgcccctgggctaccccatcaaggcccccaagctgcccggctacggccccggcggcgtggccggcgccgccggcaaggccggctaccccaccggcaccggcgtgggcccccaggccgccgccgccgccgccgccaaggccgccgccaagttcggcgccggcgccgccggcgtgctgcccggcgtgggcggcgccggcgtgcccggcgtgcccggcgccatccccggcatcggcggcatcgccggcgtgggcacccccgccgccgccgccgccgcctag

SEQ ID NO: 1983 - DNA, 885 bp, Homo sapiens
atggccggcctgaccgccgccgcccccagacccggcgtgctgctgctgctgctgagcatcctgcaccccagcagacccggcggcgtgcccggcgccatccccggcggcgtgcccggcggcgtgttctaccccggcgccggcctgggcgccctgggcggcggcgccctgggccccggcggcaagcccctgaagcccggcctgggcgccttccccgccgtgaccttccccggcgccctggtgcccggcggcgtggccgacgccgccgccgcctacaaggccgccaaggccggcgccggcctgggcggcgtgcccggcgtgggcggcctgggcgtgagcgccggcgccgtggtgccccagcccggcgccggcgtgaagcccggcaaggtgcccggcgtgggcctgcccggcgtgtaccccggcggcgtgctgcccggcgccagattccccggcgtgggcgtgctgcccggcgtgcccaccggcgccggcgtgaagcccaaggcccccggcgtgggccccttcggcggcccccagcccggcgtgcccctgggctaccccatcaaggcccccaagctgcccggcggctacggcctgccctacaccaccggcaagctgccctacggctacggccccggcggcgtggccggcgccgccggcaaggccggctaccccaccggcaccggcgtgggcccccaggccgccgccgccgccgccgccaaggccgccgccaagttcggcgccggcgccgccggcgtgctgcccggcgtgggcggcgccggcgtgcccggcgtgcccggcgccatccccggcatcggcggcatcgccggcgtgggcacccccgccgccgccgccgccgccgccgccgccgccaaggccgccaagtactag

SEQ ID NO: 1984 - DNA, 531 bp, Homo sapiens
atggccggcctgaccgccgccgcccccagacccggcgtgctgctgctgctgctgagcatcctgcaccccagcagacccggcggcgtgcccggcgccatccccggcggcgtgcccggcggcgtgttctaccccggcgccggcctgggcgccctgggcggcggcgccctgggccccggcggcaagcccctgaagcccgtgcccggcggcctggccggcgccggcctgggcgccggcctgggcgccttccccgccgtgaccttccccggcgccctggtgcccggcggcgtggccgacgccgccgccgcctacaaggccgccaaggccggcgccggcctgggcggcgtgcccggcgtgggcggcctgggcgtgagcgccggcgccgtggtgccccagcccggcgccggcgtgaagcccggcaaggtgcccggcgtgggcggcgccttcgccggcatccccggcgtgggccccttcggcggcccccagcccggcgtgcccctgggctaccccatcaaggcccccaagctgccctag

SEQ ID NO: 1985 - DNA, 1992 bp, Homo sapiens
atggccggcctgaccgccgccgcccccagacccggcgtgctgctgctgctgctgagcatcctgcaccccagcagacccggcggcgtgcccggcgccatccccggcggcgtgcccggcggcgtgttctaccccggcgccggcctgggcgccctgggcggcggcgccctgggccccggcggcaagcccctgaagcccgtgcccggcggcctggccggcgccggcctgggcgccggcgccggcctgggcggcgtgcccggcgtgggcggcctgggcgtgagcgccggcgccgtggtgccccagcccggcgccggcgtgaagcccggcaaggtgcccggcgtgggcctgcccggcgtgtaccccggcggcgtgctgcccggcgccagattccccggcgtgggcgtgctgcccggcgtgcccaccggcgccggcgtgaagcccaaggcccccggcgtgggcggcgccttcgccggcatccccggcgtgggccccttcggcggcccccagcccggcgtgcccctgggctaccccatcaaggcccccaagctgcccggcggctacggcctgccctacaccaccggcaagctgccctacggctacggccccggcggcgtggccggcgccgccggcaaggccggctaccccaccggcaccggcgtgggcccccaggccgccgccgccgccgccgccaaggccgccgccaagttcggcgccggcgccgccggcgtgctgcccggcgtgggcggcgccggcgtgcccggcgtgcccggcgccatccccggcatcggcggcatcgccggcgtgggcacccccgccgccgccgccgccgccgccgccgccgccaaggccgccaagtacggcgccgccgccggcctggtgcccggcggccccggcttcggccccggcgtggtgggcgtgcccggcgccggcgtgcccggcgtgggcgtgcccggcgccggcatccccgtggtgcccggcgccggcatccccggcgccgccgtgcccggcgtggtgagccccgaggccgccgccaaggccgccgccaaggccgccaagtacggcgccagacccggcgtgggcgtgggcggcatccccacctacggcgtgggcgccggcggcttccccggcttcggcgtgggcgtgggcggcatccccggcgtggccggcgtgcccggcgtgggcggcgtgcccggcgtgggcggcgtgcccggcgtgggcatcagccccgaggcccaggccgccgccgccgccaaggccgccaagtacggcgtgggcacccccgccgccgccgccgccaaggccgccgccaaggccgcccagttcggcctggtgcccggcgtgggcgtggcccccggcgtgggcgtggcccccggcatcggccccggcggcgtggccgccgccgccaagagcgccgccaaggtggccgccaaggcccagctgagagccgccgccggcctgggcgccggcatccccggcctgggcgtgggcgtgggcgtgcccggcctgggcgtgggcgccggcgtgcccggcctgggcgtgggcgccggcgtgcccggcttcggcgccgtgcccggcgccctggccgccgccaaggccgccaagtacggcgccgccgtgcccggcgtgctgggcggcctgggcgccctgggcggcgtgggcatccccggcggcgtggtgggcgccggccccgccgccgccgccgccgccgccaaggccgccgccaaggccgcccagttcggcctggtgggcgccgccggcctgggcggcctgggcgtgggcggcctgggcgtgcccggcgtgggcggcctgggcggcatcccccccgccgccgccgccaaggccgccaagtacggcgccgccggcctgggcggcgtgctgggcggcgccggccagttccccctgggcggcgtggccgccagacccggcttcggcctgagccccatcttccccggcggcgcctgcctgggcaaggcctgcggcagaaagagaaagtag

SEQ ID NO: 1986 - DNA, 2121 bp, Homo sapiens
atggccggcctgaccgccgccgcccccagacccggcgtgctgctgctgctgctgagcatcctgcaccccagcagacccggcggcgtgcccggcgccatccccggcggcgtgcccggcggcgtgttctaccccggcgccggcctgggcgccctgggcggcggcgccctgggccccggcggcaagcccctgaagcccgtgcccggcggcctggccggcgccggcctgggcgccggcctgggcgccttccccgccgtgaccttccccggcgccctggtgcccggcggcgtggccgacgccgccgccgcctacaaggccgccaaggccggcgccggcctgggcggcgtgcccggcgtgggcggcctgggcgtgagcgccggcgccgtggtgccccagcccggcgccggcgtgaagcccggcaaggtgcccggcgtgggcctgcccggcgtgtaccccggcggcgtgctgcccggcgccagattccccggcgtgggcgtgctgcccggcgtgcccaccggcgccggcgtgaagcccaaggcccccggcgtgggcggcgccttcgccggcatccccggcgtgggccccttcggcggcccccagcccggcgtgcccctgggctaccccatcaaggcccccaagctgcccggcggctacggcctgccctacaccaccggcaagctgccctacggctacggccccggcggcgtggccggcgccgccggcaaggccggctaccccaccggcaccggcgtgggcccccaggccgccgccgccgccgccgccaaggccgccgccaagttcggcgccggcgccgccggcgtgctgcccggcgtgggcggcgccggcgtgcccggcgtgcccggcgccatccccggcatcggcggcatcgccggcgtgggcacccccgccgccgccgccgccgccgccgccgccgccaaggccgccaagtacggcgccgccgccggcctggtgcccggcggccccggcttcggccccggcgtggtgggcgtgcccggcgccggcgtgcccggcgtgggcgtgcccggcgccggcatccccgtggtgcccggcgccggcatccccggcgccgccgtgcccggcgtggtgagccccgaggccgccgccaaggccgccgccaaggccgccaagtacggcgccagacccggcgtgggcgtgggcggcatccccacctacggcgtgggcgccggcggcttccccggcttcggcgtgggcgtgggcggcatccccggcgtggccggcgtgcccggcgtgggcggcgtgcccggcgtgggcggcgtgcccggcgtgggcatcagccccgaggcccaggccgccgccgccgccaaggccgccaagtacggcgtgggcacccccgccgccgccgccgccaaggccgccgccaaggccgcccagttcggcctggtgcccggcgtgggcgtggcccccggcgtgggcgtggcccccggcgtgggcgtggcccccggcgtgggcctggcccccggcgtgggcgtggcccccggcgtgggcgtggcccccggcgtgggcgtggcccccggcatcggccccggcggcgtggccgccgccgccaagagcgccgccaaggtggccgccaaggcccagctgagagccgccgccggcctgggcgccggcatccccggcctgggcgtgggcgtgggcgtgcccggcctgggcgtgggcgccggcgtgcccggcctgggcgtgggcgccggcgtgcccggcttcggcgccgtgcccggcgccctggccgccgccaaggccgccaagtacggcgccgccgtgcccggcgtgctgggcggcctgggcgccctgggcggcgtgggcatccccggcggcgtggtgggcgccggccccgccgccgccgccgccgccgccaaggccgccgccaaggccgcccagttcggcctggtgggcgccgccggcctgggcggcctgggcgtgggcggcctgggcgtgcccggcgtgggcggcctgggcggcatcccccccgccgccgccgccaaggccgccaagtacggcgtggccgccagacccggcttcggcctgagccccatcttccccggcggcgcctgcctgggcaaggcctgcggcagaaagagaaagtag

SEQ ID NO: 1987 - DNA, 2145 bp, Homo sapiens
atggccggcctgaccgccgccgcccccagacccggcgtgctgctgctgctgctgagcatcctgcaccccagcagacccggcggcgtgcccggcgccatccccggcggcgtgcccggcggcgtgttctaccccgccctgggccccggcggcaagcccctgaagcccgtgcccggcggcctggccggcgccggcctgggcgccggcctgggcgccttccccgccgtgaccttccccggcgccctggtgcccggcggcgtggccgacgccgccgccgcctacaaggccgccaaggccggcgccggcctgggcggcgtgcccggcgtgggcggcctgggcgtgagcgccggcgccgtggtgccccagcccggcgccggcgtgaagcccggcaaggtgcccggcgtgggcctgcccggcgtgtaccccggcggcgtgctgcccggcgccagattccccggcgtgggcgtgctgcccggcgtgcccaccggcgccggcgtgaagcccaaggcccccggcgtgggcggcgccttcgccggcatccccggcgtgggccccttcggcggcccccagcccggcgtgcccctgggctaccccatcaaggcccccaagctgcccggcggctacggcctgccctacaccaccggcaagctgccctacggctacggccccggcggcgtggccggcgccgccggcaaggccggctaccccaccggcaccggcgtgggcccccaggccgccgccgccgccgccgccaaggccgccgccaagttcggcgccggcgccgccggcgtgctgcccggcgtgggcggcgccggcgtgcccggcgtgcccggcgccatccccggcatcggcggcatcgccggcgtgggcacccccgccgccgccgccgccgccgccgccgccgccaaggccgccaagtacggcgccgccgccggcctggtgcccggcggccccggcttcggccccggcgtggtgggcgtgcccggcgccggcgtgcccggcgtgggcgtgcccggcgccggcatccccgtggtgcccggcgccggcatccccggcgccgccgtgcccggcgtggtgagccccgaggccgccgccaaggccgccgccaaggccgccaagtacggcgccagacccggcgtgggcgtgggcggcatccccacctacggcgtgggcgccggcggcttccccggcttcggcgtgggcgtgggcggcatccccggcgtggccggcgtgcccggcgtgggcggcgtgcccggcgtgggcggcgtgcccggcgtgggcatcagccccgaggcccaggccgccgccgccgccaaggccgccaagtacggcgtgggcacccccgccgccgccgccgccaaggccgccgccaaggccgcccagttcggcctggtgcccggcgtgggcgtggcccccggcgtgggcgtggcccccggcgtgggcgtggcccccggcgtgggcctggcccccggcgtgggcgtggcccccggcgtgggcgtggcccccggcgtgggcgtggcccccggcatcggccccggcggcgtggccgccgccgccaagagcgccgccaaggtggccgccaaggcccagctgagagccgccgccggcctgggcgccggcatccccggcctgggcgtgggcgtgggcgtgcccggcctgggcgtgggcgccggcgtgcccggcctgggcgtgggcgccggcgtgcccggcttcggcgccgtgcccggcgccctggccgccgccaaggccgccaagtacggcgccgccgtgcccggcgtgctgggcggcctgggcgccctgggcggcgtgggcatccccggcggcgtggtgggcgccggccccgccgccgccgccgccgccgccaaggccgccgccaaggccgcccagttcggcctggtgggcgccgccggcctgggcggcctgggcgtgggcggcctgggcgtgcccggcgtgggcggcctgggcggcatcccccccgccgccgccgccaaggccgccaagtacggcgccgccggcctgggcggcgtgctgggcggcgccggccagttccccctgggcggcgtggccgccagacccggcttcggcctgagccccatcttccccggcggcgcctgcctgggcaaggcctgcggcagaaagagaaagtag

SEQ ID NO: 1988 - DNA, 678 bp, Homo sapiens
atggccgccctggccagcagcctgatcagacagaagagagaggtgagagagcccggcggcagcagacccgtgagcgcccagagaagagtgtgccccagaggcaccaagagcctgtgccagaagcagctgctgatcctgctgagcaaggtgagactgtgcggcggcagacccgccagacccgacagaggccccgagccccagctgaagggcatcgtgaccaagctgttctgcagacagggcttctacctgcaggccaaccccgacggcagcatccagggcacccccgaggacaccagcagcttcacccacttcaacctgatccccgtgggcctgagagtggtgaccatccagagcgccaagctgggccactacatggccatgaacgccgagggcctgctgtacagcagcccccacttcaccgccgagtgcagattcaaggagtgcgtgttcgagaactactacgtgctgtacgccagcgccctgtacagacagagaagaagcggcagagcctggtacctgggcctggacaaggagggccaggtgatgaagggcaacagagtgaagaagaccaaggccgccgcccacttcctgcccaagctgctggaggtggccatgtaccaggagcccagcctgcacagcgtgcccgaggccagccccagcagcccccccgccccctag

SEQ ID NO: 1989 - DNA, 546 bp, Homo sapiens
atggagagcaaggagccccagctgaagggcatcgtgaccagactgttcagccagcagggctacttcctgcagatgcaccccgacggcaccatcgacggcaccaaggacgagaacagcgactacaccctgttcaacctgatccccgtgggcctgagagtggtggccatccagggcgtgaaggccagcctgtacgtggccatgaacggcgagggctacctgtacagcagcgacgtgttcacccccgagtgcaagttcaaggagagcgtgttcgagaactactacgtgatctacagcagcaccctgtacagacagcaggagagcggcagagcctggttcctgggcctgaacaaggagggccagatcatgaagggcaacagagtgaagaagaccaagcccagcagccacttcgtgcccaagcccatcgaggtgtgcatgtacagagagcccagcctgcacgagatcggcgagaagcagggcagaagcagaaagagcagcggcacccccaccatgaacggcggcaaggtggtgaaccaggacagcacctag

SEQ ID NO: 1990 - DNA, 546 bp, Homo sapiens
atggagaagaccgagccccagctgaagggcatcgtgaccagactgttcagccagcagggctacttcctgcagatgcaccccgacggcaccatcgacggcaccaaggacgagaacagcgactacaccctgttcaacctgatccccgtgggcctgagagtggtggccatccagggcgtgaaggccagcctgtacgtggccatgaacggcgagggctacctgtacagcagcgacgtgttcacccccgagtgcaagttcaaggagagcgtgttcgagaactactacgtgatctacagcagcaccctgtacagacagcaggagagcggcagagcctggttcctgggcctgaacaaggagggccagatcatgaagggcaacagagtgaagaagaccaagcccagcagccacttcgtgcccaagcccatcgaggtgtgcatgtacagagagcccagcctgcacgagatcggcgagaagcagggcagaagcagaaagagcagcggcacccccaccatgaacggcggcaaggtggtgaaccaggacagcacctag

SEQ ID NO: 1991 - DNA, 324 bp, Homo sapiens
atggagagcaaggagccccagctgaagggcatcgtgaccagactgttcagccagcagggctacttcctgcagatgcaccccgacggcaccatcgacggcaccaaggacgagaacagcgactacaccctgttcaacctgatccccgtgggcctgagagtggtggccatccagggcgtgaaggccagcctgtacgtggccatgaacggcgagggctacctgtacagcagcgacgtgttcacccccgagtgcaagttcaaggagagcgtgttcgagaactactacgtgatctacagcagcaccctgtacagacagcaggagagctag

SEQ ID NO: 1992 - DNA, 546 bp, Homo sapiens; identical to SEQ ID NO: 1989

SEQ ID NO: 1993 - DNA, 546 bp, Artificial Sequence; identical to SEQ ID NO: 1989
  Description of Artificial Sequence: Synthetic coding sequence

SEQ ID NO: 1994 - DNA, 732 bp, Artificial Sequence
  Description of Artificial Sequence: Synthetic coding sequence
atggccgccgccatcgccagcagcctgatcagacagaagagacaggccagagagagcaacagcgacagagtgagcgccagcaagagaagaagcagccccagcaaggacggcagaagcctgtgcgagagacacgtgctgggcgtgttcagcaaggtgagattctgcagcggcagaaagagacccgtgagaagaagacccgagccccagctgaagggcatcgtgaccagactgttcagccagcagggctacttcctgcagatgcaccccgacggcaccatcgacggcaccaaggacgagaacagcgactacaccctgttcaacctgatccccgtgggcctgagagtggtggccatccagggcgtgaaggccagcctgtacgtggccatgaacggcgagggctacctgtacagcagcgacgtgttcacccccgagtgcaagttcaaggagagcgtgttcgagaactactacgtgatctacagcagcaccctgtacagacagcaggagagcggcagagcctggttcctgggcctgaacaaggagggccagatcatgaagggcaacagagtgaagaagaccaagcccagcagccacttcgtgcccaagcccatcgaggtgtgcatgtacagagagcccagcctgcacgagatcggcgagaagcagggcagaagcagaaagagcagcggcacccccaccatgaacggcggcaaggtggtgaaccaggacagcacctag

SEQ ID NO: 1995 - DNA, 579 bp, Artificial Sequence
  Description of Artificial Sequence: Synthetic coding sequence
atggccctgctgagaaagagctacagcgagccccagctgaagggcatcgtgaccaagctgtacagcagacagggctaccacctgcagctgcaggccgacggcaccatcgacggcaccaaggacgaggacagcacctacaccctgttcaacctgatccccgtgggcctgagagtggtggccatccagggcgtgcagaccaagctgtacctggccatgaacagcgagggctacctgtacaccagcgagctgttcacccccgagtgcaagttcaaggagagcgtgttcgagaactactacgtgacctacagcagcatgatctacagacagcagcagagcggcagaggctggtacctgggcctgaacaaggagggcgagatcatgaagggcaaccacgtgaagaagaacaagcccgccgcccacttcctgcccaagcccctgaaggtggccatgtacaaggagcccagcctgcacgacctgaccgagttcagcagaagcggcagcggcacccccaccaagagcagaagcgtgagcggcgtgctgaacggcggcaagagcatgagccacaacgagagcacctag

SEQ ID NO: 1996 - DNA, 738 bp, Artificial Sequence
  Description of Artificial Sequence: Synthetic coding sequence
atggccgccgccatcgccagcagcctgatcagacagaagagacaggccagagagagagagaagagcaacgcctgcaagtgcgtgagcagccccagcaagggcaagaccagctgcgacaagaacaagctgaacgtgttcagcagagtgaagctgttcggcagcaagaagagaagaagaagaagacccgagccccagctgaagggcatcgtgaccaagctgtacagcagacagggctaccacctgcagctgcaggccgacggcaccatcgacggcaccaaggacgaggacagcacctacaccctgttcaacctgatccccgtgggcctgagagtggtggccatccagggcgtgcagaccaagctgtacctggccatgaacagcgagggctacctgtacaccagcgagctgttcacccccgagtgcaagttcaaggagagcgtgttcgagaactactacgtgacctacagcagcatgatctacagacagcagcagagcggcagaggctggtacctgggcctgaacaaggagggcgagatcatgaagggcaaccacgtgaagaagaacaagcccgccgcccacttcctgcccaagcccctgaaggtggccatgtacaaggagcccagcctgcacgacctgaccgagttcagcagaagcggcagcggcacccccaccaagagcagaagcgtgagcggcgtgctgaacggcggcaagagcatgagccacaacgagagcacctag

SEQ ID NO: 1997 - DNA, 768 bp, Artificial Sequence
  Description of Artificial Sequence: Synthetic coding sequence
atgagcggcaaggtgaccaagcccaaggaggagaaggacgccagcaaggtgctggacgacgccccccccggcacccaggagtacatcatgctgagacaggacagcatccagagcgccgagctgaagaagaaggagagccccttcagagccaagtgccacgagatcttctgctgccccctgaagcaggtgcaccacaaggagaacaccgagcccgaggagccccagctgaagggcatcgtgaccaagctgtacagcagacagggctaccacctgcagctgcaggccgacggcaccatcgacggcaccaaggacgaggacagcacctacaccctgttcaacctgatccccgtgggcctgagagtggtggccatccagggcgtgcagaccaagctgtacctggccatgaacagcgagggctacctgtacaccagcgagctgttcacccccgagtgcaagttcaaggagagcgtgttcgagaactactacgtgacctacagcagcatgatctacagacagcagcagagcggcagaggctggtacctgggcctgaacaaggagggcgagatcatgaagggcaaccacgtgaagaagaacaagcccgccgcccacttcctgcccaagcccctgaaggtggccatgtacaaggagcccagcctgcacgacctgaccgagttcagcagaagcggcagcggcacccccaccaagagcagaagcgtgagcggcgtgctgaacggcggcaagagcatgagccacaacgagagcacctag

SEQ ID NO: 1998 - DNA, 132 bp, Artificial Sequence
  Description of Artificial Sequence: Synthetic coding sequence
atgctgagacaggacagcatccagagcgccgagctgaagaagaaggagagccccttcagagccaagtgccacgagatcttctgctgccccctgaagcaggtgcaccacaaggagaacaccgagcccgagtag

SEQ ID NO: 1999 - DNA, 666 bp, Artificial Sequence
  Description of Artificial Sequence: Synthetic coding sequence
atgagcggcaaggtgaccaagcccaaggaggagaaggacgccagcaaggtgctggacgacgccccccccggcacccaggagtacatcatgctgagacaggacagcatccagagcgccgagctgaagaagaaggagagccccttcagagccaagtgccacgagatcttctgctgccccctgaagcaggtgcaccacaaggagaacaccgagcccgaggagccccagctgaagggcatcgtgaccaagctgtacagcagacagggctaccacctgcagctgcaggccgacggcaccatcgacggcaccaaggacgaggacagcacctacaccctgttcaacctgatccccgtgggcctgagagtggtggccatccagggcgtgcagaccaagctgtacctggccatgaacagcgagggctacctgtacaccagcgagctgttcacccccgagtgcaagttcaaggagagcgtgttcgagaactactacgtgacctacagcagcatgatctacagacagcagcagagcggcagaggctggtacctgggcctgaacaaggagggcgagatcatgaagggcaaccacgtgaagaagaacaagcccgccgcccacttcctgcccaagcccctgaaggtggccatgtacaaggagcccagcctgcacgactag

SEQ ID NO: 2000 - DNA, 681 bp, Artificial Sequence
  Description of Artificial Sequence: Synthetic coding sequence
atgctgagacaggacagcatccagagcgccgagctgaagaagaaggagagccccttcagagccaagtgccacgagatcttctgctgccccctgaagcaggtgcaccacaaggagaacaccgagcccgaggagccccagctgaagggcatcgtgaccaagctgtacagcagacagggctaccacctgcagctgcaggccgacggcaccatcgacggcaccaaggacgaggacagcacctacaccctgttcaacctgatccccgtgggcctgagagtggtggccatccagggcgtgcagaccaagctgtacctggccatgaacagcgagggctacctgtacaccagcgagctgttcacccccgagtgcaagttcaaggagagcgtgttcgagaactactacgtgacctacagcagcatgatctacagacagcagcagagcggcagaggctggtacctgggcctgaacaaggagggcgagatcatgaagggcaaccacgtgaagaagaacaagcccgccgcccacttcctgcccaagcccctgaaggtggccatgtacaaggagcccagcctgcacgacctgaccgagttcagcagaagcggcagcggcacccccaccaagagcagaagcgtgagcggcgtgctgaacggcggcaagagcatgagccacaacgagagcacctag

SEQ ID NO: 2001 - DNA, 297 bp, Artificial Sequence
  Description of Artificial Sequence: Synthetic coding sequence
atgagcggcaaggtgaccaagcccaaggaggagaaggacgccagcaaggtgctggacgacgccccccccggcacccaggagtacatcatgctgagacaggacagcatccagagcgccgagctgaagaagaaggagagccccttcagagccaagtgccacgagatcttctgctgccccctgaagcaggtgcaccacaaggagaacaccgagcccgaggagccccagctgaagggcatcgtgaccaagctgtacagcagacagggctaccacctgcagctgcaggccgacggcacctag

SEQ ID NO: 2002 - DNA, 624 bp, Artificial Sequence
  Description of Artificial Sequence: Synthetic coding sequence
atgagaaccagcatgaagaaggtgggcatgcaccacctgagcagcagcggcggcagctactacctgatcctggacgacgccccccccggcacccaggagtacatcatgctgagacaggacagcatccagagcgccgagctgaagaagaaggagagccccttcagagccaagtgccacgagatcttctgctgccccctgaagcaggtgcaccacaaggagaacaccgagcccgaggagccccagctgaagggcatcgtgaccaagctgtacagcagacagggctaccacctgcagctgcaggccgacggcaccatcgacggcaccaaggacgaggacagcacctacaccctgttcaacctgatccccgtgggcctgagagtggtggccatccagggcgtgcagaccaagctgtacctggccatgaacagcgagggctacctgtacaccagcgagctgttcacccccgagtgcaagttcaaggagagcgtgttcgagaactactacgtgacctacagcagcatgatctacagacagcagcagagcggcagaggctggtacctgggcctgaacaaggagggcgagatcatgaagggcaaccacgtgaagaagaacaagcccgcctag

SEQ ID NO: 2003 - DNA, 600 bp, Artificial Sequence
  Description of Artificial Sequence: Synthetic coding sequence
atgagcggcaaggtgaccaagcccaaggaggagaaggacgccagcaaggagccccagctgaagggcatcgtgaccaagctgtacagcagacagggctaccacctgcagctgcaggccgacggcaccatcgacggcaccaaggacgaggacagcacctacaccctgttcaacctgatccccgtgggcctgagagtggtggccatccagggcgtgcagaccaagctgtacctggccatgaacagcgagggctacctgtacaccagcgagctgttcacccccgagtgcaagttcaaggagagcgtgttcgagaactactacgtgacctacagcagcatgatctacagacagcagcagagcggcagaggctggtacctgggcctgaacaaggagggcgagatcatgaagggcaaccacgtgaagaagaacaagcccgccgcccacttcctgcccaagcccctgaaggtggccatgtacaaggagcccagcctgcacgacctgaccgagttcagcagaagcggcagcggcacccccaccaagagcagaagcgtgagcggcgtgctgaacggcggcaagagcatgagccacaacgagagcacctag

SEQ ID NO: 2004 - DNA, 759 bp, Artificial Sequence
  Description of Artificial Sequence: Synthetic coding sequence
atggtgaagcccgtgcccctgttcagaagaaccgacttcaagctgctgctgtgcaaccacaaggacctgttcttcctgagagtgagcaagctgctggactgcttcagccccaagagcatgtggttcctgtggaacatcttcagcaagggcacccacatgctgcagtgcctgtgcggcaagagcctgaagaagaacaagaaccccaccgacccccagctgaagggcatcgtgaccagactgtactgcagacagggctactacctgcagatgcaccccgacggcgccctggacggcaccaaggacgacagcaccaacagcaccctgttcaacctgatccccgtgggcctgagagtggtggccatccagggcgtgaagaccggcctgtacatcgccatgaacggcgagggctacctgtaccccagcgagctgttcacccccgagtgcaagttcaaggagagcgtgttcgagaactactacgtgatctacagcagcatgctgtacagacagcaggagagcggcagagcctggttcctgggcctgaacaaggagggccaggccatgaagggcaacagagtgaagaagaccaagcccgccgcccacttcctgcccaagcccctggaggtggccatgtacagagagcccagcctgcacgacgtgggcgagaccgtgcccaagcccggcgtgacccccagcaagagcaccagcgccagcgccatcatgaacggcggcaagcccgtgaacaagagcaagaccacctag

SEQ ID NO: 2005 - DNA, 744 bp, Artificial Sequence
  Description of Artificial Sequence: Synthetic coding sequence
atggccgccgccatcgccagcggcctgatcagacagaagagacaggccagagagcagcactgggacagacccagcgccagcagaagaagaagcagccccagcaagaacagaggcctgtgcaacggcaacctggtggacatcttcagcaaggtgagaatcttcggcctgaagaagagaagactgagaagacaggacccccagctgaagggcatcgtgaccagactgtactgcagacagggctactacctgcagatgcaccccgacggcgccctggacggcaccaaggacgacagcaccaacagcaccctgttcaacctgatccccgtgggcctgagagtggtggccatccagggcgtgaagaccggcctgtacatcgccatgaacggcgagggctacctgtaccccagcgagctgttcacccccgagtgcaagttcaaggagagcgtgttcgagaactactacgtgatctacagcagcatgctgtacagacagcaggagagcggcagagcctggttcctgggcctgaacaaggagggccaggccatgaagggcaacagagtgaagaagaccaagcccgccgcccacttcctgcccaagcccctggaggtggccatgtacagagagcccagcctgcacgacgtgggcgagaccgtgcccaagcccggcgtgacccccagcaagagcaccagcgccagcgccatcatgaacggcggcaagcccgtgaacaagagcaagaccacctag

SEQ ID NO: 2006 - DNA, 351 bp, Artificial Sequence
  Description of Artificial Sequence: Synthetic coding sequence
tgaatcctggagttcatcagcctggccgtgggcctgatcagcatcagaggcgtggacagcggcctgtacctgggcatgaacgagagaggcgagctgtacggcagcaagaagctgaccagagagtgcgtgttcagagagcagttcgaggagaactggtacaacacctacgccagcaccctgtacaagcacagcgacagcgagagacagtactacgtggccctgaacaaggacggcagccccagagagggctacagaaccaagagacaccagaagttcacccacttcctgcccagacccgtggaccccagcaagctgcccagcatgagcagagacctgttccactacagatag

SEQ ID NO: 2007 - DNA, 651 bp, Artificial Sequence
  Description of Artificial Sequence: Synthetic coding sequence
atgggcgccgccagactgctgcccaacctgaccctgtgcctgcagctgctgatcctgtgctgccagacccagggcgagaaccaccccagccccaacttcaaccagtacgtgagagaccagggcgccatgaccgaccagctgagcagaagacagatcagagagtaccagctgtacagcagaaccagcggcaagcacgtgcaggtgaccggcagaagaatcagcgccaccgccgaggacggcaacaagttcgccaagctgatcgtggagaccgacaccttcggcagcagagtgagaatcaagggcgccgagagcgagaagtacatctgcatgaacaagagaggcaagctgatcggcaagcccagcggcaagagcaaggactgcgtgttcaccgagatcgtgctggagaacaactacaccgccttccagaacgccagacacgagggctggttcatggccttcaccagacagggcagacccagacaggccagcagaagcagacagaaccagagagaggcccacttcatcaagagactgtaccagggccagctgcccttccccaaccacgccgagaagcagaagcagttcgagttcgtgggcagcgcccccaccagaagaaccaagagaaccagaagaccccagcccctgacctag

SEQ ID NO: 2008 - DNA, 618 bp, Artificial Sequence
  Description of Artificial Sequence: Synthetic coding sequence
atgggcgccgccagactgctgcccaacctgaccctgtgcctgcagctgctgatcctgtgctgccagacccagtacgtgagagaccagggcgccatgaccgaccagctgagcagaagacagatcagagagtaccagctgtacagcagaaccagcggcaagcacgtgcaggtgaccggcagaagaatcagcgccaccgccgaggacggcaacaagttcgccaagctgatcgtggagaccgacaccttcggcagcagagtgagaatcaagggcgccgagagcgagaagtacatctgcatgaacaagagaggcaagctgatcggcaagcccagcggcaagagcaaggactgcgtgttcaccgagatcgtgctggagaacaactacaccgccttccagaacgccagacacgagggctggttcatggccttcaccagacagggcagacccagacaggccagcagaagcagacagaaccagagagaggcccacttcatcaagagactgtaccagggccagctgcccttccccaaccacgccgagaagcagaagcagttcgagttcgtgggcagcgcccccaccagaagaaccaagagaaccagaagaccccagcccctgacctag

SEQ ID NO: 2009 - DNA, 624 bp, Artificial Sequence
  Description of Artificial Sequence: Synthetic coding sequence
atgtacagcgcccccagcgcctgcacctgcctgtgcctgcacttcctgctgctgtgcttccaggtgcaggtgctggtggccgaggagaacgtggacttcagaatccacgtggagaaccagaccagagccagagacgacgtgagcagaaagcagctgagactgtaccagctgtacagcagaaccagcggcaagcacatccaggtgctgggcagaagaatcagcgccagaggcgaggacggcgacaagtacgcccagctgctggtggagaccgacaccttcggcagccaggtgagaatcaagggcaaggagaccgagttctacctgtgcatgaacagaaagggcaagctggtgggcaagcccgacggcaccagcaaggagtgcgtgttcatcgagaaggtgctggagaacaactacaccgccctgatgagcgccaagtacagcggctggtacgtgggcttcaccaagaagggcagacccagaaagggccccaagaccagagagaaccagcaggacgtgcacttcatgaagagataccccaagggccagcccgagctgcagaagcccttcaagtacaccaccgtgaccaagagaagcagaagaatcagacccacccaccccgcctag

SEQ ID NO: 2010 - DNA, 651 bp, Artificial Sequence
  Description of Artificial Sequence: Synthetic coding sequence
atgagaagcggctgcgtggtggtgcacgtgtggatcctggccggcctgtggctggccgtggccggcagacccctggccttcagcgacgccggcccccacgtgcactacggctggggcgaccccatcagactgagacacctgtacaccagcggcccccacggcctgagcagctgcttcctgagaatcagagccgacggcgtggtggactgcgccagaggccagagcgcccacagcctgctggagatcaaggccgtggccctgagaaccgtggccatcaagggcgtgcacagcgtgagatacctgtgcatgggcgccgacggcaagatgcagggcctgctgcagtacagcgaggaggactgcgccttcgaggaggagatcagacccgacggctacaacgtgtacagaagcgagaagcacagactgcccgtgagcctgagcagcgccaagcagagacagctgtacaagaacagaggcttcctgcccctgagccacttcctgcccatgctgcccatggtgcccgaggagcccgaggacctgagaggccacctggagagcgacatgttcagcagccccctggagaccgacagcatggaccccttcggcctggtgaccggcctggaggccgtgagaagccccagcttcgagaagtag

SEQ ID NO: 2011 - DNA, 636 bp, Artificial Sequence
  Description of Artificial Sequence: Synthetic coding sequence
atggcccccctggccgaggtgggcggcttcctgggcggcctggagggcctgggccagcaggtgggcagccacttcctgctgccccccgccggcgagagaccccccctgctgggcgagagaagaagcgccgccgagagaagcgccagaggcggccccggcgccgcccagctggcccacctgcacggcatcctgagaagaagacagctgtactgcagaaccggcttccacctgcagatcctgcccgacggcagcgtgcagggcaccagacaggaccacagcctgttcggcatcctggagttcatcagcgtggccgtgggcctggtgagcatcagaggcgtggacagcggcctgtacctgggcatgaacgacaagggcgagctgtacggcagcgagaagctgaccagcgagtgcatcttcagagagcagttcgaggagaactggtacaacacctacagcagcaacatctacaagcacggcgacaccggcagaagatacttcgtggccctgaacaaggacggcacccccagagacggcgccagaagcaagagacaccagaagttcacccacttcctgcccagacccgtggaccccgagagagtgcccgagctgtacaaggacctgctgatgtacacctag

SEQ ID NO: 2012 - DNA, 237 bp, Artificial Sequence
  Description of Artificial Sequence: Synthetic coding sequence
atggcccccctggccgaggtgggcggcttcctgggcggcctggagggcctgggccagcaggtgggcagccacttcctgctgccccccgccggcgagagaccccccgccgccctgctgccccacagactgccccccgccgaccccgccagaagacagagagccggccaccccgccggcccccagcccctgagatacctgggcatccaccagtgcggcagcggcaccggccagtactag

SEQ ID NO: 2013 - DNA, 390 bp, Artificial Sequence
  Description of Artificial Sequence: Synthetic coding sequence
atgggcgaccccgtggtgaccgagacccccaccctgctgggcctgcccgagcagagaagagccgccgtgagacacgtgaacaagggcgccggcatcctggagatcagaagcgtgcacgtgggcgtggtggtgatcaaggccgtgagcagcggcttctacgtggccatgaacagaagaggcagactgtacggcagcagactgtacaccgtggactgcagattcagagagagaatcgaggagaacggccacaacacctacgccagccagagatggagaagaagaggccagcccatgttcctggccctggacagaagaggcggccccagacccggcggcagaaccagaagataccacctgagcgcccacttcctgcccgtgctggtgagctag

SEQ ID NO: 2014 - DNA, 579 bp, Artificial Sequence
  Description of Artificial Sequence: Synthetic coding sequence
atgggcacctggatcctgttcgcctgcctggtgggcgccgccttcgccatgcccctgcccccccaccccggccaccccggctacatcaacttcagctacgaggtgctgacccccctgaagtggtaccagagcatgatcagacccccctacagcagctacggctacgagcccatgggcggctggctgcaccaccagatcatccccgtggtgagccagcagcaccccctgacccacaccctgcagagccaccaccacatccccgtggtgcccgcccagcagcccagagtgagacagcaggccctgatgcccgtgcccggccagcagagcatgacccccacccagcaccaccagcccaacctgcccctgcccgcccagcagcccttccagccccagcccgtgcagccccagccccaccagcccatgcagccccagccccccgtgcagcccatgcagcccctgctgccccagccccccctgccccccatgttccccctgagacccctgccccccatcctgcccgacctgcacctggaggcctggcccgccaccgacaagaccaagcaggaggaggtggactag

SEQ ID NO: 2015 - DNA, 756 bp, Artificial Sequence
  Description of Artificial Sequence: Synthetic coding sequence
atgctgggcgccagactgagactgtgggtgtgcgccctgtgcagcgtgtgcagcatgagcgtgctgagagcctaccccaacgccagccccctgctgggcagcagctggggcggcctgatccacctgtacaccgccaccgccagaaacagctaccacctgcagatccacaagaacggccacgtggacggcgccccccaccagaccatctacagcgccctgatgatcagaagcgaggacgccggcttcgtggtgatcaccggcgtgatgagcagaagatacctgtgcatggacttcagaggcaacatcttcggcagccactacttcgaccccgagaactgcagattccagcaccagaccctggagaacggctacgacgtgtaccacagcccccagtaccacttcctggtgagcctgggcagagccaagagagccttcctgcccggcatgaacccccccccctacagccagttcctgagcagaagaaacgagatccccctgatccacttcaacacccccatccccagaagacacaccagaagcgccgaggacgacagcgagagagaccccctgaacgtgctgaagcccagagccagaatgacccccgcccccgccagctgcagccaggagctgcccagcgccgaggacaacagccccatggccagcgaccccctgggcgtggtgagaggcggcagagtgaacacccacgccggcggcaccggccccgagggctgcagacccttcgccaagttcatctag

SEQ ID NO: 2016 - DNA, 720 bp, Artificial Sequence
  Description of Artificial Sequence: Synthetic coding sequence
atgggcctgatctggctgctgctgctgagcctgctggagcccggctggcccgccgccggccccggcgccagactgagaagagacgccggcggcagaggcggcgtgtacgagcacctgggcggcgcccccagaagaagaaagctgtactgcgccaccaagtaccacctgcagctgcaccccagcggcagagtgaacggcagcctggagaacagcgcctacagcatcctggagatcaccgccgtggaggtgggcatcgtggccatcagaggcctgttcagcggcagatacctggccatgaacaagagaggcagactgtacgccagcgagcactacagcgccgagtgcgagttcgtggagagaatccacgagctgggctacaacacctacgccagcagactgtacagaaccgtgagcagcacccccggcgccagaagacagcccagcgccgagagactgtggtacgtgagcgtgaacggcaagggcagacccagaagaggcttcaagaccagaagaacccagaagagcagcctgttcctgcccagagtgctggaccacagagaccacgagatggtgagacagctgcagagcggcctgcccagaccccccggcaagggcgtgcagcccagaagaagaagacagaagcagagccccgacaacctggagcccagccacgtgcaggccagcagactgggcagccagctggaggccagcgcccactag

SEQ ID NO: 2017 - DNA, 621 bp, Artificial Sequence
  Description of Artificial Sequence: Synthetic coding sequence
atgagcggccccggcaccgccgccgtggccctgctgcccgccgtgctgctggccctgctggccccctgggccggcagaggcggcgccgccgcccccaccgcccccaacggcaccctggaggccgagctggagagaagatgggagagcctggtggccctgagcctggccagactgcccgtggccgcccagcccaaggaggccgccgtgcagagcggcgccggcgactacctgctgggcatcaagagactgagaagactgtactgcaacgtgggcatcggcttccacctgcaggccctgcccgacggcagaatcggcggcgcccacgccgacaccagagacagcctgctggagctgagccccgtggagagaggcgtggtgagcatcttcggcgtggccagcagattcttcgtggccatgagcagcaagggcaagctgtacggcagccccttcttcaccgacgagtgcaccttcaaggagatcctgctgcccaacaactacaacgcctacgagagctacaagtaccccggcatgttcatcgccctgagcaagaacggcaagaccaagaagggcaacagagtgagccccaccatgaaggtgacccacttcctgcccagactgtag

SEQ ID NO: 2018 - DNA, 807 bp, Artificial Sequence
  Description of Artificial Sequence: Synthetic coding sequence
atgagcctgagcttcctgctgctgctgttcttcagccacctgatcctgagcgcctgggcccacggcgagaagagactggcccccaagggccagcccggccccgccgccaccgacagaaaccccagaggcagcagcagcagacagagcagcagcagcgccatgagcagcagcagcgccagcagcagccccgccgccagcctgggcagccagggcagcggcctggagcagagcagcttccagtggagccccagcggcagaagaaccggcagcctgtactgcagagtgggcatcggcttccacctgcagatctaccccgacggcaaggtgaacggcagccacgaggccaacatgctgagcgtgctggagatcttcgccgtgagccagggcatcgtgggcatcagaggcgtgttcagcaacaagttcctggccatgagcaagaagggcaagctgcacgccagcgccaagttcaccgacgactgcaagttcagagagagattccaggagaacagctacaacacctacgccagcgccatccacagaaccgagaagaccggcagagagtggtacgtggccctgaacaagagaggcaaggccaagagaggctgcagccccagagtgaagccccagcacatcagcacccacttcctgcccagattcaagcagagcgagcagcccgagctgagcttcaccgtgaccgtgcccgagaagaagaagccccccagccccatcaagcccaagatccccctgagcgcccccagaaagaacaccaacagcgtgaagtacagactgaagttcagattcggctag

SEQ ID NO: 2019 - DNA, 372 bp, Artificial Sequence
  Description of Artificial Sequence: Synthetic coding sequence
atgagcctgagcttcctgctgctgctgttcttcagccacctgatcctgagcgcctgggcccacggcgagaagagactggcccccaagggccagcccggccccgccgccaccgacagaaaccccagaggcagcagcagcagacagagcagcagcagcgccatgagcagcagcagcgccagcagcagccccgccgccagcctgggcagccagggcagcggcctggagcagagcagcttccagtggagccccagcggcagaagaaccggcagcctgtactgcagagtgggcatcggcttccacctgcagatctaccccgacggcaaggtgaacggcagccacgaggccaacatgctgagccaggtgcacagatag

SEQ ID NO: 2020 - DNA, 855 bp, Artificial Sequence
  Description of Artificial Sequence: Synthetic coding sequence
atgcccagatacgcccagctggtgatgggccccgccggcagcggcaagagcacctactgcgccaccatggtgcagcactgcgaggccctgaacagaagcgtgcaggtggtgaacctggaccccgccgccgagcacttcaactacagcgtgatggccgacatcagagagctgatcgaggtggacgacgtgatggaggacgacagcctgagattcggccccaacggcggcctggtgttctgcatggagtacttcgccaacaacttcgactggctggagaactgcctgggccacgtggaggacgactacatcctgttcgactgccccggccagatcgagctgtacacccacctgcccgtgatgaagcagctggtgcagcagctggagcagtgggagttcagagtgtgcggcgtgttcctggtggacagccagttcatggtggagagcttcaagttcatcagcggcatcctggccgccctgagcgccatgatcagcctggagatcccccaggtgaacatcatgaccaagatggacctgctgagcaagaaggccaagaaggagatcgagaagttcctggaccccgacatgtacagcctgctggaggacagcaccagcgacctgagaagcaagaagttcaagaagctgaccaaggccatctgcggcctgatcgacgactacagcatggtgagattcctgccctacgaccagagcgacgaggagagcatgaacatcgtgctgcagcacatcgacttcgccatccagtacggcgaggacctggagttcaaggagcccaaggagagagaggacgagagcagcagcatgttcgacgagtacttccaggagtgccaggacgagtag

SEQ ID NO: 2021 - DNA, 735 bp, Artificial Sequence
  Description of Artificial Sequence: Synthetic coding sequence
atgggcagccccagaagcgccctgagctgcctgctgctgcacctgctggtgctgtgcctgcaggcccaggagggccccggcagaggccccgccctgggcagagagctggccagcctgttcagagccggcagagagccccagggcgtgagccagcaggtgaccgtgcagagcagccccaacttcacccagcacgtgagagagcagagcctggtgaccgaccagctgagcagaagactgatcagaacctaccagctgtacagcagaaccagcggcaagcacgtgcaggtgctggccaacaagagaatcaacgccatggccgaggacggcgaccccttcgccaagctgatcgtggagaccgacaccttcggcagcagagtgagagtgagaggcgccgagaccggcctgtacatctgcatgaacaagaagggcaagctgatcgccaagagcaacggcaagggcaaggactgcgtgttcaccgagatcgtgctggagaacaactacaccgccctgcagaacgccaagtacgagggctggtacatggccttcaccagaaagggcagacccagaaagggcagcaagaccagacagcaccagagagaggtgcacttcatgaagagactgcccagaggccaccacaccaccgagcagagcctgagattcgagttcctgaactacccccccttcaccagaagcctgagaggcagccagagaacctgggcccccgagcccagatag

SEQ ID NO: 2022 - DNA, 702 bp, Artificial Sequence
  Description of Artificial Sequence: Synthetic coding sequence
atgggcagccccagaagcgccctgagctgcctgctgctgcacctgctggtgctgtgcctgcaggcccaggagggccccggcagaggccccgccctgggcagagagctggccagcctgttcagagccggcagagagccccagggcgtgagccagcagcacgtgagagagcagagcctggtgaccgaccagctgagcagaagactgatcagaacctaccagctgtacagcagaaccagcggcaagcacgtgcaggtgctggccaacaagagaatcaacgccatggccgaggacggcgaccccttcgccaagctgatcgtggagaccgacaccttcggcagcagagtgagagtgagaggcgccgagaccggcctgtacatctgcatgaacaagaagggcaagctgatcgccaagagcaacggcaagggcaaggactgcgtgttcaccgagatcgtgctggagaacaactacaccgccctgcagaacgccaagtacgagggctggtacatggccttcaccagaaagggcagacccagaaagggcagcaagaccagacagcaccagagagaggtgcacttcatgaagagactgcccagaggccaccacaccaccgagcagagcctgagattcgagttcctgaactacccccccttcaccagaagcctgagaggcagccagagaacctgggcccccgagcccagatag

SEQ ID NO: 2023 - DNA, 615 bp, Artificial Sequence
  Description of Artificial Sequence: Synthetic coding sequence
atgggcagccccagaagcgccctgagctgcctgctgctgcacctgctggtgctgtgcctgcaggcccagcacgtgagagagcagagcctggtgaccgaccagctgagcagaagactgatcagaacctaccagctgtacagcagaaccagcggcaagcacgtgcaggtgctggccaacaagagaatcaacgccatggccgaggacggcgaccccttcgccaagctgatcgtggagaccgacaccttcggcagcagagtgagagtgagaggcgccgagaccggcctgtacatctgcatgaacaagaagggcaagctgatcgccaagagcaacggcaagggcaaggactgcgtgttcaccgagatcgtgctggagaacaactacaccgccctgcagaacgccaagtacgagggctggtacatggccttcaccagaaagggcagacccagaaagggcagcaagaccagacagcaccagagagaggtgcacttcatgaagagactgcccagaggccaccacaccaccgagcagagcctgagattcgagttcctgaactacccccccttcaccagaagcctgagaggcagccagagaacctgggcccccgagcccagatag

SEQ ID NO: 2024 - DNA, 648 bp, Artificial Sequence
  Description of Artificial Sequence: Synthetic coding sequence
atgggcagccccagaagcgccctgagctgcctgctgctgcacctgctggtgctgtgcctgcaggcccaggtgaccgtgcagagcagccccaacttcacccagcacgtgagagagcagagcctggtgaccgaccagctgagcagaagactgatcagaacctaccagctgtacagcagaaccagcggcaagcacgtgcaggtgctggccaacaagagaatcaacgccatggccgaggacggcgaccccttcgccaagctgatcgtggagaccgacaccttcggcagcagagtgagagtgagaggcgccgagaccggcctgtacatctgcatgaacaagaagggcaagctgatcgccaagagcaacggcaagggcaaggactgcgtgttcaccgagatcgtgctggagaacaactacaccgccctgcagaacgccaagtacgagggctggtacatggccttcaccagaaagggcagacccagaaagggcagcaagaccagacagcaccagagagaggtgcacttcatgaagagactgcccagaggccaccacaccaccgagcagagcctgagattcgagttcctgaactacccccccttcaccagaagcctgagaggcagccagagaacctgggcccccgagcccagatag

SEQ ID NO: 2025 - DNA, 627 bp, Artificial Sequence
  Description of Artificial Sequence: Synthetic coding sequence
atggcccccctgggcgaggtgggcaactacttcggcgtgcaggacgccgtgcccttcggcaacgtgcccgtgctgcccgtggacagccccgtgctgctgagcgaccacctgggccagagcgaggccggcggcctgcccagaggccccgccgtgaccgacctggaccacctgaagggcatcctgagaagaagacagctgtactgcagaaccggcttccacctggagatcttccccaacggcaccatccagggcaccagaaaggaccacagcagattcggcatcctggagttcatcagcatcgccgtgggcctggtgagcatcagaggcgtggacagcggcctgtacctgggcatgaacgagaagggcgagctgtacggcagcgagaagctgacccaggagtgcgtgttcagagagcagttcgaggagaactggtacaacacctacagcagcaacctgtacaagcacgtggacaccggcagaagatactacgtggccctgaacaaggacggcacccccagagagggcaccagaaccaagagacaccagaagttcacccacttcctgcccagacccgtggaccccgacaaggtgcccgagctgtacaaggacatcctgagccagagctag

SEQ ID NO: 2026 - DNA, 7176 bp, Artificial Sequence
  Description of Artificial Sequence: Synthetic coding sequence
atgaccgacctgctgagaagcgtggtgaccgtgatcgacgtgttctacaagtacaccaagcaggacggcgagtgcggcaccctgagcaagggcgagctgaaggagctgctggagaaggagctgcaccccgtgctgaagaaccccgacgaccccgacaccgtggacgtgatcatgcacatgctggacagagaccacgacagaagactggacttcaccgagttcctgctgatgatcttcaagctgaccatggcctgcaacaaggtgctgagcaaggagtactgcaaggccagcggcagcaagaagcacagaagaggccacagacaccaggaggaggagagcgagaccgaggaggacgaggaggacacccccggccacaagagcggctacagacacagcagctggagcgagggcgaggagcacggctacagcagcggccacagcagaggcaccgtgaagtgcagacacggcagcaacagcagaagactgggcagacagggcaacctgagcagcagcggcaaccaggagggcagccagaagagataccacagaagcagctgcggccacagctggagcggcggcaaggacagacacggcagcagcagcgtggagctgagagagagaatcaacaagagccacatcagccccagcagagagagcggcgaggagtacgagagcggcagcggcagcaacagctgggagagaaagggccacggcggcctgagctgcggcctggagaccagcggccacgagagcaacagcacccagagcagaatcagagagcagaagctgggcagcagctgcagcggcagcggcgacagcggcagaagaagccacgcctgcggctacagcaacagcagcggctgcggcagaccccagaacgccagcagcagctgccagagccacagattcggcggccagggcaaccagttcagctacatccagagcggctgccagagcggcatcaagggcggccagggccacggctgcgtgagcggcggccagcccagcggctgcggccagcccgagagcaacccctgcagccagagctacagccagagaggctacggcgccagagagaacggccagccccagaactgcggcggccagtggagaaccggcagcagccagagcagctgctgcggccagtacggcagcggcggcagccagagctgcagcaacggccagcacgagtacggcagctgcggcagattcagcaacagcagcagcagcaacgagttcagcaagtgcgaccagtacggcagcggcagcagccagagcaccagcttcgagcagcacggcaccggcctgagccagagcagcggcttcgagcagcacgtgtgcggcagcggccagacctgcggccagcacgagagcaccagcagccagagcctgggctacgaccagcacggcagcagcagcggcaagaccagcggcttcggccagcacggcagcggcagcggccagagcagcggcttcggccagtgcggcagcggcagcggccagagcagcggcttcggccagcacggcagcgtgagcggccagagcagcggcttcggccagcacggcagcgtgagcggccagagcagcggcttcggccagcacgagagcagaagcagacagagcagctacggccagcacggcagcggcagcagccagagcagcggctacggccagtacggcagcagagagaccagcggcttcggccagcacggcctgggcagcggccagagcaccggcttcggccagtacggcagcggcagcggccagagcagcggcttcggccagcacggcagcggcagcggccagagcagcggcttcggccagcacgagagcagaagcggccagagcagctacggccagcacagcagcggcagcagccagagcagcggctacggccagcacggcagcagacagaccagcggcttcggccagcacggcagcggcagcagccagagcaccggcttcggccagtacggcagcggcagcggccagagcagcggcttcggccagcacgtgagcggcagcggccagagcagcggcttcggccagcacgagagcagaagcggccacagcagctacggccagcacggcttcggcagcagccagagcagcggctacggccagcacggcagcagcagcggccagaccagcggcttcggccagcacgagctgagcagcggccagagcagcagcttcggccagcacggcagcggcagcggccagagcagcggcttcggccagcacggcagcggcagcggccagagcagcggcttcggccagcacgagagcagaagcggccagagcagctacggccagcacagcagcggcagcagccagagcagcggctacggccagcacggcagcagacagaccagcggcttcggccagcacggcagcggcagcagccagagcaccggcttcggccagtacggcagcggcagcggccagagcgccggcttcggccagcacggcagcggcagcggccagagcagcggcttcggccagcacgagagcagaagccaccagagcagctacggccagcacggcagcggcagcagccagagcagcggctacggccagcacggcagcagcagcggccagaccagcggcttcggccagcacagaagcagcagcggccagtacagcggcttcggccagcacggcagcggcagcggccagagcagcggcttcggccagcacggcaccggcagcggccagtacagcggcttcggccagcacgagagcagaagccaccagagcagctacggccagcacggcagcggcagcagccagagcagcggctacggccagcacggcagcagcagcggccagaccttcggcttcggccagcacagaagcggcagcggccagagcagcggcttcggccagcacggcagcggcagcggccagagcagcggcttcggccagcacgagagcggcagcggcaagagcagcggcttcggccagcacgagagcagaagcagccagagcaactacggccagcacggcagcggcagcagccagagcagcggctacggccagcacggcagcagcagcggccagaccaccggcttcggccagcacagaagcagcagcggccagtacagcggcttcggccagcacggcagcggcagcgaccagagcagcggcttcggccagcacggcaccggcagcggccagagcagcggcttcggccagtacgagagcagaagcagacagagcagctacggccagcacggcagcggcagcagccagagcagcggctacggccagcacggcagcaacagcggccagaccagcggcttcggccagcacagacccggcagcggccagagcagcggcttcggccagtacggcagcggcagcggccagagcagcggcttcggccagcacggcagcggcaccggcaagagcagcggcttcgcccagcacgagtacagaagcggccagagcagctacggccagcacggcaccggcagcagccagagcagcggctgcggccagcacgagagcggcagcggccccaccaccagcttcggccagcacgtgagcggcagcgacaacttcagcagcagcggccagcacatcagcgacagcggccagagcaccggcttcggccagtacggcagcggcagcggccagagcaccggcctgggccagggcgagagccagcaggtggagagcggcagcaccgtgcacggcagacaggagaccacccacggccagaccatcaacaccaccagacacagccagagcggccagggccagagcacccagaccggcagcagagtgaccagaagaagaagaagcagccagagcgagaacagcgacagcgaggtgcacagcaaggtgagccacagacacagcgagcacatccacacccaggccggcagccactaccccaagagcggcagcaccgtgagaagaagacagggcaccacccacggccagagaggcgacaccaccagacacggccacagcggccacggccagagcacccagaccggcagcagaaccagcggcagacagagattcagccacagcgacgccaccgacagcgaggtgcacagcggcgtgagccacagaccccacagccaggagcagacccacagccaggccggcagccagcacggcgagagcgagagcaccgtgcacgagagacacgagaccacctacggccagaccggcgaggccaccggccacggccacagcggccacggccagagcacccagagaggcagcagaaccaccggcagaagaggcagcggccacagcgagagcagcgacagcgaggtgcacagcggcggcagccacagaccccagagccaggagcagacccacggccaggccggcagccagcacggcgagagcggcagcaccgtgcacggcagacacggcaccacccacggccagaccggcgacaccaccagacacgcccactaccaccacggcaagagcacccagagaggcagcagcaccaccggcagaagaggcagcggccacagcgagagcagcgacagcgaggtgcacagcggcggcagccacacccacagcggccacacccacggccagagcggcagccagcacggcgagagcgagagcatcatccacgacagacacagaatcacccacggccagaccggcgacaccaccagacacagctacagcggccacgagcagaccacccagaccggcagcagaaccaccggcagacagagaaccagccacagcgagagcaccgacagcgaggtgcacagcggcggcagccacagaccccacagcagagagcacacctacggccaggccggcagccagcacgaggagcccgagttcaccgtgcacgagagacacggcaccacccacggccagatcggcgacaccaccggccacagccacagcggccacggccagagcacccagagaggcagcagaaccaccggcagacagagaagcagccacagcgagagcagcgacagcgaggtgcacagcggcgtgagccacacccacaccggccacacccacggccaggccggcagccagcacggccagagcgagagcatcgtgcccgagagacacggcaccacccacggccagaccggcgacaccaccagacacgcccactaccaccacggcctgaccacccagaccggcagcagaaccaccggcagaagaggcagcggccacagcgagtacagcgacagcgagggctacagcggcgtgagccacacccacagcggccacacccacggccaggccagaagccagcacggcgagagcgagagcatcgtgcacgagagacacggcaccatccacggccagaccggcgacaccaccagacacgcccacagcggccacggccagagcacccagaccggcagcagaaccaccggcagaagaagcagcggccacagcgagtacagcgacagcgagggccacagcggcttcagccagagaccccacagcagaggccacacccacggccaggccggcagccagcacggcgagagcgagagcatcgtggacgagagacacggcaccacccacggccagaccggcgacaccagcggccacagccagagcggccacggccagagcacccagagcggcagcagcaccaccggcagaagaagaagcggccacagcgagagcagcgacagcgaggtgcacagcggcggcagccacacccacagcggccacacccacagccaggccagaagccagcacggcgagagcgagagcaccgtgcacaagagacaccagaccacccacggccagaccggcgacaccaccgagcacggccaccccagccacggccagaccatccagaccggcagcagaaccaccggcagaagaggcagcggccacagcgagtacagcgacagcgagggccccagcggcgtgagccacacccacagcggccacacccacggccaggccggcagccactaccccgagagcggcagcagcgtgcacgagagacacggcaccacccacggccagaccgccgacaccaccagacacggccacagcggccacggccagagcacccagagaggcagcagaaccaccggcagaagagccagcggccacagcgagtacagcgacagcgagggccacagcggcgtgagccacacccacagcggccacgcccacggccaggccggcagccagcacggcgagagcggcagcagcgtgcacgagagacacggcaccacccacggccagaccggcgacaccaccagacacgcccacagcggccacggccagagcacccagagaggcagcagaaccgccggcagaagaggcagcggccacagcgagagcagcgacagcgaggtgcacagcggcgtgagccacacccacagcggccacacctacggccaggccagaagccagcacggcgagagcggcagcgccatccacggcagacagggcaccatccacggccagaccggcgacaccaccagacacggccagagcggccacggccagagcacccagaccggcagcagaaccaccggcagacagagaagcagccacagcgagagcagcgacagcgaggtgcacagcgaggccagccccacccacagcggccacacccacagccaggccggcagcagacacggccagagcggcagcagcggccacggcagacagggcaccacccacggccagaccggcgacaccaccagacacgcccactacggctacggccagagcacccagagaggcagcagaaccaccggcagaagaggcagcggccacagcgagagcagcgacagcgaggtgcacagctggggcagccacacccacagcggccacatccagggccaggccggcagccagcagagacagcccggcagcaccgtgcacggcagactggagaccacccacggccagaccggcgacaccaccagacacggccacagcggctacggccagagcacccagaccggcagcagaagcagcagagccagccacttccagagccacagcagcgagagacagagacacggcagcagccaggtgtggaagcacggcagctacggccccgccgagtacgactacggccacaccggctacggccccagcggcggcagcagaaagagcatcagcaacagccacctgagctggagcaccgacagcaccgccaacaagcagctgagcagacactag

SEQ ID NO: 2027 - DNA, 2856 bp, Artificial Sequence
  Description of Artificial Sequence: Synthetic coding sequence
atggccaccggcaccggcaagcacaagctgctgagcaccggccccaccgagccctggagcatcagagagaagctgtgcctggccagcagcgtgatgagaagcggcgaccagaactgggtgagcgtgagcagagccatcaagcccttcgccgagcccggcagaccccccgactggttcagccagaagcactgcgccagccagtacagcgagctgctggagaccaccgagacccccaagagaaagagaggcgagaagggcgaggtggtggagaccgtggaggacgtgatcgtgagaaagctgaccgccgagagagtggaggagctgaagaaggtgatcaaggagacccaggagagatacagaagactgaagagagacgccgagctgatccaggccggccacatggacagcagactggacgagctgtgcaacgacatcgccaccaagaagaagctggaggaggaggaggccgaggtgaagagaaaggccaccgacgccgcctaccaggccagacaggccgtgaagaccccccccagaagactgcccaccgtgatggtgagaagccccatcgacagcgccagccccggcggcgactaccccctgggcgacctgacccccaccaccatggaggaggccaccagcggcgtgacccccggcaccctgcccagcacccccgtgaccagcttccccggcatccccgacaccctgccccccggcagcgcccccctggaggcccccatgacccccgtgaccgacgacagcccccagaagaagatgctgggccagaaggccacccccccccccagccccctgctgagcgagctgctgaagaagggcagcctgctgcccaccagccccagactggtgaacgagagcgagatggccgtggccagcggccacctgaacagcaccggcgtgctgctggaggtgggcggcgtgctgcccatgatccacggcggcgagatccagcagacccccaacaccgtggccgccagccccgccgccagcggcgcccccaccctgagcagactgctggaggccggccccacccagttcaccacccccctggccagcttcaccaccgtggccagcgagccccccgtgaagctggtgcccccccccgtggagagcgtgagccaggccaccatcgtgatgatgcccgccctgcccgcccccagcagcgcccccgccgtgagcaccaccgagagcgtggcccccgtgagccagcccgacaactgcgtgcccatggaggccgtgggcgacccccacaccgtgaccgtgagcatggacagcagcgagatcagcatgatcatcaacagcatcaaggaggagtgcttcagaagcggcgtggccgaggcccccgtgggcagcaaggcccccagcatcgacggcaaggaggagctggacctggccgagaagatggacatcgccgtgagctacaccggcgaggagctggacttcgagaccgtgggcgacatcatcgccatcatcgaggacaaggtggacgaccaccccgaggtgctggacgtggccgccgtggaggccgccctgagcttctgcgaggagaacgacgacccccagagcctgcccggcccctgggagcaccccatccagcaggagagagacaagcccgtgcccctgcccgcccccgagatgaccgtgaagcaggagagactggacttcgaggagaccgagaacaagggcatccacgagctggtggacatcagagagcccagcgccgagatcaaggtggagcccgccgagcccgagcccgtgatcagcggcgccgagatcgtggccggcgtggtgcccgccaccagcatggagccccccgagctgagaagccaggacctggacgaggagctgggcagcaccgccgccggcgagatcgtggaggccgacgtggccatcggcaagggcgacgagacccccctgaccaacgtgaagaccgaggccagccccgagagcatgctgagccccagccacggcagcaaccccatcgaggaccccctggaggccgagacccagcacaagttcgagatgagcgacagcctgaaggaggagagcggcaccatcttcggcagccagatcaaggacgcccccggcgaggacgaggaggaggacggcgtgagcgaggccgccagcctggaggagcccaaggaggaggaccagggcgagggctacctgagcgagatggacaacgagccccccgtgagcgagagcgacgacggcttcagcatccacaacgccaccctgcagagccacaccctggccgacagcatccccagcagccccgccagcagccagttcagcgtgtgcagcgaggaccaggaggccatccaggcccagaagatctggaagaaggccatcatgctggtgtggagagccgccgccaaccacagatacgccaacgtgttcctgcagcccgtgaccgacgacatcgcccccggctaccacagcatcgtgcagagacccatggacctgagcaccatcaagaagaacatcgagaacggcctgatcagaagcaccgccgagttccagagagacatcatgctgatgttccagaacgccgtgatgtacaacagcagcgaccacgacgtgtaccacatggccgtggagatgcagagagacgtgctggagcagatccagcagttcctggccacccagctgatcatgcagaccagcgagagcggcatcagcgccaagagcctgagaggcagagacagcaccagaaagcaggacgccagcgagaaggacagcgtgcccatgggcagccccgccttcctgctgagcctgttcgacggcggcaccagaggcagaagatgcgccatcgaggccgacatgaagatgaagaagtag

SEQ ID NO: 2028 - DNA, 627 bp, Artificial Sequence
  Description of Artificial Sequence: Synthetic coding sequence
atgaagctgctgcccagcgtggtgctgaagctgttcctggccgccgtgctgagcgccctggtgaccggcgagagcctggagagactgagaagaggcctggccgccggcaccagcaaccccgacccccccaccgtgagcaccgaccagctgctgcccctgggcggcggcagagacagaaaggtgagagacctgcaggaggccgacctggacctgctgagagtgaccctgagcagcaagccccaggccctggccacccccaacaaggaggagcacggcaagagaaagaagaagggcaagggcctgggcaagaagagagacccctgcctgagaaagtacaaggacttctgcatccacggcgagtgcaagtacgtgaaggagctgagagcccccagctgcatctgccaccccggctaccacggcgagagatgccacggcctgagcctgcccgtggagaacagactgtacacctacgaccacaccaccatcctggccgtggtggccgtggtgctgagcagcgtgtgcctgctggtgatcgtgggcctgctgatgttcagataccacagaagaggcggctacgacgtggagaacgaggagaaggtgaagctgggcatgaccaacagccactag

SEQ ID NO: 2029 - DNA, 1128 bp, Artificial Sequence
  Description of Artificial Sequence: Synthetic coding sequence
atggccgtgaccgaggccagcctgctgagacagtgccccctgctgctgccccagaacagaagcaagaccgtgtacgagggcttcatcagcgcccagggcagagacttccacctgagaatcgtgctgcccgaggacctgcagctgaagaacgccagactgctgtgcagctggcagctgagaaccatcctgagcggctaccacagaatcgtgcagcagagaatgcagcacagccccgacctgatgagcttcatgatggagctgaagatgctgctggaggtggccctgaagaacagacaggagctgtacgccctgcccccccccccccagttctacagcagcctgatcgaggagatcggcaccctgggctgggacaagctggtgtacgccgacacctgcttcagcaccatcaagctgaaggccgaggacgccagcggcagagagcacctgatcaccctgaagctgaaggccaagtaccccgccgagagccccgactacttcgtggacttccccgtgcccttctgcgccagctggaccccccagagcagcctgatcagcatctacagccagttcctggccgccatcgagagcctgaaggccttctgggacgtgatggacgagatcgacgagaagacctgggtgctggagcccgagaagccccccagaagcgccaccgccagaagaatcgccctgggcaacaacgtgagcatcaacatcgaggtggaccccagacaccccaccatgctgcccgagtgcttcttcctgggcgccgaccacgtggtgaagcccctgggcatcaagctgagcagaaacatccacctgtgggaccccgagaacagcgtgctgcagaacctgaaggacgtgctggagatcgacttccccgccagagccatcctggagaagagcgacttcaccatggactgcggcatctgctacgcctaccagctggacggcaccatccccgaccaggtgtgcgacaacagccagtgcggccagcccttccaccagatctgcctgtacgagtggctgagaggcctgctgaccagcagacagagcttcaacatcatcttcggcgagtgcccctactgcagcaagcccatcaccctgaagatgagcggcagaaagcactag

SEQ ID NO: 2030 - DNA, 723 bp, Artificial Sequence
  Description of Artificial Sequence: Synthetic coding sequence
atgaccccccacagactgctgccccccctgctgctgctgctggccctgctgctggccgccagccccggcggcgccctggccagatgccccggctgcggccagggcgtgcaggccggctgccccggcggctgcgtggaggaggaggacggcggcagccccgccgagggctgcgccgaggccgagggctgcctgagaagagagggccaggagtgcggcgtgtacacccccaactgcgcccccggcctgcagtgccacccccccaaggacgacgaggcccccctgagagccctgctgctgggcagaggcagatgcctgcccgccagagcccccgccgtggccgaggagaaccccaaggagagcaagccccaggccggcaccgccagaccccaggacgtgaacagaagagaccagcagagaaaccccggcaccagcaccacccccagccagcccaacagcgccggcgtgcaggacaccgagatgggcccctgcagaagacacctggacagcgtgctgcagcagctgcagaccgaggtgtacagaggcgcccagaccctgtacgtgcccaactgcgaccacagaggcttctacagaaagagacagtgcagaagcagccagggccagagaagaggcccctgctggtgcgtggacagaatgggcaagagcctgcccggcagccccgacggcaacggcagcagcagctgccccaccggcagcagcggctag

SEQ ID NO: 2031 - DNA, 411 bp, Artificial Sequence
  Description of Artificial Sequence: Synthetic coding sequence
atgaccccccacagactgctgccccccctgctgctgctgctggccctgctgctggccgccagccccggcggcgccctggccagatgccccggctgcggccagggcgtgcaggccggctgccccggcggctgcgtggaggaggaggacggcggcagccccgccgagggctgcgccgaggccgagggctgcctgagaagagagggccaggagtgcggcgtgtacacccccaactgcgcccccggcctgcagtgccacccccccaaggacgacgaggcccccctgagagccctgctgctgggcagaggcagatgcctgcccgccagagcccccgccgtgctgagcagccccagaaccctgagaaagctgagccccgagcccggcgccacctgcagctgcagaggcgagagctag

SEQ ID NO: 2032 - DNA, 717 bp, Artificial Sequence
  Description of Artificial Sequence: Synthetic coding sequence
atgaccccccacagactgctgccccccctgctgctgctgctggccctgctgctggccgccagccccggcggcgccctggccagatgccccggctgcggccagggcgtgcaggccggctgccccggcggctgcgtggaggaggaggacggcggcagccccgccgagggctgcgccgaggccgagggctgcctgagaagagagggccaggagtgcggcgtgtacacccccaactgcgcccccggcctgcagtgccacccccccaaggacgacgaggcccccctgagagccctgctgctgggcagaggcagatgcctgcccgccagagcccccgccgaggagaaccccaaggagagcaagccccaggccggcaccgccagaccccaggacgtgaacagaagagaccagcagagaaaccccggcaccagcaccacccccagccagcccaacagcgccggcgtgcaggacaccgagatgggcccctgcagaagacacctggacagcgtgctgcagcagctgcagaccgaggtgtacagaggcgcccagaccctgtacgtgcccaactgcgaccacagaggcttctacagaaagagacagtgcagaagcagccagggccagagaagaggcccctgctggtgcgtggacagaatgggcaagagcctgcccggcagccccgacggcaacggcagcagcagctgccccaccggcagcagcggctag

SEQ ID NO: 2033 - DNA, 837 bp, Artificial Sequence
  Description of Artificial Sequence: Synthetic coding sequence
atgcccagactgagcctgctgctgcccctgctgctgctgctgctgctgcccctgctgccccccctgagccccagcctgggcatcagagacgtgggcggcagaagacccaagtgcggcccctgcagacccgagggctgccccgcccccgccccctgccccgcccccggcatcagcgccctggacgagtgcggctgctgcgccagatgcctgggcgccgagggcgccagctgcggcggcagagccggcggcagatgcggccccggcctggtgtgcgccagccaggccgccggcgccgcccccgagggcaccggcctgtgcgtgtgcgcccagagaggcaccgtgtgcggcagcgacggcagaagctaccccagcgtgtgcgccctgagactgagagccagacacacccccagagcccaccccggccacctgcacaaggccagagacggcccctgcgagttcgcccccgtggtggtggtgccccccagaagcgtgcacaacgtgaccggcgcccaggtgggcctgagctgcgaggtgagagccgtgcccacccccgtgatcacctggagaaaggtgaccaagagccccgagggcacccaggccctggaggagctgcccggcgaccacgtgaacatcgccgtgcaggtgagaggcggccccagcgaccacgaggccaccgcctggatcctgatcaaccccctgagaaaggaggacgagggcgtgtaccagtgccacgccgccaacatggtgggcgaggccgagagccacagcaccgtgaccgtgctggacctgagcaagtacagaagcttccacttccccgcccccgacgacagaatgtag

SEQ ID NO: 2034 - DNA, 459 bp, Artificial Sequence
  Description of Artificial Sequence: Synthetic coding sequence
atgtgcagcctgcccatggccagatactacatcagcttcctgcccgagcccctgcccgccaagagcctgcagcacggcgtgcccctgagcctggacagcagcctgagcagcctgctggagaagatctgcatcctgcccaacagaggcctggccagaaccaaggtgcccatcttcctgggcatccagggcggcagcagatgcctggcctgcgtggagaccgaggagggccccagcctgcagctggaggacgtgaacatcgaggagctgtacaagggcggcgaggaggccaccagattcaccttcttccagagcagcagcggcagcgccttcagactggaggccgccgcctggcccggctggttcctgtgcggccccgccgagccccagcagcccgtgcagctgaccaaggagagcgagcccagcgccagaaccaagttctacttcgagcagagctggtag

SEQ ID NO: 2035 - DNA, 459 bp, Artificial Sequence
  Description of Artificial Sequence: Synthetic coding sequence
atgtgcagcctgcccatggccagatactacatcatcaagtacgccgaccagaaggccctgtacaccagagacggccagctgctggtgggcgaccccgtggccgacaactgctgcgccgagaagatctgcatcctgcccaacagaggcctggccagaaccaaggtgcccatcttcctgggcatccagggcggcagcagatgcctggcctgcgtggagaccgaggagggccccagcctgcagctggaggacgtgaacatcgaggagctgtacaagggcggcgaggaggccaccagattcaccttcttccagagcagcagcggcagcgccttcagactggaggccgccgcctggcccggctggttcctgtgcggccccgccgagccccagcagcccgtgcagctgaccaaggagagcgagcccagcgccagaaccaagttctacttcgagcagagctggtag

SEQ ID NO: 2036 - DNA, 459 bp, Artificial Sequence; identical to SEQ ID NO: 2035
  Description of Artificial Sequence: Synthetic coding sequence

SEQ ID NO: 2037 - DNA, 816 bp, Artificial Sequence
  Description of Artificial Sequence: Synthetic coding sequence
atggccaaggtgcccgacatgttcgaggacctgaagaactgctacagcgagaacgaggaggacagcagcagcatcgaccacctgagcctgaaccagaagagcttctaccacgtgagctacggccccctgcacgagggctgcatggaccagagcgtgagcctgagcatcagcgagaccagcaagaccagcaagctgaccttcaaggagagcatggtggtggtggccaccaacggcaaggtgctgaagaagagaagactgagcctgagccagagcatcaccgacgacgacctggaggccatcgccaacgacagcgaggaggagatcatcaagcccagaagcgcccccttcagcttcctgagcaacgtgaagtacaacttcatgagaatcatcaagtacgagttcatcctgaacgacgccctgaaccagagcatcatcagagccaacgaccagtacctgaccgccgccgccctgcacaacctggacgaggccgtgaagttcgacatgggcgcctacaagagcagcaaggacgacgccaagatcaccgtgatcctgagaatcagcaagacccagctgtacgtgaccgcccaggacgaggaccagcccgtgctgctgaaggagatgcccgagatccccaagaccatcaccggcagcgagaccaacctgctgttcttctgggagacccacggcaccaagaactacttcaccagcgtggcccaccccaacctgttcatcgccaccaagcaggactactgggtgtgcctggccggcggcccccccagcatcaccgacttccagatcctggagaaccaggcctag

SEQ ID NO: 2038 - DNA, 600 bp, Artificial Sequence
  Description of Artificial Sequence: Synthetic coding sequence
atgaactgcgtgtgcagactggtgctggtggtgctgagcctgtggcccgacaccgccgtggcccccggccccccccccggcccccccagagtgagccccgaccccagagccgagctggacagcaccgtgctgctgaccagaagcctgctggccgacaccagacagctggccgcccagctgagagacaagttccccgccgacggcgaccacaacctggacagcctgcccaccctggccatgagcgccggcgccctgggcgccctgcagctgcccggcgtgctgaccagactgagagccgacctgctgagctacctgagacacgtgcagtggctgagaagagccggcggcagcagcctgaagaccctggagcccgagctgggcaccctgcaggccagactggacagactgctgagaagactgcagctgctgatgagcagactggccctgccccagcccccccccgacccccccgccccccccctggccccccccagcagcgcctggggcggcatcagagccgcccacgccatcctgggcggcctgcacctgaccctggactgggccgtgagaggcctgctgctgctgaagaccagactgtag

SEQ ID NO: 2039 - DNA, 897 bp, Artificial Sequence
  Description of Artificial Sequence: Synthetic coding sequence
atgtggggcgcctgcaaggtgaaggtgcacgacagcctggccaccatcagcatcaccctgagaagatacctgagactgggcgccaccatggccaagagcaagttcgagtacgtgagagacttcgaggccgacgacacctgcctggcccactgctgggtggtggtgagactggacggcagaaacttccacagattcgccgagaagcacaacttcgccaagcccaacgacagcagagccctgcagctgatgaccaagtgcgcccagaccgtgatggaggagctggaggacatcgtgatcgcctacggccagagcgacgagtacagcttcgtgttcaagagaaagaccaactggttcaagagaagagccagcaagttcatgacccacgtggccagccagttcgccagcagctacgtgttctactggagagactacttcgaggaccagcccctgctgtacccccccggcttcgacggcagagtggtggtgtaccccagcaaccagaccctgaaggactacctgagctggagacaggccgactgccacatcaacaacctgtacaacaccgtgttctgggccctgatccagcagagcggcctgacccccgtgcaggcccagggcagactgcagggcaccctggccgccgacaagaacgagatcctgttcagcgagttcaacatcaactacaacaacgagctgcccatgtacagaaagggcaccgtgctgatctggcagaaggtggacgaggtgatgaccaaggagatcaagctgcccaccgagatggagggcaagaagatggccgtgaccagaaccagaaccaagcccgtgcccctgcactgcgacatcatcggcgacgccttctggaaggagcaccccgagatcctggacgaggacagctag

SEQ ID NO: 2040 - DNA, 441 bp, Artificial Sequence
  Description of Artificial Sequence: Synthetic coding sequence
atgcaccccctgctgaaccccctgctgctggccctgggcctgatggccctgctgctgaccaccgtgatcgccctgacctgcctgggcggcttcgccagccccggccccgtgccccccagcaccgccctgagagagctgatcgaggagctggtgaacatcacccagaaccagaaggcccccctgtgcaacggcagcatggtgtggagcatcaacctgaccgccggcatgtactgcgccgccctggagagcctgatcaacgtgagcggctgcagcgccatcgagaagacccagagaatgctgagcggcttctgcccccacaaggtgagcgccggccagttcagcagcctgcacgtgagagacaccaagatcgaggtggcccagttcgtgaaggacctgctgctgcacctgaagaagctgttcagagagggccagttcaactag

SEQ ID NO: 2041 - DNA, 3999 bp, Artificial Sequence
  Description of Artificial Sequence: Synthetic coding sequence
atggagagccacagcagagccggcaagagcagaaagagcgccaagttcagaagcatcagcagaagcctgatgctgtgcaacgccaagaccagcgacgacggcagcagccccgacgagaagtaccccgaccccttcgagatcagcctggcccagggcaaggagggcatcttccacagcagcgtgcagctggccgacaccagcgaggccggccccagcagcgtgcccgacctggccctggccagcgaggccgcccagctgcaggccgccggcaacgacagaggcaagacctgcagaagaatcttcttcatgaaggagagcagcaccgccagcagcagagagaagcccggcaagctggaggcccagagcagcaacttcctgttccccaaggcctgccaccagagagccagaagcaacagcaccagcgtgaacccctactgcaccagagagatcgacttccccatgaccaagaagagcgccgcccccaccgacagacagccctacagcctgtgcagcaacagaaagagcctgagccagcagctggactgccccgccggcaaggccgccggcaccagcagacccaccagaagcctgagcaccgcccagctggtgcagcccagcggcggcctgcaggccagcgtgatcagcaacatcgtgctgatgaagggccaggccaagggcctgggcttcagcatcgtgggcggcaaggacagcatctacggccccatcggcatctacgtgaagaccatcttcgccggcggcgccgccgccgccgacggcagactgcaggagggcgacgagatcctggagctgaacggcgagagcatggccggcctgacccaccaggacgccctgcagaagttcaagcaggccaagaagggcctgctgaccctgaccgtgagaaccagactgaccgccccccccagcctgtgcagccacctgagcccccccctgtgcagaagcctgagcagcagcacctgcatcaccaaggacagcagcagcttcgccctggagagccccagcgcccccatcagcaccgccaagcccaactacagaatcatggtggaggtgagcctgcagaaggaggccggcgtgggcctgggcatcggcctgtgcagcgtgccctacttccagtgcatcagcggcatcttcgtgcacaccctgagccccggcagcgtggcccacctggacggcagactgagatgcggcgacgagatcgtggagatcagcgacagccccgtgcactgcctgaccctgaacgaggtgtacaccatcctgagccactgcgaccccggccccgtgcccatcatcgtgagcagacaccccgacccccaggtgagcgagcagcagctgaaggaggccgtggcccaggccgtggagaacaccaagttcggcaaggagagacaccagtggagcctggagggcgtgaagagactggagagcagctggcacggcagacccaccctggagaaggagagagagaagaacagcgcccccccccacagaagagcccagaaggtgatgatcagaagcagcagcgacagcagctacatgagcggcagccccggcggcagccccggcagcggcagcgccgagaagcccagcagcgacgtggacatcagcacccacagccccagcctgcccctggccagagagcccgtggtgctgagcatcgccagcagcagactgccccaggagagcccccccctgcccgagagcagagacagccacccccccctgagactgaagaagagcttcgagatcctggtgagaaagcccatgagcagcaagcccaagcccccccccagaaagtacttcaagagcgacagcgacccccagaagagcctggaggagagagagaacagcagctgcagcagcggccacaccccccccacctgcggccaggaggccagagagctgctgcccctgctgctgccccaggaggacaccgccggcagaagccccagcgccagcgccggctgccccggccccggcatcggcccccagaccaagagcagcaccgagggcgagcccggctggagaagagccagccccgtgacccagaccagccccatcaagcaccccctgctgaagagacaggccagaatggactacagcttcgacaccaccgccgaggacccctgggtgagaatcagcgactgcatcaagaacctgttcagccccatcatgagcgagaaccacggccacatgcccctgcagcccaacgccagcctgaacgaggaggagggcacccagggccaccccgacggcaccccccccaagctggacaccgccaacggcacccccaaggtgtacaagagcgccgacagcagcaccgtgaagaagggcccccccgtggcccccaagcccgcctggttcagacagagcctgaagggcctgagaaacagagccagcgaccccagaggcctgcccgaccccgccctgagcacccagcccgcccccgccagcagagagcacctgggcagccacatcagagccagcagcagcagcagcagcatcagacagagaatcagcagcttcgagaccttcggcagcagccagctgcccgacaagggcgcccagagactgagcctgcagcccagcagcggcgaggccgccaagcccctgggcaagcacgaggagggcagattcagcggcctgctgggcagaggcgccgcccccaccctggtgccccagcagcccgagcaggtgctgagcagcggcagccccgccgccagcgaggccagagaccccggcgtgagcgagagccccccccccggcagacagcccaaccagaagaccctgccccccggccccgaccccctgctgagactgctgagcacccaggccgaggagagccagggccccgtgctgaagatgcccagccagagagccagaagcttccccctgaccagaagccagagctgcgagaccaagctgctggacgagaagaccagcaagctgtacagcatcagcagccaggtgagcagcgccgtgatgaagagcctgctgtgcctgcccagcagcatcagctgcgcccagaccccctgcatccccaaggagggcgccagccccaccagcagcagcaacgaggacagcgccgccaacggcagcgccgagaccagcgccctggacaccggcttcagcctgaacctgagcgagctgagagagtacaccgagggcctgaccgaggccaaggaggacgacgacggcgaccacagcagcctgcagagcggccagagcgtgatcagcctgctgagcagcgaggagctgaagaagctgatcgaggaggtgaaggtgctggacgaggccaccctgaagcagctggacggcatccacgtgaccatcctgcacaaggaggagggcgccggcctgggcttcagcctggccggcggcgccgacctggagaacaaggtgatcaccgtgcacagagtgttccccaacggcctggccagccaggagggcaccatccagaagggcaacgaggtgctgagcatcaacggcaagagcctgaagggcaccacccaccacgacgccctggccatcctgagacaggccagagagcccagacaggccgtgatcgtgaccagaaagctgacccccgaggccatgcccgacctgaacagcagcaccgacagcgccgccagcgccagcgccgccagcgacgtgagcgtggagagcaccgccgaggccaccgtgtgcaccgtgaccctggagaagatgagcgccggcctgggcttcagcctggagggcggcaagggcagcctgcacggcgacaagcccctgaccatcaacagaatcttcaagggcgccgccagcgagcagagcgagaccgtgcagcccggcgacgagatcctgcagctgggcggcaccgccatgcagggcctgaccagattcgaggcctggaacatcatcaaggccctgcccgacggccccgtgaccatcgtgatcagaagaaagagcctgcagagcaaggagaccaccgccgccggcgacagctag

SEQ ID NO: 2042 - DNA, 2163 bp, Artificial Sequence
  Description of Artificial Sequence: Synthetic coding sequence
atgtgcagcgtgctgcccgtggccgtgaccggcgtgaagagactggagagcagctggcacggcagacccaccctggagaaggagagagagaagaacagcgcccccccccacagaagagcccagaaggtgatgatcagaagcagcagcgacagcagctacatgagcggcagccccggcggcagccccggcagcggcagcgccgagaagcccagcagcgacgtggacatcagcacccacagccccagcctgcccctggccagagagcccgtggtgctgagcatcgccagcagcagactgccccaggagagcccccccctgcccgagagcagagacagccacccccccctgagactgaagaagagcttcgagatcctggtgagaaagcccatgagcagcaagcccaagcccccccccagaaagtacttcaagagcgacagcgacccccagaagagcctggaggagagagagaacagcagctgcagcagcggccacaccccccccacctgcggccaggaggccagagagctgctgcccctgctgctgccccaggaggacaccgccggcagaagccccagcgccagcgccggctgccccggccccggcatcggcccccagaccaagagcagcaccgagggcgagcccggctggagaagagccagccccgtgacccagaccagccccatcaagcaccccctgctgaagagacaggccagaatggactacagcttcgacaccaccgccgaggacccctgggtgagaatcagcgactgcatcaagaacctgttcagccccatcatgagcgagaaccacggccacatgcccctgcagcccaacgccagcctgaacgaggaggagggcacccagggccaccccgacggcaccccccccaagctggacaccgccaacggcacccccaaggtgtacaagagcgccgacagcagcaccgtgaagaagggcccccccgtggcccccaagcccgcctggttcagacagagcctgaagggcctgagaaacagagccagcgaccccagaggcctgcccgaccccgccctgagcacccagcccgcccccgccagcagagagcacctgggcagccacatcagagccagcagcagcagcagcagcatcagacagagaatcagcagcttcgagaccttcggcagcagccagctgcccgacaagggcgcccagagactgagcctgcagcccagcagcggcgaggccgccaagcccctgggcaagcacgaggagggcagattcagcggcctgctgggcagaggcgccgcccccaccctggtgccccagcagcccgagcaggtgctgagcagcggcagccccgccgccagcgaggccagagaccccggcgtgagcgagagccccccccccggcagacagcccaaccagaagaccctgccccccggccccgaccccctgctgagactgctgagcacccaggccgaggagagccagggccccgtgctgaagatgcccagccagagagccagaagcttccccctgaccagaagccagagctgcgagaccaagctgctggacgagaagaccagcaagctgtacagcatcagcagccaggtgagcagcgccgtgatgaagagcctgctgtgcctgcccagcagcatcagctgcgcccagaccccctgcatccccaaggagggcgccagccccaccagcagcagcaacgaggacagcgccgccaacggcagcgccgagaccagcgccctggacaccggcttcagcctgaacctgagcgagctgagagagtacaccgagggcctgaccgaggccaaggaggacgacgacggcgaccacagcagcctgcagagcggccagagcgtgatcagcctgctgagcagcgaggagctgaagaagctgatcgaggaggtgaaggtgctggacgaggccaccctgaagcagctggacggcatccacgtgaccatcctgcacaaggaggagggcgccggcctgggcttcagcctggccggcggcgccgacctggagaacaaggtgatcaccgtgcacagagtgttccccaacggcctggccagccaggagggcaccatccagaagggcaacgaggtgctgagcatcaacggcaagagcctgaagggcaccacccaccacgccagaccccagctgctgcactag

SEQ ID NO: 2043 - DNA, 3492 bp, Artificial Sequence
  Description of Artificial Sequence: Synthetic coding sequence
atggagagaggcgccagagagatggccgcccccggcgactgccccgccggcaaggccgccggcaccagcagacccaccagaagcctgagcaccgcccagctggtgcagcccagcggcggcctgcaggccagcgtgatcagcaacatcgtgctgatgaagggccaggccaagggcctgggcttcagcatcgtgggcggcaaggacagcatctacggccccatcggcatctacgtgaagaccatcttcgccggcggcgccgccgccgccgacggcagactgcaggagggcgacgagatcctggagctgaacggcgagagcatggccggcctgacccaccaggacgccctgcagaagttcaagcaggccaagaagggcctgctgaccctgaccgtgagaaccagactgaccgccccccccagcctgtgcagccacctgagcccccccctgtgcagaagcctgagcagcagcacctgcatcaccaaggacagcagcagcttcgccctggagagccccagcgcccccatcagcaccgccaagcccaactacagaatcatggtggaggtgagcctgcagaaggaggccggcgtgggcctgggcatcggcctgtgcagcgtgccctacttccagtgcatcagcggcatcttcgtgcacaccctgagccccggcagcgtggcccacctggacggcagactgagatgcggcgacgagatcgtggagatcagcgacagccccgtgcactgcctgaccctgaacgaggtgtacaccatcctgagccactgcgaccccggccccgtgcccatcatcgtgagcagacaccccgacccccaggtgagcgagcagcagctgaaggaggccgtggcccaggccgtggagaacaccaagttcggcaaggagagacaccagtggagcctggagggcgtgaagagactggagagcagctggcacggcagacccaccctggagaaggagagagagaagaacagcgcccccccccacagaagagcccagaaggtgatgatcagaagcagcagcgacagcagctacatgagcggcagccccggcggcagccccggcagcggcagcgccgagaagcccagcagcgacgtggacatcagcacccacagccccagcctgcccctggccagagagcccgtggtgctgagcatcgccagcagcagactgccccaggagagcccccccctgcccgagagcagagacagccacccccccctgagactgaagaagagcttcgagatcctggtgagaaagcccatgagcagcaagcccaagcccccccccagaaagtacttcaagagcgacagcgacccccagaagagcctggaggagagagagaacagcagctgcagcagcggccacaccccccccacctgcggccaggaggccagagagctgctgcccctgctgctgccccaggaggacaccgccggcagaagccccagcgccagcgccggctgccccggccccggcatcggcccccagaccaagagcagcaccgagggcgagcccggctggagaagagccagccccgtgacccagaccagccccatcaagcaccccctgctgaagagacaggccagaatggactacagcttcgacaccaccgccgaggacccctgggtgagaatcagcgactgcatcaagaacctgttcagccccatcatgagcgagaaccacggccacatgcccctgcagcccaacgccagcctgaacgaggaggagggcacccagggccaccccgacggcaccccccccaagctggacaccgccaacggcacccccaaggtgtacaagagcgccgacagcagcaccgtgaagaagggcccccccgtggcccccaagcccgcctggttcagacagagcctgaagggcctgagaaacagagccagcgaccccagaggcctgcccgaccccgccctgagcacccagcccgcccccgccagcagagagcacctgggcagccacatcagagccagcagcagcagcagcagcatcagacagagaatcagcagcttcgagaccttcggcagcagccagctgcccgacaagggcgcccagagactgagcctgcagcccagcagcggcgaggccgccaagcccctgggcaagcacgaggagggcagattcagcggcctgctgggcagaggcgccgcccccaccctggtgccccagcagcccgagcaggtgctgagcagcggcagccccgccgccagcgaggccagagaccccggcgtgagcgagagccccccccccggcagacagcccaaccagaagaccctgccccccggccccgaccccctgctgagactgctgagcacccaggccgaggagagccagggccccgtgctgaagatgcccagccagagagccagaagcttccccctgaccagaagccagagctgcgagaccaagctgctggacgagaagaccagcaagctgtacagcatcagcagccaggtgagcagcgccgtgatgaagagcctgctgtgcctgcccagcagcatcagctgcgcccagaccccctgcatccccaaggagggcgccagccccaccagcagcagcaacgaggacagcgccgccaacggcagcgccgagaccagcgccctggacaccggcttcagcctgaacctgagcgagctgagagagtacaccgagggcctgaccgaggccaaggaggacgacgacggcgaccacagcagcctgcagagcggccagagcgtgatcagcctgctgagcagcgaggagctgaagaagctgatcgaggaggtgaaggtgctggacgaggccaccctgaagcagctggacggcatccacgtgaccatcctgcacaaggaggagggcgccggcctgggcttcagcctggccggcggcgccgacctggagaacaaggtgatcaccgtgcacagagtgttccccaacggcctggccagccaggagggcaccatccagaagggcaacgaggtgctgagcatcaacggcaagagcctgaagggcaccacccaccacgacgccctggccatcctgagacaggccagagagcccagacaggccgtgatcgtgaccagaaagctgacccccgaggccatgcccgacctgaacagcagcaccgacagcgccgccagcgccagcgccgccagcgacgtgagcgtggagagcaccgaggccaccgtgtgcaccgtgaccctggagaagatgagcgccggcctgggcttcagcctggagggcggcaagggcagcctgcacggcgacaagcccctgaccatcaacagaatcttcaagggcgccgccagcgagcagagcgagaccgtgcagcccggcgacgagatcctgcagctgggcggcaccgccatgcagggcctgaccagattcgaggcctggaacatcatcaaggccctgcccgacggccccgtgaccatcgtgatcagaagaaagagcctgcagagcaaggagaccaccgccgccggcgacagctag

SEQ ID NO: 2044 - DNA, 1896 bp, Artificial Sequence
  Description of Artificial Sequence: Synthetic coding sequence
atggactacagcttcgacaccaccgccgaggacccctgggtgagaatcagcgactgcatcaagaacctgttcagccccatcatgagcgagaaccacggccacatgcccctgcagcccaacgccagcctgaacgaggaggagggcacccagggccaccccgacggcaccccccccaagctggacaccgccaacggcacccccaaggtgtacaagagcgccgacagcagcaccgtgaagaagggcccccccgtggcccccaagcccgcctggttcagacagagcctgaagggcctgagaaacagagccagcgaccccagaggcctgcccgaccccgccctgagcacccagcccgcccccgccagcagagagcacctgggcagccacatcagagccagcagcagcagcagcagcatcagacagagaatcagcagcttcgagaccttcggcagcagccagctgcccgacaagggcgcccagagactgagcctgcagcccagcagcggcgaggccgccaagcccctgggcaagcacgaggagggcagattcagcggcctgctgggcagaggcgccgcccccaccctggtgccccagcagcccgagcaggtgctgagcagcggcagccccgccgccagcgaggccagagaccccggcgtgagcgagagccccccccccggcagacagcccaaccagaagaccctgccccccggccccgaccccctgctgagactgctgagcacccaggccgaggagagccagggccccgtgctgaagatgcccagccagagagccagaagcttccccctgaccagaagccagagctgcgagaccaagctgctggacgagaagaccagcaagctgtacagcatcagcagccaggtgagcagcgccgtgatgaagagcctgctgtgcctgcccagcagcatcagctgcgcccagaccccctgcatccccaaggagggcgccagccccaccagcagcagcaacgaggacagcgccgccaacggcagcgccgagaccagcgccctggacaccggcttcagcctgaacctgagcgagctgagagagtacaccgagggcctgaccgaggccaaggaggacgacgacggcgaccacagcagcctgcagagcggccagagcgtgatcagcctgctgagcagcgaggagctgaagaagctgatcgaggaggtgaaggtgctggacgaggccaccctgaagcagctggacggcatccacgtgaccatcctgcacaaggaggagggcgccggcctgggcttcagcctggccggcggcgccgacctggagaacaaggtgatcaccgtgcacagagtgttccccaacggcctggccagccaggagggcaccatccagaagggcaacgaggtgctgagcatcaacggcaagagcctgaagggcaccacccaccacgacgccctggccatcctgagacaggccagagagcccagacaggccgtgatcgtgaccagaaagctgacccccgaggccatgcccgacctgaacagcagcaccgacagcgccgccagcgccagcgccgccagcgacgtgagcgtggagagcaccgccgaggccaccgtgtgcaccgtgaccctggagaagatgagcgccggcctgggcttcagcctggagggcggcaagggcagcctgcacggcgacaagcccctgaccatcaacagaatcttcaagggcgccgccagcgagcagagcgagaccgtgcagcccggcgacgagatcctgcagctgggcggcaccgccatgcagggcctgaccagattcgaggcctggaacatcatcaaggccctgcccgacggccccgtgaccatcgtgatcagaagaaagagcctgcagagcaaggagaccaccgccgccggcgacagctag

SEQ ID NO: 2045 - DNA, 1974 bp, Artificial Sequence
  Description of Artificial Sequence: Synthetic coding sequence
atgtggctgcccgtgaaggagctgaccatccacgagtgccagcagatgagcacctacagagcccccaaccaggaggccagagagctgctgcccctgctgctgccccaggaggacaccgccggcagaagccccagcgccagcgccggctgccccggccccggcatcggcccccagaccaagagcagcaccgagggcgagcccggctggagaagagccagccccgtgacccagaccagccccatcaagcaccccctgctgaagagacaggccagaatggactacagcttcgacaccaccgccgaggacccctgggtgagaatcagcgactgcatcaagaacctgttcagccccatcatgagcgagaaccacggccacatgcccctgcagcccaacgccagcctgaacgaggaggagggcacccagggccaccccgacggcaccccccccaagctggacaccgccaacggcacccccaaggtgtacaagagcgccgacagcagcaccgtgaagaagggcccccccgtggcccccaagcccgcctggttcagacagagcctgaagggcctgagaaacagagccagcgaccccagaggcctgcccgaccccgccctgagcacccagcccgcccccgccagcagagagcacctgggcagccacatcagagccagcagcagcagcagcagcatcagacagagaatcagcagcttcgagaccttcggcagcagccagctgcccgacaagggcgcccagagactgagcctgcagcccagcagcggcgaggccgccaagcccctgggcaagcacgaggagggcagattcagcggcctgctgggcagaggcgccgcccccaccctggtgccccagcagcccgagcaggtgctgagcagcggcagccccgccgccagcgaggccagagaccccggcgtgagcgagagccccccccccggcagacagcccaaccagaagaccctgccccccggccccgaccccctgctgagactgctgagcacccaggccgaggagagccagggccccgtgctgaagatgcccagccagagagccagaagcttccccctgaccagaagccagagctgcgagaccaagctgctggacgagaagaccagcaagctgtacagcatcagcagccaggtgagcagcgccgtgatgaagagcctgctgtgcctgcccagcagcatcagctgcgcccagaccccctgcatccccaaggagggcgccagccccaccagcagcagcaacgaggacagcgccgccaacggcagcgccgagaccagcgccctggacaccggcttcagcctgaacctgagcgagctgagagagtacaccgagggcctgaccgaggccaaggaggacgacgacggcgaccacagcagcctgcagagcggccagagcgtgatcagcctgctgagcagcgaggagctgaagaagctgatcgaggaggtgaaggtgctggacgaggccaccctgaagcagctggacggcatccacgtgaccatcctgcacaaggaggagggcgccggcctgggcttcagcctggccggcggcgccgacctggagaacaaggtgatcaccgtgcacagagtgttccccaacggcctggccagccaggagggcaccatccagaagggcaacgaggtgctgagcatcaacggcaagagcctgaagggcaccacccaccacgacgccctggccatcctgagacaggccagagagcccagacaggccgtgatcgtgaccagaaagctgacccccgaggccatgcccgacctgaacagcagcaccgacagcgccgccagcgccagcgccgccagcgacgtgagcgtggagagcaccgaggccaccgtgtgcaccgtgaccctggagaagatgagcgccggcctgggcttcagcctggagggcggcaagggcagcctgcacggcgacaagcccctgaccatcaacagaatcttcaagtag

SEQ ID NO: 2046 - DNA, 1365 bp, Artificial Sequence
  Description of Artificial Sequence: Synthetic coding sequence
atggagagccacagcagagccggcaagagcagaaagagcgccaagttcagaagcatcagcagaagcctgatgctgtgcaacgccaagaccagcgacgacggcagcagccccgacgagaagtaccccgaccccttcgagatcagcctggcccagggcaaggagggcatcttccacagcagcgtgcagctggccgacaccagcgaggccggccccagcagcgtgcccgacctggccctggccagcgaggccgcccagctgcaggccgccggcaacgacagaggcaagacctgcagaagaatcttcttcatgaaggagagcagcaccgccagcagcagagagaagcccggcaagctggaggcccagagcagcaacttcctgttccccaaggcctgccaccagagagccagaagcaacagcaccagcgtgaacccctactgcaccagagagatcgacttccccatgaccaagaagagcgccgcccccaccgacagacagccctacagcctgtgcagcaacagaaagagcctgagccagcagctggactgccccgccggcaaggccgccggcaccagcagacccaccagaagcctgagcaccgcccagctggtgcagcccagcggcggcctgcaggccagcgtgatcagcaacatcgtgctgatgaagggccaggccaagggcctgggcttcagcatcgtgggcggcaaggacagcatctacggccccatcggcatctacgtgaagaccatcttcgccggcggcgccgccgccgccgacggcagactgcaggagggcgacgagatcctggagctgaacggcgagagcatggccggcctgacccaccaggacgccctgcagaagttcaagcaggccaagaagggcctgctgaccctgaccgtgagaaccagactgaccgccccccccagcctgtgcagccacctgagcccccccctgtgcagaagcctgagcagcagcacctgcatcaccaaggacagcagcagcttcgccctggagagccccagcgcccccatcagcaccgccaagcccaactacagaatcatggtggaggtgagcctgcagaaggaggccggcgtgggcctgggcatcggcctgtgcagcgtgccctacttccagtgcatcagcggcatcttcgtgcacaccctgagccccggcagcgtggcccacctggacggcagactgagatgcggcgacgagatcgtggagatcagcgacagccccgtgcactgcctgaccctgaacgaggtgtacaccatcctgagccactgcgaccccggccccgtgcccatcatcgtgagcagacaccccgacccccagaaggaggagatggaggcccaggaggtgaagtag

SEQ ID NO: 2047 - DNA, 1683 bp, Artificial Sequence
  Description of Artificial Sequence: Synthetic coding sequence
atggactacagcttcgacaccaccgccgaggacccctgggtgagaatcagcgactgcatcaagaacctgttcagccccatcatgagcgagaaccacggccacatgcccctgcagcccaacgccagcctgaacgaggaggagggcacccagggccaccccgacggcaccccccccaagctggacaccgccaacggcacccccaaggtgtacaagagcgccgacagcagcaccgtgaagaagggcccccccgtggcccccaagcccgcctggttcagacagagcctgaagggcctgagaaacagagccagcgaccccagaggcctgcccgaccccgccctgagcacccagcccgcccccgccagcagagagcacctgggcagccacatcagagccagcagcagcagcagcagcatcagacagagaatcagcagcttcgagaccttcggcagcagccagctgcccgacaagggcgcccagagactgagcctgcagcccagcagcggcgaggccgccaagcccctgggcaagcacgaggagggcagattcagcggcctgctgggcagaggcgccgcccccaccctggtgccccagcagcccgagcaggtgctgagcagcggcagccccgccgccagcgaggccagagaccccggcgtgagcgagagccccccccccggcagacagcccaaccagaagaccctgccccccggccccgaccccctgctgagactgctgagcacccaggccgaggagagccagggccccgtgctgaagatgcccagccagagagccagaagcttccccctgaccagaagccagagctgcgagaccaagctgctggacgagaagaccagcaagctgtacagcatcagcagccaggtgagcagcgccgtgatgaagagcctgctgtgcctgcccagcagcatcagctgcgcccagaccccctgcatccccaaggagggcgccagccccaccagcagcagcaacgaggacagcgccgccaacggcagcgccgagaccagcgccctggacaccggcttcagcctgaacctgagcgagctgagagagtacaccgagggcctgaccgaggccaaggaggacgacgacggcgaccacagcagcctgcagagcggccagagcgtgatcagcctgctgagcagcgaggagctgaagaagctgatcgaggaggtgaaggtgctggacgaggccaccctgaagcagctggacggcatccacgtgaccatcctgcacaaggaggagggcgccggcctgggcttcagcctggccggcggcgccgacctggagaacaaggtgatcaccgtgcacagagtgttccccaacggcctggccagccaggagggcaccatccagaagggcaacgaggtgctgagcatcaacggcaagagcctgaagggcaccacccaccacgacgccctggccatcctgagacaggccagagagcccagacaggccgtgatcgtgaccagaaagctgacccccgaggccatgcccgacctgaacagcagcaccgacagcgccgccagcgccagcgccgccagcgacgtgagcgtggagagcaccgaggccaccgtgtgcaccgtgaccctggaggacgtgggcagagccggcctgcagcccggcagaagagagggcctgcccaccagaagacaggccagccaccactag

SEQ ID NO: 2048 - DNA, 3996 bp, Artificial Sequence
  Description of Artificial Sequence: Synthetic coding sequence
atggagagccacagcagagccggcaagagcagaaagagcgccaagttcagaagcatcagcagaagcctgatgctgtgcaacgccaagaccagcgacgacggcagcagccccgacgagaagtaccccgaccccttcgagatcagcctggcccagggcaaggagggcatcttccacagcagcgtgcagctggccgacaccagcgaggccggccccagcagcgtgcccgacctggccctggccagcgaggccgcccagctgcaggccgccggcaacgacagaggcaagacctgcagaagaatcttcttcatgaaggagagcagcaccgccagcagcagagagaagcccggcaagctggaggcccagagcagcaacttcctgttccccaaggcctgccaccagagagccagaagcaacagcaccagcgtgaacccctactgcaccagagagatcgacttccccatgaccaagaagagcgccgcccccaccgacagacagccctacagcctgtgcagcaacagaaagagcctgagccagcagctggactgccccgccggcaaggccgccggcaccagcagacccaccagaagcctgagcaccgcccagctggtgcagcccagcggcggcctgcaggccagcgtgatcagcaacatcgtgctgatgaagggccaggccaagggcctgggcttcagcatcgtgggcggcaaggacagcatctacggccccatcggcatctacgtgaagaccatcttcgccggcggcgccgccgccgccgacggcagactgcaggagggcgacgagatcctggagctgaacggcgagagcatggccggcctgacccaccaggacgccctgcagaagttcaagcaggccaagaagggcctgctgaccctgaccgtgagaaccagactgaccgccccccccagcctgtgcagccacctgagcccccccctgtgcagaagcctgagcagcagcacctgcatcaccaaggacagcagcagcttcgccctggagagccccagcgcccccatcagcaccgccaagcccaactacagaatcatggtggaggtgagcctgcagaaggaggccggcgtgggcctgggcatcggcctgtgcagcgtgccctacttccagtgcatcagcggcatcttcgtgcacaccctgagccccggcagcgtggcccacctggacggcagactgagatgcggcgacgagatcgtggagatcagcgacagccccgtgcactgcctgaccctgaacgaggtgtacaccatcctgagccactgcgaccccggccccgtgcccatcatcgtgagcagacaccccgacccccaggtgagcgagcagcagctgaaggaggccgtggcccaggccgtggagaacaccaagttcggcaaggagagacaccagtggagcctggagggcgtgaagagactggagagcagctggcacggcagacccaccctggagaaggagagagagaagaacagcgcccccccccacagaagagcccagaaggtgatgatcagaagcagcagcgacagcagctacatgagcggcagccccggcggcagccccggcagcggcagcgccgagaagcccagcagcgacgtggacatcagcacccacagccccagcctgcccctggccagagagcccgtggtgctgagcatcgccagcagcagactgccccaggagagcccccccctgcccgagagcagagacagccacccccccctgagactgaagaagagcttcgagatcctggtgagaaagcccatgagcagcaagcccaagcccccccccagaaagtacttcaagagcgacagcgacccccagaagagcctggaggagagagagaacagcagctgcagcagcggccacaccccccccacctgcggccaggaggccagagagctgctgcccctgctgctgccccaggaggacaccgccggcagaagccccagcgccagcgccggctgccccggccccggcatcggcccccagaccaagagcagcaccgagggcgagcccggctggagaagagccagccccgtgacccagaccagccccatcaagcaccccctgctgaagagacaggccagaatggactacagcttcgacaccaccgccgaggacccctgggtgagaatcagcgactgcatcaagaacctgttcagccccatcatgagcgagaaccacggccacatgcccctgcagcccaacgccagcctgaacgaggaggagggcacccagggccaccccgacggcaccccccccaagctggacaccgccaacggcacccccaaggtgtacaagagcgccgacagcagcaccgtgaagaagggcccccccgtggcccccaagcccgcctggttcagacagagcctgaagggcctgagaaacagagccagcgaccccagaggcctgcccgaccccgccctgagcacccagcccgcccccgccagcagagagcacctgggcagccacatcagagccagcagcagcagcagcagcatcagacagagaatcagcagcttcgagaccttcggcagcagccagctgcccgacaagggcgcccagagactgagcctgcagcccagcagcggcgaggccgccaagcccctgggcaagcacgaggagggcagattcagcggcctgctgggcagaggcgccgcccccaccctggtgccccagcagcccgagcaggtgctgagcagcggcagccccgccgccagcgaggccagagaccccggcgtgagcgagagccccccccccggcagacagcccaaccagaagaccctgccccccggccccgaccccctgctgagactgctgagcacccaggccgaggagagccagggccccgtgctgaagatgcccagccagagagccagaagcttccccctgaccagaagccagagctgcgagaccaagctgctggacgagaagaccagcaagctgtacagcatcagcagccaggtgagcagcgccgtgatgaagagcctgctgtgcctgcccagcagcatcagctgcgcccagaccccctgcatccccaaggagggcgccagccccaccagcagcagcaacgaggacagcgccgccaacggcagcgccgagaccagcgccctggacaccggcttcagcctgaacctgagcgagctgagagagtacaccgagggcctgaccgaggccaaggaggacgacgacggcgaccacagcagcctgcagagcggccagagcgtgatcagcctgctgagcagcgaggagctgaagaagctgatcgaggaggtgaaggtgctggacgaggccaccctgaagcagctggacggcatccacgtgaccatcctgcacaaggaggagggcgccggcctgggcttcagcctggccggcggcgccgacctggagaacaaggtgatcaccgtgcacagagtgttccccaacggcctggccagccaggagggcaccatccagaagggcaacgaggtgctgagcatcaacggcaagagcctgaagggcaccacccaccacgacgccctggccatcctgagacaggccagagagcccagacaggccgtgatcgtgaccagaaagctgacccccgaggccatgcccgacctgaacagcagcaccgacagcgccgccagcgccagcgccgccagcgacgtgagcgtggagagcaccgaggccaccgtgtgcaccgtgaccctggagaagatgagcgccggcctgggcttcagcctggagggcggcaagggcagcctgcacggcgacaagcccctgaccatcaacagaatcttcaagggcgccgccagcgagcagagcgagaccgtgcagcccggcgacgagatcctgcagctgggcggcaccgccatgcagggcctgaccagattcgaggcctggaacatcatcaaggccctgcccgacggccccgtgaccatcgtgatcagaagaaagagcctgcagagcaaggagaccaccgccgccggcgacagctag

SEQ ID NO: 2049 - DNA, 1785 bp, Artificial Sequence
  Description of Artificial Sequence: Synthetic coding sequence
atggagagccacagcagagccggcaagagcagaaagagcgccaagttcagaagcatcagcagaagcctgatgctgtgcaacgccaagaccagcgacgacggcagcagccccgacgagaagtaccccgaccccttcgagatcagcctggcccagggcaaggagggcatcttccacagcagcgtgcagctggccgacaccagcgaggccggccccagcagcgtgcccgacctggccctggccagcgaggccgcccagctgcaggccgccggcaacgacagaggcaagacctgcagaagaatcttcttcatgaaggagagcagcaccgccagcagcagagagaagcccggcaagctggaggcccagagcagcaacttcctgttccccaaggcctgccaccagagagccagaagcaacagcaccagcgtgaacccctactgcaccagagagatcgacttccccatgaccaagaagagcgccgcccccaccgacagacagccctacagcctgtgcagcaacagaaagagcctgagccagcagctggactgccccgccggcaaggccgccggcaccagcagacccaccagaagcctgagcaccgcccagctggtgcagcccagcggcggcctgcaggccagcgtgatcagcaacatcgtgctgatgaagggccaggccaagggcctgggcttcagcatcgtgggcggcaaggacagcatctacggccccatcggcatctacgtgaagaccatcttcgccggcggcgccgccgccgccgacggcagactgcaggagggcgacgagatcctggagctgaacggcgagagcatggccggcctgacccaccaggacgccctgcagaagttcaagcaggccaagaagggcctgctgaccctgaccgtgagaaccagactgaccgccccccccagcctgtgcagccacctgagcccccccctgtgcagaagcctgagcagcagcacctgcatcaccaaggacagcagcagcttcgccctggagagccccagcgcccccatcagcaccgccaagcccaactacagaatcatggtggaggtgagcctgcagaaggaggccggcgtgggcctgggcatcggcctgtgcagcgtgccctacttccagtgcatcagcggcatcttcgtgcacaccctgagccccggcagcgtggcccacctggacggcagactgagatgcggcgacgagatcgtggagatcagcgacagccccgtgcactgcctgaccctgaacgaggtgtacaccatcctgagccactgcgaccccggccccgtgcccatcatcgtgagcagacaccccgacccccaggtgagcgagcagcagctgaaggaggccgtggcccaggccgtggagaacaccaagttcggcaaggagagacaccagtggagcctggagggcgtgaagagactggagagcagctggcacggcagacccaccctggagaaggagagagagaagaacagcgcccccccccacagaagagcccagaaggtgatgatcagaagcagcagcgacagcagctacatgagcggcagccccggcggcagccccggcagcggcagcgccgagaagcccagcagcgacgtggacatcagcacccacagccccagcctgcccctggccagagagcccgtggtgctgagcatcgccagcagcagactgccccaggagagcccccccctgcccgagagcagagacagccacccccccctgagactgaagaagagcttcgagatcctggtgagaaagcccatgagctag

SEQ ID NO: 2050 - DNA, 468 bp, Artificial Sequence
  Description of Artificial Sequence: Synthetic coding sequence
atgacccccggcaagaccagcctggtgagcctgctgctgctgctgagcctggaggccatcgtgaaggccggcatcaccatccccagaaaccccggctgccccaacagcgaggacaagaacttccccagaaccgtgatggtgaacctgaacatccacaacagaaacaccaacaccaaccccaagagaagcagcgactactacaacagaagcaccagcccctggaacctgcacagaaacgaggaccccgagagataccccagcgtgatctgggaggccaagtgcagacacctgggctgcatcaacgccgacggcaacgtggactaccacatgaacagcgtgcccatccagcaggagatcctggtgctgagaagagagcccccccactgccccaacagcttcagactggagaagatcctggtgagcgtgggctgcacctgcgtgacccccatcgtgcaccacgtggcctag

SEQ ID NO: 2051 - DNA, 543 bp, Artificial Sequence
  Description of Artificial Sequence: Synthetic coding sequence
atggactggccccacaacctgctgttcctgctgaccatcagcatcttcctgggcctgggccagcccagaagccccaagagcaagagaaagggccagggcagacccggccccctggcccccggcccccaccaggtgcccctggacctggtgagcagaatgaagccctacgccagaatggaggagtacgagagaaacatcgaggagatggtggcccagctgagaaacagcagcgagctggcccagagaaagtgcgaggtgaacctgcagctgtggatgagcaacaagagaagcctgagcccctggggctacagcatcaaccacgaccccagcagaatccccgtggacctgcccgaggccagatgcctgtgcctgggctgcgtgaaccccttcaccatgcaggaggacagaagcatggtgagcgtgcccgtgttcagccaggtgcccgtgagaagaagactgtgcccccccccccccagaaccggcccctgcagacagagagccgtgatggagaccatcgccgtgggctgcacctgcatcttctag

SEQ ID NO: 2052 - DNA, 594 bp, Artificial Sequence
  Description of Artificial Sequence: Synthetic coding sequence
atgaccctgctgcccggcctgctgttcctgacctggctgcacacctgcctggcccaccacgaccccagcctgagaggccacccccacagccacggcaccccccactgctacagcgccgaggagctgcccctgggccaggcccccccccacctgctggccagaggcgccaagtggggccaggccctgcccgtggccctggtgagcagcctggaggccgccagccacagaggcagacacgagagacccagcgccaccacccagtgccccgtgctgagacccgaggaggtgctggaggccgacacccaccagagaagcatcagcccctggagatacagagtggacaccgacgaggacagatacccccagaagctggccttcgccgagtgcctgtgcagaggctgcatcgacgccagaaccggcagagagaccgccgccctgaacagcgtgagactgctgcagagcctgctggtgctgagaagaagaccctgcagcagagacggcagcggcctgcccacccccggcgccttcgccttccacaccgagttcatccacgtgcccgtgggctgcacctgcgtgctgcccagaagcgtgtag

SEQ ID NO: 2053 - DNA, 609 bp, Artificial Sequence
  Description of Artificial Sequence: Synthetic coding sequence
atgctggtggccggcttcctgctggccctgccccccagctgggccgccggcgcccccagagccggcagaagacccgccagacccagaggctgcgccgacagacccgaggagctgctggagcagctgtacggcagactggccgccggcgtgctgagcgccttccaccacaccctgcagctgggccccagagagcaggccagaaacgccagctgccccgccggcggcagacccgccgacagaagattcagaccccccaccaacctgagaagcgtgagcccctgggcctacagaatcagctacgaccccgccagataccccagatacctgcccgaggcctactgcctgtgcagaggctgcctgaccggcctgttcggcgaggaggacgtgagattcagaagcgcccccgtgtacatgcccaccgtggtgctgagaagaacccccgcctgcgccggcggcagaagcgtgtacaccgaggcctacgtgaccatccccgtgggctgcacctgcgtgcccgagcccgagaaggacgccgacagcatcaacagcagcatcgacaagcagggcgccaagctgctgctgggccccaacgacgcccccgccggcccctag

SEQ ID NO: 2054 - DNA, 492 bp, Artificial Sequence
  Description of Artificial Sequence: Synthetic coding sequence
atgaccgtgaagaccctgcacggccccgccatggtgaagtacctgctgctgagcatcctgggcctggccttcctgagcgaggccgccgccagaaagatccccaaggtgggccacaccttcttccagaagcccgagagctgcccccccgtgcccggcggcagcatgaagctggacatcggcatcatcaacgagaaccagagagtgagcatgagcagaaacatcgagagcagaagcaccagcccctggaactacaccgtgacctgggaccccaacagataccccagcgaggtggtgcaggcccagtgcagaaacctgggctgcatcaacgcccagggcaaggaggacatcagcatgaacagcgtgcccatccagcaggagaccctggtggtgagaagaaagcaccagggctgcagcgtgagcttccagctggagaaggtgctggtgaccgtgggctgcacctgcgtgacccccgtgatccaccacgtgcagtag

SEQ ID NO: 2055 - DNA, 531 bp, Artificial Sequence
  Description of Artificial Sequence: Synthetic coding sequence
atgaaggccagcagcctggccttcagcctgctgagcgccgccttctacctgctgtggacccccagcaccggcctgaagaccctgaacctgggcagctgcgtgatcgccaccaacctgcaggagatcagaaacggcttcagcgagatcagaggcagcgtgcaggccaaggacggcaacatcgacatcagaatcctgagaagaaccgagagcctgcaggacaccaagcccgccaacagatgctgcctgctgagacacctgctgagactgtacctggacagagtgttcaagaactaccagacccccgaccactacaccctgagaaagatcagcagcctggccaacagcttcctgaccatcaagaaggacctgagactgtgccacgcccacatgacctgccactgcggcgaggaggccatgaagaagtacagccagatcctgagccacttcgagaagctggagccccaggccgccgtggtgaaggccctgggcgagctggacatcctgctgcagtggatggaggagaccgagtag

SEQ ID NO: 2056 - DNA, 531 bp, Artificial Sequence; identical to SEQ ID NO: 2055
  Description of Artificial Sequence: Synthetic coding sequence

SEQ ID NO: 2057 - DNA, 456 bp, Artificial Sequence
  Description of Artificial Sequence: Synthetic coding sequence
atgaaggccagcagcctggccttcagcctgctgagcgccgccttctacctgctgtggacccccagcaccggcctgaagaccctgaacctgggcagctgcgtgatcgccaccaacctgcaggagatcagaaacggcttcagcgagatcagaggcagcgtgcaggccaaggacggcaacatcgacatcagaatcctgagaagaaccgagagcctgcaggacaccaagcccgccaacagatgctgcctgctgagacacctgctgagactgtacctggacagagtgttcaagaactaccagacccccgaccactacaccctgagaaagatcagcagcctggccaacagcttcctgaccatcaagaaggacctgagactgtgcctggagccccaggccgccgtggtgaaggccctgggcgagctggacatcctgctgcagtggatggaggagaccgagtag

SEQ ID NO: 2058 - DNA, 540 bp, Artificial Sequence
  Description of Artificial Sequence: Synthetic coding sequence
atggccgccctgcagaagagcgtgagcagcttcctgatgggcaccctggccaccagctgcctgctgctgctggccctgctggtgcagggcggcgccgccgcccccatcagcagccactgcagactggacaagagcaacttccagcagccctacatcaccaacagaaccttcatgctggccaaggaggccagcctggccgacaacaacaccgacgtgagactgatcggcgagaagctgttccacggcgtgagcatgagcgagagatgctacctgatgaagcaggtgctgaacttcaccctggaggaggtgctgttcccccagagcgacagattccagccctacatgcaggaggtggtgcccttcctggccagactgagcaacagactgagcacctgccacatcgagggcgacgacctgcacatccagagaaacgtgcagaagctgaaggacaccgtgaagaagctgggcgagagcggcgagatcaaggccatcggcgagctggacctgctgttcatgagcctgagaaacgcctgcatctag

SEQ ID NO: 2059 - DNA, 540 bp, Artificial Sequence; identical to SEQ ID NO: 2058
  Description of Artificial Sequence: Synthetic coding sequence

SEQ ID NO: 2060 - DNA, 1890 bp, Artificial Sequence
  Description of Artificial Sequence: Synthetic coding sequence
atgaaccaggtgaccatccagtgggacgccgtgatcgccctgtacatcctgttcagctggtgccacggcggcatcaccaacatcaactgcagcggccacatctgggtggagcccgccaccatcttcaagatgggcatgaacatcagcatctactgccaggccgccatcaagaactgccagcccagaaagctgcacttctacaagaacggcatcaaggagagattccagatcaccagaatcaacaagaccaccgccagactgtggtacaagaacttcctggagccccacgccagcatgtactgcaccgccgagtgccccaagcacttccaggagaccctgatctgcggcaaggacatcagcagcggctacccccccgacatccccgacgaggtgacctgcgtgatctacgagtacagcggcaacatgacctgcacctggaacgccggcaagctgacctacatcgacaccaagtacgtggtgcacgtgaagagcctggagaccgaggaggagcagcagtacctgaccagcagctacatcaacatcagcaccgacagcctgcagggcggcaagaagtacctggtgtgggtgcaggccgccaacgccctgggcatggaggagagcaagcagctgcagatccacctggacgacatcgtgatccccagcgccgccgtgatcagcagagccgagaccatcaacgccaccgtgcccaagaccatcatctactgggacagccagaccaccatcgagaaggtgagctgcgagatgagatacaaggccaccaccaaccagacctggaacgtgaaggagttcgacaccaacttcacctacgtgcagcagagcgagttctacctggagcccaacatcaagtacgtgttccaggtgagatgccaggagaccggcaagagatactggcagccctggagcagcctgttcttccacaagacccccgagaccgtgccccaggtgaccagcaaggccttccagcacgacacctggaacagcggcctgaccgtggccagcatcagcaccggccacctgaccagcgacaacagaggcgacatcggcctgctgctgggcatgatcgtgttcgccgtgatgctgagcatcctgagcctgatcggcatcttcaacagaagcttcagaaccggcatcaagagaagaatcctgctgctgatccccaagtggctgtacgaggacatccccaacatgaagaacagcaacgtggtgaagatgctgcaggagaacagcgagctgatgaacaacaacagcagcgagcaggtgctgtacgtggaccccatgatcaccgagatcaaggagatcttcatccccgagcacaagcccaccgactacaagaaggagaacaccggccccctggagaccagagactacccccagaacagcctgttcgacaacaccaccgtggtgtacatccccgacctgaacaccggctacaagccccagatcagcaacttcctgcccgagggcagccacctgagcaacaacaacgagatcaccagcctgaccctgaagccccccgtggacagcctggacagcggcaacaaccccagactgcagaagcaccccaacttcgccttcagcgtgagcagcgtgaacagcctgagcaacaccatcttcctgggcgagctgagcctgatcctgaaccagggcgagtgcagcagccccgacatccagaacagcgtggaggaggagaccaccatgctgctggagaacgacagccccagcgagaccatccccgagcagaccctgctgcccgacgagttcgtgagctgcctgggcatcgtgaacgaggagctgcccagcatcaacacctacttcccccagaacatcctggagagccacttcaacagaatcagcctgctggagaagtag

SEQ ID NO: 2061 - DNA, 1071 bp, Artificial Sequence
  Description of Artificial Sequence: Synthetic coding sequence
atgaaccaggtgaccatccagtgggacgccgtgatcgccctgtacatcctgttcagctggtgccacggcggcatcaccaacatcaactgcagcggccacatctgggtggagcccgccaccatcttcaagatgggcatgaacatcagcatctactgccaggccgccatcaagaactgccagcccagaaagctgcacttctacaagaacggcatcaaggagagattccagatcaccagaatcaacaagaccaccgccagactgtggtacaagaacttcctggagccccacgccagcatgtactgcaccgccgagtgccccaagcacttccaggagaccctgatctgcggcaaggacatcagcagcggctacccccccgacatccccgacgaggtgacctgcgtgatctacgagtacagcggcaacatgacctgcacctggaacgccggcaagctgacctacatcgacaccaagtacgtggtgcacgtgaagagcctggagaccgaggaggagcagcagtacctgaccagcagctacatcaacatcagcaccgacagcctgcagggcggcaagaagtacctggtgtgggtgcaggccgccaacgccctgggcatggaggagagcaagcagctgcagatccacctggacgacatcgtgatccccagcgccgccgtgatcagcagagccgagaccatcaacgccaccgtgcccaagaccatcatctactgggacagccagaccaccatcgagaaggtgagctgcgagatgagatacaaggccaccaccaaccagacctggaacgtgaaggagttcgacaccaacttcacctacgtgcagcagagcgagttctacctggagcccaacatcaagtacgtgttccaggtgagatgccaggagaccggcaagagatactggcagccctggagcagcctgttcttccacaagacccccgagaccgtgccccaggtgaccagcaaggccttccagcacgacacctggaacagcggcctgaccgtggccagcatcagcaccggccacctgaccagcggcctgaaggagggcagctactgctag

SEQ ID NO: 2062 - DNA, 1125 bp, Artificial Sequence
  Description of Artificial Sequence: Synthetic coding sequence
atgatcctgagaccctaccagccctgcggcaccgtgaaggagttcgacaccaacttcacctacgtgcagcagagcgagttctacctggagcccaacatcaagtacgtgttccaggtgagatgccaggagaccggcaagagatactggcagccctggagcagcctgttcttccacaagacccccgagaccgtgccccaggtgaccagcaaggccttccagcacgacacctggaacagcggcctgaccgtggccagcatcagcaccggccacctgaccagcgacaacagaggcgacatcggcctgctgctgggcatgatcgtgttcgccgtgatgctgagcatcctgagcctgatcggcatcttcaacagaagcttcagaaccggcatcaagagaagaatcctgctgctgatccccaagtggctgtacgaggacatccccaacatgaagaacagcaacgtggtgaagatgctgcaggagaacagcgagctgatgaacaacaacagcagcgagcaggtgctgtacgtggaccccatgatcaccgagatcaaggagatcttcatccccgagcacaagcccaccgactacaagaaggagaacaccggccccctggagaccagagactacccccagaacagcctgttcgacaacaccaccgtggtgtacatccccgacctgaacaccggctacaagccccagatcagcaacttcctgcccgagggcagccacctgagcaacaacaacgagatcaccagcctgaccctgaagccccccgtggacagcctggacagcggcaacaaccccagactgcagaagcaccccaacttcgccttcagcgtgagcagcgtgaacagcctgagcaacaccatcttcctgggcgagctgagcctgatcctgaaccagggcgagtgcagcagccccgacatccagaacagcgtggaggaggagaccaccatgctgctggagaacgacagccccagcgagaccatccccgagcagaccctgctgcccgacgagttcgtgagctgcctgggcatcgtgaacgaggagctgcccagcatcaacacctacttcccccagaacatcctggagagccacttcaacagaatcagcctgctggagaagtag

SEQ ID NO: 2063 - DNA, 354 bp, Artificial Sequence
  Description of Artificial Sequence: Synthetic coding sequence
atgacctgcacctggaacgccggcaagctgacctacatcgacaccaagtacgtggtgcacgtgaagagcctggagaccgaggaggagcagcagtacctgaccagcagctacatcaacatcagcaccgacagcctgcagggcggcaagaagtacgtgttccaggtgagatgccaggagaccggcaagagatactggcagccctggagcagcctgttcttccacaagacccccgagaccgtgccccaggtgaccagcaaggccttccagcacgacacctggaacagcggcctgaccgtggccagcatcagcaccggccacctgaccagcggcctgaaggagggcagctactgctag

SEQ ID NO: 2064 - DNA, 1176 bp, Artificial Sequence
  Description of Artificial Sequence: Synthetic coding sequence
tgacacttcctgctgccccccctgagcaagaagagcctgctgccccccaccatgatcctgagaccctaccagccctgcggcaccgtgaaggagttcgacaccaacttcacctacgtgcagcagagcgagttctacctggagcccaacatcaagtacgtgttccaggtgagatgccaggagaccggcaagagatactggcagccctggagcagcctgttcttccacaagacccccgagaccgtgccccaggtgaccagcaaggccttccagcacgacacctggaacagcggcctgaccgtggccagcatcagcaccggccacctgaccagcgacaacagaggcgacatcggcctgctgctgggcatgatcgtgttcgccgtgatgctgagcatcctgagcctgatcggcatcttcaacagaagcttcagaaccggcatcaagagaagaatcctgctgctgatccccaagtggctgtacgaggacatccccaacatgaagaacagcaacgtggtgaagatgctgcaggagaacagcgagctgatgaacaacaacagcagcgagcaggtgctgtacgtggaccccatgatcaccgagatcaaggagatcttcatccccgagcacaagcccaccgactacaagaaggagaacaccggccccctggagaccagagactacccccagaacagcctgttcgacaacaccaccgtggtgtacatccccgacctgaacaccggctacaagccccagatcagcaacttcctgcccgagggcagccacctgagcaacaacaacgagatcaccagcctgaccctgaagccccccgtggacagcctggacagcggcaacaaccccagactgcagaagcaccccaacttcgccttcagcgtgagcagcgtgaacagcctgagcaacaccatcttcctgggcgagctgagcctgatcctgaaccagggcgagtgcagcagccccgacatccagaacagcgtggaggaggagaccaccatgctgctggagaacgacagccccagcgagaccatccccgagcagaccctgctgcccgacgagttcgtgagctgcctgggcatcgtgaacgaggagctgcccagcatcaacacctacttcccccagaacatcctggagagccacttcaacagaatcagcctgctggagaagtag

SEQ ID NO: 2065 - DNA, 828 bp, Artificial Sequence
  Description of Artificial Sequence: Synthetic coding sequence
atgacctgcacctggaacgccggcaagctgacctacatcgacaccaagtacgtggtgcacgtgaagagcctggagaccgaggaggagcagcagtacctgaccagcagctacatcaacatcagcaccgacagcctgcagggcggcaagaagtacctggtgtgggtgcaggccgccaacgccctgggcatggaggagagcaagcagctgcagatccacctggacgacatcgtgatccccagcgccgccgtgatcagcagagccgagaccatcaacgccaccgtgcccaagaccatcatctactgggacagccagaccaccatcgagaaggtgagctgcgagatgagatacaaggccaccaccaaccagacctggaacgtgaaggagttcgacaccaacttcacctacgtgcagcagagcgagttctacctggagcccaacatcaagtacgtgttccaggtgagatgccaggagaccggcaagagatactggcagccctggagcagcctgttcttccacaagacccccgagaccgacaacagaggcgacatcggcctgctgctgggcatgatcgtgttcgccgtgatgctgagcatcctgagcctgatcggcatcttcaacagaagcttcagaaccggcatcaagagaagaatcctgctgctgatccccaagtggctgtacgaggacatccccaacatgaagaacagcaacgtggtgaagatgctgcaggagaacagcgagctgatgaacaacaacagcagcgagcaggtgctgtacgtggaccccatgatcaccgagatcaaggagatcttcatccccgagcacaagtag

SEQ ID NO: 2066 - DNA, 615 bp, Artificial Sequence
  Description of Artificial Sequence: Synthetic coding sequence
atgacctgcacctggaacgccggcaagctgacctacatcgacaccaagtacgtggtgcacgtgaagagcctggagaccgaggaggagcagcagtacctgaccagcagctacatcaacatcagcaccgacagcctgcagggcggcaagaagtacctggtgtgggtgcaggccgccaacgccctgggcatggaggagagcaagcagctgcagatccacctggacgacatcgtgccccaggtgaccagcaaggccttccagcacgacacctggaacagcggcctgaccgtggccagcatcagcaccggccacctgaccagcgacaacagaggcgacatcggcctgctgctgggcatgatcgtgttcgccgtgatgctgagcatcctgagcctgatcggcatcttcaacagaagcttcagaaccggcatcaagagaagaatcctgctgctgatccccaagtggctgtacgaggacatccccaacatgaagaacagcaacgtggtgaagatgctgcaggagaacagcgagctgatgaacaacaacagcagcgagcaggtgctgtacgtggaccccatgatcaccgagatcaaggagatcttcatccccgagcacaagtag

SEQ ID NO: 2067 - DNA, 441 bp, Artificial Sequence
  Description of Artificial Sequence: Synthetic coding sequence
atgaacatcagcatctactgccaggccgccatcaagaactgccagcccagaaagctgcacttctacaagaacggcatcaaggagagattccagatcaccagaatcaacaagaccaccgccagactgtggtacaagaacttcctggagccccacgccagcatgtactgcaccgccgagtgccccaagcacttccaggagaccctgatctgcggcaaggacatcagcagcggctacccccccgacatccccgacgaggtgacctgcgtgatctacgagtacagcggcaacatgacctgcacctggaacgccggcaagctgacctacatcgacaccaagtacgtggtgcacgtgaagagactgaagaacctgacccccatcctgcacatgtgcaacagccagaacagcacctggagccagaccctgagcacctacttcaagtag

SEQ ID NO: 2068 - DNA, 429 bp, Artificial Sequence
  Description of Artificial Sequence: Synthetic coding sequence
atgacctgcacctggaacgccggcaagctgacctacatcgacaccaagtacgtggtgcacgtgaagagcctggagaccgaggaggagcagcagtacctgaccagcagctacatcaacatcagcaccgacagcctgcagggcggcaagaagtacctggtgtgggtgcaggccgccaacgccctgggcatggaggagagcaagcagctgcagatccacctggacgacatcgtgatccccagcgccgccgtgatcagcagagccgagaccatcaacgccaccgtgcccaagaccatcatctactgggacagccagaccaccatcgagaaggtgagctgcgagatgagatacaaggccaccaccaaccagacctggaacttccccagaagccaccagaagcacagcaacatgacccacggcatcctgggctag

SEQ ID NO: 2069 - DNA, 669 bp, Artificial Sequence
  Description of Artificial Sequence: Synthetic coding sequence
atgaacatcagcatctactgccaggccgccatcaagaactgccagcccagaaagctgcacttctacaagaacggcatcaaggagagattccagatcaccagaatcaacaagaccaccgccagactgtggtacaagaacttcctggagccccacgccagcatgtactgcaccgccgagtgccccaagcacttccaggagaccctgatctgcggcaaggacatcagcagcggctacccccccgacatccccgacgaggtgacctgcgtgatctacgagtacagcggcaacatgacctgcacctggaacgccggcaagctgacctacatcgacaccaagtacgtggtgcacgtgaagagcctggagaccgaggaggagcagcagtacctgaccagcagctacatcaacatcagcaccgacagcctgcagggcggcaagaagtacctggtgtgggtgcaggccgccaacgccctgggcatggaggagagcaagcagctgcagatccacctggacgacatcgtgatccccagcgccgccgtgatcagcagagccgagaccatcaacgccaccgtgcccaagaccatcatctactgggacagccagaccaccatcgagaaggtgagctgcgagatgagatacaaggccaccaccaaccagacctggaacgactag

SEQ ID NO: 2070 - DNA, 1632 bp, Artificial Sequence
  Description of Artificial Sequence: Synthetic coding sequence
atggacgccttcaccggcagcggcctgaagagaaagttcgacgacgtggacgtgggcagcagcgtgagcaacagcgacgacgagatcagcagcagcgacagcgccgacagctgcgacagcctgaacccccccaccaccgccagcttcacccccaccagcatcctgaagagacagaagcagctgagaagaaagaacgtgagattcgaccaggtgaccgtgtactacttcgccagaagacagggcttcaccagcgtgcccagccagggcggcagcagcctgggcatggcccagagacacaacagcgtgagaagctacaccctgtgcgagttcgcccaggagcaggaggtgaaccacagagagatcctgagagagcacctgaaggaggagaagctgcacgccaagaagatgaagctgaccaagaacggcaccgtggagagcgtggaggccgacggcctgaccctggacgacgtgagcgacgaggacatcgacgtggagaacgtggaggtggacgactacttcttcctgcagcccctgcccaccaagagaagaagagccctgctgagagccagcggcgtgcacagaatcgacgccgaggagaagcaggagctgagagccatcagactgagcagagaggagtgcggctgcgactgcagactgtactgcgaccccgaggcctgcgcctgcagccaggccggcatcaagtgccaggtggacagaatgagcttcccctgcggctgcagcagagacggctgcggcaacatggccggcagaatcgagttcaaccccatcagagtgagaacccactacctgcacaccatcatgaagctggagctggagagcaagagacaggtgagcagacccgccgcccccgacgaggagcccagccccaccgccagctgcagcctgaccggcgcccagggcagcgagacccaggacttccaggagttcatcgccgagaacgagaccgccgtgatgcacctgcagagcgccgaggagctggagagactgaaggccgaggaggacagcagcggcagcagcgccagcctggacagcagcatcgagagcctgggcgtgtgcatcctggaggagcccctggccgtgcccgaggagctgtgccccggcctgaccgcccccatcctgatccaggcccagctgccccccggcagcagcgtgctgtgcttcaccgagaacagcgaccaccccaccgccagcaccgtgaacagccccagctacctgaacagcggccccctggtgtactaccaggtggagcagagacccgtgctgggcgtgaagggcgagcccggcaccgaggagggcagcgccagcttccccaaggagaaggacctgaacgtgttcagcctgcccgtgaccagcctggtggcctgcagcagcaccgaccccgccgccctgtgcaagagcgaggtgggcaagacccccaccctggaggccctgctgcccgaggactgcaaccccgaggagcccgagaacgaggacttccaccccagctggagccccagcagcctgcccttcagaaccgacaacgaggagggctgcggcatggtgaagaccagccagcagaacgaggacagaccccccgaggacagcagcctggagctgcccctggccgtgtag

SEQ ID NO: 2071 - DNA, 621 bp, Artificial Sequence
  Description of Artificial Sequence: Synthetic coding sequence
atgaacttccagcagagactgcagagcctgtggaccctggccagacccttctgcccccccctgctggccaccgccagccagatgcagatggtggtgctgccctgcctgggcttcaccctgctgctgtggagccaggtgagcggcgcccagggccaggagttccacttcggcccctgccaggtgaagggcgtggtgccccagaagctgtgggaggccttctgggccgtgaaggacaccatgcaggcccaggacaacatcaccagcgccagactgctgcagcaggaggtgctgcagaacgtgagcgacgccgagagctgctacctggtgcacaccctgctggagttctacctgaagaccgtgttcaagaactaccacaacagaaccgtggaggtgagaaccctgaagagcttcagcaccctggccaacaacttcgtgctgatcgtgagccagctgcagcccagccaggagaacgagatgttcagcatcagagacagcgcccacagaagattcctgctgttcagaagagccttcaagcagctggacgtggaggccgccctgaccaaggccctgggcgaggtggacatcctgctgacctggatgcagaagttctacaagctgtag

SEQ ID NO: 2072 - DNA, 465 bp, Artificial Sequence
  Description of Artificial Sequence: Synthetic coding sequence
atgaacttccagcagagactgcagagcctgtggaccctggccagcagacccttctgcccccccctgctggccaccgccagccagatgcagatggtggtgctgccctgcctgggcttcaccctgctgctgtggagccaggtgagcggcgcccagggccaggagttccacttcggcccctgccaggtgaagggcgtggtgccccagaagctgtgggaggccttctgggccgtgaaggacaccatgcaggcccaggacaacatcaccagcgccagactgctgcagcaggaggtgctgcagaacgtgagccaggagaacgagatgttcagcatcagagacagcgcccacagaagattcctgctgttcagaagagccttcaagcagctggacgtggaggccgccctgaccaaggccctgggcgaggtggacatcctgctgacctggatgcagaagttctacaagctgtag

SEQ ID NO: 2073 - DNA, 624 bp, Artificial Sequence
  Description of Artificial Sequence: Synthetic coding sequence
atgaacttccagcagagactgcagagcctgtggaccctggccagcagacccttctgcccccccctgctggccaccgccagccagatgcagatggtggtgctgccctgcctgggcttcaccctgctgctgtggagccaggtgagcggcgcccagggccaggagttccacttcggcccctgccaggtgaagggcgtggtgccccagaagctgtgggaggccttctgggccgtgaaggacaccatgcaggcccaggacaacatcaccagcgccagactgctgcagcaggaggtgctgcagaacgtgagcgacgccgagagctgctacctggtgcacaccctgctggagttctacctgaagaccgtgttcaagaactaccacaacagaaccgtggaggtgagaaccctgaagagcttcagcaccctggccaacaacttcgtgctgatcgtgagccagctgcagcccagccaggagaacgagatgttcagcatcagagacagcgcccacagaagattcctgctgttcagaagagccttcaagcagctggacgtggaggccgccctgaccaaggccctgggcgaggtggacatcctgctgacctggatgcagaagttctacaagctgtag

SEQ ID NO: 2074 - DNA, 534 bp, Artificial Sequence
  Description of Artificial Sequence: Synthetic coding sequence
atgagagagagacccagactgggcgaggacagcagcctgatcagcctgttcctgcaggtggtggccttcctggccatggtgatgggcacccacacctacagccactggcccagctgctgccccagcaagggccaggacaccagcgaggagctgctgagatggagcaccgtgcccgtgccccccctggagcccgccagacccaacagacaccccgagagctgcagagccagcgaggacggccccctgaacagcagagccatcagcccctggagatacgagctggacagagacctgaacagactgccccaggacctgtaccacgccagatgcctgtgcccccactgcgtgagcctgcagaccggcagccacatggaccccagaggcaacagcgagctgctgtaccacaaccagaccgtgttctacagaagaccctgccacggcgagaagggcacccacaagggctactgcctggagagaagactgtacagagtgagcctggcctgcgtgtgcgtgagacccagagtgatgggctag

SEQ ID NO: 2075 - DNA, 486 bp, Artificial Sequence
  Description of Artificial Sequence: Synthetic coding sequence
atgtaccaggtggtggccttcctggccatggtgatgggcacccacacctacagccactggcccagctgctgccccagcaagggccaggacaccagcgaggagctgctgagatggagcaccgtgcccgtgccccccctggagcccgccagacccaacagacaccccgagagctgcagagccagcgaggacggccccctgaacagcagagccatcagcccctggagatacgagctggacagagacctgaacagactgccccaggacctgtaccacgccagatgcctgtgcccccactgcgtgagcctgcagaccggcagccacatggaccccagaggcaacagcgagctgctgtaccacaaccagaccgtgttctacagaagaccctgccacggcgagaagggcacccacaagggctactgcctggagagaagactgtacagagtgagcctggcctgcgtgtgcgtgagacccagagtgatgggctag

SEQ ID NO: 2076 - DNA, 2775 bp, Artificial Sequence
  Description of Artificial Sequence: Synthetic coding sequence
atggacgtgctgcccaccggcggcggcagacccggcctgagaaccgagctggagttcagaggcggcggcggcgaggccagactggagagccaggaggaggagaccatccccgccgccccccccgcccccagactgagaggcgccgccgagagacccagaagaagcagagacacctgggacggcgacgaggacaccgagcccggcgaggcctgcggcggcagaaccagcagaaccgccagcctggtgagcggcctgctgaacgagctgtacagctgcaccgaggaggaggaggccgccggcggcggcagaggcgccgagggcagaagaagaagaagagacagcctggacagcagcaccgaggccagcggcagcgacgtggtgctgggcggcagaagcggcgccggcgacagcagagtgctgcaggagctgcaggagagacccagccagagacaccagatgctgtacctgagacagaaggacgccaacgagctgaagaccatcctgagagagctgaagtacagaatcggcatccagagcgccaagctgctgagacacctgaagcagaaggacagactgctgcacaaggtgcagagaaactgcgacatcgtgaccgcctgcctgcaggccgtgagccagaagagaagagtggacaccaagctgaagttcaccctggagcccagcctgggccagaacggcttccagcagtggtacgacgccctgaaggccgtggccagactgagcaccggcatccccaaggagtggagaagaaaggtgtggctgaccctggccgaccactacctgcacagcatcgccatcgactgggacaagaccatgagattcaccttcaacgagagaagcaaccccgacgacgacagcatgggcatccagatcgtgaaggacctgcacagaaccggctgcagcagctactgcggccaggaggccgagcaggacagagtggtgctgaagagagtgctgctggcctacgccagatggaacaagaccgtgggctactgccagggcttcaacatcctggccgccctgatcctggaggtgatggagggcaacgagggcgacgccctgaagatcatgatctacctgatcgacaaggtgctgcccgagagctacttcgtgaacaacctgagagccctgagcgtggacatggccgtgttcagagacctgctgagaatgaagctgcccgagctgagccagcacctggacaccctgcagagaaccgccaacaaggagagcggcggcggctacgagccccccctgaccaacgtgttcaccatgcagtggttcctgaccctgttcgccacctgcctgcccaaccagaccgtgctgaagatctgggacagcgtgttcttcgagggcagcgagatcatcctgagagtgagcctggccatctgggccaagctgggcgagcagatcgagtgctgcgagaccgccgacgagttctacagcaccatgggcagactgacccaggagatgctggagaacgacctgctgcagagccacgagctgatgcagaccgtgtacagcatggcccccttccccttcccccagctggccgagctgagagagaagtacacctacaacatcacccccttccccgccaccgtgaagcccaccagcgtgagcggcagacacagcaaggccagagacagcgacgaggagaacgaccccgacgacgaggacgccgtggtgaacgccgtgggctgcctgggccccttcagcggcttcctggcccccgagctgcagaagtaccagaagcagatcaaggagcccaacgaggagcagagcctgagaagcaacaacatcgccgagctgagccccggcgccatcaacagctgcagaagcgagtaccacgccgccttcaacagcatgatgatggagagaatgaccaccgacatcaacgccctgaagagacagtacagcagaatcaagaagaagcagcagcagcaggtgcaccaggtgtacatcagagccgacaagggccccgtgaccagcatcctgcccagccaggtgaacagcagccccgtgatcaaccacctgctgctgggcaagaagatgaagatgaccaacagagccgccaagaacgccgtgatccacatccccggccacaccggcggcaagatcagccccgtgccctacgaggacctgaagaccaagctgaacagcccctggagaacccacatcagagtgcacaagaagaacatgcccagaaccaagagccaccccggctgcggcgacaccgtgggcctgatcgacgagcagaacgaggccagcaagaccaacggcctgggcgccgccgaggccttccccagcggctgcaccgccaccgccggcagagagggcagcagccccgagggcagcaccagaagaaccatcgagggccagagccccgagcccgtgttcggcgacgccgacgtggacgtgagcgccgtgcaggccaagctgggcgccctggagctgaaccagagagacgccgccgccgagaccgagctgagagtgcaccccccctgccagagacactgccccgagccccccagcgcccccgaggagaacaaggccaccagcaaggccccccagggcagcaacagcaagacccccatcttcagccccttccccagcgtgaagcccctgagaaagagcgccaccgccagaaacctgggcctgtacggccccaccgagagaacccccaccgtgcacttcccccagatgagcagaagcttcagcaagcccggcggcggcaacagcggcaccaagaagagatag

SEQ ID NO: 2077 - DNA, 732 bp, Artificial Sequence
  Description of Artificial Sequence: Synthetic coding sequence
atgggccagaccgccggcgacctgggctggagactgagcctgctgctgctgcccctgctgctggtgcaggccggcgtgtggggcttccccagaccccccggcagaccccagctgagcctgcaggagctgagaagagagttcaccgtgagcctgcacctggccagaaagctgctgagcgaggtgagaggccaggcccacagattcgccgagagccacctgcccggcgtgaacctgtacctgctgcccctgggcgagcagctgcccgacgtgagcctgaccttccaggcctggagaagactgagcgaccccgagagactgtgcttcatcagcaccaccctgcagcccttccacgccctgctgggcggcctgggcacccagggcagatggaccaacatggagagaatgcagctgtgggccatgagactggacctgagagacctgcagagacacctgagattccaggtgctggccgccggcttcaacctgcccgaggaggaggaggaggaggaggaggaggaggaggaggagagaaagggcctgctgcccggcgccctgggcagcgccctgcagggccccgcccaggtgagctggccccagctgctgagcacctacagactgctgcacagcctggagctggtgctgagcagagccgtgagagagctgctgctgctgagcaaggccggccacagcgtgtggcccctgggcttccccaccctgagcccccagccctag

SEQ ID NO: 2078 - DNA, 603 bp, Artificial Sequence
  Description of Artificial Sequence: Synthetic coding sequence
atgaagctggacatgaccggcgactgcacccccgtgctggtgctgatggccgccgtgctgaccgtgaccggcgccgtgcccgtggccagactgcacggcgccctgcccgacgccagaggctgccacatcgcccagttcaagagcctgagcccccaggagctgcaggccttcaagagagccaaggacgccctggaggagagcctgctgctgaaggactgcagatgccacagcagactgttccccagaacctgggacctgagacagctgcaggtgagagagagacccatggccctggaggccgagctggccctgaccctgaaggtgctggaggccaccgccgacaccgaccccgccctggtggacgtgctggaccagcccctgcacaccctgcaccacatcctgagccagttcagagcctgcatccagccccagcccaccgccggccccagaaccagaggcagactgcaccactggctgtacagactgcaggaggcccccaagaaggagagccccggctgcctggaggccagcgtgaccttcaacctgttcagactgctgaccagagacctgaactgcgtggccagcggcgacctgtgcgtgtag

SEQ ID NO: 2079 - DNA, 591 bp, Artificial Sequence
  Description of Artificial Sequence: Synthetic coding sequence
atgaccggcgactgcatgcccgtgctggtgctgatggccgccgtgctgaccgtgaccggcgccgtgcccgtggccagactgagaggcgccctgcccgacgccagaggctgccacatcgcccagttcaagagcctgagcccccaggagctgcaggccttcaagagagccaaggacgccctggaggagagcctgctgctgaaggactgcaagtgcagaagcagactgttccccagaacctgggacctgagacagctgcaggtgagagagagacccgtggccctggaggccgagctggccctgaccctgaaggtgctggaggccaccgccgacaccgaccccgccctgggcgacgtgctggaccagcccctgcacaccctgcaccacatcctgagccagctgagagcctgcatccagccccagcccaccgccggccccagaaccagaggcagactgcaccactggctgcacagactgcaggaggcccccaagaaggagagccccggctgcctggaggccagcgtgaccttcaacctgttcagactgctgaccagagacctgaactgcgtggccagcggcgacctgtgcgtgtag

SEQ ID NO: 2080 - DNA, 603 bp, Artificial Sequence
  Description of Artificial Sequence: Synthetic coding sequence
atggccgccgcctggaccgtggtgctggtgaccctggtgctgggcctggccgtggccggccccgtgcccaccagcaagcccaccaccaccggcaagggctgccacatcggcagattcaagagcctgagcccccaggagctggccagcttcaagaaggccagagacgccctggaggagagcctgaagctgaagaactggagctgcagcagccccgtgttccccggcaactgggacctgagactgctgcaggtgagagagagacccgtggccctggaggccgagctggccctgaccctgaaggtgctggaggccgccgccggccccgccctggaggacgtgctggaccagcccctgcacaccctgcaccacatcctgagccagctgcaggcctgcatccagccccagcccaccgccggccccagacccagaggcagactgcaccactggctgcacagactgcaggaggcccccaagaaggagagcgccggctgcctggaggccagcgtgaccttcaacctgttcagactgctgaccagagacctgaagtacgtggccgacggcaacctgtgcctgagaaccagcacccaccccgagagcacctag

SEQ ID NO: 2081 - DNA, 495 bp, Artificial Sequence
  Description of Artificial Sequence: Synthetic coding sequence
atggccagccacagcggccccagcaccagcgtgctgttcctgttctgctgcctgggcggctggctggccagccacaccctgcccgtgagactgctgagacccagcgacgacgtgcagaagatcgtggaggagctgcagagcctgagcaagatgctgctgaaggacgtggaggaggagaagggcgtgctggtgagccagaactacaccctgccctgcctgagccccgacgcccagccccccaacaacatccacagccccgccatcagagcctacctgaagaccatcagacagctggacaacaagagcgtgatcgacgagatcatcgagcacctggacaagctgatcttccaggacgcccccgagaccaacatcagcgtgcccaccgacacccacgagtgcaagagattcatcctgaccatcagccagcagttcagcgagtgcatggacctggccctgaagagcctgaccagcggcgcccagcaggccaccacctag

SEQ ID NO: 2082 - DNA, 507 bp, Artificial Sequence
  Description of Artificial Sequence: Synthetic coding sequence
atgtgcttccccaaggtgctgagcgacgacatgaagaagctgaaggccagaatggtgatgagcagcctggccgagctggaggacgacttcaaggagggctacctggagaccgtggccgcctactacgaggagcagcaccccgagctgacccccctgctggagaaggagagagacggcctgagatgcagaggcaacagaagccccgtgcccgacgtggaggaccccgccaccgaggagcccggcgagagcttctgcgacaaggtgatgagatggttccaggccatgctgcagagactgcagacctggtggcacggcgtgctggcctgggtgaaggagaaggtggtggccctggtgcacgccgtgcaggccctgtggaagcagttccagagcttctgctgcagcctgagcgagctgttcatgagcagcttccagagctacggcgcccccagaggcgacaaggaggagctgaccccccagaagtgcagcgagccccagagcagcaagtag

SEQ ID NO: 2083 - DNA, 567 bp, Artificial Sequence
  Description of Artificial Sequence: Synthetic coding sequence
atgtgcttccccaaggtgctgagcgacgacatgaagaagctgaaggccagaatgcaccaggccatcgagagattctacgacaagatgcagaacgccgagagcggcagaggccaggtgatgagcagcctggccgagctggaggacgacttcaaggagggctacctggagaccgtggccgcctactacgaggagcagcaccccgagctgacccccctgctggagaaggagagagacggcctgagatgcagaggcaacagaagccccgtgcccgacgtggaggaccccgccaccgaggagcccggcgagagcttctgcgacaaggtgatgagatggttccaggccatgctgcagagactgcagacctggtggcacggcgtgctggcctgggtgaaggagaaggtggtggccctggtgcacgccgtgcaggccctgtggaagcagttccagagcttctgctgcagcctgagcgagctgttcatgagcagcttccagagctacggcgcccccagaggcgacaaggaggagctgaccccccagaagtgcagcgagccccagagcagcaagtag

SEQ ID NO: 2084 - DNA, 540 bp, Artificial Sequence
  Description of Artificial Sequence: Synthetic coding sequence
atgtgcttccccaaggtgctgagcgacgacatgaagaagctgaaggccagaatgcaccaggccatcgagagattctacgacaagatgcagaacgccgagagcggcagaggccaggacgacttcaaggagggctacctggagaccgtggccgcctactacgaggagcagcaccccgagctgacccccctgctggagaaggagagagacggcctgagatgcagaggcaacagaagccccgtgcccgacgtggaggaccccgccaccgaggagcccggcgagagcttctgcgacaaggtgatgagatggttccaggccatgctgcagagactgcagacctggtggcacggcgtgctggcctgggtgaaggagaaggtggtggccctggtgcacgccgtgcaggccctgtggaagcagttccagagcttctgctgcagcctgagcgagctgttcatgagcagcttccagagctacggcgcccccagaggcgacaaggaggagctgaccccccagaagtgcagcgagccccagagcagcaagtag

SEQ ID NO: 2085 - DNA, 396 bp, Artificial Sequence
  Description of Artificial Sequence: Synthetic coding sequence
atgtgcttccccaaggtgctgagcgacgacatgaagaagctgaaggccagaatgcaccaggccatcgagagattctacgacaagatgcagaacgccgagagcggcagaggccaggtgatgagcagcctggccgagctggaggacgacttcaaggagggctacctggagaccgtggccgcctactacgaggagcagcaccccgagctgacccccctgctggagaaggagagagacggcctgagatgcagaggcaacagaagccccgtgcccgacgtggaggaccccgccaccgaggagcccggcgagagcttctgcgacaagagctacggcgcccccagaggcgacaaggaggagctgaccccccagaagtgcagcgagccccagagcagcaagtag

SEQ ID NO: 2086 - DNA, 705 bp, Artificial Sequence
  Description of Artificial Sequence: Synthetic coding sequence
atgtgcttccccaaggtgctgagcgacgacatgaagaagctgaaggccagaatggtgatgctgctgcccaccagcgcccagggcctgggcgcctgggtgagcgcctgcgacaccgaggacaccgtgggccacctgggcccctggagagacaaggaccccgccctgtggtgccagctgtgcctgagcagccagcaccaggccatcgagagattctacgacaagatgcagaacgccgagagcggcagaggccaggtgatgagcagcctggccgagctggaggacgacttcaaggagggctacctggagaccgtggccgcctactacgaggagcagcaccccgagctgacccccctgctggagaaggagagagacggcctgagatgcagaggcaacagaagccccgtgcccgacgtggaggaccccgccaccgaggagcccggcgagagcttctgcgacaaggtgatgagatggttccaggccatgctgcagagactgcagacctggtggcacggcgtgctggcctgggtgaaggagaaggtggtggccctggtgcacgccgtgcaggccctgtggaagcagttccagagcttctgctgcagcctgagcgagctgttcatgagcagcttccagagctacggcgcccccagaggcgacaaggaggagctgaccccccagaagtgcagcgagccccagagcagcaagtag

SEQ ID NO: 2087 - DNA, 567 bp, Artificial Sequence; identical to SEQ ID NO: 2083
  Description of Artificial Sequence: Synthetic coding sequence

SEQ ID NO: 2088 - DNA, 567 bp, Artificial Sequence; identical to SEQ ID NO: 2083
  Description of Artificial Sequence: Synthetic coding sequence

SEQ ID NO: 2089 - DNA, 567 bp, Artificial Sequence; identical to SEQ ID NO: 2083
  Description of Artificial Sequence: Synthetic coding sequence

SEQ ID NO: 2090 - DNA, 567 bp, Artificial Sequence; identical to SEQ ID NO: 2083
  Description of Artificial Sequence: Synthetic coding sequence

SEQ ID NO: 2091 - DNA, 567 bp, Artificial Sequence; identical to SEQ ID NO: 2083
  Description of Artificial Sequence: Synthetic coding sequence

SEQ ID NO: 2092 - DNA, 567 bp, Artificial Sequence; identical to SEQ ID NO: 2083
  Description of Artificial Sequence: Synthetic coding sequence

SEQ ID NO: 2093 - DNA, 567 bp, Artificial Sequence; identical to SEQ ID NO: 2083
  Description of Artificial Sequence: Synthetic coding sequence

SEQ ID NO: 2094 - DNA, 507 bp, Artificial Sequence; identical to SEQ ID NO: 2082
  Description of Artificial Sequence: Synthetic coding sequence

SEQ ID NO: 2095 - DNA, 537 bp, Artificial Sequence
  Description of Artificial Sequence: Synthetic coding sequence
atgaagaagctgaaggccagaatgcaccaggccatcgagagattctacgacaagatgcagaacgccgagagcggcagaggccaggtgatgagcagcctggccgagctggaggacgacttcaaggagggctacctggagaccgtggccgcctactacgaggagcagcaccccgagctgacccccctgctggagaaggagagagacggcctgagatgcagaggcaacagaagccccgtgcccgacgtggaggaccccgccaccgaggagcccggcgagagcttctgcgacaaggtgatgagatggttccaggccatgctgcagagactgcagacctggtggcacggcgtgctggcctgggtgaaggagaaggtggtggccctggtgcacgccgtgcaggccctgtggaagcagttccagagcttctgctgcagcctgagcgagctgttcatgagcagcttccagagctacggcgcccccagaggcgacaaggaggagctgaccccccagaagtgcagcgagccccagagcagcaagtag

SEQ ID NO: 2096 - DNA, 567 bp, Artificial Sequence; identical to SEQ ID NO: 2083
  Description of Artificial Sequence: Synthetic coding sequence

SEQ ID NO: 2097 - DNA, 705 bp, Artificial Sequence; identical to SEQ ID NO: 2086
  Description of Artificial Sequence: Synthetic coding sequence

SEQ ID NO: 2098 - DNA, 705 bp, Artificial Sequence; identical to SEQ ID NO: 2086
  Description of Artificial Sequence: Synthetic coding sequence

SEQ ID NO: 2099 - DNA, 540 bp, Artificial Sequence; identical to SEQ ID NO: 2084
  Description of Artificial Sequence: Synthetic coding sequence

SEQ ID NO: 2100 - DNA, 678 bp, Artificial Sequence
  Description of Artificial Sequence: Synthetic coding sequence
atgtgcttccccaaggtgctgagcgacgacatgaagaagctgaaggccagaatggtgatgctgctgcccaccagcgcccagggcctgggcgcctgggtgagcgcctgcgacaccgaggacaccgtgggccacctgggcccctggagagacaaggaccccgccctgtggtgccagctgtgcctgagcagccagcaccaggccatcgagagattctacgacaagatgcagaacgccgagagcggcagaggccaggtgatgagcagcctggccgagctggaggacgacttcaaggagggctacctggagaccgtggccgcctactacgaggagcagcaccccgagctgacccccctgctggagaaggagagagacggcctgagatgcagaggcaacagaagccccgtgcccgacgtggaggaccccgccaccgaggagcccggcgagagcttctgcgacaaggtgatgagatggttccaggccatgctgcagagactgcagacctggtggcacggcgtgctggcctgggtgaaggagaaggtggtggccctggtgcacgccgtgcaggccctgtggaagcagttccagagcttctgctgcagcctgagcgagctgttcatgagcagcttccagagctacggcgcccccagaggcgacaaggaggagctgaccccccagtag

SEQ ID NO: 2101 - DNA, 396 bp, Artificial Sequence; identical to SEQ ID NO: 2085
  Description of Artificial Sequence: Synthetic coding sequence

SEQ ID NO: 2102 - DNA, 396 bp, Artificial Sequence; identical to SEQ ID NO: 2085
  Description of Artificial Sequence: Synthetic coding sequence

SEQ ID NO: 2103 - DNA, 507 bp, Artificial Sequence; identical to SEQ ID NO: 2082
  Description of Artificial Sequence: Synthetic coding sequence

SEQ ID NO: 2104 - DNA, 567 bp, Artificial Sequence; identical to SEQ ID NO: 2083
  Description of Artificial Sequence: Synthetic coding sequence

SEQ ID NO: 2105 - DNA, 813 bp, Artificial Sequence
  Description of Artificial Sequence: Synthetic coding sequence
atgaagcccaagatgaagtacagcaccaacaagatcagcaccgccaagtggaagaacaccgccagcaaggccctgtgcttcaagctgggcaagagccagcagaaggccaaggaggtgtgccccatgtacttcatgaagctgagaagcggcctgatgatcaagaaggaggcctgctacttcagaagagagaccaccaagagacccagcctgaagaccggcagaaagcacaagagacacctggtgctggccgcctgccagcagcagagcaccgtggagtgcttcgccttcggcatcagcggcgtgcagaagtacaccagagccctgcacgacagcagcatcaccggcatcagccccatcaccgagtacctggccagcctgagcacctacaacgaccagagcatcaccttcgccctggaggacgagagctacgagatctacgtggaggacctgaagaaggacgagaagaaggacaaggtgctgctgagctactacgagagccagcaccccagcaacgagagcggcgacggcgtggacggcaagatgctgatggtgaccctgagccccaccaaggacttctggctgcacgccaacaacaaggagcacagcgtggagctgcacaagtgcgagaagcccctgcccgaccaggccttcttcgtgctgcacaacatgcacagcaactgcgtgagcttcgagtgcaagaccgaccccggcgtgttcatcggcgtgaaggacaaccacctggccctgatcaaggtggacagcagcgagaacctgtgcaccgagaacatcctgttcaagctgagcgagacctag

SEQ ID NO: 2106 - DNA, 435 bp, Artificial Sequence
  Description of Artificial Sequence: Synthetic coding sequence
atgaagcccaagatgaagtacagcaccaacaagatcagcaccgccaagtggaagaacaccgccagcaaggccctgtgcttcaagctgggcaacaaggtgctgctgagctactacgagagccagcaccccagcaacgagagcggcgacggcgtggacggcaagatgctgatggtgaccctgagccccaccaaggacttctggctgcacgccaacaacaaggagcacagcgtggagctgcacaagtgcgagaagcccctgcccgaccaggccttcttcgtgctgcacaacatgcacagcaactgcgtgagcttcgagtgcaagaccgaccccggcgtgttcatcggcgtgaaggacaaccacctggccctgatcaaggtggacagcagcgagaacctgtgcaccgagaacatcctgttcaagctgagcgagacctag

SEQ ID NO: 2107 - DNA, 687 bp, Artificial Sequence
  Description of Artificial Sequence: Synthetic coding sequence
atgaagcccaagatgaagtacagcaccaacaagatcagcaccgccaagtggaagaacaccgccagcaaggccctgtgcttcaagctgggcaagagccagcagaaggccaaggaggtgtgccccatgtacttcatgaagctgagaagcggcctgatgatcaagaaggaggcctgctacttcagaagagagaccaccaagagacccagcctgaagaccggcagaaagcacaagagacacctggtgctggccgcctgccagcagcagagcaccgtggagtgcttcgccttcggcatcagcggcgtgcagaagtacaccagagccctgcacgacagcagcatcaccgacaaggtgctgctgagctactacgagagccagcaccccagcaacgagagcggcgacggcgtggacggcaagatgctgatggtgaccctgagccccaccaaggacttctggctgcacgccaacaacaaggagcacagcgtggagctgcacaagtgcgagaagcccctgcccgaccaggccttcttcgtgctgcacaacatgcacagcaactgcgtgagcttcgagtgcaagaccgaccccggcgtgttcatcggcgtgaaggacaaccacctggccctgatcaaggtggacagcagcgagaacctgtgcaccgagaacatcctgttcaagctgagcgagacctag

SEQ ID NO: 2108 - DNA, 729 bp, Artificial Sequence
  Description of Artificial Sequence: Synthetic coding sequence
atgcccagaggcttcacctggctgagatacctgggcatcttcctgggcgtggccctgggcaacgagcccctggagatgtggcccctgacccagaacgaggagtgcaccgtgaccggcttcctgagagacaagctgcagtacagaagcagactgcagtacatgaagcactacttccccatcaactacaagatcagcgtgccctacgagggcgtgttcagaatcgccaacgtgaccagactgcagagagcccaggtgagcgagagagagctgagatacctgtgggtgctggtgagcctgagcgccaccgagagcgtgcaggacgtgctgctggagggccaccccagctggaagtacctgcaggaggtggagaccctgctgctgaacgtgcagcagggcctgaccgacgtggaggtgagccccaaggtggagagcgtgctgagcctgctgaacgcccccggccccaacctgaagctggtgagacccaaggccctgctggacaactgcttcagagtgatggagctgctgtactgcagctgctgcaagcagagcagcgtgctgaactggcaggactgcgaggtgcccagcccccagagctgcagccccgagcccagcctgcagtacgccgccacccagctgtaccccccccccccctggagccccagcagccccccccacagcaccggcagcgtgagacccgtgagagcccagggcgagggcctgctgccctag

SEQ ID NO: 2109 - DNA, 729 bp, Artificial Sequence; identical to SEQ ID NO: 2108
  Description of Artificial Sequence: Synthetic coding sequence

SEQ ID NO: 2110 - DNA, 477 bp, Artificial Sequence
  Description of Artificial Sequence: Synthetic coding sequence
atggagaaggccctgaagatcgacaccccccagcagggcagcatccaggacatcaaccacagagtgtgggtgctgcaggaccagaccctgatcgccgtgcccagaaaggacagaatgagccccgtgaccatcgccctgatcagctgcagacacgtggagaccctggagaaggacagaggcaaccccatctacctgggcctgaacggcctgaacctgtgcctgatgtgcgccaaggtgggcgaccagcccaccctgcagctgaaggagaaggacatcatggacctgtacaaccagcccgagcccgtgaagagcttcctgttctaccacagccagagcggcagaaacagcaccttcgagagcgtggccttccccggctggttcatcgccgtgagcagcgagggcggctgccccctgatcctgacccaggagctgggcaaggccaacaccaccgacttcggcctgaccatgctgttctag

SEQ ID NO: 2111 - DNA, 132 bp, Artificial Sequence
  Description of Artificial Sequence: Synthetic coding sequence
agcaccttcgagagcgtggccttccccggctggttcatcgccgtgagcagcgagggcggctgccccctgatcctgacccaggagctgggcaaggccaacaccaccgacttcggcctgatcctggtggagtag

SEQ ID NO: 2112 - DNA, 495 bp, Artificial Sequence
  Description of Artificial Sequence: Synthetic coding sequence
atgaacccccagagagaggccgcccccaagagctacgccatcagagacagcagacagatggtgtgggtgctgagcggcaacagcctgatcgccgcccccctgagcagaagcatcaagcccgtgaccctgcacctgatcgcctgcagagacaccgagttcagcgacaaggagaagggcaacatggtgtacctgggcatcaagggcaaggacctgtgcctgttctgcgccgagatccagggcaagcccaccctgcagctgaagctgcagggcagccaggacaacatcggcaaggacacctgctggaagctggtgggcatccacacctgcatcaacctggacgtgagagagagctgcttcatgggcaccctggaccagtggggcatcggcgtgggcagaaagaagtggaagagcagcttccagcaccaccacctgagaaagaaggacaaggacttcagcagcatgagaaccaacatcggcatgcccggcagaatgtag

SEQ ID NO: 2113 - DNA, 474 bp, Artificial Sequence
  Description of Artificial Sequence: Synthetic coding sequence
atgaacccccagagagaggccgcccccaagagctacgccatcagagacagcagacagatggtgtgggtgctgagcggcaacagcctgatcgccgcccccctgagcagaagcatcaagcccgtgaccctgcacctgatcgcctgcagagacaccgagttcagcgacaaggagaagggcaacatggtgtacctgggcatcaagggcaaggacctgtgcctgttctgcgccgagatccagggcaagcccaccctgcagctgaaggagaagaacatcatggacctgtacgtggagaagaaggcccagaagcccttcctgttcttccacaacaaggagggcagcaccagcgtgttccagagcgtgagctaccccggctggttcatcgccaccagcaccaccagcggccagcccatcttcctgaccaaggagagaggcatcaccaacaacaccaacttctacctggacagcgtggagtag

SEQ ID NO: 2114 - DNA, 510 bp, Artificial Sequence
  Description of Artificial Sequence: Synthetic coding sequence
atgagaggcacccccggcgacgccgacggcggcggcagagccgtgtaccagagcatgtgcaagcccatcaccggcaccatcaacgacctgaaccagcaggtgtggaccctgcagggccagaacctggtggccgtgcccagaagcgacagcgtgacccccgtgaccgtggccgtgatcacctgcaagtaccccgaggccctggagcagggcagaggcgaccccatctacctgggcatccagaaccccgagatgtgcctgtactgcgagaaggtgggcgagcagcccaccctgcagctgaaggagcagaagatcatggacctgtacggccagcccgagcccgtgaagcccttcctgttctacagagccaagaccggcagaaccagcaccctggagagcgtggccttccccgactggttcatcgccagcagcaagagagaccagcccatcatcctgaccagcgagctgggcaagagctacaacaccgccttcgagctgaacatcaacgactag

SEQ ID NO: 2115 - DNA, 117 bp, Artificial Sequence
  Description of Artificial Sequence: Synthetic coding sequence
atgagaggcacccccggcgacgccgacggcggcggcagagccgtgtaccagagcatgtgcaagcccatcaccggcaccatcaacgacctgaaccagcaggtgtggaccctgcagtag

SEQ ID NO: 2116 - DNA, 657 bp, Artificial Sequence
  Description of Artificial Sequence: Synthetic coding sequence
atgagcttcgtgggcgagaacagcggcgtgaagatgggcagcgaggactgggagaaggacgagccccagtgctgcctggaggaccccgccggcagccccctggagcccggccccagcctgcccaccatgaacttcgtgcacaccagccccaaggtgaagaacctgaaccccaagaagttcagcatccacgaccaggaccacaaggtgctggtgctggacagcggcaacctgatcgccgtgcccgacaagaactacatcagacccgagatcttcttcgccctggccagcagcctgagcagcgccagcgccgagaagggcagccccatcctgctgggcgtgagcaagggcgagttctgcctgtactgcgacaaggacaagggccagagccaccccagcctgcagctgaagaaggagaagctgatgaagctggccgcccagaaggagagcgccagaagacccttcatcttctacagagcccaggtgggcagctggaacatgctggagagcgccgcccaccccggctggttcatctgcaccagctgcaactgcaacgagcccgtgggcgtgaccgacaagttcgagaacagaaagcacatcgagttcagcttccagcccgtgtgcaaggccgagatgagccccagcgaggtgagcgactag

SEQ ID NO: 2117 - DNA, 579 bp, Artificial Sequence
  Description of Artificial Sequence: Synthetic coding sequence
atgagcggctgcgacagaagagagaccgagaccaagggcaagaacagcttcaagaagagactgagaggccccaaggtgaagaacctgaaccccaagaagttcagcatccacgaccaggaccacaaggtgctggtgctggacagcggcaacctgatcgccgtgcccgacaagaactacatcagacccgagatcttcttcgccctggccagcagcctgagcagcgccagcgccgagaagggcagccccatcctgctgggcgtgagcaagggcgagttctgcctgtactgcgacaaggacaagggccagagccaccccagcctgcagctgaagaaggagaagctgatgaagctggccgcccagaaggagagcgccagaagacccttcatcttctacagagcccaggtgggcagctggaacatgctggagagcgccgcccaccccggctggttcatctgcaccagctgcaactgcaacgagcccgtgggcgtgaccgacaagttcgagaacagaaagcacatcgagttcagcttccagcccgtgtgcaaggccgagatgagccccagcgaggtgagcgactag

SEQ ID NO: 2118 - DNA, 474 bp, Artificial Sequence
  Description of Artificial Sequence: Synthetic coding sequence
atgagcttcgtgggcgagaacagcggcgtgaagatgggcagcgaggactgggagaaggacgagccccagtgctgcctggaggagatcttcttcgccctggccagcagcctgagcagcgccagcgccgagaagggcagccccatcctgctgggcgtgagcaagggcgagttctgcctgtactgcgacaaggacaagggccagagccaccccagcctgcagctgaagaaggagaagctgatgaagctggccgcccagaaggagagcgccagaagacccttcatcttctacagagcccaggtgggcagctggaacatgctggagagcgccgcccaccccggctggttcatctgcaccagctgcaactgcaacgagcccgtgggcgtgaccgacaagttcgagaacagaaagcacatcgagttcagcttccagcccgtgtgcaaggccgagatgagccccagcgaggtgagcgactag

SEQ ID NO: 2119 - DNA, 594 bp, Artificial Sequence
  Description of Artificial Sequence: Synthetic coding sequence
atgagcttcgtgggcgagaacagcggcgtgaagatgggcagcgaggactgggagaaggacgagccccagtgctgcctggagggccccaaggtgaagaacctgaaccccaagaagttcagcatccacgaccaggaccacaaggtgctggtgctggacagcggcaacctgatcgccgtgcccgacaagaactacatcagacccgagatcttcttcgccctggccagcagcctgagcagcgccagcgccgagaagggcagccccatcctgctgggcgtgagcaagggcgagttctgcctgtactgcgacaaggacaagggccagagccaccccagcctgcagctgaagaaggagaagctgatgaagctggccgcccagaaggagagcgccagaagacccttcatcttctacagagcccaggtgggcagctggaacatgctggagagcgccgcccaccccggctggttcatctgcaccagctgcaactgcaacgagcccgtgggcgtgaccgacaagttcgagaacagaaagcacatcgagttcagcttccagcccgtgtgcaaggccgagatgagccccagcgaggtgagcgactag

SEQ ID NO: 2120 - DNA, 537 bp, Artificial Sequence
  Description of Artificial Sequence: Synthetic coding sequence
atgagcttcgtgggcgagaacagcggcgtgaagatgggcagcgaggactgggagaaggacgagccccagtgctgcctggaggaccccgccggcagccccctggagcccggccccagcctgcccaccatgaacttcgtgcacaccaagatcttcttcgccctggccagcagcctgagcagcgccagcgccgagaagggcagccccatcctgctgggcgtgagcaagggcgagttctgcctgtactgcgacaaggacaagggccagagccaccccagcctgcagctgaagaaggagaagctgatgaagctggccgcccagaaggagagcgccagaagacccttcatcttctacagagcccaggtgggcagctggaacatgctggagagcgccgcccaccccggctggttcatctgcaccagctgcaactgcaacgagcccgtgggcgtgaccgacaagttcgagaacagaaagcacatcgagttcagcttccagcccgtgtgcaaggccgagatgagccccagcgaggtgagcgactag

SEQ ID NO: 2121 - DNA, 1770 bp, Artificial Sequence
  Description of Artificial Sequence: Synthetic coding sequence
atgcccaacgacgacttctgccccggcctgaccatcaaggccatgggcgccgagagagccccccagagacagccctgcaccctgcacctgctggtgctggtgcccatcctgctgagcctggtggccagccaggactggaaggccgagagaagccaggaccccttcgagaagtgcatgcaggaccccgactacgagcagctgctgaaggtggtgacctggggcctgaacagaaccctgaagccccagagagtgatcgtggtgggcgccggcgtggccggcctggtggccgccaaggtgctgagcgacgccggccacaaggtgaccatcctggaggccgacaacagaatcggcggcagaatcttcacctacagagaccagaacaccggctggatcggcgagctgggcgccatgagaatgcccagcagccacagaatcctgcacaagctgtgccagggcctgggcctgaacctgaccaagttcacccagtacgacaagaacacctggaccgaggtgcacgaggtgaagctgagaaactacgtggtggagaaggtgcccgagaagctgggctacgccctgagaccccaggagaagggccacagccccgaggacatctaccagatggccctgaaccaggccctgaaggacctgaaggccctgggctgcagaaaggccatgaagaagttcgagagacacaccctgctggagtacctgctgggcgagggcaacctgagcagacccgccgtgcagctgctgggcgacgtgatgagcgaggacggcttcttctacctgagcttcgccgaggccctgagagcccacagctgcctgagcgacagactgcagtacagcagaatcgtgggcggctgggacctgctgcccagagccctgctgagcagcctgagcggcctggtgctgctgaacgcccccgtggtggccatgacccagggcccccacgacgtgcacgtgcagatcgagaccagcccccccgccagaaacctgaaggtgctgaaggccgacgtggtgctgctgaccgccagcggccccgccgtgaagagaatcaccttcagcccccccctgcccagacacatgcaggaggccctgagaagactgcactacgtgcccgccaccaaggtgttcctgagcttcagaagacccttctggagagaggagcacatcgagggcggccacagcaacaccgacagacccagcagaatgatcttctaccccccccccagagagggcgccctgctgctggccagctacacctggagcgacgccgccgccgccttcgccggcctgagcagagaggaggccctgagactggccctggacgacgtggccgccctgcacggccccgtggtgagacagctgtgggacggcaccggcgtggtgaagagatgggccgaggaccagcacagccagggcggcttcgtggtgcagccccccgccctgtggcagaccgagaaggacgactggaccgtgccctacggcagaatctacttcgccggcgagcacaccgcctacccccacggctgggtggagaccgccgtgaagagcgccctgagagccgccatcaagatcaacagcagaaagggccccgccagcgacaccgccagccccgagggccacgccagcgacatggagggccagggccacgtgcacggcgtggccagcagccccagccacgacctggccaaggaggagggcagccacccccccgtgcagggccagctgagcctgcagaacaccacccacaccagaaccagccactag

SEQ ID NO: 2122 - DNA, 1704 bp, Artificial Sequence
  Description of Artificial Sequence: Synthetic coding sequence
atggcccccctggccctgcacctgctggtgctggtgcccatcctgctgagcctggtggccagccaggactggaaggccgagagaagccaggaccccttcgagaagtgcatgcaggaccccgactacgagcagctgctgaaggtggtgacctggggcctgaacagaaccctgaagccccagagagtgatcgtggtgggcgccggcgtggccggcctggtggccgccaaggtgctgagcgacgccggccacaaggtgaccatcctggaggccgacaacagaatcggcggcagaatcttcacctacagagaccagaacaccggctggatcggcgagctgggcgccatgagaatgcccagcagccacagaatcctgcacaagctgtgccagggcctgggcctgaacctgaccaagttcacccagtacgacaagaacacctggaccgaggtgcacgaggtgaagctgagaaactacgtggtggagaaggtgcccgagaagctgggctacgccctgagaccccaggagaagggccacagccccgaggacatctaccagatggccctgaaccaggccctgaaggacctgaaggccctgggctgcagaaaggccatgaagaagttcgagagacacaccctgctggagtacctgctgggcgagggcaacctgagcagacccgccgtgcagctgctgggcgacgtgatgagcgaggacggcttcttctacctgagcttcgccgaggccctgagagcccacagctgcctgagcgacagactgcagtacagcagaatcgtgggcggctgggacctgctgcccagagccctgctgagcagcctgagcggcctggtgctgctgaacgcccccgtggtggccatgacccagggcccccacgacgtgcacgtgcagatcgagaccagcccccccgccagaaacctgaaggtgctgaaggccgacgtggtgctgctgaccgccagcggccccgccgtgaagagaatcaccttcagcccccccctgcccagacacatgcaggaggccctgagaagactgcactacgtgcccgccaccaaggtgttcctgagcttcagaagacccttctggagagaggagcacatcgagggcggccacagcaacaccgacagacccagcagaatgatcttctaccccccccccagagagggcgccctgctgctggccagctacacctggagcgacgccgccgccgccttcgccggcctgagcagagaggaggccctgagactggccctggacgacgtggccgccctgcacggccccgtggtgagacagctgtgggacggcaccggcgtggtgaagagatgggccgaggaccagcacagccagggcggcttcgtggtgcagccccccgccctgtggcagaccgagaaggacgactggaccgtgccctacggcagaatctacttcgccggcgagcacaccgcctacccccacggctgggtggagaccgccgtgaagagcgccctgagagccgccatcaagatcaacagcagaaagggccccgccagcgacaccgccagccccgagggccacgccagcgacatggagggccagggccacgtgcacggcgtggccagcagccccagccacgacctggccaaggaggagggcagccacccccccgtgcagggccagctgagcctgcagaacaccacccacaccagaaccagccactag

SEQ ID NO: 2123 - DNA, 1770 bp, Artificial Sequence; identical to SEQ ID NO: 2121
  Description of Artificial Sequence: Synthetic coding sequence

SEQ ID NO: 2124 - DNA, 462 bp, Artificial Sequence
  Description of Artificial Sequence: Synthetic coding sequence
atgggcctgaccagccagctgctgccccccctgttcttcctgctggcctgcgccggcaacttcgtgcacggccacaagtgcgacatcaccctgcaggagatcatcaagaccctgaacagcctgaccgagcagaagaccctgtgcaccgagctgaccgtgaccgacatcttcgccgccagcaagaacaccaccgagaaggagaccttctgcagagccgccaccgtgctgagacagttctacagccaccacgagaaggacaccagatgcctgggcgccaccgcccagcagttccacagacacaagcagctgatcagattcctgaagagactggacagaaacctgtggggcctggccggcctgaacagctgccccgtgaaggaggccaaccagagcaccctggagaacttcctggagagactgaagaccatcatgagagagaagtacagcaagtgcagcagctag

SEQ ID NO: 2125 - DNA, 435 bp, Artificial Sequence
  Description of Artificial Sequence: Synthetic coding sequence
atgctgctggccatggtgctgaccagcgccctgctgctgtgcagcgtggccggccagggctgccccaccctggccggcatcctggacatcaacttcctgatcaacaagatgcaggaggaccccgccagcaagtgccactgcagcgccaacgtgaccagctgcctgtgcctgggcatccccagcgacaactgcaccagaccctgcttcagcgagagactgagccagatgaccaacaccaccatgcagaccagataccccctgatcttcagcagagtgaagaagagcgtggaggtgctgaagaacaacaagtgcccctacttcagctgcgagcagccctgcaaccagaccaccgccggcaacgccctgaccttcctgaagagcctgctggagatcttccagaaggagaagatgagaggcatgagaggcaagatctag

SEQ ID NO: 2126 - DNA, 2109 bp, Artificial Sequence
  Description of Artificial Sequence: Synthetic coding sequence
atgagacccatgagaatcttcgtgaacgacgacagacacgtgatggccaagcacagcagcgtgtaccccacccaggaggagctggaggccgtgcagaacatggtgagccacaccgagagagccctgaaggccgtgagcgactggatcgacgagcaggagaagggcagcagcgagcaggccgagagcgacaacatggacgtgccccccgaggacgacagcaaggagggcgccggcgagcagaagaccgagcacatgaccagaaccctgagaggcgtgatgagagtgggcctggtggccaagggcctgctgctgaagggcgacctggacctggagctggtgctgctgtgcaaggagaagcccaccaccgccctgctggacaaggtggccgacaacctggccatccagctggccgccgtgaccgaggacaagtacgagatcctgcagagcgtggacgacgccgccatcgtgatcaagaacaccaaggagccccccctgagcctgaccatccacctgaccagccccgtggtgagagaggagatggagaaggtgctggccggcgagaccctgagcgtgaacgacccccccgacgtgctggacagacagaagtgcctggccgccctggccagcctgagacacgccaagtggttccaggccagagccaacggcctgaagagctgcgtgatcgtgatcagagtgctgagagacctgtgcaccagagtgcccacctggggccccctgagaggctggcccctggagctgctgtgcgagaagagcatcggcaccgccaacagacccatgggcgccggcgaggccctgagaagagtgctggagtgcctggccagcggcatcgtgatgcccgacggcagcggcatctacgacccctgcgagaaggaggccaccgacgccatcggccacctggacagacagcagagagaggacatcacccagagcgcccagcacgccctgagactggccgccttcggccagctgcacaaggtgctgggcatggaccccctgcccagcaagatgcccaagaagcccaagaacgagaaccccgtggactacaccgtgcagatcccccccagcaccacctacgccatcacccccatgaagagacccatggaggaggacggcgaggagaagagccccagcaagaagaagaagaagatccagaagaaggaggagaaggccgagcccccccaggccatgaacgccctgatgagactgaaccagctgaagcccggcctgcagtacaagctggtgagccagaccggccccgtgcacgcccccatcttcaccatgagcgtggaggtggacggcaacagcttcgaggccagcggccccagcaagaagaccgccaagctgcacgtggccgtgaaggtgctgcaggacatgggcctgcccaccggcgccgagggcagagacagcagcaagggcgaggacagcgccgaggagaccgaggccaagcccgccgtggtggcccccgcccccgtggtggaggccgtgagcacccccagcgccgccttccccagcgacgccaccgccgagcagggccccatcctgaccaagcacggcaagaaccccgtgatggagctgaacgagaagagaagaggcctgaagtacgagctgatcagcgagaccggcggcagccacgacaagagattcgtgatggaggtggaggtggacggccagaagttccagggcgccggcagcaacaagaaggtggccaaggcctacgccgccctggccgccctggagaagctgttccccgacacccccctggccctggacgccaacaagaagaagagagcccccgtgcccgtgagaggcggccccaagttcgccgccaagccccacaaccccggcttcggcatgggcggccccatgcacaacgaggtgccccccccccccaacctgagaggcagaggcagaggcggcagcatcagaggcagaggcagaggcagaggcttcggcggcgccaaccacggcggctacatgaacgccggcgccggctacggcagctacggctacggcggcaacagcgccaccgccggctacagcgacttcttcaccgactgctacggctaccacgacttcggcagcagctag

SEQ ID NO: 2127 - DNA, 2109 bp, Artificial Sequence; identical to SEQ ID NO: 2126
  Description of Artificial Sequence: Synthetic coding sequence

SEQ ID NO: 2128 - DNA, 2685 bp, Artificial Sequence
  Description of Artificial Sequence: Synthetic coding sequence
atgagacccatgagaatcttcgtgaacgacgacagacacgtgatggccaagcacagcagcgtgtaccccacccaggaggagctggaggccgtgcagaacatggtgagccacaccgagagagccctgaaggccgtgagcgactggatcgacgagcaggagaagggcagcagcgagcaggccgagagcgacaacatggacgtgccccccgaggacgacagcaaggagggcgccggcgagcagaagaccgagcacatgaccagaaccctgagaggcgtgatgagagtgggcctggtggccaagggcctgctgctgaagggcgacctggacctggagctggtgctgctgtgcaaggagaagcccaccaccgccctgctggacaaggtggccgacaacctggccatccagctggccgccgtgaccgaggacaagtacgagatcctgcagagcgtggacgacgccgccatcgtgatcaagaacaccaaggagccccccctgagcctgaccatccacctgaccagccccgtggtgagagaggagatggagaaggtgctggccggcgagaccctgagcgtgaacgacccccccgacgtgctggacagacagaagtgcctggccgccctggccagcctgagacacgccaagtggttccaggccagagccaacggcctgaagagctgcgtgatcgtgatcagagtgctgagagacctgtgcaccagagtgcccacctggggccccctgagaggctggcccctggagctgctgtgcgagaagagcatcggcaccgccaacagacccatgggcgccggcgaggccctgagaagagtgctggagtgcctggccagcggcatcgtgatgcccgacggcagcggcatctacgacccctgcgagaaggaggccaccgacgccatcggccacctggacagacagcagagagaggacatcacccagagcgcccagcacgccctgagactggccgccttcggccagctgcacaaggtgctgggcatggaccccctgcccagcaagatgcccaagaagcccaagaacgagaaccccgtggactacaccgtgcagatcccccccagcaccacctacgccatcacccccatgaagagacccatggaggaggacggcgaggagaagagccccagcaagaagaagaagaagatccagaagaaggaggagaaggccgagcccccccaggccatgaacgccctgatgagactgaaccagctgaagcccggcctgcagtacaagctggtgagccagaccggccccgtgcacgcccccatcttcaccatgagcgtggaggtggacggcaacagcttcgaggccagcggccccagcaagaagaccgccaagctgcacgtggccgtgaaggtgctgcaggacatgggcctgcccaccggcgccgagggcagagacagcagcaagggcgaggacagcgccgaggagaccgaggccaagcccgccgtggtggcccccgcccccgtggtggaggccgtgagcacccccagcgccgccttccccagcgacgccaccgccgagcagggccccatcctgaccaagcacggcaagaaccccgtgatggagctgaacgagaagagaagaggcctgaagtacgagctgatcagcgagaccggcggcagccacgacaagagattcgtgatggaggtggaggtggacggccagaagttccagggcgccggcagcaacaagaaggtggccaaggcctacgccgccctggccgccctggagaagctgttccccgacacccccctggccctggacgccaacaagaagaagagagcccccgtgcccgtgagaggcggccccaagttcgccgccaagccccacaaccccggcttcggcatgggcggccccatgcacaacgaggtgccccccccccccaacctgagaggcagaggcagaggcggcagcatcagaggcagaggcagaggcagaggcttcggcggcgccaaccacggcggctacatgaacgccggcgccggctacggcagctacggctacggcggcaacagcgccaccgccggctacagccagttctacagcaacggcggccacagcggcaacgccagcggcggcggcggcggcggcggcggcggcagcagcggctacggcagctactaccagggcgacaactacaacagccccgtgccccccaagcacgccggcaagaagcagccccacggcggccagcagaagcccagctacggcagcggctaccagagccaccagggccagcagcagagctacaaccagagcccctacagcaactacggccccccccagggcaagcagaagggctacaaccacggccagggcagctacagctacagcaacagctacaacagccccggcggcggcggcggcagcgactacaactacgagagcaagttcaactacagcggcagcggcggcagaagcggcggcaacagctacggcagcggcggcgccagctacaaccccggcagccacggcggctacggcggcggcagcggcggcggcagcagctaccagggcaagcagggcggctacagccagagcaactacaacagccccggcagcggccagaactacagcggcccccccagcagctaccagagcagccagggcggctacggcagaaacgccgaccacagcatgaactaccagtacagatag

SEQ ID NO: 2129 - DNA, 2295 bp, Artificial Sequence
  Description of Artificial Sequence: Synthetic coding sequence
atgagacccatgagaatcttcgtgaacgacgacagacacgtgatggccaagcacagcagcgtgtaccccacccaggaggagctggaggccgtgcagaacatggtgagccacaccgagagagccctgaaggccgtgagcgactggatcgacgagcaggagaagggcagcagcgagcaggccgagagcgacaacatggacgtgccccccgaggacgacagcaaggagggcgccggcgagcagaagaccgagcacatgaccagaaccctgagaggcgtgatgagagtgggcctggtggccaagggcctgctgctgaagggcgacctggacctggagctggtgctgctgtgcaaggagaagcccaccaccgccctgctggacaaggtggccgacaacctggccatccagctggccgccgtgaccgaggacaagtacgagatcctgcagagcgtggacgacgccgccatcgtgatcaagaacaccaaggagccccccctgagcctgaccatccacctgaccagccccgtggtgagagaggagatggagaaggtgctggccggcgagaccctgagcgtgaacgacccccccgacgtgctggacagacagaagtgcctggccgccctggccagcctgagacacgccaagtggttccaggccagagccaacggcctgaagagctgcgtgatcgtgatcagagtgctgagagacctgtgcaccagagtgcccacctggggccccctgagaggctggcccctggagctgctgtgcgagaagagcatcggcaccgccaacagacccatgggcgccggcgaggccctgagaagagtgctggagtgcctggccagcggcatcgtgatgcccgacggcagcggcatctacgacccctgcgagaaggaggccaccgacgccatcggccacctggacagacagcagagagaggacatcacccagagcgcccagcacgccctgagactggccgccttcggccagctgcacaaggtgctgggcatggaccccctgcccagcaagatgcccaagaagcccaagaacgagaaccccgtggactacaccgtgcagatcccccccagcaccacctacgccatcacccccatgaagagacccatggaggaggacggcgaggagaagagccccagcaagaagaagaagaagatccagaagaaggaggagaaggccgagcccccccaggccatgaacgccctgatgagactgaaccagctgaagcccggcctgcagtacaagctggtgagccagaccggccccgtgcacgcccccatcttcaccatgagcgtggaggtggacggcaacagcttcgaggccagcggccccagcaagaagaccgccaagctgcacgtggccgtgaaggtgctgcaggacatgggcctgcccaccggcgccgagggcagagacagcagcaagggcgaggacagcgccgaggagaccgaggccaagcccgccgtggtggcccccgcccccgtggtggaggccgtgagcacccccagcgccgccttccccagcgacgccaccgccgagcagggccccatcctgaccaagcacggcaagaaccccgtgatggagctgaacgagaagagaagaggcctgaagtacgagctgatcagcgagaccggcggcagccacgacaagagattcgtgatggaggtggaggtggacggccagaagttccagggcgccggcagcaacaagaaggtggccaaggcctacgccgccctggccgccctggagaagctgttccccgacacccccctggccctggacgccaacaagaagaagagagcccccgtgcccgtgagaggcggccccaagttcgccgccaagccccacaaccccggcttcggcatgggcggccccatgcacaacgaggtgccccccccccccaacctgagaggcagaggcagaggcggcagcatcagaggcagaggcagaggcagaggcttcggcggcgccaaccacggcggctacatgaacgccggcgccggctacggcagctacggctacggcggcaacagcgccaccgccggctacagcaagagcagcagaccccccccccccagcagacccagatgctgcgtggtgagatgcagcggcagcccctgcggccccagctgcgacccctacctggccgtgttcggcaccccctgcctgcagtggttcgtgagctgccactacaacttcgtgtgggtggagttcctgagcttctgcagcagcgtgagcctgtgcctgttcaccctgagagtgagcggcaacagcgtgtgcctgtag

SEQ ID NO: 2130 - DNA, 2121 bp, Artificial Sequence
  Description of Artificial Sequence: Synthetic coding sequence
atgagacccatgagaatcttcgtgaacgacgacagacacgtgatggccaagcacagcagcgtgtaccccacccaggaggagctggaggccgtgcagaacatggtgagccacaccgagagagccctgaaggccgtgagcgactggatcgacgagcaggagaagggcagcagcgagcaggccgagagcgacaacatggacgtgccccccgaggacgacagcaaggagggcgccggcgagcagaagaccgagcacatgaccagaaccctgagaggcgtgatgagagtgggcctggtggccaagggcctgctgctgaagggcgacctggacctggagctggtgctgctgtgcaaggagaagcccaccaccgccctgctggacaaggtggccgacaacctggccatccagctggccgccgtgaccgaggacaagtacgagatcctgcagagcgtggacgacgccgccatcgtgatcaagaacaccaaggagccccccctgagcctgaccatccacctgaccagccccgtggtgagagaggagatggagaaggtgctggccggcgagaccctgagcgtgaacgacccccccgacgtgctggacagacagaagtgcctggccgccctggccagcctgagacacgccaagtggttccaggccagagccaacggcctgaagagctgcgtgatcgtgatcagagtgctgagagacctgtgcaccagagtgcccacctggggccccctgagaggctggcccctggagctgctgtgcgagaagagcatcggcaccgccaacagacccatgggcgccggcgaggccctgagaagagtgctggagtgcctggccagcggcatcgtgatgcccgacggcagcggcatctacgacccctgcgagaaggaggccaccgacgccatcggccacctggacagacagcagagagaggacatcacccagagcgcccagcacgccctgagactggccgccttcggccagctgcacaaggtgctgggcatggaccccctgcccagcaagatgcccaagaagcccaagaacgagaaccccgtggactacaccgtgcagatcccccccagcaccacctacgccatcacccccatgaagagacccatggaggaggacggcgaggagaagagccccagcaagaagaagaagaagatccagaagaaggaggagaaggccgagcccccccaggccatgaacgccctgatgagactgaaccagctgaagcccggcctgcagtacaagctggtgagccagaccggccccgtgcacgcccccatcttcaccatgagcgtggaggtggacggcaacagcttcgaggccagcggccccagcaagaagaccgccaagctgcacgtggccgtgaaggtgctgcaggacatgggcctgcccaccggcgccgagggcagagacagcagcaagggcgaggacagcgccgaggagaccgaggccaagcccgccgtggtggcccccgcccccgtggtggaggccgtgagcacccccagcgccgccttccccagcgacgccaccgccgagaacgtgaagcagcagggccccatcctgaccaagcacggcaagaaccccgtgatggagctgaacgagaagagaagaggcctgaagtacgagctgatcagcgagaccggcggcagccacgacaagagattcgtgatggaggtggaggtggacggccagaagttccagggcgccggcagcaacaagaaggtggccaaggcctacgccgccctggccgccctggagaagctgttccccgacacccccctggccctggacgccaacaagaagaagagagcccccgtgcccgtgagaggcggccccaagttcgccgccaagccccacaaccccggcttcggcatgggcggccccatgcacaacgaggtgccccccccccccaacctgagaggcagaggcagaggcggcagcatcagaggcagaggcagaggcagaggcttcggcggcgccaaccacggcggctacatgaacgccggcgccggctacggcagctacggctacggcggcaacagcgccaccgccggctacagcgacttcttcaccgactgctacggctaccacgacttcggcagcagctag

SEQ ID NO: 2131 - DNA, 2073 bp, Artificial Sequence
  Description of Artificial Sequence: Synthetic coding sequence
atgagacccatgagaatcttcgtgaacgacgacagacacgtgatggccaagcacagcagcgtgtaccccacccaggaggagctggaggccgtgcagaacatggtgagccacaccgagagagccctgaaggccgtgagcgactggatcgacgagcaggagaagggcagcagcgagcaggccgagagcgacaacatggacgtgccccccgaggacgacagcaaggagggcgccggcgagcagaagaccgagcacatgaccagaaccctgagaggcgtgatgagagtgggcctggtggccaagggcctgctgctgaagggcgacctggacctggagctggtgctgctgtgcaaggagaagcccaccaccgccctgctggacaaggtggccgacaacctggccatccagctggccgccgtgaccgaggacaagtacgagatcctgcagagcgtggacgacgccgccatcgtgatcaagaacaccaaggagccccccctgagcctgaccatccacctgaccagccccgtggtgagagaggagatggagaaggtgctggccggcgagaccctgagcgtgaacgacccccccgacgtgctggacagacagaagtgcctggccgccctggccagcctgagacacgccaagtggttccaggccagagccaacggcctgaagagctgcgtgatcgtgatcagagtgctgagagacctgtgcaccagagtgcccacctggggccccctgagaggctggcccctggagctgctgtgcgagaagagcatcggcaccgccaacagacccatgggcgccggcgaggccctgagaagagtgctggagtgcctggccagcggcatcgtgatgcccgacggcagcggcatctacgacccctgcgagaaggaggccaccgacgccatcggccacctggacagacagcagagagaggacatcacccagagcgcccagcacgccctgagactggccgccttcggccagctgcacaaggtgctgggcatggaccccctgcccagcaagatgcccaagaagcccaagaacgagaaccccgtggactacaccgtgcagatcccccccagcaccacctacgccatcacccccatgaagagacccatggaggaggacggcgaggagaagagccccagcaagaagaagaagaagatccagaagaaggaggagaaggccgagcccccccaggccatgaacgccctgatgagactgaaccagctgaagcccggcctgcagtacaagctggtgagccagaccggccccgtgcacgcccccatcttcaccatgagcgtggaggtggacggcaacagcttcgaggccagcggccccagcaagaagaccgccaagctgcacgtggccgtgaaggtgctgcaggacatgggcctgcccaccggcgccgagggcagagacagcagcaagggcgaggacagcgccgaggagaccgaggccaagcccgccgtggtggcccccgcccccgtggtggaggccgtgagcacccccagcgccgccttccccagcgacgccaccgccgagcagggccccatcctgaccaagcacggcaagaaccccgtgatggagctgaacgagaagagaagaggcctgaagtacgagctgatcagcgagaccggcggcagccacgacaagagattcgtgatggaggtggaggtggacggccagaagttccagggcgccggcagcaacaagaaggtggccaaggcctacgccgccctggccgccctggagaagctgttccccgacacccccctggccctggacgccaacaagaagaagagagcccccgtgcccgtgagaggcggccccaagttcgccgccaagccccacaaccccggcttcggcatgggcggccccatgcacaacgaggtgccccccccccccaacctgagaggcagaggcagaggcggcagcatcagaggcagaggcagaggcagaggcttcggcggcgccaaccacggcggctacatgaacgccggcgccggctacggcagctacggctacggcggcaacagcgccaccgccggctacaccggcttcgtgtag

SEQ ID NO: 2132 - DNA, 2697 bp, Artificial Sequence
  Description of Artificial Sequence: Synthetic coding sequence
atgagacccatgagaatcttcgtgaacgacgacagacacgtgatggccaagcacagcagcgtgtaccccacccaggaggagctggaggccgtgcagaacatggtgagccacaccgagagagccctgaaggccgtgagcgactggatcgacgagcaggagaagggcagcagcgagcaggccgagagcgacaacatggacgtgccccccgaggacgacagcaaggagggcgccggcgagcagaagaccgagcacatgaccagaaccctgagaggcgtgatgagagtgggcctggtggccaagggcctgctgctgaagggcgacctggacctggagctggtgctgctgtgcaaggagaagcccaccaccgccctgctggacaaggtggccgacaacctggccatccagctggccgccgtgaccgaggacaagtacgagatcctgcagagcgtggacgacgccgccatcgtgatcaagaacaccaaggagccccccctgagcctgaccatccacctgaccagccccgtggtgagagaggagatggagaaggtgctggccggcgagaccctgagcgtgaacgacccccccgacgtgctggacagacagaagtgcctggccgccctggccagcctgagacacgccaagtggttccaggccagagccaacggcctgaagagctgcgtgatcgtgatcagagtgctgagagacctgtgcaccagagtgcccacctggggccccctgagaggctggcccctggagctgctgtgcgagaagagcatcggcaccgccaacagacccatgggcgccggcgaggccctgagaagagtgctggagtgcctggccagcggcatcgtgatgcccgacggcagcggcatctacgacccctgcgagaaggaggccaccgacgccatcggccacctggacagacagcagagagaggacatcacccagagcgcccagcacgccctgagactggccgccttcggccagctgcacaaggtgctgggcatggaccccctgcccagcaagatgcccaagaagcccaagaacgagaaccccgtggactacaccgtgcagatcccccccagcaccacctacgccatcacccccatgaagagacccatggaggaggacggcgaggagaagagccccagcaagaagaagaagaagatccagaagaaggaggagaaggccgagcccccccaggccatgaacgccctgatgagactgaaccagctgaagcccggcctgcagtacaagctggtgagccagaccggccccgtgcacgcccccatcttcaccatgagcgtggaggtggacggcaacagcttcgaggccagcggccccagcaagaagaccgccaagctgcacgtggccgtgaaggtgctgcaggacatgggcctgcccaccggcgccgagggcagagacagcagcaagggcgaggacagcgccgaggagaccgaggccaagcccgccgtggtggcccccgcccccgtggtggaggccgtgagcacccccagcgccgccttccccagcgacgccaccgccgagaacgtgaagcagcagggccccatcctgaccaagcacggcaagaaccccgtgatggagctgaacgagaagagaagaggcctgaagtacgagctgatcagcgagaccggcggcagccacgacaagagattcgtgatggaggtggaggtggacggccagaagttccagggcgccggcagcaacaagaaggtggccaaggcctacgccgccctggccgccctggagaagctgttccccgacacccccctggccctggacgccaacaagaagaagagagcccccgtgcccgtgagaggcggccccaagttcgccgccaagccccacaaccccggcttcggcatgggcggccccatgcacaacgaggtgccccccccccccaacctgagaggcagaggcagaggcggcagcatcagaggcagaggcagaggcagaggcttcggcggcgccaaccacggcggctacatgaacgccggcgccggctacggcagctacggctacggcggcaacagcgccaccgccggctacagccagttctacagcaacggcggccacagcggcaacgccagcggcggcggcggcggcggcggcggcggcagcagcggctacggcagctactaccagggcgacaactacaacagccccgtgccccccaagcacgccggcaagaagcagccccacggcggccagcagaagcccagctacggcagcggctaccagagccaccagggccagcagcagagctacaaccagagcccctacagcaactacggccccccccagggcaagcagaagggctacaaccacggccagggcagctacagctacagcaacagctacaacagccccggcggcggcggcggcagcgactacaactacgagagcaagttcaactacagcggcagcggcggcagaagcggcggcaacagctacggcagcggcggcgccagctacaaccccggcagccacggcggctacggcggcggcagcggcggcggcagcagctaccagggcaagcagggcggctacagccagagcaactacaacagccccggcagcggccagaactacagcggcccccccagcagctaccagagcagccagggcggctacggcagaaacgccgaccacagcatgaactaccagtacagatag

SEQ ID NO: 2133 - DNA, 882 bp, Artificial Sequence
  Description of Artificial Sequence: Synthetic coding sequence
atggccaccgccagacccccctggatgtgggtgctgtgcgccctgatcaccgccctgctgctgggcgtgaccgagcacgtgctggccaacaacgacgtgagctgcgaccaccccagcaacaccgtgcccagcggcagcaaccaggacctgggcgccggcgccggcgaggacgccagaagcgacgacagcagcagcagaatcatcaacggcagcgactgcgacatgcacacccagccctggcaggccgccctgctgctgagacccaaccagctgtactgcggcgccgtgctggtgcacccccagtggctgctgaccgccgcccactgcagaaagaaggtgttcagagtgagactgggccactacagcctgagccccgtgtacgagagcggccagcagatgttccagggcgtgaagagcatcccccaccccggctacagccaccccggccacagcaacaacctgatgctgatcaagctgaacagaagaatcagacccaccaaggacgtgagacccatcaacgtgagcagccactgccccagcgccggcaccaagtgcctggtgagcggctggggcaccaccaagagcccccaggtgcacttccccaaggtgctgcagtgcctgaacatcagcgtgctgagccagaagagatgcgaggacgcctaccccagacagatcgacgacaccatgttctgcgccggcgacaaggccggcagagacagctgccagggcgacagcggcggccccgtggtgtgcaacggcagcctgcagggcctggtgagctggggcgactacccctgcgccagacccaacagacccggcgtgtacaccaacctgtgcaagttcaccaagtggatccaggagaccatccaggccaacagctag

SEQ ID NO: 2134 - DNA, 882 bp, Artificial Sequence; identical to SEQ ID NO: 2133
  Description of Artificial Sequence: Synthetic coding sequence

SEQ ID NO: 2135 - DNA, 882 bp, Artificial Sequence; identical to SEQ ID NO: 2133
  Description of Artificial Sequence: Synthetic coding sequence

SEQ ID NO: 2136 - DNA, 2109 bp, Artificial Sequence
  Description of Artificial Sequence: Synthetic coding sequence
atgcccatcaacaagagcgagaagcccgagagctgcgacaacgtgaaggtggtggtgagatgcagacccctgaacgagagagagaagagcatgtgctacaagcaggccgtgagcgtggacgagatgagaggcaccatcaccgtgcacaagaccgacagcagcaacgagccccccaagaccttcaccttcgacaccgtgttcggccccgagagcaagcagctggacgtgtacaacctgaccgccagacccatcatcgacagcgtgctggagggctacaacggcaccatcttcgcctacggccagaccggcaccggcaagaccttcaccatggagggcgtgagagccatccccgagctgagaggcatcatccccaacagcttcgcccacatcttcggccacatcgccaaggccgagggcgacaccagattcctggtgagagtgagctacctggagatctacaacgaggaggtgagagacctgctgggcaaggaccagacccagagactggaggtgaaggagagacccgacgtgggcgtgtacatcaaggacctgagcgcctacgtggtgaacaacgccgacgacatggacagaatcatgaccctgggccacaagaacagaagcgtgggcgccaccaacatgaacgagcacagcagcagaagccacgccatcttcaccatcaccatcgagtgcagcgagaagggcatcgacggcaacatgcacgtgagaatgggcaagctgcacctggtggacctggccggcagcgagagacaggccaagaccggcgccaccggccagagactgaaggaggccaccaagatcaacctgagcctgagcaccctgggcaacgtgatcagcgccctggtggacggcaagagcacccacgtgccctacagaaacagcaagctgaccagactgctgcaggacagcctgggcggcaacagcaagaccatgatgtgcgccaacatcggccccgccgactacaactacgacgagaccatcagcaccctgagatacgccaacagagccaagaacatcaagaacaaggccagaatcaacgaggaccccaaggacgccctgctgagacagttccagaaggagatcgaggagctgaagaagaagctggaggagggcgaggagatcagcggcagcgacatcagcggcagcgaggaggacgacgacgaggagggcgaggtgggcgaggacggcgagaagagaaagaagagaagagaccaggccggcaagaagaaggtgagccccgacaagatgatcgagatgcaggccaagatcgacgaggagagaaaggccctggagaccaagctggacatggaggaggaggagagaaacaaggccagagccgagctggagaagagagagaaggacctgctgaaggcccagcaggagcaccagagcctgctggagaagctgagcgccctggagaagaaggtgatcgtgggcggcgtggacctgctggccaaggccgaggagcaggagaagctgctggaggagagcaacatggagctggaggagagaagaaagagagccgagcagctgagaagagagctggaggagaaggagcaggagagactggacatcgaggagaagtacaccagcctgcaggaggaggcccagggcaagaccaagaagctgaagaaggtgtggaccatgctgatggccgccaagagcgagatggccgacctgcagcaggagcaccagagagagatcgagggcctgctggagaacatcagacagctgagcagagagctgagactgcagatgctgatcatcgacaacttcatccccagagactaccaggagatgatcgagaactacgtgcactggaacgaggacatcggcgagtggcagctgaagtgcgtggcctacaccggcaacaacatgagaaagcagacccccgtgcccgacaagaaggagaaggaccccttcgaggtggacctgagccacgtgtacctggcctacaccgaggagagcctgagacagagcctgatgaagctggagagacccagaaccagcaagggcaaggccagacccaagaccggcagaagaaagagaagcgccaagcccgagaccgtgatcgacagcctgctgcagtag

SEQ ID NO: 2137 - DNA, 2100 bp, Artificial Sequence
  Description of Artificial Sequence: Synthetic coding sequence
atgcccatcaacaagagcgagaagcccgagagctgcgacaacgtgaaggtggtggtgagatgcagacccctgaacgagagagagaagagcatgtgctacaagcaggccgtgagcgtggacgagatgagaggcaccatcaccgtgcacaagaccgacagcagcaacgagccccccaagaccttcaccttcgacaccgtgttcggccccgagagcaagcagctggacgtgtacaacctgaccgccagacccatcatcgacagcgtgctggagggctacaacggcaccatcttcgcctacggccagaccggcaccggcaagaccttcaccatggagggcgtgagagccatccccgagctgagaggcatcatccccaacagcttcgcccacatcttcggccacatcgccaaggccgagggcgacaccagattcctggtgagagtgagctacctggagatctacaacgaggaggtgagagacctgctgggcaaggaccagacccagagactggaggtgaaggagagacccgacgtgggcgtgtacatcaaggacctgagcgcctacgtggtgaacaacgccgacgacatggacagaatcatgaccctgggccacaagaacagaagcgtgggcgccaccaacatgaacgagcacagcagcagaagccacgccatcttcaccatcaccatcgagtgcagcgagaagggcatcgacggcaacatgcacgtgagaatgggcaagctgcacctggtggacctggccggcagcgagagacaggccaagaccggcgccaccggccagagactgaaggaggccaccaagatcaacctgagcctgagcaccctgggcaacgtgatcagcgccctggtggacggcaagagcacccacgtgccctacagaaacagcaagctgaccagactgctgcaggacagcctgggcggcaacagcaagaccatgatgtgcgccaacatcggccccgccgactacaactacgacgagaccatcagcaccctgagatacgccaacagagccaagaacatcaagaacaaggccagaatcaacgaggaccccaaggacgccctgctgagacagttccagaaggagatcgaggagctgaagaagaagctggaggagggcgaggagatcagcggcagcgacatcagcggcagcgaggaggacgacgacgaggagggcgaggtgggcgaggacggcgagaagagaaagaagagaagaggcaagaagaaggtgagccccgacaagatgatcgagatgcaggccaagatcgacgaggagagaaaggccctggagaccaagctggacatggaggaggaggagagaaacaaggccagagccgagctggagaagagagagaaggacctgctgaaggcccagcaggagcaccagagcctgctggagaagctgagcgccctggagaagaaggtgatcgtgggcggcgtggacctgctggccaaggccgaggagcaggagaagctgctggaggagagcaacatggagctggaggagagaagaaagagagccgagcagctgagaagagagctggaggagaaggagcaggagagactggacatcgaggagaagtacaccagcctgcaggaggaggcccagggcaagaccaagaagctgaagaaggtgtggaccatgctgatggccgccaagagcgagatggccgacctgcagcaggagcaccagagagagatcgagggcctgctggagaacatcagacagctgagcagagagctgagactgcagatgctgatcatcgacaacttcatccccagagactaccaggagatgatcgagaactacgtgcactggaacgaggacatcggcgagtggcagctgaagtgcgtggcctacaccggcaacaacatgagaaagcagacccccgtgcccgacaagaaggagaaggaccccttcgaggtggacctgagccacgtgtacctggcctacaccgaggagagcctgagacagagcctgatgaagctggagagacccagaaccagcaagggcaaggccagacccaagaccggcagaagaaagagaagcgccaagcccgagaccgtgatcgacagcctgctgcagtag

SEQ ID NO: 2138 - DNA, 1230 bp, Artificial Sequence
  Description of Artificial Sequence: Synthetic coding sequence
atgtgctacaagcaggccgtgagcgtggacgagatgagaggcaccatcaccgtgcacaagaccgacagcagcaacgagccccccaagaccttcaccttcgacaccgtgttcggccccgagagcaagcagctggacgtgtacaacctgaccgccagacccatcatcgacagcgtgctggagggctacaacggcaccatcttcgcctacggccagaccggcaccggcaagaccttcaccatggagggcgtgagagccatccccgagctgagaggcatcatccccaacagcttcgcccacatcttcggccacatcgccaaggccgagggcgacaccagattcctggtgagagtgagctacctggagatctacaacgaggaggtgagagacctgctgggcaaggaccagacccagagactggaggtgaaggagagacccgacgtgggcgtgtacatcaaggacctgagcgcctacgtggtgaacaacgccgacgacatggacagaatcatgaccctgggccacaagaacagaagcgtgggcgccaccaacatgaacgagcacagcagcagaagccacgccatcttcaccatcaccatcgagtgcagcgagaagggcatcgacggcaacatgcacgtgagaatgggcaagctgcacctggtggacctggccggcagcgagagacaggccaagaccggcgccaccggccagagactgaaggaggccaccaagatcaacctgagcctgagcaccctgggcaacgtgatcagcgccctggtggacggcaagagcacccacgtgccctacagaaacagcaagctgaccagactgctgcaggacagcctgggcggcaacagcaagaccatgatgtgcgccaacatcggccccgccgactacaactacgacgagaccatcagcaccctgagatacgccaacagagccaagaacatcaagaacaaggccagaatcaacgaggaccccaaggacgccctgctgagacagttccagaaggagatcgaggagctgaagaagaagctggaggagggcgaggagatcagcggcagcgacatcagcggcagcgaggaggacgacgacgaggagggcgaggtgggcgaggacggcgagaagagaaagaagagaagaggcaagaagaaggtgagccccgacaagatgatcgagatgcaggccaagatcgacgaggagagaaagaagaagaagaagaagaagaagaagtag

SEQ ID NO: 2139 - DNA, 2181 bp, Artificial Sequence
  Description of Artificial Sequence: Synthetic coding sequence
atgcccatcaacaagagcgagaagcccgagagctgcgacaacgtgaaggtggtggtgagatgcagacccctgaacgagagagagaagagcatgtgctacaagcaggccgtgagcgtggacgagatgagaggcaccatcaccgtgcacaagaccgacagcagcaacgagccccccaagaccttcaccttcgacaccgtgttcggccccgagagcaagcagctggacgtgtacaacctgaccgccagacccatcatcgacagcgtgctggagggctacaacggcaccatcttcgcctacggccagaccggcaccggcaagaccttcaccatggagggcgtgagagccatccccgagctgagaggcatcatccccaacagcttcgcccacatcttcggccacatcgccaaggccgagggcgacaccagattcctggtgagagtgagctacctggagatctacaacgaggaggtgagagacctgctgggcaaggaccagacccagagactggaggtgaaggagagacccgacgtgggcgtgtacatcaaggacctgagcgcctacgtggtgaacaacgccgacgacatggacagaatcatgaccctgggccacaagaacagaagcgtgggcgccaccaacatgaacgagcacagcagcagaagccacgccatcttcaccatcaccatcgagtgcagcgagaagggcatcgacggcaacatgcacgtgagaatgggcaagctgcacctggtggacctggccggcagcgagagacaggccaagaccggcgccaccggccagagactgaaggaggccaccaagatcaacctgagcctgagcaccctgggcaacgtgatcagcgccctggtggacggcaagagcacccacgtgccctacagaaacagcaagctgaccagactgctgcaggacagcctgggcggcaacagcaagaccatgatgtgcgccaacatcggccccgccgactacaactacgacgagaccatcagcaccctgagatacgccaacagagccaagaacatcaagaacaaggccagaatcaacgaggaccccaaggacgccctgctgagacagttccagaaggagatcgaggagctgaagaagaagctggaggagggcgaggagatcagcggcagcgacatcagcggcagcgaggaggacgacgacgaggagggcgaggtgggcgaggacggcgagaagagaaagaagagaagaggcagcagcagcagcagcagcagcgacagcacctgcagcgtgatcgagaagcccctggacaagttcctgcccatccagatcggcaagaagaaggtgagccccgacaagatgatcgagatgcaggccaagatcgacgaggagagaaaggccctggagaccaagctggacatggaggaggaggagagaaacaaggccagagccgagctggagaagagagagaaggacctgctgaaggcccagcaggagcaccagagcctgctggagaagctgagcgccctggagaagaaggtgatcgtgggcggcgtggacctgctggccaaggccgaggagcaggagaagctgctggaggagagcaacatggagctggaggagagaagaaagagagccgagcagctgagaagagagctggaggagaaggagcaggagagactggacatcgaggagaagtacaccagcctgcaggaggaggcccagggcaagaccaagaagctgaagaaggtgtggaccatgctgatggccgccaagagcgagatggccgacctgcagcaggagcaccagagagagatcgagggcctgctggagaacatcagacagctgagcagagagctgagactgcagatgctgatcatcgacaacttcatccccagagactaccaggagatgatcgagaactacgtgcactggaacgaggacatcggcgagtggcagctgaagtgcgtggcctacaccggcaacaacatgagaaagcagacccccgtgcccgacaagaaggagaaggaccccttcgaggtggacctgagccacgtgtacctggcctacaccgaggagagcctgagacagagcctgatgaagctggagagacccagaaccagcaagggcaaggccagacccaagaccggcagaagaaagagaagcgccaagcccgagaccgtgatcgacagcctgctgcagtag

SEQ ID NO: 2140 - DNA, 1035 bp, Artificial Sequence
  Description of Artificial Sequence: Synthetic coding sequence
atggtgagcgtgaacagcagccactgcttctacaacgacagcttcaagtacaccctgtacggctgcatgttcagcatggtgttcgtgctgggcctgatcagcaactgcgtggccatctacatcttcatctgcgtgctgaaggtgagaaacgagaccaccacctacatgatcaacctggccatgagcgacctgctgttcgtgttcaccctgcccttcagaatcttctacttcaccaccagaaactggcccttcggcgacctgctgtgcaagatcagcgtgatgctgttctacaccaacatgtacggcagcatcctgttcctgacctgcatcagcgtggacagattcctggccatcgtgtaccccttcaagagcaagaccctgagaaccaagagaaacgccaagatcgtgtgcaccggcgtgtggctgaccgtgatcggcggcagcgcccccgccgtgttcgtgcagagcacccacagccagggcaacaacgccagcgaggcctgcttcgagaacttccccgaggccacctggaagacctacctgagcagaatcgtgatcttcatcgagatcgtgggcttcttcatccccctgatcctgaacgtgacctgcagcagcatggtgctgaagaccctgaccaagcccgtgaccctgagcagaagcaagatcaacaagaccaaggtgctgaagatgatcttcgtgcacctgatcatcttctgcttctgcttcgtgccctacaacatcaacctgatcctgtacagcctggtgagaacccagaccttcgtgaactgcagcgtggtggccgccgtgagaaccatgtaccccatcaccctgtgcatcgccgtgagcaactgctgcttcgaccccatcgtgtactacttcaccagcgacaccatccagaacagcatcaagatgaagaactggagcgtgagaagaagcgacttcagattcagcgaggtgcacggcgccgagaacttcatccagcacaacctgcagaccctgaagagcaagatcttcgacaacgagagcgccgcctag

SEQ ID NO: 2141 - DNA, 1035 bp, Artificial Sequence; identical to SEQ ID NO: 2140
  Description of Artificial Sequence: Synthetic coding sequence

SEQ ID NO: 2142 - DNA, 795 bp, Artificial Sequence
  Description of Artificial Sequence: Synthetic coding sequence
atgctgagaggcccctgggccttccactacaacgtgagcagccacggctgccagctgctgccctggacccagcacagcccccacaccagactgagaagaagcggcagatgcgacctgttccagaagaaggactacgtgagaacctgcatcatgaacaacggcgtgggctacagaggcaccatggccaccaccgtgggcggcctgccctgccaggcctggagccacaagttccccaacgaccacaagtacacccccaccctgagaaacggcctggaggagaacttctgcagaaaccccgacggcgaccccggcggcccctggtgctacaccaccgaccccgccgtgagattccagagctgcggcatcaagagctgcagagaggccgcctgcgtgtggtgcaacggcgaggagtacagaggcgccgtggacagaaccgagagcggcagagagtgccagagatgggacctgcagcacccccaccagcaccccttcgagcccggcaagttcctggaccagggcctggacgacaactactgcagaaaccccgacggcagcgagagaccctggtgctacaccaccgacccccagatcgagagagagttctgcgacctgcccagatgcggcagcgaggcccagcccagacaggaggccaccaccgtgagctgcttcagaggcaagggcgagggctacagaggcaccgccaacaccaccaccgccggcgtgccctgccagagatgggacgcccagatcccccaccagcacagattcacccccgagaagtacgcctgcaagtag

SEQ ID NO: 2143 - DNA, 2178 bp, Artificial Sequence
  Description of Artificial Sequence: Synthetic coding sequence
atgggcctgtggtgggtgaccgtgcagccccccgccagaagaatgggctggctgcccctgctgctgctgctgacccagtgcctgggcgtgcccggccagagaagccccctgaacgacttccaggtgctgagaggcaccgagctgcagcacctgctgcacgccgtggtgcccggcccctggcaggaggacgtggccgacgccgaggagtgcgccggcagatgcggccccctgatggactgcagagccttccactacaacgtgagcagccacggctgccagctgctgccctggacccagcacagcccccacaccagactgagaagaagcggcagatgcgacctgttccagaagaaggactacgtgagaacctgcatcatgaacaacggcgtgggctacagaggcaccatggccaccaccgtgggcggcctgccctgccaggcctggagccacaagttccccaacgaccacaagtacacccccaccctgagaaacggcctggaggagaacttctgcagaaaccccgacggcgaccccggcggcccctggtgctacaccaccgaccccgccgtgagattccagagctgcggcatcaagagctgcagagaggccgcctgcgtgtggtgcaacggcgaggagtacagaggcgccgtggacagaaccgagagcggcagagagtgccagagatgggacctgcagcacccccaccagcaccccttcgagcccggcaagttcctggaccagggcctggacgacaactactgcagaaaccccgacggcagcgagagaccctggtgctacaccaccgacccccagatcgagagagagttctgcgacctgcccagatgcggcagcgaggcccagcccagacaggaggccaccaccgtgagctgcttcagaggcaagggcgagggctacagaggcaccgccaacaccaccaccgccggcgtgccctgccagagatgggacgcccagatcccccaccagcacagattcacccccgagaagtacgcctgcaaggacctgagagagaacttctgcagaaaccccgacggcagcgaggccccctggtgcttcaccctgagacccggcatgagagccgccttctgctaccagatcagaagatgcaccgacgacgtgagaccccaggactgctaccacggcgccggcgagcagtacagaggcaccgtgagcaagaccagaaagggcgtgcagtgccagagatggagcgccgagaccccccacaagccccagttcaccttcaccagcgagccccacgcccagctggaggagaacttctgcagaaaccccgacggcgacagccacggcccctggtgctacaccatggaccccagaacccccttcgactactgcgccctgagaagatgcgccgacgaccagccccccagcatcctggacccccccgaccaggtgcagttcgagaagtgcggcaagagagtggacagactggaccagagaagaagcaagctgagagtggtgggcggccaccccggcaacagcccctggaccgtgagcctgagaaacagacagggccagcacttctgcggcggcagcctggtgaaggagcagtggatcctgaccgccagacagtgcttcagcagctgccacatgcccctgaccggctacgaggtgtggctgggcaccctgttccagaacccccagcacggcgagcccagcctgcagagagtgcccgtggccaagatggtgtgcggccccagcggcagccagctggtgctgctgaagctggagagaagcgtgaccctgaaccagagagtggccctgatctgcctgccccccgagtggtacgtggtgccccccggcaccaagtgcgagatcgccggctggggcgagaccaagggcaccggcaacgacaccgtgctgaacgtggccctgctgaacgtgatcagcaaccaggagtgcaacatcaagcacagaggcagagtgagagagagcgagatgtgcaccgagggcctgctggcccccgtgggcgcctgcgagggcgactacggcggccccctggcctgcttcacccacaactgctgggtgctggagggcatcatcatccccaacagagtgtgcgccagaagcagatggcccgccgtgttcaccagagtgagcgtgttcgtggactggatccacaaggtgatgagactgggctag

SEQ ID NO: 2144 - DNA, 495 bp, Artificial Sequence
  Description of Artificial Sequence: Synthetic coding sequence
atgggctggctgcccctgctgctgctgctgacccagtgcctgggcgtgcccggccagagaagccccctgaacgacttccaggtgctgagaggcaccgagctgcagcacctgctgcacgccgtggtgcccggcccctggcaggaggacgtggccgacgccgaggagtgcgccggcagatgcggccccctgatggactgcagagccttccactacaacgtgagcagccacggctgccagctgctgccctggacccagcacagcccccacaccagactgagaagaagcggcagatgcgacctgttccagaagaagggcaccagacccctgagcggcatggcctggaagagaaccagcgccgtgaccctgatggccacccccgaggtgctgggcgccacccagcagaccctgctgtgcgccagcagagccgccgccagcaaccccgccggcagacccagagtgagcggcgccatggccagaaacaccgccgccagatag

SEQ ID NO: 2145 - DNA, 2070 bp, Artificial Sequence
  Description of Artificial Sequence: Synthetic coding sequence
atggcccccgcccccgtgaccctgctggcccccggcgccgccagcagcatgagctgcagccagcccggccagagaagccccagcaacgacttccaggtgctgagaggcaccgagctgcagcacctgctgcacgccgtggtgcccggcccctggcaggaggacgtggccgacgccgaggagtgcgccggcagatgcggccccctgatggactgctgggccttccactacaacgtgagcagccacggctgccagctgctgccctggacccagcacagcccccacagcagactgtggcacagcggcagatgcgacctgttccaggagaagggcgagtggggctacatgcccaccctgagaaacggcctggaggagaacttctgcagaaaccccgacggcgaccccggcggcccctggtgccacaccaccgaccccgccgtgagattccagagctgcagcatcaagagctgcagagtggccgcctgcgtgtggtgcaacggcgaggagtacagaggcgccgtggacagaaccgagagcggcagagagtgccagagatgggacctgcagcacccccaccagcaccccttcgagcccggcaagttcctggaccagggcctggacgacaactactgcagaaaccccgacggcagcgagagaccctggtgctacaccaccgacccccagatcgagagagagttctgcgacctgcccagatgcggcagcgaggcccagcccagacaggaggccaccagcgtgagctgcttcagaggcaagggcgagggctacagaggcaccgccaacaccaccaccgccgcctacctggccagcgtgggcaccagaaagagccacatcagcaccgacctgagacagaagaacaccagagccagcgaggtgggcggcggcgccggcgtgggcacctgctgctgcggcgacctgagagagaacttctgctggaacctggacggcagcgaggccccctggtgcttcaccctgagacccggcaccagagtgggcttctgctaccagatcagaagatgcaccgacgacgtgagaccccaggactgctaccacggcgccggcgagcagtacagaggcaccgtgagcaagaccagaaagggcgtgcagtgccagagatggagcgccgagaccccccacaagctgcaggccctgaccctgggcagacacgccctgatgagcggcaccagagcctggaagtggctgagactgccctgccacgacttcgcccccgcccccgccagcgtgcacatctacctgagaaccgcctgcaccaccggcggcgagctgctgcccgaccccgacggcgacagccacggcccctggtgctacaccatggaccccagaacccccttcgactactgcgccctgagaagatgcgaccaggtgcagttcgagaagtgcggcaagagagtggacagactggaccagagaagaagcaagctgagagtggccggcggccaccccggcaacagcccctggaccgtgagcctgagaaacagacacatgcccctgaccggctacgaggtgtggctgggcaccctgttccagaacccccagcacggcgagcccggcctgcagagagtgcccgtggccaagatgctgtgcggccccagcggcagccagctggtgctgctgaagctggagagaagcgtgaccctgaaccagagagtggccctgatctgcctgccccccgagtggtacgtggtgccccccggcaccaagtgcgagatcgccggctggggcgagaccaagggcaccggcaacgacaccgtgctgaacgtggccctgctgaacgtgatcagcaaccaggagtgcaacatcaagcacagaggccacgtgagagagagcgagatgtgcaccgagggcctgctggcccccgtgggcgcctgcgagggcgactacggcggccccctggcctgcttcacccacaactgctgggtgctgaagggcatcagaatccccaacagagtgtgcaccagaagcagatggcccgccgtgttcaccagagtgagcgtgttcgtggactggatccacaaggtgatgagactgggctag

SEQ ID NO: 2146 - DNA, 1698 bp, Artificial Sequence
  Description of Artificial Sequence: Synthetic coding sequence
atgaccagcagatgcagcggcgcccagagctacctgctgcacgccgtggtgcccggcccctggcaggaggacgtggccgacgccgaggagtgcgccggcagatgcggccccctgatggactgctgggccttccactacaacgtgagcagccacggctgccagctgctgccctggacccagcacagcccccacagcagactgtggcacagcggcagatgcgacctgttccaggagaaggactacatcagaacctgcatcatgaacaacggcgtgggctacagaggcaccatggccaccaccgtgggcggcctgagctgccaggcctggagccacaagttccccaacgaccacaagtacatgcccaccctgagaaacggcctggaggagaacttctgcagaaaccccgacggcgaccccggcggcccctggtgccacaccaccgaccccgccgtgagattccagagctgcagcatcaagagctgcagagtggccgcctgcgtgtggtgcaacggcgaggagtacagaggcgccgtggacagaaccgagagcggcagagagtgccagagatgggacctgcagcacccccaccagcaccccttcgagcccggcaagttcctggaccagggcctggacgacaactactgcagaaaccccgacggcagcgagagaccctggtgctacaccaccgacccccagatcgagagagagttctgcgacctgcccagatgcggcagcgaggcccagcccagacaggaggccaccagcgtgagctgcttcagaggcaagggcgagggctacagaggcaccgccaacaccaccaccggcgtgccctgccagagatgggacgcccagatcccccaccagcacagattcacccccgagaagtacgcctgcaaggacctgagagagaacttctgctggaacctggacggcagcgaggccccctggtgcttcaccctgagacccggcaccagagtgggcttctgctaccagatcagaagatgcaccgacgacgtgagaccccaggactgctaccacggcgccggcgagcagtacagaggcaccgtgagcaagaccagaaagggcgtgcagtgccagagatggagcgccgagaccccccacaagctgcagttcaccttcaccagcgagccccacgcccagctggaggagaacttctgccagcccgacggcgacagccacggcccctggtgctacaccatggaccccagaacccccttcgactactgcgccctgagaagatgcgccgacgaccagccccccagcatcctggacccccccaaccaggtgcagttcgagaagtgcggcaagagagtggacagactggaccagagaagaagcaagctgagagtggccggcggccaccccggcaacagcccctggaccgtgagcctgagaaacagacagggccagcacttctgcgccggcagcctggtgaaggagcagtggatcctgaccgccagacagtgcttcagcagctgccacatgcccctgaccggctacgaggtgtggctgggcaccctgttccagaacccccagcacggcgagcccggcctgcagagagtgcccgtggccaagatgctgtgcggccccagcggcagccagctggtgctgctgaagctggagagaagcgtgaccctgaaccagagagtggccctgatctgcctgccccccgagtag

SEQ ID NO: 2147 - DNA, 2148 bp, Artificial Sequence
  Description of Artificial Sequence: Synthetic coding sequence
atggcccccgcccccgtgaccctgctggcccccggcgccgccagcagcatgagctgcagccagcccggccagagaagccccagcaacgacttccaggtgctgagaggcaccgagctgcagcacctgctgcacgccgtggtgcccggcccctggcaggaggacgtggccgacgccgaggagtgcgccggcagatgcggccccctgatggactgctgggccttccactacaacgtgagcagccacggctgccagctgctgccctggacccagcacagcccccacagcagactgtggcacagcggcagatgcgacctgttccaggagaagggcgagtggggctacatgcccaccctgagaaacggcctggaggagaacttctgcagaaaccccgacggcgaccccggcggcccctggtgccacaccaccgaccccgccgtgagattccagagctgcagcatcaagagctgcagagtggccgcctgcgtgtggtgcaacggcgaggagtacagaggcgccgtggacagaaccgagagcggcagagagtgccagagatgggacctgcagcacccccaccagcaccccttcgagcccggcaagttcctggaccagggcctggacgacaactactgcagaaaccccgacggcagcgagagaccctggtgctacaccaccgacccccagatcgagagagagttctgcgacctgcccagatgcggcagcgaggcccagcccagacaggaggccaccagcgtgagctgcttcagaggcaagggcgagggctacagaggcaccgccaacaccaccaccgccgcctacctggccagcgtgggcaccagaaagagccacatcagcaccgacctgagacagaagaacaccagagccagcgaggtgggcggcggcgccggcgtgggcacctgctgctgcggcgacctgagagagaacttctgctggaacctggacggcagcgaggccccctggtgcttcaccctgagacccggcaccagagtgggcttctgctaccagatcagaagatgcaccgacgacgtgagaccccaggactgctaccacggcgccggcgagcagtacagaggcaccgtgagcaagaccagaaagggcgtgcagtgccagagatggagcgccgagaccccccacaagctgcaggccctgaccctgggcagacacgccctgatgagcggcaccagagcctggaagtggctgagactgccctgccacgacttcgcccccgcccccgccagcgtgcacatctacctgagaaccgcctgcaccaccggcggcgagctgctgcccgaccccgacggcgacagccacggcccctggtgctacaccatggaccccagaacccccttcgactactgcgccctgagaagatgcgaccaggtgcagttcgagaagtgcggcaagagagtggacagactggaccagagaagaagcaagctgagagtggccggcggccaccccggcaacagcccctggaccgtgagcctgagaaacagacagggccagcacttctgcgccggcagcctggtgaaggagcagtggatcctgaccgccagacagtgcttcagcagctgccacatgcccctgaccggctacgaggtgtggctgggcaccctgttccagaacccccagcacggcgagcccggcctgcagagagtgcccgtggccaagatgctgtgcggccccagcggcagccagctggtgctgctgaagctggagagaagcgtgaccctgaaccagagagtggccctgatctgcctgccccccgagtggtacgtggtgccccccggcaccaagtgcgagatcgccggctggggcgagaccaagggcaccggcaacgacaccgtgctgaacgtggccctgctgaacgtgatcagcaaccaggagtgcaacatcaagcacagaggccacgtgagagagagcgagatgtgcaccgagggcctgctggcccccgtgggcgcctgcgagggcgactacggcggccccctggcctgcttcacccacaactgctgggtgctgaagggcatcagaatccccaacagagtgtgcaccagaagcagatggcccgccgtgttcaccagagtgagcgtgttcgtggactggatccacaaggtgatgagactgggctag

SEQ ID NO: 2148 - DNA, 1101 bp, Artificial Sequence
  Description of Artificial Sequence: Synthetic coding sequence
atgagagtgatggcccccagagccctgctgctgctgctgagcggcggcctggccctgaccgagacctgggcctgcagccacagcatgagatacttcgacaccgccgtgagcagacccggcagaggcgagcccagattcatcagcgtgggctacgtggacgacacccagttcgtgagattcgacagcgacgccgccagccccagaggcgagcccagagccccctgggtggagcaggagggccccgagtactgggacagagagacccagaagtacaagagacaggcccaggccgacagagtgagcctgagaaacctgagaggctactacaaccagagcgaggacggcagccacaccctgcagagaatgagcggctgcgacctgggccccgacggcagactgctgagaggctacgaccagagcgcctacgacggcaaggactacatcgccctgaacgaggacctgagaagctggaccgccgccgacaccgccgcccagatcacccagagaaagctggaggccgccagagccgccgagcagctgagagcctacctggagggcacctgcgtggagtggctgagaagatacctggagaacggcaaggagaccctgcagagagccgagccccccaagacccacgtgacccaccaccccctgagcgaccacgaggccaccctgagatgctgggccctgggcttctaccccgccgagatcaccctgacctggcagagagacggcgaggaccagacccaggacaccgagctggtggagaccagacccgccggcgacggcaccttccagaagtgggccgccgtggtggtgcccagcggccaggagcagagatacacctgccacatgcagcacgagggcctgcaggagcccctgaccctgagctgggagcccagcagccagcccaccatccccatcatgggcatcgtggccggcctggccgtgctggtggtgctggccgtgctgggcgccgtggtgaccgccatgatgtgcagaagaaagagcagcggcggcaagggcggcagctgcagccaggccgcctgcagcaacagcgcccagggcagcgacgagagcctgatcacctgcaaggcctag

SEQ ID NO: 2149 - DNA, 396 bp, Artificial Sequence
  Description of Artificial Sequence: Synthetic coding sequence
atgagagtgatggcccccagagccctgctgctgctgctgagcggcggcctggccctgaccgagacctgggcctgcagccacagcatgagatacttcgacaccgccgtgagcagacccggcagaggcgagcccagattcatcagcgtgggctacgtggacgacacccagttcgtgagattcgacagcgacgccgccagccccagaggcgagcccagagccccctgggtggagcaggagggccccgagtactgggacagagagacccagaagtacaagagacaggcccaggccgacagagtgagcctgagaaacctgagaggctactacaaccagagcgaggacgaggacgtgtggctgagacccggcgccagaagagcccccccccccagagtgtag

SEQ ID NO: 2150 - DNA, 1119 bp, Artificial Sequence
  Description of Artificial Sequence: Synthetic coding sequence
atgagagtgatggcccccagaaccctgatcctgctgctgagcggcgccctggccctgaccgagacctgggcctgcagccacagcatgagatacttctacaccgccgtgagcagacccggcagaggcgagcccagattcatcgccgtgggctacgtggacgacacccagttcgtgcagttcgacagcgacgccgccagccccagaggcgagcccagagccccctgggtggagcaggagggccccgagtactgggacagagagacccagaagtacaagagacaggcccagaccgacagagtgaacctgagaaagctgagaggctactacaaccagagcgaggccggcagccacaccctgcagagaatgtacggctgcgacctgggccccgacggcagactgctgagaggctacaaccagttcgcctacgacggcaaggactacatcgccctgaacgaggacctgagaagctggaccgccgccgacaaggccgcccagatcacccagagaaagtgggaggccgccagagaggccgagcagagaagagcctacctggagggcacctgcgtggagtggctgagaagatacctggagaacggcaagaagaccctgcagagagccgagcaccccaagacccacgtgacccaccaccccgtgagcgaccacgaggccaccctgagatgctgggccctgggcttctaccccgccgagatcaccctgacctggcagagagacggcgaggaccagacccaggacaccgagctggtggagaccagacccgccggcgacggcaccttccagaagtgggccgccgtggtggtgcccagcggcgaggagcagagatacacctgccacgtgcagcacgagggcctgcccgagcccctgaccctgagatggggccccagcagccagcccaccatccccatcgtgggcatcgtggccggcctggccgtgctggccgtgctggccgtgctgggcgccgtgatggccgtggtgatgtgcagaagaaagagcagcggccacttcctgcccaccggcggcaagggcggcagctgcagccaggccgccagcagcaacagcgcccagggcagcgacgagagcctgatcgcctgcaaggcctag

SEQ ID NO: 2151 - DNA, 1119 bp, Artificial Sequence
  Description of Artificial Sequence: Synthetic coding sequence
atgagagtgatggcccccagagccctgctgctgctgctgagcggcggcctggccctgaccgagacctgggcctgcagccacagcatgagatacttcgacaccgccgtgagcagacccggcagaggcgagcccagattcatcagcgtgggctacgtggacgacacccagttcgtgagattcgacagcgacgccgccagccccagaggcgagcccagagccccctgggtggagcaggagggccccgagtactgggacagagagacccagaagtacaagagacaggcccaggccgacagagtgagcctgagaaacctgagaggctactacaaccagagcgaggacggcagccacaccctgcagagaatgagcggctgcgacctgggccccgacggcagactgctgagaggctacgaccagagcgcctacgacggcaaggactacatcgccctgaacgaggacctgagaagctggaccgccgccgacaccgccgcccagatcacccagagaaagctggaggccgccagagccgccgagcagctgagagcctacctggagggcacctgcgtggagtggctgagaagatacctggagaacggcaaggagaccctgcagagagccgagccccccaagacccacgtgacccaccaccccctgagcgaccacgaggccaccctgagatgctgggccctgggcttctaccccgccgagatcaccctgacctggcagagagacggcgaggaccagacccaggacaccgagctggtggagaccagacccgccggcgacggcaccttccagaagtgggccgccgtggtggtgcccagcggccaggagcagagatacacctgccacatgcagcacgagggcctgcaggagcccctgaccctgagctgggagcccagcagccagcccaccatccccatcatgggcatcgtggccggcctggccgtgctggtggtgctggccgtgctgggcgccgtggtgaccgccatgatgtgcagaagaaagagcagcggccacttcctgcccaccggcggcaagggcggcagctgcagccaggccgcctgcagcaacagcgcccagggcagcgacgagagcctgatcacctgcaaggcctag

SEQ ID NO: 2152 - DNA, 1194 bp, Artificial Sequence
  Description of Artificial Sequence: Synthetic coding sequence
atgagagtgatggcccccagaaccctgatcctgctgctgagcggcgccctggccctgaccgagacctgggcctgcagccacagcatgagatacttctacaccgccgtgagcagacccggcagaggcgagcccagattcatcgccgtgggctacgtggacgacacccagttcgtgcagttcgacagcgacgccgccagccccagaggcgagcccagagccccctgggtggagcaggagggccccgagtactgggacagagagacccagaagtacaagagacaggcccagaccgacagagtgaacctgagaaagctgagaggctactacaaccagagcgaggccggcagccacaccctgcagagaatgtacggctgcgacctgggccccgacggcagactgctgagaggctacaaccagttcgcctacgacggcaaggactacatcgccctgaacgaggacctgagaagctggaccgccgccgacaaggccgcccagatcacccagagaaagtgggaggccgccagagaggccgagcagagaagagcctacctggagggcacctgcgtggagtggctgagaagatacctggagaacggcaagaagaccctgcagagagccgagcaccccaagacccacgtgacccaccaccccgtgagcgaccacgaggccaccctgagatgctgggccctgggcttctaccccgccgagatcaccctgacctggcagagagacggcgaggaccagacccaggacaccgagctggtggagaccagacccgccggcgacggcaccttccagaagtgggccgccgtggtggtgcccagcggcgaggagcagagatacacctgccacgtgcagcacgagggcctgcccgagcccctgaccctgagatggggccccagcagccagcccaccatccccatcgtgggcatcgtggccggcctggccgtgctggccgtgctggccgtgctgggcgccgtgatggccgtggtgatgtgcagaagaaagagcagcggcagagagggcgtgagaagcggcgtgtggcccgccaccgtgcccagagccctgatgagcctgagcagcctggtgaagcccgagaccgccgcctgcgtgggcctgagatgcagaatcagcagccacctgagcttcgtgaccagcagagccagcggcatcagcttctgcaagggcatctag

SEQ ID NO: 2153 - DNA, 1119 bp, Artificial Sequence; identical to SEQ ID NO: 2150
  Description of Artificial Sequence: Synthetic coding sequence

SEQ ID NO: 2154 - DNA, 1194 bp, Artificial Sequence
  Description of Artificial Sequence: Synthetic coding sequence
atgagagtgatggcccccagagccctgctgctgctgctgagcggcggcctggccctgaccgagacctgggcctgcagccacagcatgagatacttcgacaccgccgtgagcagacccggcagaggcgagcccagattcatcagcgtgggctacgtggacgacacccagttcgtgagattcgacagcgacgccgccagccccagaggcgagcccagagccccctgggtggagcaggagggccccgagtactgggacagagagacccagaagtacaagagacaggcccaggccgacagagtgagcctgagaaacctgagaggctactacaaccagagcgaggacggcagccacaccctgcagagaatgagcggctgcgacctgggccccgacggcagactgctgagaggctacgaccagagcgcctacgacggcaaggactacatcgccctgaacgaggacctgagaagctggaccgccgccgacaccgccgcccagatcacccagagaaagctggaggccgccagagccgccgagcagctgagagcctacctggagggcacctgcgtggagtggctgagaagatacctggagaacggcaaggagaccctgcagagagccgagccccccaagacccacgtgacccaccaccccctgagcgaccacgaggccaccctgagatgctgggccctgggcttctaccccgccgagatcaccctgacctggcagagagacggcgaggaccagacccaggacaccgagctggtggagaccagacccgccggcgacggcaccttccagaagtgggccgccgtggtggtgcccagcggccaggagcagagatacacctgccacatgcagcacgagggcctgcaggagcccctgaccctgagctgggagcccagcagccagcccaccatccccatcatgggcatcgtggccggcctggccgtgctggtggtgctggccgtgctgggcgccgtggtgaccgccatgatgtgcagaagaaagagcagcggcagagagggcgtgaagagcggcgtgtgggccgccaccgtgcccagagccctgatgagcctgagcagcctggtgaagcccgagaccgccgcctgcgtgggcctgagatgcagaatcagcagccacctgagcttcgtgaccagcagagccagcggcatcagcttctgcaagggcacctag

SEQ ID NO: 2155 - DNA, 1101 bp, Artificial Sequence
  Description of Artificial Sequence: Synthetic coding sequence
atgagagtgatggcccccagaaccctgatcctgctgctgagcggcgccctggccctgaccgagacctgggcctgcagccacagcatgagatacttctacaccgccgtgagcagacccggcagaggcgagcccagattcatcgccgtgggctacgtggacgacacccagttcgtgcagttcgacagcgacgccgccagccccagaggcgagcccagagccccctgggtggagcaggagggccccgagtactgggacagagagacccagaagtacaagagacaggcccagaccgacagagtgaacctgagaaagctgagaggctactacaaccagagcgaggccggcagccacaccctgcagagaatgtacggctgcgacctgggccccgacggcagactgctgagaggctacaaccagttcgcctacgacggcaaggactacatcgccctgaacgaggacctgagaagctggaccgccgccgacaaggccgcccagatcacccagagaaagtgggaggccgccagagaggccgagcagagaagagcctacctggagggcacctgcgtggagtggctgagaagatacctggagaacggcaagaagaccctgcagagagccgagcaccccaagacccacgtgacccaccaccccgtgagcgaccacgaggccaccctgagatgctgggccctgggcttctaccccgccgagatcaccctgacctggcagagagacggcgaggaccagacccaggacaccgagctggtggagaccagacccgccggcgacggcaccttccagaagtgggccgccgtggtggtgcccagcggcgaggagcagagatacacctgccacgtgcagcacgagggcctgcccgagcccctgaccctgagatggggccccagcagccagcccaccatccccatcgtgggcatcgtggccggcctggccgtgctggccgtgctggccgtgctgggcgccgtgatggccgtggtgatgtgcagaagaaagagcagcggcggcaagggcggcagctgcagccaggccgccagcagcaacagcgcccagggcagcgacgagagcctgatcgcctgcaaggcctag

SEQ ID NO: 2156 - DNA, 1101 bp, Artificial Sequence; identical to SEQ ID NO: 2155
  Description of Artificial Sequence: Synthetic coding sequence

SEQ ID NO: 2157 - DNA, 1194 bp, Artificial Sequence; identical to SEQ ID NO: 2152
  Description of Artificial Sequence: Synthetic coding sequence

SEQ ID NO: 2158 - DNA, 1194 bp, Artificial Sequence
  Description of Artificial Sequence: Synthetic coding sequence
atgagagtgatggcccccagaaccctgatcctgctgctgagcggcgccctggccctgaccgagacctgggcctgcagccacagcatgagatacttctacaccgccgtgagcagacccggcagaggcgagcccagattcatcgccgtgggctacgtggacgacacccagttcgtgagattcgacagcgacgccgccagccccagaggcgagcccagagccccctgggtggagcaggagggccccgagtactgggacagagagacccagaagtacaagagacaggcccagaccgacagagtgagcctgagaaacctgagaggctactacaaccagagcgaggccggcagccacaccctgcagtggatgtacggctgcgacctgggccccgacggcagactgctgagaggctacgaccagagcgcctacgacggcaaggactacatcgccctgaacgaggacctgagaagctggaccgccgccgacaccgccgcccagatcacccagagaaagtgggaggccgccagagccgccgagcagcagagagcctacctggagggcacctgcgtggagtggctgagaagatacctggagaacggcaaggagaccctgcagagagccgagcaccccaagacccacgtgacccaccacctggtgagcgaccacgaggccaccctgagatgctgggccctgggcttctaccccgccgagatcaccctgacctggcagagagacggcgaggaccagacccaggacaccgagctggtggagaccagacccgccggcgacggcaccttccagaagtgggccgccgtggtggtgcccagcggcgaggagcagagatacacctgccacgtgcagcacgagggcctgcccgagcccctgaccctgagatgggagcccagcagccagcccaccatccccatcgtgggcatcgtggccggcctggccgtgctggccgtgctggccgtgctgggcgccgtggtggccgtggtgatgtgcagaagaaagagcagcggcagagagggcgtgagaagcggcgtgtggcccgccaccgtgcccagagccctgatgagcctgagcagcctggtgaagcccgagaccgccgcctgcgtgggcctgagatgcagaatcagcagccacctgagcttcgtgaccagcagagccagcggcatcagcttctgcaagggcatctag

SEQ ID NO: 2159 - DNA, 786 bp, Artificial Sequence
  Description of Artificial Sequence: Synthetic coding sequence
tgaagagtgatggcccccagagccctgctgctgctgctgagcggcggcctggccctgaccgagacctgggcctgcagccacagcatgagatacttcgacaccgccgtgagcagacccggcagaggcgagcccagattcatcagcgtgggctacgtggacgacacccagttcgtgagattcgacagcgacgccgccagccccagaggcgagcccagagccccctgggtggagcaggagggccccgagtactgggacagagagacccagaagtacaagagacaggcccaggccgacagagtgagcctgagaaacctgagaggctactacaaccagagcgaggacggcagccacaccctgcagagaatgagcggctgcgacctgggccccgacggcagactgctgagaggctacgaccagagcgcctacgacggcaaggactacatcgccctgaacgaggacctgagaagctggaccgccgccgacaccgccgcccagatcacccagagaaagctggaggccgccagagccgccgagcagctgagagcctacctggagggcacctgcgtggagtggctgagaagatacctggagaacggcaaggagaccctgcagagagccgagccccccaagacccacgtgacccaccaccccctgagcgaccacgaggccagcagaagatggaacctgcccgaggtgggcagctgcggcggcgccttctggaccagagccgagatccacgtgccctacgccgccagaggcgccgccagagccccccaccccgagtag

SEQ ID NO: 2160 - DNA, 1119 bp, Artificial Sequence
  Description of Artificial Sequence: Synthetic coding sequence
atgagagtgatggcccccagaaccctgatcctgctgctgagcggcgccctggccctgaccgagacctgggccggcagccacagcatgagatacttctacaccgccgtgagcagacccggcagaggcgagccccacttcatcgccgtgggctacgtggacgacacccagttcgtgagattcgacagcgacgccgccagccccagaggcgagcccagagccccctgggtggagcaggagggccccgagtactgggacagagagacccagaagtacaagagacaggcccagaccgacagagtgagcctgagaaacctgagaggctactacaaccagagcgaggccggcagccacatcatccagagaatgtacggctgcgacgtgggccccgacggcagactgctgagaggctacgaccagtacgcctacgacggcaaggactacatcgccctgaacgaggacctgagaagctggaccgccgccgacaccgccgcccagatcacccagagaaagtgggaggccgccagagaggccgagcagctgagagcctacctggagggcctgtgcgtggagtggctgagaagatacctgaagaacggcaaggagaccctgcagagagccgagcaccccaagacccacgtgacccaccaccccgtgagcgaccacgaggccaccctgagatgctgggccctgggcttctaccccgccgagatcaccctgacctggcagtgggacggcgaggaccagacccaggacaccgagctggtggagaccagacccgccggcgacggcaccttccagaagtgggccgccgtggtggtgcccagcggcgaggagcagagatacacctgccacgtgcagcacgagggcctgcccgagcccctgaccctgagatgggagcccagcagccagcccaccatccccatcgtgggcatcgtggccggcctggccgtgctggccgtgctggccgtgctgggcgccgtggtggccgtggtgatgtgcagaagaaagagcagcggccacttcctgcccaccggcggcaagggcggcagctgcagccaggccgccagcagcaacagcgcccagggcagcgacgagagcctgatcgcctgcaaggcctag

SEQ ID NO: 2161 - DNA, 1020 bp, Artificial Sequence
  Description of Artificial Sequence: Synthetic coding sequence
atgagagtgatggcccccagaaccctgatcctgctgctgagcggcgccctggccctgaccgagacctgggcctgcagccacagcatgagatacttctacaccgccgtgagcagacccggcagaggcgagcccagattcatcgccgtgggctacgtggacgacacccagttcgtgagattcgacagcgacgccgccagccccagaggcgagcccagagccccctgggtggagcaggagggccccgagtactgggacagagagacccagaagtacaagagacaggcccagaccgacagagtgagcctgagaaacctgagaggctactacaaccagagcgaggccggcagccacaccctgcagtggatgtacggctgcgacctgggccccgacggcagactgctgagaggctacgaccagagcgcctacgacggcaaggactacatcgccctgaacgaggacctgagaagctggaccgccgccgacaccgccgcccagatcacccagagaaagtgggaggccgccagagccgccgagcagcagagagcctacctggagggcacctgcgtggagtggctgagaagatacctggagaacggcaaggagaccctgcagagagccgagcaccccaagacccacgtgacccaccacctggtgagcgaccacgaggccaccctgagatgctgggccctgggcttctaccccgccgagatcaccctgacctggcagagagacggcgaggaccagacccaggacaccgagctggtggagaccagacccgccggcgacggcaccttccagaagtgggccgccgtggtggtgcccagcggcgaggagcagagatacacctgccacgtgcagcacgagggcctgcccgagcccctgaccctgagatgggagcccagcagccagcccaccatccccatcgtgggcatcgtggccggcctggccgtgctggccgtgctggccgtgctgggcgccgtggtggccgtggtgatgtgcagaagaaagagcagcgcctag

SEQ ID NO: 2162 - DNA, 1101 bp, Artificial Sequence
  Description of Artificial Sequence: Synthetic coding sequence
atgagagtgatggcccccagaaccctgatcctgctgctgagcggcgccctggccctgaccgagacctgggcctgcagccacagcatgagatacttcgacaccgccgtgagcagacccggcagaggcgagcccagattcatcagcgtgggctacgtggacgacacccagttcgtgagattcgacagcgacgccgccagccccagaggcgagcccagagccccctgggtggagcaggagggccccgagtactgggacagagagacccagaagtacaagagacaggcccaggccgacagagtgaacctgagaaagctgagaggctactacaaccagagcgaggacggcagccacaccctgcagtggatgtacggctgcgacctgggccccgacggcagactgctgagaggctacgaccagagcgcctacgacggcaaggactacatcgccctgaacgaggacctgagaagctggaccgccgccgacaccgccgcccagatcacccagagaaagtgggaggccgccagagaggccgagcagtggagagcctacctggagggcacctgcgtggagtggctgagaagatacctggagaacggcaaggagaccctgcagagagccgagcaccccaagacccacgtgacccaccaccccgtgagcgaccacgaggccaccctgagatgctgggccctgggcttctaccccgccgagatcaccctgacctggcagagagacggcgaggaccagacccaggacaccgagctggtggagaccagacccgccggcgacggcaccttccagaagtgggccgccgtggtggtgcccagcggcgaggagcagagatacacctgccacgtgcagcacgagggcctgcccgagcccctgaccctgagatgggagcccagcagccagcccaccatccccatcgtgggcatcgtggccggcctggccgtgctggccgtgctggccgtgctgggcgccgtgatggccgtggtgatgtgcagaagaaagagcagcggcggcaagggcggcagctgcagccaggccgccagcagcaacagcgcccagggcagcgacgagagcctgatcgcctgcaaggcctag

SEQ ID NO: 2163 - DNA, 1107 bp, Artificial Sequence
  Description of Artificial Sequence: Synthetic coding sequence
atgagagtgatggcccccagagccctgctgctgctgctgagcggcggcctggccctgaccgagacctgggcctgcagccacagcatgagatacttcgacaccgccgtgagcagacccggcagaggcgagcccagattcatcagcgtgggctacgtggacgacacccagttcgtgagattcgacagcgacgccgccagccccagaggcgagcccagagccccctgggtggagcaggagggccccgagtactgggacagagagacccagaactacaagagacaggcccaggccgacagagtgagcctgagaaacctgagaggctactacaaccagagcgaggacggcagccacaccctgcagagaatgtacggctgcgacctgggccccgacggcagactgctgagaggctacgaccagagcgcctacgacggcaaggactacatcgccctgaacgaggacctgagaagctggaccgccgccgacaccgccgcccagatcacccagagaaagctggaggccgccagagccgccgagcagctgagagcctacctggagggcacctgcgtggagtggctgagaagatacctggagaacggcaaggagaccctgcagagagccgagccccccaagacccacgtgacccaccaccccctgagcgaccacgaggccaccctgagatgctgggccctgggcttctaccccgccgagatcaccctgacctggcagagagacggcgaggaccagacccaggacaccgagctggtggagaccagacccgccggcgacggcaccttccagaagtgggccgccgtggtggtgcccagcggccaggagcagagatacacctgccacatgcagcacgagggcctgcaggagcccctgaccctgagctgggagcccagcagccagcccaccatccccatcatgggcatcgtggccggcctggccgtgctggtggtgctggccgtgctgggcgccgtggtgaccgccatgatgtgcagaagaaagagcagcgccgcctgcgtgggcctgagatgcagaatcagcagccacctgagcttcgtgaccagcagagccagcggcatcagcttctgcaagggcgtgtag

SEQ ID NO: 2164 - DNA, 1194 bp, Artificial Sequence
  Description of Artificial Sequence: Synthetic coding sequence
atgagagtgatggcccccagaaccctgatcctgctgctgagcggcgccctggccctgaccgagacctgggcctgcagccacagcatgagatacttcgacaccgccgtgagcagacccggcagaggcgagcccagattcatcagcgtgggctacgtggacgacacccagttcgtgagattcgacagcgacgccgccagccccagaggcgagcccagagccccctgggtggagcaggagggccccgagtactgggacagagagacccagaagtacaagagacaggcccaggccgacagagtgaacctgagaaagctgagaggctactacaaccagagcgaggacggcagccacaccctgcagtggatgtacggctgcgacctgggccccgacggcagactgctgagaggctacgaccagagcgcctacgacggcaaggactacatcgccctgaacgaggacctgagaagctggaccgccgccgacaccgccgcccagatcacccagagaaagtgggaggccgccagagaggccgagcagtggagagcctacctggagggcacctgcgtggagtggctgagaagatacctggagaacggcaaggagaccctgcagagagccgagcaccccaagacccacgtgacccaccaccccgtgagcgaccacgaggccaccctgagatgctgggccctgggcttctaccccgccgagatcaccctgacctggcagagagacggcgaggaccagacccaggacaccgagctggtggagaccagacccgccggcgacggcaccttccagaagtgggccgccgtggtggtgcccagcggcgaggagcagagatacacctgccacgtgcagcacgagggcctgcccgagcccctgaccctgagatgggagcccagcagccagcccaccatccccatcgtgggcatcgtggccggcctggccgtgctggccgtgctggccgtgctgggcgccgtgatggccgtggtgatgtgcagaagaaagagcagcggcagagagggcgtgagaagcggcgtgtggcccgccaccgtgcccagagccctgatgagcctgagcagcctggtgaagcccgagaccgccgcctgcgtgggcctgagatgcagaatcagcagccacctgagcttcgtgaccagcagagccagcggcatcagcttctgcaagggcatctag

SEQ ID NO: 2165 - DNA, 1119 bp, Artificial Sequence
  Description of Artificial Sequence: Synthetic coding sequence
atgagagtgatggcccccagagccctgctgctgctgctgagcggcggcctggccctgaccgagacctgggcctgcagccacagcatgagatacttcgacaccgccgtgagcagacccggcagaggcgagcccagattcatcagcgtgggctacgtggacgacacccagttcgtgagattcgacagcgacgccgccagccccagaggcgagcccagagccccctgggtggagcaggagggccccgagtactgggacagagagacccagaactacaagagacaggcccaggccgacagagtgagcctgagaaacctgagaggctactacaaccagagcgaggacggcagccacaccctgcagagaatgtacggctgcgacctgggccccgacggcagactgctgagaggctacgaccagagcgcctacgacggcaaggactacatcgccctgaacgaggacctgagaagctggaccgccgccgacaccgccgcccagatcacccagagaaagctggaggccgccagagccgccgagcagctgagagcctacctggagggcacctgcgtggagtggctgagaagatacctggagaacggcaaggagaccctgcagagagccgagccccccaagacccacgtgacccaccaccccctgagcgaccacgaggccaccctgagatgctgggccctgggcttctaccccgccgagatcaccctgacctggcagagagacggcgaggaccagacccaggacaccgagctggtggagaccagacccgccggcgacggcaccttccagaagtgggccgccgtggtggtgcccagcggccaggagcagagatacacctgccacatgcagcacgagggcctgcaggagcccctgaccctgagctgggagcccagcagccagcccaccatccccatcatgggcatcgtggccggcctggccgtgctggtggtgctggccgtgctgggcgccgtggtgaccgccatgatgtgcagaagaaagagcagcggccacttcctgcccaccggcggcaagggcggcagctgcagccaggccgcctgcagcaacagcgcccagggcagcgacgagagcctgatcacctgcaaggcctag

SEQ ID NO: 2166 - DNA, 1101 bp, Artificial Sequence
  Description of Artificial Sequence: Synthetic coding sequence
atgagagtgatggcccccagagccctgctgctgctgctgagcggcggcctggccctgaccgagacctgggcctgcagccacagcatgagatacttcgacaccgccgtgagcagacccggcagaggcgagcccagattcatcagcgtgggctacgtggacgacacccagttcgtgagattcgacagcgacgccgccagccccagaggcgagcccagagccccctgggtggagcaggagggccccgagtactgggacagagagacccagaactacaagagacaggcccaggccgacagagtgagcctgagaaacctgagaggctactacaaccagagcgaggacggcagccacaccctgcagagaatgtacggctgcgacctgggccccgacggcagactgctgagaggctacgaccagagcgcctacgacggcaaggactacatcgccctgaacgaggacctgagaagctggaccgccgccgacaccgccgcccagatcacccagagaaagctggaggccgccagagccgccgagcagctgagagcctacctggagggcacctgcgtggagtggctgagaagatacctggagaacggcaaggagaccctgcagagagccgagccccccaagacccacgtgacccaccaccccctgagcgaccacgaggccaccctgagatgctgggccctgggcttctaccccgccgagatcaccctgacctggcagagagacggcgaggaccagacccaggacaccgagctggtggagaccagacccgccggcgacggcaccttccagaagtgggccgccgtggtggtgcccagcggccaggagcagagatacacctgccacatgcagcacgagggcctgcaggagcccctgaccctgagctgggagcccagcagccagcccaccatccccatcatgggcatcgtggccggcctggccgtgctggtggtgctggccgtgctgggcgccgtggtgaccgccatgatgtgcagaagaaagagcagcggcggcaagggcggcagctgcagccaggccgcctgcagcaacagcgcccagggcagcgacgagagcctgatcacctgcaaggcctag

SEQ ID NO: 2167 - DNA, 1107 bp, Artificial Sequence
  Description of Artificial Sequence: Synthetic coding sequence
atgagagtgatggcccccagaaccctgatcctgctgctgagcggcgccctggccctgaccgagacctgggccggcagccacagcatgagatacttctacaccgccgtgagcagacccggcagaggcgagccccacttcatcgccgtgggctacgtggacgacacccagttcgtgagattcgacagcgacgccgccagccccagaggcgagcccagagccccctgggtggagcaggagggccccgagtactgggacagagagacccagaagtacaagagacaggcccagaccgacagagtgagcctgagaaacctgagaggctactacaaccagagcgaggccggcagccacatcatccagagaatgtacggctgcgacgtgggccccgacggcagactgctgagaggctacgaccagtacgcctacgacggcaaggactacatcgccctgaacgaggacctgagaagctggaccgccgccgacaccgccgcccagatcacccagagaaagtgggaggccgccagagaggccgagcagctgagagcctacctggagggcctgtgcgtggagtggctgagaagatacctgaagaacggcaaggagaccctgcagagagccgagcaccccaagacccacgtgacccaccaccccgtgagcgaccacgaggccaccctgagatgctgggccctgggcttctaccccgccgagatcaccctgacctggcagtgggacggcgaggaccagacccaggacaccgagctggtggagaccagacccgccggcgacggcaccttccagaagtgggccgccgtggtggtgcccagcggcgaggagcagagatacacctgccacgtgcagcacgagggcctgcccgagcccctgaccctgagatgggagcccagcagccagcccaccatccccatcgtgggcatcgtggccggcctggccgtgctggccgtgctggccgtgctgggcgccgtggtggccgtggtgatgtgcagaagaaagagcagcgccgcctgcgtgggcctgagatgcagaatcagcagccacctgagcttcgtgaccagcagagccagcggcatcagcttctgcaagggcatctag

SEQ ID NO: 2168 - DNA, 1194 bp, Artificial Sequence
  Description of Artificial Sequence: Synthetic coding sequence
atgagagtgatggcccccagagccctgctgctgctgctgagcggcggcctggccctgaccgagacctgggcctgcagccacagcatgagatacttcgacaccgccgtgagcagacccggcagaggcgagcccagattcatcagcgtgggctacgtggacgacacccagttcgtgagattcgacagcgacgccgccagccccagaggcgagcccagagccccctgggtggagcaggagggccccgagtactgggacagagagacccagaactacaagagacaggcccaggccgacagagtgagcctgagaaacctgagaggctactacaaccagagcgaggacggcagccacaccctgcagagaatgtacggctgcgacctgggccccgacggcagactgctgagaggctacgaccagagcgcctacgacggcaaggactacatcgccctgaacgaggacctgagaagctggaccgccgccgacaccgccgcccagatcacccagagaaagctggaggccgccagagccgccgagcagctgagagcctacctggagggcacctgcgtggagtggctgagaagatacctggagaacggcaaggagaccctgcagagagccgagccccccaagacccacgtgacccaccaccccctgagcgaccacgaggccaccctgagatgctgggccctgggcttctaccccgccgagatcaccctgacctggcagagagacggcgaggaccagacccaggacaccgagctggtggagaccagacccgccggcgacggcaccttccagaagtgggccgccgtggtggtgcccagcggccaggagcagagatacacctgccacatgcagcacgagggcctgcaggagcccctgaccctgagctgggagcccagcagccagcccaccatccccatcatgggcatcgtggccggcctggccgtgctggtggtgctggccgtgctgggcgccgtggtgaccgccatgatgtgcagaagaaagagcagcggcagagagggcgtgaagagcggcgtgtgggccgccaccgtgcccagagccctgatgagcctgagcagcctggtgaagcccgagaccgccgcctgcgtgggcctgagatgcagaatcagcagccacctgagcttcgtgaccagcagagccagcggcatcagcttctgcaagggcgtgtag

SEQ ID NO: 2169 - DNA, 1068 bp, Artificial Sequence
  Description of Artificial Sequence: Synthetic coding sequence
atgagagtgatggcccccagaaccctgatcctgctgctgagcggcgccctggccctgaccgagacctgggccggcagccacagcatgagatacttctacaccgccgtgagcagacccggcagaggcgagccccacttcatcgccgtgggctacgtggacgacacccagttcgtgagattcgacagcgacgccgccagccccagaggcgagcccagagccccctgggtggagcaggagggccccgagtactgggacagagagacccagaagtacaagagacaggcccagaccgacagagtgagcctgagaaacctgagaggctactacaaccagagcgaggccggcagccacatcatccagagaatgtacggctgcgacgtgggccccgacggcagactgctgagaggctacgaccagtacgcctacgacggcaaggactacatcgccctgaacgaggacctgagaagctggaccgccgccgacaccgccgcccagatcacccagagaaagtgggaggccgccagagaggccgagcagctgagagcctacctggagggcctgtgcgtggagtggctgagaagatacctgaagaacggcaaggagaccctgcagagagccgagcaccccaagacccacgtgacccaccaccccgtgagcgaccacgaggccaccctgagatgctgggccctgggcttctaccccgccgagatcaccctgacctggcagtgggacggcgaggaccagacccaggacaccgagctggtggagaccagacccgccggcgacggcaccttccagaagtgggccgccgtggtggtgcccagcggcgaggagcagagatacacctgccacgtgcagcacgagggcctgcccgagcccctgaccctgagatgggagcccagcagccagcccaccatccccatcgtgggcatcgtggccggcctggccgtgctggccgtgctggccgtgctgggcgccgtggtggccgtggtgatgtgcagaagaaagagcagcgccagcaacagcgcccagggcagcgacgagagcctgatcgcctgcaaggcctag

SEQ ID NO: 2170 - DNA, 1107 bp, Artificial Sequence
  Description of Artificial Sequence: Synthetic coding sequence
atgagagtgatggcccccagaaccctgatcctgctgctgagcggcgccctggccctgaccgagacctgggcctgcagccacagcatgagatacttctacaccgccgtgagcagacccggcagaggcgagcccagattcatcgccgtgggctacgtggacgacacccagttcgtgcagttcgacagcgacgccgccagccccagaggcgagcccagagccccctgggtggagcaggagggccccgagtactgggacagagagacccagaagtacaagagacaggcccagaccgacagagtgaacctgagaaagctgagaggctactacaaccagagcgaggccggcagccacaccctgcagagaatgtacggctgcgacctgggccccgacggcagactgctgagaggctacaaccagttcgcctacgacggcaaggactacatcgccctgaacgaggacctgagaagctggaccgccgccgacaaggccgcccagatcacccagagaaagtgggaggccgccagagaggccgagcagagaagagcctacctggagggcacctgcgtggagtggctgagaagatacctggagaacggcaagaagaccctgcagagagccgagcaccccaagacccacgtgacccaccaccccgtgagcgaccacgaggccaccctgagatgctgggccctgggcttctaccccgccgagatcaccctgacctggcagagagacggcgaggaccagacccaggacaccgagctggtggagaccagacccgccggcgacggcaccttccagaagtgggccgccgtggtggtgcccagcggcgaggagcagagatacacctgccacgtgcagcacgagggcctgcccgagcccctgaccctgagatggggccccagcagccagcccaccatccccatcgtgggcatcgtggccggcctggccgtgctggccgtgctggccgtgctgggcgccgtgatggccgtggtgatgtgcagaagaaagagcagcgccgcctgcgtgggcctgagatgcagaatcagcagccacctgagcttcgtgaccagcagagccagcggcatcagcttctgcaagggcatctag

SEQ ID NO: 2171 - DNA, 786 bp, Artificial Sequence
  Description of Artificial Sequence: Synthetic coding sequence
tgaagagtgatggcccccagaaccctgatcctgctgctgagcggcgccctggccctgaccgagacctgggcctgcagccacagcatgagatacttctacaccgccgtgagcagacccggcagaggcgagcccagattcatcgccgtgggctacgtggacgacacccagttcgtgagattcgacagcgacgccgccagccccagaggcgagcccagagccccctgggtggagcaggagggccccgagtactgggacagagagacccagaagtacaagagacaggcccagaccgacagagtgagcctgagaaacctgagaggctactacaaccagagcgaggccggcagccacaccctgcagtggatgtacggctgcgacctgggccccgacggcagactgctgagaggctacgaccagagcgcctacgacggcaaggactacatcgccctgaacgaggacctgagaagctggaccgccgccgacaccgccgcccagatcacccagagaaagtgggaggccgccagagccgccgagcagcagagagcctacctggagggcacctgcgtggagtggctgagaagatacctggagaacggcaaggagaccctgcagagagccgagcaccccaagacccacgtgacccaccacctggtgagcgaccacgaggccagcagaagatggaacctgcccgaggtgggcagctgcggcggcgccttctggagaagagccgagatccacgtgccctgcgccgccagaggcgccgccggcgccccccaccccgagtag

SEQ ID NO: 2172 - DNA, 1101 bp, Artificial Sequence
  Description of Artificial Sequence: Synthetic coding sequence
atgagagtgatggcccccagaaccctgatcctgctgctgagcggcgccctggccctgaccgagacctgggcctgcagccacagcatgagatacttctacaccgccgtgagcagacccggcagaggcgagcccagattcatcgccgtgggctacgtggacgacacccagttcgtgagattcgacagcgacgccgccagccccagaggcgagcccagagccccctgggtggagcaggagggccccgagtactgggacagagagacccagaagtacaagagacaggcccagaccgacagagtgagcctgagaaacctgagaggctactacaaccagagcgaggccggcagccacaccctgcagtggatgtacggctgcgacctgggccccgacggcagactgctgagaggctacgaccagagcgcctacgacggcaaggactacatcgccctgaacgaggacctgagaagctggaccgccgccgacaccgccgcccagatcacccagagaaagtgggaggccgccagagccgccgagcagcagagagcctacctggagggcacctgcgtggagtggctgagaagatacctggagaacggcaaggagaccctgcagagagccgagcaccccaagacccacgtgacccaccacctggtgagcgaccacgaggccaccctgagatgctgggccctgggcttctaccccgccgagatcaccctgacctggcagagagacggcgaggaccagacccaggacaccgagctggtggagaccagacccgccggcgacggcaccttccagaagtgggccgccgtggtggtgcccagcggcgaggagcagagatacacctgccacgtgcagcacgagggcctgcccgagcccctgaccctgagatgggagcccagcagccagcccaccatccccatcgtgggcatcgtggccggcctggccgtgctggccgtgctggccgtgctgggcgccgtggtggccgtggtgatgtgcagaagaaagagcagcggcggcaagggcggcagctgcagccaggccgccagcagcaacagcgcccagggcagcgacgagagcctgatcgcctgcaaggcctag

SEQ ID NO: 2173 - DNA, 786 bp, Artificial Sequence
  Description of Artificial Sequence: Synthetic coding sequence
tgaagagtgatggcccccagaaccctgatcctgctgctgagcggcgccctggccctgaccgagacctgggccggcagccacagcatgagatacttctacaccgccgtgagcagacccggcagaggcgagccccacttcatcgccgtgggctacgtggacgacacccagttcgtgagattcgacagcgacgccgccagccccagaggcgagcccagagccccctgggtggagcaggagggccccgagtactgggacagagagacccagaagtacaagagacaggcccagaccgacagagtgagcctgagaaacctgagaggctactacaaccagagcgaggccggcagccacatcatccagagaatgtacggctgcgacgtgggccccgacggcagactgctgagaggctacgaccagtacgcctacgacggcaaggactacatcgccctgaacgaggacctgagaagctggaccgccgccgacaccgccgcccagatcacccagagaaagtgggaggccgccagagaggccgagcagctgagagcctacctggagggcctgtgcgtggagtggctgagaagatacctgaagaacggcaaggagaccctgcagagagccgagcaccccaagacccacgtgacccaccaccccgtgagcgaccacgaggccagcagaagatggaacctgcccgaggtgggcagctgcggcggcgccttctggagaagagccgagatccacgtgccctgcgccgccagaggcgccgccggcgccccccaccccgagtag

SEQ ID NO: 2174 - DNA, 786 bp, Artificial Sequence
  Description of Artificial Sequence: Synthetic coding sequence
tgaagagtgatggcccccagaaccctgatcctgctgctgagcggcgccctggccctgaccgagacctgggcctgcagccacagcatgagatacttctacaccgccgtgagcagacccggcagaggcgagcccagattcatcgccgtgggctacgtggacgacacccagttcgtgcagttcgacagcgacgccgccagccccagaggcgagcccagagccccctgggtggagcaggagggccccgagtactgggacagagagacccagaagtacaagagacaggcccagaccgacagagtgaacctgagaaagctgagaggctactacaaccagagcgaggccggcagccacaccctgcagagaatgtacggctgcgacctgggccccgacggcagactgctgagaggctacaaccagttcgcctacgacggcaaggactacatcgccctgaacgaggacctgagaagctggaccgccgccgacaaggccgcccagatcacccagagaaagtgggaggccgccagagaggccgagcagagaagagcctacctggagggcacctgcgtggagtggctgagaagatacctggagaacggcaagaagaccctgcagagagccgagcaccccaagacccacgtgacccaccaccccgtgagcgaccacgaggccagcagaagatggaacctgcccgaggtgggcagctgcggcggcgccttctggagaagagccgagatccacgtgccctgcgccgccagaggcgccgccagagccccccaccccgagtag

SEQ ID NO: 2175 - DNA, 786 bp, Artificial Sequence; identical to SEQ ID NO: 2174
  Description of Artificial Sequence: Synthetic coding sequence

SEQ ID NO: 2176 - DNA, 1119 bp, Artificial Sequence
  Description of Artificial Sequence: Synthetic coding sequence
atgagagtgatggcccccagaaccctgatcctgctgctgagcggcgccctggccctgaccgagacctgggcctgcagccacagcatgagatacttctacaccgccgtgagcagacccggcagaggcgagcccagattcatcgccgtgggctacgtggacgacacccagttcgtgagattcgacagcgacgccgccagccccagaggcgagcccagagccccctgggtggagcaggagggccccgagtactgggacagagagacccagaagtacaagagacaggcccagaccgacagagtgagcctgagaaacctgagaggctactacaaccagagcgaggccggcagccacaccctgcagtggatgtacggctgcgacctgggccccgacggcagactgctgagaggctacgaccagagcgcctacgacggcaaggactacatcgccctgaacgaggacctgagaagctggaccgccgccgacaccgccgcccagatcacccagagaaagtgggaggccgccagagccgccgagcagcagagagcctacctggagggcacctgcgtggagtggctgagaagatacctggagaacggcaaggagaccctgcagagagccgagcaccccaagacccacgtgacccaccacctggtgagcgaccacgaggccaccctgagatgctgggccctgggcttctaccccgccgagatcaccctgacctggcagagagacggcgaggaccagacccaggacaccgagctggtggagaccagacccgccggcgacggcaccttccagaagtgggccgccgtggtggtgcccagcggcgaggagcagagatacacctgccacgtgcagcacgagggcctgcccgagcccctgaccctgagatgggagcccagcagccagcccaccatccccatcgtgggcatcgtggccggcctggccgtgctggccgtgctggccgtgctgggcgccgtggtggccgtggtgatgtgcagaagaaagagcagcggccacttcctgcccaccggcggcaagggcggcagctgcagccaggccgccagcagcaacagcgcccagggcagcgacgagagcctgatcgcctgcaaggcctag

SEQ ID NO: 2177 - DNA, 786 bp, Artificial Sequence
  Description of Artificial Sequence: Synthetic coding sequence
tgaagagtgatggcccccagaaccctgatcctgctgctgagcggcgccctggccctgaccgagacctgggcctgcagccacagcatgagatacttcgacaccgccgtgagcagacccggcagaggcgagcccagattcatcagcgtgggctacgtggacgacacccagttcgtgagattcgacagcgacgccgccagccccagaggcgagcccagagccccctgggtggagcaggagggccccgagtactgggacagagagacccagaagtacaagagacaggcccaggccgacagagtgaacctgagaaagctgagaggctactacaaccagagcgaggacggcagccacaccctgcagtggatgtacggctgcgacctgggccccgacggcagactgctgagaggctacgaccagagcgcctacgacggcaaggactacatcgccctgaacgaggacctgagaagctggaccgccgccgacaccgccgcccagatcacccagagaaagtgggaggccgccagagaggccgagcagtggagagcctacctggagggcacctgcgtggagtggctgagaagatacctggagaacggcaaggagaccctgcagagagccgagcaccccaagacccacgtgacccaccaccccgtgagcgaccacgaggccagcagaagatggaacctgcccgaggtgggcagctgcggcggcgccttctggagaagagccgagatccacgtgccctgcgccgccagaggcgccgccagagccccccaccccgagtag

SEQ ID NO: 2178 - DNA, 1107 bp, Artificial Sequence
  Description of Artificial Sequence: Synthetic coding sequence
atgagagtgatggcccccagaaccctgatcctgctgctgagcggcgccctggccctgaccgagacctgggcctgcagccacagcatgagatacttcgacaccgccgtgagcagacccggcagaggcgagcccagattcatcagcgtgggctacgtggacgacacccagttcgtgagattcgacagcgacgccgccagccccagaggcgagcccagagccccctgggtggagcaggagggccccgagtactgggacagagagacccagaagtacaagagacaggcccaggccgacagagtgaacctgagaaagctgagaggctactacaaccagagcgaggacggcagccacaccctgcagtggatgtacggctgcgacctgggccccgacggcagactgctgagaggctacgaccagagcgcctacgacggcaaggactacatcgccctgaacgaggacctgagaagctggaccgccgccgacaccgccgcccagatcacccagagaaagtgggaggccgccagagaggccgagcagtggagagcctacctggagggcacctgcgtggagtggctgagaagatacctggagaacggcaaggagaccctgcagagagccgagcaccccaagacccacgtgacccaccaccccgtgagcgaccacgaggccaccctgagatgctgggccctgggcttctaccccgccgagatcaccctgacctggcagagagacggcgaggaccagacccaggacaccgagctggtggagaccagacccgccggcgacggcaccttccagaagtgggccgccgtggtggtgcccagcggcgaggagcagagatacacctgccacgtgcagcacgagggcctgcccgagcccctgaccctgagatgggagcccagcagccagcccaccatccccatcgtgggcatcgtggccggcctggccgtgctggccgtgctggccgtgctgggcgccgtgatggccgtggtgatgtgcagaagaaagagcagcgccgcctgcgtgggcctgagatgcagaatcagcagccacctgagcttcgtgaccagcagagccagcggcatcagcttctgcaagggcatctag

SEQ ID NO: 2179 - DNA, 786 bp, Artificial Sequence
  Description of Artificial Sequence: Synthetic coding sequence
tgaagagtgatggcccccagagccctgctgctgctgctgagcggcggcctggccctgaccgagacctgggcctgcagccacagcatgagatacttcgacaccgccgtgagcagacccggcagaggcgagcccagattcatcagcgtgggctacgtggacgacacccagttcgtgagattcgacagcgacgccgccagccccagaggcgagcccagagccccctgggtggagcaggagggccccgagtactgggacagagagacccagaactacaagagacaggcccaggccgacagagtgagcctgagaaacctgagaggctactacaaccagagcgaggacggcagccacaccctgcagagaatgtacggctgcgacctgggccccgacggcagactgctgagaggctacgaccagagcgcctacgacggcaaggactacatcgccctgaacgaggacctgagaagctggaccgccgccgacaccgccgcccagatcacccagagaaagctggaggccgccagagccgccgagcagctgagagcctacctggagggcacctgcgtggagtggctgagaagatacctggagaacggcaaggagaccctgcagagagccgagccccccaagacccacgtgacccaccaccccctgagcgaccacgaggccagcagaagatggaacctgcccgaggtgggcagctgcggcggcgccttctggaccagagccgagatccacgtgccctacgccgccagaggcgccgccagagccccccaccccgagtag

SEQ ID NO: 2180 - DNA, 1101 bp, Artificial Sequence
  Description of Artificial Sequence: Synthetic coding sequence
atgagagtgatggcccccagaaccctgatcctgctgctgagcggcgccctggccctgaccgagacctgggccggcagccacagcatgagatacttctacaccgccgtgagcagacccggcagaggcgagccccacttcatcgccgtgggctacgtggacgacacccagttcgtgagattcgacagcgacgccgccagccccagaggcgagcccagagccccctgggtggagcaggagggccccgagtactgggacagagagacccagaagtacaagagacaggcccagaccgacagagtgagcctgagaaacctgagaggctactacaaccagagcgaggccggcagccacatcatccagagaatgtacggctgcgacgtgggccccgacggcagactgctgagaggctacgaccagtacgcctacgacggcaaggactacatcgccctgaacgaggacctgagaagctggaccgccgccgacaccgccgcccagatcacccagagaaagtgggaggccgccagagaggccgagcagctgagagcctacctggagggcctgtgcgtggagtggctgagaagatacctgaagaacggcaaggagaccctgcagagagccgagcaccccaagacccacgtgacccaccaccccgtgagcgaccacgaggccaccctgagatgctgggccctgggcttctaccccgccgagatcaccctgacctggcagtgggacggcgaggaccagacccaggacaccgagctggtggagaccagacccgccggcgacggcaccttccagaagtgggccgccgtggtggtgcccagcggcgaggagcagagatacacctgccacgtgcagcacgagggcctgcccgagcccctgaccctgagatgggagcccagcagccagcccaccatccccatcgtgggcatcgtggccggcctggccgtgctggccgtgctggccgtgctgggcgccgtggtggccgtggtgatgtgcagaagaaagagcagcggcggcaagggcggcagctgcagccaggccgccagcagcaacagcgcccagggcagcgacgagagcctgatcgcctgcaaggcctag

SEQ ID NO: 2181 - DNA, 1119 bp, Artificial Sequence
  Description of Artificial Sequence: Synthetic coding sequence
atgagagtgatggcccccagaaccctgatcctgctgctgagcggcgccctggccctgaccgagacctgggcctgcagccacagcatgagatacttcgacaccgccgtgagcagacccggcagaggcgagcccagattcatcagcgtgggctacgtggacgacacccagttcgtgagattcgacagcgacgccgccagccccagaggcgagcccagagccccctgggtggagcaggagggccccgagtactgggacagagagacccagaagtacaagagacaggcccaggccgacagagtgaacctgagaaagctgagaggctactacaaccagagcgaggacggcagccacaccctgcagtggatgtacggctgcgacctgggccccgacggcagactgctgagaggctacgaccagagcgcctacgacggcaaggactacatcgccctgaacgaggacctgagaagctggaccgccgccgacaccgccgcccagatcacccagagaaagtgggaggccgccagagaggccgagcagtggagagcctacctggagggcacctgcgtggagtggctgagaagatacctggagaacggcaaggagaccctgcagagagccgagcaccccaagacccacgtgacccaccaccccgtgagcgaccacgaggccaccctgagatgctgggccctgggcttctaccccgccgagatcaccctgacctggcagagagacggcgaggaccagacccaggacaccgagctggtggagaccagacccgccggcgacggcaccttccagaagtgggccgccgtggtggtgcccagcggcgaggagcagagatacacctgccacgtgcagcacgagggcctgcccgagcccctgaccctgagatgggagcccagcagccagcccaccatccccatcgtgggcatcgtggccggcctggccgtgctggccgtgctggccgtgctgggcgccgtgatggccgtggtgatgtgcagaagaaagagcagcggccacttcctgcccaccggcggcaagggcggcagctgcagccaggccgccagcagcaacagcgcccagggcagcgacgagagcctgatcgcctgcaaggcctag

SEQ ID NO: 2182 - DNA, 1107 bp, Artificial Sequence; identical to SEQ ID NO: 2170
  Description of Artificial Sequence: Synthetic coding sequence

SEQ ID NO: 2183 - DNA, 675 bp, Artificial Sequence
  Description of Artificial Sequence: Synthetic coding sequence
atgagagtgatggcccccagagccctgctgctgctgctgagcggcggcctggccctgaccgagacctgggcctgcagccacagcatgagatacttcgacaccgccgtgagcagacccggcagaggcgagcccagattcatcagcgtgggctacgtggacgacacccagttcgtgagattcgacagcgacgccgccagccccagaggcgagcccagagccccctgggtggagcaggagggccccgagtactgggacagagagacccagaagtacaagagacaggcccaggccgacagagtgagcctgagaaacctgagaggctactacaaccagagcgaggacggcagccacaccctgcagagaatgagcggctgcgacctgggccccgacggcagactgctgagaggctacgaccagagcgcctacgacggcaaggactacatcgccctgaacgaggacctgagaagctggaccgccgccgacaccgccgcccagatcacccagagaaagctggaggccgccagagccgccgagcagctgagagcctacctggagggcacctgcgtggagtggctgagaagatacctggagaacggcaaggagaccctgcagagagccggccaggaccagaagagcctgttcctgccccagagactggagctgagcaacgagtag

SEQ ID NO: 2184 - DNA, 675 bp, Artificial Sequence
  Description of Artificial Sequence: Synthetic coding sequence
atgagagtgatggcccccagaaccctgatcctgctgctgagcggcgccctggccctgaccgagacctgggcctgcagccacagcatgagatacttctacaccgccgtgagcagacccggcagaggcgagcccagattcatcgccgtgggctacgtggacgacacccagttcgtgcagttcgacagcgacgccgccagccccagaggcgagcccagagccccctgggtggagcaggagggccccgagtactgggacagagagacccagaagtacaagagacaggcccagaccgacagagtgaacctgagaaagctgagaggctactacaaccagagcgaggccggcagccacaccctgcagagaatgtacggctgcgacctgggccccgacggcagactgctgagaggctacaaccagttcgcctacgacggcaaggactacatcgccctgaacgaggacctgagaagctggaccgccgccgacaaggccgcccagatcacccagagaaagtgggaggccgccagagaggccgagcagagaagagcctacctggagggcacctgcgtggagtggctgagaagatacctggagaacggcaagaagaccctgcagagagccggccaggaccagaagagcctgttcctgccccagagactggagctgagcaacgagtag

SEQ ID NO: 2185 - DNA, 675 bp, Artificial Sequence
  Description of Artificial Sequence: Synthetic coding sequence
atgagagtgatggcccccagagccctgctgctgctgctgagcggcggcctggccctgaccgagacctgggcctgcagccacagcatgagatacttcgacaccgccgtgagcagacccggcagaggcgagcccagattcatcagcgtgggctacgtggacgacacccagttcgtgagattcgacagcgacgccgccagccccagaggcgagcccagagccccctgggtggagcaggagggccccgagtactgggacagagagacccagaactacaagagacaggcccaggccgacagagtgagcctgagaaacctgagaggctactacaaccagagcgaggacggcagccacaccctgcagagaatgtacggctgcgacctgggccccgacggcagactgctgagaggctacgaccagagcgcctacgacggcaaggactacatcgccctgaacgaggacctgagaagctggaccgccgccgacaccgccgcccagatcacccagagaaagctggaggccgccagagccgccgagcagctgagagcctacctggagggcacctgcgtggagtggctgagaagatacctggagaacggcaaggagaccctgcagagagccggccaggaccagaagagcctgttcctgccccagagactggagctgagcaacgagtag

SEQ ID NO: 2186 - DNA, 396 bp, Artificial Sequence
  Description of Artificial Sequence: Synthetic coding sequence
atgagagtgatggcccccagaaccctgatcctgctgctgagcggcgccctggccctgaccgagacctgggcctgcagccacagcatgagatacttctacaccgccgtgagcagacccggcagaggcgagcccagattcatcgccgtgggctacgtggacgacacccagttcgtgcagttcgacagcgacgccgccagccccagaggcgagcccagagccccctgggtggagcaggagggccccgagtactgggacagagagacccagaagtacaagagacaggcccagaccgacagagtgaacctgagaaagctgagaggctactacaaccagagcgaggccgaggacgtgtggctgagacccggcgccagaagagcccccccccccagagtgtag

SEQ ID NO: 2187 - DNA, 396 bp, Artificial Sequence
  Description of Artificial Sequence: Synthetic coding sequence
atgagagtgatggcccccagagccctgctgctgctgctgagcggcggcctggccctgaccgagacctgggcctgcagccacagcatgagatacttcgacaccgccgtgagcagacccggcagaggcgagcccagattcatcagcgtgggctacgtggacgacacccagttcgtgagattcgacagcgacgccgccagccccagaggcgagcccagagccccctgggtggagcaggagggccccgagtactgggacagagagacccagaactacaagagacaggcccaggccgacagagtgagcctgagaaacctgagaggctactacaaccagagcgaggacgaggacgtgtggctgagacccggcgccagaagagcccccccccccagagtgtag

SEQ ID NO: 2188 - DNA, 396 bp, Artificial Sequence
  Description of Artificial Sequence: Synthetic coding sequence
atgagagtgatggcccccagaaccctgatcctgctgctgagcggcgccctggccctgaccgagacctgggcctgcagccacagcatgagatacttcgacaccgccgtgagcagacccggcagaggcgagcccagattcatcagcgtgggctacgtggacgacacccagttcgtgagattcgacagcgacgccgccagccccagaggcgagcccagagccccctgggtggagcaggagggccccgagtactgggacagagagacccagaagtacaagagacaggcccaggccgacagagtgaacctgagaaagctgagaggctactacaaccagagcgaggacgtggacgtgtggctgagacccggcgccagaagagcccccccccccagagtgtag

SEQ ID NO: 2189 - DNA, 396 bp, Artificial Sequence; identical to SEQ ID NO: 2186
  Description of Artificial Sequence: Synthetic coding sequence

SEQ ID NO: 2190 - DNA, 396 bp, Artificial Sequence
  Description of Artificial Sequence: Synthetic coding sequence
atgagagtgatggcccccagaaccctgatcctgctgctgagcggcgccctggccctgaccgagacctgggcctgcagccacagcatgagatacttctacaccgccgtgagcagacccggcagaggcgagcccagattcatcgccgtgggctacgtggacgacacccagttcgtgagattcgacagcgacgccgccagccccagaggcgagcccagagccccctgggtggagcaggagggccccgagtactgggacagagagacccagaagtacaagagacaggcccagaccgacagagtgagcctgagaaacctgagaggctactacaaccagagcgaggccgtggacgtgtggctgagacccggcgccagaagagcccccccccccagagtgtag

SEQ ID NO: 2191 - DNA, 396 bp, Artificial Sequence
  Description of Artificial Sequence: Synthetic coding sequence
atgagagtgatggcccccagaaccctgatcctgctgctgagcggcgccctggccctgaccgagacctgggccggcagccacagcatgagatacttctacaccgccgtgagcagacccggcagaggcgagccccacttcatcgccgtgggctacgtggacgacacccagttcgtgagattcgacagcgacgccgccagccccagaggcgagcccagagccccctgggtggagcaggagggccccgagtactgggacagagagacccagaagtacaagagacaggcccagaccgacagagtgagcctgagaaacctgagaggctactacaaccagagcgaggccgaggacgtgtggctgagaagaggcgccagaagagcccccccccccagagtgtag

SEQ ID NO: 2192 - DNA, 1212 bp, Artificial Sequence
  Description of Artificial Sequence: Synthetic coding sequence
atgagagtgatggcccccagagccctgctgctgctgctgagcggcggcctggccctgaccgagacctgggcctgcgagtgcggcgtgggcagagaggccgccagcgccgagagaagcgagggcccccccggcgagcccagaagagaggtgggcagagccggcctgagccccagcagcccccccggcagccacagcatgagatacttcgacaccgccgtgagcagacccggcagaggcgagcccagattcatcagcgtgggctacgtggacgacacccagttcgtgagattcgacagcgacgccgccagccccagaggcgagcccagagccccctgggtggagcaggagggccccgagtactgggacagagagacccagaagtacaagagacaggcccaggccgacagagtgagcctgagaaacctgagaggctactacaaccagagcgaggacggcagccacaccctgcagagaatgagcggctgcgacctgggccccgacggcagactgctgagaggctacgaccagagcgcctacgacggcaaggactacatcgccctgaacgaggacctgagaagctggaccgccgccgacaccgccgcccagatcacccagagaaagctggaggccgccagagccgccgagcagctgagagcctacctggagggcacctgcgtggagtggctgagaagatacctggagaacggcaaggagaccctgcagagagccgagccccccaagacccacgtgacccaccaccccctgagcgaccacgaggccaccctgagatgctgggccctgggcttctaccccgccgagatcaccctgacctggcagagagacggcgaggaccagacccaggacaccgagctggtggagaccagacccgccggcgacggcaccttccagaagtgggccgccgtggtggtgcccagcggccaggagcagagatacacctgccacatgcagcacgagggcctgcaggagcccctgaccctgagctgggagcccagcagccagcccaccatccccatcatgggcatcgtggccggcctggccgtgctggtggtgctggccgtgctgggcgccgtggtgaccgccatgatgtgcagaagaaagagcagcggcggcaagggcggcagctgcagccaggccgcctgcagcaacagcgcccagggcagcgacgagagcctgatcacctgcaaggcctag

SEQ ID NO: 2193 - DNA, 1212 bp, Artificial Sequence
  Description of Artificial Sequence: Synthetic coding sequence
atgagagtgatggcccccagagccctgctgctgctgctgagcggcggcctggccctgaccgagacctgggcctgcgagtgcggcgtgggcagagaggccgccagcgccgagagaagcgagggcccccccggcgagcccagaagagaggtgggcagagccggcctgagccccagcagcccccccggcagccacagcatgagatacttcgacaccgccgtgagcagacccggcagaggcgagcccagattcatcagcgtgggctacgtggacgacacccagttcgtgagattcgacagcgacgccgccagccccagaggcgagcccagagccccctgggtggagcaggagggccccgagtactgggacagagagacccagaactacaagagacaggcccaggccgacagagtgagcctgagaaacctgagaggctactacaaccagagcgaggacggcagccacaccctgcagagaatgtacggctgcgacctgggccccgacggcagactgctgagaggctacgaccagagcgcctacgacggcaaggactacatcgccctgaacgaggacctgagaagctggaccgccgccgacaccgccgcccagatcacccagagaaagctggaggccgccagagccgccgagcagctgagagcctacctggagggcacctgcgtggagtggctgagaagatacctggagaacggcaaggagaccctgcagagagccgagccccccaagacccacgtgacccaccaccccctgagcgaccacgaggccaccctgagatgctgggccctgggcttctaccccgccgagatcaccctgacctggcagagagacggcgaggaccagacccaggacaccgagctggtggagaccagacccgccggcgacggcaccttccagaagtgggccgccgtggtggtgcccagcggccaggagcagagatacacctgccacatgcagcacgagggcctgcaggagcccctgaccctgagctgggagcccagcagccagcccaccatccccatcatgggcatcgtggccggcctggccgtgctggtggtgctggccgtgctgggcgccgtggtgaccgccatgatgtgcagaagaaagagcagcggcggcaagggcggcagctgcagccaggccgcctgcagcaacagcgcccagggcagcgacgagagcctgatcacctgcaaggcctag

SEQ ID NO: 2194 - DNA, 981 bp, Artificial Sequence
  Description of Artificial Sequence: Synthetic coding sequence
atgagagtgatggcccccagaaccctgatcctgctgctgagcggcgccctggccctgaccgagacctgggcctgcagccacagcatgagatacttctacaccgccgtgagcagacccggcagaggcgagcccagattcatcgccgtgggctacgtggacgacacccagttcgtgagattcgacagcgacgccgccagccccagaggcgagcccagagccccctgggtggagcaggagggccccgagtactgggacagagagacccagaagtacaagagacaggcccagaccgacagagtgagcctgagaaacctgagaggctactacaaccagagcgaggccggcagccacaccctgcagtggatgtacggctgcgacctgggccccgacggcagactgctgagaggctacgaccagagcgcctacgacggcaaggactacatcgccctgaacgaggacctgagaagctggaccgccgccgacaccgccgcccagatcacccagagaaagtgggaggccgccagagccgccgagcagcagagagcctacctggagggcacctgcgtggagtggctgagaagatacctggagaacggcaaggagaccctgcagagagccgagcaccccaagacccacgtgacccaccacctggtgagcgaccacgaggccaccctgagatgctgggccctgggcttctaccccgccgagatcaccctgacctggcagagagacggcgaggaccagacccaggacaccgagctggtggagaccagacccgccggcgacggcaccttccagaagtgggccgccgtggtggtgcccagcggcgaggagcagagatacacctgccacgtgcagcacgagggcctgcccgagcccctgaccctgagatggggcggcaagggcggcagctgcagccaggccgccagcagcaacagcgcccagggcagcgacgagagcctgatcgcctgcaaggcctag

SEQ ID NO: 2195 - DNA, 1041 bp, Artificial Sequence
  Description of Artificial Sequence: Synthetic coding sequence
atggccagaccccagagaacccccgccagaagccccgacagcatcgtggaggtgaagagcaagttcgacgccgagttcagaagattcgccctgcccagagccagcgtgagcggcttccaggagttcagcagactgctgagagccgtgcaccagatccccggcctggacgtgctgctgggctacaccgacgcccacggcgacctgctgcccctgaccaacgacgacagcctgcacagagccctggccagcggccccccccccctgagactgctggtgcagaagagagccgaggccgacagcagcggcctggccttcgccagcaacagcctgcagagaagaaagaagggcctgctgctgagacccgtggcccccctgagaaccagaccccccctgctgatcagcctgccccaggacttcagacaggtgagcagcgtgatcgacgtggacctgctgcccgagacccacagaagagtgagactgcacaagcacggcagcgacagacccctgggcttctacatcagagacggcatgagcgtgagagtggccccccagggcctggagagagtgcccggcatcttcatcagcagactggtgagaggcggcctggccgagagcaccggcctgctggccgtgagcgacgagatcctggaggtgaacggcatcgaggtggccggcaagaccctggaccaggtgaccgacatgatggtggccaacagccacaacctgatcgtgaccgtgaagcccgccaaccagagaaacaacgtggtgagaggcgccagcggcagactgaccggcccccccagcgccggccccggccccgccgagcccgacagcgacgacgacagcagcgacctggtgatcgagaacagacagccccccagcagcaacggcctgagccagggccccccctgctgggacctgcaccccggctgcagacaccccggcaccagaagcagcctgcccagcctggacgaccaggagcaggccagcagcggctggggcagcagaatcagaggcgacggcagcggcttcagcctgtag

SEQ ID NO: 2196 - DNA, 1824 bp, Artificial Sequence
  Description of Artificial Sequence: Synthetic coding sequence
atgatcctgctgaccttcagcaccggcagaagactggacttcgtgcaccacagcggcgtgttcttcctgcagaccctgctgtggatcctgtgcgccaccgtgtgcggcaccgagcagtacttcaacgtggaggtgtggctgcagaagtacggctacctgccccccaccgaccccagaatgagcgtgctgagaagcgccgagaccatgcagagcgccctggccgccatgcagcagttctacggcatcaacatgaccggcaaggtggacagaaacaccatcgactggatgaagaagcccagatgcggcgtgcccgaccagaccagaggcagcagcaagttccacatcagaagaaagagatacgccctgaccggccagaagtggcagcacaagcacatcacctacagcatcaagaacgtgacccccaaggtgggcgaccccgagaccagaaaggccatcagaagagccttcgacgtgtggcagaacgtgacccccctgaccttcgaggaggtgccctacagcgagctggagaacggcaagagagacgtggacatcaccatcatcttcgccagcggcttccacggcgacagcagccccttcgacggcgagggcggcttcctggcccacgcctacttccccggccccggcatcggcggcgacacccacttcgacagcgacgagccctggaccctgggcaaccccaaccacgacggcaacgacctgttcctggtggccgtgcacgagctgggccacgccctgggcctggagcacagcaacgaccccaccgccatcatggcccccttctaccagtacatggagaccgacaacttcaagctgcccaacgacgacctgcagggcatccagaagatctacggcccccccgacaagatccccccccccaccagacccctgcccaccgtgcccccccacagaagcatcccccccgccgaccccagaaagaacgacagacccaagccccccagaccccccaccggcagacccagctaccccggcgccaagcccaacatctgcgacggcaacttcaacaccctggccatcctgagaagagagatgttcgtgttcaaggaccagtggttctggagagtgagaaacaacagagtgatggacggctaccccatgcagatcacctacttctggagaggcctgccccccagcatcgacgccgtgtacgagaacagcgacggcaacttcgtgttcttcaagggcaacaagtactgggtgttcaaggacaccaccctgcagcccggctacccccacgacctgatcaccctgggcagcggcatccccccccacggcatcgacagcgccatctggtgggaggacgtgggcaagacctacttcttcaagggcgacagatactggagatacagcgaggagatgaagaccatggaccccggctaccccaagcccatcaccgtgtggaagggcatccccgagagcccccagggcgccttcgtgcacaaggagaacggcttcacctacttctacaagggcaaggagtactggaagttcaacaaccagatcctgaaggtggagcccggctaccccagaagcatcctgaaggacttcatgggctgcgacggccccaccgacagagtgaaggagggccacagcccccccgacgacgtggacatcgtgatcaagctggacaacaccgccagcaccgtgaaggccatcgccatcgtgatcccctgcatcctggccctgtgcctgctggtgctggtgtacaccgtgttccagttcaagagaaagggcacccccagacacatcctgtactgcaagagaagcatgcaggagtgggtgtag

SEQ ID NO: 2197 - DNA, 1812 bp, Artificial Sequence
  Description of Artificial Sequence: Synthetic coding sequence
atgagaagaagagccgccagaggccccggcccccccccccccggccccggcctgagcagactgcccctgcccctgctgctgctgctggccctgggcaccagaggcggctgcgccgcccccgcccccgcccccagagccgaggacctgagcctgggcgtggagtggctgagcagattcggctacctgccccccgccgaccccaccaccggccagctgcagacccaggaggagctgagcaaggccatcaccgccatgcagcagttcggcggcctggaggccaccggcatcctggacgaggccaccctggccctgatgaagacccccagatgcagcctgcccgacctgcccgtgctgacccaggccagaagaagaagacaggcccccgcccccaccaagtggaacaagagaaacctgagctggagagtgagaaccttccccagagacagccccctgggccacgacaccgtgagagccctgatgtactacgccctgaaggtgtggagcgacatcgcccccctgaacttccacgaggtggccggcagcgccgccgacatccagatcgacttcagcaaggccgaccacaacgacggctaccccttcgacggccccggcggcaccgtggcccacgccttcttccccggccaccaccacaccgccggcgacacccacttcgacgacgacgaggcctggaccttcagaagcagcgacgcccacggcatggacctgttcgccgtggccgtgcacgagttcggccacgccatcggcctgagccacgtggccgccgcccacagcatcatgagaccctactaccagggccccgtgggcgaccccctgagatacggcctgccctacgaggacaaggtgagagtgtggcagctgtacggcgtgagagagagcgtgagccccaccgcccagcccgaggagccccccctgctgcccgagccccccgacaacagaagcagcgccccccccagaaaggacgtgccccacagatgcagcacccacttcgacgccgtggcccagatcagaggcgaggccttcttcttcaagggcaagtacttctggagactgaccagagacagacacctggtgagcctgcagcccgcccagatgcacagattctggagaggcctgcccctgcacctggacagcgtggacgccgtgtacgagagaaccagcgaccacaagatcgtgttcttcaagggcgacagatactgggtgttcaaggacaacaacgtggaggagggctaccccagacccgtgagcgacttcagcctgccccccggcggcatcgacgccgccttcagctgggcccacaacgacagaacctacttcttcaaggaccagctgtactggagatacgacgaccacaccagacacatggaccccggctaccccgcccagagccccctgtggagaggcgtgcccagcaccctggacgacgccatgagatggagcgacggcgccagctacttcttcagaggccaggagtactggaaggtgctggacggcgagctggaggtggcccccggctacccccagagcaccgccagagactggctggtgtgcggcgacagccaggccgacggcagcgtggccgccggcgtggacgccgccgagggccccagagccccccccggccagcacgaccagagcagaagcgaggacggctacgaggtgtgcagctgcaccagcggcgccagcagcccccccggcgcccccggccccctggtggccgccaccatgctgctgctgctgccccccctgagccccggcgccctgtggaccgccgcccaggccctgaccctgtag

SEQ ID NO: 2198 - DNA, 1560 bp, Artificial Sequence
  Description of Artificial Sequence: Synthetic coding sequence
atgcagcagttcggcggcctggaggccaccggcatcctggacgaggccaccctggccctgatgaagacccccagatgcagcctgcccgacctgcccgtgctgacccaggccagaagaagaagacaggcccccgcccccaccaagtggaacaagagaaacctgagctggagagtgagaaccttccccagagacagccccctgggccacgacaccgtgagagccctgatgtactacgccctgaaggtgtggagcgacatcgcccccctgaacttccacgaggtggccggcagcgccgccgacatccagatcgacttcagcaaggccgaccacaacgacggctaccccttcgacggccccggcggcaccgtggcccacgccttcttccccggccaccaccacaccgccggcgacacccacttcgacgacgacgaggcctggaccttcagaagcagcgacgcccacggcatggacctgttcgccgtggccgtgcacgagttcggccacgccatcggcctgagccacgtggccgccgcccacagcatcatgagaccctactaccagggccccgtgggcgaccccctgagatacggcctgccctacgaggacaaggtgagagtgtggcagctgtacggcgtgagagagagcgtgagccccaccgcccagcccgaggagccccccctgctgcccgagccccccgacaacagaagcagcgccccccccagaaaggacgtgccccacagatgcagcacccacttcgacgccgtggcccagatcagaggcgaggccttcttcttcaagggcaagtacttctggagactgaccagagacagacacctggtgagcctgcagcccgcccagatgcacagattctggagaggcctgcccctgcacctggacagcgtggacgccgtgtacgagagaaccagcgaccacaagatcgtgttcttcaagggcgacagatactgggtgttcaaggacaacaacgtggaggagggctaccccagacccgtgagcgacttcagcctgccccccggcggcatcgacgccgccttcagctgggcccacaacgacagaacctacttcttcaaggaccagctgtactggagatacgacgaccacaccagacacatggaccccggctaccccgcccagagccccctgtggagaggcgtgcccagcaccctggacgacgccatgagatggagcgacggcgccagctacttcttcagaggccaggagtactggaaggtgctggacggcgagctggaggtggcccccggctacccccagagcaccgccagagactggctggtgtgcggcgacagccaggccgacggcagcgtggccgccggcgtggacgccgccgagggccccagagccccccccggccagcacgaccagagcagaagcgaggacggctacgaggtgtgcagctgcaccagcggcgccagcagcccccccggcgcccccggccccctggtggccgccaccatgctgctgctgctgccccccctgagccccggcgccctgtggaccgccgcccaggccctgaccctgtag

SEQ ID NO: 2199 - DNA, 348 bp, Artificial Sequence
  Description of Artificial Sequence: Synthetic coding sequence
atgcagcagttcggcggcctggaggccaccggcatcctggacgaggccaccctggccctgatgaagacccccagatgcagcctgcccgacctgcccgtgctgacccaggccagaagaagaagacaggcccccgcccccaccaagtggaacaagagaaacctgagctggagagtgagaaccttccccagagacagccccctgggccacgacaccgtgagagccctgatgtactacgccctgaaggtgtggagcgacatcgcccccctgaacttccacgaggtggccggcagcgccgccgacatccagatcgacttcagcaaggccgaccacaacgacggctacccctag

SEQ ID NO: 2200 - DNA, 1527 bp, Artificial Sequence
  Description of Artificial Sequence: Synthetic coding sequence
atgaactgccagcagctgtggctgggcttcctgctgcccatgaccgtgagcggcagagtgctgggcctggccgaggtggcccccgtggactacctgagccagtacggctacctgcagaagcccctggagggcagcaacaacttcaagcccgaggacatcaccgaggccctgagagccttccaggaggccagcgagctgcccgtgagcggccagctggacgacgccaccagagccagaatgagacagcccagatgcggcctggaggaccccttcaaccagaagaccctgaagtacctgctgctgggcagatggagaaagaagcacctgaccttcagaatcctgaacctgcccagcaccctgcccccccacaccgccagagccgccctgagacaggccttccaggactggagcaacgtggcccccctgaccttccaggaggtgcaggccggcgccgccgacatcagactgagcttccacggcagacagagcagctactgcagcaacaccttcgacggccccggcagagtgctggcccacgccgacatccccgagctgggcagcgtgcacttcgacgaggacgagttctggaccgagggcacctacagaggcgtgaacctgagaatcatcgccgcccacgaggtgggccacgccctgggcctgggccacagcagatacagccaggccctgatggcccccgtgtacgagggctacagaccccacttcaagctgcaccccgacgacgtggccggcatccaggccctgtacggcaagaagagccccgtgatcagagacgaggaggaggaggagaccgagctgcccaccgtgccccccgtgcccaccgagcccagccccatgcccgacccctgcagcagcgagctggacgccatgatgctgggccccagaggcaagacctacgccttcaagggcgactacgtgtggaccgtgagcgacagcggccccggccccctgttcagagtgagcgccctgtgggagggcctgcccggcaacctggacgccgccgtgtacagccccagaacccagtggatccacttcttcaagggcgacaaggtgtggagatacatcaacttcaagatgagccccggcttccccaagaagctgaacagagtggagcccaacctggacgccgccctgtactggcccctgaaccagaaggtgttcctgttcaagggcagcggctactggcagtgggacgagctggccagaaccgacttcagcagctaccccaagcccatcaagggcctgttcaccggcgtgcccaaccagcccagcgccgccatgagctggcaggacggcagagtgtacttcttcaagggcaaggtgtactggagactgaaccagcagctgagagtggagaagggctaccccagaaacatcagccacaactggatgcactgcagacccagaaccatcgacaccacccccagcggcggcaacaccacccccagcggcaccggcatcaccctggacaccaccctgagcgccaccgagaccaccttcgagtactag

SEQ ID NO: 2201 - DNA, 669 bp, Artificial Sequence
  Description of Artificial Sequence: Synthetic coding sequence
atgggcgtgacctgggacttcagcatgagcaacggcggccccagaggcaagacctacgccttcaagggcgactacgtgtggaccgtgagcgacagcggccccggccccctgttcagagtgagcgccctgtgggagggcctgcccggcaacctggacgccgccgtgtacagccccagaacccagtggatccacttcttcaagggcgacaaggtgtggagatacatcaacttcaagatgagccccggcttccccaagaagctgaacagagtggagcccaacctggacgccgccctgtactggcccctgaaccagaaggtgttcctgttcaagggcagcggctactggcagtgggacgagctggccagaaccgacttcagcagctaccccaagcccatcaagggcctgttcaccggcgtgcccaaccagcccagcgccgccatgagctggcaggacggcagagtgtacttcttcaagggcaaggtgtactggagactgaaccagcagctgagagtggagaagggctaccccagaaacatcagccacaactggatgcactgcagacccagaaccatcgacaccacccccagcggcggcaacaccacccccagcggcaccggcatcaccctggacaccaccctgagcgccaccgagaccaccttcgagtactag

SEQ ID NO: 2202 - DNA, 918 bp, Artificial Sequence
  Description of Artificial Sequence: Synthetic coding sequence
atgaactgccagcagctgtggctgggcttcctgctgcccatgaccgtgagcggcagagtgctgggcctggccgaggtggcccccgtggactacctgagccagtacggctacctgcagaagcccctggagggcagcaacaacttcaagcccgaggacatcaccgaggccctgagagccttccaggaggccagcgagctgcccgtgagcggccagctggacgacgccaccagagccagaatgagacagcccagatgcggcctggaggaccccttcaaccagaagaccctgaagtacctgctgctgggcagatggagaaagaagcacctgaccttcagaatcctgaacctgcccagcaccctgcccccccacaccgccagagccgccctgagacaggccttccaggactggagcaacgtggcccccctgaccttccaggaggtgcaggccggcgccgccgacatcagactgagcttccacggcagacagagcagctactgcagcaacaccttcgacggccccggcaagaagagccccgtgatcagagacgaggaggaggaggagaccgagctgcccaccgtgccccccgtgcccaccgagcccagccccatgcccgacccctgcagcagcgagctggacgccatgatgctgggcgaggccccccccctgcaggccgtgggcagaagatggggccagcccgccgaccccgaggcctggaccaacggcagcgacatgggcctgcagcacgagcagtggagagccccctgggaggacctgtgcttccagggcggcctgtgcgtggactgcatcagattcagaaccggccccctggtgcccagcgtgtgccccctgggcggcgcccccagaaagcccggctgctgctgcctgctggccagcaacaccatggacagcctgctgtag

SEQ ID NO: 2203 - DNA, 1452 bp, Artificial Sequence
  Description of Artificial Sequence: Synthetic coding sequence
atgaaggtgctgcccgccagcggcctggccgtgttcctgatcatggccctgaagttcagcaccgccgcccccagcctggtggccgccagccccagaacctggagaaacaactacagactggcccaggcctacctggacaagtactacaccaacaaggagggccaccagatcggcgagatggtggccagaggcagcaacagcatgatcagaaagatcaaggagctgcaggccttcttcggcctgcaggtgaccggcaagctggaccagaccaccatgaacgtgatcaagaagcccagatgcggcgtgcccgacgtggccaactacagactgttccccggcgagcccaagtggaagaagaacaccctgacctacagaatcagcaagtacacccccagcatgagcagcgtggaggtggacaaggccgtggagatggccctgcaggcctggagcagcgccgtgcccctgagcttcgtgagaatcaacagcggcgaggccgacatcatgatcagcttcgagaacggcgaccacggcgacagctaccccttcgacggccccagaggcaccctggcccacgccttcgcccccggcgagggcctgggcggcgacacccacttcgacaacgccgagaagtggaccatgggcaccaacggcttcaacctgttcaccgtggccgcccacgagttcggccacgccctgggcctggcccacagcaccgaccccagcgccctgatgtaccccacctacaagtacaagaacccctacggcttccacctgcccaaggacgacgtgaagggcatccaggccctgtacggccccagaaaggtgttcctgggcaagcccaccctgccccacgccccccaccacaagcccagcatccccgacctgtgcgacagcagcagcagcttcgacgccgtgaccatgctgggcaaggagctgctgctgttcaaggacagaatcttctggagaagacaggtgcacctgagaaccggcatcagacccagcaccatcaccagcagcttcccccagctgatgagcaacgtggacgccgcctacgaggtggccgagagaggcaccgcctacttcttcaagggcccccactactggatcaccagaggcttccagatgcagggcccccccagaaccatctacgacttcggcttccccagacacgtgcagcagatcgacgccgccgtgtacctgagagagccccagaagaccctgttcttcgtgggcgacgagtactacagctacgacgagagaaagagaaagatggagaaggactaccccaagaacaccgaggaggagttcagcggcgtgaacggccagatcgacgccgccgtggagctgaacggctacatctacttcttcagcggccccaagacctacaagtacgacaccgagaaggaggacgtggtgagcgtggtgaagagcagcagctggatcggctgctag

SEQ ID NO: 2204 - DNA, 1710 bp, Artificial Sequence
  Description of Artificial Sequence: Synthetic coding sequence
atgctggccgccagcatcttcagacccaccctgctgctgtgctggctggccgccccctggcccacccagcccgagagcctgttccacagcagagacagaagcgacctggagcccagccccctgagacaggccaagcccatcgccgacctgcacgccgcccagagattcctgagcagatacggctggagcggcgtgtgggccgcctggggccccagccccgagggcccccccgagacccccaagggcgccgccctggccgaggccgtgagaagattccagagagccaacgccctgcccgccagcggcgagctggacgccgccaccctggccgccatgaacagacccagatgcggcgtgcccgacatgagaccccccccccccagcgccccccccagcccccccggccccccccccagagccagaagcagaagaagccccagagcccccctgagcctgagcagaagaggctggcagcccagaggctaccccgacggcggcgccgcccaggccttcagcaagagaaccctgagctggagactgctgggcgaggccctgagcagccagctgagcgtggccgaccagagaagaatcgtggccctggccttcagaatgtggagcgaggtgacccccctggacttcagagaggacctggccgcccccggcgccgccgtggacatcaagctgggcttcggcagaggcagacacctgggctgccccagagccttcgacggcagcggccaggagttcgcccacgcctggagactgggcgacatccacttcgacgacgacgagcacttcaccccccccaccagcgacaccggcatcagcctgctgaaggtggccgtgcacgagatcggccacgtgctgggcctgccccacacctacagaaccggcagcatcatgcagcccaactacatcccccaggagcccgccttcgagctggactggagcgacagaaaggccatccagaagctgtacggcagctgcgagggcagcttcgacaccgccttcgactggatcagaaaggagagaaaccagtacggcgaggtgatggtgagattcagcacctacttcttcagaaacagctggtactggctgtacgagaacagaaacaacagaaccagatacggcgaccccatccagatcctgaccggctggcccggcatccccacccacaacatcgacgccttcgtgcacatctggacctggaagagagacgagagatacttcttccagggcaaccagtactggagatacgacagcgacaaggaccaggccctgaccgaggacgagcagggcaagagctaccccaagctgatcagcgagggcttccccggcatccccagccccctggacaccgccttctacgacagaagacagaagctgatctacttcttcaaggagagcctggtgttcgccttcgacgtgaacagaaacagagtgctgaacagctaccccaagagaatcaccgaggtgttccccgccgtgatcccccagaaccaccccttcagaaacatcgacagcgcctactacagctacgcctacaacagcatcttcttcttcaagggcaacgcctactggaaggtggtgaacgacaaggacaagcagcagaacagctggctgcccgccaacggcctgttccccaagaagttcatcagcgagaagtggttcgacgtgtgcgacgtgcacatcagcaccctgaacatgtag

SEQ ID NO: 2205 - DNA, 1173 bp, Artificial Sequence
  Description of Artificial Sequence: Synthetic coding sequence
atgggcagaggcgccagagtgcccagcgaggcccccggcgccggcgtggagagaagatggctgggcgccgccctggtggccctgtgcctgctgcccgccctggtgctgctggccagactgggcgcccccgccgtgcccgcctggagcgccgcccagggcgacgtggccgccctgggcctgagcgccgtgccccccaccagagtgcccggccccctggcccccagaagaagaagatacaccctgacccccgccagactgagatgggaccacttcaacctgacctacagaatcctgagcttccccagaaacctgctgagccccagagagaccagaagagccctggccgccgccttcagaatgtggagcgacgtgagccccttcagcttcagagaggtggcccccgagcagcccagcgacctgagaatcggcttctaccccatcaaccacaccgactgcctggtgagcgccctgcaccactgcttcgacggccccaccggcgagctggcccacgccttcttccccccccacggcggcatccacttcgacgacagcgagtactgggtgctgggccccaccagatacagctggaagaagggcgtgtggctgaccgacctggtgcacgtggccgcccacgagatcggccacgccctgggcctgatgcacagccagcacggcagagccctgatgcacctgaacgccaccctgagaggctggaaggccctgagccaggacgagctgtggggcctgcacagactgtacggctgcctggacagactgttcgtgtgcgccagctgggccagaagaggcttctgcgacgccagaagaagactgatgaagagactgtgccccagcagctgcgacttctgctacgagttccccttccccaccgtggccaccaccccccccccccccagaaccaagaccagactggtgcccgagggcagaaacgtgaccttcagatgcggccagaagatcctgcacaagaagggcaaggtgtactggtacaaggaccaggagcccctggagttcagctaccccggctacctggccctgggcgaggcccacctgagcatcatcgccaacgccgtgaacgagggcacctacacctgcgtggtgagaagacagcagagagtgctgaccacctacagctggagagtgagagtgagaggctag

SEQ ID NO: 2206 - DNA, 1161 bp, Artificial Sequence
  Description of Artificial Sequence: Synthetic coding sequence
atgggcagaggcgccagagtgcccagcgaggcccccggcgccggcgtggagagaagatggctgggcgccgccctggtggccctgtgcctgctgcccgccctggtgctgctggccagactgggcgcccccgccgtgcccgcctggagcgccgcccagggcgacgtggccgccctgggcctgagcgccgtgccccccaccagagtgcccggccccctggcccccagaagaagaagatacaccctgacccccgccagactgagatgggaccacttcaacctgacctacagaatcctgagcttccccagaaacctgctgagccccagagagaccagaagagccctggccgccgccttcagaatgtggagcgacgtgagccccttcagcttcagagaggtggcccccgagcagcccagcgacctgagaatcggcggcagaccccccccccccagacccggccccgccagacccgccagccagcccagagccccccccagactgctgcccgaccagccccacggcctgcccggcctgagagccgcccccctgctgagaagaccccacggcggcgccggccccagactgctgccccccgccagaagacaccccctgagaagacagagagtgctgggccccggcccccacgccctgcagctggaggagagaagagtggcccacggccccggcgccagaggcggccccagagacagacccagagccggccccgacgccctgaccaccagacccggcgcccacgcccccgagagacacgccgccagactggagggcgtggtgcccggcagagccgtgggcgccgcccccgccctgagaatgcccagacaggccgtgagagtgagagtgctgggcgccgagggcctgctgagaagaagccccgccgcccacgaggaggccctgccccagcagctgagactgctgctgagaatccccctgccccacggcggccaccaccccaccgccccccaggaccagaaccaggccggcgccagaggccaggagagagacctgcccctgagacccgaggaccccccccaggagagagagagcgtgctggtgcagggccccggcgcccccggcgtgctgctgcccagactgcccggccccggcagaggcgcccccgagcaccacagacagagaagacagtag

SEQ ID NO: 2207 - DNA, 1293 bp, Artificial Sequence
  Description of Artificial Sequence: Synthetic coding sequence
atgggcagaggcgccagagtgcccagcgaggcccccggcgccggcgtggagagaagatggctgggcgccgccctggtggccctgtgcctgctgcccgccctggtgctgctggccagactgggcgcccccgccgtgcccgcctggagcgccgcccagggcgacgtggccgccctgggcctgagcgccgtgccccccaccagagtgcccggccccctggcccccagaagaagaagatacaccctgacccccgccagactgagatgggaccacttcaacctgacctacagaatcctgagcttccccagaaacctgctgagccccagagagaccagaagagccctggccgccgccttcagaatgtggagcgacgtgagccccttcagcttcagagaggtggcccccgagcagcccagcgacctgagaatcggcttctaccccatcaaccacaccgactgcctggtgagcgccctgcaccactgcttcgacggccccaccggcgagctggcccacgccttcttccccccccacggcggcatccacttcgacgacagcgagtactgggtgctgggccccaccagatacagctggaagaagggcgacagacccggcagctggagacccctgctgtgcagcaccgtgggctgcagaggcagagccctgggccagaccgccggcggcaccttcagaggcggcggctgccactggagcctggccggcgtgtggctgaccgacctggtgcacgtggccgcccacgagatcggccacgccctgggcctgatgcacagccagcacggcagagccctgatgcacctgaacgccaccctgagaggctggaaggccctgagccaggacgagctgtggggcctgcacagactgtacggctgcctggacagactgttcgtgtgcgccagctgggccagaagaggcttctgcgacgccagaagaagactgatgaagagactgtgccccagcagctgcgacttctgctacgagttccccttccccaccgtggccaccaccccccccccccccagaaccaagaccagactggtgcccgagggcagaaacgtgaccttcagatgcggccagaagatcctgcacaagaagggcaaggtgtactggtacaaggaccaggagcccctggagttcagctaccccggctacctggccctgggcgaggcccacctgagcatcatcgccaacgccgtgaacgagggcacctacacctgcgtggtgagaagacagcagagagtgctgaccacctacagctggagagtgagagtgagaggctag

SEQ ID NO: 2208 - DNA, 717 bp, Artificial Sequence
  Description of Artificial Sequence: Synthetic coding sequence
atgggcagaggcgccagagtgcccagcgaggcccccggcgccggcgtggagagaagatggctgggcgccgccctggtggccctgtgcctgctgcccgccctggtgctgctggccagactgggcgcccccgccgtgcccgcctggagcgccgcccagggcgacgtggccgccctgggcctgagcgccgtgccccccaccagagtgcccggccccctggcccccagaagaagaagatacaccctgacccccgccagactgagatgggaccacttcaacctgacctacagaatcctgagcttccccagaaacctgctgagccccagagagaccagaagagccctggccgccgccttcagaatgtggagcgacgtgagccccttcagcttcagagaggtggcccccgagcagcccagcgacctgagaatcggcttctaccccatcaaccacaccgactgcctggtgagcgccctgcaccactgcttcgacggccccaccggcgagctggcccacgccttcttccccccccacggcggcatccacttcgacgacagcgagtactgggtgctgggccccaccagatacagctggaagaagggcgacagacccggctggccccccggcggcctgagcagcgccgcccagtgggccgccgccgtgggcctgtggggcagaagacaggagggccccagcggcgtggtggccgccaccggcgtgtag

SEQ ID NO: 2209 - DNA, 1938 bp, Artificial Sequence
  Description of Artificial Sequence: Synthetic coding sequence
atgcccagaagcagaggcggcagagccgcccccggcccccccccccccccccccccccccggccaggcccccagatggagcagatggagagtgcccggcagactgctgctgctgctgctgcccgccctgtgctgcctgcccggcgccgccagagccgccgccgccgccgccggcgccggcaacagagccgccgtggccgtggccgtggccagagccgacgaggccgaggcccccttcgccggccagaactggctgaagagctacggctacctgctgccctacgacagcagagccagcgccctgcacagcgccaaggccctgcagagcgccgtgagcaccatgcagcagttctacggcatccccgtgaccggcgtgctggaccagaccaccatcgagtggatgaagaagcccagatgcggcgtgcccgaccacccccacctgagcagaagaagaagaaacaagagatacgccctgaccggccagaagtggagacagaagcacatcacctacagcatccacaactacacccccaaggtgggcgagctggacaccagaaaggccatcagacaggccttcgacgtgtggcagaaggtgacccccctgaccttcgaggaggtgccctaccacgagatcaagagcgacagaaaggaggccgacatcatgatcttcttcgccagcggcttccacggcgacagcagccccttcgacggcgagggcggcttcctggcccacgcctacttccccggccccggcatcggcggcgacacccacttcgacagcgacgagccctggaccctgggcaacgccaaccacgacggcaacgacctgttcctggtggccgtgcacgagctgggccacgccctgggcctggagcacagcagcgaccccagcgccatcatggcccccttctaccagtacatggagacccacaacttcaagctgccccaggacgacctgcagggcatccagaagatctacggcccccccgccgagcccctggagcccaccagacccctgcccaccctgcccgtgagaagaatccacagccccagcgagagaaagcacgagagacagcccagaccccccagaccccccctgggcgacagacccagcacccccggcaccaagcccaacatctgcgacggcaacttcaacaccgtggccctgttcagaggcgagatgttcgtgttcaaggacagatggttctggagactgagaaacaacagagtgcaggagggctaccccatgcagatcgagcagttctggaagggcctgcccgccagaatcgacgccgcctacgagagagccgacggcagattcgtgttcttcaagggcgacaagtactgggtgttcaaggaggtgaccgtggagcccggctacccccacagcctgggcgagctgggcagctgcctgcccagagagggcatcgacaccgccctgagatgggagcccgtgggcaagacctacttcttcaagggcgagagatactggagatacagcgaggagagaagagccaccgaccccggctaccccaagcccatcaccgtgtggaagggcatcccccaggccccccagggcgccttcatcagcaaggagggctactacacctacttctacaagggcagagactactggaagttcgacaaccagaagctgagcgtggagcccggctaccccagaaacatcctgagagactggatgggctgcaaccagaaggaggtggagagaagaaaggagagaagactgccccaggacgacgtggacatcatggtgaccatcaacgacgtgcccggcagcgtgaacgccgtggccgtggtgatcccctgcatcctgagcctgtgcatcctggtgctggtgtacaccatcttccagttcaagaacaagaccggcccccagcccgtgacctactacaagagacccgtgcaggagtgggtgtag

SEQ ID NO: 2210 - DNA, 1782 bp, Artificial Sequence
  Description of Artificial Sequence: Synthetic coding sequence
atgcccagaagcagaggcggcagagccgcccccggcccccccctggccgtggccagagccgacgaggccgaggcccccttcgccggccagaactggctgaagagctacggctacctgctgccctacgacagcagagccagcgccctgcacagcgccaaggccctgcagagcgccgtgagcaccatgcagcagttctacggcatccccgtgaccggcgtgctggaccagaccaccatcgagtggatgaagaagcccagatgcggcgtgcccgaccacccccacctgagcagaagaagaagaaacaagagatacgccctgaccggccagaagtggagacagaagcacatcacctacagcatccacaactacacccccaaggtgggcgagctggacaccagaaaggccatcagacaggccttcgacgtgtggcagaaggtgacccccctgaccttcgaggaggtgccctaccacgagatcaagagcgacagaaaggaggccgacatcatgatcttcttcgccagcggcttccacggcgacagcagccccttcgacggcgagggcggcttcctggcccacgcctacttccccggccccggcatcggcggcgacacccacttcgacagcgacgagccctggaccctgggcaacgccaaccacgacggcaacgacctgttcctggtggccgtgcacgagctgggccacgccctgggcctggagcacagcagcgaccccagcgccatcatggcccccttctaccagtacatggagacccacaacttcaagctgccccaggacgacctgcagggcatccagaagatctacggcccccccgccgagcccctggagcccaccagacccctgcccaccctgcccgtgagaagaatccacagccccagcgagagaaagcacgagagacagcccagaccccccagaccccccctgggcgacagacccagcacccccggcaccaagcccaacatctgcgacggcaacttcaacaccgtggccctgttcagaggcgagatgttcgtgttcaaggacagatggttctggagactgagaaacaacagagtgcaggagggctaccccatgcagatcgagcagttctggaagggcctgcccgccagaatcgacgccgcctacgagagagccgacggcagattcgtgttcttcaagggcgacaagtactgggtgttcaaggaggtgaccgtggagcccggctacccccacagcctgggcgagctgggcagctgcctgcccagagagggcatcgacaccgccctgagatgggagcccgtgggcaagacctacttcttcaagggcgagagatactggagatacagcgaggagagaagagccaccgaccccggctaccccaagcccatcaccgtgtggaagggcatcccccaggccccccagggcgccttcatcagcaaggagggctactacacctacttctacaagggcagagactactggaagttcgacaaccagaagctgagcgtggagcccggctaccccagaaacatcctgagagactggatgggctgcaaccagaaggaggtggagagaagaaaggagagaagactgccccaggacgacgtggacatcatggtgaccatcaacgacgtgcccggcagcgtgaacgccgtggccgtggtgatcccctgcatcctgagcctgtgcatcctggtgctggtgtacaccatcttccagttcaagaacaagaccggcccccagcccgtgacctactacaagagacccgtgcaggagtgggtgtag

SEQ ID NO: 2211 - DNA, 561 bp, Artificial Sequence
  Description of Artificial Sequence: Synthetic coding sequence
atgagccccgccgaccccggcaccgtggccaccatgagaaagcccagatgcagcctgcccgacgtgctgggcgtggccggcctggtgagaagaagaagaagatacgccctgagcggcagcgtgtggaagaagagaaccctgacctggagagtgagaagcttcccccagagcagccagctgagccaggagaccgtgagagtgctgatgagctacgccctgatggcctggggcatggagagcggcctgaccttccacgaggtggacagcccccagggccaggagcccgacatcctgatcgacttcgccagagccttccaccaggacagctaccccttcgacggcctgggcggcaccctggcccacgccttcttccccggcgagcaccccatcagcggcgacacccacttcgacgacgaggagacctggaccttcggcagcaaggccagccagcagctggagcaggagctggccggcggcagccccgtggacgaggagctgggcttcagcagaggctggagagtgaaccccctgggccccggcagccccgagagactgagctag

SEQ ID NO: 2212 - DNA, 1689 bp, Artificial Sequence
  Description of Artificial Sequence: Synthetic coding sequence
atgagactgagactgagactgctggccctgctgctgctgctgctggccccccccgccagagcccccaagcccagcgcccaggacgtgagcctgggcgtggactggctgaccagatacggctacctgccccccccccaccccgcccaggcccagctgcagagccccgagaagctgagagacgccatcaaggtgatgcagagattcgccggcctgcccgagaccggcagaatggaccccggcaccgtggccaccatgagaaagcccagatgcagcctgcccgacgtgctgggcgtggccggcctggtgagaagaagaagaagatacgccctgagcggcagcgtgtggaagaagagaaccctgacctggagagtgagaagcttcccccagagcagccagctgagccaggagaccgtgagagtgctgatgagctacgccctgatggcctggggcatggagagcggcctgaccttccacgaggtggacagcccccagggccaggagcccgacatcctgatcgacttcgccagagccttccaccaggacagctaccccttcgacggcctgggcggcaccctggcccacgccttcttccccggcgagcaccccatcagcggcgacacccacttcgacgacgaggagacctggaccttcggcagcaaggacggcgagggcaccgacctgttcgccgtggccgtgcacgagttcggccacgccctgggcctgggccacagcagcgcccccaacagcatcatgagacccttctaccagggccccgtgggcgaccccgacaagtacagactgagccaggacgacagagacggcctgcagcagctgtacggcaaggccccccagaccccctacgacaagcccaccagaaagcccctggccccccccccccagccccccgccagccccacccacagccccagcttccccatccccgacagatgcgagggcaacttcgacgccatcgccaacatcagaggcgagaccttcttcttcaagggcccctggttctggagactgcagcccagcggccagctggtgagccccagacccgccagactgcacagattctgggagggcctgcccgcccaggtgagagtggtgcaggccgcctacgccagacacagagacggcagaatcctgctgttcagcggcccccagttctgggtgttccaggacagacagctggagggcggcgccagacccctgaccgagctgggcctgccccccggcgaggaggtggacgccgtgttcagctggccccagaacggcaagacctacctggtgagaggcagacagtactggagatacgacgaggccgccgccagacccgaccccggctaccccagagacctgagcctgtgggagggcgccccccccagccccgacgacgtgaccgtgagcaacgccggcgacacctacttcttcaagggcgcccactactggagattccccaagaacagcatcaagaccgagcccgacgccccccagcccatgggccccaactggctggactgccccgcccccagcagcggccccagagcccccagaccccccaaggccacccccgtgagcgagacctgcgactgccagtgcgagctgaaccaggccgccggcagatggcccgcccccatccccctgctgctgctgcccctgctggtgggcggcgtggccagcagatag

SEQ ID NO: 2213 - DNA, 786 bp, Artificial Sequence
  Description of Artificial Sequence: Synthetic coding sequence
atgcagctggtgatcctgagagtgaccatcttcctgccctggtgcttcgccgtgcccgtgccccccgccgccgaccacaagggctgggacttcgtggagggctacttccaccagttcttcctgaccaagaaggagagccccctgctgacccaggagacccagacccagctgctgcagcagttccacagaaacggcaccgacctgctggacatgcagatgcacgccctgctgcaccagccccactgcggcgtgcccgacggcagcgacaccagcatcagccccggcagatgcaagtggaacaagcacaccctgacctacagaatcatcaactacccccacgacatgaagcccagcgccgtgaaggacagcatctacaacgccgtgagcatctggagcaacgtgacccccctgatcttccagcaggtgcagaacggcgacgccgacatcaaggtgagcttctggcagtgggcccacgaggacggctggcccttcgacggccccggcggcatcctgggccacgccttcctgcccaacagcggcaaccccggcgtggtgcacttcgacaagaacgagcactggagcgccagcgacaccggctacaacctgttcctggtggccacccacgagatcggccacagcctgggcctgcagcacagcggcaaccagagcagcatcatgtaccccacctactggtaccacgaccccagaaccttccagctgagcgccgacgacatccagagaatccagcacctgtacggcgagaagtgcagcagcgacatcccctag

SEQ ID NO: 2214 - DNA, 786 bp, Artificial Sequence; identical to SEQ ID NO: 2213
  Description of Artificial Sequence: Synthetic coding sequence

SEQ ID NO: 2215 - DNA, 1542 bp, Artificial Sequence
  Description of Artificial Sequence: Synthetic coding sequence
atgaagagactgctgctgctgttcctgttcttcatcaccttcagcagcgccttccccctggtgagaatgaccgagaacgaggagaacatgcagctggcccaggcctacctgaaccagttctacagcctggagatcgagggcaaccacctggtgcagagcaagaacagaagcctgatcgacgacaagatcagagagatgcaggccttcttcggcctgaccgtgaccggcaagctggacagcaacaccctggagatcatgaagacccccagatgcggcgtgcccgacgtgggccagtacggctacaccctgcccggctggagaaagtacaacctgacctacagaatcatcaactacacccccgacatggccagagccgccgtggacgaggccatccaggagggcctggaggtgtggagcaaggtgacccccctgaagttcaccaagatcagcaagggcatcgccgacatcatgatcgccttcagaaccagagtgcacggcagatgccccagatacttcgacggccccctgggcgtgctgggccacgccttcccccccggccccggcctgggcggcgacacccacttcgacgaggacgagaactggaccaaggacggcgccggcttcaacctgttcctggtggccgcccacgagttcggccacgccctgggcctgagccacagcaacgaccagaccgccctgatgttccccaactacgtgagcctggaccccagaaagtaccccctgagccaggacgacatcaacggcatccagagcatctacggcggcctgcccaaggagcccgccaagcccaaggagcccaccatcccccacgcctgcgaccccgacctgaccttcgacgccatcaccaccttcagaagagaggtgatgttcttcaagggcagacacctgtggagaatctactacgacatcaccgacgtggagttcgagctgatcgccagcttctggcccagcctgcccgccgacctgcaggccgcctacgagaaccccagagacaagatcctggtgttcaaggacgagaacttctggatgatcagaggctacgccgtgctgcccgactaccccaagagcatccacaccctgggcttccccggcagagtgaagaagatcgacgccgccgtgtgcgacaagaccaccagaaagacctacttcttcgtgggcatctggtgctggagattcgacgagatgacccagaccatggacaagggcttcccccagagagtggtgaagcacttccccggcatcagcatcagagtggacgccgccttccagtacaagggcttcttcttcttcagcagaggcagcaagcagttcgagtacgacatcaagaccaagaacatcaccagaatcatgagaaccaacacctggttccagtgcaaggagcccaagaacagcagcttcggcttcgacatcaacaaggagaaggcccacagcggcggcatcaagatcctgtaccacaagagcctgagcctgttcatcttcggcatcgtgcacctgctgaagaacaccagcatctaccagtag

SEQ ID NO: 2216 - DNA, 393 bp, Artificial Sequence
  Description of Artificial Sequence: Synthetic coding sequence
atggtggccagagtgggcctgctgctgagagccctgcagctgctgctgtggggccacctggacgcccagcccgccgagagaggcggccaggagctgagaaaggaggccgaggccttcctggagaagtacggctacctgaacgagcaggtgcccaaggcccccaccagcaccagattcagcgacgccatcagagccttccagtgggtgagccagctgcccgtgagcggcgtgctggacagagccaccctgagacagatgaccagacccagatgcggcgtgaccgacaccaacagctacgccgcctgggccgagagaatcagcgacctgttcgccagacacagaaccaagatgagaagaaagaagagattcgccaagcagggcgagcactgctag

SEQ ID NO: 2217 - DNA, 1560 bp, Artificial Sequence
  Description of Artificial Sequence: Synthetic coding sequence
atggtggccagagtgggcctgctgctgagagccctgcagctgctgctgtggggccacctggacgcccagcccgccgagagaggcggccaggagctgagaaaggaggccgaggccttcctggagaagtacggctacctgaacgagcaggtgcccaaggcccccaccagcaccagattcagcgacgccatcagagccttccagtgggtgagccagctgcccgtgagcggcgtgctggacagagccaccctgagacagatgaccagacccagatgcggcgtgaccgacaccaacagctacgccgcctgggccgagagaatcagcgacctgttcgccagacacagaaccaagatgagaagaaagaagagattcgccaagcagggcaacaagtggtacaagcagcacctgagctacagactggtgaactggcccgagcaccccgagcccgccgtgagaggcgccgtgagagccgccttccagctgtggagcaacgtgagcgccctggagttctgggaggcccccgccaccggccccgccgacatcagactgaccttcttccagggcgaccacaacgacggcctgggcaacgccttcgacggccccggcggcgccctggcccacgccttcctgcccagaagaggcgaggcccacttcgaccaggacgagagatggagcctgagcagaagaagaggcagaaacctgttcgtggtgctggcccacgagatcggccacaccctgggcctgacccacagccccgcccccagagccctgatggccccctactacaagagactgggcagagacgccctgctgagctgggacgacgtgctggccgtgcagagcctgtacggcaagcccctgggcggcagcgtggccgtgcagctgcccggcaagctgttcaccgacttcgagacctgggacagctacagcccccagggcagaagacccgagacccagggccccaagtactgccacagcagcttcgacgccatcaccgtggacagacagcagcagctgtacatcttcaagggcagccacttctgggaggtggccgccgacggcaacgtgagcgagcccagacccctgcaggagagatgggtgggcctgccccccaacatcgaggccgccgccgtgagcctgaacgacggcgacttctacttcttcaagggcggcagatgctggagattcagaggccccaagcccgtgtggggcctgccccagctgtgcagagccggcggcctgcccagacaccccgacgccgccctgttcttcccccccctgagaagactgatcctgttcaagggcgccagatactacgtgctggccagaggcggcctgcaggtggagccctactaccccagaagcctgcaggactggggcggcatccccgaggaggtgagcggcgccctgcccagacccgacggcagcatcatcttcttcagagacgacagatactggagactggaccaggccaagctgcaggccaccaccagcggcagatgggccaccgagctgccctggatgggctgctggcacgccaacagcggcagcgccctgttctag

SEQ ID NO: 2218 - DNA, 1179 bp, Artificial Sequence
  Description of Artificial Sequence: Synthetic coding sequence
atggtggccagagtgggcctgctgctgagagccctgcagctgctgctgtggggccacctggacgcccagcccgccgagagaggcggccaggagctgagaaaggaggccgaggccttcctggagaagtacggctacctgaacgagcaggtgcccaaggcccccaccagcaccagattcagcgacgccatcagagccttccagtgggtgagccagctgcccgtgagcggcgtgctggacagagccaccctgagacagatgaccagacccagatgcggcgtgaccgacaccaacagctacgccgcctgggccgagagaatcagcgacctgttcgccagacacagaaccaagatgagaagaaagaagagattcgccaagcagggcaacaagtggtacaagcagcacctgagctacagactggtgaactggcccgagcaccccgagcccgccgtgagaggcgccgtgagagccgccttccagctgtggagcaacgtgagcgccctggagttctgggaggcccccgccaccggccccgccgacatcagactgaccttcttccagggcgaccacaacgacggcctgggcaacgccttcgacggccccggcggcgccctggcccacgccttcctgcccagaagaggcgaggcccacttcgaccaggacgagagatggagcctgagcagaagaagaggcagaaacctgttcgtggtgctggcccacgagatcggccacaccctgggcctgacccacagccccgcccccagagccctgatggccccctactacaagagactgggcagagacgccctgctgagctgggacgacgtgctggccgtgcagagcctgtacggcaagcccctgggcggcagcgtggccgtgcagctgcccggcaagctgttcaccgacttcgagacctgggacagctacagcccccagggcagaagacccgagacccagggccccaagtactgccacagcagcttcgacgccatcaccgtggacagacagcagcagctgtacatcttcaagggcagccacttctgggaggtggccgccgacggcaacgtgagcgagcccagacccctgcaggagagatgggtgggcctgccccccaacatcgaggccgccgccgtgagcctgaacgacggcgacttctacttcttcaaggtgcagagcgtgtag

SEQ ID NO: 2219 - DNA, 678 bp, Artificial Sequence
  Description of Artificial Sequence: Synthetic coding sequence
atggtggccagagtgggcctgctgctgagagccctgcagctgctgctgtggggccacctggacgcccagcccgccgagagaggcggccaggagctgagaaaggaggccgaggccttcctggagaagtacggctacctgaacgagcaggtgcccaaggcccccaccagcaccagattcagcgacgccatcagagccttccagtgggtgagccagctgcccgtgagcggcgtgctggacagagccaccctgagacagatgaccagacccagatgcggcgtgaccgacaccaacagctacgccgcctgggccgagagaatcagcgacctgttcgccagacacagaaccaagatgagaagaaagaagagattcgccaagcagggcaacaagtggtacaagcagcacctgagctacagactggtgaactggcccgagcacctgagaagcagacagttcggcgccccctgcgccccccccagcagctgcggcgccaccagccagagatggagcagcggcagaccccagccccaggcccccctgaccagcggcagccccagcagcaagggcaccaccaccatgggctgggccatgcccctgatggcccagggcgccccctggagaacccccagctgccccgccgccgccaagagaaccagcaccaagatgagcgccggcccctag

SEQ ID NO: 2220 - DNA, 1404 bp, Artificial Sequence
  Description of Artificial Sequence: Synthetic coding sequence
atgttcagcctgaagaccctgcccttcctgctgctgctgcacgtgcagatcagcaaggccttccccgtgagcagcaaggagaagaacaccaagaccgtgcaggactacctggagaagttctaccagctgcccagcaaccagtaccagagcaccagaaagaacggcaccaacgtgatcgtggagaagctgaaggagatgcagagattcttcggcctgaacgtgaccggcaagcccaacgaggagaccctggacatgatgaagaagcccagatgcggcgtgcccgacagcggcggcttcatgctgacccccggcaaccccaagtgggagagaaccaacctgacctacagaatcagaaactacaccccccagctgagcgaggccgaggtggagagagccatcaaggacgccttcgagctgtggagcgtggccagccccctgatcttcaccagaatcagccagggcgaggccgacatcaacatcgccttctaccagagagaccacggcgacaacagccccttcgacggccccaacggcatcctggcccacgccttccagcccggccagggcatcggcggcgacgcccacttcgacgccgaggagacctggaccaacaccagcgccaactacaacctgttcctggtggccgcccacgagttcggccacagcctgggcctggcccacagcagcgaccccggcgccctgatgtaccccaactacgccttcagagagaccagcaactacagcctgccccaggacgacatcgacggcatccaggccatctacggcctgagcagcaaccccatccagcccaccggccccagcacccccaagccctgcgaccccagcctgaccttcgacgccatcaccaccctgagaggcgagatcctgttcttcaaggacagatacttctggagaagacacccccagctgcagagagtggagatgaacttcatcagcctgttctggcccagcctgcccaccggcatccaggccgcctacgaggacttcgacagagacctgatcttcctgttcaagggcaaccagtactgggccctgagcggctacgacatcctgcagggctaccccaaggacatcagcaactacggcttccccagcagcgtgcaggccatcgacgccgccgtgttctacagaagcaagacctacttcttcgtgaacgaccagttctggagatacgacaaccagagacagttcatggagcccggctaccccaagagcatcagcggcgccttccccggcatcgagagcaaggtggacgccgtgttccagcaggagcacttcttccacgtgttcagcggccccagatactacgccttcgacctgatcgcccagagagtgaccagagtggccagaggcaacaagtggctgaactgcagatacggctag

SEQ ID NO: 2221 - DNA, 918 bp, Artificial Sequence
  Description of Artificial Sequence: Synthetic coding sequence
atgcagagattcttcggcctgaacgtgaccggcaagcccaacgaggagaccctggacatgatgaagaagcccagatgcggcgtgcccgacagcggcggcttcatgctgacccccggcaaccccaagtgggagagaaccaacctgacctacagaatcagaaactacaccccccagctgagcgaggccgaggtggagagagccatcaaggacgccttcgagctgtggagcgtggccagccccctgatcttcaccagaatcagccagggcgaggccgacatcaacatcgccttctaccagagagaccacggcgacaacagccccttcgacggccccaacggcatcctggcccacgccttccagcccggccagggcatcggcggcgacgcccacttcgacgccgaggagacctggaccaacaccagcgccaactacaacctgttcctggtggccgcccacgagttcggccacagcctgggcctggcccacagcagcgaccccggcgccctgatgtaccccaactacgccttcagagagaccagcaactacagcctgccccaggacgacatcgacggcatccaggccatctacggcctgagcagcaaccccatccagcccaccggccccagcacccccaagccctgcgaccccagcctgaccttcgacgccatcaccaccctgagaggcgagatcctgttcttcaaggacagatacttctggagaagacacccccagctgcagagagtggagatgaacttcatcagcctgttctggcccagcctgcccaccggcatccaggccgcctacgaggacttcgacagagacctgatcttcctgttcaaggacatgatcaccaaggacaacagctggagccaggtgatccccaaggcctaccaggtgcccttcagaaacagagagtag

SEQ ID NO: 2222 - DNA, 1284 bp, Artificial Sequence
  Description of Artificial Sequence: Synthetic coding sequence
atgcagcagatcccccaggagaagagcatcaacgactacctggagaagttctaccagctgcccagcaaccagtaccagagcaccagaaagaacggcaccaacgtgatcgtggagaagctgaaggagatgcagagattcttcggcctgaacgtgaccggcaagcccaacgaggagaccctggacatgatgaagaagcccagatgcggcgtgcccgacagcggcggcttcatgctgacccccggcaaccccaagtgggagagaaccaacctgacctacagaatcagaaactacaccccccagctgagcgaggccgaggtggagagagccatcaaggacgccttcgagctgtggagcgtggccagccccctgatcttcaccagaatcagccagggcgaggccgacatcaacatcgccttctaccagagagaccacggcgacaacagccccttcgacggccccaacggcatcctggcccacgccttccagcccggccagggcatcggcggcgacgcccacttcgacgccgaggagacctggaccaacaccagcgccaactacaacctgttcctggtggccgcccacgagttcggccacagcctgggcctggcccacagcagcgaccccggcgccctgatgtaccccaactacgccttcagagagaccagcaactacagcctgccccaggacgacatcgacggcatccaggccatctacggcctgagcagcaaccccatccagcccaccggccccagcacccccaagccctgcgaccccagcctgaccttcgacgccatcaccaccctgagaggcgagatcctgttcttcaaggacagatacttctggagaagacacccccagctgcagagagtggagatgaacttcatcagcctgttctggcccagcctgcccaccggcatccaggccgcctacgaggacttcgacagagacctgatcttcctgttcaagggcaaccagtactgggccctgagcggctacgacatcctgcagggctaccccaaggacatcagcaactacggcttccccagcagcgtgcaggccatcgacgccgccgtgttctacagaagcaagacctacttcttcgtgaacgaccagttctggagatacgacaaccagagacagttcatggagcccggctaccccaagagcatcagcggcgccttccccggcatcgagagcaaggtggacgccgtgttccagcaggagcacttcttccacgtgttcagcggccccagatactacgccttcgacctgatcgcccagtag

SEQ ID NO: 2223 - DNA, 954 bp, Artificial Sequence
  Description of Artificial Sequence: Synthetic coding sequence
atggccgtgcagggcagccagagaagactgctgggcagcctgaacagcacccccaccgccatcccccagctgggcctggccgccaaccagaccggcgccagatgcctggaggtgagcatcagcgacggcctgttcctgagcctgggcctggtgagcctggtggagaacgccctggtggtggccaccatcgccaagaacagaaacctgcacagccccatgtactgcttcatctgctgcctggccctgagcgacctgctggtgagcggcagcaacgtgctggagaccgccgtgatcctgctgctggaggccggcgccctggtggccagagccgccgtgctgcagcagctggacaacgtgatcgacgtgatcacctgcagcagcatgctgagcagcctgtgcttcctgggcgccatcgccgtggacagatacatcagcatcttctacgccctgagataccacagcatcgtgaccctgcccagagccagaagagccgtggccgccatctgggtggccagcgtggtgttcagcaccctgttcatcgcctactacgaccacgtggccgtgctgctgtgcctggtggtgttcttcctggccatgctggtgctgatggccgtgctgtacgtgcacatgctggccagagcctgccagcacgcccagggcatcgccagactgcacaagagacagagacccgtgcaccagggcttcggcctgaagggcgccgtgaccctgaccatcctgctgggcatcttcttcctgtgctggggccccttcttcctgcacctgaccctgatcgtgctgtgccccgagcaccccacctgcggctgcatcttcaagaacttcaacctgttcctggccctgatcatctgcaacgccatcatcgaccccctgatctacgccttccacagccaggagctgagaagaaccctgaaggaggtgctgacctgcagctggtag

SEQ ID NO: 2224 - DNA, 894 bp, Artificial Sequence
  Description of Artificial Sequence: Synthetic coding sequence
atgaagcacatcatcaacagctacgagaacatcaacaacaccgccagaaacaacagcgactgccccagagtggtgctgcccgaggagatcttcttcaccatcagcatcgtgggcgtgctggagaacctgatcgtgctgctggccgtgttcaagaacaagaacctgcaggcccccatgtacttcttcatctgcagcctggccatcagcgacatgctgggcagcctgtacaagatcctggagaacatcctgatcatcctgagaaacatgggctacctgaagcccagaggcagcttcgagaccaccgccgacgacatcatcgacagcctgttcgtgctgagcctgctgggcagcatcttcagcctgagcgtgatcgccgccgacagatacatcaccatcttccacgccctgagataccacagcatcgtgaccatgagaagaaccgtggtggtgctgaccgtgatctggaccttctgcaccggcaccggcatcaccatggtgatcttcagccaccacgtgcccaccgtgatcaccttcaccagcctgttccccctgatgctggtgttcatcctgtgcctgtacgtgcacatgttcctgctggccagaagccacaccagaaagatcagcaccctgcccagagccaacatgaagggcgccatcaccctgaccatcctgctgggcgtgttcatcttctgctgggcccccttcgtgctgcacgtgctgctgatgaccttctgccccagcaacccctactgcgcctgctacatgagcctgttccaggtgaacggcatgctgatcatgtgcaacgccgtgatcgaccccttcatctacgccttcagaagccccgagctgagagacgccttcaagaagatgatcttctgcagcagatactggtag

SEQ ID NO: 2225 - DNA, 894 bp, Artificial Sequence; identical to SEQ ID NO: 2224
  Description of Artificial Sequence: Synthetic coding sequence

SEQ ID NO: 2226 - DNA, 972 bp, Artificial Sequence
  Description of Artificial Sequence: Synthetic coding sequence
atgaacgccagctgctgcctgcccagcgtgcagcccaccctgcccaacggcagcgagcacctgcaggcccccttcttcagcaaccagagcagcagcgccttctgcgagcaggtgttcatcaagcccgaggtgttcctgagcctgggcatcgtgagcctgctggagaacatcctggtgatcctggccgtggtgagaaacggcaacctgcacagccccatgtacttcttcctgtgcagcctggccgtggccgacatgctggtgagcgtgagcaacgccctggagaccatcatgatcgccatcgtgcacagcgactacctgaccttcgaggaccagttcatccagcacatggacaacatcttcgacagcatgatctgcatcagcctggtggccagcatctgcaacctgctggccatcgccgtggacagatacgtgaccatcttctacgccctgagataccacagcatcatgaccgtgagaaaggccctgaccctgatcgtggccatctgggtgtgctgcggcgtgtgcggcgtggtgttcatcgtgtacagcgagagcaagatggtgatcgtgtgcctgatcaccatgttcttcgccatgatgctgctgatgggcaccctgtacgtgcacatgttcctgttcgccagactgcacgtgaagagaatcgccgccctgccccccgccgacggcgtggccccccagcagcacagctgcatgaagggcgccgtgaccatcaccatcctgctgggcgtgttcatcttctgctgggcccccttcttcctgcacctggtgctgatcatcacctgccccaccaacccctactgcatctgctacaccgcccacttcaacacctacctggtgctgatcatgtgcaacagcgtgatcgaccccctgatctacgccttcagaagcctggagctgagaaacaccttcagagagatcctgtgcggctgcaacggcatgaacctgggctag

SEQ ID NO: 2227 - DNA, 999 bp, Artificial Sequence
  Description of Artificial Sequence: Synthetic coding sequence
atggtgaacagcacccacagaggcatgcacaccagcctgcacctgtggaacagaagcagctacagactgcacagcaacgccagcgagagcctgggcaagggctacagcgacggcggctgctacgagcagctgttcgtgagccccgaggtgttcgtgaccctgggcgtgatcagcctgctggagaacatcctggtgatcgtggccatcgccaagaacaagaacctgcacagccccatgtacttcttcatctgcagcctggccgtggccgacatgctggtgagcgtgagcaacggcagcgagaccatcgtgatcaccctgctgaacagcaccgacaccgacgcccagagcttcaccgtgaacatcgacaacgtgatcgacagcgtgatctgcagcagcctgctggccagcatctgcagcctgctgagcatcgccgtggacagatacttcaccatcttctacgccctgcagtaccacaacatcatgaccgtgaagagagtgggcatcatcatcagctgcatctgggccgcctgcaccgtgagcggcatcctgttcatcatctacagcgacagcagcgccgtgatcatctgcctgatcaccatgttcttcaccatgctggccctgatggccagcctgtacgtgcacatgttcctgatggccagactgcacatcaagagaatcgccgtgctgcccggcaccggcgccatcagacagggcgccaacatgaagggcgccatcaccctgaccatcctgatcggcgtgttcgtggtgtgctgggcccccttcttcctgcacctgatcttctacatcagctgcccccagaacccctactgcgtgtgcttcatgagccacttcaacctgtacctgatcctgatcatgtgcaacagcatcatcgaccccctgatctacgccctgagaagccaggagctgagaaagaccttcaaggagatcatctgctgctaccccctgggcggcctgtgcgacctgagcagcagatactag

SEQ ID NO: 2228 - DNA, 978 bp, Artificial Sequence
  Description of Artificial Sequence: Synthetic coding sequence
atgaacagcagcttccacctgcacttcctggacctgaacctgaacgccaccgagggcaacctgagcggccccaacgtgaagaacaagagcagcccctgcgaggacatgggcatcgccgtggaggtgttcctgaccctgggcgtgatcagcctgctggagaacatcctggtgatcggcgccatcgtgaagaacaagaacctgcacagccccatgtacttcttcgtgtgcagcctggccgtggccgacatgctggtgagcatgagcagcgcctgggagaccatcaccatctacctgctgaacaacaagcacctggtgatcgccgacgccttcgtgagacacatcgacaacgtgttcgacagcatgatctgcatcagcgtggtggccagcatgtgcagcctgctggccatcgccgtggacagatacgtgaccatcttctacgccctgagataccaccacatcatgaccgccagaagaagcggcgccatcatcgccggcatctgggccttctgcaccggctgcggcatcgtgttcatcctgtacagcgagagcacctacgtgatcctgtgcctgatcagcatgttcttcgccatgctgttcctgctggtgagcctgtacatccacatgttcctgctggccagaacccacgtgaagagaatcgccgccctgcccggcgccagcagcgccagacagagaaccagcatgcagggcgccgtgaccgtgaccatgctgctgggcgtgttcaccgtgtgctgggcccccttcttcctgcacctgaccctgatgctgagctgcccccagaacctgtactgcagcagattcatgagccacttcaacatgtacctgatcctgatcatgtgcaacagcgtgatggaccccctgatctacgccttcagaagccaggagatgagaaagaccttcaaggagatcatctgctgcagaggcttcagaatcgcctgcagcttccccagaagagactag

SEQ ID NO: 2229 - DNA, 1242 bp, Artificial Sequence
  Description of Artificial Sequence: Synthetic coding sequence
atgctggagatgctggagtacaaccactaccaggtgcagacccacctggagaaccccaccaagtaccacatccagcaggcccagagacagcaggtgaagcagtacctgagcaccaccctggccaacaagcacgccaaccaggtgctgagcctgccctgccccaaccagcccggcgaccacgtgatgccccccgtgcccggcagcagcgcccccaacagccccatggccatgctgaccctgaacagcaactgcgagaaggagggcttctacaagttcgaggagcagaacagagccgagagcgagtgccccggcatgaacacccacagcagagccagctgcatgcagatggacgacgtgatcgacgacatcatcagcctggagagcagctacaacgaggagatcctgggcctgatggaccccgccctgcagatggccaacaccctgcccgtgagcggcaacctgatcgacctgtacggcaaccagggcctgcccccccccggcctgaccatcagcaacagctgccccgccaacctgcccaacatcaagagagagctgaccgagagcgaggccagagccctggccaaggagagacagaagaaggacaaccacaacctgatcgagagaagaagaagattcaacatcaacgacagaatcaaggagctgggcaccctgatccccaagagcaacgaccccgacatgagatggaacaagggcaccatcctgaaggccagcgtggactacatcagaaagctgcagagagagcagcagagagccaaggagctggagaacagacagaagaagctggagcacgccaacagacacctgctgctgagaatccaggagctggagatgcaggccagagcccacggcctgagcctgatccccagcaccggcctgtgcagccccgacctggtgaacagaatcatcaagcaggagcccgtgctggagaactgcagccaggacctgctgcagcaccacgccgacctgacctgcaccaccaccctggacctgaccgacggcaccatcaccttcaacaacaacctgggcaccggcaccgaggccaaccaggcctacagcgtgcccaccaagatgggcagcaagctggaggacatcctgatggacgacaccctgagccccgtgggcgtgaccgaccccctgctgagcagcgtgagccccggcgccagcaagaccagcagcagaagaagcagcatgagcatggaggagaccgagcacacctgctag

SEQ ID NO: 2230 - DNA, 1515 bp, Artificial Sequence
  Description of Artificial Sequence: Synthetic coding sequence
atggaggccctgagagtgcagatgttcatgccctgcagcttcgagagcctgtacctgagcagcgccgagcaccccggcgccagcaagccccccatcagcagcagcagcatgaccagcagaatcctgctgagacagcagctgatgagagagcagatgcaggagcaggagagaagagagcagcagcagaagctgcaggccgcccagttcatgcagcagagagtgcccgtgagccagacccccgccatcaacgtgagcgtgcccaccaccctgcccagcgccacccaggtgcccatggaggtgctgaaggtgcagacccacctggagaaccccaccaagtaccacatccagcaggcccagagacagcaggtgaagcagtacctgagcaccaccctggccaacaagcacgccaaccaggtgctgagcctgccctgccccaaccagcccggcgaccacgtgatgccccccgtgcccggcagcagcgcccccaacagccccatggccatgctgaccctgaacagcaactgcgagaaggagggcttctacaagttcgaggagcagaacagagccgagagcgagtgccccggcatgaacacccacagcagagccagctgcatgcagatggacgacgtgatcgacgacatcatcagcctggagagcagctacaacgaggagatcctgggcctgatggaccccgccctgcagatggccaacaccctgcccgtgagcggcaacctgatcgacctgtacggcaaccagggcctgcccccccccggcctgaccatcagcaacagctgccccgccaacctgcccaacatcaagagagagctgaccgagagcgaggccagagccctggccaaggagagacagaagaaggacaaccacaacctgatcgagagaagaagaagattcaacatcaacgacagaatcaaggagctgggcaccctgatccccaagagcaacgaccccgacatgagatggaacaagggcaccatcctgaaggccagcgtggactacatcagaaagctgcagagagagcagcagagagccaaggagctggagaacagacagaagaagctggagcacgccaacagacacctgctgctgagaatccaggagctggagatgcaggccagagcccacggcctgagcctgatccccagcaccggcctgtgcagccccgacctggtgaacagaatcatcaagcaggagcccgtgctggagaactgcagccaggacctgctgcagcaccacgccgacctgacctgcaccaccaccctggacctgaccgacggcaccatcaccttcaacaacaacctgggcaccggcaccgaggccaaccaggcctacagcgtgcccaccaagatgggcagcaagctggaggacatcctgatggacgacaccctgagccccgtgggcgtgaccgaccccctgctgagcagcgtgagccccggcgccagcaagaccagcagcagaagaagcagcatgagcatggaggagaccgagcacacctgctag

SEQ ID NO: 2231 - DNA, 1560 bp, Artificial Sequence
  Description of Artificial Sequence: Synthetic coding sequence
atgggccacctggagaacaccagcgtggtgttccccagagccatcttcagcctgtgcgagaaggagaccagaaagctgaccctgtgcctgttcagcagaagcagcagcgccgagcaccccggcgccagcaagccccccatcagcagcagcagcatgaccagcagaatcctgctgagacagcagctgatgagagagcagatgcaggagcaggagagaagagagcagcagcagaagctgcaggccgcccagttcatgcagcagagagtgcccgtgagccagacccccgccatcaacgtgagcgtgcccaccaccctgcccagcgccacccaggtgcccatggaggtgctgaaggtgcagacccacctggagaaccccaccaagtaccacatccagcaggcccagagacagcaggtgaagcagtacctgagcaccaccctggccaacaagcacgccaaccaggtgctgagcctgccctgccccaaccagcccggcgaccacgtgatgccccccgtgcccggcagcagcgcccccaacagccccatggccatgctgaccctgaacagcaactgcgagaaggagggcttctacaagttcgaggagcagaacagagccgagagcgagtgccccggcatgaacacccacagcagagccagctgcatgcagatggacgacgtgatcgacgacatcatcagcctggagagcagctacaacgaggagatcctgggcctgatggaccccgccctgcagatggccaacaccctgcccgtgagcggcaacctgatcgacctgtacggcaaccagggcctgcccccccccggcctgaccatcagcaacagctgccccgccaacctgcccaacatcaagagagagctgaccgagagcgaggccagagccctggccaaggagagacagaagaaggacaaccacaacctgatcgagagaagaagaagattcaacatcaacgacagaatcaaggagctgggcaccctgatccccaagagcaacgaccccgacatgagatggaacaagggcaccatcctgaaggccagcgtggactacatcagaaagctgcagagagagcagcagagagccaaggagctggagaacagacagaagaagctggagcacgccaacagacacctgctgctgagaatccaggagctggagatgcaggccagagcccacggcctgagcctgatccccagcaccggcctgtgcagccccgacctggtgaacagaatcatcaagcaggagcccgtgctggagaactgcagccaggacctgctgcagcaccacgccgacctgacctgcaccaccaccctggacctgaccgacggcaccatcaccttcaacaacaacctgggcaccggcaccgaggccaaccaggcctacagcgtgcccaccaagatgggcagcaagctggaggacatcctgatggacgacaccctgagccccgtgggcgtgaccgaccccctgctgagcagcgtgagccccggcgccagcaagaccagcagcagaagaagcagcatgagcatggaggagaccgagcacacctgctag

SEQ ID NO: 2232 - DNA, 1563 bp, Artificial Sequence
  Description of Artificial Sequence: Synthetic coding sequence
atgcagagcgagagcggcatcgtgcccgacttcgaggtgggcgaggagttccacgaggagcccaagacctactacgagctgaagagccagcccctgaagagcagcagcagcgccgagcaccccggcgccagcaagccccccatcagcagcagcagcatgaccagcagaatcctgctgagacagcagctgatgagagagcagatgcaggagcaggagagaagagagcagcagcagaagctgcaggccgcccagttcatgcagcagagagtgcccgtgagccagacccccgccatcaacgtgagcgtgcccaccaccctgcccagcgccacccaggtgcccatggaggtgctgaaggtgcagacccacctggagaaccccaccaagtaccacatccagcaggcccagagacagcaggtgaagcagtacctgagcaccaccctggccaacaagcacgccaaccaggtgctgagcctgccctgccccaaccagcccggcgaccacgtgatgccccccgtgcccggcagcagcgcccccaacagccccatggccatgctgaccctgaacagcaactgcgagaaggagggcttctacaagttcgaggagcagaacagagccgagagcgagtgccccggcatgaacacccacagcagagccagctgcatgcagatggacgacgtgatcgacgacatcatcagcctggagagcagctacaacgaggagatcctgggcctgatggaccccgccctgcagatggccaacaccctgcccgtgagcggcaacctgatcgacctgtacggcaaccagggcctgcccccccccggcctgaccatcagcaacagctgccccgccaacctgcccaacatcaagagagagctgaccgagagcgaggccagagccctggccaaggagagacagaagaaggacaaccacaacctgatcgagagaagaagaagattcaacatcaacgacagaatcaaggagctgggcaccctgatccccaagagcaacgaccccgacatgagatggaacaagggcaccatcctgaaggccagcgtggactacatcagaaagctgcagagagagcagcagagagccaaggagctggagaacagacagaagaagctggagcacgccaacagacacctgctgctgagaatccaggagctggagatgcaggccagagcccacggcctgagcctgatccccagcaccggcctgtgcagccccgacctggtgaacagaatcatcaagcaggagcccgtgctggagaactgcagccaggacctgctgcagcaccacgccgacctgacctgcaccaccaccctggacctgaccgacggcaccatcaccttcaacaacaacctgggcaccggcaccgaggccaaccaggcctacagcgtgcccaccaagatgggcagcaagctggaggacatcctgatggacgacaccctgagccccgtgggcgtgaccgaccccctgctgagcagcgtgagccccggcgccagcaagaccagcagcagaagaagcagcatgagcatggaggagaccgagcacacctgctag

SEQ ID NO: 2233 - DNA, 1260 bp, Artificial Sequence
  Description of Artificial Sequence: Synthetic coding sequence
atgctggagatgctggagtacaaccactaccaggtgcagacccacctggagaaccccaccaagtaccacatccagcaggcccagagacagcaggtgaagcagtacctgagcaccaccctggccaacaagcacgccaaccaggtgctgagcctgccctgccccaaccagcccggcgaccacgtgatgccccccgtgcccggcagcagcgcccccaacagccccatggccatgctgaccctgaacagcaactgcgagaaggagggcttctacaagttcgaggagcagaacagagccgagagcgagtgccccggcatgaacacccacagcagagccagctgcatgcagatggacgacgtgatcgacgacatcatcagcctggagagcagctacaacgaggagatcctgggcctgatggaccccgccctgcagatggccaacaccctgcccgtgagcggcaacctgatcgacctgtacggcaaccagggcctgcccccccccggcctgaccatcagcaacagctgccccgccaacctgcccaacatcaagagagagctgaccgcctgcatcttccccaccgagagcgaggccagagccctggccaaggagagacagaagaaggacaaccacaacctgatcgagagaagaagaagattcaacatcaacgacagaatcaaggagctgggcaccctgatccccaagagcaacgaccccgacatgagatggaacaagggcaccatcctgaaggccagcgtggactacatcagaaagctgcagagagagcagcagagagccaaggagctggagaacagacagaagaagctggagcacgccaacagacacctgctgctgagaatccaggagctggagatgcaggccagagcccacggcctgagcctgatccccagcaccggcctgtgcagccccgacctggtgaacagaatcatcaagcaggagcccgtgctggagaactgcagccaggacctgctgcagcaccacgccgacctgacctgcaccaccaccctggacctgaccgacggcaccatcaccttcaacaacaacctgggcaccggcaccgaggccaaccaggcctacagcgtgcccaccaagatgggcagcaagctggaggacatcctgatggacgacaccctgagccccgtgggcgtgaccgaccccctgctgagcagcgtgagccccggcgccagcaagaccagcagcagaagaagcagcatgagcatggaggagaccgagcacacctgctag

SEQ ID NO: 2234 - DNA, 1488 bp, Artificial Sequence
  Description of Artificial Sequence: Synthetic coding sequence
atgctgtacgccttctggttcagccacagcagcagcgccgagcaccccggcgccagcaagccccccatcagcagcagcagcatgaccagcagaatcctgctgagacagcagctgatgagagagcagatgcaggagcaggagagaagagagcagcagcagaagctgcaggccgcccagttcatgcagcagagagtgcccgtgagccagacccccgccatcaacgtgagcgtgcccaccaccctgcccagcgccacccaggtgcccatggaggtgctgaaggtgcagacccacctggagaaccccaccaagtaccacatccagcaggcccagagacagcaggtgaagcagtacctgagcaccaccctggccaacaagcacgccaaccaggtgctgagcctgccctgccccaaccagcccggcgaccacgtgatgccccccgtgcccggcagcagcgcccccaacagccccatggccatgctgaccctgaacagcaactgcgagaaggagggcttctacaagttcgaggagcagaacagagccgagagcgagtgccccggcatgaacacccacagcagagccagctgcatgcagatggacgacgtgatcgacgacatcatcagcctggagagcagctacaacgaggagatcctgggcctgatggaccccgccctgcagatggccaacaccctgcccgtgagcggcaacctgatcgacctgtacggcaaccagggcctgcccccccccggcctgaccatcagcaacagctgccccgccaacctgcccaacatcaagagagagctgaccgagagcgaggccagagccctggccaaggagagacagaagaaggacaaccacaacctgatcgagagaagaagaagattcaacatcaacgacagaatcaaggagctgggcaccctgatccccaagagcaacgaccccgacatgagatggaacaagggcaccatcctgaaggccagcgtggactacatcagaaagctgcagagagagcagcagagagccaaggagctggagaacagacagaagaagctggagcacgccaacagacacctgctgctgagaatccaggagctggagatgcaggccagagcccacggcctgagcctgatccccagcaccggcctgtgcagccccgacctggtgaacagaatcatcaagcaggagcccgtgctggagaactgcagccaggacctgctgcagcaccacgccgacctgacctgcaccaccaccctggacctgaccgacggcaccatcaccttcaacaacaacctgggcaccggcaccgaggccaaccaggcctacagcgtgcccaccaagatgggcagcaagctggaggacatcctgatggacgacaccctgagccccgtgggcgtgaccgaccccctgctgagcagcgtgagccccggcgccagcaagaccagcagcagaagaagcagcatgagcatggaggagaccgagcacacctgctag

SEQ ID NO: 2235 - DNA, 1581 bp, Artificial Sequence
  Description of Artificial Sequence: Synthetic coding sequence
atgcagagcgagagcggcatcgtgcccgacttcgaggtgggcgaggagttccacgaggagcccaagacctactacgagctgaagagccagcccctgaagagcagcagcagcgccgagcaccccggcgccagcaagccccccatcagcagcagcagcatgaccagcagaatcctgctgagacagcagctgatgagagagcagatgcaggagcaggagagaagagagcagcagcagaagctgcaggccgcccagttcatgcagcagagagtgcccgtgagccagacccccgccatcaacgtgagcgtgcccaccaccctgcccagcgccacccaggtgcccatggaggtgctgaaggtgcagacccacctggagaaccccaccaagtaccacatccagcaggcccagagacagcaggtgaagcagtacctgagcaccaccctggccaacaagcacgccaaccaggtgctgagcctgccctgccccaaccagcccggcgaccacgtgatgccccccgtgcccggcagcagcgcccccaacagccccatggccatgctgaccctgaacagcaactgcgagaaggagggcttctacaagttcgaggagcagaacagagccgagagcgagtgccccggcatgaacacccacagcagagccagctgcatgcagatggacgacgtgatcgacgacatcatcagcctggagagcagctacaacgaggagatcctgggcctgatggaccccgccctgcagatggccaacaccctgcccgtgagcggcaacctgatcgacctgtacggcaaccagggcctgcccccccccggcctgaccatcagcaacagctgccccgccaacctgcccaacatcaagagagagctgaccgcctgcatcttccccaccgagagcgaggccagagccctggccaaggagagacagaagaaggacaaccacaacctgatcgagagaagaagaagattcaacatcaacgacagaatcaaggagctgggcaccctgatccccaagagcaacgaccccgacatgagatggaacaagggcaccatcctgaaggccagcgtggactacatcagaaagctgcagagagagcagcagagagccaaggagctggagaacagacagaagaagctggagcacgccaacagacacctgctgctgagaatccaggagctggagatgcaggccagagcccacggcctgagcctgatccccagcaccggcctgtgcagccccgacctggtgaacagaatcatcaagcaggagcccgtgctggagaactgcagccaggacctgctgcagcaccacgccgacctgacctgcaccaccaccctggacctgaccgacggcaccatcaccttcaacaacaacctgggcaccggcaccgaggccaaccaggcctacagcgtgcccaccaagatgggcagcaagctggaggacatcctgatggacgacaccctgagccccgtgggcgtgaccgaccccctgctgagcagcgtgagccccggcgccagcaagaccagcagcagaagaagcagcatgagcatggaggagaccgagcacacctgctag

SEQ ID NO: 2236 - DNA, 1086 bp, Artificial Sequence
  Description of Artificial Sequence: Synthetic coding sequence
atggaggccctgagagtgcagatgttcatgccctgcagcttcgagagcctgtacctgagcagcgccgagcaccccggcgccagcaagccccccatcagcagcagcagcatgaccagcagaatcctgctgagacagcagctgatgagagagcagatgcaggagcaggagagaagagagcagcagcagaagctgcaggccgcccagttcatgcagcagagagtgcccgtgagccagacccccgccatcaacgtgagcgtgcccaccaccctgcccagcgccacccaggtgcccatggaggtgctgaaggtgcagacccacctggagaaccccaccaagtaccacatccagcaggcccagagacagcaggtgaagcagtacctgagcaccaccctggccaacaagcacgccaaccaggtgctgagcctgccctgccccaaccagcccggcgaccacgtgatgccccccgtgcccggcagcagcgcccccaacagccccatggccatgctgaccctgaacagcaactgcgagaaggagggcttctacaagttcgaggagcagaacagagccgagagcgagtgccccggcatgaacacccacagcagagccagctgcatgcagatggacgacgtgatcgacgacatcatcagcctggagagcagctacaacgaggagatcctgggcctgatggaccccgccctgcagatggccaacaccctgcccgtgagcggcaacctgatcgacctgtacggcaaccagggcctgcccccccccggcctgaccatcagcaacagctgccccgccaacctgcccaacatcaagagagagctgaccgcctgcatcttccccaccgagagcgaggccagagccctggccaaggagagacagaagaaggacaaccacaacctgatcgagagaagaagaagattcaacatcaacgacagaatcaaggagctgggcaccctgatccccaagagcaacgaccccgacatgagatggaacaagggcaccatcctgaaggccagcgtggactacatcagaaagctgcagagagagcagcagagagccaaggagctggagaacagatag

SEQ ID NO: 2237 - DNA, 354 bp, Artificial Sequence
  Description of Artificial Sequence: Synthetic coding sequence
atgggccacctggagaacaccagcgtggtgttccccagagccatcttcagcctgtgcgagaaggagaccagaaagctgaccctgtgcctgttcagcagaagcagcagcgccgagcaccccggcgccagcaagccccccatcagcagcagcagcatgaccagcagaatcctgctgagacagcagctgatgagagagcagatgcaggagcaggagagaagagagcagcagcagaagctgcaggccgcccagttcatgcagcagagagtgcccgtgagccagacccccgccatcaacgtgagcgtgcccaccaccctgcccagcgccacccaggtgcccatggaggtgctgaagtag

SEQ ID NO: 2238 - DNA, 1074 bp, Artificial Sequence
  Description of Artificial Sequence: Synthetic coding sequence
atgctggagatgctggagtacaaccactaccaggtgcagacccacctggagaaccccaccaagtaccacatccagcaggcccagagacagcagggcttctacaagttcgaggagcagaacagagccgagagcgagtgccccggcatgaacacccacagcagagccagctgcatgcagatggacgacgtgatcgacgacatcatcagcctggagagcagctacaacgaggagatcctgggcctgatggaccccgccctgcagatggccaacaccctgcccgtgagcggcaacctgatcgacctgtacggcaaccagggcctgcccccccccggcctgaccatcagcaacagctgccccgccaacctgcccaacatcaagagagagctgaccgagagcgaggccagagccctggccaaggagagacagaagaaggacaaccacaacctgatcgagagaagaagaagattcaacatcaacgacagaatcaaggagctgggcaccctgatccccaagagcaacgaccccgacatgagatggaacaagggcaccatcctgaaggccagcgtggactacatcagaaagctgcagagagagcagcagagagccaaggagctggagaacagacagaagaagctggagcacgccaacagacacctgctgctgagaatccaggagctggagatgcaggccagagcccacggcctgagcctgatccccagcaccggcctgtgcagccccgacctggtgaacagaatcatcaagcaggagcccgtgctggagaactgcagccaggacctgctgcagcaccacgccgacctgacctgcaccaccaccctggacctgaccgacggcaccatcaccttcaacaacaacctgggcaccggcaccgaggccaaccaggcctacagcgtgcccaccaagatgggcagcaagctggaggacatcctgatggacgacaccctgagccccgtgggcgtgaccgaccccctgctgagcagcgtgagccccggcgccagcaagaccagcagcagaagaagcagcatgagcatggaggagaccgagcacacctgctag

SEQ ID NO: 2239 - DNA, 1407 bp, Artificial Sequence
  Description of Artificial Sequence: Synthetic coding sequence
atgaccagcagaatcctgctgagacagcagctgatgagagagcagatgcaggagcaggagagaagagagcagcagcagaagctgcaggccgcccagttcatgcagcagagagtgcccgtgagccagacccccgccatcaacgtgagcgtgcccaccaccctgcccagcgccacccaggtgcccatggaggtgctgaaggtgcagacccacctggagaaccccaccaagtaccacatccagcaggcccagagacagcaggtgaagcagtacctgagcaccaccctggccaacaagcacgccaaccaggtgctgagcctgccctgccccaaccagcccggcgaccacgtgatgccccccgtgcccggcagcagcgcccccaacagccccatggccatgctgaccctgaacagcaactgcgagaaggagggcttctacaagttcgaggagcagaacagagccgagagcgagtgccccggcatgaacacccacagcagagccagctgcatgcagatggacgacgtgatcgacgacatcatcagcctggagagcagctacaacgaggagatcctgggcctgatggaccccgccctgcagatggccaacaccctgcccgtgagcggcaacctgatcgacctgtacggcaaccagggcctgcccccccccggcctgaccatcagcaacagctgccccgccaacctgcccaacatcaagagagagctgaccgagagcgaggccagagccctggccaaggagagacagaagaaggacaaccacaacctgatcgagagaagaagaagattcaacatcaacgacagaatcaaggagctgggcaccctgatccccaagagcaacgaccccgacatgagatggaacaagggcaccatcctgaaggccagcgtggactacatcagaaagctgcagagagagcagcagagagccaaggagctggagaacagacagaagaagctggagcacgccaacagacacctgctgctgagaatccaggagctggagatgcaggccagagcccacggcctgagcctgatccccagcaccggcctgtgcagccccgacctggtgaacagaatcatcaagcaggagcccgtgctggagaactgcagccaggacctgctgcagcaccacgccgacctgacctgcaccaccaccctggacctgaccgacggcaccatcaccttcaacaacaacctgggcaccggcaccgaggccaaccaggcctacagcgtgcccaccaagatgggcagcaagctggaggacatcctgatggacgacaccctgagccccgtgggcgtgaccgaccccctgctgagcagcgtgagccccggcgccagcaagaccagcagcagaagaagcagcatgagcatggaggagaccgagcacacctgctag

SEQ ID NO: 2240 - DNA, 4422 bp, Artificial Sequence
  Description of Artificial Sequence: Synthetic coding sequence
atggccggcggcgcctggggcagactggcctgctacctggagttcctgaagaaggaggagctgaaggagttccagctgctgctggccaacaaggcccacagcagaagcagcagcggcgagacccccgcccagcccgagaagaccagcggcatggaggtggccagctacctggtggcccagtacggcgagcagagagcctgggacctggccctgcacacctgggagcagatgggcctgagaagcctgtgcgcccaggcccaggagggcgccggccacagccccagcttcccctacagccccagcgagccccacctgggcagccccagccagcccaccagcaccgccgtgctgatgccctggatccacgagctgcccgccggctgcacccagggcagcgagagaagagtgctgagacagctgcccgacaccagcggcagaagatggagagagatcagcgccagcctgctgtaccaggccctgcccagcagccccgaccacgagagccccagccaggagagccccaacgcccccaccagcaccgccgtgctgggcagctggggcagccccccccagcccagcctggcccccagagagcaggaggcccccggcacccagtggcccctggacgagaccagcggcatctactacaccgagatcagagagagagagagagagaagagcgagaagggcagacccccctgggccgccgtggtgggcacccccccccaggcccacaccagcctgcagccccaccaccacccctgggagcccagcgtgagagagagcctgtgcagcacctggccctggaagaacgaggacttcaaccagaagttcacccagctgctgctgctgcagagaccccaccccagaagccaggaccccctggtgaagagaagctggcccgactacgtggaggagaacagaggccacctgatcgagatcagagacctgttcggccccggcctggacacccaggagcccagaatcgtgatcctgcagggcgccgccggcatcggcaagagcaccctggccagacaggtgaaggaggcctggggcagaggccagctgtacggcgacagattccagcacgtgttctacttcagctgcagagagctggcccagagcaaggtggtgagcctggccgagctgatcggcaaggacggcaccgccacccccgcccccatcagacagatcctgagcagacccgagagactgctgttcatcctggacggcgtggacgagcccggctgggtgctgcaggagcccagcagcgagctgtgcctgcactggagccagccccagcccgccgacgccctgctgggcagcctgctgggcaagaccatcctgcccgaggccagcttcctgatcaccgccagaaccaccgccctgcagaacctgatccccagcctggagcaggccagatgggtggaggtgctgggcttcagcgagagcagcagaaaggagtacttctacagatacttcaccgacgagagacaggccatcagagccttcagactggtgaagagcaacaaggagctgtgggccctgtgcctggtgccctgggtgagctggctggcctgcacctgcctgatgcagcagatgaagagaaaggagaagctgaccctgaccagcaagaccaccaccaccctgtgcctgcactacctggcccaggccctgcaggcccagcccctgggcccccagctgagagacctgtgcagcctggccgccgagggcatctggcagaagaagaccctgttcagccccgacgacctgagaaagcacggcctggacggcgccatcatcagcaccttcctgaagatgggcatcctgcaggagcaccccatccccctgagctacagcttcatccacctgtgcttccaggagttcttcgccgccatgagctacgtgctggaggacgagaagggcagaggcaagcacagcaactgcatcatcgacctggagaagaccctggaggcctacggcatccacggcctgttcggcgccagcaccaccagattcctgctgggcctgctgagcgacgagggcgagagagagatggagaacatcttccactgcagactgagccagggcagaaacctgatgcagtgggtgcccagcctgcagctgctgctgcagccccacagcctggagagcctgcactgcctgtacgagaccagaaacaagaccttcctgacccaggtgatggcccacttcgaggagatgggcatgtgcgtggagaccgacatggagctgctggtgtgcaccttctgcatcaagttcagcagacacgtgaagaagctgcagctgatcgagggcagacagcacagaagcacctggagccccaccatggtggtgctgttcagatgggtgcccgtgaccgacgcctactggcagatcctgttcagcgtgctgaaggtgaccagaaacctgaaggagctggacctgagcggcaacagcctgagccacagcgccgtgaagagcctgtgcaagaccctgagaagacccagatgcctgctggagaccctgagactggccggctgcggcctgaccgccgaggactgcaaggacctggccttcggcctgagagccaaccagaccctgaccgagctggacctgagcttcaacgtgctgaccgacgccggcgccaagcacctgtgccagagactgagacagcccagctgcaagctgcagagactgcagctggtgagctgcggcctgaccagcgactgctgccaggacctggccagcgtgctgagcgccagccccagcctgaaggagctggacctgcagcagaacaacctggacgacgtgggcgtgagactgctgtgcgagggcctgagacaccccgcctgcaagctgatcagactgggcctggaccagaccaccctgagcgacgagatgagacaggagctgagagccctggagcaggagaagccccagctgctgatcttcagcagaagaaagcccagcgtgatgacccccaccgagggcctggacaccggcgagatgagcaacagcaccagcagcctgaagagacagagactgggcagcgagagagccgccagccacgtggcccaggccaacctgaagctgctggacgtgagcaagatcttccccatcgccgagatcgccgaggagagcagccccgaggtggtgcccgtggagctgctgtgcgtgcccagccccgccagccagggcgacctgcacaccaagcccctgggcaccgacgacgacttctggggccccaccggccccgtggccaccgaggtggtggacaaggagaagaacctgtacagagtgcacttccccgtggccggcagctacagatggcccaacaccggcctgtgcttcgtgatgagagaggccgtgaccgtggagatcgagttctgcgtgtgggaccagttcctgggcgagatcaacccccagcacagctggatggtggccggccccctgctggacatcaaggccgagcccggcgccgtggaggccgtgcacctgccccacttcgtggccctgcagggcggccacgtggacaccagcctgttccagatggcccacttcaaggaggagggcatgctgctggagaagcccgccagagtggagctgcaccacatcgtgctggagaaccccagcttcagccccctgggcgtgctgctgaagatgatccacaacgccctgagattcatccccgtgaccagcgtggtgctgctgtaccacagagtgcaccccgaggaggtgaccttccacctgtacctgatccccagcgactgcagcatcagaaaggccatcgacgacctggagatgaagttccagttcgtgagaatccacaagcccccccccctgacccccctgtacatgggctgcagatacaccgtgagcggcagcggcagcggcatgctggagatcctgcccaaggagctggagctgtgctacagaagccccggcgaggaccagctgttcagcgagttctacgtgggccacctgggcagcggcatcagactgcaggtgaaggacaagaaggacgagaccctggtgtgggaggccctggtgaagcccggcgacctgatgcccgccaccaccctgatcccccccgccagaatcgccgtgcccagccccctggacgccccccagctgctgcacttcgtggaccagtacagagagcagctgatcgccagagtgaccagcgtggaggtggtgctggacaagctgcacggccaggtgctgagccaggagcagtacgagagagtgctggccgagaacaccagacccagccagatgagaaagctgttcagcctgagccagagctgggacagaaagtgcaaggacggcctgtaccaggccctgaaggagacccacccccacctgatcatggagctgtgggagaagggcagcaagaagggcctgctgcccctgagcagctag

SEQ ID NO: 2241 - DNA, 4200 bp, Artificial Sequence
  Description of Artificial Sequence: Synthetic coding sequence
atggccggcggcgcctggggcagactggcctgctacctggagttcctgaagaaggaggagctgaaggagttccagctgctgctggccaacaaggcccacagcagaagcagcagcggcgagacccccgcccagcccgagaagaccagcggcatggaggtggccagctacctggtggcccagtacggcgagcagagagcctgggacctggccctgcacacctgggagcagatgggcctgagaagcctgtgcgcccaggcccaggagggcgccggccacagccccagcttcccctacagccccagcgagccccacctgggcagccccagccagcccaccagcaccgccgtgctgatgccctggatccacgagctgcccgccggctgcacccagggcagcgagagaagagtgctgagacagctgcccgacaccagcggcagaagatggagagagatcagcgccagcctgctgtaccaggccctgcccagcagccccgaccacgagagccccagccaggagagccccaacgcccccaccagcaccgccgtgctgggcagctggggcagccccccccagcccagcctggcccccagagagcaggaggcccccggcacccagtggcccctggacgagaccagcggcatctactacaccgagatcagagagagagagagagagaagagcgagaagggcagacccccctgggccgccgtggtgggcacccccccccaggcccacaccagcctgcagccccaccaccacccctgggagcccagcgtgagagagagcctgtgcagcacctggccctggaagaacgaggacttcaaccagaagttcacccagctgctgctgctgcagagaccccaccccagaagccaggaccccctggtgaagagaagctggcccgactacgtggaggagaacagaggccacctgatcgagatcagagacctgttcggccccggcctggacacccaggagcccagaatcgtgatcctgcagggcgccgccggcatcggcaagagcaccctggccagacaggtgaaggaggcctggggcagaggccagctgtacggcgacagattccagcacgtgttctacttcagctgcagagagctggcccagagcaaggtggtgagcctggccgagctgatcggcaaggacggcaccgccacccccgcccccatcagacagatcctgagcagacccgagagactgctgttcatcctggacggcgtggacgagcccggctgggtgctgcaggagcccagcagcgagctgtgcctgcactggagccagccccagcccgccgacgccctgctgggcagcctgctgggcaagaccatcctgcccgaggccagcttcctgatcaccgccagaaccaccgccctgcagaacctgatccccagcctggagcaggccagatgggtggaggtgctgggcttcagcgagagcagcagaaaggagtacttctacagatacttcaccgacgagagacaggccatcagagccttcagactggtgaagagcaacaaggagctgtgggccctgtgcctggtgccctgggtgagctggctggcctgcacctgcctgatgcagcagatgaagagaaaggagaagctgaccctgaccagcaagaccaccaccaccctgtgcctgcactacctggcccaggccctgcaggcccagcccctgggcccccagctgagagacctgtgcagcctggccgccgagggcatctggcagaagaagaccctgttcagccccgacgacctgagaaagcacggcctggacggcgccatcatcagcaccttcctgaagatgggcatcctgcaggagcaccccatccccctgagctacagcttcatccacctgtgcttccaggagttcttcgccgccatgagctacgtgctggaggacgagaagggcagaggcaagcacagcaactgcatcatcgacctggagaagaccctggaggcctacggcatccacggcctgttcggcgccagcaccaccagattcctgctgggcctgctgagcgacgagggcgagagagagatggagaacatcttccactgcagactgagccagggcagaaacctgatgcagtgggtgcccagcctgcagctgctgctgcagccccacagcctggagagcctgcactgcctgtacgagaccagaaacaagaccttcctgacccaggtgatggcccacttcgaggagatgggcatgtgcgtggagaccgacatggagctgctggtgtgcaccttctgcatcaagttcagcagacacgtgaagaagctgcagctgatcgagggcagacagcacagaagcacctggagccccaccatggtggtgctgttcagatgggtgcccgtgaccgacgcctactggcagatcctgttcagcgtgctgaaggtgaccagaaacctgaaggagctggacctgagcggcaacagcctgagccacagcgccgtgaagagcctgtgcaagaccctgagaagacccagatgcctgctggagaccctgagactggccggctgcggcctgaccgccgaggactgcaaggacctggccttcggcctgagagccaaccagaccctgaccgagctggacctgagcttcaacgtgctgaccgacgccggcgccaagcacctgtgccagagactgagacagcccagctgcaagctgcagagactgcagctggtgagctgcggcctgaccagcgactgctgccaggacctggccagcgtgctgagcgccagccccagcctgaaggagctggacctgcagcagaacaacctggacgacgtgggcgtgagactgctgtgcgagggcctgagacaccccgcctgcaagctgatcagactgggcaagcccagcgtgatgacccccaccgagggcctggacaccggcgagatgagcaacagcaccagcagcctgaagagacagagactgggcagcgagagagccgccagccacgtggcccaggccaacctgaagctgctggacgtgagcaagatcttccccatcgccgagatcgccgaggagagcagccccgaggtggtgcccgtggagctgctgtgcgtgcccagccccgccagccagggcgacctgcacaccaagcccctgggcaccgacgacgacttctggggccccaccggccccgtggccaccgaggtggtggacaaggagaagaacctgtacagagtgcacttccccgtggccggcagctacagatggcccaacaccggcctgtgcttcgtgatgagagaggccgtgaccgtggagatcgagttctgcgtgtgggaccagttcctgggcgagatcaacccccagcacagctggatggtggccggccccctgctggacatcaaggccgagcccggcgccgtggaggccgtgcacctgccccacttcgtggccctgcagggcggccacgtggacaccagcctgttccagatggcccacttcaaggaggagggcatgctgctggagaagcccgccagagtggagctgcaccacatcgtgctggagaaccccagcttcagccccctgggcgtgctgctgaagatgatccacaacgccctgagattcatccccgtgaccagcgtggtgctgctgtaccacagagtgcaccccgaggaggtgaccttccacctgtacctgatccccagcgactgcagcatcagaaaggagctggagctgtgctacagaagccccggcgaggaccagctgttcagcgagttctacgtgggccacctgggcagcggcatcagactgcaggtgaaggacaagaaggacgagaccctggtgtgggaggccctggtgaagcccggcgacctgatgcccgccaccaccctgatcccccccgccagaatcgccgtgcccagccccctggacgccccccagctgctgcacttcgtggaccagtacagagagcagctgatcgccagagtgaccagcgtggaggtggtgctggacaagctgcacggccaggtgctgagccaggagcagtacgagagagtgctggccgagaacaccagacccagccagatgagaaagctgttcagcctgagccagagctgggacagaaagtgcaaggacggcctgtaccaggccctgaaggagacccacccccacctgatcatggagctgtgggagaagggcagcaagaagggcctgctgcccctgagcagctag

SEQ ID NO: 2242 - DNA, 4128 bp, Artificial Sequence
  Description of Artificial Sequence: Synthetic coding sequence
atggccggcggcgcctggggcagactggcctgctacctggagttcctgaagaaggaggagctgaaggagttccagctgctgctggccaacaaggcccacagcagaagcagcagcggcgagacccccgcccagcccgagaagaccagcggcatggaggtggccagctacctggtggcccagtacggcgagcagagagcctgggacctggccctgcacacctgggagcagatgggcctgagaagcctgtgcgcccaggcccaggagggcgccggccacagccccagcttcccctacagccccagcgagccccacctgggcagccccagccagcccaccagcaccgccgtgctgatgccctggatccacgagctgcccgccggctgcacccagggcagcgagagaagagtgctgagacagctgcccgacaccagcggcagaagatggagagagatcagcgccagcctgctgtaccaggccctgcccagcagccccgaccacgagagccccagccaggagagccccaacgcccccaccagcaccgccgtgctgggcagctggggcagccccccccagcccagcctggcccccagagagcaggaggcccccggcacccagtggcccctggacgagaccagcggcatctactacaccgagatcagagagagagagagagagaagagcgagaagggcagacccccctgggccgccgtggtgggcacccccccccaggcccacaccagcctgcagccccaccaccacccctgggagcccagcgtgagagagagcctgtgcagcacctggccctggaagaacgaggacttcaaccagaagttcacccagctgctgctgctgcagagaccccaccccagaagccaggaccccctggtgaagagaagctggcccgactacgtggaggagaacagaggccacctgatcgagatcagagacctgttcggccccggcctggacacccaggagcccagaatcgtgatcctgcagggcgccgccggcatcggcaagagcaccctggccagacaggtgaaggaggcctggggcagaggccagctgtacggcgacagattccagcacgtgttctacttcagctgcagagagctggcccagagcaaggtggtgagcctggccgagctgatcggcaaggacggcaccgccacccccgcccccatcagacagatcctgagcagacccgagagactgctgttcatcctggacggcgtggacgagcccggctgggtgctgcaggagcccagcagcgagctgtgcctgcactggagccagccccagcccgccgacgccctgctgggcagcctgctgggcaagaccatcctgcccgaggccagcttcctgatcaccgccagaaccaccgccctgcagaacctgatccccagcctggagcaggccagatgggtggaggtgctgggcttcagcgagagcagcagaaaggagtacttctacagatacttcaccgacgagagacaggccatcagagccttcagactggtgaagagcaacaaggagctgtgggccctgtgcctggtgccctgggtgagctggctggcctgcacctgcctgatgcagcagatgaagagaaaggagaagctgaccctgaccagcaagaccaccaccaccctgtgcctgcactacctggcccaggccctgcaggcccagcccctgggcccccagctgagagacctgtgcagcctggccgccgagggcatctggcagaagaagaccctgttcagccccgacgacctgagaaagcacggcctggacggcgccatcatcagcaccttcctgaagatgggcatcctgcaggagcaccccatccccctgagctacagcttcatccacctgtgcttccaggagttcttcgccgccatgagctacgtgctggaggacgagaagggcagaggcaagcacagcaactgcatcatcgacctggagaagaccctggaggcctacggcatccacggcctgttcggcgccagcaccaccagattcctgctgggcctgctgagcgacgagggcgagagagagatggagaacatcttccactgcagactgagccagggcagaaacctgatgcagtgggtgcccagcctgcagctgctgctgcagccccacagcctggagagcctgcactgcctgtacgagaccagaaacaagaccttcctgacccaggtgatggcccacttcgaggagatgggcatgtgcgtggagaccgacatggagctgctggtgtgcaccttctgcatcaagttcagcagacacgtgaagaagctgcagctgatcgagggcagacagcacagaagcacctggagccccaccatggtggtgctgttcagatgggtgcccgtgaccgacgcctactggcagatcctgttcagcgtgctgaaggtgaccagaaacctgaaggagctggacctgagcggcaacagcctgagccacagcgccgtgaagagcctgtgcaagaccctgagaagacccagatgcctgctggagaccctgagactggccggctgcggcctgaccgccgaggactgcaaggacctggccttcggcctgagagccaaccagaccctgaccgagctggacctgagcttcaacgtgctgaccgacgccggcgccaagcacctgtgccagagactgagacagcccagctgcaagctgcagagactgcagctggtgagctgcggcctgaccagcgactgctgccaggacctggccagcgtgctgagcgccagccccagcctgaaggagctggacctgcagcagaacaacctggacgacgtgggcgtgagactgctgtgcgagggcctgagacaccccgcctgcaagctgatcagactgggcctggaccagaccaccctgagcgacgagatgagacaggagctgagagccctggagcaggagaagccccagctgctgatcttcagcagaagaaagcccagcgtgatgacccccaccgagggcctggacaccggcgagatgagcaacagcaccagcagcctgaagagacagagactgggcagcgagagagccgccagccacgtggcccaggccaacctgaagctgctggacgtgagcaagatcttccccatcgccgagatcgccggcaagagccacgaggagagcagccccgaggtggtgcccgtggagctgctgtgcgtgcccagccccgccagccagggcgacctgcacaccaagcccctgggcaccgacgacgacttctggggccccaccggccccgtggccaccgaggtggtggacaaggagaagaacctgtacagagtgcacttccccgtggccggcagctacagatggcccaacaccggcctgtgcttcgtgatgagagaggccgtgaccgtggagatcgagttctgcgtgtgggaccagttcctgggcgagatcaacccccagcacagctggatggtggccggccccctgctggacatcaaggccgagcccggcgccgtggaggccgtgcacctgccccacttcgtggccctgcagggcggccacgtggacaccagcctgttccagatggcccacttcaaggaggagggcatgctgctggagaagcccgccagagtggagctgcaccacatcgtgctggagaaccccagcttcagccccctgggcgtgctgctgaagatgatccacaacgccctgagattcatccccgtgaccagcgtggtgctgctgtaccacagagtgcaccccgaggaggtgaccttccacctgtacctgatccccagcgactgcagcatcagaaaggccatcgacgacctggagatgaagttccagttcgtgagaatccacaagcccccccccctgacccccctgtacatgggctgcagatacaccgtgagcggcagcggcagcggcatgctggagatcctgcccaaggagctggagctgtgctacagaagccccggcgaggaccagctgttcagcgagttctacgtgggccacctgggcagcggcatcagactgcaggtgaaggacaagaaggacgagaccctggtgtgggaggccctggtgaagcccggcagaaacaccagccagccctggaacctgagatgcaacagagacgccagaagatactag

SEQ ID NO: 2243 - DNA, 4422 bp, Artificial Sequence; identical to SEQ ID NO: 2240
  Description of Artificial Sequence: Synthetic coding sequence

SEQ ID NO: 2244 - DNA, 4290 bp, Artificial Sequence
  Description of Artificial Sequence: Synthetic coding sequence
atggccggcggcgcctggggcagactggcctgctacctggagttcctgaagaaggaggagctgaaggagttccagctgctgctggccaacaaggcccacagcagaagcagcagcggcgagacccccgcccagcccgagaagaccagcggcatggaggtggccagctacctggtggcccagtacggcgagcagagagcctgggacctggccctgcacacctgggagcagatgggcctgagaagcctgtgcgcccaggcccaggagggcgccggccacagccccagcttcccctacagccccagcgagccccacctgggcagccccagccagcccaccagcaccgccgtgctgatgccctggatccacgagctgcccgccggctgcacccagggcagcgagagaagagtgctgagacagctgcccgacaccagcggcagaagatggagagagatcagcgccagcctgctgtaccaggccctgcccagcagccccgaccacgagagccccagccaggagagccccaacgcccccaccagcaccgccgtgctgggcagctggggcagccccccccagcccagcctggcccccagagagcaggaggcccccggcacccagtggcccctggacgagaccagcggcatctactacaccgagatcagagagagagagagagagaagagcgagaagggcagacccccctgggccgccgtggtgggcacccccccccaggcccacaccagcctgcagccccaccaccacccctgggagcccagcgtgagagagagcctgtgcagcacctggccctggaagaacgaggacttcaaccagaagttcacccagctgctgctgctgcagagaccccaccccagaagccaggaccccctggtgaagagaagctggcccgactacgtggaggagaacagaggccacctgatcgagatcagagacctgttcggccccggcctggacacccaggagcccagaatcgtgatcctgcagggcgccgccggcatcggcaagagcaccctggccagacaggtgaaggaggcctggggcagaggccagctgtacggcgacagattccagcacgtgttctacttcagctgcagagagctggcccagagcaaggtggtgagcctggccgagctgatcggcaaggacggcaccgccacccccgcccccatcagacagatcctgagcagacccgagagactgctgttcatcctggacggcgtggacgagcccggctgggtgctgcaggagcccagcagcgagctgtgcctgcactggagccagccccagcccgccgacgccctgctgggcagcctgctgggcaagaccatcctgcccgaggccagcttcctgatcaccgccagaaccaccgccctgcagaacctgatccccagcctggagcaggccagatgggtggaggtgctgggcttcagcgagagcagcagaaaggagtacttctacagatacttcaccgacgagagacaggccatcagagccttcagactggtgaagagcaacaaggagctgtgggccctgtgcctggtgccctgggtgagctggctggcctgcacctgcctgatgcagcagatgaagagaaaggagaagctgaccctgaccagcaagaccaccaccaccctgtgcctgcactacctggcccaggccctgcaggcccagcccctgggcccccagctgagagacctgtgcagcctggccgccgagggcatctggcagaagaagaccctgttcagccccgacgacctgagaaagcacggcctggacggcgccatcatcagcaccttcctgaagatgggcatcctgcaggagcaccccatccccctgagctacagcttcatccacctgtgcttccaggagttcttcgccgccatgagctacgtgctggaggacgagaagggcagaggcaagcacagcaactgcatcatcgacctggagaagaccctggaggcctacggcatccacggcctgttcggcgccagcaccaccagattcctgctgggcctgctgagcgacgagggcgagagagagatggagaacatcttccactgcagactgagccagggcagaaacctgatgcagtgggtgcccagcctgcagctgctgctgcagccccacagcctggagagcctgcactgcctgtacgagaccagaaacaagaccttcctgacccaggtgatggcccacttcgaggagatgggcatgtgcgtggagaccgacatggagctgctggtgtgcaccttctgcatcaagttcagcagacacgtgaagaagctgcagctgatcgagggcagacagcacagaagcacctggagccccaccatggtggtgctgttcagatgggtgcccgtgaccgacgcctactggcagatcctgttcagcgtgctgaaggtgaccagaaacctgaaggagctggacctgagcggcaacagcctgagccacagcgccgtgaagagcctgtgcaagaccctgagaagacccagatgcctgctggagaccctgagactggccggctgcggcctgaccgccgaggactgcaaggacctggccttcggcctgagagccaaccagaccctgaccgagctggacctgagcttcaacgtgctgaccgacgccggcgccaagcacctgtgccagagactgagacagcccagctgcaagctgcagagactgcagctggtgagctgcggcctgaccagcgactgctgccaggacctggccagcgtgctgagcgccagccccagcctgaaggagctggacctgcagcagaacaacctggacgacgtgggcgtgagactgctgtgcgagggcctgagacaccccgcctgcaagctgatcagactgggcctggaccagaccaccctgagcgacgagatgagacaggagctgagagccctggagcaggagaagccccagctgctgatcttcagcagaagaaagcccagcgtgatgacccccaccgagggcctggacaccggcgagatgagcaacagcaccagcagcctgaagagacagagactgggcagcgagagagccgccagccacgtggcccaggccaacctgaagctgctggacgtgagcaagatcttccccatcgccgagatcgccgaggagagcagccccgaggtggtgcccgtggagctgctgtgcgtgcccagccccgccagccagggcgacctgcacaccaagcccctgggcaccgacgacgacttctggggccccaccggccccgtggccaccgaggtggtggacaaggagaagaacctgtacagagtgcacttccccgtggccggcagctacagatggcccaacaccggcctgtgcttcgtgatgagagaggccgtgaccgtggagatcgagttctgcgtgtgggaccagttcctgggcgagatcaacccccagcacagctggatggtggccggccccctgctggacatcaaggccgagcccggcgccgtggaggccgtgcacctgccccacttcgtggccctgcagggcggccacgtggacaccagcctgttccagatggcccacttcaaggaggagggcatgctgctggagaagcccgccagagtggagctgcaccacatcgtgctggagaaccccagcttcagccccctgggcgtgctgctgaagatgatccacaacgccctgagattcatccccgtgaccagcgtggtgctgctgtaccacagagtgcaccccgaggaggtgaccttccacctgtacctgatccccagcgactgcagcatcagaaaggagctggagctgtgctacagaagccccggcgaggaccagctgttcagcgagttctacgtgggccacctgggcagcggcatcagactgcaggtgaaggacaagaaggacgagaccctggtgtgggaggccctggtgaagcccggcgacctgatgcccgccaccaccctgatcccccccgccagaatcgccgtgcccagccccctggacgccccccagctgctgcacttcgtggaccagtacagagagcagctgatcgccagagtgaccagcgtggaggtggtgctggacaagctgcacggccaggtgctgagccaggagcagtacgagagagtgctggccgagaacaccagacccagccagatgagaaagctgttcagcctgagccagagctgggacagaaagtgcaaggacggcctgtaccaggccctgaaggagacccacccccacctgatcatggagctgtgggagaagggcagcaagaagggcctgctgcccctgagcagctag

SEQ ID NO: 2245 - DNA, 4332 bp, Artificial Sequence
  Description of Artificial Sequence: Synthetic coding sequence
atggccggcggcgcctggggcagactggcctgctacctggagttcctgaagaaggaggagctgaaggagttccagctgctgctggccaacaaggcccacagcagaagcagcagcggcgagacccccgcccagcccgagaagaccagcggcatggaggtggccagctacctggtggcccagtacggcgagcagagagcctgggacctggccctgcacacctgggagcagatgggcctgagaagcctgtgcgcccaggcccaggagggcgccggccacagccccagcttcccctacagccccagcgagccccacctgggcagccccagccagcccaccagcaccgccgtgctgatgccctggatccacgagctgcccgccggctgcacccagggcagcgagagaagagtgctgagacagctgcccgacaccagcggcagaagatggagagagatcagcgccagcctgctgtaccaggccctgcccagcagccccgaccacgagagccccagccaggagagccccaacgcccccaccagcaccgccgtgctgggcagctggggcagccccccccagcccagcctggcccccagagagcaggaggcccccggcacccagtggcccctggacgagaccagcggcatctactacaccgagatcagagagagagagagagagaagagcgagaagggcagacccccctgggccgccgtggtgggcacccccccccaggcccacaccagcctgcagccccaccaccacccctgggagcccagcgtgagagagagcctgtgcagcacctggccctggaagaacgaggacttcaaccagaagttcacccagctgctgctgctgcagagaccccaccccagaagccaggaccccctggtgaagagaagctggcccgactacgtggaggagaacagaggccacctgatcgagatcagagacctgttcggccccggcctggacacccaggagcccagaatcgtgatcctgcagggcgccgccggcatcggcaagagcaccctggccagacaggtgaaggaggcctggggcagaggccagctgtacggcgacagattccagcacgtgttctacttcagctgcagagagctggcccagagcaaggtggtgagcctggccgagctgatcggcaaggacggcaccgccacccccgcccccatcagacagatcctgagcagacccgagagactgctgttcatcctggacggcgtggacgagcccggctgggtgctgcaggagcccagcagcgagctgtgcctgcactggagccagccccagcccgccgacgccctgctgggcagcctgctgggcaagaccatcctgcccgaggccagcttcctgatcaccgccagaaccaccgccctgcagaacctgatccccagcctggagcaggccagatgggtggaggtgctgggcttcagcgagagcagcagaaaggagtacttctacagatacttcaccgacgagagacaggccatcagagccttcagactggtgaagagcaacaaggagctgtgggccctgtgcctggtgccctgggtgagctggctggcctgcacctgcctgatgcagcagatgaagagaaaggagaagctgaccctgaccagcaagaccaccaccaccctgtgcctgcactacctggcccaggccctgcaggcccagcccctgggcccccagctgagagacctgtgcagcctggccgccgagggcatctggcagaagaagaccctgttcagccccgacgacctgagaaagcacggcctggacggcgccatcatcagcaccttcctgaagatgggcatcctgcaggagcaccccatccccctgagctacagcttcatccacctgtgcttccaggagttcttcgccgccatgagctacgtgctggaggacgagaagggcagaggcaagcacagcaactgcatcatcgacctggagaagaccctggaggcctacggcatccacggcctgttcggcgccagcaccaccagattcctgctgggcctgctgagcgacgagggcgagagagagatggagaacatcttccactgcagactgagccagggcagaaacctgatgcagtgggtgcccagcctgcagctgctgctgcagccccacagcctggagagcctgcactgcctgtacgagaccagaaacaagaccttcctgacccaggtgatggcccacttcgaggagatgggcatgtgcgtggagaccgacatggagctgctggtgtgcaccttctgcatcaagttcagcagacacgtgaagaagctgcagctgatcgagggcagacagcacagaagcacctggagccccaccatggtggtgctgttcagatgggtgcccgtgaccgacgcctactggcagatcctgttcagcgtgctgaaggtgaccagaaacctgaaggagctggacctgagcggcaacagcctgagccacagcgccgtgaagagcctgtgcaagaccctgagaagacccagatgcctgctggagaccctgagactggccggctgcggcctgaccgccgaggactgcaaggacctggccttcggcctgagagccaaccagaccctgaccgagctggacctgagcttcaacgtgctgaccgacgccggcgccaagcacctgtgccagagactgagacagcccagctgcaagctgcagagactgcagctggtgagctgcggcctgaccagcgactgctgccaggacctggccagcgtgctgagcgccagccccagcctgaaggagctggacctgcagcagaacaacctggacgacgtgggcgtgagactgctgtgcgagggcctgagacaccccgcctgcaagctgatcagactgggcaagcccagcgtgatgacccccaccgagggcctggacaccggcgagatgagcaacagcaccagcagcctgaagagacagagactgggcagcgagagagccgccagccacgtggcccaggccaacctgaagctgctggacgtgagcaagatcttccccatcgccgagatcgccgaggagagcagccccgaggtggtgcccgtggagctgctgtgcgtgcccagccccgccagccagggcgacctgcacaccaagcccctgggcaccgacgacgacttctggggccccaccggccccgtggccaccgaggtggtggacaaggagaagaacctgtacagagtgcacttccccgtggccggcagctacagatggcccaacaccggcctgtgcttcgtgatgagagaggccgtgaccgtggagatcgagttctgcgtgtgggaccagttcctgggcgagatcaacccccagcacagctggatggtggccggccccctgctggacatcaaggccgagcccggcgccgtggaggccgtgcacctgccccacttcgtggccctgcagggcggccacgtggacaccagcctgttccagatggcccacttcaaggaggagggcatgctgctggagaagcccgccagagtggagctgcaccacatcgtgctggagaaccccagcttcagccccctgggcgtgctgctgaagatgatccacaacgccctgagattcatccccgtgaccagcgtggtgctgctgtaccacagagtgcaccccgaggaggtgaccttccacctgtacctgatccccagcgactgcagcatcagaaaggccatcgacgacctggagatgaagttccagttcgtgagaatccacaagcccccccccctgacccccctgtacatgggctgcagatacaccgtgagcggcagcggcagcggcatgctggagatcctgcccaaggagctggagctgtgctacagaagccccggcgaggaccagctgttcagcgagttctacgtgggccacctgggcagcggcatcagactgcaggtgaaggacaagaaggacgagaccctggtgtgggaggccctggtgaagcccggcgacctgatgcccgccaccaccctgatcccccccgccagaatcgccgtgcccagccccctggacgccccccagctgctgcacttcgtggaccagtacagagagcagctgatcgccagagtgaccagcgtggaggtggtgctggacaagctgcacggccaggtgctgagccaggagcagtacgagagagtgctggccgagaacaccagacccagccagatgagaaagctgttcagcctgagccagagctgggacagaaagtgcaaggacggcctgtaccaggccctgaaggagacccacccccacctgatcatggagctgtgggagaagggcagcaagaagggcctgctgcccctgagcagctag

SEQ ID NO: 2246 - DNA, 1527 bp, Artificial Sequence
  Description of Artificial Sequence: Synthetic coding sequence
atggcccacttcgaggagatgggcatgtgcgtggagaccgacatggagctgctggtgtgcaccttctgcatcaagttcagcagacacgtgaagaagctgcagctgatcgagggcagacagcacagaagcacctggagccccaccatggtggtgctgttcagatgggtgcccgtgaccgacgcctactggcagatcctgttcagcgtgctgaaggtgaccagaaacctgaaggagctggacctgagcggcaacagcctgagccacagcgccgtgaagagcctgtgcaagaccctgagaagacccagatgcctgctggagaccctgagactggccggctgcggcctgaccgccgaggactgcaaggacctggccttcggcctgagagccaaccagaccctgaccgagctggacctgagcttcaacgtgctgaccgacgccggcgccaagcacctgtgccagagactgagacagcccagctgcaagctgcagagactgcagctggtgagctgcggcctgaccagcgactgctgccaggacctggccagcgtgctgagcgccagccccagcctgaaggagctggacctgcagcagaacaacctggacgacgtgggcgtgagactgctgtgcgagggcctgagacaccccgcctgcaagctgatcagactgggcctggaccagaccaccctgagcgacgagatgagacaggagctgagagccctggagcaggagaagccccagctgctgatcttcagcagaagaaagcccagcgtgatgacccccaccgagggcctggacaccggcgagatgagcaacagcaccagcagcctgaagagacagagactgggcagcgagagagccgccagccacgtggcccaggccaacctgaagctgctggacgtgagcaagatcttccccatcgccgagatcgccgaggagagcagccccgaggtggtgcccgtggagctgctgtgcgtgcccagccccgccagccagggcgacctgcacaccaagcccctgggcaccgacgacgacttctggggccccaccggccccgtggccaccgaggtggtggacaaggagaagaacctgtacagagtgcacttccccgtggccggcagctacagatggcccaacaccggcctgtgcttcgtgatgagagaggccgtgaccgtggagatcgagttctgcgtgtgggaccagttcctgggcgagatcaacccccagcacagctggatggtggccggccccctgctggacatcaaggccgagcccggcgccgtggaggccgtgcacctgccccacttcgtggccctgcagggcggccacgtggacaccagcctgttccagatggcccacttcaaggaggagggcatgctgctggagaagcccgccagagtggagctgcaccacatcgtgctggagaaccccagcttcagccccctgggcgtgctgctgaagatgatccacaacgccctgagattcatccccgtgaccagcgtggtgctgctgtaccacagacccagctag

SEQ ID NO: 2247 - DNA, 4128 bp, Artificial Sequence; identical to SEQ ID NO: 2242
  Description of Artificial Sequence: Synthetic coding sequence

SEQ ID NO: 2248 - DNA, 2703 bp, Artificial Sequence
  Description of Artificial Sequence: Synthetic coding sequence
atggagagctgctacaaccccggcctggacggcatcatcgagtacgacgacttcaagctgaacagcagcatcgtggagcccaaggagcccgcccccgagaccgccgacggcccctacctggtgatcgtggagcagcccaagcagagaggcttcagattcagatacggctgcgagggccccagccacggcggcctgcccggcgccagcagcgagaagggcagaaagacctaccccaccgtgaagatctgcaactacgagggccccgccaagatcgaggtggacctggtgacccacagcgacccccccagagcccacgcccacagcctggtgggcaagcagtgcagcgagctgggcatctgcgccgtgagcgtgggccccaaggacatgaccgcccagttcaacaacctgggcgtgctgcacgtgaccaagaagaacatgatgggcaccatgatccagaagctgcagagacagagactgagaagcagaccccagggcctgaccgaggccgagcagagagagctggagcaggaggccaaggagctgaagaaggtgatggacctgagcatcgtgagactgagattcagcgccttcctgagagccagcgacggcagcttcagcctgcccctgaagcccgtgatcagccagcccatccacgacagcaagagccccggcgccagcaacctgaagatcagcagaatggacaagaccgccggcagcgtgagaggcggcgacgaggtgtacctgctgtgcgacaaggtgcagaaggacgacatcgaggtgagattctacgaggacgacgagaacggctggcaggccttcggcgacttcagccccaccgacgtgcacaagcagtacgccatcgtgttcagaacccccccctaccacaagatgaagatcgagagacccgtgaccgtgttcctgcagctgaagagaaagagaggcggcgacgtgagcgacagcaagcagttcacctactaccccctggtggaggacaaggaggaggtgcagagaaagagaagaaaggccctgcccaccttcagccagcccttcggcggcggcagccacatgggcggcggcagcggcggcgccgccggcggctacggcggcgccggcggcggcggcagcctgggcttcttccccagcagcctggcctacagcccctaccagagcggcgccggccccatgggctgctaccccggcggcggcggcggcgcccagatggccgccaccgtgcccagcagagacagcggcgaggaggccgccgagcccagcgcccccagcagaaccccccagtgcgagccccaggcccccgagatgctgcagagagccagagagtacaacgccagactgttcggcctggcccagagaagcgccagagccctgctggactacggcgtgaccgccgacgccagagccctgctggccggccagagacacctgctgaccgcccaggacgagaacggcgacacccccctgcacctggccatcatccacggccagaccagcgtgatcgagcagatcgtgtacgtgatccaccacgcccaggacctgggcgtggtgaacctgaccaaccacctgcaccagacccccctgcacctggccgtgatcaccggccagaccagcgtggtgagcttcctgctgagagtgggcgccgaccccgccctgctggacagacacggcgacagcgccatgcacctggccctgagagccggcgccggcgcccccgagctgctgagagccctgctgcagagcggcgcccccgccgtgccccagctgctgcacatgcccgacttcgagggcctgtaccccgtgcacctggccgtgagagccagaagccccgagtgcctggacctgctggtggacagcggcgccgaggtggaggccaccgagagacagggcggcagaaccgccctgcacctggccaccgagatggaggagctgggcctggtgacccacctggtgaccaagctgagagccaacgtgaacgccagaaccttcgccggcaacacccccctgcacctggccgccggcctgggctaccccaccctgaccagactgctgctgaaggccggcgccgacatccacgccgagaacgaggagcccctgtgccccctgcccagcccccccaccagcgacagcgacagcgacagcgagggccccgagaaggacaccagaagcagcttcagaggccacacccccctggacctgacctgcagcaccaaggtgaagaccctgctgctgaacgccgcccagaacaccatggagccccccctgaccccccccagccccgccggccccggcctgagcctgggcgacaccgccctgcagaacctggagcagctgctggacggccccgaggcccagggcagctgggccgagctggccgagagactgggcctgagaagcctggtggacacctacagacagaccaccagccccagcggcagcctgctgagaagctacgagctggccggcggcgacctggccggcctgctggaggccctgagcgacatgggcctggaggagggcgtgagactgctgagaggccccgagaccagagacaagctgcccagcaccgccgaggtgaaggaggacagcgcctacggcagccagagcgtggagcaggaggccgagaagctgggccccccccccgagccccccggcggcctgtgccacggccacccccagccccaggtgcactag

SEQ ID NO: 2249 - DNA, 2700 bp, Artificial Sequence
  Description of Artificial Sequence: Synthetic coding sequence
atggagagctgctacaaccccggcctggacggcatcatcgagtacgacgacttcaagctgaacagcagcatcgtggagcccaaggagcccgcccccgagaccgccgacggcccctacctggtgatcgtggagcagcccaagcagagaggcttcagattcagatacggctgcgagggccccagccacggcggcctgcccggcgccagcagcgagaagggcagaaagacctaccccaccgtgaagatctgcaactacgagggccccgccaagatcgaggtggacctggtgacccacagcgacccccccagagcccacgcccacagcctggtgggcaagcagtgcagcgagctgggcatctgcgccgtgagcgtgggccccaaggacatgaccgcccagttcaacaacctgggcgtgctgcacgtgaccaagaagaacatgatgggcaccatgatccagaagctgcagagacagagactgagaagcagaccccagggcctgaccgaggccgagcagagagagctggagcaggaggccaaggagctgaagaaggtgatggacctgagcatcgtgagactgagattcagcgccttcctgagagccagcgacggcagcttcagcctgcccctgaagcccgtgatcagccagcccatccacgacagcaagagccccggcgccagcaacctgaagatcagcagaatggacaagaccgccggcagcgtgagaggcggcgacgaggtgtacctgctgtgcgacaaggtgcagaaggacgacatcgaggtgagattctacgaggacgacgagaacggctggcaggccttcggcgacttcagccccaccgacgtgcacaagcagtacgccatcgtgttcagaacccccccctaccacaagatgaagatcgagagacccgtgaccgtgttcctgcagctgaagagaaagagaggcggcgacgtgagcgacagcaagcagttcacctactaccccctggtggaggacaaggaggaggtgcagagaaagagaagaaaggccctgcccaccttcagccagcccttcggcggcggcagccacatgggcggcggcagcggcggcgccgccggcggctacggcggcgccggcggcggcggcagcctgggcttcttccccagcagcctggcctacagcccctaccagagcggcgccggccccatgggctgctaccccggcggcggcggcggcgcccagatggccgccaccgtgcccagcagagacagcggcgaggaggccgccgagcccagcgcccccagcagaaccccccagtgcgagccccaggcccccgagatgctgcagagagccagagagtacaacgccagactgttcggcctggcccagagaagcgccagagccctgctggactacggcgtgaccgccgacgccagagccctgctggccggccagagacacctgctgaccgcccaggacgagaacggcgacacccccctgcacctggccatcatccacggccagaccagcgtgatcgagcagatcgtgtacgtgatccaccacgcccaggacctgggcgtggtgaacctgaccaaccacctgcaccagacccccctgcacctggccgtgatcaccggccagaccagcgtggtgagcttcctgctgagagtgggcgccgaccccgccctgctggacagacacggcgacagcgccatgcacctggccctgagagccggcgccggcgcccccgagctgctgagagccctgctgcagagcggcgcccccgccgtgccccagctgctgcacatgcccgacttcgagggcctgtaccccgtgcacctggccgtgagagccagaagccccgagtgcctggacctgctggtggacagcggcgccgaggtggaggccaccgagagacagggcggcagaaccgccctgcacctggccaccgagatggaggagctgggcctggtgacccacctggtgaccaagctgagagccaacgtgaacgccagaaccttcgccggcaacacccccctgcacctggccgccggcctgggctaccccaccctgaccagactgctgctgaaggccggcgccgacatccacgccgagaacgaggagcccctgtgccccctgcccagcccccccaccagcgacagcgacagcgacagcgagggccccgagaaggacaccagaagcagcttcagaggccacacccccctggacctgacctgcagcaccaaggtgaagaccctgctgctgaacgccgcccagaacaccatggagccccccctgaccccccccagccccgccggccccggcctgagcctgggcgacaccgccctgcagaacctggagcagctgctggacggccccgaggcccagggcagctgggccgagctggccgagagactgggcctgagaagcctggtggacacctacagacagaccaccagccccagcggcagcctgctgagaagctacgagctggccggcggcgacctggccggcctgctggaggccctgagcgacatgggcctggaggagggcgtgagactgctgagaggccccgagaccagagacaagctgcccagcaccgaggtgaaggaggacagcgcctacggcagccagagcgtggagcaggaggccgagaagctgggccccccccccgagccccccggcggcctgtgccacggccacccccagccccaggtgcactag

SEQ ID NO: 2250 - DNA, 2703 bp, Artificial Sequence; identical to SEQ ID NO: 2248
  Description of Artificial Sequence: Synthetic coding sequence

SEQ ID NO: 2251 - DNA, 2700 bp, Artificial Sequence; identical to SEQ ID NO: 2249
  Description of Artificial Sequence: Synthetic coding sequence

SEQ ID NO: 2252 - DNA, 804 bp, Artificial Sequence
  Description of Artificial Sequence: Synthetic coding sequence
atgcccagagccttcctggtgaagaagccctgcgtgagcacctgcaagagaaactggagcgagctgcccgacgaggagagaggcgagatctacgtgcccgtgagcctgggcttctgccccccccagccctacagagagcccgagcccagcgtggccgagccccccagctgccccctggccctgaacatgagcctgagagacagcagctacagcatggcccccggcccctgcgtggtggcccagctgcccagcgaggacatgggccacctgaccgacccccagagcagagaccacggcttcctgagaaccaagatgaaggtgaccctgggcgacagccccagcggcgacctgttcacctgcagagtgtgccagaaggccttcacctaccagagaatgctgaacagacacatgaagtgccacaacgacgtgaagagacacctgtgcacctactgcggcaagggcttcaacgacaccttcgacctgaagagacacgtgagaacccacaccggcgtgagaccctacaagtgcagcctgtgcgacaaggccttcacccagagatgcagcctggagagccacctgaagaagatccacggcgtgcagcagaagtacgcctacaaggagagaagagccaagctgtacgtgtgcgaggagtgcggctgcaccagcgagagccaggagggccacgtgctgcacctgaaggagcaccaccccgacagccccctgctgagaaagaccagcaagaaggtggccgtggccctgcagaacaccgtgaccagcctgctgcagggcagcccccacctgtag

SEQ ID NO: 2253 - DNA, 1095 bp, Artificial Sequence
  Description of Artificial Sequence: Synthetic coding sequence
atgcacagactgatcttcgtgtacaccctgatctgcgccaacttctgcagctgcagagacaccagcgccaccccccagagcgccagcatcaaggccctgagaaacgccaacctgagaagagacgacctgtacagaagagacgagaccatccaggtgaagggcaacggctacgtgcagagccccagattccccaacagctaccccagaaacctgctgctgacctggagactgcacagccaggagaacaccagaatccagctggtgttcgacaaccagttcggcctggaggaggccgagaacgacatctgcagatacgacttcgtggaggtggaggacatcagcgagaccagcaccatcatcagaggcagatggtgcggccacaaggaggtgccccccagaatcaagagcagaaccaaccagatcaagatcaccttcaagagcgacgactacttcgtggccaagcccggcttcaagatctactacagcctgctggaggacttccagcccgccgccgccagcgagaccaactgggagagcgtgaccagcagcatcagcggcgtgagctacaacagccccagcgtgaccgaccccaccctgatcgccgacgccctggacaagaagatcgccgagttcgacaccgtggaggacctgctgaagtacttcaaccccgagagctggcaggaggacctggagaacatgtacctggacacccccagatacagaggcagaagctaccacgacagaaagagcaaggtggacctggacagactgaacgacgacgccaagagatacagctgcacccccagaaactacagcgtgaacatcagagaggagctgaagctggccaacgtggtgttcttccccagatgcctgctggtgcagagatgcggcggcaactgcggctgcggcaccgtgaactggagaagctgcacctgcaacagcggcaagaccgtgaagaagtaccacgaggtgctgcagttcgagcccggccacatcaagagaagaggcagagccaagaccatggccctggtggacatccagctggaccaccacgagagatgcgactgcatctgcagcagcagaccccccagatag

SEQ ID NO: 2254 - DNA, 1113 bp, Artificial Sequence
  Description of Artificial Sequence: Synthetic coding sequence
atgcacagactgatcttcgtgtacaccctgatctgcgccaacttctgcagctgcagagacaccagcgccaccccccagagcgccagcatcaaggccctgagaaacgccaacctgagaagagacgagagcaaccacctgaccgacctgtacagaagagacgagaccatccaggtgaagggcaacggctacgtgcagagccccagattccccaacagctaccccagaaacctgctgctgacctggagactgcacagccaggagaacaccagaatccagctggtgttcgacaaccagttcggcctggaggaggccgagaacgacatctgcagatacgacttcgtggaggtggaggacatcagcgagaccagcaccatcatcagaggcagatggtgcggccacaaggaggtgccccccagaatcaagagcagaaccaaccagatcaagatcaccttcaagagcgacgactacttcgtggccaagcccggcttcaagatctactacagcctgctggaggacttccagcccgccgccgccagcgagaccaactgggagagcgtgaccagcagcatcagcggcgtgagctacaacagccccagcgtgaccgaccccaccctgatcgccgacgccctggacaagaagatcgccgagttcgacaccgtggaggacctgctgaagtacttcaaccccgagagctggcaggaggacctggagaacatgtacctggacacccccagatacagaggcagaagctaccacgacagaaagagcaaggtggacctggacagactgaacgacgacgccaagagatacagctgcacccccagaaactacagcgtgaacatcagagaggagctgaagctggccaacgtggtgttcttccccagatgcctgctggtgcagagatgcggcggcaactgcggctgcggcaccgtgaactggagaagctgcacctgcaacagcggcaagaccgtgaagaagtaccacgaggtgctgcagttcgagcccggccacatcaagagaagaggcagagccaagaccatggccctggtggacatccagctggaccaccacgagagatgcgactgcatctgcagcagcagaccccccagatag

SEQ ID NO: 2255 - DNA, 726 bp, Artificial Sequence
  Description of Artificial Sequence: Synthetic coding sequence
atgaacagatgctgggccctgttcctgagcctgtgctgctacctgagactggtgagcgccgagggcgaccccatccccgaggagctgtacgagatgctgagcgaccacagcatcagaagcttcgacgacctgcagagactgctgcacggcgaccccggcgaggaggacggcgccgagctggacctgaacatgaccagaagccacagcggcggcgagctggagagcctggccagaggcagaagaagcctgggcagcctgaccatcgccgagcccgccatgatcgccgagtgcaagaccagaaccgaggtgttcgagatcagcagaagactgatcgacagaaccaacgccaacttcctggtgtggcccccctgcgtggaggtgcagagatgcagcggctgctgcaacaacagaaacgtgcagtgcagacccacccaggtgcagctgagacccgtgcaggtgagaaagatcgagatcgtgagaaagaagcccatcttcaagaaggccaccgtgaccctggaggaccacctggcctgcaagtgcgagaccgtggccgccgccagacccgtgaccagaagccccggcggcagccaggagcagagagccaagaccccccagaccagagtgaccatcagaaccgtgagagtgagaagaccccccaagggcaagcacagaaagttcaagcacacccacgacaagaccgccctgaaggagaccctgggcgcctag

SEQ ID NO: 2256 - DNA, 681 bp, Artificial Sequence
  Description of Artificial Sequence: Synthetic coding sequence
atgttcatcatgggcctgggcgaccccatccccgaggagctgtacgagatgctgagcgaccacagcatcagaagcttcgacgacctgcagagactgctgcacggcgaccccggcgaggaggacggcgccgagctggacctgaacatgaccagaagccacagcggcggcgagctggagagcctggccagaggcagaagaagcctgggcagcctgaccatcgccgagcccgccatgatcgccgagtgcaagaccagaaccgaggtgttcgagatcagcagaagactgatcgacagaaccaacgccaacttcctggtgtggcccccctgcgtggaggtgcagagatgcagcggctgctgcaacaacagaaacgtgcagtgcagacccacccaggtgcagctgagacccgtgcaggtgagaaagatcgagatcgtgagaaagaagcccatcttcaagaaggccaccgtgaccctggaggaccacctggcctgcaagtgcgagaccgtggccgccgccagacccgtgaccagaagccccggcggcagccaggagcagagagccaagaccccccagaccagagtgaccatcagaaccgtgagagtgagaagaccccccaagggcaagcacagaaagttcaagcacacccacgacaagaccgccctgaaggagaccctgggcgcctag

SEQ ID NO: 2257 - DNA, 411 bp, Artificial Sequence
  Description of Artificial Sequence: Synthetic coding sequence
atgctgagcgaccacagcatcagaagcttcgacgacctgcagagactgctgcacggcgaccccggcgaggaggacggcgccgagctggacctgaacatgaccagaagccacagcggcggcgagctggagagcctggccagaggcagaagaagcctgggcagcctgaccatcgccgagcccgccatgatcgccgagtgcaagaccagaaccgaggtgttcgagatcagcagaagactgatcgacagaaccaacgccaacttcctggtgtggcccccctgcgtggaggtgcagagatgcagcggctgctgcaacaacagaaacgtgcagtgcagacccacccaggtgcagctgagacccgtgcaggtgagaaagatcgagatcgtgagaaagaagcccatcttcaagaagtag

SEQ ID NO: 2258 - DNA, 435 bp, Artificial Sequence
  Description of Artificial Sequence: Synthetic coding sequence
atgctgagcgaccacagcatcagaagcttcgacgacctgcagagactgctgcacggcgaccccggcgaggaggacggcgccgagctggacctgaacatgaccagaagccacagcggcggcgagctggagagcctggccagaggcagaagaagcctgggcagcctgaccatcgccgagcccgccatgatcgccgagtgcaagaccagaaccgaggtgttcgagatcagcagaagactgatcgacagaaccaacgccaacttcctggtgtggcccccctgcgtggaggtgcagagatgcagcggctgctgcaacaacagaaacgtgcagtgcagacccacccaggtgcagctgagacccgtgcaggtgagaaagatcgagatcgtgagaaagaagcccatcttcaagaaggccaccgtgaccctggaggaccactag

SEQ ID NO: 2259 - DNA, 804 bp, Artificial Sequence
  Description of Artificial Sequence: Synthetic coding sequence
atgcccagaagctgctgcagcagaagcggcgccctgctgctggccctgctgctgcaggccagcatggaggtgagaggctggtgcctggagagcagccagtgccaggacctgaccaccgagagcaacctgctggagtgcatcagagcctgcaagcccgacctgagcgccgagacccccatgttccccggcaacggcgacgagcagcccctgaccgagaaccccagaaagtacgtgatgggccacttcagatgggacagattcggcagaagaaacagcagcagcagcggcagcagcggcgccggccagaagagagaggacgtgagcgccggcgaggactgcggccccctgcccgagggcggccccgagcccagaagcgacggcgccaagcccggccccagagagggcaagagaagctacagcatggagcacttcagatggggcaagcccgtgggcaagaagagaagacccgtgaaggtgtaccccaacggcgccgaggacgagagcgccgaggccttccccctggagttcaagagagagctgaccggccagagactgagagagggcgacggccccgacggccccgccgacgacggcgccggcgcccaggccgacctggagcacagcctgctggtggccgccgagaagaaggacgagggcccctacagaatggagcacttcagatggggcagcccccccaaggacaagagatacggcggcttcatgaccagcgagaagagccagacccccctggtgaccctgttcaagaacgccatcatcaagaacgcctacaagaagggcgagtag

SEQ ID NO: 2260 - DNA, 804 bp, Artificial Sequence; identical to SEQ ID NO: 2259
  Description of Artificial Sequence: Synthetic coding sequence

SEQ ID NO: 2261 - DNA, 804 bp, Artificial Sequence; identical to SEQ ID NO: 2259
  Description of Artificial Sequence: Synthetic coding sequence

SEQ ID NO: 2262 - DNA, 804 bp, Artificial Sequence; identical to SEQ ID NO: 2259
  Description of Artificial Sequence: Synthetic coding sequence

SEQ ID NO: 2263 - DNA, 741 bp, Artificial Sequence
  Description of Artificial Sequence: Synthetic coding sequence
atgcccagaagctgctgcagcagaagcggcgccctgctgctggccctgctgctgcaggccagcatggaggtgagaggctggtgcctggagagcagccagtgccaggacctgaccaccgagagcaacctgctggagtgcatcagagcctgcaagcccgacctgagcgccgagacccccatgttccccggcaacggcgacgagcagcccctgaccgagaaccccagaaagtacgtgatgggccacttcagatgggacagattcggcagaagaaacagcagcagcagcggcagcagcggcgccggccagaagagagaggacgtgagcgccggcgaggactgcggccccctgcccgagggcggccccgagcccagaagcgacggcgccaagcccggccccagagagggcaagagaagctacagcatggagcacttcagatggggcaagcccgtgggcaagaagagaagacccgtgaaggtgtaccccaacggcgccgaggacgagagcgccgaggccttccccctggagttcaagagagagctgaccggccagagactgagagagggcgacggccccgacggccccgccgacgacggcgccggcgcccaggccgacctggagcacagcctgctggtggccgccgagaagaaggacgagggcccctacagaatggagcacttcagatggggcagcccccccaaggacaagagatacggcggcttcatgaccagcgagaagagctag

SEQ ID NO: 2264 - DNA, 459 bp, Artificial Sequence
  Description of Artificial Sequence: Synthetic coding sequence
atgacctgcaccgaccagaagagccacagccagagagccctgggcacccagacccccgccctgcagggcccccagctgctgaacaccgaccccagcagcgaggagaccagacccccccacgtgaaccccgacagactgtgccacatggagcccgccaaccacttctggcacgccggcgacctgcaggccatgatcagcaaggagttccacctggccgccacccaggacgactgcagaaagggcagaacccaggaggacatcctggtgcccagcagccaccccgagctgttcgccagcgtgctgcccatggcccccgaggaggccgccagactgcagcagccccagcccctgcccccccccagcggcatccacctgagcgccagcagaaccctggcccccaccctgctgtacagcagcccccccagccacagccccttcggcctgagcagcctgatctag

SEQ ID NO: 2265 - DNA, 315 bp, Artificial Sequence
  Description of Artificial Sequence: Synthetic coding sequence
atggagcccgccaaccacttctggcacgccggcgacctgcaggccatgatcagcaaggagttccacctggccgccacccaggacgactgcagaaagggcagaacccaggaggacatcctggtgcccagcagccaccccgagctgttcgccagcgtgctgcccatggcccccgaggaggccgccagactgcagcagccccagcccctgcccccccccagcggcatccacctgagcgccagcagaaccctggccctgaccctgctgtacagcagcccccccagccacagccccttcggcctgagcagcctgatctag

SEQ ID NO: 2266 - DNA, 459 bp, Artificial Sequence; identical to SEQ ID NO: 2264
  Description of Artificial Sequence: Synthetic coding sequence

SEQ ID NO: 2267 - DNA, 459 bp, Artificial Sequence
  Description of Artificial Sequence: Synthetic coding sequence
atgacctgcaccgaccagaagagccacagccagagagccctgggcacccagacccccgccctgcagggcccccagctgctgaacaccgaccccagcagcaaggagaccagacccccccacgtgaaccccgacagactgtgccacatggagcccgccaaccacttctggcacgccggcgacctgcaggccatgatcagcaaggagttccacctggccgccacccaggacgactgcagaaagggcagaacccaggaggacatcctggtgcccagcagccaccccgagctgttcgccagcgtgctgcccatggcccccgaggaggccgccagactgcagcagccccagcccctgcccccccccagcggcatccacctgagcgccagcagaaccctggcccccaccctgctgtacagcagcccccccagccacagccccttcggcctgagcagcctgatctag

SEQ ID NO: 2268 - DNA, 459 bp, Artificial Sequence; identical to SEQ ID NO: 2264
  Description of Artificial Sequence: Synthetic coding sequence

SEQ ID NO: 2269 - DNA, 459 bp, Artificial Sequence; identical to SEQ ID NO: 2264
  Description of Artificial Sequence: Synthetic coding sequence

SEQ ID NO: 2270 - DNA, 453 bp, Artificial Sequence
  Description of Artificial Sequence: Synthetic coding sequence
ccccagaccgaccagaagagccacagccagagagccctgggcacccagacccccgccctgcagggcccccagctgctgaacaccgaccccagcagcgaggagacccacccccacgtgaaccccgacagactgtgccacatggagcccgccaaccacttctggcacgccggcgacctgcaggccatgatcagcaaggagttccacctggccgccacccaggacgactgcagaaagggcagaacccaggaggacatcctggtgcccagcagccaccccgagctgttcgccagcgtgctgcccatggcccccgaggaggccgccagactgcagcagccccagcccctgcccccccccagcggcatccacctgagcgccagcagaaccctggccctgaccctgctgtacagcagcccccccagccacagccccttcggcctgagcagcctgatctag

SEQ ID NO: 2271 - DNA, 411 bp, Artificial Sequence
  Description of Artificial Sequence: Synthetic coding sequence
atgatcctgaactggaagctgctgggcatcctggtgctgtgcctgcacaccagaggcatcagcggcagcgagggccaccccagccacccccccgccgaggacagagaggaggccggcagccccaccctgccccagggcccccccgtgcccggcgacccctggcccggcgccccccccctgttcgaggaccccccccccaccagacccagcagaccctggagagacctgcccgagaccggcgtgtggctgcccgagccccccagaaccgaccccccccagccccccagacccgacgacccctggcccgccggcccccagccccccgagaacccctggccccccgcccccgaggtggacaacagaccccaggaggagcccgacctggacccccccagagaggagtacagatag

SEQ ID NO: 2272 - DNA, 411 bp, Artificial Sequence
  Description of Artificial Sequence: Synthetic coding sequence
atgatcctgaactggaagctgctgggcatcctggtgctgtgcctgcacaccagaggcatcagcggcagcgagggccaccccagccacccccccgccgaggacagagaggaggccggcagccccaccctgccccagggcccccccgtgcccggcgacccctggcccggcgccccccccctgttcgaggaccccccccccaccagacccagcagaccctggagagacctgcccgagaccggcgtgtggccccccgagccccccagaaccgaccccccccagccccccagacccgacgacccctggcccgccggcccccagccccccgagaacccctggccccccgcccccgaggtggacaacagaccccaggaggagcccgacctggacccccccagagaggagtacagatag

SEQ ID NO: 2273 - DNA, 411 bp, Artificial Sequence; identical to SEQ ID NO: 2272
  Description of Artificial Sequence: Synthetic coding sequence

SEQ ID NO: 2274 - DNA, 411 bp, Artificial Sequence; identical to SEQ ID NO: 2272
  Description of Artificial Sequence: Synthetic coding sequence

SEQ ID NO: 2275 - DNA, 411 bp, Artificial Sequence; identical to SEQ ID NO: 2272
  Description of Artificial Sequence: Synthetic coding sequence

SEQ ID NO: 2276 - DNA, 411 bp, Artificial Sequence; identical to SEQ ID NO: 2272
  Description of Artificial Sequence: Synthetic coding sequence

SEQ ID NO: 2277 - DNA, 753 bp, Artificial Sequence
  Description of Artificial Sequence: Synthetic coding sequence
gccctgctgctggccgtgatccagggcagacccggcgcccagcacgacgtggaggccctgggcggcctgtgctgggccctgggcttcgagaccaccgtgagaaccgaccccaccgcccaggccttccaggaggagctggcccagttcagagagcagctggacacctgcagaggccccgtgagctgcgccctggtggccctgatggcccacggcggccccagaggccagctgctgggcgccgacggccaggaggtgcagcccgaggccctgatgcaggagctgagcagatgccaggtgctgcagggcagacccaagatcttcctgctgcaggcctgcagaggcggcaacagagacgccggcgtgggccccaccgccctgccctggtactggagctggctgagagccccccccagcgtgcccagccacgccgacgtgctgcagatctacgccgaggcccagggcagcagctgcagaggcaccccccccggcagcagcgaccaggccgacatcctgaccgtgtacagcgccgccgagggctacgtggcctacagagacgacaagggcagcgacttcatccagaccctggtggaggtgctgagagccaaccccggcagagacctgctggagctgctgaccgaggtgaacagaagagtgtgcgagcaggaggtgctgggccccgactgcgacgagctgagaaaggcctgcctggagatcagaagcagcctgagaagaagactgtgcctgcaggcctag

SEQ ID NO: 2278 - DNA, 3165 bp, Artificial Sequence
  Description of Artificial Sequence: Synthetic coding sequence
atgaccagctacagagagagaagcgccgacctggccagattctacaccgtgaccgagccccagagacaccccagaggctacaccgtgtacaaggtgaccgccagaatcatcgtgtggaagagatacagcgacttcaagaagctgcacaaggagctgtggcagatccacaagaacctgttcagacacagcgagctgttcccccccttcgccaagggcatcgtgttcggcagattcgacgagaccgtgatcgaggagagaagacagtgcgccgaggacctgctgcagttcagcgccaacatccccgccctgtacaacagcaagcagctggaggacttcttcaagggcggcatcatcaacgacagcagcgagctgatcggccccgccgaggcccacagcgacagcctgatcgacaccttccccgagtgcagcaccgagggcttcagcagcgacagcgacctggtgagcctgaccgtggacgtggacagcctggccgagctggacgacggcatggccagcaaccagaacagccccatcagaaccttcggcctgaacctgagcagcgacagcagcgccctgggcgccgtggccagcgacagcgagcagagcaagaccgaggaggagagagagagcagaagcctgttccccggcagcctgaagcccaagctgggcaagagagactacctggagaaggccggcgagctgatcaagctggccctgaagaaggaggaggaggacgactacgaggccgccagcgacttctacagaaagggcgtggacctgctgctggagggcgtgcagggcgagagcagccccaccagaagagaggccgtgaagagaagaaccgccgagtacctgatgagagccgagagcatcagcagcctgtacggcaagccccagctggacgacgtgagccagccccccggcagcctgagcagcagacccctgtggaacctgagaagccccgccgaggagctgaaggccttcagagtgctgggcgtgatcgacaaggtgctgctggtgatggacaccagaaccgagcagaccttcatcctgaagggcctgagaaagagcagcgagtacagcagaaacagaaagaccatcatccccagatgcgtgcccaacatggtgtgcctgcacaagtacatcatcagcgaggagagcgtgttcctggtgctgcagcacgccgagggcggcaagctgtggagctacatcagcaagttcctgaacagaagccccgaggagagcttcgacatcaaggaggtgaagaagcccaccctggccaaggtgcacctgcagcagcccaccagcagcccccaggacagcagcagcttcgagagcagaggcagcgacggcggcagcatgctgaaggccctgcccctgaagagcagcctgacccccagcagccaggacgacagcaaccaggaggacgacggccaggacagcagccccaagtggcccgacagcggcagcagcagcgaggaggagtgcaccaccagctacctgaccctgtgcaacgagtacggccaggagaagatcgagcccggcagcctgaacgaggagcccttcatgaagaccgagggcaacggcgtggacaccaaggccatcaagagcttccccgcccacctggccgccgacagcgacagccccagcacccagctgagagcccacgagctgaagttcttccccaacgacgaccccgaggccgtgagcagccccagaaccagcgacagcctgagcagaagcaagaacagccccatggagttcttcagaatcgacagcaaggacagcgccagcgagctgctgggcctggacttcggcgagaagctgtacagcctgaagagcgagcccctgaagcccttcttcaccctgcccgacggcgacagcgccagcagaagcttcaacaccagcgagagcaaggtggagttcaaggcccaggacaccatcagcagaggcagcgacgacagcgtgcccgtgatcagcttcaaggacgccgccttcgacgacgtgagcggcaccgacgagggcagacccgacctgctggtgaacctgcccggcgagctggagagcaccagagaggccgccgccatgggccccaccaagttcacccagaccaacatcggcatcatcgagaacaagctgctggaggcccccgacgtgctgtgcctgagactgagcaccgagcagtgccaggcccacgaggagaagggcatcgaggagctgagcgaccccagcggccccaagagctacagcatcaccgagaagcactacgcccaggaggaccccagaatgctgttcgtggccgccgtggaccacagcagcagcggcgacatgagcctgctgcccagcagcgaccccaagttccagggcctgggcgtggtggagagcgccgtgaccgccaacaacaccgaggagagcctgttcagaatctgcagccccctgagcggcgccaacgagtacatcgccagcaccgacaccctgaagaccgaggaggtgctgctgttcaccgaccagaccgacgacctggccaaggaggagcccaccagcctgttccagagagacagcgagaccaagggcgagagcggcctggtgctggagggcgacaaggagatccaccagatcttcgaggacctggacaagaagctggccctggccagcagattctacatccccgagggctgcatccagagatgggccgccgagatggtggtggccctggacgccctgcacagagagggcatcgtgtgcagagacctgaaccccaacaacatcctgctgaacgacagaggccacatccagctgacctacttcagcagatggagcgaggtggaggacagctgcgacagcgacgccatcgagagaatgtactgcgcccccgaggtgggcgccatcaccgaggagaccgaggcctgcgactggtggagcctgggcgccgtgctgttcgagctgctgaccggcaagaccctggtggagtgccaccccgccggcatcaacacccacaccaccctgaacatgcccgagtgcgtgagcgaggaggccagaagcctgatccagcagctgctgcagttcaaccccctggagagactgggcgccggcgtggccggcgtggaggacatcaagagccaccccttcttcacccccgtggactgggccgagctgatgagatag

SEQ ID NO: 2279 - DNA, 3201 bp, Artificial Sequence
  Description of Artificial Sequence: Synthetic coding sequence
atgaccagctacagagagagaagcgccgacctggccagattctacaccgtgaccgagccccagagacaccccagaggctacaccgtgtacaaggtgaccgccagagtggtgagcagaagaaaccccgaggacgtgcaggagatcatcgtgtggaagagatacagcgacttcaagaagctgcacaaggagctgtggcagatccacaagaacctgttcagacacagcgagctgttcccccccttcgccaagggcatcgtgttcggcagattcgacgagaccgtgatcgaggagagaagacagtgcgccgaggacctgctgcagttcagcgccaacatccccgccctgtacaacagcaagcagctggaggacttcttcaagggcggcatcatcaacgacagcagcgagctgatcggccccgccgaggcccacagcgacagcctgatcgacaccttccccgagtgcagcaccgagggcttcagcagcgacagcgacctggtgagcctgaccgtggacgtggacagcctggccgagctggacgacggcatggccagcaaccagaacagccccatcagaaccttcggcctgaacctgagcagcgacagcagcgccctgggcgccgtggccagcgacagcgagcagagcaagaccgaggaggagagagagagcagaagcctgttccccggcagcctgaagcccaagctgggcaagagagactacctggagaaggccggcgagctgatcaagctggccctgaagaaggaggaggaggacgactacgaggccgccagcgacttctacagaaagggcgtggacctgctgctggagggcgtgcagggcgagagcagccccaccagaagagaggccgtgaagagaagaaccgccgagtacctgatgagagccgagagcatcagcagcctgtacggcaagccccagctggacgacgtgagccagccccccggcagcctgagcagcagacccctgtggaacctgagaagccccgccgaggagctgaaggccttcagagtgctgggcgtgatcgacaaggtgctgctggtgatggacaccagaaccgagcagaccttcatcctgaagggcctgagaaagagcagcgagtacagcagaaacagaaagaccatcatccccagatgcgtgcccaacatggtgtgcctgcacaagtacatcatcagcgaggagagcgtgttcctggtgctgcagcacgccgagggcggcaagctgtggagctacatcagcaagttcctgaacagaagccccgaggagagcttcgacatcaaggaggtgaagaagcccaccctggccaaggtgcacctgcagcagcccaccagcagcccccaggacagcagcagcttcgagagcagaggcagcgacggcggcagcatgctgaaggccctgcccctgaagagcagcctgacccccagcagccaggacgacagcaaccaggaggacgacggccaggacagcagccccaagtggcccgacagcggcagcagcagcgaggaggagtgcaccaccagctacctgaccctgtgcaacgagtacggccaggagaagatcgagcccggcagcctgaacgaggagcccttcatgaagaccgagggcaacggcgtggacaccaaggccatcaagagcttccccgcccacctggccgccgacagcgacagccccagcacccagctgagagcccacgagctgaagttcttccccaacgacgaccccgaggccgtgagcagccccagaaccagcgacagcctgagcagaagcaagaacagccccatggagttcttcagaatcgacagcaaggacagcgccagcgagctgctgggcctggacttcggcgagaagctgtacagcctgaagagcgagcccctgaagcccttcttcaccctgcccgacggcgacagcgccagcagaagcttcaacaccagcgagagcaaggtggagttcaaggcccaggacaccatcagcagaggcagcgacgacagcgtgcccgtgatcagcttcaaggacgccgccttcgacgacgtgagcggcaccgacgagggcagacccgacctgctggtgaacctgcccggcgagctggagagcaccagagaggccgccgccatgggccccaccaagttcacccagaccaacatcggcatcatcgagaacaagctgctggaggcccccgacgtgctgtgcctgagactgagcaccgagcagtgccaggcccacgaggagaagggcatcgaggagctgagcgaccccagcggccccaagagctacagcatcaccgagaagcactacgcccaggaggaccccagaatgctgttcgtggccgccgtggaccacagcagcagcggcgacatgagcctgctgcccagcagcgaccccaagttccagggcctgggcgtggtggagagcgccgtgaccgccaacaacaccgaggagagcctgttcagaatctgcagccccctgagcggcgccaacgagtacatcgccagcaccgacaccctgaagaccgaggaggtgctgctgttcaccgaccagaccgacgacctggccaaggaggagcccaccagcctgttccagagagacagcgagaccaagggcgagagcggcctggtgctggagggcgacaaggagatccaccagatcttcgaggacctggacaagaagctggccctggccagcagattctacatccccgagggctgcatccagagatgggccgccgagatggtggtggccctggacgccctgcacagagagggcatcgtgtgcagagacctgaaccccaacaacatcctgctgaacgacagaggccacatccagctgacctacttcagcagatggagcgaggtggaggacagctgcgacagcgacgccatcgagagaatgtactgcgcccccgaggtgggcgccatcaccgaggagaccgaggcctgcgactggtggagcctgggcgccgtgctgttcgagctgctgaccggcaagaccctggtggagtgccaccccgccggcatcaacacccacaccaccctgaacatgcccgagtgcgtgagcgaggaggccagaagcctgatccagcagctgctgcagttcaaccccctggagagactgggcgccggcgtggccggcgtggaggacatcaagagccaccccttcttcacccccgtggactgggccgagctgatgagatag

SEQ ID NO: 2280 - DNA, 1983 bp, Artificial Sequence
  Description of Artificial Sequence: Synthetic coding sequence
atgagagccgagagcatcagcagcctgtacggcaagccccagctggacgacgtgagccagccccccggcagcctgagcagcagacccctgtggaacctgagaagccccgccgaggagctgaaggccttcagagtgctgggcgtgatcgacaaggtgctgctggtgatggacaccagaaccgagcagaccttcatcctgaagggcctgagaaagagcagcgagtacagcagaaacagaaagaccatcatccccagatgcgtgcccaacatggtgtgcctgcacaagtacatcatcagcgaggagagcgtgttcctggtgctgcagcacgccgagggcggcaagctgtggagctacatcagcaagttcctgaacagaagccccgaggagagcttcgacatcaaggaggtgaagaagcccaccctggccaaggtgcacctgcagcagcccaccagcagcccccaggacagcagcagcttcgagagcagaggcagcgacggcggcagcatgctgaaggccctgcccctgaagagcagcctgacccccagcagccaggacgacagcaaccaggaggacgacggccaggacagcagccccaagtggcccgacagcggcagcagcagcgaggaggagtgcaccaccagctacctgaccctgtgcaacgagtacggccaggagaagatcgagcccggcagcctgaacgaggagcccttcatgaagaccgagggcaacggcgtggacaccaaggccatcaagagcttccccgcccacctggccgccgacagcgacagccccagcacccagctgagagcccacgagctgaagttcttccccaacgacgaccccgaggccgtgagcagccccagaaccagcgacagcctgagcagaagcaagaacagccccatggagttcttcagaatcgacagcaaggacagcgccagcgagctgctgggcctggacttcggcgagaagctgtacagcctgaagagcgagcccctgaagcccttcttcaccctgcccgacggcgacagcgccagcagaagcttcaacaccagcgagagcaaggtggagttcaaggcccaggacaccatcagcagaggcagcgacgacagcgtgcccgtgatcagcttcaaggacgccgccttcgacgacgtgagcggcaccgacgagggcagacccgacctgctggtgaacctgcccggcgagctggagagcaccagagaggccgccgccatgggccccaccaagttcacccagaccaacatcggcatcatcgagaacaagctgctggaggcccccgacgtgctgtgcctgagactgagcaccgagcagtgccaggcccacgaggagaagggcatcgaggagctgagcgaccccagcggccccaagagctacagcatcaccgagaagcactacgcccaggaggaccccagaatgctgttcgtggccgccgtggaccacagcagcagcggcgacatgagcctgctgcccagcagcgaccccaagttccagggcctgggcgtggtggagagcgccgtgaccgccaacaacaccgaggagagcctgttcagaatctgcagccccctgagcggcgccaacgagtacatcgccagcaccgacaccctgaagaccgaggaggtgctgctgttcaccgaccagaccgacgacctggccaaggaggagcccaccagcctgttccagagagacagcgagaccaagggcgagagcggcctggtgctggagggcgacaaggagatccaccagatcttcgaggacctggacaagaagctggccctggccagcagattctacatccccgagggctgcatccagagatgggccgccgagatggtggtggccctggacgccctgcacagagagggcatcgtgtgcagagacctgaaccccaacaacatcctgctgaacgacagaggccaggagctgctgcagatgcacttcttcctgttcgccgtggccagcaactag

SEQ ID NO: 2281 - DNA, 2565 bp, Artificial Sequence
  Description of Artificial Sequence: Synthetic coding sequence
atggccagcaaccagaacagccccatcagaaccttcggcctgaacctgagcagcgacagcagcgccctgggcgccgtggccagcgacagcgagcagagcaagaccgaggaggagagagagagcagaagcctgttccccggcagcctgaagcccaagctgggcaagagagactacctggagaaggccggcgagctgatcaagctggccctgaagaaggaggaggaggacgactacgaggccgccagcgacttctacagaaagggcgtggacctgctgctggagggcgtgcagggcgagagcagccccaccagaagagaggccgtgaagagaagaaccgccgagtacctgatgagagccgagagcatcagcagcctgtacggcaagccccagctggacgacgtgagccaggtgctgctggtgatggacaccagaaccgagcagaccttcatcctgaagggcctgagaaagagcagcgagtacagcagaaacagaaagaccatcatccccagatgcgtgcccaacatggtgtgcctgcacaagtacatcatcagcgaggagagcgtgttcctggtgctgcagcacgccgagggcggcaagctgtggagctacatcagcaagttcctgaacagaagccccgaggagagcttcgacatcaaggaggtgaagaagcccaccctggccaaggtgcacctgcagcagcccaccagcagcccccaggacagcagcagcttcgagagcagaggcagcgacggcggcagcatgctgaaggccctgcccctgaagagcagcctgacccccagcagccaggacgacagcaaccaggaggacgacggccaggacagcagccccaagtggcccgacagcggcagcagcagcgaggaggagtgcaccaccagctacctgaccctgtgcaacgagtacggccaggagaagatcgagcccggcagcctgaacgaggagcccttcatgaagaccgagggcaacggcgtggacaccaaggccatcaagagcttccccgcccacctggccgccgacagcgacagccccagcacccagctgagagcccacgagctgaagttcttccccaacgacgaccccgaggccgtgagcagccccagaaccagcgacagcctgagcagaagcaagaacagccccatggagttcttcagaatcgacagcaaggacagcgccagcgagctgctgggcctggacttcggcgagaagctgtacagcctgaagagcgagcccctgaagcccttcttcaccctgcccgacggcgacagcgccagcagaagcttcaacaccagcgagagcaaggtggagttcaaggcccaggacaccatcagcagaggcagcgacgacagcgtgcccgtgatcagcttcaaggacgccgccttcgacgacgtgagcggcaccgacgagggcagacccgacctgctggtgaacctgcccggcgagctggagagcaccagagaggccgccgccatgggccccaccaagttcacccagaccaacatcggcatcatcgagaacaagctgctggaggcccccgacgtgctgtgcctgagactgagcaccgagcagtgccaggcccacgaggagaagggcatcgaggagctgagcgaccccagcggccccaagagctacagcatcaccgagaagcactacgcccaggaggaccccagaatgctgttcgtggccgccgtggaccacagcagcagcggcgacatgagcctgctgcccagcagcgaccccaagttccagggcctgggcgtggtggagagcgccgtgaccgccaacaacaccgaggagagcctgttcagaatctgcagccccctgagcggcgccaacgagtacatcgccagcaccgacaccctgaagaccgaggaggtgctgctgttcaccgaccagaccgacgacctggccaaggaggagcccaccagcctgttccagagagacagcgagaccaagggcgagagcggcctggtgctggagggcgacaaggagatccaccagatcttcgaggacctggacaagaagctggccctggccagcagattctacatccccgagggctgcatccagagatgggccgccgagatggtggtggccctggacgccctgcacagagagggcatcgtgtgcagagacctgaaccccaacaacatcctgctgaacgacagaggccacatccagctgacctacttcagcagatggagcgaggtggaggacagctgcgacagcgacgccatcgagagaatgtactgcgcccccgaggtgggcgccatcaccgaggagaccgaggcctgcgactggtggagcctgggcgccgtgctgttcgagctgctgaccggcaagaccctggtggagtgccaccccgccggcatcaacacccacaccaccctgaacatgcccgagtgcgtgagcgaggaggccagaagcctgatccagcagctgctgcagttcaaccccctggagagactgggcgccggcgtggccggcgtggaggacatcaagagccaccccttcttcacccccgtggactgggccgagctgatgagatag

SEQ ID NO: 2282 - DNA, 1449 bp, Artificial Sequence
  Description of Artificial Sequence: Synthetic coding sequence
atggccgccgtgttcgacctggacctggagaccgaggagggcagcgagggcgagggcgagcccgagctgagccccgccgacgcctgccccctggccgagctgagagccgccggcctggagcccgtgggccactacgaggaggtggagctgaccgagaccagcgtgaacgtgggccccgagagaatcggcccccactgcttcgagctgctgagagtgctgggcaagggcggctacggcaaggtgttccaggtgagaaaggtgcagggcaccaacctgggcaagatctacgccatgaaggtgctgagaaaggccaagatcgtgagaaacgccaaggacaccgcccacaccagagccgagagaaacatcctggagagcgtgaagcaccccttcatcgtggagctggcctacgccttccagaccggcggcaagctgtacctgatcctggagtgcctgagcggcggcgagctgttcacccacctggagagagagggcatcttcctggaggacaccgcctgcttctacctggccgagatcaccctggccctgggccacctgcacagccagggcatcatctacagagacctgaagcccgagaacatcatgctgagcagccagggccacatcaagctgaccgacttcggcctgtgcaaggagagcatccacgagggcgccgtgacccacaccttctgcggcaccatcgagtacatggcccccgagatcctggtgagaagcggccacaacagagccgtggactggtggagcctgggcgccctgatgtacgacatgctgaccggcagcccccccttcaccgccgagaacagaaagaagaccatggacaagatcatcagaggcaagctggccctgcccccctacctgacccccgacgccagagacctggtgaagaagttcctgaagagaaaccccagccagagaatcggcggcggccccggcgacgccgccgacgtgcagagacaccccttcttcagacacatgaactgggacgacctgctggcctggagagtggacccccccttcagaccctgcctgcagagcgaggaggacgtgagccagttcgacaccagattcaccagacagacccccgtggacagccccgacgacaccgccctgagcgagagcgccaaccaggccttcctgggcttcacctacgtggcccccagcgtgctggacagcatcaaggagggcttcagcttccagcccaagctgagaagccccagaagactgaacagcagccccagagcccccgtgagccccctgaagttcagccccttcgagggcttcagacccagccccagcctgcccgagcccaccgagctgcccctgccccccctgctgcccccccccccccccagcaccaccgcccccctgcccatcagaccccccagcggcaccaagaagagcaagagaggcagaggcagacccggcagatag

SEQ ID NO: 2283 - DNA, 465 bp, Artificial Sequence
  Description of Artificial Sequence: Synthetic coding sequence
atggccgccgtgttcgacctggacctggagaccgaggagggcagcgagggcgagggcgagcccgagctgagccccgccgacgcctgccccctggccgagctgagagccgccggcctggagcccgtgggccactacgaggaggtggagctgaccgagaccagcgtgaacgtgggccccgagagaatcggcccccactgcttcgagctgctgagagtgctgggcaagggcggctacggcaaggtgttccaggtgagaaaggtgcagggcaccaacctgggcaagatctacgccatgaaggtgctgagaaaggccaagatcgtgagaaacgccaaggacaccgcccacaccagagccgagagaaacatcctggagagcgtgaagcaccccttcatcgtggagctggcctacgccttccagaccggcggcaagctgtacctgatcctggagtgcctgagcgtggactag

SEQ ID NO: 2284 - DNA, 465 bp, Artificial Sequence; identical to SEQ ID NO: 2283
  Description of Artificial Sequence: Synthetic coding sequence

SEQ ID NO: 2285 - DNA, 2133 bp, Artificial Sequence
  Description of Artificial Sequence: Synthetic coding sequence
atgttcaagttcctgagcttcagagtgagaagcatccaggaggaggtgagcatcaaggagatcgccatcacccaccacgtgaaggagggccacgagaaggccgaccccagccagttcgagctgctgaaggtgctgggccagggcagcttcggcaaggtgttcctggtgaagaagatcagcggcagcgacgccagacagctgtacgccatgaaggtgctgaagaaggccaccctgaaggtgagagacagagtgagaaccaagatggagagagacatcctggtggaggtgaaccaccccttcatcgtgaagctgcactacgccttccagaccgagggcaagctgtacctgatcctggacttcctgagaggcggcgacctgttcaccagactgagcaaggaggtgatgttcaccgaggaggacgtgaagttctacctggccgagctggccctggccctggaccacctgcacagcctgggcatcatctacagagacctgaagcccgagaacatcctgctggacgaggagggccacatcaagctgaccgacttcggcctgagcaaggagagcatcgaccacgagaagaaggcctacagcttctgcggcaccgtggagtacatggcccccgaggtggtgaacagaagaggccacacccagagcgccgactggtggagcttcggcgtgctgatgttcgagatgctgaccggcaccctgcccttccagggcaaggacagaaaggagaccatgaccatgatcctgaaggccaagctgggcatgccccagttcctgagccccgaggcccagagcctgctgagaatgctgttcaagagaaaccccgccaacagactgggcgccggccccgacggcgtggaggagatcaagagacacagcttcttcagcaccatcgactggaacaagctgtacagaagagagatccacccccccttcaagcccgccaccggcagacccgaggacaccttctacttcgaccccgagttcaccgccaagacccccaaggacagccccggcatcccccccagcgccaacgcccaccagctgttcagaggcttcagcttcgtggccatcaccagcgacgacgagagccaggccatgcagaccgtgggcgtgcacagcatcgtgcagctgcacagaaacagcatccagttcaccgacggctacgaggtgaaggaggacatcggcgtgggcagctacagcgtgtgcaagagatgcatccacaaggccaccaacatggagttcgccgtgaagatcatcgacaagagcaagagagaccccaccgaggagatcgagatcctgctgagatacggccagcaccccaacatcatcaccctgaaggacgtgtacgacgacggcaagtacgtgtacgtggtgaccgagctgatgaagggcggcgagctgctggacaagatcctgagacagaagttcttcagcgagagagaggccagcgccgtgctgttcaccatcaccaagaccgtggagtacctgcacgcccagggcgtggtgcacagagacctgaagcccagcaacatcctgtacgtggacgagagcggcaaccccgagagcatcagaatctgcgacttcggcttcgccaagcagctgagagccgagaacggcctgctgatgaccccctgctacaccgccaacttcgtggcccccgaggtgctgaagagacagggctacgacgccgcctgcgacatctggagcctgggcgtgctgctgtacaccatgctgaccggctacacccccttcgccaacggccccgacgacacccccgaggagatcctggccagaatcggcagcggcaagttcagcctgagcggcggctactggaacagcgtgagcgacaccgccaaggacctggtgagcaagatgctgcacgtggacccccaccagagactgaccgccgccctggtgctgagacacccctggatcgtgcactgggaccagctgccccagtaccagctgaacagacaggacgccccccacctggtgaagggcgccatggccgccacctacagcgccctgaacagaaaccagagccccgtgctggagcccgtgggcagaagcaccctggcccagagaagaggcatcaagaagatcaccagcaccgccctgtag

SEQ ID NO: 2286 - DNA, 2223 bp, Artificial Sequence
  Description of Artificial Sequence: Synthetic coding sequence
atgcccctggcccagctggccgacccctggcagaagatggccgtggagagccccagcgacagcgccgagaacggccagcagatcatggacgagcccatgggcgaggaggagatcaacccccagaccgaggaggtgagcatcaaggagatcgccatcacccaccacgtgaaggagggccacgagaaggccgaccccagccagttcgagctgctgaaggtgctgggccagggcagcttcggcaaggtgttcctggtgaagaagatcagcggcagcgacgccagacagctgtacgccatgaaggtgctgaagaaggccaccctgaaggtgagagacagagtgagaaccaagatggagagagacatcctggtggaggtgaaccaccccttcatcgtgaagctgcactacgccttccagaccgagggcaagctgtacctgatcctggacttcctgagaggcggcgacctgttcaccagactgagcaaggaggtgatgttcaccgaggaggacgtgaagttctacctggccgagctggccctggccctggaccacctgcacagcctgggcatcatctacagagacctgaagcccgagaacatcctgctggacgaggagggccacatcaagctgaccgacttcggcctgagcaaggagagcatcgaccacgagaagaaggcctacagcttctgcggcaccgtggagtacatggcccccgaggtggtgaacagaagaggccacacccagagcgccgactggtggagcttcggcgtgctgatgttcgagatgctgaccggcaccctgcccttccagggcaaggacagaaaggagaccatgaccatgatcctgaaggccaagctgggcatgccccagttcctgagccccgaggcccagagcctgctgagaatgctgttcaagagaaaccccgccaacagactgggcgccggccccgacggcgtggaggagatcaagagacacagcttcttcagcaccatcgactggaacaagctgtacagaagagagatccacccccccttcaagcccgccaccggcagacccgaggacaccttctacttcgaccccgagttcaccgccaagacccccaaggacagccccggcatcccccccagcgccaacgcccaccagctgttcagaggcttcagcttcgtggccatcaccagcgacgacgagagccaggccatgcagaccgtgggcgtgcacagcatcgtgcagcagctgcacagaaacagcatccagttcaccgacggctacgaggtgaaggaggacatcggcgtgggcagctacagcgtgtgcaagagatgcatccacaaggccaccaacatggagttcgccgtgaagatcatcgacaagagcaagagagaccccaccgaggagatcgagatcctgctgagatacggccagcaccccaacatcatcaccctgaaggacgtgtacgacgacggcaagtacgtgtacgtggtgaccgagctgatgaagggcggcgagctgctggacaagatcctgagacagaagttcttcagcgagagagaggccagcgccgtgctgttcaccatcaccaagaccgtggagtacctgcacgcccagggcgtggtgcacagagacctgaagcccagcaacatcctgtacgtggacgagagcggcaaccccgagagcatcagaatctgcgacttcggcttcgccaagcagctgagagccgagaacggcctgctgatgaccccctgctacaccgccaacttcgtggcccccgaggtgctgaagagacagggctacgacgccgcctgcgacatctggagcctgggcgtgctgctgtacaccatgctgaccggctacacccccttcgccaacggccccgacgacacccccgaggagatcctggccagaatcggcagcggcaagttcagcctgagcggcggctactggaacagcgtgagcgacaccgccaaggacctggtgagcaagatgctgcacgtggacccccaccagagactgaccgccgccctggtgctgagacacccctggatcgtgcactgggaccagctgccccagtaccagctgaacagacaggacgccccccacctggtgaagggcgccatggccgccacctacagcgccctgaacagaaaccagagccccgtgctggagcccgtgggcagaagcaccctggcccagagaagaggcatcaagaagatcaccagcaccgccctgtag

SEQ ID NO: 2287 - DNA, 402 bp, Artificial Sequence
  Description of Artificial Sequence: Synthetic coding sequence
atggacgagcccatgggcgaggaggagatcaacccccagaccgaggaggtgagcatcaaggagatcgccatcacccaccacgtgaaggagggccacgagaaggccgaccccagccagttcgagctgctgaaggtgctgggccagggcagcttcggcaaggtgttcctggtgaagaagatcagcggcagcgacgccagacagctgtacgccatgaaggtgctgaagaaggccaccctgaaggtgagagacagagtgagaaccaagatggagagagacatcctggtggaggtgaaccaccccttcatcgtgaagctgcactacgccttccagaccgagggcaagctgtacctgatcctggacttcctgagaggcggcgacctgttcaccagactgagcaagtag

SEQ ID NO: 2288 - DNA, 684 bp, Artificial Sequence
  Description of Artificial Sequence: Synthetic coding sequence
atgttcaagttcctgagcttcagagtgagaagcatccaggaggaggtgagcatcaaggagatcgccatcacccaccacgtgaaggagggccacgagaaggccgaccccagccagttcgagctgctgaaggtgctgggccagggcagcttcggcaaggtgttcctggtgaagaagatcagcggcagcgacgccagacagctgtacgccatgaaggtgctgaagaaggccaccctgaaggtgagagacagagtgagaaccaagatggagagagacatcctggtggaggtgaaccaccccttcatcgtgaagctgcactacgccttccagaccgagggcaagctgtacctgatcctggacttcctgagaggcggcgacctgttcaccagactgagcaaggaggtgatgttcaccgaggaggacgtgaagttctacctggccgagctggccctggccctggaccacctgcacagcctgggcatcatctacagagacctgaagcccgagaacatcctgctggacgaggagggccacatcaagctgaccgacttcggcctgagcaaggagagcatcgaccacgagaagaaggcctacagcttctgcggcaccgtggagtacatggcccccgaggtggtgaacagaagaggccacacccagagcgccgactggtggagcttcggcgtgtag

SEQ ID NO: 2289 - DNA, 2136 bp, Artificial Sequence
  Description of Artificial Sequence: Synthetic coding sequence
atggacgagcccatgggcgaggaggagatcaacccccagaccgaggaggtgagcatcaaggagatcgccatcacccaccacgtgaaggagggccacgagaaggccgaccccagccagttcgagctgctgaaggtgctgggccagggcagcttcggcaaggtgttcctggtgaagaagatcagcggcagcgacgccagacagctgtacgccatgaaggtgctgaagaaggccaccctgaaggtgagagacagagtgagaaccaagatggagagagacatcctggtggaggtgaaccaccccttcatcgtgaagctgcactacgccttccagaccgagggcaagctgtacctgatcctggacttcctgagaggcggcgacctgttcaccagactgagcaaggaggtgatgttcaccgaggaggacgtgaagttctacctggccgagctggccctggccctggaccacctgcacagcctgggcatcatctacagagacctgaagcccgagaacatcctgctggacgaggagggccacatcaagctgaccgacttcggcctgagcaaggagagcatcgaccacgagaagaaggcctacagcttctgcggcaccgtggagtacatggcccccgaggtggtgaacagaagaggccacacccagagcgccgactggtggagcttcggcgtgctgatgttcgagatgctgaccggcaccctgcccttccagggcaaggacagaaaggagaccatgaccatgatcctgaaggccaagctgggcatgccccagttcctgagccccgaggcccagagcctgctgagaatgctgttcaagagaaaccccgccaacagactgggcgccggccccgacggcgtggaggagatcaagagacacagcttcttcagcaccatcgactggaacaagctgtacagaagagagatccacccccccttcaagcccgccaccggcagacccgaggacaccttctacttcgaccccgagttcaccgccaagacccccaaggacagccccggcatcccccccagcgccaacgcccaccagctgttcagaggcttcagcttcgtggccatcaccagcgacgacgagagccaggccatgcagaccgtgggcgtgcacagcatcgtgcagctgcacagaaacagcatccagttcaccgacggctacgaggtgaaggaggacatcggcgtgggcagctacagcgtgtgcaagagatgcatccacaaggccaccaacatggagttcgccgtgaagatcatcgacaagagcaagagagaccccaccgaggagatcgagatcctgctgagatacggccagcaccccaacatcatcaccctgaaggacgtgtacgacgacggcaagtacgtgtacgtggtgaccgagctgatgaagggcggcgagctgctggacaagatcctgagacagaagttcttcagcgagagagaggccagcgccgtgctgttcaccatcaccaagaccgtggagtacctgcacgcccagggcgtggtgcacagagacctgaagcccagcaacatcctgtacgtggacgagagcggcaaccccgagagcatcagaatctgcgacttcggcttcgccaagcagctgagagccgagaacggcctgctgatgaccccctgctacaccgccaacttcgtggcccccgaggtgctgaagagacagggctacgacgccgcctgcgacatctggagcctgggcgtgctgctgtacaccatgctgaccggctacacccccttcgccaacggccccgacgacacccccgaggagatcctggccagaatcggcagcggcaagttcagcctgagcggcggctactggaacagcgtgagcgacaccgccaaggacctggtgagcaagatgctgcacgtggacccccaccagagactgaccgccgccctggtgctgagacacccctggatcgtgcactgggaccagctgccccagtaccagctgaacagacaggacgccccccacctggtgaagggcgccatggccgccacctacagcgccctgaacagaaaccagagccccgtgctggagcccgtgggcagaagcaccctggcccagagaagaggcatcaagaagatcaccagcaccgccctgtag

SEQ ID NO: 2290 - DNA, 2139 bp, Artificial Sequence
  Description of Artificial Sequence: Synthetic coding sequence
atggacgagcccatgggcgaggaggagatcaacccccagaccgaggaggtgagcatcaaggagatcgccatcacccaccacgtgaaggagggccacgagaaggccgaccccagccagttcgagctgctgaaggtgctgggccagggcagcttcggcaaggtgttcctggtgaagaagatcagcggcagcgacgccagacagctgtacgccatgaaggtgctgaagaaggccaccctgaaggtgagagacagagtgagaaccaagatggagagagacatcctggtggaggtgaaccaccccttcatcgtgaagctgcactacgccttccagaccgagggcaagctgtacctgatcctggacttcctgagaggcggcgacctgttcaccagactgagcaaggaggtgatgttcaccgaggaggacgtgaagttctacctggccgagctggccctggccctggaccacctgcacagcctgggcatcatctacagagacctgaagcccgagaacatcctgctggacgaggagggccacatcaagctgaccgacttcggcctgagcaaggagagcatcgaccacgagaagaaggcctacagcttctgcggcaccgtggagtacatggcccccgaggtggtgaacagaagaggccacacccagagcgccgactggtggagcttcggcgtgctgatgttcgagatgctgaccggcaccctgcccttccagggcaaggacagaaaggagaccatgaccatgatcctgaaggccaagctgggcatgccccagttcctgagccccgaggcccagagcctgctgagaatgctgttcaagagaaaccccgccaacagactgggcgccggccccgacggcgtggaggagatcaagagacacagcttcttcagcaccatcgactggaacaagctgtacagaagagagatccacccccccttcaagcccgccaccggcagacccgaggacaccttctacttcgaccccgagttcaccgccaagacccccaaggacagccccggcatcccccccagcgccaacgcccaccagctgttcagaggcttcagcttcgtggccatcaccagcgacgacgagagccaggccatgcagaccgtgggcgtgcacagcatcgtgcagcagctgcacagaaacagcatccagttcaccgacggctacgaggtgaaggaggacatcggcgtgggcagctacagcgtgtgcaagagatgcatccacaaggccaccaacatggagttcgccgtgaagatcatcgacaagagcaagagagaccccaccgaggagatcgagatcctgctgagatacggccagcaccccaacatcatcaccctgaaggacgtgtacgacgacggcaagtacgtgtacgtggtgaccgagctgatgaagggcggcgagctgctggacaagatcctgagacagaagttcttcagcgagagagaggccagcgccgtgctgttcaccatcaccaagaccgtggagtacctgcacgcccagggcgtggtgcacagagacctgaagcccagcaacatcctgtacgtggacgagagcggcaaccccgagagcatcagaatctgcgacttcggcttcgccaagcagctgagagccgagaacggcctgctgatgaccccctgctacaccgccaacttcgtggcccccgaggtgctgaagagacagggctacgacgccgcctgcgacatctggagcctgggcgtgctgctgtacaccatgctgaccggctacacccccttcgccaacggccccgacgacacccccgaggagatcctggccagaatcggcagcggcaagttcagcctgagcggcggctactggaacagcgtgagcgacaccgccaaggacctggtgagcaagatgctgcacgtggacccccaccagagactgaccgccgccctggtgctgagacacccctggatcgtgcactgggaccagctgccccagtaccagctgaacagacaggacgccccccacctggtgaagggcgccatggccgccacctacagcgccctgaacagaaaccagagccccgtgctggagcccgtgggcagaagcaccctggcccagagaagaggcatcaagaagatcaccagcaccgccctgtag

SEQ ID NO: 2291 - DNA, 1575 bp, Artificial Sequence
  Description of Artificial Sequence: Synthetic coding sequence
atgggcgacgaggacgacgacgagagctgcgccgtggagctgagaatcaccgaggccaacctgaccggccacgaggagaaggtgagcgtggagaacttcgagctgctgaaggtgctgggcaccggcgcctacggcaaggtgttcctggtgagaaaggccggcggccacgacgccggcaagctgtacgccatgaaggtgctgagaaaggccgccctggtgcagagagccaagacccaggagcacaccagaaccgagagaagcgtgctggagctggtgagacaggcccccttcctggtgaccctgcactacgccttccagaccgacgccaagctgcacctgatcctggactacgtgagcggcggcgagatgttcacccacctgtaccagagacagtacttcaaggaggccgaggtgagagtgtacggcggcgagatcgtgctggccctggagcacctgcacaagctgggcatcatctacagagacctgaagctggagaacgtgctgctggacagcgagggccacatcgtgctgaccgacttcggcctgagcaaggagttcctgaccgaggagaaggagagaaccttcagcttctgcggcaccatcgagtacatggcccccgagatcatcagaagcaagaccggccacggcaaggccgtggactggtggagcctgggcatcctgctgttcgagctgctgaccggcgccagccccttcaccctggagggcgagagaaacacccaggccgaggtgagcagaagaatcctgaagtgcagcccccccttcccccccagaatcggccccgtggcccaggacctgctgcagagactgctgtgcaaggaccccaagaagagactgggcgccggcccccagggcgcccaggaggtgagaaaccaccccttcttccagggcctggactgggtggccctggccgccagaaagatccccgcccccttcagaccccagatcagaagcgagctggacgtgggcaacttcgccgaggagttcaccagactggagcccgtgtacagcccccccggcagccccccccccggcgaccccagaatcttccagggctacagcttcgtggcccccagcatcctgttcgaccacaacaacgccgccgagatcatgtgcaagatcagagagggcagattcagcctggacggcgaggcctggcagggcgtgagcgaggaggccaaggagctggtgagaggcctgctgaccgtggaccccgccaagagactgaagctggagggcctgagaggcagcagctggctgcaggacggcagcgccagaagcagcccccccctgagaacccccgacgtgctggagagcagcggccccgccgtgagaagcggcctgaacgccaccttcatggccttcaacagaggcaagagagagggcttcttcctgaagagcgtggagaacgcccccctggccaagagaagaaagcagaagctgagaagcgccaccgccagcagaagaggcagccccgcccccgccaaccccggcagagcccccgtggccagcaagggcgcccccagaagagccaacggccccctgccccccagctag

SEQ ID NO: 2292 - DNA, 2319 bp, Artificial Sequence
  Description of Artificial Sequence: Synthetic coding sequence
atgggcgacgaggacgacgacgagagctgcgccgtggagctgagaatcaccgaggccaacctgaccggccacgaggagaaggtgagcgtggagaacttcgagctgctgaaggtgctgggcaccggcgcctacggcaaggtgttcctggtgagaaaggccggcggccacgacgccggcaagctgtacgccatgaaggtgctgagaaaggccgccctggtgcagagagccaagacccaggagcacaccagaaccgagagaagcgtgctggagctggtgagacaggcccccttcctggtgaccctgcactacgccttccagaccgacgccaagctgcacctgatcctggactacgtgagcggcggcgagatgttcacccacctgtaccagagacagtacttcaaggaggccgaggtgagagtgtacggcggcgagatcgtgctggccctggagcacctgcacaagctgggcatcatctacagagacctgaagctggagaacgtgctgctggacagcgagggccacatcgtgctgaccgacttcggcctgagcaaggagttcctgaccgaggagaaggagagaaccttcagcttctgcggcaccatcgagtacatggcccccgagatcatcagaagcaagaccggccacggcaaggccgtggactggtggagcctgggcatcctgctgttcgagctgctgaccggcgccagccccttcaccctggagggcgagagaaacacccaggccgaggtgagcagaagaatcctgaagtgcagcccccccttcccccccagaatcggccccgtggcccaggacctgctgcagagactgctgtgcaaggaccccaagaagagactgggcgccggcccccagggcgcccaggaggtgagaaaccaccccttcttccagggcctggactgggtggccctggccgccagaaagatccccgcccccttcagaccccagatcagaagcgagctggacgtgggcaacttcgccgaggagttcaccagactggagcccgtgtacagcccccccggcagccccccccccggcgaccccagaatcttccagggctacagcttcgtggcccccagcatcctgttcgaccacaacaacgccgtgatgaccgacggcctggaggcccccggcgccggcgacagacccggcagagccgccgtggccagaagcgccatgatgcaggacagccccttcttccagcagtacgagctggacctgagagagcccgccctgggccagggcagcttcagcgtgtgcagaagatgcagacagagacagagcggccaggagttcgccgtgaagatcctgagcagaagactggaggccaacacccagagagaggtggccgccctgagactgtgccagagccaccccaacgtggtgaacctgcacgaggtgcaccacgaccagctgcacacctacctggtgctggagctgctgagaggcggcgagctgctggagcacatcagaaagaagagacacttcagcgagagcgaggccagccagatcctgagaagcctggtgagcgccgtgagcttcatgcacgaggaggccggcgtggtgcacagagacctgaagcccgagaacatcctgtacgccgacgacacccccggcgcccccgtgaagatcatcgacttcggcttcgccagactgagaccccagagccccggcgtgcccatgcagaccccctgcttcaccctgcagtacgccgcccccgagctgctggcccagcagggctacgacgagagctgcgacctgtggagcctgggcgtgatcctgtacatgatgctgagcggccaggtgcccttccagggcgccagcggccagggcggccagagccaggccgccgagatcatgtgcaagatcagagagggcagattcagcctggacggcgaggcctggcagggcgtgagcgaggaggccaaggagctggtgagaggcctgctgaccgtggaccccgccaagagactgaagctggagggcctgagaggcagcagctggctgcaggacggcagcgccagaagcagcccccccctgagaacccccgacgtgctggagagcagcggccccgccgtgagaagcggcctgaacgccaccttcatggccttcaacagaggcaagagagagggcttcttcctgaagagcgtggagaacgcccccctggccaagagaagaaagcagaagctgagaagcgccaccgccagcagaagaggcagccccgcccccgccaaccccggcagagcccccgtggccagcaagggcgcccccagaagagccaacggccccctgccccccagctag

SEQ ID NO: 2293 - DNA, 2298 bp, Artificial Sequence
  Description of Artificial Sequence: Synthetic coding sequence
atgggcgacgaggacgacgacgagagctgcgccgtggagctgagaatcaccgaggccaacctgaccggccacgaggagaaggtgagcgtggagaacttcgagctgctgaaggtgctgggcaccggcgcctacggcaaggtgttcctggtgagaaaggccggcggccacgacgccggcaagctgtacgccatgaaggtgctgagaaaggccgccctggtgcagagagccaagacccaggagcacaccagaaccgagagaagcgtgctggagctggtgagacaggcccccttcctggtgaccctgcactacgccttccagaccgacgccaagctgcacctgatcctggactacgtgagcggcggcgagatgttcacccacctgtaccagagacagtacttcaaggaggccgaggtgagagtgtacggcggcgagatcgtgctggccctggagcacctgcacaagctgggcatcatctacagagacctgaagctggagaacgtgctgctggacagcgagggccacatcgtgctgaccgacttcggcctgagcaaggagttcctgaccgaggagaaggagagaaccttcagcttctgcggcaccatcgagtacatggcccccgagatcatcagaagcaagaccggccacggcaaggccgtggactggtggagcctgggcatcctgctgttcgagctgctgaccggcgccagccccttcaccctggagggcgagagaaacacccaggccgaggtgagcagaagaatcctgaagtgcagcccccccttcccccccagaatcggccccgtggcccaggacctgctgcagagactgctgtgcaaggaccccaagaagagactgggcgccggcccccagggcgcccaggaggtgagaaaccaccccttcttccagggcctggactgggtggccctggccgccagaaagatccccgcccccttcagaccccagatcagaagcgagctggacgtgggcaacttcgccgaggagttcaccagactggagcccgtgtacagcccccccggcagccccccccccggcgaccccagaatcttccagggctacagcttcgtggcccccagcatcctgttcgaccacaacaacgccgtgatgaccgacggcctggaggcccccggcgccggcgacagacccggcagagccgccgtggccagaagcgccatgatgcagtacgagctggacctgagagagcccgccctgggccagggcagcttcagcgtgtgcagaagatgcagacagagacagagcggccaggagttcgccgtgaagatcctgagcagaagactggaggccaacacccagagagaggtggccgccctgagactgtgccagagccaccccaacgtggtgaacctgcacgaggtgcaccacgaccagctgcacacctacctggtgctggagctgctgagaggcggcgagctgctggagcacatcagaaagaagagacacttcagcgagagcgaggccagccagatcctgagaagcctggtgagcgccgtgagcttcatgcacgaggaggccggcgtggtgcacagagacctgaagcccgagaacatcctgtacgccgacgacacccccggcgcccccgtgaagatcatcgacttcggcttcgccagactgagaccccagagccccggcgtgcccatgcagaccccctgcttcaccctgcagtacgccgcccccgagctgctggcccagcagggctacgacgagagctgcgacctgtggagcctgggcgtgatcctgtacatgatgctgagcggccaggtgcccttccagggcgccagcggccagggcggccagagccaggccgccgagatcatgtgcaagatcagagagggcagattcagcctggacggcgaggcctggcagggcgtgagcgaggaggccaaggagctggtgagaggcctgctgaccgtggaccccgccaagagactgaagctggagggcctgagaggcagcagctggctgcaggacggcagcgccagaagcagcccccccctgagaacccccgacgtgctggagagcagcggccccgccgtgagaagcggcctgaacgccaccttcatggccttcaacagaggcaagagagagggcttcttcctgaagagcgtggagaacgcccccctggccaagagaagaaagcagaagctgagaagcgccaccgccagcagaagaggcagccccgcccccgccaaccccggcagagcccccgtggccagcaagggcgcccccagaagagccaacggccccctgccccccagctag

SEQ ID NO: 2294 - DNA, 2118 bp, Artificial Sequence
  Description of Artificial Sequence: Synthetic coding sequence
accgaggccaacctgaccggccacgaggagaaggtgagcgtggagaacttcgagctgctgaaggtgctgggcaccggcgcctacggcaaggtgttcctggtgagaaaggccggcggccacgacgccggcaagctgtacgccatgaaggtgctgagaaaggccgccctggtgcagagagccaagacccaggagcacaccagaaccgagagaagcgtgctggagctggtgagacaggcccccttcctggtgaccctgcactacgccttccagaccgacgccaagctgcacctgatcctggactacgtgagcggcggcgagatgttcacccacctgtaccagagacagtacttcaaggaggccgaggtgagagtgtacggcggcgagatcgtgctggccctggagcacctgcacaagctgggcatcatctacagagacctgaagctggagaacgtgctgctggacagcgagggccacatcgtgctgaccgacttcggcctgagcaaggagttcctgaccgaggagaaggagagaaccttcagcttctgcggcaccatcgagtacatggcccccgagatcatcagaagcaagaccggccacggcaaggccgtggactggtggagcctgggcatcctgctgttcgagctgctgaccggcgccagccccttcaccctggagggcgagagaaacacccaggccgaggtgagcagaagaatcctgaagtgcagcccccccttcccccccagaatcggccccgtggcccaggacctgctgcagagactgctgtgcaaggaccccaagaagagactgggcgccggcccccagggcgcccaggaggtgagaaaccaccccttcttccagggcctggactgggtggccctggccgccagaaagatccccgcccccttcagaccccagatcagaagcgagctggacgtgggcaacttcgccgaggagttcaccagactggagcccgtgtacagcccccccggcagccccccccccggcgaccccagaatcttccagggctacagcttcgtggcccccagcatcctgttcgaccacaacaacgccgtgatgaccgacggcctggaggcccccggcgccggcgacagacccggcagagccgccgtggccagaagcgccatgatgcagcagtacgagctggacctgagagagcccgccctgggccagggcagcttcagcgtgtgcagaagatgcagacagagacagagcggccaggagttcgccgtgaagatcctgagcagaagactggaggccaacacccagagagaggtggccgccctgagactgtgccagagccaccccaacgtggtgaacctgcacgaggtgcaccacgaccagctgcacacctacctggtgctggagctgctgagaggcggcgagctgctggagcacatcagaaagaagagacacttcagcgagagcgaggccagccagatcctgagaagcctggtgagcgccgtgagcttcatgcacgaggaggccggcgtggtgcacagagacctgaagcccgagaacatcctgtacgccgacgacacccccggcgcccccgtgaagatcatcgacttcggcttcgccagactgagaccccagagccccggcgtgcccatgcagaccccctgcttcaccctgcagtacgccgcccccgagctgctggcccagcagggctacgacgagagctgcgacctgtggagcctgggcgtgatcctgtacatgatgctgagcggccaggtgcccttccagggcgccagcggccagggcggccagagccaggccgccgagatcatgtgcaagatcagagagggcagattcagcctggacggcgaggcctggcagggcgtgagcgaggaggccaaggagctggtgagaggcctgctgaccgtggaccccgccaagagactgaagctggagggcctgagaggcagcagctggctgcaggacggcagcgccagaagcagcccccccctgagaacccccgacgtgctggagagcagcggccccgccgtgagaagcggcctgaacgccaccttcatggccttcaacagaggcaagagagagggcttcttcctgaagagcgtggagaacgcccccctgtag

SEQ ID NO: 2295 - DNA, 2409 bp, Artificial Sequence
  Description of Artificial Sequence: Synthetic coding sequence
atggaggaggagggcggcagcagcggcggcgccgccggcaccagcgccgacggcggcgacggcggcgagcagctgctgaccgtgaagcacgagctgagaaccgccaacctgaccggccacgccgagaaggtgggcatcgagaacttcgagctgctgaaggtgctgggcaccggcgcctacggcaaggtgttcctggtgagaaagatcagcggccacgacaccggcaagctgtacgccatgaaggtgctgaagaaggccaccatcgtgcagaaggccaagaccaccgagcacaccagaaccgagagacaggtgctggagcacatcagacagagccccttcctggtgaccctgcactacgccttccagaccgagaccaagctgcacctgatcctggactacatcaacggcggcgagctgttcacccacctgagccagagagagagattcaccgagcacgaggtgcagatctacgtgggcgagatcgtgctggccctggagcacctgcacaagctgggcatcatctacagagacatcaagctggagaacatcctgctggacagcaacggccacgtggtgctgaccgacttcggcctgagcaaggagttcgtggccgacgagaccgagagagcctacagcttctgcggcaccatcgagtacatggcccccgacatcgtgagaggcggcgacagcggccacgacaaggccgtggactggtggagcctgggcgtgctgatgtacgagctgctgaccggcgccagccccttcaccgtggacggcgagaagaacagccaggccgagatcagcagaagaatcctgaagagcgagcccccctacccccaggagatgagcgccctggccaaggacctgatccagagactgctgatgaaggaccccaagaagagactgggctgcggccccagagacgccgacgagatcaaggagcacctgttcttccagaagatcaactgggacgacctggccgccaagaaggtgcccgcccccttcaagcccgtgatcagagacgagctggacgtgagcaacttcgccgaggagttcaccgagatggaccccacctacagccccgccgccctgccccagagcagcgagaagctgttccagggctacagcttcgtggcccccagcatcctgttcaagagaaacgccgccgtgatcgaccccctgcagttccacatgggcgtggagagacccggcgtgaccaacgtggccagaagcgccatgatgaaggacagccccttctaccagcactacgacctggacctgaaggacaagcccctgggcgagggcagcttcagcatctgcagaaagtgcgtgcacaagaagagcaaccaggccttcgccgtgaagatcatcagcaagagaatggaggccaacacccagaaggagatcaccgccctgaagctgtgcgagggccaccccaacatcgtgaagctgcacgaggtgttccacgaccagctgcacaccttcctggtgatggagctgctgaacggcggcgagctgttcgagagaatcaagaagaagaagcacttcagcgagaccgaggccagctacatcatgagaaagctggtgagcgccgtgagccacatgcacgacgtgggcgtggtgcacagagacctgaagcccgagaacctgctgttcaccgacgagaacgacaacctggagatcaagatcatcgacttcggcttcgccagactgaagccccccgacaaccagcccctgaagaccccctgcttcaccctgcactacgccgcccccgagctgctgaaccagaacggctacgacgagagctgcgacctgtggagcctgggcgtgatcctgtacaccatgctgagcggccaggtgcccttccagagccacgacagaagcctgacctgcaccagcgccgtggagatcatgaagaagatcaagaagggcgacttcagcttcgagggcgaggcctggaagaacgtgagccaggaggccaaggacctgatccagggcctgctgaccgtggaccccaacaagagactgaagatgagcggcctgagatacaacgagtggctgcaggacggcagccagctgagcagcaaccccctgatgacccccgacatcctgggcagcagcggcgccgccgtgcacacctgcgtgaaggccaccttccacgccttcaacaagtacaagagagagggcttctgcctgcagaacgtggacaaggcccccctggccaagagaagaaagatgaagaagaccagcaccagcaccgagaccagaagcagcagcagcgagagcagccacagcagcagcagccacagccacggcaagaccacccccaccaagaccctgcagcccagcaaccccgccgacagcaacaaccccgagaccctgttccagttcagcgacagcgtggcctag

SEQ ID NO: 2296 - DNA, 1650 bp, Artificial Sequence
  Description of Artificial Sequence: Synthetic coding sequence
atggaggaggagggcggcagcagcggcggcgccgccggcaccagcgccgacggcggcgacggcggcgagcagctgctgaccgtgaagcacgagctgagaaccgccaacctgaccggccacgccgagaaggtgggcatcgagaacttcgagctgctgaaggtgctgggcaccggcgcctacggcaaggtgttcctggtgagaaagatcagcggccacgacaccggcaagctgtacgccatgaaggtgctgaagaaggccaccatcgtgcagaaggccaagaccaccgagcacaccagaaccgagagacaggtgctggagcacatcagacagagccccttcctggtgaccctgcactacgccttccagaccgagaccaagctgcacctgatcctggactacatcaacggcggcgagctgttcacccacctgagccagagagagagattcaccgagcacgaggtgcagatctacgtgggcgagatcgtgctggccctggagcacctgcacaagctgggcatcatctacagagacatcaagctggagaacatcctgctggacagcaacggccacgtggtgctgaccgacttcggcctgagcaaggagttcgtggccgacgagaccgagagagcctacagcttctgcggcaccatcgagtacatggcccccgacatcgtgagaggcggcgacagcggccacgacaaggccgtggactggtggagcctgggcgtgctgatgtacgagctgctgaccggcgccagccccttcaccgtggacggcgagaagaacagccaggccgagatcagcagaagaatcctgaagagcgagcccccctacccccaggagatgagcgccctggccaaggacctgatccagagactgctgatgaaggaccccaagaagagactgggctgcggccccagagacgccgacgagatcaaggagcacctgttcttccagaagatcaactgggacgacctggccgccaagaaggtgcccgcccccttcaagcccgtgatcagagacgagctggacgtgagcaacttcgccgaggagttcaccgagatggaccccacctacagccccgccgccctgccccagagcagcgagaagctgttccagggctacagcttcgtggcccccagcatcctgttcaagagaaacgccgccgtgatcgaccccctgcagttccacatgggcgtggagagacccggcgtgaccaacgtggccagaagcgccatgatgaaggacagccccttctaccagcactacgacctggacctgaaggacaagcccctgggcgagggcagcttcagcatctgcagaaagtgcgtgcacaagaagagcaaccaggccttcgccgtgaagatcatcagcaagagaatggaggccaacacccagaaggagatcaccgccctgaagctgtgcgagggccaccccaacatcgtgaagctgcacgaggtgttccacgaccagctgcacaccttcctggtgatggagctgctgaacggcggcgagctgttcgagagaatcaagaagaagaagcacttcagcgagaccgaggccagctacatcatgagaaagctggtgagcgccgtgagccacatgcacgacgtgggcgtggtgcacagagacctgaagcccgaggtgtag

SEQ ID NO: 2297 - DNA, 2172 bp, Artificial Sequence
  Description of Artificial Sequence: Synthetic coding sequence
atgaaggtgctgaagaaggccaccatcgtgcagaaggccaagaccaccgagcacaccagaaccgagagacaggtgctggagcacatcagacagagccccttcctggtgaccctgcactacgccttccagaccgagaccaagctgcacctgatcctggactacatcaacggcggcgagctgttcacccacctgagccagagagagagattcaccgagcacgaggtgcagatctacgtgggcgagatcgtgctggccctggagcacctgcacaagctgggcatcatctacagagacatcaagctggagaacatcctgctggacagcaacggccacgtggtgctgaccgacttcggcctgagcaaggagttcgtggccgacgagaccgagagagcctacagcttctgcggcaccatcgagtacatggcccccgacatcgtgagaggcggcgacagcggccacgacaaggccgtggactggtggagcctgggcgtgctgatgtacgagctgctgaccggcgccagccccttcaccgtggacggcgagaagaacagccaggccgagatcagcagaagaatcctgaagagcgagcccccctacccccaggagatgagcgccctggccaaggacctgatccagagactgctgatgaaggaccccaagaagagactgggctgcggccccagagacgccgacgagatcaaggagcacctgttcttccagaagatcaactgggacgacctggccgccaagaaggtgcccgcccccttcaagcccgtgatcagagacgagctggacgtgagcaacttcgccgaggagttcaccgagatggaccccacctacagccccgccgccctgccccagagcagcgagaagctgttccagggctacagcttcgtggcccccagcatcctgttcaagagaaacgccgccgtgatcgaccccctgcagttccacatgggcgtggagagacccggcgtgaccaacgtggccagaagcgccatgatgaaggacagccccttctaccagcactacgacctggacctgaaggacaagcccctgggcgagggcagcttcagcatctgcagaaagtgcgtgcacaagaagagcaaccaggccttcgccgtgaagatcatcagcaagagaatggaggccaacacccagaaggagatcaccgccctgaagctgtgcgagggccaccccaacatcgtgaagctgcacgaggtgttccacgaccagctgcacaccttcctggtgatggagctgctgaacggcggcgagctgttcgagagaatcaagaagaagaagcacttcagcgagaccgaggccagctacatcatgagaaagctggtgagcgccgtgagccacatgcacgacgtgggcgtggtgcacagagacctgaagcccgagaacctgctgttcaccgacgagaacgacaacctggagatcaagatcatcgacttcggcttcgccagactgaagccccccgacaaccagcccctgaagaccccctgcttcaccctgcactacgccgcccccgagctgctgaaccagaacggctacgacgagagctgcgacctgtggagcctgggcgtgatcctgtacaccatgctgagcggccaggtgcccttccagagccacgacagaagcctgacctgcaccagcgccgtggagatcatgaagaagatcaagaagggcgacttcagcttcgagggcgaggcctggaagaacgtgagccaggaggccaaggacctgatccagggcctgctgaccgtggaccccaacaagagactgaagatgagcggcctgagatacaacgagtggctgcaggacggcagccagctgagcagcaaccccctgatgacccccgacatcctgggcagcagcggcgccgccgtgcacacctgcgtgaaggccaccttccacgccttcaacaagtacaagagagagggcttctgcctgcagaacgtggacaaggcccccctggccaagagaagaaagatgaagaagaccagcaccagcaccgagaccagaagcagcagcagcgagagcagccacagcagcagcagccacagccacggcaagaccacccccaccaagaccctgcagcccagcaaccccgccgacagcaacaaccccgagaccctgttccagttcagcgacagcgtggcctag

SEQ ID NO: 2298 - DNA, 2238 bp, Artificial Sequence
  Description of Artificial Sequence: Synthetic coding sequence
atgctgcccttcgccccccaggacgagccctgggacagagagatggaggtgttcagcggcggcggcgccagcagcggcgaggtgaacggcctgaagatggtggacgagcccatggaggagggcgaggccgacagctgccacgacgagggcgtggtgaaggagatccccatcacccaccacgtgaaggagggctacgagaaggccgaccccgcccagttcgagctgctgaaggtgctgggccagggcagcttcggcaaggtgttcctggtgagaaagaagaccggccccgacgccggccagctgtacgccatgaaggtgctgaagaaggccagcctgaaggtgagagacagagtgagaaccaagatggagagagacatcctggtggaggtgaaccaccccttcatcgtgaagctgcactacgccttccagaccgagggcaagctgtacctgatcctggacttcctgagaggcggcgacgtgttcaccagactgagcaaggaggtgctgttcaccgaggaggacgtgaagttctacctggccgagctggccctggccctggaccacctgcaccagctgggcatcgtgtacagagacctgaagcccgagaacatcctgctggacgagatcggccacatcaagctgaccgacttcggcctgagcaaggagagcgtggaccaggagaagaaggcctacagcttctgcggcaccgtggagtacatggcccccgaggtggtgaacagaagaggccacagccagagcgccgactggtggagctacggcgtgctgatgttcgagatgctgaccggcaccctgcccttccagggcaaggacagaaacgagaccatgaacatgatcctgaaggccaagctgggcatgccccagttcctgagcgccgaggcccagagcctgctgagaatgctgttcaagagaaaccccgccaacagactgggcagcgagggcgtggaggagatcaagagacacctgttcttcgccaacatcgactgggacaagctgtacaagagagaggtgcagccccccttcaagcccgccagcggcaagcccgacgacaccttctgcttcgaccccgagttcaccgccaagacccccaaggacagccccggcctgcccgccagcgccaacgcccaccagctgttcaagggcttcagcttcgtggccaccagcatcgccgaggagtacaagatcacccccatcaccagcgccaacgtgctgcccatcgtgcagatcaacggcaacgccgcccagttcggcgaggtgtacgagctgaaggaggacatcggcgtgggcagctacagcgtgtgcaagagatgcatccacgccaccaccaacatggagttcgccgtgaagatcatcgacaagagcaagagagaccccagcgaggagatcgagatcctgatgagatacggccagcaccccaacatcatcaccctgaaggacgtgttcgacgacggcagatacgtgtacctggtgaccgacctgatgaagggcggcgagctgctggacagaatcctgaagcagaagtgcttcagcgagagagaggccagcgacatcctgtacgtgatcagcaagaccgtggactacctgcactgccagggcgtggtgcacagagacctgaagcccagcaacatcctgtacatggacgagagcgccagcgccgacagcatcagaatctgcgacttcggcttcgccaagcagctgagaggcgagaacggcctgctgctgaccccctgctacaccgccaacttcgtggcccccgaggtgctgatgcagcagggctacgacgccgcctgcgacatctggagcctgggcgtgctgttctacaccatgctggccggctacacccccttcgccaacggccccaacgacacccccgaggagatcctgctgagaatcggcaacggcaagttcagcctgagcggcggcaactgggacaacatcagcgacggcgccaaggacctgctgagccacatgctgcacatggacccccaccagagatacaccgccgagcagatcctgaagcacagctggatcacccacagagaccagctgcccaacgaccagcccaagagaaacgacgtgagccacgtggtgaagggcgccatggtggccacctacagcgccctgacccacaagaccttccagcccgtgctggagcccgtggccgccagcagcctggcccagagaagaagcatgaagaagagaaccagcaccggcctgtag

SEQ ID NO: 2299 - DNA, 2238 bp, Artificial Sequence
  Description of Artificial Sequence: Synthetic coding sequence
atgggcctgagcaccagcgccatctggaagaacaccagagtggagatcgtgaacccctacgaggtgaagagaaaggtgaaggtgaacggcctgaagatggtggacgagcccatggaggagggcgaggccgacagctgccacgacgagggcgtggtgaaggagatccccatcacccaccacgtgaaggagggctacgagaaggccgaccccgcccagttcgagctgctgaaggtgctgggccagggcagcttcggcaaggtgttcctggtgagaaagaagaccggccccgacgccggccagctgtacgccatgaaggtgctgaagaaggccagcctgaaggtgagagacagagtgagaaccaagatggagagagacatcctggtggaggtgaaccaccccttcatcgtgaagctgcactacgccttccagaccgagggcaagctgtacctgatcctggacttcctgagaggcggcgacgtgttcaccagactgagcaaggaggtgctgttcaccgaggaggacgtgaagttctacctggccgagctggccctggccctggaccacctgcaccagctgggcatcgtgtacagagacctgaagcccgagaacatcctgctggacgagatcggccacatcaagctgaccgacttcggcctgagcaaggagagcgtggaccaggagaagaaggcctacagcttctgcggcaccgtggagtacatggcccccgaggtggtgaacagaagaggccacagccagagcgccgactggtggagctacggcgtgctgatgttcgagatgctgaccggcaccctgcccttccagggcaaggacagaaacgagaccatgaacatgatcctgaaggccaagctgggcatgccccagttcctgagcgccgaggcccagagcctgctgagaatgctgttcaagagaaaccccgccaacagactgggcagcgagggcgtggaggagatcaagagacacctgttcttcgccaacatcgactgggacaagctgtacaagagagaggtgcagccccccttcaagcccgccagcggcaagcccgacgacaccttctgcttcgaccccgagttcaccgccaagacccccaaggacagccccggcctgcccgccagcgccaacgcccaccagctgttcaagggcttcagcttcgtggccaccagcatcgccgaggagtacaagatcacccccatcaccagcgccaacgtgctgcccatcgtgcagatcaacggcaacgccgcccagttcggcgaggtgtacgagctgaaggaggacatcggcgtgggcagctacagcgtgtgcaagagatgcatccacgccaccaccaacatggagttcgccgtgaagatcatcgacaagagcaagagagaccccagcgaggagatcgagatcctgatgagatacggccagcaccccaacatcatcaccctgaaggacgtgttcgacgacggcagatacgtgtacctggtgaccgacctgatgaagggcggcgagctgctggacagaatcctgaagcagaagtgcttcagcgagagagaggccagcgacatcctgtacgtgatcagcaagaccgtggactacctgcactgccagggcgtggtgcacagagacctgaagcccagcaacatcctgtacatggacgagagcgccagcgccgacagcatcagaatctgcgacttcggcttcgccaagcagctgagaggcgagaacggcctgctgctgaccccctgctacaccgccaacttcgtggcccccgaggtgctgatgcagcagggctacgacgccgcctgcgacatctggagcctgggcgtgctgttctacaccatgctggccggctacacccccttcgccaacggccccaacgacacccccgaggagatcctgctgagaatcggcaacggcaagttcagcctgagcggcggcaactgggacaacatcagcgacggcgccaaggacctgctgagccacatgctgcacatggacccccaccagagatacaccgccgagcagatcctgaagcacagctggatcacccacagagaccagctgcccaacgaccagcccaagagaaacgacgtgagccacgtggtgaagggcgccatggtggccacctacagcgccctgacccacaagaccttccagcccgtgctggagcccgtggccgccagcagcctggcccagagaagaagcatgaagaagagaaccagcaccggcctgtag

SEQ ID NO: 2300 - DNA, 1626 bp, Artificial Sequence
  Description of Artificial Sequence: Synthetic coding sequence
atgagcctggtggcctgcgagtgcctgcccagccccggcctggagcccgagccctgcagcagagccagaagccaggcccacgtgtacctggagcagatcagaaacagagtggccctgggcgtgcccgacatgaccaagagagactacctggtggacgccgccacccagatcagactggccctggagagagacgtgagcgaggactacgaggccgccttcaaccactaccagaacggcgtggacgtgctgctgagaggcatccacgtggaccccaacaaggagagaagagaggccgtgaagctgaagatcaccaagtacctgagaagagccgaggagatcttcaactgccacctgcagagacccctgagcagcggcgccagccccagcgccgtgcagctggtgcaggaccccgccaccggcggcaccttcgtggtgaagagcctgcccagatgccacatggtgagcagagagagactgaccatcatcccccacggcgtgccctacatgaccaagctgctgagatacttcgtgagcgaggacagcatcttcctgcacctggagcacgtgcagggcggcaccctgtggagccacctgctgagccaggcccacagcagacacagcggcctgagcagcggcagcacccaggagagaatgaaggcccagctgaacccccacctgaacctgctgacccccgccagactgcccagcggccacgcccccggccaggacagaatcgccctggagccccccagaaccagccccaacctgctgctggccggcgaggcccccagcaccagaccccagagagaggccgagggcgagcccaccgccagaaccagcaccagcggcagcagcgacctgcccaaggcccccggcggccacctgcacctgcaggccagaagagccggccagaacagcgacgccggcccccccagaggcctgacctgggtgcccgagggcgccggccccgtgctgggcggctgcggcagaggcatggaccagagctgcctgagcgccgacggcgccggcagaggctgcggcagagccacctggagcgtgagagaggagcaggtgaagcagtgggccgccgagatgctggtggccctggaggccctgcacgagcagggcgtgctgtgcagagacctgcaccccggcaacctgctgctggaccaggccggccacatcagactgacctacttcggccagtggagcgaggtggagccccagtgctgcggcgaggccgtggacaacctgtacagcgcccccgaggtgggcggcatcagcgagctgaccgaggcctgcgactggtggagcttcggcagcctgctgtacgagctgctgaccggcatggccctgagccagagccaccccagcggcatccaggcccacacccagctgcagctgcccgagtggctgagcagacccgccgccagcctgctgaccgagctgctgcagttcgagcccaccagaagactgggcatgggcgagggcggcgtgagcaagctgaagagccaccccttcttcagcaccatccagtggagcaagctggtgggcaccagcctggagacccacctgagaaccctgatccactggctgagcggccccaagcccgactgccccggctag

SEQ ID NO: 2301 - DNA, 1650 bp, Artificial Sequence
  Description of Artificial Sequence: Synthetic coding sequence
atgagcctggtggcctgcgagtgcctgcccagccccggcctggagcccgagccctgcagcagagccagaagccaggcccacgtgtacctggagcagatcagaaacagagtggccctgggcgtgcccgacatgaccaagagagactacctggtggacgccgccacccagatcagactggccctggagagagacgtgagcgaggactacgaggccgccttcaaccactaccagaacggcgtggacgtgctgctgagaggcatccacgtggaccccaacaaggagagaagagaggccgtgaagctgaagatcaccaagtacctgagaagagccgaggagatcttcaactgccacctgcagagacccctgagcagcggcgccagccccagcgccggcttcagcagcctgagactgagacccatcagaaccctgagcagcgccgtggagcagctgagaggctgcagagtggtgggcgtgatcgagaaggtgcagctggtgcaggaccccgccaccggcggcaccttcgtggtgaagagcctgcccagatgccacatggtgagcagagagagactgaccatcatcccccacggcgtgccctacatgaccaagctgctgagatacttcgtgagcgaggacagcatcttcctgcacctggagcacgtgcagggcggcaccctgtggagccacctgctgagccaggcccacagcagacacagcggcctgagcagcggcagcacccaggagagaatgaaggcccagctgaacccccacctgaacctgctgacccccgccagactgcccagcggccacgcccccggccaggacagaatcgccctggagccccccagaaccagccccaacctgctgctggccggcgaggcccccagcaccagaccccagagagaggccgagggcgagcccaccgccagaaccagcaccagcggcagcagcgacctgcccaaggcccccggcggccacctgcacctgcaggccagaagagccggccagaacagcgacgccggcccccccagaggcctgacctgggtgcccgagggcgccggccccgtgctgggcggctgcggcagaggcatggaccagagctgcctgagcgccgacggcgccggcagaggctgcggcagagccacctggagcgtgagagaggagcaggtgaagcagtgggccgccgagatgctggtggccctggaggccctgcacgagcagggcgtgctgtgcagagacctgcaccccggcaacctgctgctggaccaggccggccacatcagactgacctacttcggccagtggagcgaggtggagccccagtgctgcggcgaggccgtggacaacctgtacagcgcccccgaggtgggcggcatcagcgagctgaccgaggcctgcgactggtggagcttcggcagcctgctgtacgagctgctgaccggcatggccctgagccagagccaccccagcggcatccaggcccacacccagctgcagctgcccgagtggctgagcagacccgccgccagcctgctgaccgagctgctgcagttcgagcccaccagaagactgggcatgggcgagggcggcgtgagcaagctgaagagccaccccttcttcagcaccatccagtggagcaagctggtgggctag

SEQ ID NO: 2302 - DNA, 1650 bp, Artificial Sequence; identical to SEQ ID NO: 2301
  Description of Artificial Sequence: Synthetic coding sequence

SEQ ID NO: 2303 - DNA, 30 bp, Artificial Sequence
  Description of Artificial Sequence: Synthetic coding sequence
atgagcctggtggcctgcgagtgcctgtag

SEQ ID NO: 2304 - DNA, 1650 bp, Artificial Sequence; identical to SEQ ID NO: 2301
  Description of Artificial Sequence: Synthetic coding sequence

SEQ ID NO: 2305 - DNA, 1818 bp, Artificial Sequence
  Description of Artificial Sequence: Synthetic coding sequence
atgctgccccagcaggtgggcttcgtgtgcgccgtgctggccctggtgtgctgcgccagcggcctgttcggcagcctgggccacaagaccgccagcgccagcaagagagtgctgcccgacacctggagaaacagaaagctgatggcccccgtgaacggcacccagaccgccaagaactgcaccgaccccgccatccacgagttccccaccgacctgttcagcaacaaggagagacagcacggcgccgtgctgctgcacatcctgggcgccctgtacatgttctacgccctggccatcgtgtgcgacgacttcttcgtgcccagcctggagaagatctgcgagagactgcacctgagcgaggacgtggccggcgccaccttcatggccgccggcagcagcacccccgagctgttcgccagcgtgatcggcgtgttcatcacccacggcgacgtgggcgtgggcaccatcgtgggcagcgccgtgttcaacatcctgtgcatcatcggcgtgtgcggcctgttcgccggccaggtggtgagactgacctggtgggccgtgtgcagagacagcgtgtactacaccatcagcgtgatcgtgctgatcgtgttcatctacgacgagcagatcgtgtggtgggagggcctggtgctgatcatcctgtacgtgttctacatcctgatcatgaagtacaacgtgaagatgcaggccttcttcaccgtgaagcagaagagcatcgccaacggcaaccccgtgaacagcgagctggaggccggcaacgacttctacgacggcagctacgacgaccccagcgtgcccctgctgggccaggtgaaggagaagccccagtacggcaagaaccccgtggtgatggtggacgagatcatgagcagcagcccccccaagttcaccttccccgaggccggcctgagaatcatgatcaccaacaagttcggccccagaaccagactgagaatggccagcagaatcatcatcaacgagagacagagactgatcaacagcgccaacggcgtgagcagcaagcccctgcagaacggcagacacgagaacatcgagaacggcaacgtgcccgtggagaaccccgaggacccccagcagaaccaggagcagcagccccccccccagccccccccccccgagcccgagcccgtggaggccgacttcctgagccccttcagcgtgcccgaggccagaggcgacaaggtgaagtgggtgttcacctggcccctgatcttcctgctgtgcgtgaccatccccaactgcagcaagcccagatgggagaagttcttcatggtgaccttcatcaccgccaccctgtggatcgccgtgttcagctacatcatggtgtggctggtgaccatcatcggctacaccctgggcatccccgacgtgatcatgggcatcaccttcctggccgccggcaccagcgtgcccgactgcatggccagcctgatcgtggccagacagggcctgggcgacatggccgtgagcaacaccatcggcagcaacgtgttcgacatcctggtgggcctgggcgtgccctggggcctgcagaccatggtggtgaactacggcagcaccgtgaagatcaacagcagaggcctggtgtacagcgtggtgctgctgctgggcagcgtggccctgaccgtgctgggcatccacctgaacaagtggagactggacagaaagctgggcgtgtacgtgctggtgctgtacgccatcttcctgtgcttcagcatcatgatcgagttcaacgtgttcaccttcgtgaacctgcccatgtgcagagaggacgactag

SEQ ID NO: 2306 - DNA, 1059 bp, Artificial Sequence
  Description of Artificial Sequence: Synthetic coding sequence
atgttctacgccctggccatcgtgtgcgacgacttcttcgtgcccagcctggagaagatctgcgagagactgcacctgagcgaggacgtggccggcgccaccttcatggccgccggcagcagcacccccgagctgttcgccagcgtgatcggcgtgttcatcacccacggcgacgtgggcgtgggcaccatcagcgtgagcttcgccctgcagttcatctacgacgagcagatcgtgtggtgggagggcctggtgctgatcatcctgtacgtgttctacatcctgatcatgaagtacaacgtgaagatgcaggccttcttcaccgtgaagcagaagagcatcgccaacggcaaccccgtgaacagcgagctggaggccggcaacgacttctacgacggcagctacgacgaccccagcgtgcccctgctgggccaggtgaaggagaagccccagtacggcaagaaccccgtggtgatggtggacgagatcatgagcagcagcccccccaagttcaccttccccgaggccggcctgagaatcatgatcaccaacaagttcggccccagaaccagactgagaatggccagcagaatcatcatcaacgagagacagagactgatcaacagcgccaacggcgtgagcagcaagcccctgcagaacggcagacacgagaacatcgagaacggcaacgtgcccgtggagaaccccgaggacccccagcagaaccaggagcagcagccccccccccagccccccccccccgagcccgagcccgtggaggccgacttcctgagccccttcagcgtgcccgaggccagaggcgacaaggtgaagtgggtgttcacctggcccctgatcttcctgctgtgcgtgaccatccccaactgcagcaagcccagatgggagaagttcttcatggtgaccttcatcaccgccaccctgtggatcgccgtgttcagctacatcatggtgtggctggagcagagagagggcaagcagttccagcacggctgcagcagcgtggactgcgagacccacagccagcccctgaccccctag

SEQ ID NO: 2307 - DNA, 1761 bp, Artificial Sequence
  Description of Artificial Sequence: Synthetic coding sequence
atgctgccccagcaggtgggcttcgtgtgcgccgtgctggccctggtgtgctgcgccagcggcctgttcggcagcctgggccacaagaccgccagcgccagcaagagagtgctgcccgacacctggagaaacagaaagctgatggcccccgtgaacggcacccagaccgccaagaactgcaccgaccccgccatccacgagttccccaccgacctgttcagcaacaaggagagacagcacggcgccgtgctgctgcacatcctgggcgccctgtacatgttctacgccctggccatcgtgtgcgacgacttcttcgtgcccagcctggagaagatctgcgagagactgcacctgagcgaggacgtggccggcgccaccttcatggccgccggcagcagcacccccgagctgttcgccagcgtgatcggcgtgttcatcacccacggcgacgtgggcgtgggcaccatcgtgggcagcgccgtgttcaacatcctgtgcatcatcggcgtgtgcggcctgttcgccggccaggtggtgagactgacctggtgggccgtgtgcagagacagcgtgtactacaccatcagcgtgatcgtgctgatcgtgttcatctacgacgagcagatcgtgtggtgggagggcctggtgctgatcatcctgtacgtgttctacatcctgatcatgaagtacaacgtgaagatgcaggccttcttcaccgtgaagcagaagagcatcgccaacggcaaccccgtgaacagcgagctggaggccgtgaaggagaagccccagtacggcaagaaccccgtggtgatggtggacgagatcatgagcagcagcccccccaagttcaccttccccgaggccggcctgagaatcatgatcaccaacaagttcggccccagaaccagactgagaatggccagcagaatcatcatcaacgagagacagagactgatcaacagcgccaacggcgtgagcagcaagcccctgcagaacggcagacacgagaacatcgagaacggcaacgtgcccgtggagaaccccgaggacccccagcagaaccaggagcagcagccccccccccagccccccccccccgagcccgagcccgtggaggccgacttcctgagccccttcagcgtgcccgaggccagaggcgacaaggtgaagtgggtgttcacctggcccctgatcttcctgctgtgcgtgaccatccccaactgcagcaagcccagatgggagaagttcttcatggtgaccttcatcaccgccaccctgtggatcgccgtgttcagctacatcatggtgtggctggtgaccatcatcggctacaccctgggcatccccgacgtgatcatgggcatcaccttcctggccgccggcaccagcgtgcccgactgcatggccagcctgatcgtggccagacagggcctgggcgacatggccgtgagcaacaccatcggcagcaacgtgttcgacatcctggtgggcctgggcgtgccctggggcctgcagaccatggtggtgaactacggcagcaccgtgaagatcaacagcagaggcctggtgtacagcgtggtgctgctgctgggcagcgtggccctgaccgtgctgggcatccacctgaacaagtggagactggacagaaagctgggcgtgtacgtgctggtgctgtacgccatcttcctgtgcttcagcatcatgatcgagttcaacgtgttcaccttcgtgaacctgcccatgtgcagagaggacgactag

SEQ ID NO: 2308 - DNA, 1677 bp, Artificial Sequence
  Description of Artificial Sequence: Synthetic coding sequence
atggcccccgtgaacggcacccagaccgccaagaactgcaccgaccccgccatccacgagttccccaccgacctgttcagcaacaaggagagacagcacggcgccgtgctgctgcacatcctgggcgccctgtacatgttctacgccctggccatcgtgtgcgacgacttcttcgtgcccagcctggagaagatctgcgagagactgcacctgagcgaggacgtggccggcgccaccttcatggccgccggcagcagcacccccgagctgttcgccagcgtgatcggcgtgttcatcacccacggcgacgtgggcgtgggcaccatcgtgggcagcgccgtgttcaacatcctgtgcatcatcggcgtgtgcggcctgttcgccggccaggtggtgagactgacctggtgggccgtgtgcagagacagcgtgtactacaccatcagcgtgatcgtgctgatcgtgttcatctacgacgagcagatcgtgtggtgggagggcctggtgctgatcatcctgtacgtgttctacatcctgatcatgaagtacaacgtgaagatgcaggccttcttcaccgtgaagcagaagagcatcgccaacggcaaccccgtgaacagcgagctggaggccggcaacgacttctacgacggcagctacgacgaccccagcgtgcccctgctgggccaggtgaaggagaagccccagtacggcaagaaccccgtggtgatggtggacgagatcatgagcagcagcccccccaagttcaccttccccgaggccggcctgagaatcatgatcaccaacaagttcggccccagaaccagactgagaatggccagcagaatcatcatcaacgagagacagagactgatcaacagcgccaacggcgtgagcagcaagcccctgcagaacggcagacacgagaacatcgagaacggcaacgtgcccgtggagaaccccgaggacccccagcagaaccaggagcagcagccccccccccagccccccccccccgagcccgagcccgtggaggccgacttcctgagccccttcagcgtgcccgaggccagaggcgacaaggtgaagtgggtgttcacctggcccctgatcttcctgctgtgcgtgaccatccccaactgcagcaagcccagatgggagaagttcttcatggtgaccttcatcaccgccaccctgtggatcgccgtgttcagctacatcatggtgtggctggtgaccatcatcggctacaccctgggcatccccgacgtgatcatgggcatcaccttcctggccgccggcaccagcgtgcccgactgcatggccagcctgatcgtggccagacagggcctgggcgacatggccgtgagcaacaccatcggcagcaacgtgttcgacatcctggtgggcctgggcgtgccctggggcctgcagaccatggtggtgaactacggcagcaccgtgaagatcaacagcagaggcctggtgtacagcgtggtgctgctgctgggcagcgtggccctgaccgtgctgggcatccacctgaacaagtggagactggacagaaagctgggcgtgtacgtgctggtgctgtacgccatcttcctgtgcttcagcatcatgatcgagttcaacgtgttcaccttcgtgaacctgcccatgtgcagagaggacgactag

SEQ ID NO: 2309 - DNA, 1812 bp, Artificial Sequence
  Description of Artificial Sequence: Synthetic coding sequence
atggccctgagaggcaccctgagacccctgaaggtgagaagaagaagagagatgctgccccagcaggtgggcttcgtgtgcgccgtgctggccctggtgtgctgcgccagcggcctgttcggcagcctgggccacaagaccgccagcgccagcaagagagtgctgcccgacacctggagaaacagaaagctgatggcccccgtgaacggcacccagaccgccaagaactgcaccgaccccgccatccacgagttccccaccgacctgttcagcaacaaggagagacagcacggcgccgtgctgctgcacatcctgggcgccctgtacatgttctacgccctggccatcgtgtgcgacgacttcttcgtgcccagcctggagaagatctgcgagagactgcacctgagcgaggacgtggccggcgccaccttcatggccgccggcagcagcacccccgagctgttcgccagcgtgatcggcgtgttcatcacccacggcgacgtgggcgtgggcaccatcgtgggcagcgccgtgttcaacatcctgtgcatcatcggcgtgtgcggcctgttcgccggccaggtggtgagactgacctggtgggccgtgtgcagagacagcgtgtactacaccatcagcgtgatcgtgctgatcgtgttcatctacgacgagcagatcgtgtggtgggagggcctggtgctgatcatcctgtacgtgttctacatcctgatcatgaagtacaacgtgaagatgcaggccttcttcaccgtgaagcagaagagcatcgccaacggcaaccccgtgaacagcgagctggaggccgtgaaggagaagccccagtacggcaagaaccccgtggtgatggtggacgagatcatgagcagcagcccccccaagttcaccttccccgaggccggcctgagaatcatgatcaccaacaagttcggccccagaaccagactgagaatggccagcagaatcatcatcaacgagagacagagactgatcaacagcgccaacggcgtgagcagcaagcccctgcagaacggcagacacgagaacatcgagaacggcaacgtgcccgtggagaaccccgaggacccccagcagaaccaggagcagcagccccccccccagccccccccccccgagcccgagcccgtggaggccgacttcctgagccccttcagcgtgcccgaggccagaggcgacaaggtgaagtgggtgttcacctggcccctgatcttcctgctgtgcgtgaccatccccaactgcagcaagcccagatgggagaagttcttcatggtgaccttcatcaccgccaccctgtggatcgccgtgttcagctacatcatggtgtggctggtgaccatcatcggctacaccctgggcatccccgacgtgatcatgggcatcaccttcctggccgccggcaccagcgtgcccgactgcatggccagcctgatcgtggccagacagggcctgggcgacatggccgtgagcaacaccatcggcagcaacgtgttcgacatcctggtgggcctgggcgtgccctggggcctgcagaccatggtggtgaactacggcagcaccgtgaagatcaacagcagaggcctggtgtacagcgtggtgctgctgctgggcagcgtggccctgaccgtgctgggcatccacctgaacaagtggagactggacagaaagctgggcgtgtacgtgctggtgctgtacgccatcttcctgtgcttcagcatcatgatcgagttcaacgtgttcaccttcgtgaacctgcccatgtgcagagaggacgactag

SEQ ID NO: 2310 - DNA, 1869 bp, Artificial Sequence
  Description of Artificial Sequence: Synthetic coding sequence
atggccctgagaggcaccctgagacccctgaaggtgagaagaagaagagagatgctgccccagcaggtgggcttcgtgtgcgccgtgctggccctggtgtgctgcgccagcggcctgttcggcagcctgggccacaagaccgccagcgccagcaagagagtgctgcccgacacctggagaaacagaaagctgatggcccccgtgaacggcacccagaccgccaagaactgcaccgaccccgccatccacgagttccccaccgacctgttcagcaacaaggagagacagcacggcgccgtgctgctgcacatcctgggcgccctgtacatgttctacgccctggccatcgtgtgcgacgacttcttcgtgcccagcctggagaagatctgcgagagactgcacctgagcgaggacgtggccggcgccaccttcatggccgccggcagcagcacccccgagctgttcgccagcgtgatcggcgtgttcatcacccacggcgacgtgggcgtgggcaccatcgtgggcagcgccgtgttcaacatcctgtgcatcatcggcgtgtgcggcctgttcgccggccaggtggtgagactgacctggtgggccgtgtgcagagacagcgtgtactacaccatcagcgtgatcgtgctgatcgtgttcatctacgacgagcagatcgtgtggtgggagggcctggtgctgatcatcctgtacgtgttctacatcctgatcatgaagtacaacgtgaagatgcaggccttcttcaccgtgaagcagaagagcatcgccaacggcaaccccgtgaacagcgagctggaggccggcaacgacttctacgacggcagctacgacgaccccagcgtgcccctgctgggccaggtgaaggagaagccccagtacggcaagaaccccgtggtgatggtggacgagatcatgagcagcagcccccccaagttcaccttccccgaggccggcctgagaatcatgatcaccaacaagttcggccccagaaccagactgagaatggccagcagaatcatcatcaacgagagacagagactgatcaacagcgccaacggcgtgagcagcaagcccctgcagaacggcagacacgagaacatcgagaacggcaacgtgcccgtggagaaccccgaggacccccagcagaaccaggagcagcagccccccccccagccccccccccccgagcccgagcccgtggaggccgacttcctgagccccttcagcgtgcccgaggccagaggcgacaaggtgaagtgggtgttcacctggcccctgatcttcctgctgtgcgtgaccatccccaactgcagcaagcccagatgggagaagttcttcatggtgaccttcatcaccgccaccctgtggatcgccgtgttcagctacatcatggtgtggctggtgaccatcatcggctacaccctgggcatccccgacgtgatcatgggcatcaccttcctggccgccggcaccagcgtgcccgactgcatggccagcctgatcgtggccagacagggcctgggcgacatggccgtgagcaacaccatcggcagcaacgtgttcgacatcctggtgggcctgggcgtgccctggggcctgcagaccatggtggtgaactacggcagcaccgtgaagatcaacagcagaggcctggtgtacagcgtggtgctgctgctgggcagcgtggccctgaccgtgctgggcatccacctgaacaagtggagactggacagaaagctgggcgtgtacgtgctggtgctgtacgccatcttcctgtgcttcagcatcatgatcgagttcaacgtgttcaccttcgtgaacctgcccatgtgcagagaggacgactag

SEQ ID NO: 2311 - DNA, 1503 bp, Artificial Sequence
  Description of Artificial Sequence: Synthetic coding sequence
atgcagaccaagggcggccagacctgggccagaagagccctgctgctgggcatcctgtgggccaccgcccacctgcccctgagcggcaccagcctgccccagagactgcccagagccaccggcaacagcacccagtgcgtgatcagccccagcagcgagttccccgagggcttcttcaccagacaggagagaagagacggcggcatcatcatctacttcctgatcatcgtgtacatgttcatggccatcagcatcgtgtgcgacgagtacttcctgcccagcctggagatcatcagcgagagcctgggcctgagccaggacgtggccggcaccaccttcatggccgccggcagcagcgcccccgagctggtgaccgccttcctgggcgtgttcatcaccaagggcgacatcggcatcagcaccatcctgggcagcgccatctacaacctgctgggcatctgcgccgcctgcggcctgctgagcaacaccgtgagcaccctgagctgctggcccctgttcagagactgcgccgcctacaccatcagcgccgccgccgtgctgggcatcatctacgacaaccaggtgtactggtacgagggcgccctgctgctgctgatctacggcctgtacgtgctggtgctgtgcttcgacatcaagatcaaccagtacatcatcaagaagtgcagcccctgctgcgcctgcctggccaaggccatggagagaagcgagcagcagcccctgatgggctgggaggacgagggccagcccttcatcagaagacagagcagaaccgacagcggcatcttctacgaggacagcggctacagccagctgagcatcagcctgcacggcctgagccaggtgagcgaggacccccccagcgtgttcaacatgcccgaggccgacctgaagagaatcttctgggtgctgagcctgcccatcatcaccctgctgttcctgaccacccccgactgcagaaagaagttctggaagaactacttcgtgatcaccttcttcatgagcgccatctggatcagcgccttcacctacatcctggtgtggatggtgaccatcaccggcgagaccctggagatccccgacaccgtgatgggcctgaccctgctggccgccggcaccagcatccccgacaccatcgccagcgtgctggtggccagaaagggcaagggcgacatggccatgagcaacatcgtgggcagcaacgtgttcgacatgctgtgcctgggcatcccctggttcatcaagaccgccttcatcaacggcagcgcccccgccgaggtgaacagcagaggcctgacctacatcaccatcagcctgaacatcagcatcatcttcctgttcctggccgtgcacttcaacggctggaagctggacagaaagctgggcatcgtgtgcctgctgagctacctgggcctggccaccctgagcgtgctgtacgagctgggcatcatcggcaacaacaagatcagaggctgcggcggctag

SEQ ID NO: 2312 - DNA, 1323 bp, Artificial Sequence
  Description of Artificial Sequence: Synthetic coding sequence
atgcagaccaagggcggccagacctgggccagaagagccctgctgctgggcatcctgtgggccaccgcccacctgcccctgagcggcaccagcctgccccagagactgcccagagccaccgccctgggcctgagccaggacgtggccggcaccaccttcatggccgccggcagcagcgcccccgagctggtgaccgccttcctgggcgtgttcatcaccaagggcgacatcggcatcagcaccatcctgggcagcgccatctacaacctgctgggcatctgcgccgcctgcggcctgctgagcaacaccgtgagcaccctgagctgctggcccctgttcagagactgcgccgcctacaccatcagcgccgccgccgtgctgggcatcatctacgacaaccaggtgtactggtacgagggcgccctgctgctgctgatctacggcctgtacgtgctggtgctgtgcttcgacatcaagatcaaccagtacatcatcaagaagtgcagcccctgctgcgcctgcctggccaaggccatggagagaagcgagcagcagcccctgatgggctgggaggacgagggccagcccttcatcagaagacagagcagaaccgacagcggcatcttctacgaggacagcggctacagccagctgagcatcagcctgcacggcctgagccaggtgagcgaggacccccccagcgtgttcaacatgcccgaggccgacctgaagagaatcttctgggtgctgagcctgcccatcatcaccctgctgttcctgaccacccccgactgcagaaagaagttctggaagaactacttcgtgatcaccttcttcatgagcgccatctggatcagcgccttcacctacatcctggtgtggatggtgaccatcaccggcgagaccctggagatccccgacaccgtgatgggcctgaccctgctggccgccggcaccagcatccccgacaccatcgccagcgtgctggtggccagaaagggcaagggcgacatggccatgagcaacatcgtgggcagcaacgtgttcgacatgctgtgcctgggcatcccctggttcatcaagaccgccttcatcaacggcagcgcccccgccgaggtgaacagcagaggcctgacctacatcaccatcagcctgaacatcagcatcatcttcctgttcctggccgtgcacttcaacggctggaagctggacagaaagctgggcatcgtgtgcctgctgagctacctgggcctggccaccctgagcgtgctgtacgagctgggcatcatcggcaacaacaagatcagaggctgcggcggctag

SEQ ID NO: 2313 - DNA, 552 bp, Artificial Sequence
  Description of Artificial Sequence: Synthetic coding sequence
atgctgagcagagccgtgtgcggcaccagcagacagctggcccccgtgctgggctacctgggcagcagacagaagcacagcctgcccgacctgccctacgactacggcgccctggagccccacatcaacgcccagatcatgcagctgcaccacagcaagcaccacgccgcctacgtgaacaacctgaacgtgaccgaggagaagtaccaggaggccctggccaagggcgagctgctggaggccatcaagagagacttcggcagcttcgacaagttcaaggagaagctgaccgccgccagcgtgggcgtgcagggcagcggctggggctggctgggcttcaacaaggagagaggccacctgcagatcgccgcctgccccaaccaggaccccctgcagggcaccaccggcctgatccccctgctgggcatcgacgtgtgggagcacgcctactacctgcagtacaagaacgtgagacccgactacctgaaggccatctggaacgtgatcaactgggagaacgtgaccgagagatacatggcctgcaagaagtag

SEQ ID NO: 2314 - DNA, 552 bp, Artificial Sequence; identical to SEQ ID NO: 2313
  Description of Artificial Sequence: Synthetic coding sequence

SEQ ID NO: 2315 - DNA, 669 bp, Artificial Sequence
  Description of Artificial Sequence: Synthetic coding sequence
atgctgagcagagccgtgtgcggcaccagcagacagctggcccccgtgctgggctacctgggcagcagacagaagcacagcctgcccgacctgccctacgactacggcgccctggagccccacatcaacgcccagatcatgcagctgcaccacagcaagcaccacgccgcctacgtgaacaacctgaacgtgaccgaggagaagtaccaggaggccctggccaagggcgacgtgaccgcccagatcgccctgcagcccgccctgaagttcaacggcggcggccacatcaaccacagcatcttctggaccaacctgagccccaacggcggcggcgagcccaagggcgagctgctggaggccatcaagagagacttcggcagcttcgacaagttcaaggagaagctgaccgccgccagcgtgggcgtgcagggcagcggctggggctggctgggcttcaacaaggagagaggccacctgcagatcgccgcctgccccaaccaggaccccctgcagggcaccaccggcctgatccccctgctgggcatcgacgtgtgggagcacgcctactacctgcagtacaagaacgtgagacccgactacctgaaggccatctggaacgtgatcaactgggagaacgtgaccgagagatacatggcctgcaagaagtag

SEQ ID NO: 2316 - DNA, 669 bp, Artificial Sequence; identical to SEQ ID NO: 2315
  Description of Artificial Sequence: Synthetic coding sequence

SEQ ID NO: 2317 - DNA, 531 bp, Artificial Sequence
  Description of Artificial Sequence: Synthetic coding sequence
atgcagctgcaccacagcaagcaccacgccgcctacgtgaacaacctgaacgtgaccgaggagaagtaccaggaggccctggccaagggcgacgtgaccgcccagatcgccctgcagcccgccctgaagttcaacggcggcggccacatcaaccacagcatcttctggaccaacctgagccccaacggcggcggcgagcccaagggcgagctgctggaggccatcaagagagacttcggcagcttcgacaagttcaaggagaagctgaccgccgccagcgtgggcgtgcagggcagcggctggggctggctgggcttcaacaaggagagaggccacctgcagatcgccgcctgccccaaccaggaccccctgcagggcaccaccggcctgatccccctgctgggcatcgacgtgtgggagcacgcctactacctgcagtacaagaacgtgagacccgactacctgaaggccatctggaacgtgatcaactgggagaacgtgaccgagagatacatggcctgcaagaagtag

SEQ ID NO: 2318 - DNA, 723 bp, Artificial Sequence
  Description of Artificial Sequence: Synthetic coding sequence
atgctggccctgctgtgcagctgcctgctgctggccgccggcgccagcgacgcctggaccggcgaggacagcgccgagcccaacagcgacagcgccgagtggatcagagacatgtacgccaaggtgaccgagatctggcaggaggtgatgcagagaagagacgacgacggcgccctgcacgccgcctgccaggtgcagcccagcgccaccctggacgccgcccagcccagagtgaccggcgtggtgctgttcagacagctggcccccagagccaagctggacgccttcttcgccctggagggcttccccaccgagcccaacagcagcagcagagccatccacgtgcaccagttcggcgacctgagccagggctgcgagagcaccggcccccactacaaccccctggccgtgccccacccccagcaccccggcgacttcggcaacttcgccgtgagagacggcagcctgtggagatacagagccggcctggccgccagcctggccggcccccacagcatcgtgggcagagccgtggtggtgcacgccggcgaggacgacctgggcagaggcggcaaccaggccagcgtggagaacggcaacgccggcagaagactggcctgctgcgtggtgggcgtgtgcggccccggcctgtgggagagacaggccagagagcacagcgagagaaagaagagaagaagagagagcgagtgcaaggccgcctag

SEQ ID NO: 2319 - DNA, 390 bp, Artificial Sequence
  Description of Artificial Sequence: Synthetic coding sequence
atgaagatcctggtggccctggccgtgttcttcctggtgagcacccagctgttcgccgaggagatcggcgccaacgacgacctgaactactggagcgactggtacgacagcgaccagatcaaggaggagctgcccgagcccttcgagcacctgctgcagagaatcgccagaagacccaagccccagcagttcttcggcctgatgggcaagagagacgccgacagcagcatcgagaagcaggtggccctgctgaaggccctgtacggccacggccagatcagccacaagagacacaagaccgacagcttcgtgggcctgatgggcaagagagccctgaacagcgtggcctacgagagaagcgccatgcagaactacgagagaagaagatag

SEQ ID NO: 2320 - DNA, 345 bp, Artificial Sequence
  Description of Artificial Sequence: Synthetic coding sequence
atgaagatcctggtggccctggccgtgttcttcctggtgagcacccagctgttcgccgaggagatcggcgccaacgacgacctgaactactggagcgactggtacgacagcgaccagatcaaggaggagctgcccgagcccttcgagcacctgctgcagagaatcgccagaagacccaagccccagcagttcttcggcctgatgggcaagagagacgccggccacggccagatcagccacaagagacacaagaccgacagcttcgtgggcctgatgggcaagagagccctgaacagcgtggcctacgagagaagcgccatgcagaactacgagagaagaagatag

SEQ ID NO: 2321 - DNA, 336 bp, Artificial Sequence
  Description of Artificial Sequence: Synthetic coding sequence
atgaagatcctggtggccctggccgtgttcttcctggtgagcacccagctgttcgccgaggagatcggcgccaacgacgacctgaactactggagcgactggtacgacagcgaccagatcaaggaggagctgcccgagcccttcgagcacctgctgcagagaatcgccagaagacccaagccccagcagttcttcggcctgatgggcaagagagacgccgacagcagcatcgagaagcaggtggccctgctgaaggccctgtacggccacggccagatcagccacaagatggcctacgagagaagcgccatgcagaactacgagagaagaagatag

SEQ ID NO: 2322 - DNA, 417 bp, Artificial Sequence
  Description of Artificial Sequence: Synthetic coding sequence
atgaccgccctgttcctgatgagcatgctgttcggcctgacctgcggccaggccatgagcttctgcatccccaccgagtacaccatgcacatcgagagaagagagtgcgcctactgcctgaccatcaacaccaccatctgcgccggctactgcatgaccagagacatcaacggcaagctgttcctgcccaagtacgccctgagccaggacgtgtgcacctacagagacttcatctacagaaccgtggagatccccggctgccccctgcacgtggccccctacttcagctaccccgtggccctgagctgcaagtgcggcaagtgcaacaccgactacagcgactgcatccacgaggccatcaagaccaactactgcaccaagccccagaagagctacctggtgggcttcagcgtgtag

SEQ ID NO: 2323 - DNA, 417 bp, Artificial Sequence; identical to SEQ ID NO: 2322
  Description of Artificial Sequence: Synthetic coding sequence

SEQ ID NO: 2324 - DNA, 2418 bp, Artificial Sequence
  Description of Artificial Sequence: Synthetic coding sequence
atggcccagcccctggccttcatcctggacgtgcccgagacccccggcgaccagggccagggccccagcccctacgacgagagcgaggtgcacgacagcttccagcagctgatccaggagcagagccagtgcaccgcccaggagggcctggagctgcagcagagagagagagaggtgaccggcagcagccagcagaccctgtggagacccgagggcacccagagcaccgccaccctgagaatcctggccagcatgcccagcagaaccatcggcagaagcagaggcgccatcatcagccagtactacaacagaaccgtgcagctgagatgcagaagcagcagacccctgctgggcaacttcgtgagaagcgcctggcccagcctgagactgtacgacctggagctggaccccaccgccctggaggaggaggagaagcagagcctgctggtgaaggagctgcagagcctggccgtggcccagagagaccacatgctgagaggcatgcccctgagcctggccgagaagagaagcctgagagagaagagcagaacccccagaggcaagtggagaggccagcccggcagcggcggcgtgtgcagctgctgcggcagactgagatacgcctgcgtgctggccctgcacagcctgggcctggccctgctgagcgccctgcaggccctgatgccctggagatacgccctgaagagaatcggcggccagttcggcagcagcgtgctgagctacttcctgttcctgaagaccctgctggccttcaacgccctgctgctgctgctgctggtggccttcatcatgggcccccaggtggccttcccccccgccctgcccggccccgcccccgtgtgcaccggcctggagctgctgaccggcgccggctgcttcacccacaccgtgatgtactacggccactacagcaacgccaccctgaaccagccctgcggcagccccctggacggcagccagtgcacccccagagtgggcggcctgccctacaacatgcccctggcctacctgagcaccgtgggcgtgagcttcttcatcacctgcatcaccctggtgtacagcatggcccacagcttcggcgagagctacagagtgggcagcaccagcggcatccacgccatcaccgtgttctgcagctgggactacaaggtgacccagaagagagccagcagactgcagcaggacaacatcagaaccagactgaaggagctgctggccgagtggcagctgagacacagccccagaagcgtgtgcggcagactgagacaggccgccgtgctgggcctggtgtggctgctgtgcctgggcaccgccctgggctgcgccgtggccgtgcacgtgttcagcgagttcatgatccagagccccgaggccgccggccaggaggccgtgctgctggtgctgcccctggtggtgggcctgctgaacctgggcgccccctacctgtgcagagtgctggccgccctggagccccacgacagccccgtgctggaggtgtacgtggccatctgcagaaacctgatcctgaagctggccatcctgggcaccctgtgctaccactggctgggcagaagagtgggcgtgctgcagggccagtgctgggaggacttcgtgggccaggagctgtacagattcctggtgatggacttcgtgctgatgctgctggacaccctgttcggcgagctggtgtggagaatcatcagcgagaagaagctgaagagaagaagaaagcccgagttcgacatcgccagaaacgtgctggagctgatctacggccagaccctgacctggctgggcgtgctgttcagccccctgctgcccgccgtgcagatcatcaagctgctgctggtgttctacgtgaagaagaccagcctgctggccaactgccaggcccccagaagaccctggctggccagccacatgagcaccgtgttcctgaccctgctgtgcttccccgccttcctgggcgccgccgtgttcctgtgctacgccgtgtggcaggtgaagcccagcagcacctgcggccccttcagaaccctggacaccatgtacgaggccggcagagtgtgggtgagacacctggaggccgccggccccagagtgagctggctgccctgggtgcacagatacctgatggagaacaccttcttcgtgttcctggtgagcgccctgctgctggccgtgatctacctgaacatccaggtggtgagaggccagagaaaggtgatctgcctgctgaaggagcagatcagcaacgagggcgaggacaagatcttcctgatcaacaagctgcacagcatctacgagagaaaggagagagaggagagaagcagagtgggcaccaccgaggaggccgccgccccccccgccctgctgaccgacgagcaggacgcctag

SEQ ID NO: 2325 - DNA, 864 bp, Artificial Sequence
  Description of Artificial Sequence: Synthetic coding sequence
atgctgctgcccagaagcgtgagcagcgagagagcccccggcgtgcccgagcccgaggagctgtgggaggccgagatggagagactgagaggcagcggcacccccgtgagaggcctgccctacgccatgatggacaagagactgatctggcagctgagagagcccgccggcgtgcagaccctgagatggcagagatggcagagaagaagacagaccgtggagagaagactgagagaggccgcccagagactggccagaggcctgggcctgtgggagggcgccctgtacgagatcggcggcctgttcggcaccggcatcagaagctacttcaccttcctgagattcctgctgctgctgaacctgctgagcctgctgctgaccgccagcttcgtgctgctgcccctggtgtggctgagaccccccgaccccggccccaccctgaacctgaccctgcagtgccccggcagcagacagagcccccccggcgtgctgagattccacaaccagctgtggcacgtgctgaccggcagagccttcaccaacacctacctgttctacggcgcctacagagtgggccccgagagcagcagcgtgtacagcatcagactggcctacctgctgagccccctggcctgcctgctgctgtgcttctgcggcaccctgagaagactgctgagcaccctggccagcggccccggcgccggcggcccctgggcccccgcccactggcccgcctgcccccccctgcccggcctgcccagactgcagctgccccccccccaccacgcccaggtgctgagagccgccggcgccatgggcggcgacacctggagaggcagaagcttcctgccctggggctggtag

SEQ ID NO: 2326 - DNA, 2181 bp, Artificial Sequence
  Description of Artificial Sequence: Synthetic coding sequence
atgctgctgcccagaagcgtgagcagcgagagagcccccggcgtgcccgagcccgaggagctgtgggaggccgagatggagagactgagaggcagcggcacccccgtgagaggcctgccctacgccatgatggacaagagactgatctggcagctgagagagcccgccggcgtgcagaccctgagatggcagagatggcagagaagaagacagaccgtggagagaagactgagagaggccgcccagagactggccagaggcctgggcctgtgggagggcgccctgtacgagatcggcggcctgttcggcaccggcatcagaagctacttcaccttcctgagattcctgctgctgctgaacctgctgagcctgctgctgaccgccagcttcgtgctgctgcccctggtgtggctgagaccccccgaccccggccccaccctgaacctgaccctgcagtgccccggcagcagacagagcccccccggcgtgctgagattccacaaccagctgtggcacgtgctgaccggcagagccttcaccaacacctacctgttctacggcgcctacagagtgggccccgagagcagcagcgtgtacagcatcagactggcctacctgctgagccccctggcctgcctgctgctgtgcttctgcggcaccctgagaagaatggtgaagggcctgccccagaagaccctgctgggccagggctaccaggcccccctgagcgccaaggtgttcagcagctgggacttctgcatcagagtgcaggaggccgccaccatcaagaagcacgagatcagcaacgagttcaaggtggagctggaggagggcagaagattccagctgatgcagcagcagaccagagcccagaccgcctgcagactgctgagctacctgagagtgaacgtgctgaacggcctgctggtggtgggcgccatcagcgccatcttctgggccaccaagtacagccaggacaacaaggaggagagcctgttcctgctgctgcagtacctgccccccggcgtgatcgccctggtgaacttcctgggccccctgctgttcaccttcctggtgcagctggagaactacccccccaacaccgaggtgaacctgaccctgatctggtgcgtggtgctgaagctggccagcctgggcatgttcagcgtgagcctgggccagaccatcctgtgcatcggcagagacaagagcagctgcgagagctacggctacaacgtgtgcgactaccagtgctgggagaacagcgtgggcgaggagctgtacaagctgagcatcttcaacttcctgctgaccgtggccttcgccttcctggtgaccctgcccagaagactgctggtggacagattcagcggcagattctgggcctggctggagagagaggagttcctggtgcccaagaacgtgctggacatcgtggccggccagaccgtgacctggatgggcctgttctactgccccctgctgcccctgctgaacagcgtgttcctgttcctgaccttctacatcaagaagtacaccctgctgaagaacagcagagccagcagcagacccttcagagccagcagcagcaccttcttcttccagctggtgctgctgctgggcctgctgctggccgccgtgcccctgggctacgtggtgagcagcatccacagcagctgggactgcggcctgttcaccaactacagcgccccctggcaggtggtgcccgagctggtggccctgggcctgccccccatcggccagagagccctgcactacctgggcagccacgccttcagcttccccctgctgatcatgctgagcctggtgctgaccgtgtgcgtgagccagacccaggccaacgccagagccatccacagactgagaaagcagctggtgtggcaggtgcaggagaagtggcacctggtggaggacctgagcagactgctgcccgagcccggccccagcgacagccccggccccaagtaccccgccagccaggccagcagaccccagagcttctgccccggctgcccctgccccggcagccccggccaccaggcccccagacccggccccagcgtggtggacgccgccggcctgagaagcccctgccccggccagcacggcgcccccgccagcgccagaagattcagattccccagcggcgccgagctgtag

SEQ ID NO: 2327 - DNA, 702 bp, Artificial Sequence
  Description of Artificial Sequence: Synthetic coding sequence
atgagcaccgagagcatgatcagagacgtggagctggccgaggaggccctgcccaagaagaccggcggcccccagggcagcagaagatgcctgttcctgagcctgttcagcttcctgatcgtggccggcgccaccaccctgttctgcctgctgcacttcggcgtgatcggcccccagagagaggagttccccagagacctgagcctgatcagccccctggcccaggccgtgagaagcagcagcagaacccccagcgacaagcccgtggcccacgtggtggccaacccccaggccgagggccagctgcagtggctgaacagaagagccaacgccctgctggccaacggcgtggagctgagagacaaccagctggtggtgcccagcgagggcctgtacctgatctacagccaggtgctgttcaagggccagggctgccccagcacccacgtgctgctgacccacaccatcagcagaatcgccgtgagctaccagaccaaggtgaacctgctgagcgccatcaagagcccctgccagagagagacccccgagggcgccgaggccaagccctggtacgagcccatctacctgggcggcgtgttccagctggagaagggcgacagactgagcgccgagatcaacagacccgactacctggacttcgccgagagcggccaggtgtacttcggcatcatcgccctgtag

SEQ ID NO: 2328 - DNA, 702 bp, Artificial Sequence; identical to SEQ ID NO: 2327
  Description of Artificial Sequence: Synthetic coding sequence

SEQ ID NO: 2329 - DNA, 702 bp, Artificial Sequence; identical to SEQ ID NO: 2327
  Description of Artificial Sequence: Synthetic coding sequence

SEQ ID NO: 2330 - DNA, 702 bp, Artificial Sequence; identical to SEQ ID NO: 2327
  Description of Artificial Sequence: Synthetic coding sequence

SEQ ID NO: 2331 - DNA, 702 bp, Artificial Sequence; identical to SEQ ID NO: 2327
  Description of Artificial Sequence: Synthetic coding sequence

SEQ ID NO: 2332 - DNA, 702 bp, Artificial Sequence; identical to SEQ ID NO: 2327
  Description of Artificial Sequence: Synthetic coding sequence

SEQ ID NO: 2333 - DNA, 702 bp, Artificial Sequence; identical to SEQ ID NO: 2327
  Description of Artificial Sequence: Synthetic coding sequence

SEQ ID NO: 2334 - DNA, 741 bp, Artificial Sequence
  Description of Artificial Sequence: Synthetic coding sequence
atggcccaggtgcccccccccgccagcggcgagagacacgccggcaccgaggacggccccatcagaagaaaccccgccggcaacgtggccagacccatggtgcagagactgcccgagccccaggacgtggcccagtgcctggaggtgggcctgttcgacaccccccccttctacagcaacagcaccaacagcttcagaaacaccgtggagggcaacgaccccaccggcaagtacgaccccgccgtgagaagcctgcacaacctggcccacctgttcctgaacggcaccggcggccagacccacctgagccccaacgaccccatcttcgtgctgctgcacaccttcaccgacgccgtgttcgacgagtggctgagaagatacaacgccgacatcagcaccttccccctggagaacgcccccatcggccacaacagacagtacaacatggtgcccttctggccccccgtgaccaacaccgagatgttcgtgaccgcccccgacaacctgggctacacctacgagatccagtggcccagcagagagttcagcgtgcccgagatcatcgccatcgccgtggtgggcgccctgctgctggtggccctgatcttcggcaccgccagctacctgatcagagccagaagaagcatggacgaggccaaccagcccctgctgaccgaccagtaccagtgctacgccgaggagtacgagaagctgcagaaccccaaccagagcgtggtgtag

SEQ ID NO: 2335 - DNA, 1614 bp, Artificial Sequence
  Description of Artificial Sequence: Synthetic coding sequence
atgagcgcccccaagctgctgagcctgggctgcatcttcttccccctgctgctgttccagcaggccagagcccagttccccagacagtgcgccaccgtggaggccctgagaagcggcatgtgctgccccgacctgagccccgtgagcggccccggcaccgacagatgcggcagcagcagcggcagaggcagatgcgaggccgtgaccgccgacagcagaccccacagcccccagtacccccacgacggcagagacgacagagaggtgtggcccctgagattcttcaacagaacctgccactgcaacggcaacttcagcggccacaactgcggcacctgcagacccggctggagaggcgccgcctgcgaccagagagtgctgatcgtgagaagaaacctgctggacctgagcaaggaggagaagaaccacttcgtgagagccctggacatggccaagagaaccacccaccccctgttcgtgatcgccaccagaagaagcgaggagatcctgggccccgacggcaacaccccccagttcgagaacatcagcatctacaactacttcgtgtggacccactactacagcgtgaagaagaccttcctgggcgtgggccaggagagcttcggcgaggtggacttcagccacgagggccccgccttcctgacctggcacagataccacctgctgagactggagaaggacatgcaggagatgctgcaggagcccagcttcagcctgccctactggaacttcgccaccggcaagaacgtgtgcgacatctgcaccgacgacctgatgggcagcagaagcaacttcgacagcaccctgatcagccccaacagcgtgttcagccagtggagagtggtgtgcgacagcctggaggactacgacaccctgggcaccctgtgcaacagcaccgaggacggccccatcagaagaaaccccgccggcaacgtggccagacccatggtgcagagactgcccgagccccaggacgtggcccagtgcctggaggtgggcctgttcgacaccccccccttctacagcaacagcaccaacagcttcagaaacaccgtggagggctacagcgaccccaccggcaagtacgaccccgccgtgagaagcctgcacaacctggcccacctgttcctgaacggcaccggcggccagacccacctgagccccaacgaccccatcttcgtgctgctgcacaccttcaccgacgccgtgttcgacgagtggctgagaagatacaacgccgacatcagcaccttccccctggagaacgcccccatcggccacaacagacagtacaacatggtgcccttctggccccccgtgaccaacaccgagatgttcgtgaccgcccccgacaacctgggctacacctacgagatccagtggcccagcagagagttcagcgtgcccgagatcatcgccatcgccgtggtgggcgccctgctgctggtggccctgatcttcggcaccgccagctacctgatcagagccagaagaagcatggacgaggccaaccagcccctgctgaccgaccagtaccagtgctacgccgaggagtacgagaagctgcagaaccccaaccagagcgtggtgtag

SEQ ID NO: 2336 - DNA, 309 bp, Artificial Sequence
  Description of Artificial Sequence: Synthetic coding sequence
atgagcgcccccaagctgctgagcctgggctgcatcttcttccccctgctgctgttccagcaggccagagcccagttccccagacagtgcgccaccgtggaggccctgagaagcggcatgtgctgccccgacctgagccccgtgagcggccccggcaccgacagatgcggcagcagcagcggcagaggcagatgcgaggccgtgaccgccgacagcagaccccacagcccccagtacccccacgacggcagagacgacagagaggtgtggcccctgagattcttcaacagaacctgccactgcaactag

SEQ ID NO: 2337 - DNA, 1128 bp, Artificial Sequence
  Description of Artificial Sequence: Synthetic coding sequence
atggaggaagaaattgccgctttggttatcgacaatggctctgggatgtgcaaggccggattcgccggagacgacgctcctcgtgccgtgttcccctcaatcgttggcagaccccggcaccagggggtaatggtcggaatgggccagaaggatagctacgtgggcgacgaggcacagtcaaagaggggcatattgaccctgaagtacccaattgagcacgggattgtgactaattgggacgacatggagaagatctggcatcacacattttacaacgagttgcgggtagccccagaagagcaccctgtgctgctcacagaagctcctttgaatcctaaggcaaacagagagaagatgacccagataatgtttgagacatttaatactccggcgatgtatgtggcaattcaggctgtgctgagcctttatgcaagcgggcggactaccggcatagtcatggactcaggtgatggtgtgactcacactgttccaatttacgaagggtacgcgctcccccacgcaatcctgaggctcgacctggcaggtagagacctgactgactatttgatgaaaatccttacggagagagggtactcgttcaccactaccgccgagagggaaatcgtgcgtgatattaaagagaagctatgctacgtggccctcgattttgaacaggagatggctacagcagcctcttctagctcacttgaaaagagttacgagctgcctgatgggcaagttatcaccattggcaacgaaaggtttagatgtcccgaggccctgttccagccttccttcctgggtatggaatcctgtgggattcacgagacaaccttcaattccattatgaagtgcgacgtggatataaggaaggatctgtatgcgaatacagttctgagcgggggaaccactatgtaccccgggatcgccgatcgaatgcagaaggaaattaccgccttggccccttccacaatgaaaattaagattatcgcccccccggagaggaaatattccgtttggattggcggctcaatcttggcttccttgtccaccttccaacagatgtggatcagcaagcaggagtatgacgagtccggtccaagcatcgttcatcgaaagtgcttctag

SEQ ID NO: 2338 - DNA, 1599 bp, Artificial Sequence
  Description of Artificial Sequence: Synthetic coding sequence
atgccacagctgtacatctacatacgtctgctcggggcatacctctttataatttcccgcgtgcaaggccagaacctcgatagtatgttgcacggcaccgggatgaagagtgacagcgatcaaaaaaagtcagaaaatggcgtaacccttgcgccagaagatactctaccattccttaaatgctattgcagcggtcattgtcctgacgacgccatcaacaacacctgtatcaccaatggccactgctttgcaatcattgaggaagacgaccaaggggagacaaccctcgcatcaggttgcatgaagtacgaaggttccgactttcagtgtaaggattcccccaaggctcagcttcgtcggacgatcgagtgctgccggacaaacctgtgcaaccaatacctgcagcccaccctcccgccggttgtgattgggccattcttcgatggatccatcagatggctggtgctactgatttctatggccgtctgcattatcgcgatgataatattctccagctgtttttgctacaaacactattgtaagagcatctctagccggcggcgctacaatcgcgacctcgagcaggacgaggcctttatacccgtaggcgagtcgttaaaggatctgattgatcagagtcagagttcgggaagcgggagtggcttgcctcttttagtgcagcggactatcgcaaaacagatccagatggtgcgtcaagtcggcaaaggcaggtatggcgaagtatggatgggaaaatggagaggcgagaaagtggcagtgaaagttttctttacaaccgaagaagctagctggttccgcgagacagagatttatcagactgttttgatgcgccacgagaatattctggggttcattgctgccgacattaaggggactggcagctggacacaactgtatctgattacagactatcacgagaacggttctctctatgattttcttaagtgcgctaccttggacacaagagcccttctcaaactggcatactctgccgcttgtgggctgtgccatctccacactgagatttacggcacacaaggaaagccagctattgcacaccgggacctgaagagtaaaaatatcctgattaaaaaaaatggatcctgctgcattgctgacctcggcctcgctgtgaaattcaattctgacacgaatgaggtcgatgtgcctctgaatactagagttggcactaagaggtatatggcgcccgaggtgctggacgaatctttgaacaagaaccactttcagccttatattatggcggatatctacagcttcggtctgatcatatgggagatggctcgacgatgcatcaccggtgggattgttgaggagtatcaactgccatattacaacatggtgccctctgacccgtcatatgaagacatgcgcgaggtggtttgcgttaaacgactgagaccaatagtttctaatcggtggaattctgacgagtgcctgcgtgcggtattaaagctgatgagtgaatgttgggctcacaacccagctagtagactgaccgctctgcgtatcaaaaagactcttgcaaagatggtggaatcccaagatgttaagatttag

SEQ ID NO: 2339 - DNA, 456 bp, Artificial Sequence
  Description of Artificial Sequence: Synthetic coding sequence
atgtgcgaggaggaggactcgacagccctggtgtgcgataacggctccggcctgtgtaaagcaggttttgccggagatgatgcaccccgcgcagtattcccaagcattgtgggcaggccacggcatcagggtgttatggttggaatgggacagaaggactcttatgttggtgacgaggcacaaagcaaacgtgggattctgaccctgaagtatcctatcgaacacgggatcattacgaactgggacgatatggagaaaatctggcatcactccttttataacgaactgagagtggccccagaagaacatccaacccttctcactgaagccccactgaatccaaaagctaatagagagaagatgacccagattatgttcgagacatttaatgtaccagccatgtatgtggcgatccaggctgttctgtccttgtacgccagcggccggactacctag

SEQ ID NO: 2340 - DNA, 456 bp, Artificial Sequence
  Description of Artificial Sequence: Synthetic coding sequence
atgtgcgaggaggaagatagcaccgccttggtatgcgacaatggaagcgggctctgcaaggccggattcgctggagacgacgcgcctcgagccgtgttcccttccattgtcggacgaccccggcaccagggtgtgatggtcggaatgggccagaaggatagctacgtcggcgacgaagcccagagtaaaaggggaattctgactctaaaatatcccattgagcacggcattatcaccaattgggatgatatggaaaagatctggcatcactccttttacaacgagctgcgagtcgctccagaagaacaccccaccctattgacggaggcgccactcaatcctaaagcaaatagagagaagatgacgcagattatgtttgaaacatttaacgtgccggcaatgtatgtcgctattcaggctgtcctgagtctttatgcgtccggccgtacaacttag

SEQ ID NO: 2341 - DNA, 1134 bp, Artificial Sequence
  Description of Artificial Sequence: Synthetic coding sequence
atgtgtgaggaagaagactcaacagccctggtctgcgacaacggaagtggactttgcaaggcgggtttcgccggcgatgatgcgccccgtgctgtgttcccaagtatcgttggccgccctcggcatcagggtgtaatggttggaatgggtcaaaaggactcctatgtcggcgatgaagcacagtccaaaagaggcatccttactctgaaataccctatcgagcacgggatcatcacaaattgggacgatatggagaaaatctggcaccactcattctacaacgagctgcgcgtggcccccgaggaacacccgactctcctgaccgaggcccccctgaaccccaaagctaatagagagaaaatgacacagatcatgttcgaaacattcaatgttccagccatgtatgtggccattcaggctgtcctgtctctgtacgccagcggccgcaccaccggaatcgttctcgattcaggcgacggcgtcacacacaatgttcctatctatgagggttacgcgctgcctcacgctatcatgagattagacctggccggccgggatctgacggactacttgatgaaaattctgacagaaagaggttatagttttgtcaccaccgcagaacgagaaatagtgagagacataaaggaaaagctttgctatgtggcgctggatttcgagaatgaaatggcaaccgcagcctcttcgagcagcctggagaagtcctacgaattacccgacggtcaagttattaccattggtaacgagaggttccgctgtccagaaacattgtttcagccgagctttataggaatggagtcggccgggattcacgagactacatacaacagcatcatgaaatgtgacatcgatattagaaaggatctatacgcaaacaacgtgctgagcggcggcacaaccatgtacccagggattgcagacaggatgcaaaaagaaatcacggctctggccccttccacaatgaaaatcaagattatcgccccgcccgagagaaaatattccgtctggatcggggggagtatactcgctagcttaagtacttttcagcagatgtggatctcaaagcaggaatatgatgaggccgggccctccattgtgcacagaaagtgcttctag

SEQ ID NO: 2342 - DNA, 999 bp, Artificial Sequence
  Description of Artificial Sequence: Synthetic coding sequence
atggtgggaatgggacaaaaagattcgtacgtgggggacgaagctcagtccaagcgcggcattctgactttaaagtaccctatcgaacatggtatcattacaaactgggacgacatggagaaaatttggcatcactccttttataacgagctgcgggttgccccggaagaacatcccaccctcttaactgaagctcctctgaaccccaaggcaaatcgggaaaaaatgacgcagatcatgtttgagacctttaatgtgcccgctatgtacgttgcgatccaagcggtgctgagcctctatgcaagcggcaggaccaccggcatcgtgttggatagcggggatggtgtcacccacaatgttccaatttacgagggttacgccttgccccacgcgatcatgaggctcgacttggctggccgcgatctcacagactacctcatgaaaattctgaccgagcgaggctacagtttcgtgaccacagcagaacgcgagatagtgcgcgatatcaaagagaaactgtgctatgtggccttagacttcgagaatgagatggcaacagccgcatctagctcatccctggaaaagtcctatgaattgccagatggccaggtcatcactattggcaacgagagattcaggtgccctgaaaccttattccagcccagttttatcgggatggagtcagccggcattcatgagaccacttacaactccattatgaaatgtgacattgacatccgtaaagacttatacgcaaataacgtgctgtccgggggcaccactatgtatcctggcatagccgaccggatgcagaaggaaataacagctctcgctccctcaacaatgaagataaaaatcattgcccctcccgaacgcaagtactctgtctggattggaggaagtatcttggcttcgttatctacttttcagcagatgtggattagtaaacaagagtatgatgaggccgggccttccattgtacaccggaagtgtttctag

SEQ ID NO: 2343 - DNA, 1134 bp, Artificial Sequence
  Description of Artificial Sequence: Synthetic coding sequence
atgtgtgacgacgaagaaactaccgcattggtgtgtgacaacgggagcggcttagtaaaagctggttttgctggagatgacgctccccgagccgttttccccagtatcgtcggccgtcctcggcatcagggcgtcatggtgggaatgggccagaaagactcatacgtcggcgacgaagctcagagcaaaagggggatactaacgctcaaatatccgatcgagcacggaattattacaaattgggatgacatggagaagatttggcatcatacattctataacgagctccgtgtggccccagaagaacatcccacgctcttgacagaggcccccctgaatccaaaggctaaccgggagaaaatgacacaaatcatgttcgaaacattcaatgtgcccgcaatgtatgttgctattcaggctgtcctcagtctgtacgcgtcgggtagaacaaccggcatcgtgctcgacagcggcgatggcgtcacacacaacgtgccaatatacgagggatacgctctgcctcatgccattatgaggcttgacctcgctggcagggatctgacagattaccttatgaagattctgactgagcgcggctattcgtttgttacaaccgctgaaagggagatagtgagagacataaaggaaaaactgtgttacgtagcactcgatttcgaaaacgagatggctaccgctgccagttctagctctctggagaagagctacgagctgcccgatggacaggtcatcacaatcgggaatgaaaggttcagatgtcctgaaaccctgtttcagccatcattcattgggatggaaagtgcgggaattcatgaaaccacatataactcaatcatgaagtgcgatattgacattagaaaagacctctacgccaataatgtcctgtcaggcggcacaactatgtaccccggcattgctgatcggatgcaaaaggagatcaccgcattggcgccctctacgatgaaaattaaaatcattgctccgcccgagaggaagtactccgtgtggatagggggcagcattcttgcatcactctccacctttcagcagatgtggattagcaagcaggaatacgacgaggccgggcctagcatagtccacagaaagtgcttctag

SEQ ID NO: 2344 - DNA, 1029 bp, Artificial Sequence
  Description of Artificial Sequence: Synthetic coding sequence
atgtgcgatgatgaggagacgaccgccctcgtatgcgacaatggcagtggcctcgtgaaggccggcttcgctggcgatgatgcccccagggcagtctttcccagcatagtcggtcgaccccgccaccagggggtaatggtgggcatggggcagaaggattcatacgtgggcgacgaagcccaatcaaagcgtgggatccttacactgaaataccccatagaacatggaataattacaaaggctaaccgagaaaagatgacacagattatgtttgagaccttcaacgtccccgcgatgtatgttgccatacaggccgtgttaagtctttacgcttccggacggaccaccggcattgttctggatagcggtgacggtgttacacataatgtgcccatctatgaagggtatgctctcccccacgccatcatgcgcctggacctcgccgggcgggatctcaccgattaccttatgaaaatccttactgagagagggtacagctttgtgactaccgcagagcgtgagatagtaagggatataaaggagaagctctgttatgtcgccctagactttgaaaacgaaatggctaccgccgcaagttcctctagcctggaaaagtcttacgaactgcctgatggccaggtgatcacaatcggcaatgagcgcttccgctgcccagagacattattccagccgtccttcatcggaatggaatctgctggaattcacgagacgacttacaattcaatcatgaagtgtgacatagacatccggaaggacctatatgcgaataatgtgctcagcgggggaaccacgatgtatccgggcatagccgaccggatgcagaaggagattacagctctggctccaagtactatgaaaattaaaatcattgcacctcccgagcgtaaatacagcgtctggatcggtggcagcattcttgcaagcctgtctacgttccagcagatgtggatatcgaaacaagagtatgacgaagcaggaccttccattgttcacaggaaatgtttctag

SEQ ID NO: 2345 - DNA, 885 bp, Artificial Sequence
  Description of Artificial Sequence: Synthetic coding sequence
atggaaaaaatctggcatcatacattctacaatgagcttcgggtggcccccgaggaacacccagtcttgctcacagaagccccactgaatcctaaggctaaccgcgaaaagatgactcagattatgtttgaaaccttcaatacccccgctatgtatgtagccatccaggctgtactctctttgtatgcgagcggaaggaccactggaattgttatggacagtggtgatggagtgactcataccgtccccatatatgagggttacgctctgccgcatgccatcctgcgtcttgatctggcgggtcgagacttaacagactacctgatgaaaatattaacggagaggggctattctttcacgaccacagcagagcgcgaaattgtgagggacataaaagagaaactgtgctacgtagcactggatttcgaacaggagatggccacagcggcctcctcaagttcactcgaaaaatcctatgaattgccggatggacaggtgattacaatcggaaacgagcgctttcggtgtccagaggccctattccagccttcgttccttggaatggagagttgtggaattcatgaaaccacctttaactctatcatgaaatgcgatgtggatattaggaaagatctgtatgccaacaccgttctgagtggcggtactacgatgtaccccggcatcgctgacaggatgcagaaggagattacagctctggccccgtctaccatgaagatcaaaatcatagcacccccagagaggaaatactcagtgtggataggtggatccatcttggcgtccctgtcaacctttcagcagatgtggatcagcaagcaggaatatgacgagtccggcccctctatcgtgcatcggaagtgtttctag

SEQ ID NO: 2346 - DNA, 1128 bp, Artificial Sequence
  Description of Artificial Sequence: Synthetic coding sequence
atggacgatgacattgcagccctggtggttgataatggatctgggatgtgtaaggcaggcttcgctggagatgatgccccaagagccgtattcccttcaatcgtggggcgtccacgtcaccaaggagtcatggtgggcatgggtcagaaggattcttacgttggagatgaggctcagtcgaagaggggcatcctgactcttaaataccctatcgagcacggtatagtgacgaactgggacgatatggagaaaatctggcatcataccttttacaatgagcttcgcgtggctcccgaggaacatcccgtattgctcacagaggctcccctgaatcctaaggctaatcgtgagaaaatgactcaaattatgttcgagaccttcaatacacccgcgatgtacgttgccatccaggctgtgctgagtctttatgcaagcgggcgcacaacgggaatagtaatggatagtggagacggtgtaacccatactgtgcccatctacgagggctacgccctgccccacgccatcctgcggcttgacctggcgggacgtgacttgaccgattacctgatgaagatattaaccgagcgcggctacagtttcactacgaccgcagaaagagagatcgtgagggacataaaggaaaaactttgctacgtggcactggactttgaacaggagatggctaccgcagcttctagctccagtctcgaaaaatcctacgagctgcctgacgggcaagttataactattgggaatgagcgctttagatgccccgaggctctgttccaaccatccttcctgggtatggaaagctgtggaatccacgagacgacatttaattctatcatgaagtgcgatgtggacatcagaaaggatctgtacgctaatacggttctgtctggaggcacaaccatgtatcccggaattgcagatcgtatgcagaaagagattaccgctctcgcccctagcaccatgaaaattaaaataatcgcaccccccgagcgtaagtatagtgtgtggatcggcggctccattctagcctctctatctaccttccagcagatgtggattagtaaacaggaatacgatgaaagtggaccctcgatagtccatcggaaatgtttctag

SEQ ID NO: 2347 - DNA, 1044 bp, Artificial Sequence
  Description of Artificial Sequence: Synthetic coding sequence
atggacgatgatatagctgccctggtggttgataatggatcagggatgtgcaaggcaggcttcgctggcgacgacgccccccgggctgtgttcccttctatcgtaggaagaccacggcaccagggcgtaatggttggcatcgtgaccaactgggatgatatggagaaaatttggcatcatacattttacaacgagctcagggtggctccagaagaacacccagtactcttgactgaagccccacttaaccccaaagctaaccgggaaaagatgacgcagattatgtttgagacattcaatacaccggctatgtacgttgccatacaggcagtgttaagcctgtatgcttcaggtcgcaccacgggtattgttatggactccggggacggcgttactcacacagtgccaatctacgaagggtacgccttgcctcacgccatactgcgcctagacctggctgggagggacctgaccgactatctgatgaagatcttaacggaacgagggtatagcttcacgacaaccgccgaaagggagatcgtgcgagacataaaggagaagttgtgctatgtggccctggatttcgaacaggagatggcaactgccgcctctagctcatctctggagaaaagttatgagctgccggacggccaggtgataactattgggaatgaacggttccgctgtccagaagctctgtttcagccctcctttctggggatggaatcttgtggaatccacgagaccacattcaattctattatgaagtgtgacgttgatatccgaaaggatctgtacgccaataccgtcctgtctgggggaacaacgatgtaccccgggatagccgatcgcatgcagaaagagattacagccctcgctccatctacgatgaaaataaaaataattgcccctcccgagagaaaatacagcgtgtggatcggcggcagcattttggcctcactctctaccttccagcagatgtggattagcaaacaagaatatgatgagtctgggccgagcatcgtccaccgaaaatgcttttag

SEQ ID NO: 2348 - DNA, 243 bp, Artificial Sequence
  Description of Artificial Sequence: Synthetic coding sequence
atggacgatgatatagccgcactggttgttgataatggcagcggaatgtgcaaagctgggtttgctggtgacgatgctcccagagcggtgttcccctccattgtggggagacctcgccaccagggtgtgatggttggaatgggccaaaaagatagctacgtcggcgatgaagcccagagcaagagaggtatcctgacgctgaagtaccccatcgagcacggcattgtgactaattgggattag

SEQ ID NO: 2349 - DNA, 300 bp, Artificial Sequence
  Description of Artificial Sequence: Synthetic coding sequence
atgctgacaatggatgatgatatcgctgctctggtggttgataacggcagtggaatgtgcaaggccgggttcgccggggacgacgcaccacgagctgtcttcccatctattgttgggcgacctcgtcaccagggggtgatggtgggaatgggccagaaggactcatatgttggcgacgaagcccagtcaaagcgaggaatcctgaccctgaaatatcccattgagcacggcatcgtcactaactgggacgatatggagaagatatggcaccacactttttacaatgaactgcgcgtttag

SEQ ID NO: 2350 - DNA, 495 bp, Artificial Sequence
  Description of Artificial Sequence: Synthetic coding sequence
atggacgacgatatagcagcgttagtagtcgacaacggcagcggtatgtgcaaagccgggtttgcaggtgacgacgccccacgggcggtcttcccttcaatcgttggtcgcccacggcaccagggcgtcatggtaggcatgggtcagaaagattcatatgttggggatgaggcgcaaagcaagcgcggaattttaaccctgaaatatcccatcgaacatggtatcgtgaccaattgggatgatatggaaaagatttggcaccacacattctacaatgaattgcgagtggctcctgaggagcaccctgtcctgttaacagaggcaccgctaaacccaaaggctaaccgtgagaagatgacacagataatgttcgaaacatttaataccccggctatgtatgtggctatccaagccgttcttagcctgtacgcgtccggccgcacgactggaatcgtcatggattccggcgacggcgtgacccatactgtgccttag

SEQ ID NO: 2351 - DNA, 312 bp, Artificial Sequence
  Description of Artificial Sequence: Synthetic coding sequence
atggacgacgacatcgccgccctcgtggtggacaacggatctggaatgtgtaaagccggatttgccggggacgacgccccccgagctgtgtttcccagtatagtaggaagaccacgccatcagggcgtcatggtcggaatgggacagaaagactcatatgtgggcgacgaagctcagagtaaacggggaattttgactctcaaatacccaatcgagcatggcatcgtcaccaattgggacgacatggagaaaatctggcatcacaccttctataacgaactgcgcgtcgccccagaagagcacccagtgtag

SEQ ID NO: 2352 - DNA, 1056 bp, Artificial Sequence
  Description of Artificial Sequence: Synthetic coding sequence
atggatgacgacatagccgctctggtcgtcgataacggttctggcatgtgtaaggctggatttgccggggacgacgcccccagggccgtgttcccatcaattgtgggtcggccacggcaccagggagtgatggtgggaatgggacagaaggactcgtacgtgggtgacgaggcccagtctaaaagaggcatcctcacactgaagtaccctatcgagcacggaattgtgactaattgggatgacatggaaaagatctggcaccacaccttctacaacgagctccgtgtcgcgccggaggagcatcccgtcctattgaccgaagcacccctgaaccccaaagcaaatagggaaaagatgacgcagattatgtttgagacatttaataccccagccatgtacgtggcaatccaagctgttctctctttgtatgcatccggccgcactactgctatacttaggctcgaccttgctggccgagacctcaccgactatctcatgaagatcctgaccgaaaggggttacagtttcacaacaacagccgagcgcgaaatcgtgagagacattaaagagaaactgtgctacgtggcattggattttgagcaggagatggctactgcggcatcatcttcttcgttagagaaaagctacgagctacctgacggtcaagttattacaattggtaacgagagattcaggtgcccagaggccctgtttcaaccatccttcctcggtatggagagttgtggcattcacgagaccacgtttaatagtattatgaagtgcgatgtggatatccgcaaagatctttacgcaaatacggtgctcagcggcggcacaacaatgtatccggggatcgctgatagaatgcagaaggaaattactgctctggcaccctctactatgaagatcaagataatcgcgcctccagagcggaagtattccgtgtggattggtgggtctatcctggccagcctgtcaacgttccagcaaatgtggatttctaagcaggaatatgacgaatcaggacccagcattgtgcatcgaaagtgcttctag

SEQ ID NO: 2353 - DNA, 1131 bp, Artificial Sequence
  Description of Artificial Sequence: Synthetic coding sequence
atgacagacaatgagctgtccgcacttgtggtggataatggctccggaatgtgcaaagcggggttcgggggcgatgatgctccgcgagccgtgtttccttcaatgatcgggagaccaagacaccagggggtcatggtgggaatgggacaaaaagactgttatgtgggagatgaggcccagagcaagagaggagtgcttacattgaaatatcctattgagcacggcgtcgtgacaaattgggatgacatggagaaaatttggtaccataccttttacaacgaattacgtgtagcgcctgatgagcatccaatcttgctcactgaagctcctctcaaccctaaaataaaccgggaaaagatgacccaaatcatgttcgaggcttttaacacgcctgctatgtacgtggctatccaggccgtgctctcactctacgccagcggaaggacgaccggaattgtcatggattcgggtgacggggtgacccatattgtgccaatttacgaaggatacgcattgccacacgccattctgagactcgacttagctggccgcgatctcaccgattacctgatgaagattctcacagaacgaggctacaacttcacaaccacagccgagcgagagatcgtgagagacgtgaaggaaaaactgtgctacgtcgccctcgatttcgaacaggagatggtcagagctgccgcttcctccagccctgagcgttcatatgagctgccggacggccaagtgattactatcggaaatgagcgtttccgctgtccggaagcaatctttcaaccctcattcctagggatcgaaagttcgggaatccatgagacgaccttcaatagtatcatgaagtgtgatgtagatatccggaaggatctttatgcgaacactgttctcagtggcggtagcactatgtatccgggaatagctgatagaatgcaaaaggagatcataacactggctcctagtaccatgaaaatcaagatcatcgctccccctgaaagaaaatactctgtatggatcggaggctccatccttgcctccctgtctacctttcagcagatgtggatcagcaaacaggagtatgatgaagctgggccgccgatagtgcacagaaagtgtttttag

SEQ ID NO: 2354 - DNA, 1128 bp, Artificial Sequence
  Description of Artificial Sequence: Synthetic coding sequence
atggaagaagagattgccgccctggtgatcgacaatgggtctggaatgtgtaaagcgggttttgccggcgacgatgccccgagagcagtctttccatcaatcgtaggccggccaagacaccagggcgtaatggtcggcatgggacaaaaggacagttatgtcggagatgaggcccagtccaagcgaggcattctcactctgaagtatcctatcgagcatggaattgtgacaaactgggacgacatggaaaagatatggcaccacaccttctacaacgaactgcgggtggctccggaagaacacccagtgcttcttacagaggcaccattgaacccaaaagctaatcgagagaagatgacgcaaattatgtttgaaacatttaacacccctgcaatgtacgtggctatccaggcggttctgtcactgtatgcatccggccgaactacagggatcgtcatggattctggggacggcgttacacataccgtgcccatttacgaaggatatgcactcccccacgcaattcttcggctggatttggctggccgcgacctgacagattatctaatgaagatactgacagagcggggttatagcttcactactactgcagaaagggaaattgtccgggacattaaggagaaactgtgttacgttgcactggatttcgaacaggagatggccaccgctgcaagctcatcaagcttagagaagagttatgaactgcctgacggacaagttatcactatcgggaacgaaaggttccgatgtcctgaagccctctttcagccttcttttctgggaatggagagctgtggcatccacgaaaccacattcaattcaattatgaagtgtgacgtagatatacggaaggacctatacgccaacacagttttgagtggcggaaccactatgtacccaggaatagcagacagaatgcagaaggaaataaccgccctggccccatctactatgaaaattaagattattgctccacctgagcgcaagtacagcgtgtggatcggcggctctattttggccagcctctctactttccagcagatgtggatctccaagcaggaatacgatgagagtgggccaagcattgtccacaggaaatgtttctag

SEQ ID NO: 2355 - DNA, 1002 bp, Artificial Sequence
  Description of Artificial Sequence: Synthetic coding sequence
atggaagaggaaatcgcggctctggtcatcgacaacggcagcggaatgtgtaaggccggcttcgccggggatgatgccccccgggcagtttttccttcgattgtgggtcggccccggcaccagggggtcatggtgggcatgggccagaaggattcatatgtcggagacgaggcccagagtaagcggggaatactgacactcaagtatcctatagaacatggcatcgtcactaattgggacgatatggaaaaaatctggcaccacaccttctacaacgaactgcgcgttgccccggaagaacaccccgtcctcttgacagaggcccctttgaaccccaaagcgaacagggaaaaaatgactcagatcatgttcgagacatatgcgcttccacatgctattctgcggttggacctggccgggagagacttgaccgattatctgatgaagatcctcaccgagcgcgggtatagcttcacaaccacagccgaacgagagatcgtgagagacattaaagaaaaactgtgctacgtcgctctcgatttcgaacaggaaatggcaaccgctgcctcttcctcctctctggagaaatcctacgaactacctgacggacaggttattaccatagggaatgaacgtttcagatgcccggaggcgctgtttcagcccagttttttgggaatggagtcctgtgggattcatgaaactacattcaattctattatgaaatgcgatgtggacatccgtaaggacctgtatgccaacacagtgctgtctggaggcaccactatgtacccaggaatagctgacaggatgcagaaggagattacggccctcgccccgagtacaatgaagatcaagatcattgctcctccagaaaggaagtattcagtatggatcggggggtcgattcttgcctctttatcaacattccaacagatgtggattagtaaacaagaatatgacgagtctgggccaagtattgtacaccgcaagtgcttttag

SEQ ID NO: 2356 - DNA, 1131 bp, Artificial Sequence
  Description of Artificial Sequence: Synthetic coding sequence
atgtgtgaggaggaaacgacagcgctcgtttgtgataacgggagcggactttgcaaagcaggcttcgcaggtgacgatgcgccgcgtgcagtgttcccgagcatcgtggggcgtccaaggcatcagggcgttatggtgggcatgggtcagaaagactcctatgtaggggacgaggcccaatcaaagaggggcatcctgaccctcaaatacccaatcgagcacggcataattactaactgggatgacatggaaaaaatctggcaccactcgttctataatgaacttcgcgttgccccagaagagcatccaaccctgttaacagaagcgcccctgaaccccaaagctaacagagagaagatgacacagattatgttcgaaacctttaacgttcctgccatgtatgtggctatacaggctgttttgtcgctgtatgctagtgggaggaccactggcattgttctcgattccggcgacggagtcacccataacgtccctatatatgaggggtacgccctgccacatgctatcatgcgcctggatttggctggcagagacctgactgactacctaatgaagatcctgactgagcgtgggtactcctttgtcaccactgcagagcgggagattgtcagggatattaaggagaagctctgctacgtagctttggatttcgaaaacgaaatggccacagccgcctcgtcatcctcattggaaaaatcatatgagctgccggatggacaggtgataacaatcggcaacgaaagattccgttgccccgagactttgttccagccttcattcatcggaatggagtcagcgggtatccatgaaactacttacaactctattatgaaatgcgacatcgacattcggaaggatttgtatgcaaacaatgtgctcagcgggggcacaaccatgtaccctggaatagcggacaggatgcagaaggagattacagccctggcgccctccacaatgaagatcaagataatcgcccctcccgaaagaaaatattcagtgtggatcggtggtagtattctggcatccctttctacctttcaacagatgtggatctccaaacctgaatacgatgaggcaggcccttccatcgtacatcgcaagtgtttttag

SEQ ID NO: 2357 - DNA, 1131 bp, Artificial Sequence
  Description of Artificial Sequence: Synthetic coding sequence
atgtgtgaagaggagaccaccgccttggtgtgtgacaacgggtcaggactctgtaaagcagggttcgctggggatgatgctccacgcgctgtgtttcccagcattgtcggccgaccacggcatcagggcgttatggtgggcatggggcagaaggatagctatgtcggggacgaggcgcagagcaaaagaggcatccttaccctcaagtacccaatagaacatggtatcatcacaaactgggatgatatggaaaagatttggcaccactctttctataacgaactccgggtggcgccagaagagcaccctaccctcttaactgaggctcctctgaaccccaaggctaaccgcgaaaaaatgacacagatcatgtttgaaacttttaatgtgcccgcgatgtacgtggctatccaggccgtgctgagtctgtacgcctcaggccgcacaaccgggatcgtccttgatagcggggacggtgtcacccataatgtgcctatctacgaaggctatgcacttccgcacgccataatgcggctggacctggccggacgggacttgaccgattatctcatgaagatcttgacggaacgaggctactccttcgtcaccactgcggagcgcgagatcgtccgtgacataaaagaaaagctctgttacgtagcactcgacttcgagaatgagatggcaaccgctgcatcatcctcatcactcgaaaaatcatatgaacttccagatggacaggtgatcaccattgggaacgaacgcttcaggtgccccgaaactctattccagcccagctttatcggtatggaaagcgctggcattcatgagactacctacaattcgatcatgaaatgtgatattgatattaggaaagacctctacgctaataatgtgctttcgggggggacaacaatgtatcctggaatcgcagatcgaatgcaaaaagaaattacagctctagccccaagcactatgaaaattaagatcatcgctcctcccgagcggaaatatagcgtatggatcggcggctcaatcctggcctccctgtctacgttccagcagatgtggatttcaaagcctgaatatgacgaggctgggccctccatcgtccaccgtaaatgtttctag

SEQ ID NO: 2358 - DNA, 1164 bp, Artificial Sequence
  Description of Artificial Sequence: Synthetic coding sequence
atggtggtggaacgggatgacgggtctaccctaatggagattgatggagataaagggaagcaggggggccccacatactacattgatacgaacgctctccgcgtgccccgcgagaacatggaggcaatctctccactgaaaaacggcatggttgaggactgggactcctttcaagctatcctggaccacacctacaaaatgcacgttaaatctgaagcctccctgcacccggtgctgatgtccgaggccccttggaacacccgcgcaaagcgagagaagctgacagagctgatgtttgagcactataacatccccgctttttttctctgtaagactgccgtgctgacggccttcgcaaatggcaggtcaaccggactgatactggattcgggtgccactcacacaacagcaattcccgtacacgatggatacgtcctgcagcaagggattgtcaagtccccactggccggcgatttcattaccatgcagtgtcgggagttattccaggagatgaacattgagttagtacctccttacatgatcgcatcaaaagaggcagtgagggaaggaagtcccgcaaactggaagcgcaaagagaagctgccccaggtcactcgctcttggcacaattatatgtgcaattgtgtcatccaagattttcaggcttcagtgctccaggttagcgactcaacctatgatgaacaggtggccgcccaaatgcctacagtgcactatgaattcccaaacggctataattgcgatttcggggctgaacggcttaaaatacccgaaggcttattcgatccatccaacgtaaaggggctgtcaggaaacacaatgctaggcgtttcgcacgtggtgaccacctccgtgggcatgtgtgacatcgatatacggccaggcctgtatgggtctgttattgtggccggcggaaataccctgattcagagttttactgatcggttaaatcgggaactctcacagaaaacaccaccaagcatgcgcttgaaactgatagctaacaataccacggtagaaaggaggtttagtagctggatcggcggtagcattttagcttccctgggaacgttccagcagatgtggatcagcaaacaggaatacgaggagggaggcaagcaatgtgtcgagaggaagtgcccttag

SEQ ID NO: 2359 - DNA, 1290 bp, Artificial Sequence
  Description of Artificial Sequence: Synthetic coding sequence
atgtctggtggcgtgtatggaggcgatgaggtgggggctttagtgtttgacattggctcttatactgttagagcagggtacgcaggcgaggactgtcctaaggttgatttccccactgctatcggaatggtggttgagagagatgacggatcgacgctgatggaaatcgacggggataagggtaagcagggcggcccaacatactatattgataccaatgccctccgggtcccccgcgaaaacatggaagccatttcacccctgaaaaacgggatggttgaggattgggacagttttcaggctattctagatcacacgtataagatgcatgtcaagtccgaggcgagcttacacccagtgctgatgagtgaggcaccatggaacacaagagccaagcgggaaaaacttaccgagctgatgttcgagcactacaacattcccgcctttttcctgtgtaaaactgcggtgcttactgcgtttgcaaatgggagatccacgggcttgatcctagattccggcgcaactcacaccacagccatccccgtgcacgacggctacgtcctgcaacaggggatcgtaaaatcccctctagctggcgattttatcacaatgcagtgtagggagctttttcaagaaatgaatatcgaacttgtgccaccttacatgatcgctagtaaggaagctgtgagagagggatcacccgcaaactggaaaaggaaggagaaattgccgcaggtgaccaggtcttggcataattacatgtgtaattgcgtgatccaggattttcaagcctctgtgctgcaggtgtcggattccacctatgatgaacaggtcgccgctcaaatgcccacagttcactacgaattccccaacggctacaactgtgattttggggctgagcgtcttaagattcccgagggactgttcgatccaagcaacgtgaagggtctcagcgggaataccatgctcggcgtgtcacatgtcgtaacaactagtgtggggatgtgcgacatcgacatccgaccaggtctttatggctccgtgatcgtggcaggcggaaataccctgatccaatcctttacagacagactaaaccgcgagctgagccagaagaccccgccgagcatgaggctgaagctgatagcaaacaacacgactgtggaacgccgcttttcatcatggattggtggctccatattagcctcattaggcacgtttcaacagatgtggataagtaagcaggaatacgaagaaggaggcaaacagtgtgtggagcgaaagtgtccttag

SEQ ID NO: 2360 - DNA, 1164 bp, Artificial Sequence
  Description of Artificial Sequence: Synthetic coding sequence
atggttgtagaacgagacgatggttctaccctaatggaaattgacggcgataaaggtaagcagggagggccaacatactacattgacaccaacgcattgagggtccctagagagaacatggaggccattagtccactaaagaacgggatggtagaggactgggatagtttccaggccatcctggaccacacctacaagatgcacgttaaaagtgaagccagcctgcacccagtactgatgtccgaggcaccttggaacacacgggctaaaagagaaaaactgaccgagttgatgttcgaacattacaacattcctgcttttttcttatgtaagacagctgtacttaccgcatttgctaatgggcggagtacagggttgatcctggatagtggggccactcacacaaccgctattcctgtgcacgacggatacgtcttgcagcaggggatagtgaagtctccactggctggtgacttcattactatgcagtgtagggagctctttcaggaaatgaatatagaacttgtgccaccttatatgattgcctccaaggaggcagtgagggaaggcagtcctgcaaactggaagaggaaagagaagcttccccaagtgacgaggagctggcacaactacatgtgtaactgtgtgattcaggattttcaagcctccgttcttcaggtgagcgatagcacgtacgatgagcaggtcgcagcacagatgcccaccgtgcactatgagtttccgaacgggtataactgcgacttcggggccgagcggcttaagattccagagggtttgtttgatcctagcaacgtcaaaggcttatccggtaacaccatgctgggcgtgtcccacgtcgttacgaccagtgtaggcatgtgcgacatcgacatcaggcctgggctatacggatcagtgatagtcgccggcgggaatactttgatccaatcctttactgataggctcaatagggaactctcacaaaagacccctcccagtatgcgcttgaaactgattgcaaataatacaacagtagagagaaggttctcgagctggattggaggctctatcctcgcgtccctggggacattccaacagatgtggatcagcaaacaagaatacgaggagggaggcaaacagtgtgtcgagcgtaagtgcccctag

SEQ ID NO: 2361 - DNA, 153 bp, Artificial Sequence
  Description of Artificial Sequence: Synthetic coding sequence
atggtcgtggaacgcgacgatggaagtaccctgatggaaattgatggcgacaagggaaagcaagggggcccaacatattacattgacactaacgcgctgagggtcccccgcgagaatatggaggccattagcccattgaaaaacgggatgtag

SEQ ID NO: 2362 - DNA, 1281 bp, Artificial Sequence
  Description of Artificial Sequence: Synthetic coding sequence
atgagcgggggcgtttatggaggtgacgaggtcggggctctcgtgttcgatataggttctttcagtgtgcgtgccggttacgccggggaagattgcccaaaggccgattttccgactacagtcgggctactggcggcagaggaggggggtgggcttgagttggaaggagataaagaaaagaagggcaaaatattccacatcgataccaatgctttacacgttcctcgggatggcgccgaggtgatgtcccctctcaagaatgggatgatagaggactgggagtgctttcgtgccatactggaccatacttattcaaagcacgtcaagagtgagccaaatctgcatcctgtgctcatgtccgaggctccgtggaacacccgagcgaagcgggagaagttaaccgaactaatgtttgagcaatacaatattcctgcattcttcctctgtaagacggccgtgctcacagcattcgctaacggtagatcgaccgggctcgtgctagactccggcgcgacccacacaacagcaatccccgtacacgacgggtatgtgctgcagcagggtatcgttaagagccccttggccggcgattttatcagcatgcagtgccgggaactgtttcaggagatggccattgatatcatccccccttacatgattgccgcaaaagaacctgtgagagaaggcgctccacccaactggaagaaaaaagaaaagctgcctcaggtaagcaaatcctggcataattatatgtgtaacgaagtcatccaggatttccaagcttcagttctgcaggtatccgattccccctacgacgagcaggtggctgcccagatgcctactgtgcactatgagatgcccaacggctacaataccgattatggagcagaaagactgcgcatcccagagggattgtttgacccaagcaacgtgaagggtctttctggcaataccatgttgggcgtgggacacgtcgtcaccacttccatcggaatgtgtgatatcgatatacggcccggcttatatggatctgtgatcgtgaccggcggcaacacgttgctgcagggcttcactgaccgactgaaccgggaactcagccagaaaactcctccttcaatgcggctgaagttgattgctagtaactcaaccatggaacgtaaatttagcccctggatcgggggaagtatcttggcttcgcttggaacgtttcagcagatgtggataagcaaacaggagtacgaagagggaggtaagcagtgcgtggagcgtaaatgcccctag

SEQ ID NO: 2363 - DNA, 1308 bp, Artificial Sequence
  Description of Artificial Sequence: Synthetic coding sequence
atgtgggcacccccagccgcaatcatgggcgacgggccgaccaagaaagttggtaaccaggcccctctgcagacacaagctttgcagacagcctcactgagagatggtcctgccaagagagccgtgtgggttcgtcacactagctccgagccacaggagcctacagagagcaaggccgccaaagagaggcccaaacaggaggtgactaaggcggtggtggtcgacctcggcaccggatactgcaaatgtgggtttgccgggctccccagaccaactcacaagatatccacgaccgtcggcaagccatacatggagaccgcaaagaccggcgacaaccggaaggagaccttcgtgggacaggagctgaacaacacaaacgtccatctgaaactagttaaccccctccgccacgggatcattgtggattgggatacagtgcaggacatttgggaatacctctttagacaggagatgaaaattgcccccgaggagcacgctgtcctcgtgagcgacccgcccctcagtccacataccaaccgggaaaaatatgcggaaatgctattcgaggccttcaatactccagcaatgcacatcgcctatcaaagccgtttgtctatgtattcctatggcaggacttccggtctcgtggtggaggtgggtcatggagttagctacgtggttcccatatacgagggataccctctgccctctattacaggcagacttgactacgctgggagtgatcttactgcctacctcctgggcttgctcaactcagctgggaatgaattcactcaggaccagatgggtatagtcgaggacataaagaagaaatgctgtttcgttgctcttgaccccatcgaggaaaaaaaagtgcctctcagcgagcacaccattcggtatgtcctgcccgatggtaaggagatccaactctgtcaagagagatttctgtgttccgagatgttcttcaaaccctcactgattaagagcatgcagttggggcttcacactcagacagtgtcatgtcttaataaatgcgacattgctctgaagcgcgacctcatgggtaacattctcttatgcggagggtccaccatgctgtccggtttcccaaaccgactgcagaaggaactgtcatccatgtgtcccaacgacactccccaggtgaacgtcctgccggaacgcgactctgccgtatggacaggcggcagcatcttggcctccctacagggcttccagccactgtgggtccaccgcttcgaatacgaggagcacgggccattttttctttataggcggtgtttctag

SEQ ID NO: 2364 - DNA, 1248 bp, Artificial Sequence
  Description of Artificial Sequence: Synthetic coding sequence
atggcgaccagaaacagccccatgcccctggggaccgcacaaggtgaccccggcgaagcaggaacgcggccggggcccgatgcaagtctgcgagacacaggcgctgccacccagctgaagatgaaaccccggaaggtgcataagatcaaagcggttatcatagacctgggttctcagtactgcaagtgtggttacgccggcgagccccggccaacgtactttattagctcaacagtcgggaaacggtgcccagaagccgctgacgcgggagatactcgtaaatggaccttagtaggtcatgaactcttgaacaccgaggcgcctctgaaactcgtgaatccactgaagcatgggatagtggtagactgggattgtgtgcaagacatttgggagtatatatttcgcacagctatgaagatacttcctgaggaacacgccgtgctcgtgtcggaccctcccctatccccctcctccaatagggagaaatatgctgagcttatgtttgaaacattcggcatacccgccatgcatgtaacatcacagtcccttttgtccatctattcttacggtaagacttccggccttgtagtggagtccggccatggtgtcagtcacgtggtgccaatttcagagggagacgtcttacctggactcacatcccgcgccgactacgccggcggcgatttgactaactacctaatgcagctactgaacgaagcaggacatgcctttacagacgaccacctgcacattatagagcacatcaaaaagaagtgttgctacgcagctttcctgcccgaagaggaactaggacttgtaccggaagaattgagggtggattacgaacttccggatgggaagttgatcaccatcggtcaggagagattccgttgctccgaaatgctattccaaccaagtcttgcgggatctactcagccggggctgcccgagttaacagccgcctgtctcggcagatgccaggacaccgggtttaaggaggagatggccgcaaatgtcttactttgtggaggctgtaccatgttggacggtttccccgagcgattccaacgggagctctctctgctttgccctggagactcgcctgcagtggccgctgcaccagagcgcaagacctccgtttggacgggggggtcaatcctggctagtttacaggccttccaacaactgtgggtcagcaaggaggaattcgaagagcgggggagcgtagccatctatagcaagtgctag

SEQ ID NO: 2365 - DNA, 1101 bp, Artificial Sequence
  Description of Artificial Sequence: Synthetic coding sequence
atggccgctcggaccgtgataatcgaccatggatctggcttcttgaaggcagggaccgcgggatggaatgagcctcagatggtgttcccaaacatcgtgaactaccttccatgcaaggagaatcctggaccaagctatgcaagacgacgcgtatcattaggtattgacatttgtcatcccgataccttcagctaccctattgagaggggaagaattttgaattgggaaggtgtgcagtatctgtggagctttgtgttggaaaaccatcggcgggagcaagaggtaccaccagtgattatcaccgagactcccctgagagagcccgctgaccgaaagaaaatgttagagattctcttcgaactgctccacgtcccttctgtactgctcgcggatcagctgcagatgagcctctacgcatctgggctgttaacaggggtagttgttgacagcggttatggccttacccgtgttcagccttttcaccaggggcgccctctgcccgcctccggcaagacactagagttcgccgggcaggacctctccgcgtacttgctgaaaagcctctttaaggaagactgtgaccggagatgtttgtttcagctggaaacagtcgccgtaactcaaatgaacaagtgctacgtgccacagaatctgggagaggccctggattttagagaaaggcagcagtccgccctggacgagagcaacacctaccagctacctgacggctctcgtgtggaattgactcccatgcagagggtcgcgcctgagatgtttttcagcccacaggtcttcgagcaaccaggtccttcgatcccccgggctattgtggagagcgtggagtcttgcgagatttcattgaggccccttctggtttcacacgtgatggcatgtggaggtaacacattgtatcccggcttcacaaagcgattgtttcgggagctgatgggagatcatgtctcctccacgaaggcaacagtgtgggaagggagcaaccgtaattttagtgtctggctgggagcctcagtagtggcccatctgtccacctaccaaagcgaatggatgtccagagaggagtacggagaacacatgcggatgtag

SEQ ID NO: 2366 - DNA, 1251 bp, Artificial Sequence
  Description of Artificial Sequence: Synthetic coding sequence
atggatgcatcacgtcccaaatccagcgagtctcaatcttccctggaggccccccgccccggtcctaatccaagtccgaacgtggtcaataaaccactgcagcgtgacttccccggtatggtagccgatcgcctcccaccgaaaaccggggttgtggtcatcgatatgggaactgggacatgcaaagtcggttttgctggtcaagcttctcccacctacacagtggccactatattggggtgtcagcctaagaagcccgctacttcagggcaatcgggcctgcaaacattcatcggtgaagcagctagggttctgccggagttgactctcgttcaacctctgaggagtggaattgtcgtcgactgggacgcggctgagcttatttggcgccacttgctggagcacgacctcagagttgctacccacgaccatccacttctcttttctgatccaccgttttcgcccgcgaccaaccgagaaaaattggtggaggtggcatttgagagcttgcgctctcccgcaatgtatgtcgctagtcagtctgtgttaagtgtgtacgcacatgggagagtgtcaggcctagtggttgacacgggacatggggttacttacactgtccccgttttccagggctacaacctgttgcacgcaacagagcgtttagatctcgccggaaatcatttgactgccttcctcgcggagatgctgctccaagcaggactccctttagggcaacaggatcttgacctggtggagaacatcaagcatcattactgctatgtggcctctgattttcagaaagagcaggcgcgaccagagcaggagtataaacgaactctgaaacttcctgacggtcgcaccgtgactttgggtaaggagttgtttcaatgcccagaacttttatttaaccctccagaggtgcctggcctttctcccgttggactttctaccatggctaagcagagtctgaggaagttgagccttgagatgcgcgcagacctggctcagaacgtcttattatgtgggggctctagtctgttcacaggtttcgaagggaggtttagagctgagctcttgcgagctctcccagcagagacccacgttgtagtagcagcgcagccgactcggaactttagtgtgtggatagggggttcaatcctcgcatcactgagagcttttcagtcatgctgggtgctgcgggaacagtacgaggagcaggggccgtacatagtgtataggaagtgttattag

SEQ ID NO: 2367 - DNA, 2763 bp, Artificial Sequence
  Description of Artificial Sequence: Synthetic coding sequence
atggaggttcagctcggactgggccgggtctacccacggcccccgagtaaaacctatcgcggcgcttttcagaatttattccaatccgtgagagaggttatccagaacccgggcccaaggcatcctgaagcagcgtccgctgcaccacctggcgctagtctattattactgcagcagcagcagcagcagcaacagcagcagcagcaacagcaacagcagcaacagcagcagcaacagcaggagacttctccccgacaacagcagcagcaacagggcgaggatggatcacctcaggctcatcggagagggccaaccggttacctggttctcgacgaagagcagcaaccctctcagcctcagtcggcacttgaatgccaccccgaacggggatgtgtgcctgaacccggcgccgccgtcgctgcatcaaaggggttaccccagcagctccccgcaccccctgatgaagatgatagtgccgcgcccagcaccctgagtttgctaggacccacttttccaggcctgtcctcgtgtagcgcagacctgaaggatatcctcagcgaagctagcacaatgcagctgctacagcagcagcagcaggaggcagtgtccgaaggcagtagctctggaagagctagagaggcgagcggagcccccacctcttcaaaagacaactacctcggcggtacctctaccattagcgacaatgccaaggagttgtgtaaagcagtgtctgtgtctatgggccttggcgtggaagcactggaacatttgtcaccaggtgaacagcttcgcggggattgcatgtacgcaccattgcttggcgtgccccctgccgtccggcccacaccatgcgctccattggcagagtgcaaggggagtctcctcgatgactccgctggcaagtctaccgaggatactgctgagtactcaccgttcaagggtggttatactaagggactcgaaggtgaatccctcgggtgcagcggatccgcagccgcaggatccagtggcacactggaactgccctcaacgctgtctttgtataagagcggggcgttggatgaggcagctgcataccagagccgcgattactataactttccactcgccctggcaggccccccaccgcccccgcctccgccccacccgcacgcccgcattaagctcgagaacccactggactacggctcggcctgggccgcggcagccgcgcagtgccgctatggcgacctggcatctcttcatggcgccggagccgccggtcctggctccggctctcctagtgccgccgcttccagctcctggcataccctgttcactgctgaagagggccagctgtatggaccatgcggcggcggcggagggggtgggggcggaggaggcggcggggggggaggcggaggtgggggagggggcggtgaggccggtgctgtcgccccctacggatataccagacctccccaaggacttgccggacaagaatccgatttcaccgcccccgacgtttggtacccaggaggcatggtgtcacgagtcccgtatccatctcccacctgtgtgaagtcagaaatgggcccatggatggactcctactcgggcccctatggagacatgaggctggaaacggcccgtgaccacgtgctgccgatagattactatttccccccacagaaaacttgcttaatctgtggagatgaagcctcaggctgccactacggagccctcacttgtggctcctgtaaggtcttctttaaaagagctgcagagggcaaacaaaaatatctgtgtgcaagccgaaacgactgcactatagataagttccgccgcaagaactgcccctcttgtagattgcgtaagtgttacgaggccggcatgacattgggtgcccgcaaattgaagaaattaggcaaccttaaattgcaagaggagggcgaagcctcctcgacgacatcccccaccgaggagaccacacagaagctgacagtcagccacatagaggggtatgagtgccaaccgattttcctgaacgtcttggaggctattgagcccggggtggtgtgtgctgggcatgataataatcagcctgacagctttgccgccctgctctcctctctgaatgagctaggggagcgccagctggtgcatgttgtcaaatgggccaaagctcttccaggctttcggaatttgcacgtcgatgaccagatggccgtgatacaatactcctggatgggactcatggttttcgctatggggtggcggtcattcaccaatgtgaatagtcgtatgctttatttcgcgccagacctcgtttttaatgagtaccgcatgcacaagtctcggatgtattctcagtgcgtacggatgcggcacttgagccaggaattcggctggcttcagataacccctcaggagtttctgtgtatgaaagcgctgctgttgttcagtataatcccagttgacggcctgaaaaaccagaaattcttcgacgaactgagaatgaattacatcaaggaactggatcgcatcatagcttgtaagcgcaagaatccaacatcatgctcccgccgtttctaccagctgaccaagctactagatagtgtgcagccgattgcacgcgagctccaccaattcacattcgaccttctgatcaagtctcacatggtgtctgtggattttccagaaatgatggccgaaataatctcagttcaagtgccaaaaattctgagtggcaaagtgaaaccgatctatttccacacgcagtag

SEQ ID NO: 2368 - DNA, 1167 bp, Artificial Sequence
  Description of Artificial Sequence: Synthetic coding sequence
atgatcctctggctccactcactcgaaactgcgcgggatcacgtcttgcccatcgattactatttcccccctcagaaaacttgtctgatttgcggggatgaggcttcaggatgccactatggcgctctcacctgtggttcctgtaaggtgttctttaaacgagctgccgagggaaaacaaaagtacctttgtgcttccagaaacgattgcaccatagacaaattccgcagaaaaaattgcccctcttgtcggctgcgtaagtgttatgaggccggcatgacgctgggtgcaaggaagttaaaaaagctaggcaacctaaagcttcaggaggagggcgaggcctcctctacaactagccctaccgaggaaacgacacagaagctgaccgtttcccatatcgaaggatatgaatgtcagccaatattcctgaacgtcctggaggccatagaacccggcgttgtatgtgccggacacgacaataatcagcctgattcctttgccgccctactctcttctttaaatgaactgggggagagacaactagtgcatgtcgtgaagtgggctaaagccctgcctggcttcaggaatcttcacgtcgatgaccagatggccgtcattcagtactcttggatgggtctaatggtgttcgcaatggggtggagaagcttcaccaatgttaatagccggatgttgtatttcgctccagatctggtcttcaatgagtaccggatgcataagagccgaatgtattcacagtgcgtgaggatgcggcacttaagccaggaatttggatggctgcagatcaccccacaggaattcctgtgtatgaaggctttactcctgtttagtatcatccctgtcgatgggcttaagaaccagaaattcttcgatgaattacgaatgaactatatcaaagagctggacaggatcatcgcatgcaagcgaaagaacccgacatcctgctcacgaagattctaccaattgactaagctgctggatagtgtccaacccatcgccagggagctgcaccagttcacgttcgacctgctgatcaagtcccacatggtgtccgtcgattttcccgagatgatggctgaaattatctccgtccaggtgccgaagattctctctgggaaagtcaagccaatctattttcacacccagtag

SEQ ID NO: 2369 - DNA, 2205 bp, Artificial Sequence
  Description of Artificial Sequence: Synthetic coding sequence
atggaggtgcagttggggttgggccgcgtgtaccccagacctccctctaagacttaccggggggccttccagaacctgtttcagtctgtgcgggaggtgatacaaaaccctggcccgagacatccagaggccgcctccgcggccccacccggggcaagcctgctgctgctgcagcagcagcagcagcagcagcagcagcagcaacaacagcagcagcagcagcagcagcagcagcaacaggagaccagccctagacaacagcagcaacagcaaggggaggacgggtcaccccaagctcaccgtcgcgggcctacgggatacctggttctcgatgaggagcaacaaccatcgcagccacaatctgcccttgaatgtcatccagaacgaggttgcgtgcccgaacctggggccgcagtcgccgcctccaaaggcttgccacagcaattaccagctccaccagacgaagacgacagcgcagccccttccaccctgagcctgctgggtcccactttccctggcttgagctcctgcagtgccgatttgaaggatattctgtctgaagctagcactatgcagctgctgcagcagcagcagcaggaagccgtctcggaaggctcgtcaagtgggagagccagggaggcatccggcgcccccaccagctccaaggacaactatttgggcggaacctcaactatttccgataacgcaaaagaactgtgcaaagcagtatcagttagcatgggcctgggcgttgaagccctcgagcacctttctcctggggaacagttgcgtggagattgcatgtacgctcctttgctaggagtacctcctgccgtgcgtccaaccccttgcgccccactagccgagtgtaagggctcactactggatgacagtgccgggaagagcaccgaggatactgcggagtactctcccttcaagggaggttacaccaaggggcttgaaggtgaaagccttggctgtagcggctctgccgcggccggcagctccggtacacttgagctgcccagcactctcagcctgtacaagagtggcgctctggatgaggccgccgcctaccagtcacgggattattataattttcccttggccctagctggcccgccaccacctccaccaccaccccacccacacgccaggatcaaactggagaacccattggactatggtagcgcatgggctgcagccgccgcacagtgcaggtacggggacctcgcaagcctgcacggcgcaggcgccgctgggccaggatcaggtagcccttcagcagccgcctcttcaagctggcacaccctgtttacggcggaagaaggtcagctctacggcccttgcggcgggggtggaggtgggggaggaggcggtggcggtggaggcgggggtggcggtggaggcggcgggggagaggccggggccgtggctccatatggatataccagacccccacagggcttggcgggccaggaatcagatttcacagcaccagatgtgtggtacccaggagggatggtgtcaagggtcccatacccatcaccaacctgcgtgaagtctgaaatggggccatggatggattcctattctgggccctacggcgatatgagattggagacagcgagggatcacgtgctgccaattgattattacttcccgccacagaagacatgcctgatttgtggggatgaagccagcgggtgccattatggagctctcacctgcgggtcatgtaaagtttttttcaagagagcagctgagggaaagcaaaagtacttatgcgcaagtcggaacgactgtaccatcgataaatttagacggaagaattgcccctcctgtcggctgcgaaagtgctacgaggcggggatgacactcggagcaaggaagcttaaaaagctggggaatttgaaacttcaagaagagggtgaggcttcctctacaactagccctactgaagaaactactcaaaagctgaccgtgagccacatcgaggggtacgaatgccaacctatatttttaaatgtgctggaagccatagagcccggagtggtttgtgcgggccacgataacaaccagccagactcttttgccgccctgctgtcaagccttaatgagctgggagagagacagctggtgcatgtggtcaaatgggcaaaagctctccctgattgtgaacgtgctgcctcagtgcacttttag

SEQ ID NO: 2370 - DNA, 1596 bp, Artificial Sequence
  Description of Artificial Sequence: Synthetic coding sequence
atggaagtccagctcggattggggagggtgtaccccagacctccttccaagacatatcgaggcgcctttcagaatttattccagagcgtgagagaggtgatacagaatccgggcccaaggcatcccgaagccgcttcagccgcacctcccggtgcgtcactactgcttctccaacaacagcagcaacagcagcagcagcaacaacagcaacagcaggagacttcaccccgccagcagcagcagcagcagggcgaggatggatctccacaggcacatcgacgcggacccactggatatcttgtcctcgatgaagaacagcaaccgagccagccacaatcagctcttgagtgtcacccagagcgcggctgcgtgcccgagcctggggctgccgtggcggctagcaagggattaccacagcagctgccagctccacctgatgaggacgatagtgcagccccaagcactctgtctctgctcggacccacttttcctggcctgagctcgtgctctgctgatctgaaggacatactaagtgaagcctctaccatgcaacttctgcagcagcaacaacaggaggcggtctcggaaggatcctcttccgggcgggctcgcgaagcctctggtgcacctacgagttcgaaggataactatctaggcgggacctctaccatctcagataatgccaaagaactttgcaaagccgtgtccgtgagtatgggcttaggcgtggaggctcttgaacacctatctcccggcgaacagctgagaggggactgcatgtacgcccccttgctgggagtacctcctgcggttcgccctacgccatgtgcccccctcgccgagtgtaaaggttccctgctggatgatagcgcaggtaagtcaacggaagatactgccgaatacagcccattcaagggcggctacaccaaaggcctcgagggggagagtttggggtgcagtggctccgcagcagccggatcatctggaaccctggaactgccgagtaccctgagcctgtataaaagcggcgcccttgacgaggccgcagcctaccagagtcgggattactacaacttcccactcgcactcgcagggcccccaccaccaccacctccaccccatccgcacgctcgtataaaacttgagaacccactggactatggcagcgcctgggcagccgccgcggctcagtgtagatacggcgatctagcttctctccatggggccggtgctgccggccctggatcagggagcccctcagccgccgcaagctctagttggcacaccctgtttacagcagaagaaggacagctgtatggcccgtgtgggggcggcggaggagggggaggcggcggaggcggaggcggaggaggaggcggcggaggtggtgggggagaggccggcgcagttgccccctatggatatacgaggccaccccagggcctagccggacaggaaagcgacttcacggctcccgatgtgtggtatcccgggggcatggtctcacgggtaccttacccttctccgacctgcgttaagagcgagatgggtccatggatggattcttactctggaccatatggggacatgcgttag

SEQ ID NO: 2371 - DNA, 2217 bp, Artificial Sequence
  Description of Artificial Sequence: Synthetic coding sequence
atgcaattactgcagcagcagcagcaggaggccgtctccgaaggaagttcaagtggcagagccagggaggcaagcggcgcacctacctcaagcaaagacaactatctcggggggacatccaccatttcagataacgccaaggagctgtgtaaggccgtttctgtcagcatgggccttggagtggaagccttggagcacctgtcccccggcgagcagctccgaggtgattgcatgtacgcccctctgctgggtgtgcccccagccgtgcgccctacaccttgtgcaccgctggctgagtgtaagggaagtcttcttgatgattccgccggcaaatcaaccgaagatacggctgaatattcacccttcaaaggagggtacactaagggactggaaggtgagtcactggggtgctcgggatcagccgcagctggatcttcagggactctggaacttccttcaaccctctcattgtataaatccggcgcactcgatgaggcggcagcttatcagtcacgcgactattacaacttccccctggcacttgccggccctccgcctcctccgccacccccccaccctcatgctcgcataaaactagaaaatccactcgattatggcagtgcatgggctgccgccgcagcacagtgtcgctacggggacttggcgtcgcttcatggggcaggagctgccggaccgggtagtggttccccttctgccgcagcctcctccagctggcacaccctgttcacagccgaagaagggcagttgtacggcccttgcggcggaggtggaggcggaggcggaggaggtggtgggggtggaggcggtggagggggcggaggcggaggcgaagccggtgcagtcgccccctacgggtataccagaccgccccagggtctggcggggcaagagtctgattttacggcacccgacgtctggtaccccggcgggatggtgagtcgcgtaccctacccaagtcctacctgtgtcaaatcagagatgggcccctggatggactcatactctggcccatatggagatatgaggttggagacagccagggatcatgttcttccaatcgattattattttccaccacagaagacttgcctaatctgtggagacgaagccagcggatgccactacggcgcattgacttgtggctcttgcaaagtgttcttcaaacgggccgccgagggtaaacagaaatatctttgcgcttctaggaacgattgtactatcgacaagttcagacgcaaaaattgcccaagctgtagattacgcaagtgttacgaagccgggatgactctgggggcgcgaaaattgaagaagttgggtaacctgaaactgcaagaagagggcgaggcatccagtactactagccctacagaggagaccactcagaagttgaccgtgagccacatagaagggtatgagtgtcagccaattttcttaaatgttttggaagctatcgagccaggtgttgtctgtgccggtcatgataacaatcaaccagattcattcgccgcccttctgagctccctaaatgaactcggcgaacgacagctggtccacgtagttaaatgggcaaaggctctgcctggatttcggaacctgcatgtcgacgaccagatggcagtgattcagtatagctggatggggttgatggtgtttgcaatggggtggaggtctttcaccaacgtaaatagtaggatgctgtatttcgcaccagatctagtgtttaatgagtatcggatgcacaagagcaggatgtacagtcagtgtgtaagaatgcgacacctgtcacaggaatttggctggctgcagatcaccccacaggagttcctctgcatgaaggcgcttcttctgttttccatcactttttgcctgcacccaacttccgtgccggtagatggcctgaagaatcagaagttcttcgatgagctgaggatgaactatattaaggaacttgaccggatcatagcatgtaagcggaaaaatcctacaagctgcagcaggcgcttttaccagttgacaaaattgctggacagcgtgcagcccatcgctagggagttgcatcagtttactttcgatttgctcatcaaatctcatatggtgtccgtggatttcccggagatgatggcagagatcatctccgtgcaggtgcccaaaatcctcagcgggaaagtgaagcccatctactttcacactcagtag

SEQ ID NO: 2372 - DNA, 4290 bp, Artificial Sequence
  Description of Artificial Sequence: Synthetic coding sequence
atggtggctgctgccgcggcaactgaggcccgattacgtcggcggacagccgctacagcagccctggccgggcgcagtggcggccctcactgggactgggatgtgacgcgtgccggtcgtcccgggttaggtgcaggacttagactgcctaggttactttctccccctctcaggccgcggctgcttctcttgctgttgcttctctcgccccctcttttgcttttgctgctaccgtgcgaggcggaggcggcggctgcagctgccgcggtgtccggtagcgctgctgctgaagcaaaagagtgcgaccggccctgcgttaatggtgggcggtgcaaccccggtaccggtcagtgcgtctgtcccgcagggtgggtgggagagcagtgccagcactgcgggggacgcttccgcctgaccggtagttctgggttcgtgaccgacggtcccgggaactacaagtacaaaacaaaatgcacatggttaattgagggccagcctaaccgcatcatgaggttgcgctttaaccacttcgctactgagtgtagctgggaccacctgtacgtgtacgacggcgattctatctacgccccactggtggctgccttctcagggttgatcgtgccggagcgggacggcaatgaaaccgtccccgaggttgtggcaaccagtggctatgctctgctccactttttttccgatgccgcatataacctgaccggcttcaatatcacctatagctttgacatgtgccctaataactgcagtggccgaggtgagtgtaagattagtaattcttctgatacagtcgaatgcgaatgttcagaaaattggaaaggcgaggcttgcgatattcctcattgtacggacaattgcggattcccccacagagggatttgtaactcctcagacgtgcgtggctgttcttgtttctccgactggcagggtccgggctgttctgtacccgtgcctgccaatcagtcattttggacacgagaagaatactccaacctcaagctgccccgggcaagccacaaagcagtggttaatggaaatatcatgtgggtcgttggtggctacatgtttaaccacagcgactacaacatggtgctcgcttacgacttagcaagcagggagtggctcccactgaaccggtcagttaataacgttgtggtgcgctatgggcactccctagccctgtacaaggacaagatctatatgtatggagggaagattgactccaccggaaatgttactaacgagctgagagtattccacatccataacgagtcctgggtgttgctcacccctaaagcaaaagagcagtatgcagtggtggggcacagtgcacatattgtgaccctgaagaatggcagggtggtgatgctggtcattttcggccactgtcctctctacgggtatatctctaatgtgcaggagtatgatctggacaaaaatacatggtccatcttgcatacacagggagcactagttcagggcggatatggacacagttctgtgtatgaccacaggacaagggccctgtatgtccatggcggctacaaggccttctccgccaacaagtaccgccttgcagacgatctttacagatacgacgtcgatacacagatgtggacgatactgaaggatagtcgctttttcaggtatctgcataccgctgtaatcgtgtcaggtacaatgctagtcttcgggggcaatacccacaatgatacatctatgtctcacggcgctaaatgctttagttcagatttcatggcctatgatattgcatgtgacaggtggtctgtcctgccccgacctgacttgcaccatgacgttaatcgctttgggcattctgccgttctgcacaacagcaccatgtacgtcttcggtgggtttaactcactgctgttgagcgacattttggtgttcaccagcgagcagtgtgacgctcatagatccgaagccgcctgcctggctgcgggacccggcatccgctgtgtctggaacaccggatcatctcagtgcatcagctgggcactggccaccgacgaacaggaggagaagttgaaaagcgagtgcttttccaagcgcacgcttgaccacgaccggtgtgaccagcacactgactgctatagttgcacggccaatactaatgactgccactggtgcaacgaccactgcgtgccccggaatcactcttgctccgaaggtcagattagcatctttcgctacgaaaactgccccaaagacaacccgatgtactattgtaacaaaaagacctcttgcagatcctgtgccctggaccagaactgccaatgggagccgaggaaccaggagtgtattgctttaccagagaacatctgcggaattggatggcatcttgtgggaaatagttgcctaaaaatcaccaccgcaaaggagaactacgacaacgcgaaactgttttgtcggaatcacaacgcactgctggcctcactgaccacgcagaaaaaagtggaattcgtgttgaagcagcttagaatcatgcagagcagccagtccatgtctaaattgaccctcacaccttgggtgggcttacgaaaaatcaatgtgagttactggtgttgggaagacatgtcccctttcaccaactcacttctgcaatggatgccttctgagccatccgatgcaggtttctgcggaatattaagtgagccgtctacccggggcctgaaggccgcgacctgcatcaatcctctcaacggttcagtatgcgagaggccggcaaatcacagcgccaagcagtgcagaactccttgtgccctgaggacagcctgcggggattgtacctctgggtctagtgagtgtatgtggtgttccaacatgaaacaatgtgtcgactccaacgcttacgttgcatccttcccttttggccagtgtatggagtggtacacaatgagcacttgtccgccagaaaactgtagcggatactgcacctgctcccactgtctagaacagccaggctgcgggtggtgtaccgatccaagcaatacgggtaagggcaaatgcatcgagggatcttataagggtcctgtcaagatgcccagtcaggctccaaccggcaacttttatccccaacctctgctgaacagtagcatgtgtttagaggattcacgctataactggtccttcatacactgccccgcatgtcagtgcaacggtcactcaaagtgtattaaccaatcgatctgcgagaaatgcgagaacctgacaacaggcaaacattgcgagacctgtatcagcggattttacggagaccctacaaatggagggaagtgtcagccttgcaaatgcaacgggcacgcctctttgtgtaacaccaacactgggaaatgtttctgcaccaccaagggggtaaaaggcgatgaatgtcagttgtgcgaggtggagaatcggtatcagggtaaccccctgcgcggcacatgctattacacactattgattgattaccagtttactttttctctcagccaggaagatgaccgatactacactgcaatcaatttcgtcgctacaccagatgagcagaaccgcgatttggacatgtttataaacgcgagtaaaaattttaaccttaacattacctgggccgcaagcttctccgccggaacacaagccggggaggagatgcccgtggtgagcaagaccaacattaaggaatataaagactccttctccaacgaaaagtttgactttaggaatcatccaaatatcacttttttcgtttatgtgtccaactttacatggcccatcaaaattcagattgcttttagtcaacactccaactttatggacctcgtgcagttttttgttacgtttttttcctgctttctgtcactgctgctagtggccgctgttgtgtggaaaatcaagcaaagttgctgggcatctcggagaagggagcagctcctgcgcgaaatgcagcagatggcatctaggccatttgcttcagttaacgtggcactcgagaccgatgaagagccccccgatttgatcggaggctctatcaagactgtgcccaagcccatagccctagagccttgtttcggcaacaaagcggccgtcttatctgttttcgtgcgactccctcgcggtctgggcgggattcctccaccaggacagtctggcttagccgtcgcatccgccctggtggacatctcccagcagatgcccattgtttataaagaaaaaagcggcgctgtgaggaatagaaagcagcagcctcccgcccaacctggaacttgtatttag

SEQ ID NO: 2373 - DNA, 3582 bp, Artificial Sequence
  Description of Artificial Sequence: Synthetic coding sequence
atggtagctgctgcggccgcaacagaagctaggttgcgtaggcgcaccgctgcaaccgcagctttagcaggcagatccgggggaccgcactgcgttaatggcggaagatgcaaccctggaacagggcagtgtgtatgcccggccggatgggttggcgaacagtgtcagcattgcggaggcaggttccggcttacaggatcctctggatttgtgacggatggtccaggaaactataagtataaaacaaaatgtacttggctcattgagggccagccgaatcgcattatgagactgagatttaatcattttgcaaccgaatgtagttgggaccacctttatgtatacgacggcgacagcatctacgcccctcttgtggcagccttttctggtctcatcgtcccagaacgtgacggtaacgagaccgttcctgaagtcgtggccacatccggatatgccctgctgcacttttttagtgatgcggcttataacctgacaggattcaacattacttactcatttgatatgtgtcctaacaattgcagcggacggggagaatgcaaaatctctaatagttctgacacagtggaatgcgaatgttccgaaaattggaagggggaggcttgtgacatcccacattgcacggataactgcggtttcccccacagaggaatttgtaactcttccgatgttaggggatgctcgtgtttctcagactggcagggacccggatgttccgttcctgtacccgctaatcaatccttttggacacgggaagaatactcaaatctgaagcttccaagggcatcccacaaggccgtggtcaatggaaacattatgtgggttgtaggagggtacatgtttaaccacagtgattataacatggttttggcttacgacctggcaagtcgcgagtggctcccgcttaacaggagtgttaataatgtggtggtgcgatacggtcattctctggcactgtacaaggacaagatctatatgtacggtggcaaaatcgacagcactggcaacgtgaccaatgagctgagggttttccatattcataatgaatcttgggtgttgctgacgccgaaggccaaggagcaatatgcagtggttggtcattcagcccacatcgtaacgttaaagaacggcagagttgtgatgctcgttatattcggccactgccccctgtacggctatatatctaacgtacaggaatatgatttggataagaatacgtggtcaattctgcatacacagggtgccctggtacaggggggatacggacatagtagcgtatacgatcatcgcacaagagctttatacgtgcacggcggctacaaggcatttagcgctaataaatacaggcttgctgatgacttgtatcggtacgacgtagatacacaaatgtggacaatcctcaaagatagccggttcttccggtacctgcatacagctgtaatcgtcagtggcacaatgctcgtctttggagggaacacccacaacgacacatctatgagccacggggccaagtgtttctcaagtgattttatggcgtatgacatcgcatgcgaccgctggtctgtactgccaaggcccgatttgcaccatgacgtcaaccggtttggacatagtgcagtgctacataactccactatgtatgtatttggaggttttaatagcttgctcctatccgatatcttggttttcacaagtgagcaatgcgatgcacatcgtagtgaagcggcctgtctggcagctggccctgggattcgctgtgtctggaatactggtagctcccagtgcatctcctgggcactggctaccgatgaacaggaggaaaaactcaaaagcgagtgtttttcaaagcgcaccctcgaccatgacagatgtgatcagcacactgattgttactcttgcactgctaatactaatgattgccactggtgcaatgatcactgcgtaccaaggaaccacagttgcagcgaaggtcagatttccatatttcggtatgagaattgtccaaaagataaccctatgtactattgtaataagaagacatcttgcagatcttgtgctctggatcagaattgccagtgggaacctcggaaccaggaatgcatcgccctaccagaaaacatatgtggtatcggctggcacttggttggcaattcttgtctgaagattaccacagccaaagagaattatgacaacgctaagttgttctgccgcaaccataacgctctgctcgccagcctgactacacaaaagaaagtagaatttgttctaaagcagctccgcatcatgcagtcgtctcaaagcatgagtaaattgaccttgactccttgggtcggtcttcgaaaaatcaacgtgtcgtattggtgttgggaagacatgtctccgttcactaattctctgctgcagtggatgcccagcgaaccatctgatgcaggcttctgtggtatcctgtctgaaccaagcacgagaggcctgaaagcagctacttgtatcaaccccctgaatggtagtgtgtgtgaaaggcccgctaaccactcagcaaaacagtgtaggacaccctgtgcactgcgtactgcttgcggggattgcacaagtgggtcatccgagtgtatgtggtgttccaatatgaagcaatgtgtggacagcaatgcctacgtcgccagttttccctttgggcagtgtatggagtggtataccatgtctacatgccctcctgaaaactgtagtggttactgtacatgttcccattgcctcgagcagccaggatgtgggtggtgtacagacccttccaatactggtaaagggaagtgcattgagggctcatataaaggtcccgtcaagatgcctagccaggctcccactggtaatttctacccccagcccttgctgaacagctctatgtgtctggaggactccaggtataattggtcttttatccactgccccgcgtgtcagtgcaacggacacagtaagtgcatcaaccagtccatctgtgaaaaatgcgaaaacctcacaactggaaagcattgcgaaacctgcatctcgggattttacggcgacccgaccaacggcggcaaatgtcagccctgcaagtgcaatggtcatgcatccctctgcaataccaacaccgggaaatgtttttgtacgaccaagggtgtgaagggagatgagtgtcaattgtgcgaggtcgagaatcgctaccaggggaacccactcagaggcacatgctactacacactcctaattgattaccagtttaccttttcactgtctcaggaagacgatcgctattatacggccattaattttgtcgccactcctgatgagcagaatagggatctggacatgtttataaacgctagtaagaattttaacctgaatataacttgggcagccagcttcagcgctggcacacaggccggtgaggaaatgccagtggtgtcgaaaaccaacattaaagagtacaaggatagctttagtaatgaaaaatttgacttcagaaaccatcccaatattacttttttcgtctacgtgagcaattttacctggcccatcaagatacagtag

SEQ ID NO: 2374 - DNA, 3819 bp, Artificial Sequence
  Description of Artificial Sequence: Synthetic coding sequence
atggtggcagctgccgcagccacggaggccaggttgaggagacggacagcagccaccgccgctctggcgggtcggtctggcggtccacactgggattgggacgtgacccgtgctggaagacccgggctgggcgcaggcttgcgactgccgagattgctgagcccccctctgcggccccggctgctgctgctgctgttactcctgtcgccccctcttttgctcttactgctgccatgtgaggccgaggcagcggcagccgccgccgctgtgagcgggtccgcggccgcggaggcgaaggagtgcgacaggccctgcgtcaatggggggagatgcaaccccgggaccggccaatgcgtctgccctgctggctgggtcggggagcaatgtcagcactgcggcgggaggtttcggctcaccggcagcagcgggttcgtcactgacgggcccggtaattacaagtacaaaactaagtgcacctggttgatcgagggtcaaccaaatagaataatgcggttgaggtttaaccacttcgctacagaatgtagttgggaccatctttacgtatatgatggagattccatatacgcgccgctagtggccgcgttctctggccttatcgtccctgaacgagatggcaacgagacggtgccggaagtggttgccaccagtggatacgccctgctgcacttcttctctgatgctgcgtataatttgactggcttcaacatcacatactccttcgatatgtgtcccaataactgttcaggcagaggagagtgcaagatcagcaattcttcggatacagtggaatgcgagtgtagtgaaaactggaaaggcgaggcttgcgatattccgcactgtactgacaactgcggatttcctcatcggggcatctgtaattcctctgacgttcgaggttgttcctgcttttccgactggcaaggcccaggatgttccgtccccgtaccagcaaaccagtctttttggacaagagaggaatatagcaatctgaagttgcccagagcaagccacaaggcagttgtgaatggcaatatcatgtgggttgtgggcgggtacatgtttaaccacagtgactacaacatggtgcttgcttacgaccttgcctctcgggagtggctccccctgaatcgttctgtcaacaatgtggtggtgcgttatggccattccctcgctctctacaaagataaaatatatatgtatgggggcaagattgactctactggcaatgtgactaacgaattgcgagtgttccacatccacaatgagagttgggttcttctaaccccgaaagccaaggaacagtacgccgttgtcgggcatagcgctcacatcgtcactctgaaaaacggcagagtggttatgttggttatctttggccactgtcctctgtacggatacatttccaatgtgcaggaatatgacctggacaagaatacatggtccattctgcacacacagggcgcccttgttcagggaggctacggacacagctccgtctacgatcaccgcacccgcgcactctacgtgcacggagggtataaagcattttccgcgaataaataccgactggcggacgatctgtacagatatgacgtggacacgcagatgtggacaattctgaaggactctcgtttctttagatatctgcatacagcagtgatcgtgagcggaacaatgctggtgttcggagggaacacacataacgatacctctatgtctcatggagctaaatgcttttccagtgacttcatggcatatgatattgcctgcgatagatggtctgtcttgccaaggcctgacctgcaccacgacgtcaacaggttcggtcacagtgcagttctgcataacagcactatgtacgtatttgggggcttcaattccttgctcctgagtgatattctggtatttacttccgaacaatgcgatgcacaccgcagcgaagcagcttgcttagccgcaggccctggcatccgatgcgtctggaacacaggaagctcccaatgcatctcctgggcccttgccactgatgagcaggaagagaagttaaaatcggagtgcttctccaaaagaacactggaccacgatcgctgcgaccagcacaccgactgttatagctgcaccgcaaacactaatgactgtcactggtgcaatgatcactgcgtgccccggaaccactcctgcagtgaaggccagatttcaattttccggtacgagaactgtcccaaagataaccccatgtattattgcaataaaaaaacttcctgtcgaagttgtgccctcgatcagaactgccagtgggaaccgcggaatcaggagtgtattgctttaccggaaaacatttgcggcatcgggtggcacctggttggtaattcctgcctcaaaataaccacagcgaaggaaaattatgacaacgctaagttattctgccgtaaccacaacgcgctgttggctagcttgaccactcagaaaaaagttgagtttgtgctgaaacagttacgcataatgcagagtagtcagagcatgagtaaactgacattgactccatgggtaggactgcggaagataaatgtctcgtattggtgctgggaagacatgtccccatttactaatagtcttctgcagtggatgccctctgagccctctgatgcaggcttctgcgggattttgtccgagccaagtactcgggggttaaaggcagcaacatgtattaaccccctgaatggctcggtctgtgagagacccgcaaaccattccgccaaacagtgtcgcaccccatgcgccctgagaaccgcctgtggggactgcacatctggatcttcggagtgtatgtggtgtagtaacatgaaacaatgcgtggattccaatgcttatgtcgcatcctttccctttggacagtgcatggaatggtacactatgagcacttgtccaccagaaaattgctccggatattgcacatgttcacactgcctggagcagcccggctgcggctggtgcacagacccctccaacactggcaagggaaaatgtatcgaaggatcttacaaagggccagtgaagatgcctagtcaggcccccacgggcaacttctatcctcaaccactgctcaactctagcatgtgcctggaagatagcaggtacaattggagctttatccactgccccgcatgtcaatgtaatggtcactctaagtgcatcaaccagtccatctgcgagaaatgtgagaatctgactaccggaaagcactgtgagacttgcatatccggattctatggtgatcccaccaacggaggcaagtgccagccttgtaagtgcaatggacacgcgtccctgtgtaacacaaataccggcaagtgcttctgtacgactaaaggtgtgaaaggggacgagtgtcagctgtgcgaagttgagaacagataccagggcaaccccctccgaggcacctgttattatactctgcttattgactatcagtttacattttcactgagccaggaggatgacagatactacactgcaatcaactttgtggctacacccgatgagcagaatagggacttggatatgtttatcaacgcttcaaagaatttcaatctgaacatcacctgggccgccagtttctcagccggcacccaagcaggtgaagagatgccagtagtgagcaagactaacatcaaagagtacaaggattccttctcaaacgagaaattcgattttaggaatcatccgaatatcaccttctttgtctatgtcagcaattttacatggcccattaagatccaggttcagacggaacaatag

SEQ ID NO: 2375 - DNA, 768 bp, Artificial Sequence
  Description of Artificial Sequence: Synthetic coding sequence
atgttccaccaggtgaggagagtgatgacaatcttattcctgacaatggtcattagttatttcggctgcatgaaggccgctcctatgaaggaggctaacattcgaggtcaggggggcctggcttatcctggggtccggacgcatggcaccttggagtccgtcaacggcccaaaggccgggtccagaggacttacctctcttgctgataccttcgagcacgttatcgaagaacttttggatgaggatcagaaggtgagacctaacgaggagaacaataaggacgcagatctctatacctctcgagtgatgctgtccagtcaggttcctctcgagcctccgctgttgttcctgctagaagaatataagaattatctggacgctgccaacatgagcatgcgcgtcagacgccatagcgatccagcacgacggggggaactgtctgtttgtgattctatctccgagtgggtcaccgccgcggacaagaaaacggccgttgatatgtctggcgggaccgtcacagtcctggaaaaggtccctgtgtcaaaaggccaattgaagcaatatttctacgagacaaagtgcaatccaatgggttataccaaggagggctgccggggcatcgacaagcgccactggaacagccaatgtcggaccacacagagctatgtgcgggctctcaccatggactccaaaaagaggattggctggagatttatcaggattgacaccagctgcgtgtgtaccttgaccatcaaaaggggccgctag

SEQ ID NO: 2376 - DNA, 744 bp, Artificial Sequence
  Description of Artificial Sequence: Synthetic coding sequence
atgacaattctcttccttaccatggtcatttcttatttcggatgcatgaaagcagctccaatgaaagaggcaaacattcgtggccagggagggctggcctaccctggagttagaacccacggcactctggagtctgtgaacggtccgaaagccggcagtaggggtctaacatcactggcagacacattcgaacatgttattgaagaactgctggatgaagatcagaaagtcagaccaaacgaggagaacaacaaggatgccgatctttatacaagccgcgtcatgctatccagccaggttccactggagccacctcttctgttccttctcgaggagtacaaaaactacttggatgcagccaatatgtccatgcgggtgagaagacatagcgaccccgcgcgccgcggagaactttcagtttgcgattctattagtgaatgggtgactgccgcagacaagaaaactgcagtggacatgtccggcgggacagtgacagtgcttgaaaaagttccagtcagcaaaggccagttgaaacagtatttttacgaaactaagtgcaaccctatggggtataccaaggagggctgtaggggaatcgacaaaagacattggaattcccagtgtaggacaacacagtcgtatgtgcgagctctcactatggacagcaaaaaacggatcggctggcgatttatacgcattgacactagttgcgtctgcaccctcactatcaagcgcggcagatag

SEQ ID NO: 2377 - DNA, 744 bp, Artificial Sequence
  Description of Artificial Sequence: Synthetic coding sequence
atgaccattctgtttctaactatggtcattagttacttcggttgtatgaaggcagcaccaatgaaagaggccaatattcgcggtcaggggggactggcctaccctggtgtgagaacacacgggactttggagagcgtaaacgggcctaaagcgggtagtcgtggcttgacgtctctcgccgatacgttcgaacacgttattgaggaactgttggacgaagaccagaaggtccgacctaatgaggagaacaataaagatgcagatctctatacttcccgtgtcatgctatcttcccaggtccctctcgaacctccactgcttttcttgctggaagaatacaaaaactacctggatgccgccaacatgtcaatgcgcgtgcggagacactccgaccctgctagacggggtgaactgtctgtttgcgactcaatatcagagtgggtcaccgctgcagacaaaaagacagccgtagacatgtctgggggtacagtgaccgtcctggagaaggtccctgttagcaaagggcagctgaaacagtatttctacgagaccaaatgtaatccaatgggctacaccaaagagggatgtagagggattgacaagagacactggaactcccagtgccgtacaacacagtcatatgtgcgcgcactgaccatggactccaaaaagcggatcggttggagatttattcggatagacacttcctgcgtttgtacgctaacgatcaagagggggcggtag

SEQ ID NO: 2378 - DNA, 744 bp, Artificial Sequence
  Description of Artificial Sequence: Synthetic coding sequence
atgacgatactcttcctgacgatggtgataagctattttggatgcatgaaggccgctcccatgaaagaggcaaatatccggggtcaaggagggcttgcataccccggcgtgagaactcatggcaccctggagtcggttaacggaccaaaagccggcagtcgcgggcttaccagccttgccgatacctttgagcatgtgattgaagaattgcttgatgaggatcaaaaagtacgccctaacgaggagaataacaaagatgctgacttatatacctccagagtgatgctatcaagccaggtccctctggagccccctctcctgtttctgctcgaagagtataaaaactatttggacgctgccaatatgtccatgcgggtcagaaggcactccgaccccgccagacgcggagaactgtctgtgtgtgactccatctctgagtgggtgactgccgctgacaagaagaccgctgttgatatgtcagggggcaccgtaacagttctggaaaaagttccagtgtcaaaaggccaactcaagcagtacttttacgagacgaaatgtaatcccatgggatatactaaggaggggtgtcgtggaattgacaaacgtcactggaattctcagtgccggaccacgcaatcatatgtcagagccctcaccatggacagcaagaaaagaattggctggcgttttatccggattgataccagctgtgtgtgtaccctcaccataaagcgcgggcgatag

SEQ ID NO: 2379 - DNA, 744 bp, Artificial Sequence
  Description of Artificial Sequence: Synthetic coding sequence
atgactattctgtttctgaccatggtgattagctattttgggtgcatgaaagcggcgcctatgaaggaagctaacattaggggccaagggggcctcgcctaccccggcgttcgcacacacggaacactggaatccgtgaacgggcccaaagctgggtccagagggttgacctctctcgccgacacctttgagcatgtgatagaggagctgctcgatgaagaccagaaggtgagaccaaacgaagaaaataataaagacgctgatctgtatacgagccgggtgatgctgtcttctcaggtgcctcttgaaccacccctgcttttcttactggaagagtacaagaactatctggatgcggccaacatgtctatgcgcgtccgaagacattccgatcccgcccggaggggagagctgtctgtatgtgattcaatcagcgaatgggtgacggcggcagacaagaagacagctgttgatatgtccgggggtacagttaccgtactggagaaggtgcccgtatctaagggccagctgaagcagtatttctacgaaacgaagtgcaacccgatgggctatacaaaagaaggctgtagaggaatcgataagaggcattggaatagtcagtgccgaacaacccaaagctacgttcgcgccttgactatggacagtaagaagcggattggctggcggttcataagaattgacacgagttgtgtgtgtactctcaccatcaagcggggacggtag

SEQ ID NO: 2380 - DNA, 744 bp, Artificial Sequence
  Description of Artificial Sequence: Synthetic coding sequence
atgactatcctgttcttgactatggtcattagttacttcgggtgcatgaaggccgcacccatgaaagaagccaacatccgcggccaaggggggctggcatatcccggtgtgaggactcatggcacgctggagagcgtaaatggtcctaaggcaggctcccgcggcttgacttccctggccgacacttttgagcacgtgatcgaggagctgctggatgaagaccagaaggtcagacccaacgaggagaacaacaaggatgccgatttatatacttcgagggtgatgttatcatcccaggtaccacttgaaccgcccttgctgtttttgttggaggagtataagaattatctcgacgcagctaacatgtccatgcgggtccgtagacattcagaccctgctcggcggggcgaattatccgtttgtgatagtatttccgaatgggttaccgcagccgacaagaaaacagcagtggatatgagcggtggaacagtcactgtcctagaaaaggtccccgtttcaaaggggcagctgaagcagtacttttatgagaccaaatgcaaccctatgggatatacgaaggagggctgccgcgggatcgataagaggcactggaatagccaatgccgcaccacgcagtcttacgtgcgggccttaactatggatagcaagaagaggattggttggcgcttcattcggatcgacacatcttgcgtgtgcactctgactatcaaaagaggccggtag

SEQ ID NO: 2381 - DNA, 789 bp, Artificial Sequence
  Description of Artificial Sequence: Synthetic coding sequence
atgcagtcgcgggaggaggagtggttccaccaagtgcgcagggttatgacgatccttttcctgactatggttatatcctattttggttgtatgaaggcagccccaatgaaggaagctaacatcaggggacagggtggtcttgcatacccaggagtcagaacccacggtactctcgaatcagtaaatgggcctaaggccggatcaagaggcctgacgtcccttgcggatacctttgaacatgtaatcgaagaactcctggatgaagaccagaaagtccgacctaacgaggagaacaacaaggatgccgatctgtatacttcccgggtgatgttatcatcccaggttcccctcgagcctcctctgctgttccttcttgaagagtataagaactatctagacgcggcgaatatgagcatgcgggtgaggcggcattccgaccccgctagacggggggagctttcagtgtgcgactcgatttccgagtgggtcaccgctgcggataaaaaaacagccgtggacatgtccggtggaacagtgacggtgctggaaaaggtgccagtctcaaaaggccaactgaaacaatacttttatgaaactaagtgcaacccaatgggatacactaaagaagggtgtcggggaatcgacaaacgtcactggaatagccagtgccggaccacccagtcatatgttagagccttaactatggactccaaaaaaagaatcgggtggcggttcatcaggattgatacctcctgtgtgtgtacactcacaataaaacggggtaggtag

SEQ ID NO: 2382 - DNA, 744 bp, Artificial Sequence
  Description of Artificial Sequence: Synthetic coding sequence
atgacaatactgtttttgaccatggtcatcagctattttggttgtatgaaagcagcaccaatgaaggaggcaaacattaggggacagggtggactggcgtaccccggcgtccggacacatggaaccctagagagcgttaacggacctaaggctggttctcgaggtctgacaagcctcgcagataccttcgagcatgtgattgaggagctgctggacgaggatcagaaagtgcgccccaacgaggagaacaacaaggatgcggatctgtacacctcccgagtcatgctcagcagtcaggttcctctcgaacctccattgctgttcctgctagaggaatacaagaattacttagatgcagccaacatgtcaatgcgcgtgcggcggcatagcgatccagcccggagaggtgagctgtcagtctgtgactccatcagtgagtgggtgacagccgccgacaagaaaaccgccgtggacatgagcggtggcactgtgaccgtactggaaaaggtaccggttagcaaaggccagctgaaacagtacttttatgaaaccaagtgtaatccgatgggttacactaaggaagggtgtcgcggaatcgacaaacggcactggaattctcagtgcagaacaacccaaagctatgtgcgtgccctgaccatggactctaagaaacggattggatggcgattcatccggatcgatacctcttgcgtatgcaccttgaccataaagagaggcaggtag

SEQ ID NO: 2383 - DNA, 744 bp, Artificial Sequence
  Description of Artificial Sequence: Synthetic coding sequence
atgaccatactgttcctaactatggtaatctcttacttcggatgtatgaaagctgctcccatgaaagaagctaatatacgaggacagggcggcctggcatatcccggggtgcggacccatggcacccttgaatcagtgaatggccccaaggccggatcaagaggcctcacaagcctcgctgacacctttgagcacgtaatcgaagagctgttggatgaggaccagaaggtgagacccaatgaagaaaacaataaggacgcagacctgtatacttcaagagtcatgctgagctcgcaggttccgcttgagcctccattgttgttcctacttgaagagtacaaaaactatctggatgctgccaatatgagcatgcgtgtgcgaagacattccgaccccgcaaggcggggggaattgtctgtctgtgacagcatttcagagtgggtaacagcagcagacaagaaaacggccgtggacatgtccggtgggacagttactgtcctagagaaagtgccagttagcaaaggccagctgaagcaatacttctacgaaacaaaatgtaaccctatgggatatacaaaagaaggttgtcggggaattgataagcggcattggaactcacagtgccgcacgacgcagtcttatgtgcgcgccttaaccatggattctaagaaacggataggttggcgatttattcgtatagacacatcctgcgtgtgcacgctgacgatcaaacgggggcgctag

SEQ ID NO: 2384 - DNA, 990 bp, Artificial Sequence
  Description of Artificial Sequence: Synthetic coding sequence
atgtgcggggccactagcttcttgcatgaatgtaccaggttaattctcgtgacgacgcagaatgctgagttcttgcagaagggtctccaagtccacacttgctttggggtgtacccacacgccagtgtgtggcatgattgcgcctctcagaaaaaggggtgcgccgtatatctacacgttagcgtggaattcaacaagctgatccctgaaaatggctttattaaatttcatcaagtccggcgagtgatgaccatcctctttttaacaatggttattagctattttgggtgcatgaaagctgccccaatgaaggaggccaacatccggggtcagggcggtctggcatacccaggtgtgagaacccacggtactcttgagtcagtgaacggccctaaggctggatcccgcggtctgactagcttagctgatacattcgagcatgtcatcgaagaattattagacgaggaccagaaagtcagaccaaatgaagaaaacaataaagatgcagatctgtatactagtcgcgtcatgttgagctctcaggttcccctcgagcctccgctcttattcctgttggaggagtataagaactacttagatgctgctaatatgagcatgcgggtgagaagacacagtgatccggctcgaaggggcgaactctcagtgtgtgattctattagcgagtgggttactgctgctgacaagaaaactgccgtggatatgtccggaggcactgtaaccgtgctagagaaggtgcctgtctcaaagggacagcttaagcaatacttctatgaaaccaagtgtaatcccatgggatacacgaaggagggctgcaggggtatagataaacgccattggaactctcagtgtaggaccacccagtcttacgttcgcgcgcttaccatggatagtaagaagaggataggctggaggttcattcgaatagacactagctgcgtctgtactctgaccattaagaggggccgctag

SEQ ID NO: 2385 - DNA, 744 bp, Artificial Sequence
  Description of Artificial Sequence: Synthetic coding sequence
atgactatactctttttaaccatggtgatcagttacttcgggtgcatgaaggcagctccaatgaaagaggccaacatcagggggcagggagggctggcataccctggagtgaggacacacgggaccttagaaagtgtcaacggccctaaggctggatcacgcggcctcaccagtctggccgatacatttgaacatgtaattgaggagctactggacgaggaccagaaggtgcgccctaacgaggagaataataaggacgccgacctatacactagcagggtaatgctatcatcacaggttccccttgaaccaccccttttgtttctgctggaagaatacaaaaattaccttgatgctgctaacatgtctatgagagtgcgtcgacacagtgacccagcacgcaggggtgagctgtctgtatgtgattcaatcagcgaatgggtgactgcagcagacaaaaaaactgcggtggatatgtccggcgggactgttaccgtgctcgagaaggtgccagtttcgaaaggccagctgaagcagtatttctatgagacaaaatgcaacccgatgggctatacgaaggaaggatgccgtgggatcgacaaacgtcactggaattcacagtgtcggactactcagagctatgtgagagcactcaccatggacagcaagaaacggatcggatggcgctttatccgcatcgacacatcttgtgtctgtacactcacaatcaagcggggaaggtag

SEQ ID NO: 2386 - DNA, 744 bp, Artificial Sequence
  Description of Artificial Sequence: Synthetic coding sequence
atgacgatccttttcttaacaatggtgatctcatatttcgggtgcatgaaggctgcccccatgaaagaagctaatatacgcggccagggaggccttgcctaccccggcgttcgaactcacggaactctcgagtcagtcaatggcccaaaggccgggagccggggcttgacatctctagctgatacatttgagcatgttatagaggaactacttgacgaggaccagaaggttaggcccaacgaggagaacaacaaggatgcggacctgtacactagtcgcgtgatgttgagctcccaggtgccgctggagccgccgttactgtttctgctggaagagtacaagaattacttagacgcagcaaatatgtccatgagggtgagaagacactcagacccggcgagaagaggagagctgtccgtgtgtgactcaatcagcgaatgggtcacggctgcagataaaaagactgcagtcgacatgtcagggggaaccgtgaccgttctggagaaagtgcccgtctcgaaaggacaactcaagcaatacttttatgaaaccaagtgcaacccaatgggttacacaaaggaaggttgccgtggtatcgacaaacgtcattggaacagccaatgtcggaccacccagtcctacgtgagagcactgaccatggactcgaagaagcgaatcggttggaggttcatccgcatcgacacaagctgcgtgtgtacccttacaatcaaaaggggcaggtag

SEQ ID NO: 2387 - DNA, 744 bp, Artificial Sequence
  Description of Artificial Sequence: Synthetic coding sequence
atgacgattttgtttctgaccatggtgatttcctatttcggttgtatgaaagctgcaccgatgaaggaagctaacatccgtggacagggtggattggcctatccgggggtgaggactcatggcacattggagtctgtgaatggcccaaaggccggcagccgcggcttaacatcgctcgccgacacgttcgagcatgtgatcgaggagctgcttgacgaagaccagaaggtgcgtccaaacgaagagaataacaaggacgccgacctgtacacatccagggtcatgctgagttcacaagtccctttggaacccccactcttgtttttgttagaagaatacaagaactatcttgacgccgccaacatgtccatgcgcgtaagaagacattcagatccagcccggaggggggaactgtccgtgtgtgacagcatctcagagtgggtgactgccgccgacaaaaagactgccgtagatatgagtgggggaacagtgactgtgctggaaaaggtcccggtatcaaagggtcagctgaagcagtatttctatgaaactaaatgcaacccgatgggttataccaaggaggggtgcagaggaattgacaaacggcactggaactcccagtgccgtactacccagtcttatgtccgcgccttgactatggacagtaaaaagagaataggctggcgcttcatccgaatagacacctcttgcgtatgtacactgacaataaaacgcgggagatag

SEQ ID NO: 2388 - DNA, 744 bp, Artificial Sequence
  Description of Artificial Sequence: Synthetic coding sequence
atgacaattctcttcctaaccatggttatttcctactttggatgtatgaaggccgcccctatgaaggaggcaaacatacgcggccagggcggacttgcttacccaggggtgcgaacgcacggtaccctagagtcagtaaacggcccgaaagctggcagtaggggcttgacgagcctggccgatacttttgaacacgttatcgaggaactcctggatgaggatcagaaagtgcgccctaacgaagagaacaataaagatgcagatctgtataccagtcgggtcatgctctcttctcaggtaccactggaacccccgctgttattccttctcgaggagtataagaattacttagacgccgctaacatgtccatgcgcgtccgccggcactcagatcccgcgaggcggggtgaactgagtgtatgcgattcaatatccgaatgggtaaccgcggctgataagaagactgctgtcgacatgtccggcggcaccgtaacagttctggaaaaggttcccgtgtccaagggacagctgaaacagtacttttatgaaactaaatgtaaccccatgggatacacgaaggagggctgtcgaggtatagacaagaggcattggaatagccaatgccgtacgacccagagttatgttcgggcccttactatggactccaagaagaggatagggtggaggtttattcgcatagacaccagctgtgtctgtaccctgacaataaagaggggacgatag

SEQ ID NO: 2389 - DNA, 744 bp, Artificial Sequence
  Description of Artificial Sequence: Synthetic coding sequence
atgaccatactgtttcttaccatggtcatcagctactttggatgcatgaaggccgcaccaatgaaggaggcaaatattcggggccagggggggctggcctatccgggcgttaggacgcatgggacccttgagtctgtcaatggccctaaggcgggctctcggggcctgaccagcctcgctgacacgtttgagcacgtgatcgaagaactgttggacgaggaccagaaagtgagaccaaatgaggagaacaacaaagacgccgacctatacacttcacgcgtcatgctttcctcgcaggtacccctggagccgcctttactttttttattagaggaatataagaactatctggatgccgccaacatgtctatgcgcgttcgcagacattccgatccagctcggcgcggagaactgagtgtatgtgacagcatctccgaatgggtgacagcagctgacaaaaaaaccgccgtcgacatgagcggcggcaccgttactgtcctggaaaaagtgccggtatctaaggggcagctaaaacaatacttctatgagaccaagtgtaatccaatgggctataccaaagagggttgtcggggcatcgacaagaggcactggaattctcaatgtcgaaccacacagtcgtatgtgagggctctgacaatggacagcaaaaagcgcatcggctggaggttcatccggatcgacacgtcctgcgtttgtacactaacaattaagcgaggcaggtag

SEQ ID NO: 2390 - DNA, 744 bp, Artificial Sequence
  Description of Artificial Sequence: Synthetic coding sequence
atgactatcttatttctgacgatggttatcagttacttcggctgcatgaaagccgcgccaatgaaggaagccaacatccgaggacagggtgggctggcctaccccggcgtgagaacacatgggaccctagaaagcgtgaacggtccaaaggccggtagccggggtttgaccagccttgcagatacctttgagcatgtcatcgaagagctgctggacgaggatcagaaagtgcgccctaatgaagagaacaacaaagatgcagatctgtatacttctcgagtgatgcttagttctcaagtcccgctagagccacccttgctgtttctactcgaggaatataagaattacttggacgcagcaaacatgagtatgagagtgaggagacattcggaccccgcaagaaggggcgagctgtccgtgtgtgactcgatctctgaatgggtcactgctgcggacaaaaaaaccgcagtggatatgtctgggggcactgtcactgtgctggagaaggtgccagtcagtaaaggacagctgaagcagtacttttacgaaactaagtgcaaccccatggggtataccaaggagggatgcaggggcatcgacaagcgtcattggaattcccaatgtcgcacgactcaaagctacgtgcgcgcgctgactatggactctaaaaaacggattggctggcggtttatccggatcgatacatcgtgcgtgtgtactctgactataaagcgcggacgttag

SEQ ID NO: 2391 - DNA, 744 bp, Artificial Sequence
  Description of Artificial Sequence: Synthetic coding sequence
atgactattctctttcttacaatggtgatctcctacttcgggtgcatgaaagccgccccaatgaaggaagctaatatccggggacagggtgggcttgcctaccccggcgtgcgaactcatggtactttggagtctgtcaatggccctaaagccggctcccgcggactgactagtctcgcagacacttttgagcacgtcatcgaggaactgttggatgaggatcaaaaggttcgacccaacgaggagaataataaggatgctgatctatacacgagtagagtgatgctgtcgtcacaggtccccctggaaccaccactgttattcttgctggaagaatacaaaaactatctagatgccgcaaatatgtctatgcgagtcagacggcactctgaccccgccagaaggggggagctttctgtgtgtgatagcatcagcgagtgggtgacagctgccgacaagaaaacagccgtagacatgtctggcggcactgtgacagtgctggaaaaggtcccagtctcgaaaggccagctcaagcagtatttttacgaaaccaagtgcaatcccatggggtacacgaaagaagggtgtcgtggcatagataagaggcactggaatagccagtgccgaacaacccagtcctacgtgcgcgcacttacgatggatagcaaaaagcggattgggtggagatttattagaatcgatacctcttgtgtttgtacgttgaccatcaagaggggccgctag

SEQ ID NO: 2392 - DNA, 234 bp, Artificial Sequence
  Description of Artificial Sequence: Synthetic coding sequence
atgtgcggcgctacctccttcctacatgaatgtacgcgcctgatcctggtaaccactcagaacgcggaatttcttcaaaagggcctgcaggtgcatacctgttttggagtttatcctcatgcaagcgtttggcacgactgtgcttcacagaagaaagggtgcgcggtatacctccatgtttcagttgagttcaacaagttaatccctgagaacggttttatcaagggctggtag

SEQ ID NO: 2393 - DNA, 894 bp, Artificial Sequence
  Description of Artificial Sequence: Synthetic coding sequence
atgtccagtgcgcactttaacagaggtccagcctatgggctgtccgcggaggttaagaataaactggctcaaaaatatgaccatcagcgagagcaggagctgagggaatggatcgagggagtgacgggaaggagaatcgggaacaactttatggatggtttgaaggatggcataattctgtgtgagttcataaataaactgcaacctgggagtgtaaagaagattaacgaatccacccagaattggcatcaacttgaaaacatcggaaatttcattaaagcaattactaagtatggtgtaaaaccgcacgacatttttgaggcgaatgatctgtttgagaacactaatcatactcaggtccagagtactttactcgccctcgccagcatggctaagacaaagggaaacaaggtaaacgtgggagtcaaatacgcagagaaacaggagcggaagttcgagcccggcaagctcagggaaggacgaaacattatcgggctccagatggggacaaataagttcgcttcacagcagggaatgacagcctacgggacacgccggcacctgtacgatcctaaactcggaactgaccagccactcgaccaagcaaccattagtctccagatgggcacaaacaaaggggcgagtcaggccggcatgaccgcccccggtacgaagcgccaaatcttcgaacccgggctgggcatggagcattgtgacacgctgaacgtgtcattgcagatgggctcgaataagggtgcgagccagcggggtatgaccgtctatgggctccctagacaggtctatgatcctaagtactgtttgacccctgaatatccagagcttggtgagcccgcacacaatcatcatgcccacaattactacaactccgcatag

SEQ ID NO: 2394 - DNA, 744 bp, Artificial Sequence
  Description of Artificial Sequence: Synthetic coding sequence
atggacggcctcaaagacggcatcatcctctgtgaattcattaataagttgcagccgggtagtgtgaaaaaaattaatgagtcaacccaaaattggcatcagttggaaaacattgggaacttcatcaaagccattactaagtatggagtgaaaccccacgacattttcgaagccaatgatctgttcgagaacacaaaccatacccaggtgcagtccaccctgttggccctggcttccatggccaaaacaaaaggcaataaggtgaatgtgggagtcaaatacgccgagaagcaggagagaaaattcgaaccgggtaaactgcgagagggtcggaacataattggccttcagatggggactaataaattcgcttcccagcaaggtatgaccgcctatggcacacgcagacacctctatgatcccaagctcggcaccgaccagccactcgaccaagcaacaatctccctgcagatggggacaaacaagggagcttctcaggccggcatgaccgctcccgggactaaaaggcagatttttgagccgggcttagggatggaacattgtgacaccctaaacgtgagtctccaaatgggtagcaacaaaggagcttcacagagagggatgacggtctatggactcccccggcaagtttatgatcccaagtactgcctgaccccagaatacccggaactgggtgagcccgctcacaatcaccacgcccataactactataactcagcctag

SEQ ID NO: 2395 - DNA, 834 bp, Artificial Sequence
  Description of Artificial Sequence: Synthetic coding sequence
atgttagctcaaaagtacgatcaccagcgagagcaggaactccgggagtggatagagggagtgaccgggcggcgtattggcaacaactttatggatggcttaaaggacggcattatcttatgtgagtttatcaacaagctccagccgggctccgtgaagaagatcaacgaaagcacacagaactggcatcaactggaaaacattgggaatttcattaaagcaatcaccaaatatggcgttaaaccgcacgacattttcgaggccaacgatctcttcgagaacaccaaccacacccaggtgcagtccacattgcttgcccttgcgtctatggccaagacgaaaggaaataaggtgaatgtcggggtcaaatacgcagagaagcaggaaaggaagtttgaacctggtaagctgagggaaggccgtaacatcattggcctgcagatgggcacaaataagttcgctagccagcaggggatgaccgcatatggcactcgccgccacctctatgatcccaaactggggaccgatcaacctcttgatcaagctacaatctctttacagatgggaacgaataagggagcatcccaggccggaatgaccgctccgggaacgaaacggcagatcttcgaacccggcctgggaatggagcactgcgacactttgaacgttagtctccaaatgggaagcaacaagggtgcatcacagcgggggatgaccgtttatggtttgccgaggcaagtgtacgatcctaaatactgtctgacacctgaatatccggagctgggcgaacccgctcacaatcatcatgcacacaactattacaactctgcctag

SEQ ID NO: 2396 - DNA, 930 bp, Artificial Sequence
  Description of Artificial Sequence: Synthetic coding sequence
atgtcttctacgcagttcaacaaggggccttcatacggcctgagcgccgaggtcaagaaccggctcctgtctaaatacgacccgcagaaagaggcggaacttcgaacatggattgagggactgaccggcctttccatcgggcccgatttccagaaaggcctgaaagatggtacgatactgtgcacgttgatgaacaaactgcagcctggtagtgttcccaagatcaatagatccatgcaaaattggcaccagctcgaaaacctgtcaaactttattaaagcgatggtttcatatggaatgaaccctgttgatctgttcgaggcaaatgatctcttcgagagcggcaatatgacccaggtgcaggtgtctcttctggctctcgcagggaaggcaaaaacaaaaggcttacagtctggtgttgatataggcgtgaagtatagtgagaagcaggagagaaattttgatgatgcgaccatgaaagccggccagtgcgtaataggactgcaaatgggcacaaacaaatgcgcatcacagtcaggtatgactgcatacggaacccgcaggcatctgtatgatcccaaaaaccatatactgccacccatggaccacagcaccatctccctgcagatgggcacgaacaaatgcgcttctcaggtgggcatgacggcccctggcacaaggagacacatttatgacactaagttgggaactgataagtgcgacaattcttcaatgtctctgcagatgggttatactcagggggcaaaccaatctggacaggtgttcggactggggcggcagatctatgatcctaagtattgccctcagggcactgttgcagacggtgcccccagtggaactggagattgccctgatccaggggaggtccctgaataccctccatactatcaggaagaagccgggtactag

SEQ ID NO: 2397 - DNA, 813 bp, Artificial Sequence
  Description of Artificial Sequence: Synthetic coding sequence
atgtcctctacacagtttaacaaggggcctagctatggactgtctgcggaggtgaagaataggctactgagcaagtatgacccccagaaggaggccgagctccggacctggattgaaggactgacaggcctgtctattggcccagatttccagaaaggactgaaggatggcaccattttgtgtaccttaatgaataagctacaacctggcagcgtgccgaagatcaaccgaagcatgcaaaactggcatcagctggaaaacctgtctaattttattaaagctatggtgtcttacgggatgaacccagtggacctgtttgaggccaacgacctttttgagagcggtaatatgacccaggtgcaggtgtcactgttagcgcttgctggcaaaatgggaaccaacaagtgtgccagccagagtggcatgactgcctatggtactagacgacacctgtatgatccgaagaaccatatcttaccgccaatggatcacagcaccatatccctacagatgggaacaaacaaatgcgcatcccaggtcggtatgactgcccctgggactcgacggcatatttatgatacaaaactggggaccgacaagtgcgacaacagttccatgagtctccaaatgggctacacccaaggggccaatcagtctggccaggtgtttggactgggtcgtcagatttacgaccctaaatattgtccccaggggactgttgctgatggcgcaccgagcgggaccggggattgcccggaccctggcgaggtgccagagtaccctccttactatcaggaagaagctgggtactag

SEQ ID NO: 2398 - DNA, 867 bp, Artificial Sequence
  Description of Artificial Sequence: Synthetic coding sequence
atgtcttcaacgcaattcaataaagggccatcatacggtcttagtgctgaggtgaaaaatcggctcctttccaagtacgaccctcagaagaagggcctgaaggatggcaccattctgtgcaccctgatgaacaagctgcagcccggctctgttccaaagattaatagatcgatgcagaattggcaccagctagaaaacctatccaattttatcaaggcgatggttagttacggcatgaatcccgttgatctgttcgaggcaaatgatttgttcgaatctgggaatatgacgcaagtccaggtgtcattactcgccctagcaggcaaagccaaaactaaggggctgcaatctggagtagacatcggcgtaaagtactccgagaagcaggagcgcaattttgacgatgccactatgaaagccggacagtgtgtgatcgggctgcagatgggcactaataaatgcgctagccagagtggaatgacagcgtacggtacccgccggcacctgtacgaccctaagaaccatatcctgccacccatggatcattcaacaataagcctccagatggggaccaacaagtgtgcatctcaggtagggatgacagctccaggtacacgacgccatatctatgacacaaagctgggcaccgataagtgcgacaattcaagcatgtcactgcagatgggttatacacagggggctaaccagtctggccaggtattcggcctggggaggcagatctatgaccctaaatattgtcctcagggcacagtggctgacggggcaccaagcggaacaggagactgtcctgaccctggagaagttcctgaatatcctccgtactatcaggaagaagcaggatattag

SEQ ID NO: 2399 - DNA, 990 bp, Artificial Sequence
  Description of Artificial Sequence: Synthetic coding sequence
atgactcacttcaacaaagggcctagttatgggctgtcggccgaggtgaaaaacaagatcgcatctaagtacgaccaccaggcagaggaagatctgcgcaattggatcgaggaggtcacagggatgagtatcggccccaacttccagttgggactcaaagatggcattattctctgtgagttgatcaataagctccagcctggatccgttaagaaagtgaatgagtcttctctcaactggccccagctggagaatattggcaacttcatcaaggcgatacaggcctacggaatgaagccgcatgatatcttcgaggctaacgatctgttcgaaaatgggaatatgacccaggtccagaccacactggtggctctcgctggattagccaagactaagggttttcacacaactatcgatatcggcgtaaaatatgctgaaaagcagacaagaaggttcgatgaaggtaaattgaaggccgggcagtcagtgatcggactgcagatgggaacaaacaagtgtgcatcgcaagcagggatgaccgcctatggcaccaggcggcatctgtatgacccaaaaatgcagaccgataaacccttcgatcagacaacgatttcactgcagatgggcaccaataaaggagcgagccaggccggcatgctggcccccggcacaaggagagacatttatgatcagaaactaacactgcagccagtggataattctacaatctctctgcagatgggtaccaacaaggtagccagccagaaaggaatgtctgtgtacgggctgggccgacaggtgtacgaccccaagtactgcgctgcgccaacggaaccagtaattcataatggcagtcagggtaccggcaccaatggctcagagatctccgatagtgattaccaggctgaatacccagatgagtatcatggggaatatcaggacgactaccccagagactaccaatacagtgaccaaggtatagattactag

SEQ ID NO: 2400 - DNA, 852 bp, Artificial Sequence
  Description of Artificial Sequence: Synthetic coding sequence
atgacacatttcaataaggggcctagttatggactgagcgccgaggtgaagaacaaaatcgcttctaaatacgatcaccaagctgaagaagatcttcgcaactggatcgaggaggtgacaggcatgtcaatcggaccgaactttcagcttggactcaaggacgggataattctgtgtgagctgattaacaaactccagcctggctcagtgaagaaggtaaatgagtcaagccttaattggccacaagccaagaccaaagggtttcatactactattgatatcggtgtgaaatatgccgaaaagcagacacggaggttcgatgaagggaagctcaaggccggccagagcgtcattgggctgcagatgggtaccaataaatgcgcctcgcaggccggcatgactgcatatggtaccagaagacacctgtacgaccccaaaatgcagacggataaaccgtttgaccagactacgattagcctccagatgggaacaaataaaggagcaagtcaggcagggatgctcgctccagggacaagacgggatatctatgaccaaaagttaacattacagcccgtggataattcgaccatttctttacagatgggaactaacaaggtggcatcacaaaaaggtatgagcgtgtatgggctcgggcgtcaggtgtatgaccccaagtactgcgcagcccccaccgagcccgttattcataacgggtcccagggcaccggtaccaacgggagcgaaataagtgattccgactatcaggcggagtatcccgacgagtatcacggtgagtatcaagatgattacccacgcgactatcagtattctgatcaaggaatagactactag

SEQ ID NO: 2401 - DNA, 558 bp, Artificial Sequence
  Description of Artificial Sequence: Synthetic coding sequence
atgtctattggtcctaacttccagctgggtttaaaagatggtataatcctttgtgaactaattaacaaactgcaacccggcagtgtgaagaaggtaaacgaatccagtctgaactggccacaacttgaaaacatcgggaactttatcaaggccattcaagcatacggtatgaaacctcacgatatatttgaagctaatgatctatttgaaaacggaaatatgacgcaagtgcagactaccctagtggctttggctggactcgccaagaccaagggatttcatacaacaattgacattggggtgaagtacgcagagaagcagacgcggaggttcgacgaaggcaagcttaaggccgggcagtcggtgattgggctccagatgggcacgaacaagtgcgcgagtcaggccggcatgacagcctatggcacaaggcggcacctgtatgacccaaagatgcagaccgacaagccgttcgaccagaccacaatatctttgcagatgggaacaaataagggagctagccaggcagggatgctggcccccggaacccgccgatag

SEQ ID NO: 2402 - DNA, 990 bp, Artificial Sequence
  Description of Artificial Sequence: Synthetic coding sequence
atgactcatttcaacaaaggaccctcctacggtctgtccgccgaggttaagaataaaatcgcctcaaagtatgaccaccaggccgaagaggatttgaggaattggattgaggaagtgacagggatgagtattggaccaaatttccagctgggccttaaggatgggatcatcctgtgtgaattgattaacaaactgcaacctggaagcgtgaaaaaggtgaacgaaagcagcctgaactggccacagttagagaatatcggaaactttatcaaagctatacaagcctacggtatgaaaccccacgacatcttcgaggcaaacgatttgttcgaaaacgggaatatgacccaggtgcagactaccctcgtggcattggccggtctcgctaagaccaaggggttccatacaacaattgatataggagtgaaatatgcggaaaaacagacccggagattcgacgaaggcaagctcaaagctggccagtccgtcattggcctgcaaatgggaactaacaaatgtgcaagtcaggcgggaatgactgcttacggtactcgccgccacctctacgaccctaagatgcagaccgataaaccatttgaccagacaacgatctcactgcagatgggaactaataagggggcctcccaagcaggtatgctggcaccaggtacacggcgggacatatatgatcaaaaacttaccctgcagcccgtggataatagcaccatctcccttcagatgggaaccaacaaggtagcatcacagaagggtatgagtgtttatggcttgggccggcaggtatacgaccctaagtattgcgctgcacccacagagccggtgattcacaacggttcccagggcactggtactaacggctcagagatctctgattctgattaccaagcagaataccctgatgagtaccacggggaatatcaggatgactacccacgtgactaccagtattctgaccagggcatcgactactag

SEQ ID NO: 2403 - DNA, 867 bp, Artificial Sequence
  Description of Artificial Sequence: Synthetic coding sequence
atgtccatcggacccaactttcaacttggtctgaaggacgggatcatcctctgcgaactgataaataagctgcagccaggctctgtgaagaaagttaatgagagctcactgaattggccccagcttgagaacataggcaatttcataaaggcgatacaggcttatgggatgaagccccacgacatttttgaggctaatgatttgtttgagaatggtaatatgacacaggttcagactactctcgtggcgctggcggggctggccaagacaaaggggttccacaccaccatcgatatcggagtgaagtacgccgaaaagcagactcgacgcttcgacgaaggaaagctgaaagctgggcagagcgtgatcggcctgcaaatgggtaccaataagtgtgccagccaagccggaatgaccgcgtacgggacacgccgccacctctacgacccgaagatgcaaaccgacaagccctttgaccagacaaccatctccttgcaaatgggcaccaataaaggagcaagccaagccgggatgctcgcaccaggaacgcgacgcgatatttacgaccagaaattaactttacaacccgttgataactccactatcagtctccagatggggacaaataaagtggcttcccagaaggggatgtcagtctacggccttgggaggcaggtctatgatcctaagtactgcgctgcacccacagaacccgtcattcacaatggttcgcagggaacaggcacaaatggctccgagatttctgacagcgattaccaggcggaatatcccgatgagtatcacggagaatatcaggatgactaccctagggactaccagtatagtgaccagggaatcgactattag

SEQ ID NO: 2404 - DNA, 2223 bp, Artificial Sequence
  Description of Artificial Sequence: Synthetic coding sequence
atgggcgagctctgtcggagagatagcgccctcacagccctcgacgaggagaccctctgggagatgatggaatcacataggcatagaatagtgcggtgtatctgtccttcaagattgactccttacctacgccaggccaaagtcctgtgccagcttgatgaggaagaagtgctgcactcacctcgactgaccaatagcgcaatgagagcggggcacttgctggatctacttaaaactaggggaaaaaatggtgccatagcattcctggagtccctcaagtttcacaaccccgacgtctatacacttgtcaccggtttacagcctgacgtcgactttagtaacttcagcggcctcatggaaaccagcaaactgactgagtgtcttgcaggagcaattgggtcccttcaagaagaactgaaccaagagaagggccaaaaggaggttttgctgcgccgctgtcagcagttgcaggagcacctgggactggccgagaccagagcggagggcttgcaccaattggaggctgaccactcacggatgaaacgagaagtgtcggctcattttcacgaggttctccgtctcaaggatgaaatgctgtccctgtccctccactattcaaatgcccttcaggaaaaagagctcgccgcctcgaggtgtcgctcactgcaggaagaactgtacctgctgaagcaagaactccagcgggcaaacatggtcagcagctgtgaactggaactccaagaacagtccctgaggacagcatccgatcaagaatccggggacgaggaattgaaccgcttgaaggaagagaacgagaagcttcggtctcttacttttagcctggctgaaaaagatatactggagcaatcacttgacgaagcacgcggttcgcgacaggagctggtggagagaatacatagccttcgggaaagagcggtcgccgccgaacgccaaagagaacagtattgggaggagaaggaacaaactctcctgcagtttcaaaagtccaagatggcatgccagttataccgcgaaaaggtaaacgccctacaggcacaagtctgcgagctacaaaaagaaagagaccaagcatactccgctcgtgatagcgcccagcgggagatttcccaaagcctggtagagaaggacagcctgagaaggcaggtgtttgagctcacagaccaggtgtgtgaattacggacccagttgaggcagctccaggccgaacctcccggggtgctaaaacaggaagcccggaccagggagccatgccccagagagaaacagcgcttagtccggatgcacgccatctgtccacgagacgacagcgattgttctctggtgtcatctacagaatcccagctcctctcggatctaagtgctaccagtagtagggagttggtagacagctttcgctcatctagtcctgcccccccatctcagcagtctctgtataagcgagtcgcagaagacttcggagaggagccctggtcctttagctcatgcctagaaatcccggaaggcgaccccggagctttacccggcgcgaaggccggcgatcctcatctcgattatgaactgctggacaccgccgacttgccgcagctggagtcttcgctgcagcctgtatcgccagggcgtctggacgtgtctgagtctggcgtgctgatgcgccggaggcccgcccgtagaattctgagccaggtgacaatgttggctttccaaggggacgctcttctcgaacagattagcgtgatcggcggaaatctgaccggcatctttatccaccgcgttacaccgggctcagctgctgatcagatggccctacggcccggcacccaaatagtgatggtcgactacgaggccagtgaaccattatttaaggccgtgctggaagacaccacactagaggaggctgtgggcctcctcagacgcgttgacggtttctgttgcctgtccgtaaaagtgaacaccgacggctataagcggctgctgcaggatctggaagccaaagtggctacttccggcgactcattctacatccgcgtgaatcttgctatggaggggcgcgctaagggagagcttcaggtccactgtaacgaggtgctccatgtcaccgacactatgttccagggatgcggttgctggcatgcacatagggtaaatagttacacaatgaaggataccgccgcacacggaaccatccctaattactcccggtag

SEQ ID NO: 2405 - DNA, 3015 bp, Artificial Sequence
  Description of Artificial Sequence: Synthetic coding sequence
atgggtgagctgtgtaggagagattccgctttgacagccctggacgaagagacgctgtgggagatgatggaatcccacagacatagaattgtgcgttgtatttgtcctagcaggctgacaccttacctgcgccaggccaaggtactgtgccagctggatgaggaagaagttctgcattcaccccggcttactaactcagccatgcgtgcgggccaccttttagacttgctcaagacacgcggtaagaatggcgcaatcgcatttctggaatctctgaagttccataaccctgatgtgtatacgctcgtaaccggactgcagcccgacgtggacttcagcaattttagcgggttaatggagactagtaaacttactgagtgccttgccggggcgataggttcgttacaggaagaacttaatcaagagaaaggccaaaaggaagtgttacttcggcgctgtcagcaactgcaagagcacctggggctggccgaaaccagggccgaaggcctccatcagctggaagcagatcactcacgtatgaaacgggaggtgagcgcccactttcatgaagtgctacgattgaaggacgagatgctgtccctgagcctacattattccaatgcactgcaagagaaggaactcgctgcttcacgctgtaggagcctccaggaggaactgtatctcctcaagcaggaattgcagcgagcaaacatggtcagttcctgtgagctggaacttcaagagcagagccttagaacagcctctgaccaggagagcggcgacgaggaactgaataggcttaaagaggagaatgaaaaactccgctccctcactttttcacttgctgaaaaagatatcctggagcaaagcttagacgaagctcgtggaagtaggcaggagttggtagagaggattcactctcttcgagagcgggccgtagcagccgagcggcagagggagcaatactgggaagaaaaggagcagacactccttcaatttcagaaatccaagatggcctgccagttatacagagagaaagtcaatgcactgcaagctcaagtgtgcgagctacagaaggaaagagaccaggcttactccgctcgtgactctgcccagcgagaaataagccaatccctcgtggaaaaggactcacttaggcgacaagtcttcgaactgacagatcaggtctgcgaacttcggactcaattgcggcagcttcaagcagagccacccggagtgttgaaacaggaggccagaacgcgggagccgtgccctagggaaaaacagaggcttgtccgaatgcacgcgatctgcccgcgcgacgattccgactgttcgttggtgtcctcgacagaaagccaattattgagtgacctgagtgccacaagttcaagggagcttgtggacagttttagatccagctctcccgctcctccatcacaacagtcactgtataagcgcgtcgctgaggacttcggcgaagagccctggagcttttcatcttgcctggagatccctgaaggggatcccggggctctgccgggagccaaagctggggacccccacctggattatgaattgttagataccgccgacctgcctcagttggaatcgtcattgcagccagtcagcccaggccgcttggatgtgtctgagtccggagtcctgatgcgtcggcgacctgcccgcaggatcttatctcaggtcacaatgcttgcgttccaaggtgatgccctgcttgaacagatttctgttatcggaggtaacctgacgggcattttcattcacagggtgaccccagggtcggcggctgatcaaatggcactgaggccaggcacccagattgtgatggtggattacgaggctagcgagcccctgtttaaggccgtcctcgaggacacaactctcgaggaggctgtgggactcctgcgtagagtggatggtttttgctgcctcagcgtgaaggtgaatactgacggttataagaggttgcttcaggatcttgaggctaaagtcgctacatctggagatagcttttatataagggtcaatctggcaatggaaggtagagccaaaggggaactgcaggtccactgtaacgaggtactccacgttacagacaccatgtttcaggggtgtggttgctggcatgcgcacagggtaaacagttataccatgaaagacacagccgctcatggcacaatcccaaactacagtagagcccagcagcagttaattgcactcatccaagacatgactcagcagtgtactgtgactcggaagccgtcgtcaggtggcccgcagaagctggtcagaatagtgagtatggacaaggccaaggcctcaccactacggctttcattcgacaggggacagctggaccctagtagaatggagggcagcagtacctgtttctgggctgagagttgcctcacactggttccatacaccttggtccgaccccatagaccagcgagacccaggcccgtgttattagtgccacgggcagtggggaagattctatcagagaaactatgccttctgcagggcttcaaaaagtgcctcgcggagtacctaagccaggaggagtacgaagcatggtcacagcgaggtgatattatccaggagggcgaagttagcggcgggcggtgttgggttacacgccatgccgttgagtctttaatggaaaagaacacacatgccctgctggatgttcagcttgactcagtgtgcaccctccatcgtatggatatatttccgattgtgatccacgtatccgtgaatgaaaaaatggccaagaaactcaaaaagggactgcagcggctcggcacatcagaagagcagttgctagaagctgctcggcaggaggagggagatctggatagagccccctgtctgtactcatccctcgctccagatggttggtctgacctggatggacttttgtcctgcgtgcggcaggctattgccgatgagcagaaaaaggtagtgtggacggaacagtccccgcggtag

SEQ ID NO: 2406 - DNA, 1305 bp, Artificial Sequence
  Description of Artificial Sequence: Synthetic coding sequence
atggttagtagctgtgagttggagctgcaggaacagtccctgcgcacggctagtgatcaggagagcggcgatgaggaactcaaccggctcaaggaagaaaacgaaaaactgcggtcgctgaccttctccctggcagaaaaggatattctggaacagtccttggatgaagcaagagggagtcgtcaggagcttgtggaacgtatccactcactgcgtgagagagcggttgcggccgagagacagcgagagcagtattgggaggaaaaagagcagacactgctgcagtttcagaagagcaagatggcgtgtcaactttaccgtgagaaagtgaacgccctccaagcccaggtttgtgagttgcagaaagaacgggatcaggcttattcggccagggattcagcccagagggagatttcacaatcacttgtggagaaagatagtttaagacggcaagtgttcgaactgactgaccaagtgtgtgagcttagaactcaacttcggcagctgcaagccgagccaccaggtgtcttaaagcaggaggccagaaccagagaaccctgcccccgcgaaaaacagcggctggttagaatgcacgctatctgcccgcgtgacgactcagactgtagtctggtatcctctactgagtctcagctactcagcgacctgagcgcaacgtcgtcccgtgaactcgtcgacagcttccggagttcatccccggcccccccttctcagcagagcttatacaagagggtagccgaggacttcggtgaagagccttggtccttcagctcctgtcttgagattcccgagggggaccccggcgccctcccaggtgctaaggcgggggaccctcacttagactatgagctactggatacagcggatctaccccagttagagtcaagcttacaaccagtaagtccgggaaggcttgacgtgtccgaatccggagttctcatgcggcggcgacctgccaggcgcatcctgagccaggttacaatgttagcgttccagggagacgcactattggaacaaatctcagttattggaggaaatctcacagggatatttatccaccgtgtgacgcccggcagcgcggcagatcaaatggcgctgcgccctggaactcaaatagtgatggtgtcccgggcccggccccttctgtcccccggcctcctcatgggaaccgttgccgccgggggtgttactcaagccgattttacgagcccaaggagatgtcgttcaacccttggatgggcttccgccttgagctgggccgacgtcaagcggtcggcccacctttag

SEQ ID NO: 2407 - DNA, 3015 bp, Artificial Sequence
  Description of Artificial Sequence: Synthetic coding sequence
atgggtgagctgtgtcgtcgagattctgcattgacagctcttgatgaggagacattatgggagatgatggagtcccacaggcaccgaattgtacgctgtatctgcccaagcagacttaccccttacctgcgccaagccaaggtgctgtgccaactcgatgaggaagaggtgctgcatagtccaaggcttactaacagtgctatgcgagctggccacctgttggacttactcaagacacgagggaagaatggagcaatagcgtttctggaaagtcttaaatttcataacccagacgtgtatacgcttgttactggactccagccagacgttgatttctccaacttctcaggactgatggagacatcgaaactcaccgagtgcctggccggggcaattggaagtctgcaggaggaattgaaccaggagaagggacagaaagaggttctccttcggcggtgccagcagctgcaggaacacctgggtttggctgagaccagagcggaaggattgcaccagctggaggctgaccattcaagaatgaagagggaggtttctgcccacttccatgaggtgcttaggctgaaggacgaaatgcttagcttgagcttgcactattccaatgccttgcaagagaaagagctggctgcctctagatgccgcagcctgcaagaggaactgtacctcctaaaacaagagctacagagggctaatatggtcagttcatgcgagctggagctgcaagagcaatctttacgaacagcttccgaccaggaatctggcgacgaagaactgaacaggctaaaggaggagaatgagaagctcagatctctcacattttcgctcgccgagaaagatattctggagcagtcactggacgaggcccggggcagcaggcaggagctagttgagcgcattcactcacttcgtgaacgggccgttgctgccgaaagacaaagggagcaatactgggaggagaaagaacagacgctgctccagttccagaagtcgaagatggcgtgccaattgtatcgagaaaaggtgaacgccttgcaggcacaggtgtgtgaactgcaaaaggaacgcgatcaggcttacagcgctagagacagtgcgcaacgggagatttctcagtcattggtcgaaaaagattctttaaggcgccaggtgtttgaactgaccgaccaagtttgtgaattaagaacccagctgaggcagctgcaggccgagccacctggcgtcttaaagcaggaagcacggaccagagagccatgcccgcgggagaaacagagactggtgaggatgcacgccatctgtccccgcgacgattccgattgttccctcgtatcctctactgaatcccagttgttgagcgacctcagcgcgacgagctctcgcgagttagtagactcctttagaagttcttctcctgccccgccttcccagcagtctttatacaagagagtagcagaggatttcggagaggaaccttggagcttttccagctgcctggagatacctgagggagatccaggggcactgcccggcgcgaaggctggcgaccctcacctcgattacgagctccttgacaccgcggatctgccccagctcgaatccagtctgcaaccggtgtccccaggtaggctcgatgtaagcgagtccggagtcctgatgcgccgaaggccagctcgaaggatattaagtcaggtgacgatgctggcattccagggtgacgctttactggaacaaataagcgtgatcggagggaatctcaccggtatattcatacaccgtgtgacacctggatcagcagccgaccagatggccttgagacccggcacacagatagtgatggtagattacgaagcctcagagccactgtttaaggcagtgctcgaagacacgaccctagaggaggcagtgggactcctaagacgcgttgatggtttctgctgtttatctgtcaaggtcaacactgatggatataaacgcttgctccaggacttagaagctaaagtggcaacgtctggagatagcttttacattagggtgaatcttgctatggaaggccgcgcaaaaggggaactccaggtgcactgcaatgaggtgttgcatgtgacagacacaatgtttcagggttgtggctgttggcatgcccacagagtgaatagctataccatgaaggacacagccgcccacggcaccatccccaattatagcagggcacagcaacagctgatcgctttgatccaggatatgacacaacagtgtacggttacaagaaagccttcctcaggaggcccacagaaacttgttagaatagtctccatggacaaagcaaaggcctctccattacgcctctcttttgatcggggccaattagatccatcgaggatggaaggctcatctacctgtttttgggccgagagctgtttgaccctggtgccatacacccttgtgcgtcctcaccggcctgcccgcccacgccccgtactgttagtgccaagagccgtcgggaaaattctctcagagaaactttgcctgctgcagggcttcaagaagtgcttagcagagtacctcagccaggaggaatatgaggcatggtctcagaggggcgacataatccaggaaggggaggtctcggggggccgctgctgggtaacgaggcacgccgttgagagtttaatggaaaagaacactcatgctttgctggatgtgcaattagactctgtgtgtactctccataggatggacatcttcccgatcgtaatacatgtgtctgttaatgagaaaatggctaagaagctgaaaaaaggtctccaacggctggggaccagtgaggagcagctgttggaagccgcccgacaagaggagggtgatctggaccgggcgccatgcctatacagctctctcgcacctgatggctggagtgacctcgatgggttactcagttgcgttcgacaggctatcgcagatgaacagaagaaagtagtttggaccgagcagtctccccggtag

SEQ ID NO: 2408 - DNA, 1326 bp, Artificial Sequence
  Description of Artificial Sequence: Synthetic coding sequence
atggtctcctcatgtgaactcgagctacaggaacaatccctgcgaactgcttctgaccaggaatctggtgacgaagagttaaaccggttaaaggaggaaaacgagaaactgaggtcactgaccttctcactcgccgagaaagatattctggaacagtctctcgatgaggcccgcggatctcgacaggaactagtggaaagaatacactcattgcgggaaagggcggtggccgccgaaaggcaaagggagcagtactgggaagagaaggaacagaccttgttacagttccagaaatcaaaaatggcctgccaactgtatcgggagaaggtaaacgctctgcaggcccaggtctgcgaacttcaaaaggagagagatcaggcatacagcgccagagattccgcccaacgtgaaattagtcagtcactcgttgagaaagatagcctccgccgacaggtgtttgaactcacggatcaggtgtgcgaattgcgcacccagctgagacagctccaggctgaacccccaggcgtgcttaagcaggaggctaggacaagagagccatgccccagggagaagcagcggcttgtgagaatgcatgcaatatgccctcgagacgattccgattgctctcttgtgtcctctacagagtctcagctcttatctgacttgtcagcaacaagttctagagagctcgttgattccttccgcagcagtagcccagcccctccgtcccagcagagcctgtacaagcgcgttgccgaagatttcggcgaggaaccttggagcttcagcagctgcttggaaatcccggagggggaccccggtgcactcccaggtgctaaggccggcgatccccatctggactacgagctgctggatacagcagacctgccacagctggagagttcactgcagccagtatccccagggcggttggatgtgagtgaatcgggcgtgctaatgcggagacgcccggcacgccggattctaagccaggtgacaatgctggcctttcagggggatgctctcctggagcagatctctgtaataggggggaatcttaccggcatttttatacaccgagtgacccctgggtcggcagccgaccagatggcactgcgcccaggaacccagattgttatggtgatacgcggctacagtaggacttggcggccaaagtggaggccacgcggtacccacagcacctccggttccacctggccctggagagcaggccctaaaggctcatgtagatgtattgcaacccggagttgcacgagtcccaccccatgcagtcgggccgcagctgccgggatgccaacagcctag

SEQ ID NO: 2409 - DNA, 2349 bp, Artificial Sequence
  Description of Artificial Sequence: Synthetic coding sequence
atgttcccacccagtggcagcacagggctgattcctcctagccacttccaggcacgaccactgagcactctgccccgtatggctccaacatggctatcggatatccctctcgtccagccaccggggcatcaggacgtgtcggaacggcggttagacacgcagcggccccaagtgaccatgtgggaacgggatgtgtcctctgatagacaggaacccgggcgccgcggccggtcttggggtttggaaggttctcaggcactcagccagcaagcagaagtaatagtaagacagctgcaagagctaaggcggctcgaggaagaagtgcggcttctcagggagacttccttgcagcaaaagatgcggcttgaggcacaggccatggaactagaagcattggcacgcgcagagaaagccggcagagccgaggccgaggggctgagggccgcgctggctggggccgaagtcgtgaggaaaaacctcgaagaaggtagtcagcgtgaactcgaggaggtccagcgcctccaccaggagcagttgtctagcttaacccaggcacatgaggaagcgctttcctctttaacctccaaagctgaagggctggagaagtctctctccagcttggaaacacgtagagccggagaagctaaagagctggcagaagcacagagagaagcagaactgctgcggaagcagctcagcaagacgcaagaagacctggaggctcaggtgacgctcgtcgagaaccttcgtaagtatgtcggcgaacaagtgccgtcggaagtccactctcagacttgggaattggaaaggcagaagctcctggaaacaatgcagcaccttcaagaggatcgcgactcactgcatgccactgctgagcttcttcaggtgcgagtccagtctctgacccacatacttgccctgcaagaggaggaattgacaaggaaagtgcagccaagcgacagtctggaacctgagtttaccaggaagtgccaaagcctcctgaatcgatggcgggaaaaggtctttgccttgatggtgcaacttaaagcacaggagcttgagcacagtgactctgttaagcaactaaaggggcaggttgcgtccctgcaagaaaaggtgaccagccagagtcaggagcaggctattctccaacggtccctccaagataaagcggccgaggtggaagtagagaggatgggagcaaagggattgcagctggagttatcccgagcacaggaggccaggcggcgatggcagcagcagacagcatcagcggaagaacagctgaggctcgtagtgaacgcagtgtcatccagccagatctggttggagactaccatggccaaagtcgagggagctgctgcacaactgccctccctgaacaaccggctgtcctacgccgtgagaaaggttcatacaatcagaggtcttatcgcccgcaagctggccctcgctcaactccgacaggagtcttgtccactccccccaccagttaccgatgtgtccctggagctgcagcagctcagggaagaaagaaataggctcgacgccgagctccagctctccgccaggttgatacaacaggaagtggggagagcccgggaacagggggaggccgaaaggcaacagctgtctaaggtagcacagcaactcgaacaggagctgcagcagacacaagagtcactggcgagtctgggactccaactggaagtggcaagacaggggcagcaggaaagtaccgaggaggccgcatccctgaggcaggaacttactcagcagcaggaactgtacggccaggccctacaggaaaaagtagctgaagttgagactagactgagagaacagttatccgacactgaacgccggcttaatgaagcaagacgggaacatgccaaggccgtggtaagtctgagacagatccagcggcgggcagcccaggagaaggagcgaagccaggaactaaggagattgcaagaagaagcccggaaggaggaaggccagagactggctcggcggttacaggaactggagcgcgacaagaatctcatgctggctaccctgcagcaagaggggctgctctcacgatacaaacagcaacgccttctgaccgtccttcctagcctgctggacaaaaaaaaaagtgttgtctcaagtccaagacccccggagtgcagtgccagcgcacccgtcgcagcagccgtaccgaccagagaatcaattaaaggtagcctttcggtgcttctggatgatctccaggacctcagtgaggcaataagcaaggaggaagcagtttgtcagggcgacaatcttgaccgttgtagttcgtcgaacccacagatgtcttcttag

SEQ ID NO: 2410 - DNA, 2349 bp, Artificial Sequence
  Description of Artificial Sequence: Synthetic coding sequence
atgtttccgccatccggtagcaccgggttgatccccccctcacacttccaggcgcgccccttatcaactttgccaaggatggcccccacctggctgagcgacatcccgcttgtgcaacctccaggtcatcaagacgtttcagagaggcgtctcgacactcagcgtccccaggtgaccatgtgggagagggacgttagcagcgaccgacaggaacctggacggcgggggagatcttggggacttgaagggagccaggcccttagccagcaggctgaggtcattgttaggcagctccaggaactgaggtggctagaggaggaggtgtggcttctgagggagaccagcttgcaacagaagatgaggctggaagcccaggcaatggaacttgaggctctggcacgggccgagaaagcagggcgcgctgaggccgaggggctgcgggctgcacttgcgggcgccgaggtggtccgcaaaaatctagaggagggccgccagagggaactggaagaggtgcagaggctgcaccaggagcaactgagtagtctgacccaagcccacgaagaggcgttatcgtctctgaccagtaaagccgagggcctggagaaatcactgtctagcctggaaaccaggagagcaggagaggcaaaagagctagccgaagctcagagggaggccgaactcttgcggaaacagctctctaaaacccaggaagacttagaagctcaggtgacgctggtggaaaacctaagaaagtacgtgggagagcaggttccatctgaagtgcattcccaaacctgggaactcgaaaggcaaaagctgctggaaacgatgcaacatctgcaagaagatcgggattctctgcacgcaactgcagaacttttacaggtgcgcgtgcagagtctcacccacatactcgcactgcaggaggaagaactgacccggaaggtgcagcccagtgatagtctcgagccagagtttacccggaagtgtcagtccctgctgaatcgatggcgcgagaaggtattcgcactcatggtacagctgaaggctcaggaactggaacacagtgattcagttaagcagctgaaggggcaagtggcctccctgcaggagaaggttaccagccagtcccaagagcaagccatcttgcaacggagtctccaggataaggccgcagaagtagaggttgagagaatgggggccaaagggctgcagctcgaactctcgcgtgctcaggaggcgaggcggtggtggcagcagcagaccgcgagtgcagaagagcagctcaggttggttgtgaatgccgtgagcagcagccagatctggctagaaacaactatggcaaaggtcgaaggggcagccgctcaactgcccagtttgaataatcggctgagctacgcagtccgcaaagtgcacaccattcgcggcctgatcgcccgcaaactggctctggcacaacttaggcaggagtcttgtccgctccctccaccggtgaccgacgtctcactagagctccagcaattgcgtgaagagagaaaccggctggatgccgaactgcagcttagtgcaaggcttatccaacaggaggtgggccgggctcgcgaacaaggagaggcagaacggcagcaactctccaaggtggcacaacagctggagcaggaactccagcagacacaggagtccctcgcaagcttggggttacagctggaggttgcacgccagtgccaacaggagtcaaccgaggaggcagcctccctgagacaggagttgacccagcagcaagaactctatggtcaggccctgcaggaaaaggtcgctgaggtcgagacccggttgcgggaacaattgtccgatacagagcgacggttaaacgaagcccgccgggagcatgcaaaggccgttgtttcattgagacagattcagcggcgcgccgcacaggaaaaggagcggagtcaagagctgcgccgactccaggaggaggctcgcaaggaggaaggacagaggctggcacgaaggctccaagaactagaaagggacaagaatctgatgctcgccactttgcagcaggagggcctcctgtctcgttataagcaacagcgcctcctgacagtgctcccgtcccttctggataagaagaagtcagtggttagtagtcctagaccacctgaatgttcagccagcgcacctgtggccgccgctgtccccacgagggaatcgattaagggctccctgagcgtgctgcttgacgatcttcaggacctgtccgaggccatcagcaaagaagaagcagtctgtcagggggataatctggacagatgctcctcctgcaaccctcagatgtctagctag

SEQ ID NO: 2411 - DNA, 2349 bp, Artificial Sequence
  Description of Artificial Sequence: Synthetic coding sequence
atgtttcctccctccggctctactgggctcatcccgccgagtcattttcaggcacgtcctctgtcaaccctgccgcgcatggctccaacctggctttcagatatcccgctggtccagccgccaggacaccaggatgtgagtgagcgccgcctggatacccagagaccacaggttaccatgtgggagagagacgtgagctccgatcgacaggagccaggtcgccgtggccgaagttggggtttggaagggtcccaggccctaagtcaacaagccgaagtgattgtcagacagctccaagagttgaggcgcctggaagaagaggtgcggttgcttcgggagacttccctgcagcagaagatgcgactcgaagcccaggccatggagctggaagccctggcaagagcagagaaagccggaagggccgaggccgaaggactaagggcagctctggctggtgcagaggtggtgcggaagaatctggaagaagggtctcagcgggaactggaggaagttcagcgattacaccaggaacaactgtcttcccttacacaggcgcacgaggaggccctaagcagtttgacctctaaggcagaaggcctggaaaagagcctgtcatccctggaaactaggagagcgggcgaggccaaggaactggccgaagcacagcgcgaagcggagctgctgcggaaacaattatccaaaacacaggaggacttagaggcacaagtcactctggtcgagaatctccggaagtatgtcggtgaacaggtgccatccgaggtccatagccaaacctgggaactcgaacgacaaaaactcctggagaccatgcaacatctccaggaggaccgggactctctgcacgcaacagccgagctcctgcaggtgcgagtccagtcacttacccatatattagctctccaggaagaagagcttacccgcaaggttcagccttcagattcgcttgagcccgagtttaccagaaagtgtcaatccttattgaatagatggagagagaaggttttcgctcttatggtacagctgaaggcgcaggagctcgaacactccgatagtgttaagcagctgaaaggccaggttgccagtctgcaagaaaaagtgacaagtcagtctcaagaacaggcgatcctccagcgcagtctgcaagataaggccgccgaagtcgaggtggaacgcatgggggccaaggggttgcaactagagctgtcacgggctcaagaggcccggcgtcgctggcagcaacagaccgcatcagccgaagagcagctgaggttggtggttaacgcagtgtcttcatcacagatttggttagaaaccacgatggccaaagtggagggcgccgccgcacagctgccaagcctgaataataggttgagctatgccgtgaggaaagttcacacaataagggggctgatagctaggaaactggccctggctcagctccgccaagagtcctgccctttgccaccacctgttactgacgtcagtctcgagcttcagcaattgcgcgaggagcgcaatcgcttggacgcggaactacaactgagcgcacgtctgattcaacaggaggtcggcagggcaagggaacagggtgaagccgagcgtcagcagctcagcaaagtagctcagcagctggaacaggagctgcagcaaacccaggagagcctggcgtcccttggcttacagctagaagtggctcgtcagggtcagcaagaaagcactgaggaagccgcatccttgcgccaggaactgactcagcagcaagagctgtacggacaggccctgcaagaaaaagtggccgaggtggagactcgtctgcgtgagcaattgagcgacaccgagcgtaggcttaacgaggcccgaagagagcacgctaaggccgtggtgagtctacgccaaattcaaagacgggcagctcaggaaaaagagcgctcccaggagctgagaagactacaggaggaagccagaaaagaggagggacagagacttgcgagacggctccaggaactggaacgtgacaaaaatctgatgctcgctacattacagcaggagggcttgctcagccggtataagcaacagaggttactgaccgtcctccctagcctgctcgataagaaaaagtcagtggtgtcttcaccccgcccacccgaatgctccgcgtccgcgcccgtcgctgctgctgtgcctacgcgcgagagcatcaagggctcgttgtcagtgctgctagatgacctgcaggatctgtccgaggcaattagtaaggaggaagcagtttgtcagggtgataacctggaccgctgttcttccagtaatccccagatgtcgagctag

SEQ ID NO: 2412 - DNA, 2190 bp, Artificial Sequence
  Description of Artificial Sequence: Synthetic coding sequence
atgttccctccgtcaggctcaacagggctgatcccaccctcccatttccaggcccgtcctctaagcaccctgcctcgaatggcccctacttggctgagcgatatacccctggtccagcctcccggccaccaggatgtgagtgaaaggcgtcttgatacccaacgtcctcaggtcacaatgtgggagagagatgtgtcctctgaccgacaggaaccgggtcggaggggacgatcctggggtctggaagggagtcaggccctgtcccagcaggcagaggtgatcgtgcgccagttgcaggaactccggcgcctggaagaggaggtccgcctgctgagggaaacctcactgcaacagaagatgcgactcgaagctcaggcaatggaactcgaggcattagctcgcgccgagaaggcaggacgcgccgaggcagaaggtctcagagcggccctcgcgggtgctgaggttgtgcggaagaatctggaggagggtagccagagagaactggaggaagtgcaaaggctgcaccaggaacagcttagctcccttactcaggcccatgaagaggccctgagttcactgacatctaaggcagaaggattggagaagtctttatcttcccttgaaacccggcgtgctggcgaggcaaaggaattagctgaagcccagagggaggctgaattgctgcggaagcagttgagcaagacccaggaggatctggaagcccaagtcaccttggtagagaatcttcggaaatacgtgggggagcaggtgccatccgaggtacacagtcagacctgggaattggagcgtcaaaaactgctggagactatgcagcatctgcaggaagatcgcgacagtctccatgcaaccgctgagctattgcaggtgcgcgtgcagagcttaacacatatactggcactgcaagaggaggagctgactaggaaagtgcagcccagtgattcccttgagccagagtttacaaggaagtgtcagagtctgctgaatcgctggcgcgagaaggtatttgctctcatggtgcaactgaaagcccaggaattggagcactctgatagtgtaaaacagctgaagggtcaagttgccagcctccaggagaaagtgacctcgcagtctcaggagcaggcaattctgcagaggagccttcaggataaagcagccgaggtggaggtcgagcgtatgggtgccaaggggcttcaacttgagctctctagagcccaggaagcacgtaggagatggcagcagcagactgcaagtgcggaagaacagctgcgacttgtggtgaatgccgtatcatcttgccccttgccaccccccgtcactgatgtgtctctggaattacagcagctgcgcgaggagcggaaccgcctcgatgctgagttacagctgagtgcacgcctcatccagcaagaggtaggacgggcccgagagcagggggaagccgagagacagcagctgtccaaggtggcacagcagctggaacaggaactgcagcagacgcaggaatcactggcctcactgggcctgcagctggaggtggcccgacagggccaacaagaaagcactgaggaggctgcttcgctgcgacaggagctaactcagcagcaggaattgtacggacaagcactccaggagaaggtcgccgaggtggaaacccgactgcgagagcaactgtccgatacagagagaagacttaatgaggctaggagagaacatgctaaagcagttgtgtcccttcggcagatccagagacgtgcagcccaggaaaaggaacggtctcaagagctccgacggctacaggaagaggcacggaaggaggaaggccaaaggcttgcgagacgactgcaggaactggagagagataaaaatcttatgttggctacccttcagcaggaggggctacttagcagatataaacagcagcggctattaactgtccttccaagcctgcttgacaaaaagaaatcagtcgtgtcttcaccacgaccccctgaatgttccgcttctgcccctgtggcggccgccgtcccaacccgcgaatccatcaaaggatcactgagcgttctgctggatgatctccaggatctgagcgaggccatatcgaaggaggaagcagtgtgccagggggataatctggatcgctgctcgagtagtaatccgcagatgtcaagttag

SEQ ID NO: 2413 - DNA, 2616 bp, Artificial Sequence
  Description of Artificial Sequence: Synthetic coding sequence
atgtggccccactccgccggggcccggccctgggccagtactttaacaggtaaagacccacgggtgatggcctgttggtgtctagatggcctgccttcagggctcgctgagccctggagggaactgtggagatggagaagccgaccactccattgcgtgccacctttctcccccctggcgcgatctagccgcgatcacagaaacctgcgtagacgcgggaacatcgatggatggagacaaaacctagagcctagtaacaacgtcgaaatgttccctccttccggtagtactgggctgatccctccttcacatttccaggcacgtccactttcaaccttgccccgaatggcccccacctggctatctgacataccacttgttcagccccctgggcaccaggatgtgtctgaacgaaggttggacacgcagagaccacaggtcaccatgtgggagcgggacgtgtcatcggacagacaggagcctggacgccgtggccggtcttgggggctagaagggagccaggccctgagccagcaggcggaagtgattgtgcggcagctccaggagctgcggagactcgaggaagaagtacgactcctgagagagacatctctccagcagaaaatgcggctggaagcacaagcaatggagctggaggcgctggctagagcggagaaggcggggcgtgccgaagcggaaggtcttagggccgcactggcgggcgctgaggtcgtgcgcaaaaacctcgaagagggttcccagcgagaactggaagaagtccagaggctacatcaggaacaactgtcatcactgactcaggcgcatgaggaggctctcagctctcttactagcaaggccgaagggcttgagaaatctctgtcctctctggaaacacgcagggccggggaagctaaagaattagctgaggcccagcgggaggccgagttgcttcgcaaacaactgtcaaaaactcaagaggacctggaggcccaagttactttggtcgaaaatctgaggaagtacgtcggggaacaggtgccttccgaggtgcacagccagacctgggagctggagcgccagaagctgttagagaccatgcagcacctccaagaagacagggatagcctgcacgcaacagctgagttactgcaggtaagagtacaatcgttgacacatatcctagccttgcaggaggaggagcttacccggaaagtgcagccatcagattcccttgagcctgagttcacccggaaatgtcagagccttttaaatcgatggcgcgaaaaagtatttgcattaatggtgcaactcaaagcacaggagctcgagcactcagatagtgtgaaacagctcaaagggcaggttgccagtttgcaggagaaagttacttcgcagtcacaggaacaggccatcttgcaaagatcattacaggataaagctgctgaggtggaggtggaacggatgggcgctaaagggcttcagctggagctcagccgcgcgcaggaagcccggcgccgttggcagcagcagaccgcctcagctgaggagcaactgaggctggtcgtcaatgcagtgtctagttcacagatctggctcgaaaccacaatggcaaaggtggagggggccgccgcccagctcccttctttgaacaatcgtctgagctatgcagtgaggaaggtgcataccattcgtggtctaatagcaaggaagttggcactcgcacagctccgccaggagtcctgcccccttcctcctcctgtgacagacgtgtcactcgaattacagcagctgagggaggagcgcaatcggctggacgccgagttacagctgagcgcacgactgattcagcaagaggttggtcgggcaagggaacagggtgaggccgaaaggcagcagctcagtaaagtggcacagcagctggaacaagaactccagcagacacaggagagcctggcgagtctcggactgcagctggaagtcgctaggcaggggcagcaggaatctacggaagaggctgcaagtctgaggcaggaactgacacagcagcaggaactttatggacaggctcttcaggagaaggttgcggaggtcgagacacgactaagggagcagctttcagacacagaaagaagactgaacgaggcacgccgggaacacgcaaaggccgtggtttcactgcgacaaattcaacgccgcgcagcccaggagaaggagcgcagtcaggaactccgtcggctacaggaggaggcaagaaaggaggagggtcagcggctggcccgtcgcctgcaagagttggaaagagacaagaatctgatgttggctactctgcagcaagagggactgctctcacgctataagcagcagaggctgctgaccgtgctgccgtcattgttggataagaaaaaatctgtggtttccagccccagacccccggagtgttcagcttcagcccccgttgccgccgccgtgccaacacgtgaatccataaaaggaagcctgtccgttctattagatgacctccaagatctgtccgaagctatctccaaagaggaagctgtgtgccaaggtgacaatctggataggtgttcctcaagtaatccgcaaatgtcctcatag

SEQ ID NO: 2414 - DNA, 2190 bp, Artificial Sequence
  Description of Artificial Sequence: Synthetic coding sequence
atgtttccgccctccgggtctacaggcctcatcccgccctctcacttccaggctaggccactcagcaccctgcctcggatggcacccacgtggctgtctgacatccccttggtgcaacctcccggtcaccaggatgtatcggaacgcaggctcgacacacagcgcccacaggtgactatgtgggagcgagatgtgagctctgatcggcaggagccgggtagacgcggtcggagctggggactggaaggaagccaagccctctcccagcaggctgaagtaatcgtgagacagctgcaggagcttagatggttggaagaggaggtctggttgttgagggagacctcgctgcagcaaaagatgcgcctggaggctcaggccatggaactggaggctctggcccgcgccgaaaaggctggaagagccgaggccgagggactgagggcagccctcgccggtgctgaagtggtgaggaagaacctggaggagggcaggcaacgggagttagaagaggtgcagcgtcttcatcaggagcaattatctagcctgacccaggcccatgaagaagccttgtctagcctgacgagcaaagccgaaggactggaaaagtctttgagtagtctggaaacacggcgggcaggcgaagctaaggaacttgcagaagcacagagagaggcagagctcctgcggaagcaattgtccaagactcaggaggatctcgaagcacaagttaccctcgtggaaaatttacggaaatatgtcggcgaacaggttccaagcgaggtgcattcccagacatgggagcttgagagacaaaagctgctcgaaactatgcaacacctgcaggaagacagggacagcctgcatgcaaccgccgaactgctacaggtgcgtgtacagtcactcacccatatactcgctttacaggaggaggaattgactcgtaaggtacagccatccgatagcctcgagcctgaattcacccgcaaatgccaatctctcctcaacagatggagagaaaaagtcttcgccttgatggttcagttgaaggctcaagagctggagcactccgatagcgtgaaacaactcaaaggacaggttgcgagccttcaggagaaggttacctcccaatctcaggagcaagcaatcttgcagaggagtctgcaggacaaggccgctgaggtcgaagtggaaagaatgggcgctaaaggcctgcagctggagttaagccgggcccaggaagcccgaaggtggtggcagcaacagactgcatccgccgaggagcagctaagacttgtggtgaatgccgtctcctcctgtcccctgccccccccagttacggacgtatctctggagttacagcagctccgtgaagagcgtaatcggttagacgccgagctccagctgagtgcccgtctcattcagcaggaagttggaagagccagagagcagggagaggccgagcgccaacagctgtctaaagtggctcaacaactggagcaagagctgcaacagacgcaggagtcccttgcatcattaggccttcagctggaagtggccaggcaatgccagcaagagtccaccgaggaagccgcaagcctcaggcaagaactgactcaacagcaggaactgtatggtcaagccctgcaggagaaagtggctgaagttgaaacacgactgagagaacagttgagcgatacagaacgcagacttaacgaggcacggcgggagcatgctaaagccgtggtatccctgcgccagatccagagaagagcggcacaggaaaaggagcggagtcaggaacttagacggctgcaagaagaagctaggaaagaagagggccagcggctggcccgaaggttgcaggagctggagcgagacaaaaatctcatgcttgcaactctgcagcaggaaggactcctcagccggtataaacaacagagactcctgacagtgctgcctagcctgcttgacaagaagaaaagcgtagtcagctctcctagaccgcctgagtgcagtgcttcggccccagttgctgccgccgtgccaacgagagaatctatcaaaggctcactaagcgtgctgctggacgacctgcaagatctgagtgaagctatcagcaaggaggaggccgtgtgccagggggataatttagaccgctgttcctcttgtaacccacaaatgagtagctag

SEQ ID NO: 2415 - DNA, 2349 bp, Artificial Sequence
  Description of Artificial Sequence: Synthetic coding sequence
atgtttcctccctccggctctaccggcctgatccctccttcacacttccaagcccggccgctatctaccttgcccaggatggcccccacatggctgtctgacattcctctcgtacagccaccggggcaccaggatgtcagcgaaaggcgcctggacactcagagaccacaggtgactatgtgggagagggatgtgagctccgaccgacaggaacccgggaggaggggaagaagttggggcctcgaagggtctcaggccctgagtcagcaggcggaggttatcgtgcgccaactgcaggagctgaggtggctggaggaagaagtgtggctcctgagggagacatcactgcaacagaaaatgcgcctggaggcacaagccatggagctggaggctctggctagggcagagaaggctggccgggccgaggcggagggtctcagggcagctctcgccggggccgaggtggtccggaagaacttggaagagggacgccagcgggagctcgaggaggtgcaacgcctccaccaggagcaacttagctctttaacccaggcccacgaggaagccctgagctctctaacctcgaaggcagaggggctggagaaatcgctgtcatccttagagacacggcgggcaggggaagcaaaagaactggctgaggctcagagggaggctgagctgcttagaaaacagctttctaaaactcaggaagatctggaggcccaggtaacactggtcgaaaatctgaggaagtacgtcggcgaacaggtgccttcagaggtgcattctcagacttgggaacttgaaagacagaagctcctggagactatgcaacaccttcaggaggatagagactcacttcatgccacagccgagctcctgcaggtccgggtgcagagccttactcacatcttggcactccaagaggaagagttgactaggaaggtccagccgagcgattccttggaaccagagttcactagaaaatgccagagtctgctgaacagatggagagagaaagtattcgccctgatggtccagctgaaggcccaggagttagagcactcagattcagtaaagcaacttaaaggacaggtcgcctccttgcaggagaaagtgactagtcagtcacaggaacaggcaatcttgcagcgctctctgcaggacaaggcagcggaggtggaggtcgaaagaatgggagcaaagggccttcagttagagctaagtcgcgcgcaagaagccaggaggtggtggcagcaacagaccgccagcgctgaagaacagttgcgcttggtagtcaatgccgtttcaagctcacaaatatggctggagaccacgatggctaaggtggaaggggcagcagcccagcttccaagcctgaataacagactatcctatgccgtgcggaaggtgcatacaataaggggcctgatcgccagaaagctggctctggcccagctaaggcaagagagctgccccttaccgccgcctgtgactgacgtttctctcgaactgcagcagcttagggaggaaaggaatagattagatgcggagttgcagctcagtgcccgcctgattcagcaggaggtgggcagagcccgggaacagggtgaggctgagcgacagcagctctctaaggtggcccagcagctcgagcaagaactgcaacagacacaggaaagccttgcgagtttaggactccaactggaagttgccagacaatgccagcaagagtctaccgaggaagctgccagtctccgacaggagttaactcaacagcaggagctgtacggccaggcccttcaggaaaaagttgccgaggtagaaacgaggctaagggagcagctaagcgataccgagcgacgcctcaacgaggctcgtcgggaacacgccaaggcggtcgttagtctgagacagatacaaagacgagccgcccaggagaaagaacggtctcaggagctgcggaggctgcaagaggaggcgcggaaagaagaaggtcagaggctcgctcgtcggctccaggagctggagagagataagaatctgatgctggccactttgcaacaggagggccttctgtcaagatacaagcaacaacgtctcctgacagtactgccttccttgcttgacaaaaagaaatctgtcgtctcatctccaaggccacctgaatgcagcgcaagcgcacctgttgccgctgccgtaccaacccgggagtccatcaaaggtagcctgagcgttctcctagatgatctgcaagacctgagtgaagcaatcagcaaggaggaagcagtgtgccaaggagacaaccttgatcgctgcagtagctgtaacccccaaatgtcgagctag

SEQ ID NO: 2416 - DNA, 2190 bp, Artificial Sequence
  Description of Artificial Sequence: Synthetic coding sequence
atgttccccccttccgggagtacgggcctaattccgccctcacattttcaggctagacccctaagcactctgccgcgcatggccccaacttggctctcagacatcccactggtgcagcccccaggccaccaggacgtctccgagcgcagactagatacacagaggccgcaggtgacgatgtgggagcgggacgtgtccagcgatcgtcaggagcccgggcgtaggggcagaagctggggtctggagggcagccaggcactgtcccagcaggcggaggtaatcgtgcgccagctgcaggaactgcggagactcgaagaagaagtgcggttgttacgcgaaacctcactgcaacaaaagatgaggctggaagcccaggcaatggaactcgaggccctggcccgggctgaaaaggcagggcgggctgaagctgagggactcagagcggccctggccggagccgaggtggtccgaaaaaacctggaagagggaagccaaagggaactggaggaggtgcagcgcctgcatcaagaacagctgagctcactgacccaggcccacgaggaggctctctccagtctgacttctaaagctgagggactagagaagagcttgagcagcctggaaacccggcgtgccggagaagcaaaggaactcgctgaagcgcagagagaggctgaattactcaggaagcagctttccaagactcaggaggatcttgaagcccaggttaccctggtggaaaacctgcgcaagtacgttggcgagcaagttccaagcgaggtccatagtcagacatgggaactcgagcggcagaaactcctggaaactatgcaacatttgcaggaagatagagacagcctgcacgcgaccgctgaattattgcaggttcgggttcaaagcctaacacacattcttgccctccaagaggaggaactgaccagaaaggtccagccctctgatagtctcgagccagaattcactcggaagtgtcagtcactgctgaaccgctggcgggagaaagttttcgccctcatggtccagctcaaggcacaagagctggaacacagtgatagcgtcaagcagctgaagggccaggtggcttcactccaggaaaaagtcacctcccagagccaggagcaagccatcttgcaaagatctttacaagacaaggcggccgaggtcgaggttgagcgcatgggcgctaaaggcttgcaactcgagttaagcagggcccaagaggcgaggcgacgttggcagcagcaaactgcctcagcagaggaacaacttcgtctcgtggtgaatgccgtgagtagttgtccgctgcctccaccagtgactgatgtctccctggagctgcagcagctgcgggaggagcggaatagactcgatgccgagctccagctgagcgccaggctgatccagcaggaggtcggacgcgcacgagagcagggtgaggctgaaaggcaacagcttagcaaagttgcgcaacaacttgaacaagaacttcagcagactcaggagtcgctggcaagccttggtttacagctagaagtggcgcgacaaggtcaacaagagtctaccgaagaagcagctagtctgcgacaagagcttacccaacagcaggaactgtatggccaagcactgcaagaaaaggtcgccgaagtggagactagacttagggaacagttgagtgacaccgagcggaggctgaatgaggctagaagggagcatgccaaggccgtcgttagccttagacagatacagcgacgagcggcccaggaaaaggagaggtctcaggagctgagacggctgcaggaggaggctaggaaggaagagggacaaagactcgcacgtaggttacaggaactggagcgggacaagaacctaatgcttgctacacttcagcaggagggtctgctgtcaaggtataagcagcagaggcttttgacagtattgccatccttgcttgacaagaagaagtccgtggtgtccagtcctcgtccccctgaatgtagcgcctccgcaccagtagctgccgccgtcccaactagagaatctatcaaagggtcactgtctgtcctgctggatgacctacaggatctgtcggaagctatctccaaggaagaggccgtatgtcagggagacaacctagaccgatgcagcagctctaatcctcagatgagctcatag

SEQ ID NO: 2417 - DNA, 2616 bp, Artificial Sequence
  Description of Artificial Sequence: Synthetic coding sequence
atgtggccacactctgcaggcgccagaccttgggcctctacgttaactggaaaagacccccgggtgatggcgtgttggtgtttagacggattgcccagcgggctcgctgagccctggcgcgagctctggaggtggcggagcagacctctacattgtgtgccgccgtttagcccacttgcgcggtccagcagagatcatcgaaatctgcggagaaggggcaatattgacggttggaggcagaatctagaaccaagcaataatgtggagatgttccctccatccggctcaaccgggttgattccaccctcacacttccaggctcgccccctgtcgactttgccgaggatggcccccacatggttaagcgacatccccctggtacaaccacctgggcaccaggatgtatctgagcgcaggctggacacccagcggcctcaggtgactatgtgggagagggacgtcagttccgataggcaggaacctggccggcggggacgtagctggggattggaagggtcgcaggctttatcgcagcaggcggaagtcatcgtccggcagttgcaggagctcagacggttagaagaggaagtcagattgttgcgcgagacatccctccagcagaagatgcgattggaggcccaagccatggagcttgaagccctggctcgggccgaaaaggctggccgggcagaagctgagggtctacgggcggccctcgccggcgccgaagtcgtgcgcaaaaatttagaggaagggagtcaacgcgagctggaagaagtgcagcggttacatcaggagcaactgtctagtctgactcaagcccatgaggaggcattgtcttcactgacctccaaggccgagggtctggaaaaaagcctgtcttctctagagactcgccgagccggtgaggcaaaagagcttgctgaagctcagagagaggcagaattgctccggaaacagctgagcaaaacccaggaggatctggaagcccaggtgacactggtagagaacctccgcaaatatgtgggggaacaggtgccctcagaagtccacagccagacctgggagcttgagcgacaaaagctgctcgagactatgcaacatctgcaggaggaccgcgatagcttgcatgcgactgctgagctgctgcaggtgcgagtgcaatctttgacacatattctggcacttcaggaagaggagcttactaggaaggttcagcccagcgattcattggagcctgaatttacccgaaagtgccagtctctgttaaaccgctggcgggagaaggtgtttgcgcttatggtccagctcaaggctcaagaactggaacacagcgacagcgtgaaacagctgaaaggacaggtggcaagcctgcaagagaaagtgacttcccagtcccaagagcaagccatcctccagaggtctctacaggacaaggccgcagaggtagaggtagaacggatgggagcaaagggcttgcagctggagctgagtcgcgcacaagaagctcgcagacgttggcagcagcagacagcatcagccgaggagcagctcagactggtggttaacgcagtttcctctagtcagatttggctcgaaactaccatggctaaggtggagggcgccgcagcacagttgcctagccttaacaaccggctgtcctacgccgtgcgaaaggtccacaccatacgcggtctgatcgcccgcaagctcgccctcgcacaacttaggcaagagtcatgcccgctcccacctccagtgaccgacgtgagtttggagttgcaacagctccgcgaggaacgcaatcgccttgacgctgaactgcagctgtctgctaggttgattcagcaggaggtgggcagggccagagaacagggcgaggcagagcgtcagcagctatctaaggtggcccagcagcttgaacaggaacttcagcagactcaggaaagtctcgcctcccttggtctgcaacttgaagtggcaagacagggtcaacaggagagcaccgaggaggccgcctctctgaggcaagaactgacacagcagcaggaactttacggacaggcactccaagaaaaggtggcggaggttgaaaccagattgagggaacagctttcagatactgaacggaggctcaacgaggcccgacgggagcatgctaaggccgtggtcagtctgcgacagattcaaagaagagctgcacaggagaaagaacgctcccaggaacttaggcgcctccaggaggaggctagaaaagaggagggtcagcgcctggcccgcagactgcaggagttggaacgcgacaaaaatctgatgcttgccacactccagcaggaaggtcttctcagtcgatataagcagcagagacttctaacagtcctgcccagccttttagataaaaagaaaagcgtggtgtctagtcctagaccaccagaatgttcagcaagtgctcccgtagctgctgcagttccaactagggagagtatcaagggttcgctatcagtattgctggatgatctgcaggatctgtctgaggccatctcaaaggaggaggccgtgtgtcaaggcgacaaccttgacaggtgttcttctagtaacccacagatgtcatcatag

SEQ ID NO: 2418 - DNA, 516 bp, Artificial Sequence
  Description of Artificial Sequence: Synthetic coding sequence
atgtttccaccctctgggcaatgggatcagactcggggtgttgtggttgtctcggcctgggagaccgaccacctgtgcttctgcaattcttcaggttcaacagggctgattcccccctcacacttccaggccagaccgctgtccacactgcccagaatggcgcctacttggctgagcgacatccctctggtccaacctccaggtcaccaagatgtgagcgagaggcggctggacacgcaaagaccacaagtgaccatgtgggagcgcgacgtgagtagcgaccgtcaggagccaggccgaagaggcagatcttgggggttagaagggtctcaagcactttctcaacaggccgaggtgatcgtccggcagttacaggaactgcggcggctggaggaggaagtgcgcctgctgagagagacgtcattacagcagaagatgcggctggaggcgcaggcaatggagctggaagcactcgccagagccgagaaggccgggcgggccgaagcagagggctag

SEQ ID NO: 2419 - DNA, 516 bp, Artificial Sequence
  Description of Artificial Sequence: Synthetic coding sequence
atgttcccccctagtggccagtgggaccagacccgtggtgtggtcgtagtgagcgcctgggaaacagaccatttatgcttctgtaattcctctgggtctactggactgattccgcctagccatttccaggccaggcctctctccacccttcctcgcatggcccctacatggctgtctgatattccactggtgcagccgcctggccatcaagacgtttccgagcgccgcctggacactcagcgacctcaggtgaccatgtgggagagagacgtgtctagtgacaggcaagagcctggtcggagaggtcgctcctggggcctggaaggatctcaagcattgtctcagcaggctgaggtgatcgttagacagcttcaggaactgcgacgcttggaagaggaagtgaggctgctccgggaaaccagcctccagcagaagatgcgtctagaggcacaagctatggagttggaagcactcgctagagccgagaaggctggcagagccgaggcagagggttag

SEQ ID NO: 2420 - DNA, 2190 bp, Artificial Sequence
  Description of Artificial Sequence: Synthetic coding sequence
atgtttccacccagtgggagcacaggcctcataccaccatctcacttccaggccaggcccctgagcacattacctagaatggctcctacctggttatccgacatccctcttgtgcagcctccaggccaccaggacgtgagcgagaggcgcctggatacccaaaggccgcaggtgactatgtgggaaagagacgtgagcagtgatcgccaggaaccaggaagacggggacggtcctggggactggagggaagtcaggctctgagccagcaggcagaagtcattgtcagacagctgcaggaactgagatggctggaagaggaagtttggttactgcgggagaccagcctccaacagaagatgcgcctggaggcccaggcgatggagcttgaagcattggcacgagccgaaaaggccggtcgggccgaggccgagggcctccgggcagccttggccggcgccgaggtcgtccggaagaatctcgaggagggtagacagagggagctcgaggaagtccaacgcctgcatcaggaacagttatcctcattaacacaagcccacgaagaggctttatccagcctcacttctaaagctgagggattagaaaagagcctgagttcacttgaaacccgtcgggccggagaggccaaagagctggcagaggcccagcgggaggccgaactactcaggaagcagctttccaagactcaagaagatctcgaagcgcaggtgaccttggtggaaaacctgaggaaatacgttggggagcaggtgccctcagaggtgcacagtcaaacttgggaactggaacggcagaagttactggagactatgcagcacctacaagaagatcgcgattccctccacgccaccgccgaacttctgcaagtgcgggtccagtcgctgacacatatcctcgctctccaggaggaagagctgacccgtaaagtacagccaagcgatagtctggaaccagaattcacacgcaagtgtcagagcttactcaacagatggagagagaaagtctttgcgctcatggtgcagttgaaagcccaagagctggaacattccgactccgttaagcaactgaagggtcaggtggcctccctgcaggagaaggtcacaagccaatctcaggagcaggccatcctccagagatccctccaggacaaggctgccgaggtcgaggtcgaaagaatgggagccaaggggctgcagctggaactgtcgagggcacaggaggccagacggtggtggcaacaacaaacagccagtgccgaagagcagctgaggctggtcgttaatgctgtctcctcttgtccactccccccaccagtaaccgatgttagccttgagttgcaacagctcagggaggaaaggaacaggttagatgccgagctccagctatccgccagattgatccagcaggaagtcgggcgggcacgggagcaaggtgaggctgaaagacagcagctttccaaagttgctcagcaactagagcaagagctacaacagacccaggaaagcctggcgtcgctgggcttacagctggaagtcgcgcgccagtgtcagcaggagagtacggaggaagccgcttcattgagacaggaactaacccaacagcaagagctttatggccaggctttgcaggaaaaggtggccgaagtggagacacgcctacgggagcaactctcagacactgagcgacgcctcaatgaagcccgccgggagcatgccaaagctgtggttagcctgaggcagattcagcggcgcgctgcgcaggagaaggagcgaagtcaggaactgcgaagattacaggaggaagcaaggaaggaggagggccagcggctggcacggcgcctgcaggagctggagcgggacaaaaatctcatgttggccacccttcagcaagaagggctgctgtcccggtataagcagcaacgactcctgactgtgctgccaagcctgctggacaagaaaaaatctgtcgtgagctcccccagaccacccgagtgctctgcctcagctccagtcgctgccgccgttcctacaagagagtccataaaaggaagtctgagcgtgctgctagacgatctacaggacctgtcagaggctattagcaaagaggaagccgtgtgtcagggggacaatctggaccggtgtagtagctgtaatccacagatgagttcttag

SEQ ID NO: 2421 - DNA, 2349 bp, Artificial Sequence
  Description of Artificial Sequence: Synthetic coding sequence
atgttccctccatctgggagcacaggtctgattccaccatcacattttcaggcccggccgctctccacactgccgagaatggccccgacctggctgtcagatatcccccttgtgcagccaccagggcaccaggacgtttctgaacgccgcttggacacacagaggcctcaagtcaccatgtgggagcgggacgtgtctagtgatcgacaggaaccaggacgcagaggtcgctcttggggattggaagggagccaagctttgagccagcaggcagaggtcattgtgcgacaactgcaggaactgcggtggttagaggaggaggtgtggcttttgcgagagacctctttacaacagaagatgcgccttgaggcgcaggctatggaactggaggcactggcacgcgctgaaaaggcaggtcgcgccgaggctgaaggcctgagggcagctctggcaggggccgaagtggtccggaaaaacctagaggagggccgccagagagagctcgaggaggtgcaaaggctgcatcaggagcagctgagtagcctaacccaggcgcacgaggaagccttatcctcactgacttccaaagcggagggtctcgaaaagtctctgtcctctctggagactaggagggcaggcgaggccaaagaactcgccgaggcccagagggaggccgaactcctgagaaagcaactctccaagactcaggaggaccttgaagcccaagtgacactggtagagaacctcagaaaatacgtcggcgagcaggttccatctgaggtgcacagccaaacttgggaactggagcggcagaaattgttggagaccatgcagcacttacaggaggatcgcgattcactgcatgccactgcggagctcctgcaggttcgagtgcagtccttaactcatatcctggccctgcaggaagaagaactgactagaaaggtgcagcctagtgacagcctggagccagagttcactcgcaagtgccagtcgctgctgaatcggtggcgtgagaaggtattcgcactgatggtgcagctgaaagctcaggagctggaacattctgactcagttaaacaactcaagggccaagttgcatccctccaggaaaaagtgacgagccagtcccaggaacaggctattctgcaacggtcccttcaagataaagctgcagaggttgaagtcgagcggatgggagcaaaggggctgcaactggagttatctcgagcacaagaggctcgaaggtggtggcagcagcaaacagcctccgctgaagagcagttaaggttggtggtaaacgctgtttcttcctcacagatctggttagagaccacaatggccaaggttgagggagcagctgcccagcttcccagcctgaacaaccgtctgagctacgccgtgcggaaggtccatacaatcagaggcctcatagctagaaagttagcccttgcacagttacggcaggaaagttgccctctgccacctcctgttacggacgttagcctggagcttcagcaattgcgggaggagcgaaatagattggacgccgaactgcagcttagcgctcgtcttatccaacaagaggtcggacgggccagagagcagggtgaagccgagagacagcagttatctaaggtggcacaacagctcgaacaggagctgcagcagactcaggaaagcctggcttccctaggcctgcagctggaagtcgcaaggcagtgccagcaggaatcaacagaggaggctgccagcctgcgtcaggagctgacacagcaacaagagctgtacggccaggcactgcaggaaaaagtcgcagaagtcgagacccgccttcgggagcagttgtccgatacagagagacgcttaaacgaggctaggcgcgaacacgccaaagccgtcgtgtccctcagacaaattcagcggcgggccgcacaggagaaggaacgctcacaggagttacggcggctccaggaagaagcccgcaaggaagagggacagcggctggcgaggcgattacaggagcttgaaagagataagaacctgatgttggctacactgcagcaggagggcctgctgtctcgttacaagcagcagaggcttttaacagttctcccttctttactggacaaaaagaaaagtgtggtttcttcacctcgcccgcccgagtgctcagcttccgcccccgttgccgccgcagtacctactcgggagtccataaaaggatccctctctgtactgctcgacgacctgcaagacctgtctgaggcaatttctaaggaagaagccgtgtgccagggggataacttggacagatgttcttcttgcaacccccagatgtctagctag

SEQ ID NO: 2422 - DNA, 2349 bp, Artificial Sequence
  Description of Artificial Sequence: Synthetic coding sequence
atgttcccccctagcggatccacaggcctcatcccgccatcacacttccaggctcggccactaagtactctgcctcgaatggctcctacttggctgtccgatatcccactggtgcagcctccagggcatcaggacgtgtccgaaagaaggcttgacactcagcgccctcaagtgaccatgtgggagcgggatgtgtcttccgacaggcaggagcctgggaggaggggcagaagctggggtttggagggctcccaagcgttgtcacagcaggcagaagtaatcgtgcggcagcttcaagaactgcggcgcttggaggaggaagtacgcctgctgcgcgaaactagcctgcagcagaaaatgcgacttgaggcacaagccatggagctggaggccctggcacgggcggaaaaggcaggccgcgcggaagctgaaggactgcgtgccgcactcgccggcgcagaggtggttaggaagaatctggaggagggccgccagcgcgaattagaggaggtgcagcgcctacaccaggagcagctttcatcgcttacacaggcacatgaggaggcattgagttctctgacatccaaggcagaaggtttggagaagtctctgtctagcctcgaaacccggagagctggggaggcaaaagagctggccgaggcacagcgcgaagctgagctgctccgcaaacagctgtctaaaacccaggaggacttggaggcccaggtcaccctcgtggaaaatctgcgcaagtatgtcggtgagcaggtgccctcagaagtgcatagtcagacctgggagttagagagacagaagctgctggatacaatgcagcacctgcaggaggatagagactcacttcatgcaaccgctgagcttcttcaggtgcgcgtgcagagtctgacccacattctggccttgcaagaggaggagctgactaggaaggtgcagccgtcagactccctggagcccgaatttacgcgcaaatgccagtctctcctcaaccgttggagagaaaaagttttcgccctgatggtgcagctgaaggcacaagagttggaacatagtgattcggtcaaacagcttaaagggcaagtagcttcattacaggagaaggtgacgtcccagagtcaggaacaagccatcctacagcggtctcttcaagataaggcagcagaagtcgaagtggagagaatgggagcgaaaggtctgcagttggaactgtccagagctcaggaggctcggcgacgatggcaacagcagacagccagtgccgaagagcaacttaggctggtcgtaaacgccgtgagcagcagccagatctggctcgaaaccaccatggccaaagtagagggagccgcggcccagcttccgagtcttaacaataggttgagttatgctgtaaggaaggtccataccatccgcggactcatcgccaggaaactcgctttggcccagctgcgccaggagagctgtccattgccacctccagttaccgacgtatcactggagctgcagcaattaagagaagagcggaatagattggacgcagagttacaactgtccgctagactgatccagcaggaagttgggcgcgcaagagaacagggcgaggctgagcgacaacaactgtcaaaagttgcccaacaactagaacaggaactacagcagacccaggagtcactcgccagcttaggactgcagctggaagtagctcgacagggccagcaggaaagcacagaagaggctgcctccttaaggcaggaactaacacaacagcaggagctctacggtcaagccctgcaggaaaaggtggcagaggttgagacccgcttacgagaacagctcagtgacacagaaagaaggttgaacgaagcaaggagggagcatgcgaaagctgttgtaagccttagacagattcaaaggcgcgccgcccaagaaaaagaaaggtcccaggagctgcgaagactgcaggaagaggcacggaaggaggagggtcagcgcctggccagacggttgcaggaactggagagggacaaaaacctcatgctggccaccctgcaacaggaggggctgttaagccgatataaacaacagagactgttaaccgttctgccttcacttctcgataaaaagaagagcgtcgtcagttcgcccagaccccctgaatgcagcgcaagcgcaccagtggccgccgcagttcccactagagagagcatcaaggggtcattgtccgttttgttggatgatctgcaagatctgtctgaggccattagtaaggaggaagcggtatgccaaggagacaatctggaccgctgttcctcatctaacccgcaaatgtctagctag

SEQ ID NO: 2423 - DNA, 384 bp, Artificial Sequence
  Description of Artificial Sequence: Synthetic coding sequence
atgttccctccttctgggcagtgggatcagaccaggggagttgtggtagtgtcggcgtgggaaaccgaccacctctgcttctgtaattcatcaggatcaaccgggcttattcccccctcccactttcaggctcggccgctgtcgacgcttcctcgcatggcccccacctggctgtccgatatccccttggtccagccgcctggtcatcaagacgtgagtgaaaggaggcttgacactcagagaccccaagtgactatgtgggaacgggacgtatcttccgaccggcaggaacccgggaggcgcgggaggtcgtgggggctggagggcagtcaggctctttctcagcaggctgaggtgattgtgcgccaactacaagaactatag

SEQ ID NO: 2424 - DNA, 384 bp, Artificial Sequence
  Description of Artificial Sequence: Synthetic coding sequence
atgttcccaccttctggacagtgggaccagactaggggggtggttgtggtctcggcttgggagacggaccacctctgtttctgcaactcttcaggcagtaccggactaattcctccatcacactttcaggccaggcctctaagcactctgccacggatggcacctacctggcttagtgatattccgctggtccaaccaccagggcatcaggatgtgagcgagaggcgactggacacccagaggccacaggtcactatgtgggaaagagacgtgagttccgatagacaggagccaggccgccgtggtaggagctggggtctcgagggatcccaagctctgtcccagcaagccgaagtcattgtaagacagctgcaggagctgtag

SEQ ID NO: 2425 - DNA, 516 bp, Artificial Sequence
  Description of Artificial Sequence: Synthetic coding sequence
atgtttcccccaagtggtcaatgggaccagacgcgcggggtggtggttgtgtcagcctgggaaaccgaccacctctgcttttgcaacagctcgggtagcaccgggttgatcccaccttcccatttccaagcaaggccgctgagtaccctccctaggatggctcctacctggttgtcggatatccccctggtgcagcccccaggccatcaagatgtgtcggaaaggcggctcgacacccagaggccgcaggtgaccatgtgggaaagagacgtgtcaagcgaccggcaggaacctggaagacggggccggagttggggattagagggatctcaggcgctgtctcagcaagcagaggtcattgtgagacagctgcaagagctgaggtggttggaggaggaagtttggctactccgggagacctctctccagcagaaaatgcgtctcgaggcccaagcaatggagcttgaagccctggccagggctgaaaaggcaggtcgggccgaggctgaagggtag

SEQ ID NO: 2426 - DNA, 771 bp, Artificial Sequence
  Description of Artificial Sequence: Synthetic coding sequence
tagcgcctggatgccgaactgcaattgagtgcacgattaattcagcaagaggtgggaagggcccgggaacaaggcgaagccgaaaggcagcagctgtcaaaggtcgcgcaacagctggagcaggaactgcagcaaacccaggagagtcttgcgtcccttggacttcagttagaggtcgcacgccaaggccagcaggagagcacggaggaggccgccagccttaggcaggaacttacacaacagcaggagctttatggccaggcattacaggagaaggtggccgaggtggagacccggttgagggagcagctatccgatactgaaaggagactgaacgaagctcggcgggaacatgccaaagccgtggttagcctcaggcagatacagagacgggcagctcaagagaaggaacgttcacaagagcttcgtagattgcaggaggaggccagaaaagaagaaggccagcgcttagcacgtcggcttcaggaactcgagcgggataaaaatttaatgctgcagcggctccttacagtcctgcccagtctgctggacaagaagaagagtgtagtgagctctccgcggccaccagaatgctctgcgtctgccccagtagcagcggcggtgccgacgagagaatccattaaggggtccctgagcgtattgctggatgatctgcaagatcttagtgaggcgatcagcaaagaagaagctgtgtgccagggggacaacttagaccgctgctcctcttcaaacccccagatgagctcatag

SEQ ID NO: 2427 - DNA, 2349 bp, Artificial Sequence
  Description of Artificial Sequence: Synthetic coding sequence
atgttcccaccaagtgggtcgaccggattgatacctccgtcccacttccaggccagacccctgagtactctccccaggatggcccctacatggctgtccgatattccattggtgcagcctccaggccaccaggatgtaagtgagagaaggctggatacacagagaccacaggtgaccatgtgggaacgtgacgtcagcagcgaccgtcaggagcctgggaggagagggagatcttggggactagagggctcgcaggcattaagccagcaagcagaggtcatcgtgaggcagctccaggaactgagaaggttggaagaagaagtgcggttgctccgcgaaacctcgctgcagcagaagatgcggctggaggcccaagccatggagctggaggctctggctcgagcagaaaaagcagggagggccgaagccgagggccttagagcagccctcgcaggcgcagaggtcgtcagaaagaacctggaggaagggcggcaacgggagcttgaagaggtccagaggctgcaccaggaacagctgagctctttgactcaggcgcatgaagaggccctgtcttcattgacctccaaggcagaaggactcgaaaaatccctttcatccctggagacccggagggcaggagaggccaaggagttggcagaggcccagagggaggcggaactcctgagaaaacagctctccaaaacacaggaagatttagaggcacaagtgactttggtggagaatctccggaaatacgtgggcgaacaagtgccaagcgaggtacactcccagacgtgggaacttgagcgacaaaagctgttagataccatgcagcacctgcaagaagatagggactccctgcatgccactgcagagcttctacaggtgcgtgtccagagtctgacacatattttagccttacaagaagaggaactgactcgaaaggttcagccgagcgatagccttgaaccggagtttactagaaaatgccagtccctccttaatcgatggcgcgaaaaagtatttgctcttatggtgcagctgaaagcccaggaacttgagcattctgacagtgtcaagcagcttaaagggcaggtggcttctctccaggagaaagttacatcgcaatctcaggaacaagcgatcctgcagaggtctctccaggataaagctgctgaagtggaggtcgagcgaatgggcgcaaagggactgcaactggaacttagtcgcgcgcaagaagctagacggagatggcagcagcagactgccagcgctgaggagcagctgcgcctggtagtcaacgctgtgtcatcctcacagatttggcttgagaccactatggccaaggtcgaaggggccgctgcccagctcccaagcttgaataacaggctctcctacgcagttaggaaagtgcataccatcagggggcttatagctcgaaagctggctcttgcccagcttaggcaggagtcttgccctttgcctccccctgtcaccgatgtgagtttagaactgcagcagctccgcgaagagcgtaacaggctcgacgccgagctgcagctgtccgctcgcctcatccaacaggaagtgggaagggcgagggagcagggcgaagcagaacgccagcagctaagtaaagtggctcaacaactggaacaagagttgcagcagacacaagagagcctggcctcccttggcttacagcttgaggtggctcgtcaggggcagcaggagagcaccgaggaagctgcctccctcaggcaggagctaacacagcagcaggagctgtacggccaggcgctgcaagagaaggtggcggaggtggagacccgcctgagagagcagctcagtgacactgaacgtcggctcaacgaagcccgccgggagcacgccaaagcggtcgttagcttgcgccagattcagcggcgagccgcacaggagaaagaacgttcccaggaacttagacgacttcaggaggaggctagaaaggaggaaggtcagaggctcgccaggcgtttgcaggaactggagagagacaagaatctgatgttggcaacacttcagcaggagggactgctctctcgctacaagcaacaaaggctgctaacagttttgccctccttattggacaagaaaaagtcagtggtgagctctccgcgaccccccgagtgctctgccagtgcacccgttgcggccgcagtgccgacacgcgaatccattaaaggctcactcagtgtgctactggatgacttgcaagacctttctgaggctatttcaaaagaagaagccgtgtgtcagggtgataacctcgacagatgctcttcttctaatccgcaaatgtcctcttag

SEQ ID NO: 2428 - DNA, 771 bp, Artificial Sequence
  Description of Artificial Sequence: Synthetic coding sequence
tagcggctagacgcagagttacagttgagcgcaaggttgatccagcaggaggtcggaagggcacgagaacagggggaggctgagaggcagcaactgagtaaagtggctcagcagttagaacaggagttacagcagacacaggagtccctcgcgagcctaggcttgcaactcgaagtcgcaaggcagggccaacaagaatcaactgaggaagctgcatcactgcgccaagaattgacgcagcagcaagagctgtacgggcaggcgcttcaagagaaggttgcagaagtagaaacaaggcttcgcgaacagctgagtgacacggaacgacgacttaacgaagcccgccgggagcacgcgaaagctgtcgtgtcactgagacagatccagagaagagctgcccaggagaaggaaagaagtcaagagctgcgcagactgcaggaagaggctaggaaagaagaaggccagaggctcgcccggcgcttacaggaactggagagggacaaaaacctcatgcttcaacgcctgctgaccgtgcttccttctcttttagacaagaagaaaagcgtagtttcttcaccccgacccccagagtgttctgccagcgcacctgttgctgcagcagtcccaactagggaatcaattaaagggagtctgtcagtgttactggatgacctgcaggatttgtctgaagcaatcagtaaggaggaggctgtttgtcagggtgataatttggaccggtgctcttcctctaacccacaaatgtctagctag

SEQ ID NO: 2429 - DNA, 771 bp, Artificial Sequence
  Description of Artificial Sequence: Synthetic coding sequence
tagcgattggatgctgagttgcagctatccgcacgactgatacagcaagaggttggcagggctagagaacagggagaggccgagcgtcagcagttatccaaagtggcccaacagctggagcaggaactgcagcagactcaggaaagcctggcgagtctgggccttcagctcgaagtggcccgccagtgtcagcaggagtctactgaggaggccgcctctttacgccaggagctcacccagcaacaggaactctacggacaggcgctccaggaaaaagttgctgaagtggagactcgactgcgagaacagctatcagacactgagaggagactgaacgaggccaggcgggaacacgctaaggccgtggtcagcctgaggcagatccagagacgcgcagcccaggaaaaggagcgaagtcaagaactgcgccgtctgcaagaagaagcccgcaaagaggaaggacagcggctggccaggcgcctgcaggagcttgaaagggacaagaaccttatgttacagaggttgcttaccgtcctgcccagccttttggacaaaaagaaatccgttgttagtagccctcgccccccggagtgttccgcctcagctccagtggcagccgctgttcccacaagggagagcatcaaagggtcactgtcagttttgctggacgacctgcaagatctgagcgaagctatttctaaggaagaggctgtctgtcagggcgacaatctggacaggtgctctagttgtaacccccagatgagctcctag

SEQ ID NO: 2430 - DNA, 516 bp, Artificial Sequence
  Description of Artificial Sequence: Synthetic coding sequence
atgtttccaccttctggccaatgggatcaaaccagaggcgtggtggtcgtgtccgcctgggaaacagaccacctgtgcttctgtaatagtagcggtagcaccggcttaattcctcctagccatttccaagccagacccctcagtaccctaccacgtatggcgccgacttggttgtcagatattcccctcgtgcaacctcctgggcaccaagacgtgtctgagcgccgactggatactcagcgccctcaggtcacgatgtgggaacgcgacgtctcctctgatcggcaggaaccgggacggcggggacgttcatgggggctggagggctcccaggctcttagccagcaggccgaggtcatcgtgcgtcagctccaggagctgcgtagactggaagaagaggtgcgtttgctgcgggagacttctttacaacagaagatgcgactggaagcccaggcgatggagctggaagcacttgcccgagctgagaaagccggtagggctgaagccgaaggctag

SEQ ID NO: 2431 - DNA, 462 bp, Artificial Sequence
  Description of Artificial Sequence: Synthetic coding sequence
atgttccctccatctggctcgaccggcctcattccaccatctcatttccaggcaaggcccctgagcacactaccccggatggccccaacatggctaagtgacatccccctagttcagcccccgggacatcaggacgtatctgagcggaggttggacacacagcgccctcaggtaactatgtgggagagggacgtatcctcagatcggcaggaacctggccgtagaggtaggtcttggggattagaagggagccaggccctgtctcaacaggcggaagtgatcgtgcggcagctgcaggagttgagaaggttggaggaagaagtaagactgctgagggagacctcattgcaacagaaaatgcggcttgaagcacaggctatggagctggaagctctggccagagccgaaaaagccgggagagcagaggcagagggattgcgcgcagctctcgctggagcctag

SEQ ID NO: 2432 - DNA, 462 bp, Artificial Sequence
  Description of Artificial Sequence: Synthetic coding sequence
atgttccctccatctggtagtactgggcttatccctccatctcattttcaggctagacccttatccacgctgcctcgaatggccccgacatggctgagtgacattcccctcgtacagccgccagggcaccaagatgtcagcgaacgtcgactcgacacacaacggccacaggtgaccatgtgggagagagacgtctcaagcgatcggcaagagccaggcagaagggggcgatcttgggggctcgagggcagtcaagccctcagtcagcaagctgaggtgatcgtgcgacaactgcaggaattacggaggctggaagaggaagtccggttactgagagaaacaagcctgcaacagaaaatgaggctggaggcccaggcgatggaactcgaggcactagctagagccgagaaggcaggacgcgcagaggcagagggcctgcgcgctgccctggctggtgcctag

SEQ ID NO: 2433 - DNA, 2349 bp, Artificial Sequence
  Description of Artificial Sequence: Synthetic coding sequence
atgttccccccttccgggtccacaggtctaatccccccatctcacttccaggcccgacccctgagtactctccccagaatggcccctacttggcttagcgatatccctcttgtgcagccaccgggtcaccaggacgtgtcagagcgcagacttgatacccagaggcctcaggtcaccatgtgggagagggatgtaagctcggacagacaagagccgggacgccgcggacgctcatggggcctggaaggcagtcaagccctttcgcagcaggcagaagtcatcgttcggcagttgcaggaactgcgttggctggaggaggaggtgtggcttttgagggagacgagcctccagcaaaaaatgcgtttagaagcccaagccatggaactggaggctttagccagggcagaaaaagctggcagggctgaagccgaggggcttcgcgctgcgctcgcgggcgcggaggtggtgcggaagaacctagaagaaggccgccaaagagaattggaagaggtccagaggttgcaccaggaacaactgtcttccttaactcaggctcacgaggaggccttgagttcactcacgagcaaagctgagggcctggagaagagcctttcctccttagagacccggcgtgcaggcgaggccaaggaactcgccgaggctcagcgtgaggccgaactgctacgcaagcaattatctaaaacacaggaagatttggaagcacaagttaccctggttgaaaatttaaggaaatatgttggcgaacaggtgccgtctgaggtccacagccagacttgggagctcgaaaggcagaagctcttggaaacaatgcagcatctccaggaagacagggacagcctccatgctacggctgaacttttgcaagtcagagtgcaatcgctgacacatatccttgcccttcaggaggaggagctcactcggaaggttcagccctctgactcccttgagcctgaatttacccgtaaatgccagagcttgttgaatagatggcgagagaaagtgtttgccctcatggtgcagcttaaagctcaggagctggaacatagcgatagtgttaagcaacttaagggccaggtggctagcctccaggaaaaagtgaccagtcagtcgcaagagcaagcgatcctacagcgatccttacaggacaaagctgcagaagtggaagtggagcgcatgggcgccaaggggctgcagttggagctatcgcgagcacaggaagctcggaggtggtggcagcaacaaacagcctccgcagaggagcagctgagactcgtggtgaacgctgtatcaagttcccaaatatggctggagacaactatggccaaagttgagggtgcagctgctcagctgccatcactaaacaatcgcttgtcttatgccgtaaggaaggtacacacaataagagggctgattgcccgcaaactagcgctggctcaactacgtcaggagtcatgtcctctcccccccccagtgacggacgtctcccttgagctccagcagctgagggaagagcgcaacaggctagatgccgaattgcaattgtccgcccgactgatacagcaagaggttggcagggcccgcgagcagggagaggctgagcggcagcagctgtccaaagttgctcagcagctggagcaggagttacaacagacacaggaatctttagcctcactgggcttgcagctggaggtggcaaggcagtgccagcaggagtctactgaggaggcggcttctctcagacaagagctaactcagcagcaggaactctacggccaggcgctacaggagaaagtcgctgaggtggaaacccggctgagagaacagctaagcgatacagagaggcggctgaacgaggctcggcgggaacatgcaaaagccgtcgtatctctgcggcaaatccaaaggagagcagcgcaggaaaaggaacgaagtcaagagctaagacgactacaggaggaagcacgaaaagaagaaggtcagaggctggcacggcggctccaggagcttgagcgtgacaaaaatctgatgctggcaaccctgcagcaagaggggctactctccagatataagcaacagcggctactcacggtcctgcctagccttctcgacaagaagaaaagtgttgtatcctctccaagacccccagaatgctcggctagcgcccctgtggccgcagcagttcctactagggagtctattaagggatccctgagcgttctcctggatgacctgcaggatctttctgaggcaatttctaaagaggaagccgtgtgccaaggcgacaacttagatcgatgctccagctgcaacccccagatgtcaagctag

SEQ ID NO: 2434 - DNA, 651 bp, Artificial Sequence
  Description of Artificial Sequence: Synthetic coding sequence
atgtggccccattccgctggggctagaccctgggctagcacactaactggcaaagacccacgggtgatggcatgttggtgcctggacgggctgcctagcggtttggccgagccttggcgtgagctctggcggtggagatcaaggcctttgcattgtgtgccacccttttccccgctcgctaggtctagccgggaccaccgtaatttgagacgacgggtcgaagccctcccaagaattctgaagggtaatattgatgggtggaggcaaaatctggaacctagcaataacgtggaaatgttcccaccctccgggagtactggtctgatccctccctctcatttccaggctcgacccttatccactctgcccaggatggcgcctacctggctgtccgatatccccctagtacagccacctgggcaccaggatgtgtccgaaaggagactggacactcagaggccccaggtcacaatgtgggaacgcgacgtgtcctcagatcgacaagaacctggcaggagagggcgaagctggggccttgaggggagccaagccctctcccagcaggccgaagtgatcgttagacagctgcaggagctgcggagattggaggaggaggtcaggcttttgcgcgagactagtctgcagcagtag

SEQ ID NO: 2435 - DNA, 357 bp, Artificial Sequence
  Description of Artificial Sequence: Synthetic coding sequence
atgttcccgccatctggaagcaccggtctgattccaccctctcacttccaggctcgaccactgtccacgctgcccaggatggcccccacctggctgtccgacattccattagtgcagccaccgggccaccaggatgtgagcgagcgacgacttgatacacagagacctcaggtgacaatgtgggagcgagacgtttcctcagatcgccaagagccagggcgcaggggacgctcatgggggctggagggttcccaggcactgtcacagcaggctgaagtcattgtgcgccagttgcaggagctacgtcggctggaagaggaggtgcgcctgctgcgcgaaaccagccttcaacagtag

SEQ ID NO: 2436 - DNA, 384 bp, Artificial Sequence
  Description of Artificial Sequence: Synthetic coding sequence
atgttccccccatcaggacaatgggatcaaactagaggagtagtggtggtttccgcttgggaaacagaccatctgtgtttttgtaactctagtggctcaactggtctgattccgcccagccattttcaggcccggcctctgtctaccctgccgaggatggccccgacctggcttagtgatataccgctcgtgcaaccacctggccaccaggatgtgtcggagagaaggttagacacgcagaggccccaggttactatgtgggaacgcgatgtgagctctgaccgccaggaacccggccgaagggggcgctcctggggtctggagggatcccaggctctctcccaacaagccgaagttatcgtcaggcagttgcaggagctctag

SEQ ID NO: 2437 - DNA, 2190 bp, Artificial Sequence
  Description of Artificial Sequence: Synthetic coding sequence
atgttcccaccaagcgggagcacagggcttattccaccatcccactttcaggccagacccctgtccacactaccccgaatggctcccacatggctcagcgatatcccgcttgttcaaccacctggacaccaggacgtgagcgagcgaaggctggatacacagcggcctcaggttacaatgtgggaaagggacgtgtcttctgacagacaggaacccgggcggaggggaaggtcttggggacttgagggctcccaggctctgagccagcaagctgaggtgattgtaaggcagcttcaggagctccggaggttggaggaggaggtgcgactacttagggagactagcctgcagcagaagatgaggcttgaggctcaggctatggaactcgaagctctggccagggcagagaaggcaggccgtgcggaggccgagggcctgagagcagccctggccggcgccgaggttgtcaggaagaatttagaggaaggcagacagagagaactggaggaggtgcagcggcttcatcaggagcagctgtcatccctcactcaggcccacgaagaggcattaagcagtctgacttcgaaagccgagggattggaaaaaagcttgtcgagtctcgagaccagacgggctggcgaggctaaagaactggctgaggcccagcgcgaagccgaactcttgaggaaacagctcagcaagactcaggaggatctagaggcccaagtgaccctcgtcgaaaatctgagaaaatatgtcggagaacaagtccctagcgaggtgcattctcagacatgggagctggaacgccagaaattattagatactatgcaacacctccaggaggacagggatagcctgcacgcaaccgccgagctgctccaggtgcgcgtgcaaagcctgacccatatattggccttgcaggaagaggaattaactcgaaaggttcagccatctgactctcttgaacccgagttcactagaaaatgtcagagcctgctcaatcgatggagagagaaggttttcgcattgatggtccagctgaaagcgcaggagctcgaacactccgattccgtgaagcagctgaaaggacaggtggcaagcctacaggagaaggtgacttcgcaaagccaggaacaggctattctgcagcgtagtcttcaagacaaggcagcggaagtagaggtggagcgaatgggggcaaaaggcctgcagctcgaactttctagagctcaggaagcccgccgaaggtggcaacagcagacggcctccgcagaggagcagctgcgactcgtcgtcaatgccgtgagctcctgtccactgccacctccagtgacagatgtctctctcgaactgcagcagttgcgagaggaacgcaatcggttagacgctgagctccagttgtccgccagacttatccagcaggaggtgggccgcgcgcgtgagcagggcgaggccgagcgccaacagctctctaaagtcgcccaacaactggaacaggaactccagcagacccaggaaagtttagcttctctgggtttgcagctggaagtagctcgccagggacagcaggaatcgaccgaggaggccgcctctttacgtcaagagcttacgcagcagcaggaactctacggccaagcactgcaggaaaaagtggccgaggttgaaaccaggctccgtgagcagctgagtgacacagagcgacggcttaatgaggccagaagagaacatgccaaagctgtggtgagcctgaggcagatccagcgaagagctgctcaggagaaagagcgatcacaagaattgaggagactgcaggaagaggccaggaaagaggaaggccagcggttggcgaggagattgcaagagctggaaagagataaaaacctgatgctagccacacttcagcaggagggcctactcagcagatacaagcagcagaggctactgaccgttctcccttcattgctggacaagaagaaatcagtagtgagcagtcccaggcctccagagtgcagcgcatccgcaccagtggcagctgcagtccccacaagggagagtattaaagggtccctgtcagtgcttctggatgatctccaagacttatctgaggcgatctccaaggaagaagctgtgtgccagggggacaatctggataggtgttcctctagcaatccccagatgtcctcctag

SEQ ID NO: 2438 - DNA, 951 bp, Artificial Sequence
  Description of Artificial Sequence: Synthetic coding sequence
atgtttccaccttccggacatcaggatgttagcgagcgacggctcgatacgcagagaccccaagtgacgatgtgggaacgggacgtgagctcagaccgccaggaacccggaaggcggggacggtcttggggactagagggatcccaggcactaagtcaacaggcagaggtcattgtgcgacagttacaggaactccgcaggctggaagaagaggtgcgtctgctgcgtgaaacctctctacagcagaaaatgagattggaagcccaggctatggaactggaagctttagcccgagccgaaaaggccggcagggccgaggctgagggccttagggcagcactcgcaggggccgaggtcgtccgaaagaacctggaggaaggctcccagagagagcttgaggaagtgcagcgccttcatcaggagcagcttagtagtctgactcaggcacacgaggaagccctgtcaagtctgacaagtaaagcagagggccttgaaaagtctctgagtagcttggaaactcgaagggctggcgaggcaaaggagctggctgaggcacagcgggaggcagagctgttaaggaagcagctctctaagactcaggaggatctggaggctcaggtgaccctggtagagaacctgaggaaatatgtgggagagcaggtaccgtccgaagtccacagccagacctgggaactggagcggcagaagttgctcgagaccatgcagcatctacaggaggaccgagactccttgcacgcgactgcagagctcctgcaggtcagagtgcagtcccttacgcatattctggctctgcaagaagaggaactgacaaggaaagttcagccctcagatagtctcgagcccgaatttacccggaaatgccagagtctcctgaatcgctggcgagagaaggtgtttgctttaatggtgcagctgaaggcccaagaatag

SEQ ID NO: 2439 - DNA, 771 bp, Artificial Sequence
  Description of Artificial Sequence: Synthetic coding sequence
tagcgcttggacgccgaactgcaactctctgcacggctcatacagcaggaagtggggcgggctcgagaacagggggaggctgagaggcagcagttatctaaggtagcccaacagctcgagcaggagctgcagcaaacccaggagtcactggcaagtctggggctacagctggaagtcgcaaggcagggccagcaggaatcaacggaggaggcggcaagcctgcggcaagagcttactcagcagcaggagctttacggccaggctttgcaggagaaggttgcagaagtcgagacccggttaagagagcagctgtcggacactgagcggcgtttgaatgaggccagaagagaacatgccaaagccgtcgtgagcctgaggcagatccagagacgggccgcccaagagaaagaacgcagccaggaactgcgacgcctgcaggaggaagccagaaaagaagagggtcagaggcttgcacgtagacttcaggagctcgaacgcgacaagaatctgatgctccaacgccttttgactgtcctgcccagcctccttgataagaagaagtccgtcgtgagcagtcccagaccccctgagtgtagcgcttccgcccccgtggctgctgcagttcctacaagagagtccataaagggcagtctgagtgtgcttctagacgacttgcaggacctgtccgaggccattagtaaagaagaggcagtgtgtcagggggacaacctcgacaggtgctcctcttccaatccacagatgagctcctag

SEQ ID NO: 2440 - DNA, 357 bp, Artificial Sequence
  Description of Artificial Sequence: Synthetic coding sequence
atgttccctccatccggctccacaggcttaattcccccctcccactttcaggcccgtcccctcagcaccctgccaaggatggcaccaacttggctcagcgatattccactggtgcagcctcctggccaccaggacgtatcagaacgtagacttgatacgcaacggcctcaggtgactatgtgggaacgagatgtgagttctgaccgacaggagccaggacggcgcggacgttcatggggactggaggggtcgcaagccctctcacagcaggccgaagtaatcgtgcggcagttgcaggagctgcgccgcctggaagaggaagtccgactgcttagagaaacttcattgcaacagtag

SEQ ID NO: 2441 - DNA, 2349 bp, Artificial Sequence
  Description of Artificial Sequence: Synthetic coding sequence
atgttcccacccagcggctctaccggcctcattcctccgtctcattttcaagcgcggcccctgtcaaccctgccgcgcatggcccctacttggctgtctgatatcccattggtgcagccccctggtcaccaggacgtgtctgaaagacggctcgatacccagcggcctcaagtgactatgtgggagcgcgatgtctcaagtgacagacaggagcccgggcgcagagggcgtagttggggcttagaagggagtcaagccctgtctcagcaggccgaggtgattgtgcgacaactgcaggagctgcggaggctggaggaggaggtccggctgctccgggaaacctctctccagcagaagatgcggctggaggcgcaggccatggagttagaagccctggcacgagctgagaaggctggtcgcgcagaggcagaaggactgagagcagcactggcgggcgcggaggtcgttcggaaaaacctggaggaaggtcggcagcgtgaactggaagaagtccagcggcttcaccaagagcagctctcatccttgacccaggcgcacgaggaggccttgagctcactgacttcaaaagctgagggactggagaaaagtctgtcctccctagaaactaggcgtgcaggagaagcaaaagagctggccgaagcacagcgagaggcagaacttctcagaaagcaactgagcaagacccaggaagatctggaggctcaggtgacccttgtggaaaacctgcgcaaatatgtcggcgagcaggtaccctctgaggtgcactcccagacttgggaattggagcgacagaagttgttagacaccatgcagcacctccaagaggacagggacagccttcatgccacagctgagctgctacaggtccgagtacaatcactgacccacatactggcccttcaagaggaggagctgacccggaaggttcagccaagcgattctctggagcctgaattcacaagaaaatgccaaagcctgctcaaccggtggcgagaaaaggttttcgctttgatggtccagctgaaggcacaagagttagagcacagcgatagcgtcaagcagcttaagggacaagttgcgtcgcttcaagagaaagtcacttcacaatcccaggagcaggctatcttacaacgaagcctgcaggataaggcagccgaggttgaagtcgaacgcatgggggcgaaaggtctccaactagagctttctagggcacaggaggcccgcagacgatggcagcagcaaactgcttctgccgaagagcagctcaggctggttgtgaatgccgtctccagctcacagatatggctggaaacgacgatggccaaggtcgagggagcagccgcccagctgccatcactcaacaataggctctcctacgcagtgcggaaagtgcacaccattcgcggcctaattgccaggaagctggcattggctcagttgaggcaggagagctgccctttaccacctccggttacagacgttagcctggagcttcagcagctccgagaagaacggaaccgccttgacgccgagctgcagctgtcagctcgcctcatacagcaggaagtaggccgtgcacgtgagcagggtgaagcggaacgccagcagctgtccaaagttgcacaacaactggagcaggaactgcaacaaacacaggagagtctggcctccttggggttacagctagaggttgcccgtcaagggcaacaggagagcacagaagaagctgccagcttgcggcaagaattgacccagcagcaggagctgtacgggcaggccttgcaggagaaggtggctgaggtggaaacaagacttcgagaacagctcagcgatactgagaggcggctcaacgaggcacggcgggaacacgccaaagccgtagttagcttgaggcagattcaacgaagggccgcccaggaaaaggaaagaagccaggaactgcggcgtttgcaggaggaggctagaaaggaagaaggtcaaaggctagcgcgccgcctccaggagctggagcgcgacaaaaatttgatgctcgcaactctccagcaggaggggttacttagcagatacaagcagcagagacttcttaccgttctccctagcctgttggataaaaaaaagtcagtggttagctcacccaggcctcctgagtgcagcgcgtccgcgcccgttgccgccgctgtccccactcgagagagcattaagggctccctctctgtcttacttgacgatttacaagatctgtcagaagccatttccaaggaagaggctgtgtgccagggggacaatttggataggtgtagctcctcaaacccacaaatgtcttcgtag

SEQ ID NO: 2442 - DNA, 384 bp, Artificial Sequence
  Description of Artificial Sequence: Synthetic coding sequence
atgtttccgccatcaggtcagtgggatcaaactaggggggtcgttgtcgtgagtgcgtgggaaactgaccatttatgcttttgtaactcttccggcagcaccggattgatcccacctagccatttccaggcccgccccctgtccacccttccccgcatggcacctacttggctgagtgacatacccctcgtccagccacctggacaccaggacgtcagtgagcggaggctcgacacccagcgtccacaagtgacaatgtgggaacgagacgtgtcttccgatcgccaggagccggggagaaggggaagatcctggggcctagaaggctcgcaagccctgagccagcaggcagaggtaatcgtacgccaactgcaggagttatag

SEQ ID NO: 2443 - DNA, 462 bp, Artificial Sequence
  Description of Artificial Sequence: Synthetic coding sequence
atgttccctcctagtggttccaccgggctgataccccccagccactttcaggccaggcctctctccactctccctagaatggccccaacatggttgtcagacattccactcgtgcagccgccgggccaccaggatgtcagtgaaaggcgcctggacactcagaggccccaggtaaccatgtgggagcgggacgtatccagcgaccgccaggagccagggcgcagaggacgatcttgggggctggaaggctcccaagccttatcccagcaggccgaagtgatcgtcaggcagctccaagagttgcggtggctggaggaggaagtgtggctgctcagggaaacgagtctccaacaaaaaatgcgactggaggcccaagcgatggagctggaagcgctcgctagggcggaaaaggccgggagagcagaagccgaagggctgcgcgcagctctggccggggcctag

SEQ ID NO: 2444 - DNA, 384 bp, Artificial Sequence
  Description of Artificial Sequence: Synthetic coding sequence
atgttccccccctctgggcagtgggatcagacaaggggagttgtcgtggtcagtgcttgggaaaccgatcatctctgcttttgtaacagctcggggtccacaggactcattccgccaagtcatttccaggcacgtcctctgtctactctgccgcgaatggcacctacatggctgagtgacattcccctggttcaaccccccggccaccaggatgtctcagagaggcgccttgatactcagcgacctcaagttacgatgtgggagagggacgtcagttccgaccgacaggaaccaggacgtaggggacggtcctggggactggagggctctcaggcgctgagccagcaggcagaggtcatcgtcagacagctccaagaactgtag

SEQ ID NO: 2445 - DNA, 567 bp, Artificial Sequence
  Description of Artificial Sequence: Synthetic coding sequence
atgttccctccttccggtagtaccgggctcattccgccctctcatttccaggcacgacccctcagcacactcccccgaatggccccgacttggttaagcgacattcctctggttcagccacctggtcaccaggatgtgagcgagagacggctcgacactcagagaccccaggttactatgtgggaacgcgacgtcagctcggatcgtcaggaaccagggcgacgcggcaggagctggggcctggagggaagtcaggccctttcacaacaggctgaagtgatcgtgcggcagttacaagagttgcgtaggctggaggaagaagtgcggttgttacgagagacctccctgcagcagaaaatgcgactcgaagcacaggccatggaacttgaagccctcgcccgggccgagaaagctggacgagccgaggcagaagggttgcgagcagcactggccggcgccgaagtcgtgaggaagaatttggaagaaggtcggcagcgcgaacttgaggaggtccagagactacatcaggaacagttgtcgtccctgacccaggcacatgaagagtag

SEQ ID NO: 2446 - DNA, 567 bp, Artificial Sequence
  Description of Artificial Sequence: Synthetic coding sequence
atgtttcccccatcaggtagtaccggactgatccctcctagccacttccaggcccgcccactgtcaaccctgccccgaatggccccaacgtggctgtccgacattcccctcgtccagcctcctggacaccaggacgtcagtgagcggagattagatacccaacggccacaagtgaccatgtgggaacgggacgtgagcagcgaccggcaagaacccggccgaaggggaaggtcttggggcctcgaaggatcacaggccctgtcgcaacaagcagaagtgatagtgcgccaactgcaggagcttagatggcttgaggaagaagtttggctcttgagggaaaccagtttgcagcagaagatgcgcctggaagcgcaagcaatggaactggaagctctggccagggccgagaaagccgggcgcgccgaagctgaggggctccgagcggccctggccggggccgaggtggtaaggaagaacctcgaggaagggaggcagcgggaactggaagaagttcaacgcctgcaccaagaacagttgtcttcccttacccaggctcatgaagaatag

SEQ ID NO: 2447 - DNA, 951 bp, Artificial Sequence
  Description of Artificial Sequence: Synthetic coding sequence
atgtttcccccttccggccaccaggatgtgagtgagaggcgactggacactcaacggccccaggtcactatgtgggaacgggatgtgagcagcgatcggcaggagcctggccgtcggggtagaagttgggggttagaaggctcgcaggccctgagtcagcaggcagaggttatcgttcgtcagctgcaggaacttcggagattggaggaggaggttagactgcttcgagagacctccttacaacaaaaaatgcggctagaggcccaggccatggagctagaagcactcgcacgcgccgaaaaagccggtcgggccgaggccgaaggcctccgggccgccctagcaggtgctgaggtggtgaggaaaaatctggaggaagggcgtcagagggaactggaggaagtccagaggcttcatcaggagcagttatctagcctgacacaggcccatgaggaagccttgtcaagcctgacctctaaggcagaaggcctggagaaatccctatcctctctggagacccgacgagccggggaggcaaaagagctggctgaggctcagagggaggccgaactgctgcggaagcagcttagcaaaacccaggaggacttggaagctcaggtgaccctcgtggaaaatttgcggaaatatgtaggcgagcaggtgccctccgaggtgcacagccagacctgggagctggagcggcagaagctcctcgacaccatgcaacatttgcaggaagatcgtgattccctgcacgcaacggcagagctcctgcaggtgagggtgcaaagccttacccatattctggcactgcaggaggaggagctgacccgcaaggtgcaaccctctgacagcttggaacccgagtttactagaaaatgtcagagtttacttaatcgatggcgcgaaaaagtattcgccctaatggtgcaacttaaggcgcaggaatag

SEQ ID NO: 2448 - DNA, 567 bp, Artificial Sequence
  Description of Artificial Sequence: Synthetic coding sequence
atgttcccaccgtctggctccacgggcctcataccaccttcgcactttcaagcccgcccactcagtacactgcctcgtatggctccaacatggttaagcgatatacccctggttcaacccccaggccatcaggatgtcagcgaaaggagactggatacccaacgcccccaagtcacaatgtgggaaagggatgtgtctagcgaccggcaagagcccggaaggcgaggtaggagctggggcctggagggctcccaggcactgtctcaacaggcagaagtcatagtgcggcaattgcaggaattaaggcgattagaagaagaggtgcgcctgctccgcgagacgagtttgcagcagaagatgcgtcttgaggcccaggctatggagctcgaagctctagcccgtgccgagaaagcagggagggcagaggctgaaggcttgcgggccgcactagccggcgccgaagtggtgcggaagaacctcgaggagggctctcagcgagaactggaggaggtacagaggctgcaccaggagcaactttctagcttaacacaagcccatgaagagtag

SEQ ID NO: 2449 - DNA, 2307 bp, Artificial Sequence
  Description of Artificial Sequence: Synthetic coding sequence
atgttcccccctagcgggagtacgggtctcattccaccttctcacttccaagcaagacctctctctacactccctcggatggcccctacatggctgtccgacattccactagtgcagccgcctggccaccaggacgtgtccgaacggaggcttgatacccaacgcccacaggtcaccatgtgggaaagggacgtgagctccgacagacaggagccagggcgccggggaaggagttggggtctggagggctcccaagcgctgtcccagcaagccgaggtgatcgttcgacagctgcaagaactgcgccgactcgaagaggaggtgcggctgttacgagagacatccctccagcagaagatgcgacttgaagcccaagccatggagctggaagccttagctcgtgctgagaaggcaggccgtgcagaggctgagggcctacgggccgccctagcgggagccgaggtggtgcgcaagaacctggaggagggatctcaacgcgaactggaagaggtgcagagactccaccaggagcagctgtccagcttaactcaagcccacgaggaggccctgtcatccctgacatctaaggctgaaggcctggagaagagtctgtcgtcactcgaaacaaggcgcgcaggtgaggcaaaagagctagcggaagcccagcgagaagctgagctgctgcggaaacagctgagcaagacacaggaggaccttgaagcccaggtgaccctggtcgagaatctaagaaagtacgtaggggaacaagtcccttcagaggttcatagccaaacttgggaactcgaaaggcagaagctgctagagactatgcagcaccttcaggaggaccgtgactcccttcacgcaaccgctgaacttctgcaggtgcgtgttcagtctctgactcatatcctggccctgcaggaagaggagttgacccggaaagtgcaaccctccgactcgttggagcccgagttcacacgaaaatgtcagtccctgctcaaccgatggcgagaaaaagtgttcgcgctgatggtccagcttaaggcccaagagctggaacattctgatagcgtgaagcagctgaaaggccaagtcgccagcctgcaagaaaaggtcacctctcagtcccaagaacaggcgatcttgcaacgcagtttacaggataaagcggccgaggtagaggtggaaagaatgggcgctaagggactgcagctagaactctcccgggcacaggaagcacgtaggcgctggcagcaacagaccgcctccgcagaggaacaattgcggctcgtggtcaacgctgtcagcagctcccaaatttggctcgagaccacaatggctaaagtggagggcgctgcagcacaactgcctagtctgaacaatcgcctctcctatgccgtgagaaaggttcacacaataagaggcttgatagcccgcaagctggctctggcgcagcttagacaggagagctgccccttgcctcctcctgtgacggacgtgtccttggaacttcagcaactaagagaggagaggaatcgcttggacgctgagttacagctgagtgcccgacttattcagcaagaagtgggccgagctcgggagcagggcgaggcagaacgccagcagttgagcaaggtggcacagcagctcgagcaggaactacagcagacacaggagagtttggccagcttaggtctccagttagaagttgcccgccagggtcagcaggaaagcactgaagaggcagcttcgctccgccaggagctgacacagcagcaggagctgtatggacaggccttgcaggagaaagtggccgaggttgagaccaggctgcgcgaacagctgtcggacacagaaagaagattgaacgaggcccggagagaacatgctaaggccgtcgtgtccctccggcagatccagcgcagagccgcccaggagaaagaacgttcacaggaactacgccgtttgcaggaagaggcaagaaaagaggaaggacagaggctagcaagacgactccaagagctggagagagataaaaacctgatgctccaacggctgctgacagtcctgccctccctcctggataaaaaaaagtctgttgtgtcatcaccaaggccaccagaatgctccgcgtcagccccagtggccgccgcggtgcccacgagagagtccatcaaaggatctctgagcgttctgttagacgatttgcaagatctgtccgaggcaatctctaaggaagaagctgtgtgccagggggacaacctggatagatgctcctcttccaatccacaaatgagctcctag

SEQ ID NO: 2450 - DNA, 951 bp, Artificial Sequence
  Description of Artificial Sequence: Synthetic coding sequence
atgtttccaccaagcggccaccaggatgtctctgagcgacggctcgacactcaaaggcctcaagtgaccatgtgggaacgcgatgtgtcctctgatagacaggaaccagggagacggggacgctcttggggactggaagggtcacaggctctctcccagcaggcagaggtgattgttaggcagctccaagagctccggtggctggaagaggaagtgtggcttctgagagagacaagcttacaacagaaaatgcgtttagaagctcaggcgatggagctggaggcactggctcgagctgaaaaagcaggaagggccgaagcagagggtctccgggccgccctcgctggggccgaagttgtgcgaaaaaacttggaggaaggacgtcagcgcgagcttgaagaggtgcagaggctacatcaagagcagttaagctccctaactcaagctcatgaggaggctttgtcttcactcacaagcaaagccgaaggattagagaaaagcctcagcagtctcgaaaccagacgagcaggcgaggccaaggagctagccgaggctcagagagaagccgagctcctccgcaagcaactatctaaaacccaggaggacttggaagctcaagtgacattagtggagaacctgcggaagtatgtgggagagcaggtaccaagcgaggtacacagtcagacttgggaactggagcggcagaaactccttgaaacaatgcaacacctgcaggaagacagggatagtctgcacgccactgctgagctgctgcaggtgagagtgcagtctttgactcatatattggctttgcaggaagaagaactcacccggaaagtgcaacctagtgatagtctggaacccgagtttacaagaaaatgccagagtctgctgaatagatggcgggaaaaagtgttcgccctcatggttcagttgaaagcacaggaatag

SEQ ID NO: 2451 - DNA, 357 bp, Artificial Sequence
  Description of Artificial Sequence: Synthetic coding sequence
atgttcccccccagcggttctactggccttatccccccctcccactttcaggcccgaccactctctacactgccacggatggcacccacttggctgagtgacatacccctagtgcagcctcctggacaccaggacgtgtcggagcgccggctggacacccagcgcccacaggtgaccatgtgggagcgggacgtctctagcgaccggcaggaaccaggacggagaggccggtcctggggcctcgagggcagccaggcactgtcccagcaggcggaggttattgttcgccagctgcaggagctgaggtggctggaagaagaagtgtggctgctgcgcgagacctctctccagcaatag

SEQ ID NO: 2452 - DNA, 2349 bp, Artificial Sequence
  Description of Artificial Sequence: Synthetic coding sequence
atgttcccacctagtggatcaactggacttataccaccatcacattttcaggcccgccctctgtctactcttccgagaatggccccgacctggctgtctgacatccccttggtgcaacctccaggccatcaggacgtgtccgagaggcggttggatacccagagaccccaggttaccatgtgggaacgagacgtgagttccgacagacaggagcctggacgccgtggccgctcctggggcctcgaaggaagccaagctctgagccagcaggcagaggtcatcgtgcgacaattgcaggagctgcgccgcctggaagaggaggtccggcttctccgtgagaccagcctccagcagaagatgcgtctggaggctcaagctatggagctggaagctctggccagggctgaaaaggcgggcagggcagaggccgaaggcctccgagccgccctggctggagccgaggtggtcagaaaaaacctcgaggagggtcgtcagagggaactcgaggaggtccaacgactccatcaggaacagctttcctctcttacgcaggcccacgaagaagcactgtccagtctgacgagcaaggccgaagggctcgaaaaaagcctgtcatctctcgaaactcggagggcaggtgaggccaaagaattggccgaagcccagagagaggcagaactacttcgcaaacagcttagtaagacccaggaggatctggaggcacaagtgactctggtagagaacctgcgcaaatacgtgggcgaacaggtacccagtgaagtccattcccagacatgggagctggaacgacaaaaattactggacaccatgcagcacctccaggaggaccgggatagtctacatgccactgcggagcttctccaggtgcgggtgcagtccttgactcatattctcgccctacaggaggaagaactcacaaggaaggtgcagccaagtgattccttagaacctgaatttacacggaaatgccagtccctgctgaaccgatggagggagaaagtgtttgcactcatggtccagttaaaggcacaggaactcgaacactccgatagcgtgaaacaactcaagggtcaggtggctagccttcaggagaaggtcacatcgcagagtcaagaacaggcgatactgcagagatcattgcaggacaaggctgccgaagtggaagtcgaacgcatgggtgcgaaagggttgcaactggagttgtcacgggcccaagaagcgaggcggagatggcagcagcagaccgcctctgcggaggagcagctgaggctggtggtcaatgctgtctcttcctcccagatctggttggaaaccacaatggctaaggtggaaggggccgctgcgcaacttcctagccttaataatagattgagttatgccgtgcgtaaggtacatactatccgtggcctcatcgcacggaaactggcactagcccaactgaggcaagaatcttgtcccttgccccctccagtgactgatgtctctctggaactgcagcagctgagggaggaaaggaaccggctggatgctgaactccagctaagcgctcgtttgattcagcaggaggtagggagagctcgcgagcagggagaggccgagcgtcaacagctgagtaaggtggctcaacaactggagcaggagttgcagcaaacgcaggagtctctggcctcccttggtcttcaactcgaggtcgctcggcagggacagcaggagtcaaccgaagaggccgccagcttgcggcaagagctgactcagcagcaggagttatatggccaggctctccaagaaaaagtggccgaagtagagactcgactgcgtgaacaacttagcgacactgagcggagactcaatgaagccaggcgagaacatgctaaggcagtggtcagcctcaggcagatacagagaagagcggctcaggaaaaggaacgatcccaggaactccgacgacttcaggaggaggccaggaaagaagaaggtcagagactggcacggcgcttgcaagaactggaaagggacaagaatcttatgctcgcaactctgcaacaggaggggctcctcagtcggtataagcagcagagattgctcaccgttttaccaagtctgcttgacaaaaaaaagtccgtggtgtcttccccccggcccccggaatgcagtgccagcgcacctgttgcagccgccgtccccacccgagaatccattaaaggatctctctccgttttgctggacgaccttcaggacttgagtgaagctatcagcaaggaggaagcggtgtgtcagggggataacctggacaggtgttctagctctaaccctcagatgtcatcttag

SEQ ID NO: 2453 - DNA, 567 bp, Artificial Sequence
  Description of Artificial Sequence: Synthetic coding sequence
atgttcccaccctccggatctactgggctcatcccccccagccattttcaggcaaggccactgagcaccctgccccgaatggctccaacctggctgtccgacatcccgctggttcagcctccaggccaccaggatgtgtcggaaaggaggttggatacgcagcgcccacaggtgacgatgtgggaacgggacgttagtagtgaccgacaggagcccggccgcagaggacggagctggggtctcgagggcagccaggctctgtcacaacaggctgaggtgatcgtcaggcagttacaagagctccgacggttggaggaagaagttagactgctcagagaaacaagccttcaacagaagatgcggttggaggctcaggccatggaactggaggctctggcacgcgcagagaaagcagggagagccgaggccgagggactaagagccgcacttgcaggagcagaagtggttcggaagaacctagaagagggccggcagagagagctggaggaagtgcagcgcctgcaccaggagcagctcagcagcctgacacaggctcacgaggaatag

SEQ ID NO: 2454 - DNA, 576 bp, Artificial Sequence
  Description of Artificial Sequence: Synthetic coding sequence
atgttccctccttctggacatcaagatgtttccgagcgccgcctcgatacgcaacggcctcaggtaactatgtgggaacgcgatgtctcaagtgaccggcaggagcctgggaggagggggcgtagttggggactcgaaggaagccaggctctatctcagcaggccgaggtaatcgtaagacagctgcaagagcttagacgcctggaggaggaagtcagacttctgcgggagaccagcctgcagcagaaaatgagattggaagcccaggccatggaattggaggccctcgccagagctgaaaaggcgggaagggcagaagccgaaggcctgcgtgctgccttagctggtgctgaagttgtgagaaagaatcttgaggaaggctcacagcgggagttagaggaggtgcagcgattgcaccaggaacaattgtcttcactgactcaggcacatgaagaggccctatccagcctgacaagtaaagcagaagggttggagaagtccctatccagcctcgagacccgacgtgctggagaggctaaggagctcgctgaagcacagagagaagccgaactgtag

SEQ ID NO: 2455 - DNA, 567 bp, Artificial Sequence
  Description of Artificial Sequence: Synthetic coding sequence
atgtttcctccttcaggctctactggacttatcccacccagccatttccaggcccgtcccctttccacccttcccagaatggctccaacgtggctctccgacatcccactggtacagcctccggggcaccaggatgtaagtgaaaggagactcgacacacagaggccacaggttactatgtgggagcgagacgtgtccagtgatcgacaagagcctggccggcgcggtagatcttggggtctggaaggtagtcaggcactgtcgcagcaggctgaagtgatcgtgcgccagctgcaggaactgcgtagactcgaagaggaagtcaggctgctccgtgaaactagtctgcaacaaaaaatgcgactggaggcccaggcaatggagcttgaagcacttgccagagcagagaaagcaggcagggcagaagcagaggggttgcgtgccgcattggcgggagccgaggtcgtgaggaagaatctggaggagggaagccagagagagcttgaagaagtgcaacggttgcaccaggaacagctgagctccctcacccaagcgcacgaggagtag

SEQ ID NO: 2456 - DNA, 951 bp, Artificial Sequence
  Description of Artificial Sequence: Synthetic coding sequence
atgtttccaccaagcggacaccaggatgtcagcgaacggagactcgacacccagaggcctcaggtcacaatgtgggagagagatgtgagcagcgaccgccaggagcctggaagaaggggtcgaagctgggggttggaaggaagccaggccctgagtcagcaggcagaagtaatcgtgcgtcaactgcaggagctgcggtggctcgaggaggaagtttggctgttgcgcgagacttccctgcagcagaagatgcggctggaggcccaggccatggagctagaggctctggcgagagctgagaaggccggtagagcggaggctgagggtctgcgggcggccctagccggggctgaggtggtgcgtaagaatttggaggaggggaggcaaagggagctggaggaagtgcagagactgcaccaggagcagctttcctcgctgactcaagcccacgaggaagcattgtcctcactgacatcaaaggctgagggcctcgagaagtccctctcctcactggagacacggcgagccggcgaggcgaaagagctggcggaggctcagcgcgaggccgagttattgcgcaaacagctgagtaaaacccaggaagacctggaggcccaggtgactctggtggagaacctccgaaaatacgtgggagaacaagtcccctctgaagtacattcacaaacttgggagcttgaacgtcaaaaactgctggaaacaatgcagcatctgcaggaagaccgcgactccctgcacgcaacagccgaacttttgcaggtgcgggttcagagtctcactcatattctggcactccaagaggaggagctcacacgtaaagttcagccgagcgactcactcgaacccgagttcaccaggaagtgccaaagtctactcaacagatggcgagagaaagttttcgcattgatggtgcagttgaaggctcaggagtag

SEQ ID NO: 2457 - DNA, 516 bp, Artificial Sequence
  Description of Artificial Sequence: Synthetic coding sequence
atgttccctccatccggtcagtgggatcagacgaggggagtggtggttgtatctgcttgggagacagatcatctttgtttctgcaactcctccggctctaccggcctgatcccgccatctcacttccaagcgcggcccctgagcactctcccgcggatggccccaacctggctgtctgacattccactggtccaaccaccagggcaccaggacgtgagcgagcggcggttagacacgcaaagaccgcaggtcaccatgtgggagcgagatgtctcttccgatcgccaggaacccggccgacgaggcaggtcttggggactggaaggctcccaagccctgtcacaacaggcagaggtcattgtgagacagttacaagaactgagatggctcgaggaagaagtgtggttattgcgcgaaacttctttgcagcagaaaatgcgcctagaagctcaagctatggaacttgaggctttagctagggccgagaaggccggtcgcgcagaagccgagggatag

SEQ ID NO: 2458 - DNA, 357 bp, Artificial Sequence
  Description of Artificial Sequence: Synthetic coding sequence
atgtttcccccatccggtagcacagggcttattcccccatcacattttcaggcccgccctctgtctacccttcctcggatggctccaacttggctgagcgatatccctctcgtgcaaccgcctggacaccaggacgtctcagaaagacgcctcgatactcagaggccacaggtcacgatgtgggaacgggacgtcagctccgaccgccaagaacccggtcggaggggacgctcttggggacttgagggctcccaggccctgagtcagcaggccgaagtgatcgtccggcagctacaggagctgagatggctggaggaggaggtgtggctcctgcgagagacctctctgcagcagtag

SEQ ID NO: 2459 - DNA, 771 bp, Artificial Sequence
  Description of Artificial Sequence: Synthetic coding sequence
taaaggctggatgcagagctgcaattgtctgcccgactaattcaacaggaggttgggagggccagagagcagggagaggctgagaggcaacagttgagtaaagtcgctcaacaattggaacaggaattgcagcagacccaggagtccctggcctcattgggccttcagcttgaagtcgctcgccagtgtcagcaggaatccacagaggaggccgcttccttaaggcaagagctcactcaacagcaggaactctacgggcaggcgctgcaggagaaagttgccgaggtggagacccgacttcgcgagcagctcagcgacaccgaacgccgcctgaacgaggcccgcagggagcacgctaaggcagttgtctctttaagacagatccaacggcgcgccgcccaggagaaagaacgttctcaagaactgcggcggctgcaggaggaagctcgcaaggaagagggccagcgtctggcacgtaggctgcaggaattggagcgagataagaatctcatgttacagcgtctgctgactgttctgccctcacttttggacaaaaagaagagcgtcgtgagttccccacgtccaccagaatgttctgcaagtgcccccgtcgcggcagctgttcccacccgtgagtccatcaaaggctccctctccgtgctgctcgatgacttgcaggatctgtccgaggctatcagcaaggaagaggctgtctgtcagggggacaacctcgaccgatgtagctcatgtaatccccagatgtcaagctag

SEQ ID NO: 2460 - DNA, 2508 bp, Artificial Sequence
  Description of Artificial Sequence: Synthetic coding sequence
atgtggccacacagcgctggcgcgcggccgtgggcctctacattgacaggcaaggacccacgggttatggcctgctggtgcctggatggactgccaagcggacttgccgaaccttggcgagagttgtggaggtggaggtcacggccactccactgcgtgccacccttctcacctctggcccggtcgagccgagatcatagaaacttgagaagacgagggaacatagacgggtggcggcaaaatctcgagccatcaaataacgtggaaatgttccccccatccggccatcaggacgtaagtgaaaggaggctggacacacaacgtccccaggtaactatgtgggaaagagatgtcagcagcgaccggcaggagcctggtaggaggggccggagctggggactcgaaggcagtcaggccctgagtcagcaggctgaagtaatcgtgcgccagctccaggaactgcgtcgcctggaggaggaggtccgtctgcttagggagacgtccctacagcaaaaaatgcgtctggaggctcaggccatggagttggaggcactggctagggcagaaaaagccgggcgcgctgaggcagaaggcctacgggcggccttagccggggccgaggttgttcgcaagaatctggaagaaggttcacagcgagaacttgaggaggtgcagaggctccatcaagagcagctgtctagtctcactcaagcccatgaggaggccctctcatcgttaacctctaaagctgaaggactggagaagtccctgtccagtctggaaacccgtcgggcaggtgaggccaaggagctggctgaagcgcaacgcgaggccgaactgctgcggaagcagctatccaaaacacaagaggacctagaagcccaggtgaccctagtcgaaaatctcagaaagtatgtcggggagcaagtgccatctgaggtgcacagccagacatgggaactggagaggcagaaactgctggaaacaatgcaacatctgcaggaagatcgggatagtctacacgccaccgctgagctgctgcaggtgcgagtacagtcgttaacacacatcctcgccctgcaggaggaagagctcacgcgaaaggtgcagcctagcgacagtctcgagcccgagtttactcgaaaatgccaatcattgttgaatcggtggcgggaaaaggtttttgcgctgatggtgcagcttaaggcacaagagctggaacattcggattccgtaaagcagctcaagggccaggtggcgtcactgcaagagaaggtgactagccagagccaggagcaagctattctgcaacgtagtttacaggataaggccgctgaagtggaggttgagcggatgggcgccaaaggcctccagctcgagctctcacgggcacaggaagcccggcggcgatggcaacagcagacagcgtcagcagaagagcaattacggctggtggtgaatgctgtgtcaagcagccagatctggctagaaacgaccatggccaaggtggagggcgctgctgcccaactgccatcgttgaacaatcggctcagttacgcagtcaggaaagtgcatacgatccgcggactcattgcccgaaaactcgccctggcgcaactccgacaggaatcctgtcctctccctcctccagtgacagacgtttctctggaacttcaacagctgcgggaggagcgtaataggctggacgccgagttacagctttcagctagattgatacaacaggaagtgggaagagcacgcgagcaaggcgaggccgagcggcagcagctcagtaaagtggctcagcagctcgaacaagagctccagcagacccaggagagtctggcctcattggggctgcaacttgaagtcgcccgccagggtcaacaagagtctaccgaggaggcagcatcgttgcgacaggaactgacacagcagcaggaactgtatggccaggcgctgcaggaaaaggtggccgaagtggagaccaggctccgggagcagctgagtgacacagaacgaagactcaacgaagctcgaagggaacatgcaaaagcagtcgtgtcactccgtcagattcagcgaagggccgctcaggagaaggagaggtcacaagaacttcggagactccaagaagaggcaagaaaggaagagggtcagaggctcgccaggagactccaggagctggaacgcgataagaatctgatgctggccactctgcagcaggaaggcctcttgagccgctataagcaacagaggctcctcacagttctcccatcccttctggacaagaagaagtcagtcgtcagtagtccccgacctccggaatgtagcgctagtgctcccgtagctgcagcagttcccactcgggagtccataaaaggatccctttctgtgctgctggacgacctccaggatctcagcgaagctatcagcaaagaggaggctgtgtgtcaaggagataaccttgaccggtgcagttcctcaaaccctcagatgagttcatag

SEQ ID NO: 2461 - DNA, 2190 bp, Artificial Sequence
  Description of Artificial Sequence: Synthetic coding sequence
atgtttcctcccagcggatcaacgggacttatcccaccaagccacttccaggctaggccgttgagcacgctcccacgcatggctccaacctggcttagtgacatacctctggtgcagcctccgggccatcaggacgttagcgagcggcgtctcgatacacaaagaccccaagtcacaatgtgggagcgcgatgtttcttctgataggcaggagcccgggcgccgcggacgcagctgggggctggagggcagccaggccctttcacagcaggcagaggtgatcgtccgccagctccaagagttgcgccggctcgaagaggaagtacggttgctgagagagacctctttacagcaaaagatgcgtctggaagcgcaggctatggagttggaggctctggcccgcgctgagaaggctggcagggccgaagcagagggtctacgcgcagctcttgcgggggctgaagtggtccgaaagaacctagaagaagggaggcagagagagctcgaagaggtacagaggctgcatcaggagcagcttagcagcctcacacaggcacacgaggaagctctgagttccttaacatctaaggctgaggggctggaaaagtcactttcctcgctggagacccggagagctggtgaagctaaggaattagctgaagcgcagagagaggccgagctgctaaggaagcagctcagtaagactcaagaagacctggaagctcaggtcactctagttgagaacttaagaaaatatgtgggagagcaagtgccctcagaggtccactctcaaacctgggagttggagcgtcaaaagttgctggatactatgcagcatctgcaagaagatcgcgatagcctccacgcaactgctgaattactgcaggttagagttcagagtttgactcacatactcgccctccaggaagaggaactgacacgaaaggtgcagccctcagacagtctcgagccagagtttacacgcaagtgtcaatctctgctgaatcgctggcgcgaaaaagtgttcgcgttgatggtgcagctcaaggcccaagaactggagcattccgattcagtcaaacagctaaaaggccaagtggcatccctgcaggaaaaagtaacctcacaatcacaggagcaggctattctgcagagaagtctgcaggacaaagcagctgaagtcgaggtggagaggatgggggctaaaggcttacagctagagttgagtcgagctcaggaagcaagaaggagatggcaacagcaaacggcaagcgccgaggagcaactgaggcttgtggttaatgccgtgtcttcttgtcccctcccccctcccgtaaccgacgtgagtctggaactccagcaactgcgagaggagaggaacagactcgacgcagaactccagttatccgctcggcttatccagcaagaggtgggacgcgctagagaacagggcgaagccgaaagacagcagctctctaaggtcgcccagcagcttgaacaagaactacagcagacccaagagagtctagcttcgctgggcctgcaactggaagtggcccgacaaggtcagcaagagagtacagaagaggccgccagcctccgacaggaactgacgcaacagcaggagctgtatgggcaggccctacaggagaaggtcgctgaggtcgaaacacggctgcgtgagcagttaagtgacaccgagcggcgactcaatgaggccaggagggagcatgcgaaagctgtggtctccctgcgacagatccaacgcagggcagcccaggaaaaagagagaagccaggaattgagaagactccaggaagaggctcgcaaagaggagggccagcggcttgcacggaggctgcaagagcttgaacgggacaaaaacttgatgctggccacactacagcaggagggccttctctcaaggtacaagcagcagcggttgctgaccgtgctcccaagcctattggacaagaagaagtctgttgtgtcatcccccagaccaccggagtgtagcgcgagcgcgcctgtcgctgctgccgtgccgaccagagaatccattaaaggctcattgtcggtcctcctagacgatttgcaggacctaagcgaggctatctctaaggaggaggccgtgtgccaaggtgataatcttgacaggtgtagttcctctaacccccagatgagttcgtag

SEQ ID NO: 2462 - DNA, 384 bp, Artificial Sequence
  Description of Artificial Sequence: Synthetic coding sequence
atgtttccgccatctggccaatgggatcagaccaggggcgttgtggtagtctccgcttgggaaaccgaccatctgtgcttctgtaactcctcaggcagtactggattgatcccacccagccattttcaggcacgccctctgagtacgctccctcgcatggcaccaacctggctgtcggatatccccctggtgcaaccaccagggcaccaggacgtgagtgaaagacgcctggacactcagcgaccccaggtaactatgtgggaacgcgatgtgtcttctgacagacaggaaccaggacggcgcggccgaagttggggtcttgagggctcccaggccctgagccagcaggcagaggttatcgtcagacagttacaggagctgtag

SEQ ID NO: 2463 - DNA, 462 bp, Artificial Sequence
  Description of Artificial Sequence: Synthetic coding sequence
atgtttccaccgtcaggctctaccggcctaatccctcctagccatttccaggctcggccactgtccactcttcctaggatggctcccacatggctgagcgatatcccgctggtccaacccccagggcaccaggacgtgagtgagagaaggcttgacacacagcgaccacaggttaccatgtgggaaagggacgtttcatccgatcggcaggagccgggaaggcggggaaggagctggggtctggagggcagtcaggcattgagccagcaggcagaagtgattgtgagacagctgcaagagctacgtaggctcgaggaagaggtgcgcctcctcagagagacatctctacagcagaagatgcgtctggaagctcaagcaatggagctggaggccctggcccgcgctgagaaagccggcagagctgaagccgaaggcctgcgcgcagcgctcgctggcgcctag

SEQ ID NO: 2464 - DNA, 567 bp, Artificial Sequence
  Description of Artificial Sequence: Synthetic coding sequence
atgtttcccccaagcggcagcaccggtctcatcccgccatctcattttcaggccagacctctctccactctgccgcggatggcccccacttggctgtcagatattccactggtgcagcctccaggccaccaagatgtttccgaaagaaggctcgatacgcagcgtccacaggtgacaatgtgggaaagggatgtgtccagtgaccgccaggaacctggacgcagagggagatcgtggggactagaaggcagccaggcactttcccagcaagcagaagtaattgtgcggcagctgcaggaacttcggtggctggaggaggaggtttggctactaagggagacttcattacagcaaaagatgagactcgaggcgcaggcaatggagctggaagctctcgctcgcgcagagaaagccggccgggcagaggcggaagggctgcgggcagcactggcaggagctgaagttgttcgaaaaaacttagaagagggccgccagcgcgagctcgaggaggtgcagcgtttacaccaggaacagctgagctccctgacccaggcccacgaggagtag

SEQ ID NO: 2465 - DNA, 462 bp, Artificial Sequence
  Description of Artificial Sequence: Synthetic coding sequence
atgtttccgcccagcggcagcactgggctgatcccccctagtcactttcaggctcgccctctgtcaacactgccaaggatggcgcccacatggctctcagatattccactagtgcaacctcctggacatcaggatgtgtcagagagacgcctcgacacacagcgccctcaggtaacaatgtgggagcgggatgtgagcagcgatcgtcaggagccaggtaggagaggtaggagctgggggctggaaggctcgcaggcactcagccagcaggcagaggtgatcgtgagacaactgcaggagctgcgcagactggaggaagaggtgcgtctcttgagagagacctcccttcagcagaagatgaggcttgaggcacaggccatggagttggaagcattggctcgggccgaaaaagccggcagggccgaagctgaggggctccgagccgctctggccggagcatag

SEQ ID NO: 2466 - DNA, 462 bp, Artificial Sequence
  Description of Artificial Sequence: Synthetic coding sequence
atgttccctccctccggctccaccgggctcattcccccgtcacacttccaggctaggccactcagtaccctcccccgaatggcccctacatggctatctgacatcccgctggtgcagccacctggccatcaggacgtctcagagagacggctggacactcagcgtcctcaggtgacgatgtgggagagggacgtttcttccgatagacaggaaccggggcgccggggtcgaagttggggcctggagggatctcaggcgctcagccagcaagcagaagtgatcgtacgccagcttcaggaactccgctggcttgaggaggaggtgtggttactccgagagacatctctgcagcagaaaatgcggcttgaagcgcaggcaatggaacttgaggctttggcacgtgccgagaaggcaggcagggcagaggccgaaggattaagggcagcactggctggcgcctag

SEQ ID NO: 2467 - DNA, 951 bp, Artificial Sequence
  Description of Artificial Sequence: Synthetic coding sequence
atgttccccccctctggacatcaagacgtatcagagaggcgcctagacacccaacgaccgcaggtcacaatgtgggaacgggacgtctctagcgaccgccaggagcccgggcgccgcggccggtcctggggacttgaaggtagccaagcgttaagtcagcaggccgaggtgatcgtgagacagctgcaggagctcaggagacttgaggaagaggtgcgcctgcttcgtgagactagcctgcagcaaaagatgcggctcgaagctcaggcaatggagctggaagctcttgccagggccgaaaaggctgggcgggctgaagccgaaggtctgcgagccgctctggccggagcagaggtcgtgcggaaaaatttagaagaaggaaggcagagagaactggaagaagtccaaagactccaccaggaacagctgagcagcctaacccaggcccacgaggaagctctgtcatccctcacgagtaaggcagaaggtctggagaaatctttatctagcttggaaactagacgtgcaggagaagcaaaagagctggctgaagctcagagggaggccgagcttctgcgtaaacagttatctaagacccaggaagatctcgaagcgcaggtcacgctggtggaaaacctgcgcaagtatgtcggagagcaagttcccagcgaggtgcattcacagacctgggaattggagagacagaaactcctcgacactatgcaacacctgcaggaggatcgagacagtctgcacgccaccgctgaactgttgcaggtacgggtccagagcttgacacatatactggccctgcaggaagaagagttaactaggaaagtgcagcccagtgactcactggagccagaatttacgcgaaagtgccagtccctcctcaaccggtggcgagagaaagtgtttgccttgatggtgcagctgaaagcccaggagtag

SEQ ID NO: 2468 - DNA, 651 bp, Artificial Sequence
  Description of Artificial Sequence: Synthetic coding sequence
atgtggcctcacagtgccggcgccaggccctgggcgtctacgctcactggcaaagatccgcgggtgatggcgtgctggtgtctggacggcctgcctagtggactagcggaaccatggagggaactgtggcgttggagatccaggccactacattgcgtgccgccattctctccacttgcccgaagttctagagaccaccgtaatctgagaagaagagtcgaggccctaccacggatcctgaaggggaatattgacggatggagacagaacctggagcctagcaataatgtggagatgtttccgccctcaggcagcacagggctgatcccaccgagtcatttccaggcccgcccactgtctaccctgcccaggatggccccgacatggttgagtgatatccctttggtacagcccccaggacatcaggacgtgagtgagcggcgtctggacacacagcgccctcaggtcaccatgtgggagcgggacgtttctagcgataggcaggaaccaggaaggaggggtcgtagctggggcctggagggctcccaggctcttagccagcaggcagaagtgatagtgaggcagctgcaggaactgcggaggctcgaggaggaggttaggcttcttcgggagacttccctgcagcagtag

SEQ ID NO: 2469 - DNA, 516 bp, Artificial Sequence
  Description of Artificial Sequence: Synthetic coding sequence
atgtttccaccatctggacagtgggaccagaccaggggagtggtcgttgtctccgcttgggaaaccgatcatctgtgtttttgcaactctagcggcagtacagggcttatcccacccagccactttcaggcgcgtcctctttcaaccttgccccgaatggctccaacctggctgtccgacataccactagtgcagccaccggggcatcaagatgttagcgagcggagactcgacacccagcgtccccaggtaaccatgtgggaacgagatgtatctagtgatcgacaggagcccggccggcgcggcaggagctggggcttagaagggtctcaggcgctcagccaacaagccgaggtgatcgtgcgtcaacttcaagaactccgccggctggaggaggaagtgaggctgttgcgggagaccagcttacagcagaaaatgcgcttggaggcccaagctatggaactggaagcactggccagagctgagaaggcgggtcgtgccgaggccgagggatag

SEQ ID NO: 2470 - DNA, 357 bp, Artificial Sequence
  Description of Artificial Sequence: Synthetic coding sequence
atgtttccaccttcaggtagcacaggtctgataccaccctcccactttcaggctcggcctctgtccacccttccccggatggctccaacctggctgagcgacattcctctggtccagccacccgggcatcaggatgtgagtgaaaggaggctggatactcagcgccctcaagtcacaatgtgggagcgtgacgttagcagcgatagacaggagcccgggcgccgcggtcgtagctggggtcttgaaggtagccaagctctctcacagcaggctgaggtgatcgtccgccagctccaggaacttcgaagacttgaagaggaggtgagactcctgagggagacctcgctacagcaatag

SEQ ID NO: 2471 - DNA, 423 bp, Artificial Sequence
  Description of Artificial Sequence: Synthetic coding sequence
atgtttccaccttctggctcgactggactgatccccccctcccattttcaggcacggcccctctccacgctcccgagaatggctcctacttggcttagtgacattcccctggttcaaccccccggccatcaggatgtttccgagcggcgcctggacacccagcgcccacaggttaccatgtgggagcgcgatgtctcttccgacaggcaggagcccggacggcggggccgctcttggggactggaggggtcccaagccctgagtcagcaagccgaagttatcgtgaggcagctgcaagagctgcgccgcctggaggaagaggtaagattactgcgagaaacctccctccagcagaagatgagactcgaggcccaggccatggaactcgaggctttagctagagccgaaaaagcaggccgatag

SEQ ID NO: 2472 - DNA, 111 bp, Artificial Sequence
  Description of Artificial Sequence: Synthetic coding sequence
atgttccctcccagcggtagtaccggcttaatccccccaagccatttccaggcgcgcccactcagtacccttcctcgcatggctcctacctggctctctgacatcccttag

SEQ ID NO: 2473 - DNA, 291 bp, Artificial Sequence
  Description of Artificial Sequence: Synthetic coding sequence
atgtttccaccgagcggatctacagggctgattcccccttctcatttccaggcgcggcctttatcaaccttgccaagaatggcacccacttggctctctgacattcctctggttcaacccccaggccaccaagatgtttcagaaagacgcctagacacccagcggcctcaggtaacaatgtgggagagggatgtgagcagcgatcgtcaagagccgggcaggaggggcagatcatggggccttgaaggaagccaggctctgtcccagcaggccgaggtcatagtgcgatag

SEQ ID NO: 2474 - DNA, 477 bp, Artificial Sequence
  Description of Artificial Sequence: Synthetic coding sequence
atgttccccccgtccggatcaacaggactaatccctccctcccatttccaggctcgaccattgtcgaccttgcccagaatggcgccaacatggctcagcgatatccccctagtccagccccctggtcatcaagatgtctcagaacgcaggctggacacccagaggccacaagtaaccatgtgggagagagatgtatcatctgacagacaagagccaggccggagaggcagatcctggggcctggagggttcccaggcactgtctcagcaggcggaggtcattgttagacagctgcaggagttgcggcgtttggaggaggaggtacggctgctgagggagacttctctgcagcagaagatgcgtctcgaggcgcaggctatggagttggaggctctggctcgagcagaaaaagcgggaagagctgaggcagagggactgcgggcggcgctggccggggccgaggtagtgagaaagtag

SEQ ID NO: 2475 - DNA, 351 bp, Artificial Sequence
  Description of Artificial Sequence: Synthetic coding sequence
atgtttcccccctcagggagtaccggcctcatcccgccctcccattttcaggcccgccctctgagcaccctgccccgcatggcaccaacgtggcttagcgatatcccactggttcagcctccgggccatcaggacgtaagtgaaaggcggcttgacacccaacgaccccaggtgacaatgtgggagagggacgtgagctccgacagacaggagccaggcagacggggacgatcgtggggcctggaagggtctcaggcactgagccaacaagcggaggtgattgtgcggcaactccaagaactcagacgcctggaagaggaagtgcggttgctgcgggagacctctctgtag

SEQ ID NO: 2476 - DNA, 126 bp, Artificial Sequence
  Description of Artificial Sequence: Synthetic coding sequence
atgtttcccccaagcgggtccacgggcctgattcccccaagtcatttccaggcacgacctctcagcactctgccacgcatggctccaacttggctgtctgatattccattggtccagccaccatag

SEQ ID NO: 2477 - DNA, 480 bp, Artificial Sequence
  Description of Artificial Sequence: Synthetic coding sequence
atgttccccccaagcggacatcaggatgtcagtgagaggagattggatacccaaaggcctcaagtgaccatgtgggagagggacgtatcttcggaccgtcaagagccaggacgcaggggtagatcttggggattagagggcagtcaggccctgtcccagcaggccgaagtcattgttcgacaactgcaagaactgcggcgccttgaggaagaggtacggctcctgagggaaacctcactgcagcagaaaatgcgactggaagctcaggccatggaactggaagccctggctagagccgagaaggcaggccgtgccgaggcagaagggctgcgggcagctttagccggagcggaagttgtcaggaagaatctggaggagggaagtcagagagagctggaagaggtgcaacggctccaccaggagcagctgagttctctgactcaggcccatgaggaagccctgtcctccctcacctcctag

SEQ ID NO: 2478 - DNA, 423 bp, Artificial Sequence
  Description of Artificial Sequence: Synthetic coding sequence
atggcaccaacttggttgtcagatattccactcgtacaacctcctggccatcaagacgtttcggagcgccgtctcgatacccaaaggcctcaggtcaccatgtgggagagagatgtgagtagcgatcgccaggagccaggaagacgcggaagaagttggggactggagggtagccaagctctgtcccagcaggctgaggtgattgtcagacagctgcaagaacttcgacgcctggaggaagaggttaggctgcttcgggaaacatcacttcagcagaagatgagactcgaggcccaggcaatggagttagaggcacttgctagagctgagaaggccggcagagctgaggctgaggggctgagggccgccctggccggcgccgaggttgtccgaaaaaatctcgaggagggtagccagaggtag

SEQ ID NO: 2479 - DNA, 480 bp, Artificial Sequence
  Description of Artificial Sequence: Synthetic coding sequence
atgttcccgcccagtggaagcactggactgatccccccttcccatttccaagctcggcccctttcaaccctgcccagaatggcccctacttggctgtcagatatacctctcgttcagcctcctggccaccaggacgtctctgaacggagactggatactcagcggccacaggttactatgtgggaacgcgatgtcagttcagatcgacaggaacccggaaggcgagggagatcctggggcttggaaggctcccaggctctcagtcagcaggcagaggtcatcgtgcgccaactgcaggagctcagacggctggaggaggaagtgagactccttagagaaacctctctgcagcagaaaatgcggctggaagcacaggccatggagctggaggccctggcacgagccgagaaggctggtagggcagaggccgagggcctgagggctgctctggccggggccgaggtagtaaggaagaattag

SEQ ID NO: 2480 - DNA, 3714 bp, Artificial Sequence
  Description of Artificial Sequence: Synthetic coding sequence
atgagaaagcacaggcacctccctctcgtcgccgtgttttgtctctttctttctggttttcccaccacgcatgctcagcagcagcaggcggcccaggatagtgccgacatcattttcctaatcgatggctcaaacaatactggatcagttaacttcgccgtcatcctggattttctggtgaacctacttgagaaactccctattggcacacagcagattcgcgtgggagtggtccagttctctgatgaaccacgcacaatgtttagtctggacacctactctacgaaagcacaggtcctgggcgcagttaaagcgctgggtttcgcgggaggagagctggccaatattgggttggcgctggactttgtggtagaaaatcacttcacacgcgccggtggctccagagtggaagagggagttccccaagtactggttcttatcagcgccggcccttcctctgacgagattagatacggggtcgtagccctcaagcaagcctccgtcttctcctttggactgggcgcccaggccgccagtcgagctgagcttcagcacatcgccacagacgacaacctggtattcactgtgcctgagtttcgctccttcggcgacctccaggaaaaacttctcccctacatcgtgggagtggcacagaggcacattgtcttgaagccacccactatcgtgacccaggtgatcgaggtgaataagagggatattgttttcttggtcgatggatccagcgcactcggcctggccaactttaacgccatcagagacttcatcgcaaaagtaattcagagattggaaatcgggcaggacctcatccaagtggctgtggctcaatacgcagacactgtcaggccagagttctatttcaacactcacccaaccaagcgcgaggtcatcactgcagtgcgcaaaatgaaacccctggatggcagtgccctctacaccggaagcgccctggattttgtgcgcaataacttgttcacctccagcgctggttatagggccgcagaggggattcctaaactgttggtgctcattactggagggaaaagcctggacgagatcagccagcccgcacaggagctgaagcggagttcaatcatggcctttgccatcgggaacaagggagctgaccaggctgaactagaagagatcgcctttgactcctccctagtgttcattcctgctgaatttagagccgctcccctccaaggaatgcttccaggccttttggcccccctgcgcacactgagcgggacgcctgaagtccactccaataaaagggatattatctttctgctggatggaagcgctaatgtaggaaaaactaactttccctacgtccgtgatttcgtgatgaatctagttaactcattagacatcggtaatgataatattagggttggactcgtgcagttctcggatacgccagtcaccgagttctctcttaacacgtatcagacaaaatcagacatccttgggcatctccggcagttacagctccaggggggctctggcctcaataccggcagcgctctctcatatgtttatgccaaccacttcacggaggccgggggcagtaggattcgggagcacgtgccacaacttctcctgctgctgaccgcgggacaaagcgaggatagctatctccaggccgcaaatgcgctgacaagagccggaattttgaccttctgcgtcggggcaagccaggccaataaggccgagcttgaacagattgcatttaacccttccttggtatatctgatggatgatttttctagtctgcccgcccttccacagcaactcatccaacccctgacaacttatgtgtcagggggggtggaagaggtccccctcgcgcaacctgaaagtaaaagggatatattgtttctcttcgacggcagtgccaacctggtcgggcagttcccggtggtccgagacttcctttacaagataatcgatgagctgaatgtaaagccagaagggacacgcatagccgtggcacaatatagtgatgatgtgaaggttgagtcccgttttgatgaacaccagtccaaaccagaaatactcaatctcgttaagcgcatgaaaatcaagacgggcaaggccctgaacctcggatatgccctagactatgctcagcgatacatcttcgtgaagtccgccggctccaggattgaagatggggtgttacaattcttagtgctcttggtggccggaaggagttcagatagagttgatgggcccgcgtccaatctgaagcagtcaggcgtcgtgccgtttattttccaggcaaaaaatgcagatcctgctgaactggagcaaattgttctgagccccgcctttatcctggccgctgagagccttcctaaaattggagatctccatccccagatcgtgaatctcttaaagagcgtgcataatggtgcccctgcacctgtgtctggtgaaaaagatgttgtctttctgctggacggatcggagggagtgcggagtgggttcccactgctgaaagaatttgtccagcgagtcgtcgagtcgcttgatgtcgggcaagatcgcgttagggtggcagttgttcagtattcagacagaacaagaccagaattctacctcaactcatatatgaacaagcaggatgttgtgaatgcagtacgccagctcactctacttgggggccctactcctaataccggagcggctcttgaatttgtgctccgcaacatcctcgtgtcttccgccggaagcagaatcactgagggcgttccccaactgcttatcgtgctgacggcggaccgctcaggggatgacgttcggaaccccagcgttgtggtgaagagggggggcgctgtgccaatcggaatcggcattggcaacgccgatattacagagatgcaaaccattagctttatcccagacttcgctgtggcaatcccaacctttagacaactagggactgtgcagcaggtaatttccgaacgagtgacgcaattgactagagaggagttgagccgcctgcagccagtcctgcagccactcccgtcccccggcgtgggcggcaagcgggacgtggtttttcttatcgacggatcccagagcgccgggccagagttccagtacgtgcgcactctgatagagcggctggtggattacctggatgtcggtttcgacaccacacgtgtggcagttattcagttttcggatgatcctaaggtcgagtttctattaaatgcgcacagttcaaaagacgaggtgcagaacgctgtgcagagattgcggcccaaagggggccgtcaaatcaacgtgggcaatgccttggagtacgtgtcacggaatatatttaaaaggccccttggtagccgtattgaggagggggtaccgcaatttctcgtgctcatatcctcagggaaatctgacgatgaggtcgatgatcccgctgtggagctcaaacaatttggtgtggccccctttaccatagccagaaatgccgaccaagaggagctcgtcaaaatctcgcttagtcccgagtatgtatttagtgtctctaccttcagagagttaccatcgctggaacaaaagcttctgactccgatcacgaccttgacaagtgagcagatacagaagctgttggctagcactcggtatcctcctcctggcgaaatgggagccagcgaggtcttactcggggccttctctatctag

SEQ ID NO: 2481 - DNA, 7713 bp, Artificial Sequence
  Description of Artificial Sequence: Synthetic coding sequence
atgcggaaacacaggcatctccctcttgtggccgttttctgtctgtttttgtctggctttcctactacccacgcacagcaacagcaggccgttattgaagtgaataagcgtgatatcgtgttcttagtggacggcagctccgcactcggcctagctaactttaacgccatccgggactttattgcgaaggtgatccaacgtctggaaattggccaggacctgattcaagtagcggtagcacagtacgccgacacagtgcggcccgaattctatttcaatacccatcccacgaagcgcgaggtgattactgctgtgcgaaagatgaagccactggatggatctgccctgtatactggatcagctctcgacttcgtcagaaacaacctgttcacatcttcagcaggctaccgagcagccgaaggcatcccgaaactgctagtcctgatcacaggtggcaaaagcctggatgagatttcccagccggcacaagaattaaaaaggtcttccattatggccttcgccattgggaataagggcgcggatcaggctgagctagaggagattgcctttgactccagcctggtcttcatcccagcagaatttcgggccgcacccttacaggggatgctgcccggacttctcgcgcctttaagaactttgtccggaaccccagaggaaagcaagcgtgatatcctatttctctttgacggcagcgccaatctggtcggccagttccccgtagttcgcgactttctgtacaaaatcatagacgaactgaacgtcaagcctgaaggaaccaggattgccgtggcacaatacagcgacgacgttaaagtggagtcacgttttgacgagcatcaaagtaagccggaaattctcaatctcgtgaagcgcatgaagattaaaaccggcaaggctctgaatctgggatatgccctcgactacgcgcagaggtacatcttcgtgaagtctgccggatctcgaattgaagacggagtgctgcagtttttggtccttctcgtggccggaagatcttctgaccgcgtggatggacctgccagtaatctcaagcagagcggtgtggtgcccttcatttttcaggccaagaatgctgaccccgctgagttggagcagatcgttctgtccccagcttttatactcgcagccgagtcactccccaagatcggggacctgcatccccaaatagttaacctgctcaagtccgtccacaatggcgcccctgcccccgtgagtggtgaaaaggacgtggtattcctgctggatggtagtgaaggagtgagatccgggttcccactgctaaaagagtttgtgcaaagggtggtagaatcactggacgtcgggcaggaccgcgtgagggtggcagtggtacagtatagtgatcgtacccggcctgagttttatctaaattcctatatgaacaagcaggacgtcgtgaacgcggtgcggcagctcacgttgctgggcggacccaccccgaataccggcgccgcacttgagtttgtgctccgcaacattctcgtgagcagtgccggatcccgtatcacggaaggagtgccccagctattgatagtgctcacagctgaccgaagcggcgatgatgtgaggaacccgtcagtcgtggtgaaacggggcggtgccgtaccgatcgggattggtataggcaatgcagacataacagagatgcagaccatctcattcataccagatttcgcagttgcgatacccaccttccgacagctcggtacagtgcagcaagtgataagtgagcgggtaacgcagctcacacgtgaggagctctcaagactccagcccgtcctgcagcctcttcccagccccggcgtaggaggaaagagggatgtagtgtttctgattgacggcagccaatctgccggccccgaattccagtacgtgaggacgctcatagagagactggtggactatctggacgtgggcttcgacaccaccagggtggcagtgattcagttcagcgatgaccctaaggtggaatttctgctgaatgcacacagtagcaaggacgaagtacagaatgcagtgcaaagactacgccccaaaggcgggcgacagataaatgtgggcaatgccttggaatatgtgtcccgaaacattttcaaacgtccccttggctcgcgcatcgaagagggggttccacagtttctggtcctgatttccagcggtaagtccgacgatgaagtggatgacccagccgtagagctgaaacagtttggtgtggccccttttacgatcgcgaggaatgcagatcaagaggagttggttaagataagtttatctccagagtacgtgttcagcgtgtcaacttttcgcgaactgccgtccctggagcagaagctccttacgcctattaccaccctgacctccgaacaaatccaaaaactcctcgctagcacacggtaccctccccctgccgtcgaatcagatgcagcagacatcgtgttcctgattgacagctccgagggcgtcaggccggacggctttgctcacatcagggattttgtatctaggatagtgagacgactcaacataggtcctagtaaggtgcgggtgggagtcgtgcaattttctaacgatgtttttcctgaattctatctgaaaacttaccggtcacaagcacccgtccttgatgcaataagaaggttaaggttgagagggggaagccccttaaataccgggaaggccctggagttcgtggctcggaacctgtttgtgaagtccgcgggctcacgaattgaggacggtgtgccccagcatctggttcttgtgctcggcggtaaatcccaggacgacgtctcccggtttgcccaagttatccgctcctccggcatcgtgagcttgggcgtgggagaccggaatatcgaccgcacagaactccagactatcactaacgatcccagactggtttttacagttagagagttcagggaattgcccaatattgaagagaggatcatgaatagcttcggcccaagtgccgccactcctgcccctcctggagtggacacccccccaccgtcccgtcccgagaaaaaaaaggccgacattgtgttcctgctggacgggtccatcaatttccggagagactccttccaagaggttctgaggttcgtctccgagatcgtcgatacagtctatgaagatggcgatagtatccaagtgggactggtgcagtacaacagcgatcctaccgatgagttcttcctgaaagacttcagtacgaaaagacaaattattgatgctatcaacaaggtagtgtacaaaggaggacgccatgccaacaccaaggttggattggagcaccttagggttaatcactttgtgcccgaggccggttctaggctggaccagcgtgtgccccagattgcctttgttattacaggtggaaaatctgtggaagacgctcaggacgtgagcctcgccttgactcagcgcggagtcaaggtgtttgctgtcggtgtccgcaacattgatagcgaagaagtcggcaaaatcgctagtaacagtgccaccgcattcagagtcggaaacgttcaagagctgagtgagttgagcgagcaagtcctggaaacattgcacgatgctatgcacgaaacattatgccctggtgtgaccgacgcagcaaaggcttgtaaccttgacgtaattctgggatttgatgggtcaagggaccagaacgtgttcgtcgcccagaaaggctttgaatctaaagttgatgccatactcaaccggatcagccagatgcatcgcgtgtcatgttctggaggcagatcccctactgtgcgcgtgagtgttgtagcgaataccccgtctggcccagtggaggcttttgatttcgacgaataccaacctgagatgctggagaaattccgtaatatgaggtcccagcacccttatgtgttgaccgaggatactctcaaggtgtacttaaacaaattcagacagagcagtcccgattcagtgaaagtggtcattcacttcaccgacggagcagacggtgatctcgcagacttgcacagggccagtgagaatctccgccaggaaggggtgcgcgcactgatactcgtgggcctggagcgtgtagtgaacctcgaacgccttatgcacctggaatttgggaggggatttatgtatgatcgacccctgaggcttaatctcctcgatctggattacgaactggcggaacaactggacaacattgccgagaaagcttgttgtggcgtcccctgcaagtgtagtggccaacgaggagaccgtggacccatcgggtctataggcccaaaaggcattcccggagaggacgggtaccgtggttacccgggggatgagggtgggcctggcgagcgtggacccccaggtgtcaacggcacacagggctttcaggggtgtcccgggcaacgtggggtaaaggggtcgcgtgggttccctggcgagaaaggcgaggtgggggaaataggattggacggcctggacggggaggacggtgataaaggcttaccagggagtagtggtgagaaaggtaatcctgggcggagaggcgacaaagggcctcgtggcgagaaaggcgaaagaggtgacgttggaatccgcggcgatcccggaaatcctggccaggactcgcaggaacggggtcccaagggtgagactggtgatctcggaccaatgggtgttcccggtcgcgacggcgtgccaggagggccaggggaaaccggcaaaaatggaggcttcggccgaaggggcccgcccggcgccaaggggaacaaaggaggccccgggcaacccggcttcgaaggagaacaaggtacaagaggggctcagggacccgcgggtccagccgggcctcccggactcattggagagcaaggcatctctgggccacgagggagtggcggggctgccggcgcccccggagagcgtggacgcaccgggcctttaggtaggaaaggagaacccggtgagccaggcccaaagggggggattggaaatcgggggccccggggtgaaacaggggacgacgggagagacggcgtcggcagtgagggtagacgcggcaaaaaaggtgagaggggattccccggatatcccggacccaagggcaaccccggcgaacccggtttgaacggcaccacaggcccaaagggaatcagaggacggcggggaaattctggaccgcctggtattgtcggacagaagggagatcccggctaccctgggcctgctggcccaaagggcaatcgcggggacagcattgatcagtgtgctctgatacaaagcattaaggacaaatgtccttgctgttatgggcctctggaatgtcctgtcttcccaacagaacttgctttcgccctggatacgtctgaaggggtcaaccaggacaccttcggccgcatgcgggacgtagtattaagtatcgtgaacgaccttacaattgccgaatctaactgccctaggggagcgcgggtcgcggtcgtgacttataataatgaagtgactaccgaaatcaggttcgccgatagtaagcggaagtccgttctcttggataagatcaaaaatctgcaggtggctctgacatcaaaacagcaatctctcgagacagcaatgagcttcgtggcccgcaataccttcaagcgggtgaggaacggattcttgatgagaaaggttgccgtttttttcagcaacactcctacaagagcttctccccagcttagggaggccgtcttaaaattgtctgacgctggaatcacacccttgtttctaaccagacaggaggatcgtcaactgattaatgcactgcagattaataataccgccgtcggacacgcacttgttctgccagccggccgagacctgaccgacttcctagaaaacgtgctgacctgtcacgtctgcctggacatttgtaacatcgacccttcatgtggttttggcagctggcgaccatcatttagagaccggcgtgccgccggctcagacgtcgatatcgatatggctttcatcctagactctgccgagaccaccactctgtttcagtttaacgagatgaaaaagtatatagcctacttagtgcgacagttagacatgtcccccgatcctaaagcttcacagcacttcgctagagtggccgtcgtgcaacacgccccgtctgaatccgtcgacaacgcaagcatgcccccggtcaaggtggagttctctttgacagattatgggagcaaggaaaagctcgtcgactttctctcgcgagggatgacccagctgcaagggactagggcactgggcagtgctattgagtacacaatcgagaatgtctttgagagtgctcctaatccacgcgatctgaagatagtggtgctcatgcttactggggaggtgcctgaacagcaactcgaggaggcacaacgggtcattctgcaggcaaaatgtaagggctacttctttgtggtgctcggcatcgggagaaaagtgaacatcaaggaagtatacactttcgccagcgagcccaatgacgtcttctttaagttagttgataagtcaaccgaactgaatgaggagcctttgatgcgatttggacggctgctgccctctttcgtgagttcggagaacgctttctacttgagccctgacatcagaaagcagtgtgattggttccagggggaccagcccaccaagaacctcgtgaaattcggccacaaacaggtaaacgtaccaaacaatgtcaccagcagcccaactagtaaccctgtaaccactactaaacccgtgaccactactaaaccagtgacgacaaccacaaagccagtaaccaccaccacgaaacccgtgacaattatcaaccagcccagcgtgaagcccgccgctgcaaagcctgcccccgctaagcccgtggctgccaagccagtggcaactaagatggccacagttcgcccgcccgttgcggtcaaacctgccacggccgctaagcccgtggcagccaaacctgctgccgtcaggccacctgccgcagcagccgccaagcccgtagcgaccaagcccgaggtgccacggccccaggccgctaagccagcagccactaagcccgcaaccacaaagccaatggtgaagatgagccgcgaggtacaggtgtttgaaattaccgagaattccgccaaactgcactgggaacgagcggaaccgccaggtccctacttctatgatctgaccgttaccagcgcccatgaccagtcactggtgttgaaacagaacctcacagtgaccgacagagtgatcggcgggctccttgcggggcagacttaccacgttgcagtggtgtgttacctcaggtcacaagtccgagcaacgtaccatggctcgttctctacaaagaaatcccaacccccgccacctcagccagcaaggtcagctagctcgtccacgattaacctcatggtctccaccgagccgttggcacttacggaaacagacatctgcaagttgcctaaagacgagggtacatgcagagatttcattctgaaatggtattacgatccgaatacaaagtcctgtgccaggttctggtacggcgggtgtgggggtaacgagaataagtttggaagccagaaagaatgcgagaaggtctgtgctcctgttctggctaagcctggtgtgatcagcgtgatggggacttag

SEQ ID NO: 2482 - DNA, 1938 bp, Artificial Sequence
  Description of Artificial Sequence: Synthetic coding sequence
atgctgctgaaaaaacatgccgggaaggggggcggcagggaaccccgaagcgaggatccaactcctgccgagcagcattgcgccaggaccatgcccccctgtgccgtgttggcagcattgctgagcgtcgtggcggtggtgagttgcctgtacctgggggtgaaaaccaacgaccttcaggccaggatcgcagcactggagagcgctaaaggagcaccctctatacatctcctacccgataccctggaccacctgaagaccatggtgcaggagaaggtggaacgtctgttagcacagaaatcatacgagcatatggcaaaaatcaggatagcccgtgaggccccgtcagaatgcaactgccccgccggtcccccagggaagaggggaaagaggggtagacggggcgagagtggcccgcccggccagccagggccacaaggcccccccggacccaaaggtgataaaggggagcagggcgaccaggggcctcggggactacccgggtttcccacagtcgccgccttgcatagcaaccagatcttaacagttaaaggtgaccagggccaggctggacccccgggtccaccagggcctcctggcccccggggtcctcctggtgacaccggaaaggacggacctaggggaatgccaggtgtgccaggcgagcctggtaagccaggagagcagggactgatgggcccactgggaccgccaggtcaaaaaggcagcataggcgcccccggaatccccgggatgaacggtcagaaaggcgaacccgggctgccaggcgccgttgggcagaacggcattcccggccctaagggtgagcctggggaacagggcgagaagggagacgcgggcgaaaacggtcctaagggggataccggcgagaaaggagaccccggatcgtctgccgcaggaatcaagggcgagccaggggaaagtggaagacccggacagaagggagagccgggtttgcccggcctcccaggtttgccagggattaaaggtgaacctgggtttatcggtccgcagggcgagccggggctcccaggactgcccggaaccaagggtgaacgcggcgaagcaggtcctcctgggcgtggcgaacgaggcgagcccggggcccccggccccaaaggagatagaggggaaaagggcgactccggggcccaaggtccgaggggtccccctggtcagaaaggggaccagggggctactgaaatcatcgattataatggtaatctccatgaggccctgcagggtccccccggcccacccggtccccagggcctgcaagggccaaaaggggagcaagggtcccctggcatccccgggatggacggcgaacaggggttaaagggtagcaagggtgacatgggagatccaggaatgactggagaaaagggcggtattggattgcctggtctgcctggagccaacggcatgaagggcgagaagggcgactctggcatgcccggccctcaaggtccttctatcataggaccccctggacctccggggccacatggaccccctggacctatgggtccccacggcttgcctggacctaagggggagccggggctgaacggagtgaagggtctcaagggcgaaccaggccagaaaggcgatagaggccccctaggcctcccgggagcaagcggcctggacggaaaacccggtagcagaggcactgatggtccaatggggccccacggaccagctggccctaaaggggaaagaggtgaaaagggcgcaatgggagagccaggaccccgcgggccttacgggctacccgggtttcctgggcctagaggcgaaaagggcgatctcggagagaaaggggaaaaggtcaccagcccatctcagcacgtgccctgtctcattctcctgttgctgtccgcccttttgttttcactgtgtgatagcatttag

SEQ ID NO: 2483 - DNA, 1101 bp, Artificial Sequence
  Description of Artificial Sequence: Synthetic coding sequence
atggcggaattgcagcagctccaagagtttgaaatacccactggtcgagaggctctgcgaggtaaccatagcgccctgttaagagtggccgactactgtgaagataactatgtgcaagcaactgataagcgcaaagcactggaggaaacaatggcctttaccactcaggctcttgcgagcgtcgcctatcaagttggcaatctggcagggcacacgctccgaatgttagatttgcaaggcgccgccctacgacaggtcgaggcacgcgtgtcgacactcggacagatggttaatatgcacatggagaaagtggcaaggcgggagattggtaccctggcaacagtgcagcggctaccgcctgggcagaaggtgattgccccagagaatctaccccctctgacgccttactgtcgccggcccctaaatttcggatgtctcgatgacatcgggcacggaattaaggatttatccacacagctgagcagaaccggtaccctgtcgaggaaaagcatcaaagctcccgcaacccccgcatctgccacgttgggtcggcctcccagaattccagaaccggtacatctcccagtggtgccagacggcagactgtctgcggcgtcttctgctttctctctcgcatccgcaggctctgctgaaggagttggaggtgctccaaccccaaaaggccaggctgctccccctgctccgccactgccgtccagcctggatccaccaccaccacccgcagccgtggaggtcttccagagaccccccacactcgaggaattaagtccgcctcctccagacgaagagcttcccctaccgctggacctgcccccaccaccacctctggacggtgatgagttgggcctcccaccacctccacccggattcgggcccgatgagccgagctgggtgcctgcctcttatttggaaaaggtggtaactctatatccctacacttcgcagaaggataatgaactcagcttctcagagggcacagtaatttgtgtcacgcgtaggtattctgatggatggtgcgagggtgtctccagcgagggaaccggattctttccaggcaactacgtggagccctcttgctag

SEQ ID NO: 2484 - DNA, 4257 bp, Artificial Sequence
  Description of Artificial Sequence: Synthetic coding sequence
atgatcaggttgggagcgccacaaacactggtcctgctgaccctactggtagccgctgtcctcagatgccagggacaggacgtcaggcagccaggacccaaaggccaaaaaggcgagccaggggacatcaaagatattgtggggcccaaaggaccccccggtccgcaggggcctgctggcgaacagggtccgagaggtgacaggggagacaagggggaaaaaggcgccccaggtccacgcggcagggacggcgagcccggtacacccgggaaccctgggcctccaggcccgccaggcccgcccgggcccccagggttaggaggcaacttcgccgcccagatggctgggggttttgatgagaaagcaggaggtgcccagctcggcgtgatgcaggggcctatgggaccaatgggaccacggggaccaccgggaccggctggcgcaccaggtcctcagggattccaggggaatccaggggagccgggggaacctggagtctctggtccaatgggacctcgtggcccaccgggaccccctggcaagccaggcgacgatggtgaggccggaaaaccaggaaaggccggcgaaagggggcctccagggccccaaggggctcggggtttccctggaacccccgggctgccaggagttaagggacaccgcgggtatcccgggctggatggagctaagggcgaagcaggagccccaggggtgaaaggggaaagtggcagtcctggtgaaaatgggagcccaggccctatggggcctcgcggcctgcctggagagaggggtcggacaggcccagccggcgccgcgggagcccgggggaacgacgggcagcccggacccgcaggccccccaggtccagtgggtcctgcaggaggaccggggttccctggagccccaggagctaagggggaagctggaccgaccggagccagagggcctgagggcgcacagggacccaggggagagccagggacccctggcagcccagggcccgctggagcctcaggaaatcccggtacagacggtattccaggcgccaaagggtctgctggggcaccgggcatcgccggtgcaccaggtttcccaggacctcgaggccccccgggtcctcaaggggctaccggcccgctggggcccaaaggacagaccggagagccgggaatagctggcttcaagggcgagcagggccctaaaggcgagcccggtccagcaggtcctcagggagcgcctgggcctgctggcgaagaaggaaagcgtggagctaggggggaacctggtggggtgggccccatcggacctcctggcgaacgaggtgcgcctgggaaccgcggattccccggtcaggatggactagcagggcctaaaggcgcacccggagaacgaggtccatctggactagccgggccgaaaggcgccaatggcgaccctggtagacctggtgagcctggtctgccaggagctaggggactgactggacggcccggggacgccgggccacagggaaaagttggtccatcaggcgcaccaggcgaagacggcagacctggcccaccgggtccccagggtgctcgcgggcaacccggggtgatgggcttccctgggcccaagggcgctaacggggagcccggaaaagcaggagagaagggtctgcctggagcgcctggactacgtggtttgccaggaaaggacggcgaaacaggagccgctgggcctccaggccccgcaggcccagccggggagcgaggtgagcagggcgcccccgggcccagtggcttccaaggccttccagggccaccagggcctccgggggaggggggcaaaccaggcgaccagggagtgcccggcgaggccggtgctcccggcctggtggggccgcggggggaaagaggctttcctggggagagaggcagtcccggtgcccagggactacagggcccccgagggctgcctgggacgccaggaaccgacggaccaaagggggctagcggtcccgccggaccacctggagctcagggccctccaggcctgcaaggaatgcctggagagagaggggctgctgggattgccgggcctaaaggcgaccgcggggatgtgggcgagaagggacccgagggagccccaggaaaggatggcggcaggggcttgacaggccccatcggaccccctgggcccgccggcgccaacggagaaaagggcgaggtagggcccccggggcctgccggttctgccggtgcacgcggcgcccccggagagcgcggtgaaactggtcccccaggtccggctggctttgccggcccccccggagctgatggccagcctggggccaaaggcgaacagggggaggctggccagaaaggtgacgcaggagcgcccgggccccaggggccatccggagcaccaggcccacagggacccaccggggttaccggccccaaaggggcccgcggcgcacagggacctcccggagcgactggctttccgggggccgccgggagggttggtccgccgggctcgaacggcaaccctggcccacctggtcctcccggccctagcggcaaagacggtccgaagggggcgagaggtgacagtggcccccctggaagggccggcgagcctggccttcaaggcccagccggcccccccggggagaagggcgagcccggcgatgatggcccaagtggggcagagggccctcccgggccccagggcctcgctgggcagagagggatcgtaggactgccagggcagcgcggtgagagaggattcccaggcctgcccggaccttcaggggaacccggcaaacaaggcgcgccgggggccagcggtgatcggggccccccaggcccagtcggaccaccaggcctgaccgggcctgccggcgagccaggtagagagggatcaccaggagccgacgggccccccggccgggacggtgcagctggcgttaaaggagaccgcggcgagactggggccgtgggggcacccggcgccccgggccccccagggtcacctggacctgcgggcccgacgggaaaacaaggcgaccgcggagaagctggcgctcagggccctatggggccaagtggccctgccggggctaggggcatacagggacctcagggtccacgcggcgataagggcgaggccggggagcccggcgaacggggcctaaaggggcatcgcggcttcaccgggcttcagggcttacctggtccaccgggcccaagcggcgaccagggggcaagcggccccgctggtccctccggaccacgggggcccccagggcccgtaggcccaagcggcaaagatggtgcgaatggaattcccggccccattggaccccctggtccgagaggtcgctccggggaaactggccccgccggaccccccggcaaccctggaccgccaggccctccaggtccccccggcccggggattgatatgtcagccttcgccggccttgggccccgcgagaaaggccccgatccgctgcaatatatgagagcagaccaggctgctggaggcttacgccagcatgacgccgaggtggacgcaacgttaaagtccttaaataatcagatagaaagcatccggagcccagagggcagtaggaagaaccccgcaaggacttgtcgcgacttgaagttgtgccatcccgagtggaaatctggggattactggatcgatcccaatcagggatgcaccctcgatgccatgaaagtgttctgcaatatggagactggagagacctgcgtctaccctaatccagccaatgttccaaaaaagaactggtggtcctccaaaagcaaagagaagaaacacatatggtttggcgagaccattaacgggggctttcacttttcatatggcgatgacaacctggctcccaatactgcaaatgttcagatgacatttttaagactgctctcaactgagggctcccagaatatcacctaccactgtaaaaacagtatcgcctatctggacgaggccgccggcaacctgaagaaggccctcctgatccaggggtcaaacgatgtggagattagggccgaaggaaacagcaggttcacatacaccgcacttaaagacggttgtacaaagcacaccgggaagtggggtaaaaccgtcattgaatatagatcccagaagaccagccgcctgcccataatagatattgccccaatggatatcggcgggcctgaacaggaattcggcgttgacattggacctgtgtgcttcctgtag

SEQ ID NO: 2485 - DNA, 4464 bp, Artificial Sequence
  Description of Artificial Sequence: Synthetic coding sequence
atgattagactgggcgcccctcagacattggttctgttgacattactggtcgccgcggtgctgcgctgtcagggacaggacgttcaggaagccggctcctgcgtccaggacggccaaaggtacaacgataaagatgtgtggaagccagagccctgcagaatttgcgtgtgtgataccgggacagtgctgtgcgacgacatcatctgtgaagatgtgaaagactgcctgtccccggagattccctttggggaatgctgtccaatctgccccactgacctggcaacagcttcagggcagcctggccctaaggggcagaaaggagaaccaggtgatatcaaggacatcgttggcccaaaggggccccctggaccccaggggccagccggggaacagggcccaaggggcgatcggggggacaaaggcgaaaagggggctcccgggcccagggggcgagacggtgagccgggcactccggggaatcccggacccccaggaccacctggcccacctgggcccccagggctgggcggcaattttgcagcccaaatggctggaggttttgatgaaaaggccggaggagcacagctgggggtcatgcaggggccaatgggacctatgggccctagagggccgccaggcccagccggagctccgggtccacagggtttccagggaaatcctggtgagcctggcgagcccggcgtcagtggtccaatgggcccgaggggccctccaggaccaccaggaaaacctggagatgatggagaggcaggtaagccagggaaagctggggagcggggccctcctggcccacagggcgccagaggatttcccggcacccctggcctgccaggggtaaagggccaccggggttatcctggcttggatggcgctaagggtgaggccggcgctcccggcgtaaaaggagagagtggctccccaggcgagaacggttcaccaggacccatgggtccaagaggactgccgggggagagagggcggactggtcctgccggcgccgcaggtgccagagggaatgatggacaaccaggccctgcaggtccaccaggacccgtgggccctgccggcggtccaggctttcctggggcccccggggccaagggcgaagctggtccaactggcgcccgtgggcctgagggcgcccagggccccaggggagagccaggaacaccgggaagtccagggcccgccggagcgtcaggtaatcctgggaccgacgggataccaggagcaaaggggagcgccggcgcaccaggaatcgccggagctcctgggttccctggaccacgcggcccgccgggaccacaaggtgctacaggcccactggggccgaaggggcagacaggcgagcccggcatcgccggattcaagggggaacagggacccaagggtgaacccggtcctgccggccctcagggcgcccccgggccggccggtgaggagggaaagcgcggggcccgcggagagcccggcggggtgggccccatcggaccaccaggagaaaggggagcccccggcaaccgcggcttcccagggcaggacgggttagccggaccgaaaggagctcctggagagagggggccttctggcctcgcaggcccgaagggcgccaatggggatccagggcggccaggtgaacccggcctcccaggtgccaggggtctaactggccgacccggagacgctggcccccaggggaaagtcggcccttctggcgctccaggagaagacggccggcccgggccacctgggccccaaggggcccgtggccagccgggagtgatgggctttccagggccaaaaggggcaaacggcgaacccggtaaggctggcgagaagggcttaccaggcgcacctggattgcgcggcttacctgggaaggatggcgagacgggcgccgcaggccctccaggacccgctggtccagctggcgagagaggcgagcagggggctcccgggcccagcggcttccaagggctgccaggcccacctgggcccccaggcgaagggggcaagcccggagaccagggcgtacctggcgaggcgggggcacccggcttagtgggcccacggggcgagagaggatttcccggggagcggggctctcccggtgcacagggcctccaggggcccaggggactgcccgggacacccggtaccgacggtcccaagggtgcctccggtccggctggcccaccaggagcccaaggccctcctggactccaaggcatgccaggggaaaggggtgccgcgggcatagcaggtccaaagggtgaccgcggagacgtgggagagaagggccccgaaggcgcaccaggtaaggatggtggcagaggacttacaggtcccatcgggccacctggtcccgcaggagcgaacggggagaaaggtgaggtggggccgcctggtcctgctgggagcgcaggagctcggggtgcccccggtgagcggggcgagaccggccctcctggtccagcagggttcgctgggcctccaggagctgacggccagccaggcgcgaaaggcgagcagggggaggcaggccagaagggggacgcaggcgctcccggcccgcagggcccaagtggcgccccaggtccacagggccctaccggcgtgacaggccctaaaggggccagaggggctcagggcccccctggggcaactggattccccggagcagcgggccgcgtaggtccgcctggaagtaacggcaatcctggcccccctggaccaccggggccatcgggaaaagatggaccaaagggggctcgtggagatagtggacctccgggccgtgccggcgagccaggccttcaaggcccagccgggccaccgggagagaagggggagccaggagacgacggcccttcaggtgcggaaggcccacccggaccgcagggcctcgcagggcagcgggggatcgtaggtctaccaggtcagcgaggtgagaggggttttcccggactgccaggtcctagtggagagcctgggaagcagggtgcaccaggcgcttcaggcgatcggggaccgccaggacccgttggaccccctggcctgacgggtcccgcgggcgagccggggcgcgaaggctcaccaggagctgacgggccccctggcagggatggagctgccggagtgaagggggacaggggcgaaacgggagccgtgggcgcaccaggcgcccctgggcccccaggctctccaggacctgccgggccgaccggaaagcaaggcgaccgcggagaggccggcgcgcagggccccatgggaccttcaggccctgccggggcccgcggcatccagggacctcagggccccaggggtgacaaaggagaggcgggcgaacccggtgagagaggactgaagggacataggggattcacaggcctccaggggctgcctggaccaccagggccctctggggatcagggcgcatctggcccagccggaccatccggcccccggggtccaccaggccctgttggcccttcaggtaaagatggggctaatggtatacctggccccatcggcccccctgggcccaggggccggtcaggggagactggtccggctgggccccctggtaaccctgggccacccggcccacccggaccgcctggaccaggaattgacatgagtgcgtttgctggcctgggtccccgcgaaaaaggacccgaccctctccagtacatgcgagcagatcaggccgccggtggcctgaggcagcacgatgctgaagttgacgccaccttgaagtctttgaataatcaaattgagagcatacggagccccgaagggagccggaagaatccagcacgcacctgtagagacttaaaattgtgccatccagaatggaaaagtggagactactggatcgaccccaaccagggctgtaccctcgatgccatgaaggttttctgtaatatggagacgggagaaacttgcgtctaccctaatccagccaatgtccccaaaaagaactggtggtccagcaaatcaaaggagaaaaagcatatctggtttggggagactatcaacggtggcttccacttctcttacggggacgacaacctagcacccaacaccgccaacgtgcaaatgacctttttgaggctcctgtctactgaggggagtcagaatataacgtaccactgtaagaacagtatcgcctacctggacgaggctgctggcaatctgaagaaagcactcctgatccaaggctcgaatgatgtggagatcagggctgagggaaactcacggtttacatacactgcacttaaggatgggtgcacgaagcataccggtaaatggggaaagacagttatcgagtatcgcagccagaaaacatcacggctccctatcatcgatatcgcacccatggatattgggggcccagaacaggaatttggtgtggatataggccccgtttgtttcttgtag

SEQ ID NO: 2486 - DNA, 4257 bp, Artificial Sequence
  Description of Artificial Sequence: Synthetic coding sequence
atgataagacttggagcaccccagactctggtactactcactcttttggtggccgccgtgctgaggtgccaagggcaggacgttaggaagcccgcccctgcgcttgaacccgccgcaccaggttcactcagtcagatcgtgggcccaaagggaccgccagggccccagggaccagccggcgagcagggtcccaggggggacagaggtgacaagggcgagaagggggcgccaggacctcgtggacgcgacggggagccagggaccccagggaaccccgggcctcccgggccacccgggcctccgggtcctcctgggctgggagggaactttgctgcccagatggccggtggattcgacgagaaagctggtggagcacagttgggagtgatgcaaggacctatgggccctatggggcctcgcggccctcccggcccggccggagcaccgggtccacaaggttttcagggtaatccgggcgagcctggtgagcccggcgttagcggcccgatgggcccccgcggccccccaggaccacctggcaagccgggggacgatggagaggctggcaagcccggcaaagcaggggagcgcggtcctccgggtccccagggggctaggggtttcccagggacaccagggctgcctggagtgaagggccatcgcggctatcctggtctagacggcgctaagggcgaggctggggcacccggagttaaaggtgagtctgggtcacccggggaaaatggttctccaggccccatgggcccaagaggcttacctggagaaaggggcaggacagggccagcaggggcagccggtgcccggggaaacgacggccagcctggcccagctggccctcccggaccagtgggacccgcaggaggtccaggctttcccggggctccaggggccaaaggtgaggctggacccactggggcgaggggccccgagggcgcccagggcccaaggggtgagccgggcactccaggcagtcctggacccgctggcgcgtctgggaatccggggacagatggaatcccaggggccaaaggaagcgccggtgctccgggtatcgcgggggctccaggcttccctggcccacgggggcctcccggcccccagggcgccactggccctctcgggccaaaggggcagactggggagcccggaatcgccgggtttaaaggcgaacaggggccaaaaggcgagccagggcccgctggcccccagggcgcgccaggccctgctggagaagagggcaagaggggcgccagaggggagcccgggggcgttggacctattggccctcctggagaaaggggggccccgggtaaccgggggttccctggccaggatgggttggcgggacccaagggtgctcctggggaacgcggcccctccggactggccggacctaagggggctaatggagacccgggaaggccaggggagccggggctccctggagccaggggtcttacgggccgccctggtgacgcaggcccccagggtaaggtaggcccatcaggagcgcccggggaggacggacgccctggtcccccggggccgcagggagcacggggccagcctggagtcatggggttccccgggccaaaaggggccaacggtgagccaggcaaggcgggtgagaaaggattgcctggtgcccccggtctgagaggcctgcccgggaaggatggagagaccggagctgccggcccccctggacccgcaggccccgccggcgagcgtggggagcagggagcgcccggcccatccggatttcagggccttcctggcccccccggccctcctggcgaaggtgggaaacccggagaccagggggtaccaggcgaagccggcgcacctggactcgtggggcccaggggtgagcggggatttcccggtgagagaggaagtcccggggcccaaggtctccaaggtcccaggggcctcccagggacaccaggcactgacggacctaagggggctagcgggcccgcgggcccgccaggagctcaggggccccctggactccagggcatgccgggcgagagaggcgcagcagggatagctggacccaaaggagatcgcggtgacgtgggggaaaagggcccagagggtgcccccggcaaggacgggggaaggggactcaccggacccattggaccacctggcccagctggcgccaacggtgaaaaaggcgaagtgggaccacctggccctgcgggatccgccggggccaggggagctcccggggagcgaggtgagacaggacccccaggcccagccgggtttgccgggccccctggcgccgatgggcagccaggggcgaaaggagagcagggcgaagcgggccagaaaggagacgccggcgccccagggccgcagggcccaagtggcgctcccggtcctcagggccctacaggcgtgacaggccccaaaggagccaggggcgcacagggccctcccggggccaccggatttccgggcgctgcgggtcgtgtcggcccccccgggtcaaacgggaaccctgggcctcctgggccccccggcccatctggaaaagacgggccaaagggcgcccgtggtgactctggaccacccggtagggctggggaaccgggactgcaggggcccgccggcccccctggcgaaaagggagaaccgggtgatgacggtcctagtggcgcagagggtcctccggggccccaaggactggctggtcagaggggcatagtgggattgccagggcagagaggagaacgagggtttccagggctgccaggtccaagcggagagccgggcaaacaaggcgctccgggagcatcgggcgatcgagggcctcctggccctgttggaccacccggactgacaggacctgctggcgaaccaggaagggaaggatccccaggagctgatggaccccccggccgcgatggcgctgcaggggtgaaaggagatagaggagagactggtgccgtgggtgctccaggcgccccgggaccacctgggtcgcctggacccgcgggaccgacaggcaagcaaggcgatagaggcgaggctggggcacaagggcccatgggcccgagtggccctgccggagctagaggcatccagggcccccaggggcctaggggcgataaaggagaagccggagagccaggagaaagagggttaaaaggccatagaggattcaccggcctgcagggactcccagggccccccggtccctccggcgaccagggggccagtggacccgctggtccaagcggtccaagagggccgcccgggccagtggggccctcagggaaagacggagcaaacggaattcccgggcctatcgggcccccaggcccgcgcggcaggagcggcgaaacagggcccgcgggcccccccggaaatccaggcccgccaggaccgccaggccctcccggtccaggtatcgatatgtcggccttcgcaggcctgggccccagggagaaagggccagacccactccagtatatgcgcgctgatcaggcagccggcggactccggcaacatgacgccgaggtggatgccacattgaaaagtttgaataaccaaattgagtctattcgttcacctgagggatcccgaaagaaccctgctcgcacgtgcagagatctcaagctctgccaccccgaatggaagtccggcgattactggattgaccccaatcagggctgtacgctggacgctatgaaggtgttttgtaatatggagactggtgagacatgtgtgtaccccaatcccgctaatgtgcccaagaagaattggtggtcctcaaagtcgaaagaaaaaaagcatatttggttcggagagaccatcaatgggggatttcacttctcttacggcgatgataatctggccccaaacactgctaacgtgcagatgacatttctccggctcctgtctactgaaggatctcagaacatcacctatcactgtaaaaacagcatcgcctacttggacgaagctgccggaaacctcaagaaagctttgctgatccagggaagtaatgatgtggaaatccgcgctgaggggaattcacgatttacttacacagctctaaaggatggctgtacaaagcataccggtaagtggggaaagaccgtgatagagtatcggtctcagaaaacatccaggctccccatcatagacattgcacccatggacattggcggtcctgagcaggaatttggtgtggacatcggacctgtatgtttcctctag

SEQ ID NO: 2487 - DNA, 3939 bp, Artificial Sequence
  Description of Artificial Sequence: Synthetic coding sequence
atgggtccaagattgagcgtgtggttactcttactgcctgcagccctactcctgcatgaagagcactcacgtgccgccgccaaggggggctgcgccggatcgggttgcgggaagtgcgactgccatggcgttaagggtcagaagggcgaacgggggttacccggcctgcagggggtcatcggctttcccggcatgcaggggcctgaggggccacagggacctccggggcagaaaggcgataccggtgaaccaggcctgcccggcaccaagggaactcggggtcctccaggggcttcggggtaccccggcaatccgggattacccggaatccccggccaggatggaccccctggaccccccggcatccccggctgcaatggcaccaagggggagcgcggcccccttggccccccagggctgcccggcttcgccggcaaccccggagatccaggcgagatactcggacatgtgcccggcatgctgctgaaaggggagcgggggttccctggaattcccggaactccgggcccgcctggtctgccaggactgcaaggccctgtggggccgcccggtttcactggaccccccgtatccttcggagggtgcttgtcagagtttggccacggcgggatcagctttccactcaccaagagacgccaaggggatcagggagtttcgggacctccaggcgtcccggggcaggcccaggtccaggagaagggcgacttcgccaccaagggggaaaaggggcagaagggagaaccgggctttcagggcatgcctggagtaggtgagaagggagagcccgggaaacccgggccccgaggaaagcctggaaaggacggagacaagggggagaaagggagccctgggtttcctggagaaccaggctatccggggctcattggcagacagggcccccaggtgaatgccggaaccattgcctacccactgccgccctgtcctgtgattgggaccgggccgttgggggagaaaggcgaaaggggttatccgggtaccccaggacccaggggtgaacctggcccaaagggctccttcctggccttttttccccctccacccacacctcctccattcgctggcttgcctgtccccgggcaggcaggggcgccggggttcccgggcgagagaggtgagaaaggtgacaggggattcccaggaactagcctgcctggtccatccgggagagacggccttcccggtcctccagggagtccaggccccccagggcagcccggctacaccaacggcatcgtggaatgccagcccggcccacctggcgatcagggcccacctggtataccgggacagcccggctttattggcgaaatcggtgagaaggggcagaagggcgagtcttgcctgatctgtgacatagacggctatcgaggtcccccaggaccccagggcccaccaggcgagattggtttccctggccagcccggagcgaaaggactccctggaatcaccggtcagtccggtttacccggcctgcctggccagcagggagcgcctggcattccgggtttccccggttcaaaaggcgagatgggggtcatggggaccccgggccagcctgggtctccaggtccagtcggggcacctggcctccccggagagaaaggcgatcacggttttcctggatcatccggccctcggggcgatccagggttgaaaggagacaaaggcgatgtggggctaccgggcaaacctgggtccatggacaaggtggacatggggtctatgaaaggtcaaaagggggaccagggagagaagggccagatcgggcccattggcgaaaaaggatccagaggggatcctggcacacctggggtcccgggcaaggatggacaggccggtcagccaggccagccggggcctaagggcgatccgggcatcagtgggactcctggcgccccggggctgcccggccccaaaggctcagttggaggaatggggctccccggtacacctggcgagaaaggggtcccaggcatcccaggtcctcagggaagccccggactgcctggtgacaagggggctaaaggggagaagggccaggcgggaccaccggggatcgggatcccagggctccgtggagaaaagggcgaccaggggatagcgggtttccctggatcccccggcgaaaagggagagaaaggtagcattggcattccaggcatgccgggttcaccaggactgaagggcagtccaggttctgtgggatacccaggctcgcctggtctccccggggagaagggtgacaaaggcctgcctggcctggatggaattccgggagtgaaaggagaagccggcttgccgggaacacctgggcctacaggcccagcgggtcagaaaggcgagccagggagtgatggtatccccggcagcgcaggagagaaaggggagcccggccttcccggcagaggctttcccggttttcctggagctaagggggacaaagggagtaagggtgaagttggatttcccggcctggctggtagccctgggattcctggatccaagggggagcagggattcatgggaccaccagggccccagggccagcctggattgcccggtagtcccggccacgccactgaaggaccaaagggagatagaggcccacaaggacagcccgggctccctggattgccaggccccatggggccaccaggcctgcccggcatcgatggagtgaagggcgataaggggaaccctggctggcccggggctcctggagtgcccggtcccaagggagatcccgggttccagggaatgcctggtataggcgggagtcctgggattacaggctctaaaggggacatggggcctccgggggtgcccggcttccagggccccaagggactgcctggcctgcaggggattaaaggcgatcaaggagatcaaggtgtgccaggcgcaaagggtttgcctggtccacccggcccacctgggccatacgatatcatcaagggagagccaggccttccaggcccagaagggcctcctggcctgaaaggtctgcaaggccttccaggcccgaagggtcagcagggagtcacaggcttagtcggaatcccaggcccaccgggtatccctgggttcgacggggctcctgggcagaaaggggaaatgggaccagccggacctacgggtcctaggggcttccctggacccccagggcccgacggtcttcccgggtctatgggcccgcctggcaccccatccgtggaccatggattcctggtcacaagacatagtcaaactatagacgacccacagtgcccgtccggcaccaagatattgtaccacggctattccttattgtatgtgcagggtaatgagagggcccacggccaggacctgggcactgctggaagttgtttacgtaagttcagcacaatgccttttctgttctgtaacatcaataacgtttgcaatttcgcctcaagaaatgattattcttattggctgtctacgccagaacccatgcctatgtccatggccccaatcactggcgaaaacattaggcccttcatcagccggtgcgccgtttgtgaggctccggcgatggtgatggctgtgcactctcagactatacaaattccaccttgcccgtccggatggagttctttgtggatcggctattcctttgtgatgcacactagtgccggggcagagggttcggggcaggctctcgcctcccccggatcttgcctagaggagttcaggtcggcaccattcattgaatgtcacggtcggggtacatgtaactactatgccaatgcgtactctttctggctcgcaaccatagagcgttctgaaatgttcaagaaaccaaccccatccacactaaaggccggggagctgcggactcacgtgtctcggtgtcaagtgtgcatgaggcgcacttag

SEQ ID NO: 2488 - DNA, 5010 bp, Artificial Sequence
  Description of Artificial Sequence: Synthetic coding sequence
atggggcctcggctgtcagtgtggttgcttttgcttccagcggcactgcttctccacgaagagcactcacgggcagcggccaaaggtgggtgcgccgggtcaggatgtgggaaatgtgactgtcacggagtgaaggggcagaagggcgagagaggacttccagggttgcagggcgtgataggctttccaggcatgcagggtcccgagggacctcagggtcctcccgggcagaaaggggatacaggggaacccggccttcccggcactaaaggaacacgagggcctcctggggccagcggctatccaggaaatcctgggctccccggcattccggggcaggacggtccaccaggtccaccaggtatccccgggtgtaacggaacgaagggtgagagagggcctcttgggccacccggactgcctgggttcgccgggaatcctggcccccctgggcttccaggtatgaaaggtgatcccggggagattctaggtcacgtgcccggcatgcttctgaaaggcgagcgcggctttcctggcatccccggcacccccggccccccaggcttgccaggtttacagggccctgtgggtcccccaggattcactggaccacctggaccccctggcccacctggtccgcctggagagaaggggcagatggggctcagttttcaggggccaaaaggggataagggggaccaaggggtaagcggcccaccaggtgtacccggccaggcacaggtgcaggaaaagggggacttcgcaactaagggggaaaaggggcagaagggagagcctggttttcagggaatgcctggcgtgggcgaaaagggggaaccaggaaagcccggcccgagagggaagcctggcaaagacggagacaagggcgaaaaggggtctcccggtttcccaggggagcccggctacccagggctgatcggacgccaagggcctcaaggggagaaaggggaggccgggcctccgggccctccgggaattgtgattgggacaggccccctcggcgaaaaaggggagcggggctatccaggaacccctggaccaagaggcgaaccagggcctaaaggtttcccaggacttcccggccagccaggcccccccggtttgcccgtaccaggccaggccggcgctccagggttccccggagaaagaggcgaaaagggagaccgcgggtttccggggacaagtttacctggcccatctggtagggacgggctgcctggtcctccaggctctccagggccacctggccaacccgggtacaccaatggaattgtagaatgccagccaggtcctcccggtgaccagggacctccgggcattcccggccagccggggtttatcggggagataggtgagaaaggccagaaaggcgagtcttgcctcatctgcgacattgatggctaccggggccccccaggacctcaagggccacccggagaaatagggtttccaggtcagcccggagctaagggcgatcgcggacttcccggccgcgatggtgttgccggagtccctggcccccaaggcacaccagggttgatcggacagccaggggcaaagggcgaacctggtgagttttacttcgatctgaggctgaagggcgataaaggagaccccggatttcctgggcagcccggtatgactggacgcgccggttccccggggcgcgacggccatcccggcttgcctggccctaaaggatcccctgggtctgtagggcttaaaggggaaagaggtccaccaggtggtgtcggctttccaggctctcggggcgacacaggtccgccaggcccccccgggtacggtccagcagggcccattggggacaaaggacaggctgggttcccaggggggccgggctccccaggattacctgggcctaaaggcgagcccggcaaaattgtcccactgccggggccaccaggagctgaagggctcccgggaagccctggattccccggcccacagggagaccgaggcttccccggaacacctggtagacccggcctgcccggagaaaaaggcgcagtggggcagccaggcatcggctttcctgggccccccggaccaaaaggggtggacgggttgcccggcgatatgggtccgcccggtacccctggccggcctggcttcaacggacttccagggaatccaggcgtccagggacagaagggcgaaccaggagtcgggttacctggactcaagggacttcctggcctacccggtatacctggaaccccaggggaaaagggcagcatcggggtgccaggcgtgcccggtgaacacggcgccataggcccgccaggcctacaagggatcagaggtgagccgggccctcctggcttaccaggcagtgtgggcagccctggcgtaccaggtattggaccacccggggccagaggaccaccaggcggccagggtccaccaggtctgtctggcccaccaggcattaagggagagaaggggtttcctggatttccaggccttgatatgcccggacccaagggggataaaggcgcgcaaggattacccggaatcaccggccagtcaggattacccggcttacccgggcagcagggcgcacccggaatccctggctttccaggcagtaaaggagaaatgggcgtgatgggcactcctgggcaacctggcagcccgggaccagtcggagctcccggcctcccaggtgagaagggagaccatggttttcccggcagtagtggtccccggggggatcctgggctgaagggcgataagggtgacgttggactgcctggtaagcccggtagcatggacaaggttgacatgggcagtatgaagggccagaagggtgatcagggcgagaaagggcaaattgggcctatcggagagaagggctctaggggagacccagggactcccggagtacccgggaaggacgggcaggccgggcaaccggggcagccaggccctaaaggagacccaggaataagcggaacccccggagcacctggtctccctgggcctaagggttcagtggggggaatggggctgcccggtacacccggcgagaaaggggtgcccgggatccctggaccgcagggatctcccgggctacccggagataaaggtgccaagggcgaaaaaggacaggccggcccccccggaatcggaattcccggccttcggggcgaaaagggtgatcagggaatcgccggctttcccggaagtcccggggagaagggggaaaagggctcgatcggaatcccaggaatgcccggctctccaggtttgaaggggagtccgggatcagtgggctaccctggctccccagggctgcccggcgaaaagggcgataagggtcttcctggtcttgacgggataccgggagtgaagggagaggctgggctgcctggaaccccaggccctaccggaccagctgggcagaagggcgagcccgggtctgatggaattcctggaagtgcaggggagaagggggaaccaggactgcctggaagaggatttcctggatttcccggagccaagggagacaaaggcagtaagggggaggtggggttcccgggtcttgcaggtagccctggcatcccgggttctaagggcgagcagggctttatgggaccccctggtcctcagggccagcctgggctccctggcagccccggccacgcgaccgagggccctaagggagatcggggtcctcaggggcagcccgggctgcccgggcttccagggccaatgggacccccaggtctgccaggcattgacggcgtgaagggggataagggcaatcctggctggcccggggctccgggcgttcctggcccaaaaggtgaccccggctttcaggggatgccaggcatcggcgggtcgcccggcattacaggctctaaaggtgacatgggaccgcccggtgtgccaggattccaggggcctaagggcctgccaggactgcagggcatcaagggtgatcaaggagaccagggagttccgggagccaagggattacctggaccccctggtcctccgggtccttacgatatcattaagggcgagcccggccttcctggtcctgaaggtcctcctgggctaaagggcctacagggcttaccaggaccaaagggtcagcagggagtaacagggcttgttggtatccctggtccacctggaatccccggatttgacggcgccccaggccagaagggtgagatggggcccgctggacctacagggccaaggggctttcccggaccaccaggacctgacggcctgcccggatccatgggtccccctggcacgccaagcgttgaccacgggtttctggttactaggcattcccagactatcgatgatccacagtgtcctagcgggactaagatcctctatcacggttattctctgttgtatgtccaggggaacgagcgggcacacgggcaagacctaggcaccgccggtagctgcctaaggaagttctctactatgccgttcctgttctgtaacatcaataatgtttgcaactttgcctctcggaacgactattcttactggttgagtacacccgagcccatgccaatgtccatggcacccatcaccggagaaaatattcggccttttatttcccgctgcgctgtgtgtgaggctccggccatggtgatggccgtccactcccagacgatccagatccccccatgcccatcaggatggtcaagtctgtggattgggtactcgtttgtgatgcatacttccgctggggctgaaggttctggccaagctcttgccagtcccgggtcttgtcttgaggaatttcgttctgctccgtttattgagtgtcacggacgaggaacctgtaattactacgcaaacgcatactccttctggctggcgacgatcgaaagaagtgagatgttcaaaaaacctaccccctccaccttaaaggccggggagctcaggacacacgtgtccaggtgtcaggtgtgtatgcgccggacatag

SEQ ID NO: 2489 - DNA, 3957 bp, Artificial Sequence
  Description of Artificial Sequence: Synthetic coding sequence
atgggccctcgcctgtctgtctggctgttgctgcttcctgctgcattattgttgcacgaagagcattcacgggcagctgctaaaggaggatgtgcaggttccggatgcggaaagtgcgactgtcatggtgtgaaaggacaaaaaggtgagagaggactgcctggcttgcaaggtgtgatagggttcccaggcatgcagggaccggaaggtccccaaggcccaccggggcagaaaggcgacacgggagagccgggactgccagggacaaagggaaccagaggacctcccggcgcatccgggtacccaggaaatcctggattgcccggtattcccggtcaggacggtcctccaggccctcccggcatccccggatgcaatgggaccaaaggcgaacgcggacccctggggccgccagggctgccgggtttcgccgggaacccaggcccacctgggctacccggaatgaagggagaccctggagagatccttgggcacgtgccaggcatgttgctgaagggggagcgcggattcccgggcattcctgggacccctggaccccccggactgcctgggcttcaaggacccgtcgggcccccaggattcacagggccaccgggacctcccggaccacccggtccccccggcgaaaagggtcagatgggtctatcatttcagggtcccaagggtgacaagggtgatcaaggcgtcagtggcccgcccggcgttccaggccaggcccaggtccaagagaagggcgatttcgccaccaagggcgagaaaggtcagaagggggagcccggttttcaggggatgcccggcgtgggggaaaagggggagccgggtaaacctggaccaagaggcaagcccggcaaggacggggataaaggagagaaaggttcacccggctttccgggggaacccgggtatcccgggctgattgggcgccaggggccacaaggcgagaaaggcgaagctggaccgccgggaccacccggaatcgtcattggtaccggaccgttgggcgaaaagggcgaacgtgggtaccccggaactcctgggccccggggggaacccggtccaaaagggttcccggggctcccagggcagccgggacctccaggcctccctgtgccaggccaggcaggagcccctgggttcccgggagagcgcggcgaaaaaggcgacaggggattccccgggacatccctgcccgggccctcaggcagagacggattacctgggcctcccggttccccgggtccgcctgggcagccagggtacacgaatgggattgtcgaatgccagccgggacctccaggcgaccaaggtcctcccggtatccctggccagcccggatttatcggcgagataggagaaaagggccagaaaggggagtcctgtctcatctgtgacattgacggatatagggggccgcctgggccccaggggcctccgggggagatcggcttccccggccagcccggtgcaaagggacttcccggtattacggggcagtccgggttacctggactgccaggtcagcagggcgctccaggtattcccggcttccccggaagcaaaggcgaaatgggggtgatgggtactcctggacagcctggatcccccggcccagttggcgctccaggcttgccgggcgagaaaggcgaccacggttttcctgggagcagcggcccaaggggcgatcccggcctgaagggtgataaaggagatgtggggttgcccgggaagccgggatctatggataaggtcgatatgggctccatgaaaggacagaagggggaccagggtgagaagggccagataggtcctatcggagagaaaggtagtaggggagatcctggtactcccggtgtgcctgggaaggatggccaggccggtcaacccggacaacccggacccaagggagaccccggtataagcggtacccccggcgccccaggcctccctggccccaagggaagcgtgggcggtatgggcctgcctggcacccccggggaaaagggtgtcccaggaatacccgggccccagggttcgcccgggctgccgggggataaaggagccaaaggggaaaagggacaagccgggccaccagggattgggattccaggactccggggcgaaaagggggatcagggcatcgccggcttccctggctcgcccggcgagaagggtgaaaaaggctctattggcatccccggcatgcccgggtcaccaggcctgaagggctctccggggtccgtcggctatcccggatcccctggactccccggcgaaaagggagataaaggactgcccggtttggacgggatcccaggcgtgaaaggcgaggccggactgccaggcacaccaggccccacggggcctgcggggcaaaagggggagcccggcagtgatggcattcccgggtccgcaggtgaaaaaggtgaaccgggtctgccgggacgaggctttccaggttttcctggcgcaaaaggtgataaggggagcaagggcgaggtggggtttccgggactcgctgggtcgcccggaatcccgggcagtaagggggaacaggggtttatgggcccccctggtccccagggccaacccgggttgccaggctccccgggccatgccaccgaaggaccgaaaggagacagaggaccacaggggcaacccggattaccgggacttcctggccctatgggcccgcctggtctccccggtatcgatggggtcaagggggacaagggtaatcccgggtggcctggtgccccgggcgtgcctggtcccaaaggggatcccggctttcagggcatgccggggattggtgggtccccaggaatcaccggatccaaaggcgatatggggccacccggcgtgcccggcttccaagggcctaagggacttcctggcctccaaggaattaagggggaccaaggcgaccaaggagttcctggtgccaagggcctacccggaccaccgggacccccggggccttatgatatcattaagggggagccaggtttaccagggcctgagggcccgcccggtcttaagggcctccaaggtttgccagggcccaaagggcagcagggcgtgacaggcctcgtagggattccgggcccacccggcatccctgggttcgacggcgctcctggacagaaaggtgaaatgggccccgctggccctaccggccctcgcggattcccaggacccccgggtcctgacggtctgcccggttctatgggtcctccggggactccaagtgttgaccacgggttcctcgtgactcgacacagccagacaatcgacgatccccagtgccccagcggtactaagattttgtatcatggatacagcctcctgtatgtgcaggggaatgaacgggctcatgggcaggacctgggaacagcagggtcttgtttacggaagttctcgaccatgccattcctgttctgcaacattaataacgtttgcaactttgcatccagaaatgactatagttattggctttccacacctgagcccatgccgatgtccatggccccaatcacgggagagaatatcaggcctttcatatctcgttgcgccgtgtgtgaggcccctgccatggttatggcagtccacagtcagaccattcagataccaccatgtccaagtggctggagcagcctgtggatcggctactcctttgtcatgcatacaagtgcaggggccgagggcagcggccaggccctggccagcccgggttcatgcctggaggagtttagatctgccccttttatcgaatgccatgggcgaggtacttgtaattattatgcgaatgcctattctttttggttggcgacaattgaacgtagcgaaatgtttaagaagccaacgccgtccacgctgaaggccggcgagcttcgaacacacgtgtcccgttgtcaggtctgcatgcgtaggacatag

SEQ ID NO: 2490 - DNA, 1560 bp, Artificial Sequence
  Description of Artificial Sequence: Synthetic coding sequence
atgggacctcgtttatctgtttggctgctgctcctgccagccgctttgctgttgcatgaggagcactcaagggccgccgcgaaaggggggtgtgcagggtctggatgcggcaagtgcgactgtcacggggtcaagggacagaagggagaacgtggcttgcctggtctgcagggtgtcattggattcccaggtatgcagggtccagaaggcccacaaggtccgccaggacagaaaggcgatacaggcgaacctgggttgcctgggacgaaaggcactcgaggacctccaggagcctctggatatcccggaaatcctgggctccctggaataccaggccaggatggaccccctggaccccccggtattccgggctgcaacggtacaaaaggcgagagaggtcctctgggacctcccggcctgcccggcttcgccggaaacccaggtcctcctggtctgcctgggatgaagggggatcctggcgagatcttggggcacgtccctggtatgctcctcaagggggaacgaggatttcctgggatacccggaacacctgggcctccaggcctacctgggctccagggcccagtgggtccccccgggtttactggcccaccgggccccccaggcccaccagggccacctggggaaaaagggcagatgggactcagtttccagggccccaaaggcgataagggtgaccagggagtgagtggtcctcccggtgtccccgggcaggcacaggttcaggaaaagggtgatttcgctaccaaaggagaaaaaggccagaagggcgaacctggtttccaaggtatgcccggtgtgggggagaaaggtgagcccgggaaacctggcccccggggaaaaccagggaaagatggtgacaagggtgagaagggttctccaggcttccctggagaacccgggtaccctgggttaatcgggcgacagggcccacagggcgaaaaaggagaggcggggccccccggaccgcccgggattgtcatcgggaccggcccactcggtgagaagggggaacggggctatccaggtacccctggtccacgcggagaaccaggacctaaaggattcccaggacttccgggccagcccgggcccccaggtttacccgtgcctggacaggctggcgcccccgggtttccaggtgaacgtggggagaaaggcgatcgaggcttccccggcaccagcctcccaggtccgtcgggtcgggatgggctccctggacctcccggttccccgggtccccccggacaacccggatataccaacggcatagtggagtgccaaccaggccctcccggcgatcaggggccaccaggtattcccgggcaaccgggatttattggcgaaattggcgaaaagggccagaagggcgaatcgtgcctgatctgcgacattgatgggtaccgcggccccccagggccccagggtccgcccggtgagatcggctttccggggcagcctggtgcaaagggcgatcgtgggctgcccggcagagatggggttgctggagtcccactgctgttccagatccacaaatag

SEQ ID NO: 2491 - DNA, 1797 bp, Artificial Sequence
  Description of Artificial Sequence: Synthetic coding sequence
atgtcagataaccagagctggaattcctctggttcggaagaagacccagaaaccgagtcaggcccccccgtcgaaaggtgcggcgtgttgagcaagtggacgaactatatccacggttggcaggatagatgggtcgtgctgaagaacaacgcattgagctattataagtcagaagatgaaaccgagtacgggtgccgcggcagcatatgcctgagtaaagcggttattaccccccacgatttcgacgagtgcaggtttgatataagcgttaatgactccgtctggtatctccgcgctcaggacccagatcacagacagcagtggatcgatgcaatcgagcagcacaagaccgaatctggctacggcagcgaatcttccttgcggcggcatggcagtatggtctcgctagtgtccggggcaagtggatacagcgccacttcaacatcttccttcaagaaagggcattctttgagagaaaagcttgccgagatggaaacctttcgggacatcctgtgtaggcaggtggacacactgcaaaagtactttgatgcatgtgcggacgccgtaagtaaggatgagctccagcgggataaggttgtcgaggatgatgaagacgactttcccactactcggagtgacggagattttcttcactccactaatggcaataaagagaagctcttccctcacgtgactcccaaggggatcaatggaatagattttaagggtgaggctataacattcaaggcaacgactgctggaattctcgccaccctgagccactgcattgagctgatggtaaaacgggaggattcatggcaaaaaaggttggataaagagactgagaagaagcgtaggaccgaggaagcctacaagaacgcgatgacagaactgaaaaagaagagccactttggcgggcctgactatgaggagggccccaatagtcttattaacgaggaagagttctttgacgcagtggaagccgctttagacagacaggataaaatcgaagaacagtcacagagtgaaaaagtgcgtcttcactggccgacttctctgccctccggggatgccttcagtagcgtgggcacgcaccggtttgttcaaaaggtcgaagagatggtccagaaccacatgacgtactctctgcaggacgtcggcggcgacgcaaattggcagttagtggtggaagagggtgagatgaaggtctaccgacgggaagtggaagaaaacggcatagtgctagatcccttgaaagccactcacgctgttaaaggcgtcactggacacgaggtgtgtaattacttttggaacgttgacgtccgtaacgattgggagactaccattgaaaacttccatgtagtagaaacccttgccgacaatgccattattatttaccagacgcataagagagtttggcctgctagccaacgggacgtcctctatctgagtgtcatcaggaaaattccagctcttacagaaaatgaccctgagacctggatcgtctgcaatttcagcgtcgaccatgatagcgccccactgaataatcgctgcgttagagccaagattaatgttgcaatgatctgtcaaactcttgtgtctccgcccgagggtaaccaggagatctctcgggataacattttgtgtaagattacttatgttgcaaatgtcaacccagggggatgggccccggcctcggtgctgcgggcagtggcaaaacgcgaatatcccaagtttctgaagagatttacttcttacgtgcaggagaaaacagccgggaagcccattttgttttag

SEQ ID NO: 2492 - DNA, 690 bp, Artificial Sequence
  Description of Artificial Sequence: Synthetic coding sequence
aaagtcgaagaaatggtgcagaaccacatgacatatagtctccaggacgttggtggcgatgccaactggcagctggtcgtggaagagggcgaaatgaaagtgtataggcgcgaggtggaggaaaacggaattgtcttggacccactcaaggcaacgcatgcagtcaaaggggtcactgggcacgaagtgtgcaattacttctggaatgtcgatgtccgtaatgactgggaaactacaatagaaaactttcatgtggtcgagactctcgcggataacgctatcataatttaccagactcataagcgtgtatggcctgcaagccagagagacgtgctgtatttgagcgtgatccggaagattcccgctctcacagagaatgatcccgagacttggatcgtgtgcaacttttccgttgatcacgactccgccccgttaaacaacaggtgtgtgagagctaaaatcaatgtagctatgatctgccagactttagtgtcaccgccagaggggaaccaggagatcagccgcgacaatatattgtgtaaaatcacctatgttgccaacgtgaaccctgggggttgggccccagcaagcgttctccgcgcagttgctaagcgagagtaccccaagttcctcaagagatttacctcctacgttcaggaaaagacggccggaaaaccaatcctgttttag

SEQ ID NO: 2493 - DNA, 2259 bp, Artificial Sequence
  Description of Artificial Sequence: Synthetic coding sequence
atgcagcactcctgcattcccactccaccctcacccttttctgcccctccagcgttcctccctgtggtgacaagagagagtcgtagaggtctgtcctccggtgggtcagctggccgcaatgcgggagttacggctacagccgcggctgccgacggatggaagggccgccttcctagtcctttggtgctgctgcctagaagtgcacggtgccaagcacgccgccgccgtggtggccgaacgagcagcctcctactcttacctccgacaccagaacgcgcactattcgcatcaccatcgcctgatccaagtcctagaggcctgggtgctagtagcggtgcggccgagggcgccggagcgggcttgctcctgggctgccgggcaagtatgtcagacaatcagtcgtggaatagcagcggctccgaggaggacccggaaacagagagtggacctccggtcgagagatgcggcgtactctctaagtggacaaattatatacatgggtggcaggatcgatgggtcgtgttaaaaaataacgcactttcttactacaagtctgaggatgagacagagtacggctgcagaggcagtatctgtctgtcaaaggcagtcatcactccacatgactttgatgaatgcaggtttgacatctcagtgaatgacagcgtgtggtacctgcgcgctcaggatcccgaccacagacagcagtggattgacgctatcgagcagcacaagaccgagagcgggtatgggagcgagtcgagcctgaggaggcatgggtccatggtgtccctggtgtccggagccagcggatattcagcaacctctacatccagctttaaaaagggccacagcctgcgggaaaaactggccgaaatggaaacgtttcgggacatcctgtgtaggcaagtggacacccttcaaaaatatttcgacgcctgcgcggacgctgtctcgaaagatgaactgcagcgggacaaagtagttgaggatgacgaggacgatttccctaccaccaggtctgacggagactttcttcatagtacaaatggtaacaaggagaaactgtttccccacgtcacaccgaaaggaataaacggaattgactttaagggggaggcaatcacatttaaagctaccacagcaggtatcctggctaccctcagccactgcatagagctcatggtgaaacgggaggactcctggcagaaacggctggataaagagactgaaaagaagcgcaggaccgaagaagcttacaagaatgcgatgaccgaactaaagaagaagtctcatttcgggggtcccgactacgaggaaggacctaacagtctaataaatgaagaggaattcttcgacgcggtggaggccgcgctggataggcaagacaagattgaggagcaatcccagtcagaaaaggtacggctgcattggccaacgtctcttccttcaggcgatgcattctcttccgtgggaacacacaggttcgtgcagaaaccttatagtaggagcagttccatgtcgtccatcgatctggtgtccgcttctgacgatgtgcacagattctcttcccaagttgaggagatggtccagaatcacatgacatactcgctgcaagatgttggaggggacgcaaattggcagctcgtcgtggaagagggagagatgaaggtgtaccggagggaggtagaagagaacggtatcgtgcttgaccccttgaaggccacccatgcagttaagggggtaactgggcatgaggtgtgcaactacttttggaacgtggacgtgcggaatgattgggagactactatcgaaaattttcacgtcgtcgagacgctagctgacaatgccattataatataccagacgcacaagcgggtctggccagcaagccagagggatgttctgtacctgtctgtcatcaggaagatcccagcactgacagagaacgatccggagacgtggattgtgtgtaattttagcgttgaccacgatagtgcaccactaaataatagatgcgtgcgtgccaagattaatgtggccatgatatgtcaaacattggtgtcaccccccgaaggcaatcaagaaatcagccgggacaacattctctgtaagatcacctatgttgcgaacgtgaatcccggaggctgggcacccgcttcagtgctgcgagctgtcgccaagcgggagtaccctaaatttctgaaaaggtttactagctacgtacaggaaaaaactgctggaaaacccattctcttttag

SEQ ID NO: 2494 - DNA, 1875 bp, Artificial Sequence
  Description of Artificial Sequence: Synthetic coding sequence
atgtcggataaccagtcttggaatagcagcgggtctgaggaggaccctgagacagaatctgggccaccagtggaacgctgcggagttctgtcaaagtggacaaattatatccacgggtggcaagaccggtgggtcgtgcttaagaacaatgccctgtcatactacaaatctgaggacgagactgagtacggctgcagaggatccatctgcctgagcaaggccgtcatcacacctcacgactttgacgaatgtcggttcgacattagcgtgaacgactcggtatggtacttacgggcacaggatcctgatcacaggcagcagtggatcgatgcaatagagcagcacaagactgagagcggctatggcagcgaatcatccctgagacgccacgggagtatggtgtccctggtgagtggcgcctccggatattcagcgaccagcacttcatccttcaaaaaagggcactctctaagagagaaactggcagagatggagacgtttagagatatcctttgtcggcaagtagacaccttacaaaagtattttgatgcatgcgcggacgctgtcagcaaagatgagctgcagagggataaggtggtggaagatgatgaggacgacttcccgaccacgcgcagtgatggggacttcttgcattcaactaacggaaataaagagaaattattccctcatgtgactcctaagggaatcaacggaattgacttcaagggagaagcaatcacttttaaagctaccacggctggaatcttagccacacttagtcactgtattgagcttatggtgaagcgggaggacagctggcagaagaggctcgataaagagacggagaagaagcgtcgcacggaggaagcgtataagaatgctatgaccgagttgaagaaaaaatcacattttggaggtccagattatgaggaaggtcccaactcacttattaatgaggaggaattcttcgatgcagtcgaagcagcactggatcggcaggacaaaatcgaagagcagagtcagtctgagaaggtacgtctccactggccaacctccctcccctcaggcgacgccttctcgtccgtgggcacccaccgtttcgtgcaaaagccatactctagatcgagtagtatgagttctatcgatctcgtgagtgcttctgacgatgttcacagattcagtagtcaggtcgaggagatggtccagaaccacatgacttattccctgcaggatgtgggcggagatgctaattggcaactggtggtagaagagggcgaaatgaaagtctaccgcagggaagtagaagaaaacgggattgtgcttgaccctctgaaggccacacacgcagtgaaaggcgtcacaggccatgaggtctgtaattatttttggaacgtagatgtcagaaacgattgggagactaccattgagaattttcacgtggtcgagacgctagcggataatgctatcataatctatcaaacccacaaaagagtgtggccagccagtcagagggacgtcctatacctgtccgtcattcgcaagattcccgctcttactgagaacgacccagaaacttggatcgtttgcaacttttcagtggaccacgactcagccccacttaacaaccgctgtgttcgagctaagatcaatgtggccatgatatgtcagactctggtgtctcctcctgaaggcaatcaggagatcagcagagacaacatcttgtgtaagatcacctacgtagccaatgttaatcctggaggttgggcgccagccagcgttctgagggcagtcgctaagagagaataccccaagttcctcaaaaggtttacttcctacgtgcaggaaaaaaccgcagggaagccaattcttttttag

SEQ ID NO: 2495 - DNA, 381 bp, Artificial Sequence
  Description of Artificial Sequence: Synthetic coding sequence
tagccagcatctcaaagggatgtgttatatttaagtgttatacggaagatccccgcgctgaccgagaatgatccagagacatggatcgtgtgcaattttagcgtcgaccacgactccgctcctctgaataatcgctgcgtgagagcaaagatcaacgtggcaatgatctgtcagacgctggtgtcgccccctgaggggaaccaggagatttccagggacaacattttgtgtaagattacttacgtagcaaatgttaatcccgggggctgggccccggcctctgtactccgggcggtcgccaagcgggaatatccaaaatttttgaagaggtttacctcatacgttcaggaaaaaacagcgggcaaacctatcttgttctag

SEQ ID NO: 2496 - DNA, 5064 bp, Artificial Sequence
  Description of Artificial Sequence: Synthetic coding sequence
atgtggagcctgcacattgtactgatgaggtgttcattccgcctcacgaaaagcctcgctacggggccgtggtctctcatactgatactgttcagtgtccaatatgtttatggttcagggaagaagtacattgggccatgcggcggaagagattgctccgtgtgccattgcgtgcccgagaaaggatctcgaggtccgccaggtccaccaggacctcagggtccaattggtcccctaggcgcccctggtcccattggcctctcaggcgagaaagggatgcgtggagaccggggcccaccaggggcagctggagataaaggtgacaaagggccaacaggcgtacctggttttccagggctggatggaatccccgggcacccaggccctccaggccccagaggcaagcctgggatgtccggacataacggatcccgcggagatccgggctttccaggaggccggggcgccctgggaccgggcggcccactgggtcaccccggcgaaaaaggtgaaaagggcaactccgtcttcattctcggcgctgtaaaggggatacagggagacagaggagacccaggcctacccggacttccaggctcatggggcgctggaggccccgccggaccaaccgggtaccccggtgagcccggcctcgtcggtccacccgggcagcctggccgccccggcctgaaaggtaacccgggggtgggtgtgaagggacagatgggcgatcctggggaggtgggccagcaagggtcacccggcccaacccttctcgtagaaccccccgatttttgcctgtacaagggcgaaaaagggattaaagggatccccgggatggtcggacttcctggccctcctggccggaaaggggagtctggcatcggcgccaaaggggagaagggaattccaggttttcccggcccgcgtggagaccctggctcctatggttctcctggttttcctggactcaaaggtgagcttggcctagtcggcgacccagggctgtttggactgattggtccaaagggggacccaggcaaccgtggtcatcctggacctccgggggtgctggtgacccctcctctgcccctgaaggggccaccaggggaccccggttttcctggtcgatacggagagaccggggacgtgggtcccccaggaccaccgggcctcttaggccgacccggtgaagcttgtgccggaatgattggaccgccagggccgcagggtttcccaggactgccagggttgcccggggaggccggtatccccggaagaccggactcagcccccggaaaacctggtaagccgggatcacctggactccccggagcaccaggcttacagggcctgcccggtagctccgtgatctactgttccgtcggcaatcccggcccacagggcatcaagggaaaagtggggcctcccgggggccgcggtcctaagggcgagaagggaaacgagggcctatgtgcatgcgaaccgggcccgatgggcccacccgggccacctggacttcctgggcgacaggggtccaaaggcgatctgggactcccagggtggctaggtacgaagggggaccccggcccaccgggagctgagggtccaccaggattgcccggcaaacacggagcatcagggccacccggcaacaagggcgccaaaggcgacatggttgtgtcaagagtaaaaggacataaaggcgagcgcgggcctgatggtcccccaggattcccaggacaacccgggtcccacggccgcgacggacacgcgggcgagaagggggatcccgggccacctggcgatcatgaagatgcaacccccggaggcaaagggttccccggccctctcgggccgcctggaaaagccggccccgtaggtccgccaggcctagggtttcctggccctcctggagagagggggcaccccggggtccccggtcaccctggggtgagaggacccgacggattaaaagggcagaagggggacaccatctcctgcaatgttacctatcccggtaggcacggaccccctgggttcgatggacctcctggccccaagggctttcccggaccccagggagccccagggctcagtggatcagacggccacaagggaaggcctggaactccgggaacagctgagatcccaggaccccccggattccgaggcgacatgggggaccccggttttggaggcgagaaaggcagctcccctgttgggccgcccggaccaccaggatcgcccggcgtgaacggccagaagggcatccctggagatcctgcttttggccatctgggtccaccagggaagagaggtttgagcggtgttccgggcataaaggggccacgaggagaccccggctgcccaggggcggaaggacccgccggaatcccgggttttctgggcctaaaaggccctaagggtagagaaggacacgcaggatttccaggcgtgcctggcccccctggccacagctgtgagcgcggggcacccggaattcccggacagcccggcctgcccgggtaccctggctctccaggtgcgcctggcggaaaagggcagcctggcgacgtgggtccccctggtccagcgggaatgaaaggtcttcccggactgccgggaagacccggcgcgcacggcccaccggggctcccgggaatcccaggcccattcggagatgatgggttaccaggtcctccagggccgaaggggccgagaggcctgccgggcttcccgggtttccctggagagaggggaaaaccaggagctgagggctgcccaggcgcaaaaggggaaccaggagaaaaggggatgtccggattaccaggcgacaggggactgcgaggcgctaaaggtgcaattgggccacccggggacgagggcgaaatggccataatcagccagaaaggtactccgggggagcctggcccaccaggtgacgacggctttcccggggagcgtggcgacaaaggcacgcctggcatgcagggacggcgcggcgagcctggccgctacgggcccccgggattccacaggggagagcccggagaaaaaggacagccagggccacctggccctccaggtcctcctggcagcaccggactacgcggcttcattgggtttcccggtctgccaggagatcagggggagccaggcagtccgggcccgcctggtttctctggtatcgatggggctcgcggccctaagggcaataagggcgatccagcatcccacttcggacctcctgggccaaagggagagcctggcagccctgggtgcccgggacactttggagcctcaggggagcaggggctacccggtatccagggaccccgtgggagtccgggaaggcctggccctccagggtcctctggccccccagggtgccccggcgatcacggaatgccagggctgcgcggccagcccggtgagatgggggaccccggacctagagggttgcagggagatcccggtatccctggcccacctggaattaaaggcccttccggaagtcccgggctcaatggcctgcacggcctaaaaggacagaaaggcaccaagggcgcctcaggcctccacgacgtgggtccacctggacctgtggggattcccgggctcaaaggagagcgaggcgaccctggctcaccaggcatcagcccccctgggccccgcggtaagaaaggaccacctggcccccctgggagttcaggacccccaggacctgccggggcaacaggccgagccccgaaggatattccagacccagggcccccgggcgaccagggtcctccagggcccgatggccctagaggcgcaccgggcccacccgggctgcctggctcggtggaccttctgcggggcgaacccggtgattgcggcctgcctggacccccaggccccccaggtccgcccggacctccaggctataagggcttcccgggctgcgatggcaaagacgggcagaaggggccggtggggtttcctgggccacagggaccacacggatttcccggcccgcccggcgagaagggcctgccagggcccccaggacggaagggccccactgggctgccgggagaacccggcccaccggctgatgtggacgattgtccgcgtatccctgggttgcccggagctccaggcatgagagggcctgagggagcaatgggcctacctggaatgcgtggaccctctgggcccggttgtaagggggaacctggtctcgacgggcgcaggggcgttgatggagttcccggcagccccggccctccaggcaggaaaggcgacactggggaggatggatatccgggggggcctggcccaccaggacctatcggcgatcccggacctaagggcttcggtcctggttacctcggcggattcctgctggtcctgcatagtcagaccgaccaagagcccacatgcccattgggaatgcctcggctgtggacgggttattcccttctgtatctggaaggacaggagaaagcccacaaccaggatttaggcctggcaggcagttgcctccccgtcttttccactttgccatttgcctactgtaatattcatcaggtgtgccactacgcacagcgcaatgatcggagttattggctggcctcggcagcccccctgcctatgatgccactgtcagaagaggcaataagaccttacgtatctaggtgcgctgtgtgcgaagctcctgcccaggcagttgccgtgcattctcaggatcagtcaataccgccctgtccacaaacatggcggtctctgtggatcggatattcctttctgatgcacactggcgccggggaccaaggcggaggccaggctttgatgagcccgggatcatgcctagaggactttcgagctgccccgttcctcgagtgtcaggggcggcaaggaacctgtcactttttcgcgaataaatattcattctggctcaccacggtgaaggcggacctgcagttctcctcagctccagcccccgacacgctcaaggagagtcaagctcagcggcagaaaatatcccgatgtcaggtgtgtgttaagtacagctag

SEQ ID NO: 2497 - DNA, 5073 bp, Artificial Sequence
  Description of Artificial Sequence: Synthetic coding sequence
atgtggtctctccacatagtgttgatgaggtgctccttcaggctgactaaaagcttggctactggaccttggagcttaatcctaatcttgttctcagtgcaatacgtatatggctcaggcaaaaagtacataggaccatgtggtgggcgtgattgttcagtgtgtcactgcgtgcctgagaaaggtagccgcggcccaccgggcccacccgggccccaagggcctatcggcccacttggggcgccaggcccaatcggtctgagcggcgagaaggggatgaggggagacagaggccctccaggcgctgccggcgacaaaggagacaaaggcccaaccggagtgcctggctttccaggacttgacggcattccagggcacccaggtcccccagggccccgtggcaagccgggcatgagcggccataacggcagcagaggcgatcctggattccccggcgggagaggagcactgggaccaggagggcccttaggacatcccggtgaaaagggagagaaaggcaacagtgtgtttatactgggcgcagtgaaaggcatccagggggaccgaggagatccgggcttgccagggcttcctggctcttggggtgctggcggcccggcaggacccactggatatccgggagagcctgggctagtcggacctcctggccagccaggaaggccggggttaaaaggaaaccctggcgtgggcgtgaagggacaaatgggagatcccggtgaagtgggccagcagggctctcctggcccgactctgctcgtggaaccaccagacttctgtctttacaagggcgagaagggcatcaagggaattcccgggatggtgggacttcccgggcctcctggacgaaagggagagagcgggataggagcgaaaggagagaagggaatacctggatttcccggcccccgcggcgaccctgggtcatatgggtctcctggctttcctggcctgaagggggagctagggctggtgggagatcctgggttgttcggtctgattgggccaaaaggggatcctggaaaccgcggccatccaggtcctcctggtgtactcgtcaccccacctctccccctaaaggggccccccggggatcccggttttcctggcaggtacggagaaaccggtgacgtggggccgccaggccctcctgggttgttgggacggcccggcgaagcatgtgcaggaatgattggcccacccggtcctcagggcttcccaggtctgcctggactccccggagaggccggtattcccggtcgccccgactccgcacccggtaaaccggggaagcctggttctcccggactgccaggtgcccctggacttcaggggttgcccgggtcctcggtgatctactgcagtgtgggcaaccctggaccccagggtataaagggaaaggttgggccccccggaggacgcgggccaaagggggaaaagggtaatgaaggcctatgtgcctgcgaacctggccctatgggtcccccgggtcctcctggtctacctggccggcaggggagcaaaggtgatctgggtctgccgggatggctggggacaaagggcgatccaggccctcccggtgcagaaggcccccccggattgcccgggaagcatggcgcttcaggccccccaggtaacaaaggagctaagggagatatggtcgtctctagagtgaagggccacaaaggcgagcgcggccccgacggtcccccagggtttcccggccagcccgggagccacggacgggatggacacgcaggcgagaaaggtgatccaggaccacctggggaccatgaggatgctacacccgggggcaagggcttccctggacccctaggcccaccgggcaaagccggacctgtcggacctcctggactcggctttcccggtcctcccggcgaaagaggtcatcccggcgtccccgggcaccctggtgtacggggccctgatggattgaaaggccaaaagggagataccatctcatgcaacgtgacatacccagggaggcacgggccccctgggttcgacggcccaccagggccaaaaggctttcctggacctcagggtgctcccgggctgtctggttcggatggacataagggcaggcccggtacgcccggtactgctgaaattcctgggccaccaggctttagaggcgatatgggcgatcccggattcggtggagagaagggctccagtcccgtgggaccacctgggcccccaggcagccctggcgtaaacggccagaagggcatacctggcgacccagccttcggccacctgggcccgcctggaaagaggggactgagtggggttcctgggatcaaaggccccaggggagacccagggtgccctggtgcagaagggcctgccggaattccgggcttcctcgggctaaaagggcccaaaggtcgtgaaggccatgcaggattcccgggagtgcctggaccgcccgggcactcctgtgaaaggggagctccaggcatacctggccagcctggtctgccagggtaccctggaagtcccggagcgcccggaggtaaggggcaacctggcgacgtgggcccgcccggacctgccggcatgaagggccttccaggactgcccggcaggccaggcgctcatggtccccctggactccctggcatcccgggaccctttggcgatgatggtctccctgggccacctggtccgaagggcccacggggcctcccaggattccccgggtttcccggcgaacgcggtaagcccggagcagaaggctgtcctggcgcgaagggggagccaggggagaagggcatgtcgggcctcccaggtgaccgcggtctgcgcggagcaaagggagctatagggccaccgggagatgagggagaaatggccatcatctcccagaaaggaacacccggcgaacctggtccgcccggggatgatgggtttcctggagagagaggagacaagggcactccgggcatgcaggggcggaggggcgaacctggacgttacggtcccccaggcttccacagaggagaaccaggtgagaaggggcagccgggaccacctggcccgccaggtccaccggggagcactggactgagagggtttatcgggttcccaggtctgcccggagaccaaggagaaccagggtccccagggccccctggattcagtgggatcgatggggccagaggacctaaaggaaacaagggggacccagcgagtcactttggccctcctgggccaaaaggagagcctgggagtcctgggtgcccaggccattttggagcgagcggtgagcaaggccttccagggatacagggcccgcgggggagccccgggcgacctggccctcctggctcttctggaccgcccggctgcccaggtgaccacggcatgcccgggctgagaggccaacctggagagatgggggaccctggcccccgcgggctacagggggatccagggatccccgggccaccagggatcaaggggccgtctggctcaccggggctgaacggcctccacggcctcaaagggcagaaggggacaaagggtgcgtctgggctccacgacgtggggcctccgggacctgtggggatcccagggctaaagggtgagcgcggggatcctggtagccccggcatctctcctccaggtccgcgcgggaagaaagggccaccaggaccccccggctcttcaggccccccaggccccgccggtgcaacaggacgcgctccaaaggatattcctgaccccgggccgcccggcgaccagggcccacccggaccggatggccccaggggagctccaggcccccccggccttcctggttccgtggacttgctgcgtggcgagcctggagactgcggattgcctggaccgccaggcccacccgggccccccgggccccccggttacaaagggtttccggggtgcgacggaaaagacggtcaaaaaggaccagtgggtttcccagggccacaagggccacacgggtttcccggcccacccggcgaaaagggcctgccggggccccccggaaggaaagggccaaccggtcttccaggcccacgcggggagccaggtcccccagctgacgtggatgattgcccccgaatcccaggtctacccggcgcccctggcatgagggggcctgaaggagcaatggggcttcctggcatgagaggcccaagcggtcctggctgcaagggcgaaccggggttggatgggcgcaggggagttgatggagtccccgggagtcctggacctccgggaagaaaaggtgacactggcgaagatggctacccaggagggcccggcccacctggtcccatcggagatcccggccctaaggggtttggacccggttacctcggcgggtttctgctggtgctccattctcagacagatcaagaacctacctgtccacttgggatgccacggctatggaccggctactcattgctgtatctggaaggtcaggagaaagcacataaccaagacctaggtctggccggcagctgtctgcccgtgttcagcacactgccgtttgcctactgcaatattcaccaggtctgccactatgctcagcggaacgatcgttcttattggctggcctcagccgcacccctgccaatgatgcccctctctgaggaggcgatcaggccatatgtgtcgagatgcgctgtgtgcgaagcacccgcccaggccgtggccgtacatagtcaggaccagtcgattcccccttgtccccagacttggaggagcctgtggattggttactccttcttgatgcacactggggcgggggaccagggaggaggccaagcactgatgtcccctggaagttgcctggaagattttcgggctgctccattcctggagtgtcaggggagacagggtacctgccatttttttgccaataaatactccttctggctcaccactgtaaaagcagatctgcaattcagttctgcccctgcccctgataccctgaaggagtcccaagctcaacgtcagaagatcagtagatgtcaggtctgcgtgaagtactcttag

SEQ ID NO: 2498 - DNA, 5076 bp, Artificial Sequence
  Description of Artificial Sequence: Synthetic coding sequence
atgaagttgagaggagtgagcctggctgccgggttgtttctcctggccttatccttgtgggggcagcccgctgaagctgcagcgtgctacggatgctccccgggatctaagtgcgattgctccggaatcaaaggagagaagggagagagaggattccctggactcgaaggtcaccctggactgcccgggttccccgggcccgaagggccgcctggcccccggggccagaaaggcgacgacgggatccctggaccacccggacctaaaggcatccgggggccgccaggccttccaggcttccccggtacgccaggcctcccaggaatgccgggccacgatggcgcacctgggccgcaaggtatcccgggttgcaacggcactaagggagagcgcgggtttccaggctctccgggcttccccggcctccagggaccaccaggcccccccggaatccccggcatgaaaggcgaaccaggaagtataataatgtcaagcctgccaggacctaagggtaacccaggatatccagggcctcccggtatacagggactgcctggacccactggcatccctggcccaatcgggcctcctggcccaccaggcctgatgggaccccccggcccacctggcctgcccggcccaaaagggaacatgggcctcaattttcagggtcccaaaggcgagaagggggagcagggccttcaggggccccctggaccccctggtcaaataagcgagcagaagagaccaatcgatgttgagttccagaaaggcgaccagggattaccgggggatcgggggcctcccgggccccctgggatccgagggcctccggggcccccgggtggtgagaagggggaaaagggggagcagggtgagcccggcaagagagggaagcctggtaaagacggggaaaacgggcagcccggcattccggggctgcccggcgatcctgggtaccccggcgaaccaggacgggacggggaaaagggccagaagggagataccggcccacccggcccacccggccttgtgatcccaagacccgggactggcatcactatcggggagaaaggaaatatcggtctgcccggtctgcctggagaaaagggtgaaagggggttcccgggtattcaggggccccctgggctgcccggccctcctggcgctgccgttatggggccaccaggaccccccgggttcccgggggagcggggccagaaaggcgacgagggccccccagggataagcatccctggtccacctgggctggacggacaacctggcgcgccagggctgcccggccctccaggccccgccgggccccacattccccctagtgatgaaatctgcgagcctggacctcccggccccccgggatcaccaggcgataagggactgcaaggcgagcagggcgttaagggagacaagggggacacctgctttaattgcatcggcaccggcatatccgggccaccgggccagcctggactgcctggcttgcctggcccccctggatcgctggggttccccggtcaaaaaggcgagaagggacaggccggcgcaaccggccctaaaggcctcccgggcatccccggtgcaccgggcgcgccaggctttcccggctctaaaggtgaacccggcgatattctgacctttccgggcatgaagggcgacaaaggtgaactggggtcccctggtgcacctggtctcccaggactgccggggacccctggtcaggacgggctccccgggctgcccggccccaagggagaacccggggggatcactttcaaaggcgaaagagggccccctggaaaccccggcttgcctggacttcccggcaacatcgggcccatgggtccccccgggtttgggcccccagggccagtgggcgagaagggaatccaaggggtggccggcaaccctgggcagcccggtattcccgggccaaagggagaccctgggcaaacgatcacgcagccaggcaagcccggccttccaggaaatccgggacgggatggagatgtggggcttcccggggatcccgggctgccgggtcaaccgggcctgccaggaatccccggctcaaaaggtgagcccgggatcccaggcatcggattaccaggtcctccgggacccaaaggctttccagggatccccggccctcctggggcacctggcacccccggtcggattggccttgaaggcccgccaggaccccccgggtttcctggaccaaaaggtgaacccggctttgcgctccccggcccccctggccccccaggcctgccaggctttaagggtgctctgggccccaagggtgaccggggtttccccggccctccaggaccacccggacgcacgggccttgacggactgcccggtccaaagggggatgttggtcccaatggacagccagggcctatggggccgccgggacttcctggcatcggagtccagggtcccccaggccctccaggcattcccggtccaataggtcaacctggtctgcacggaatccccggagaaaagggcgatcctggaccgccaggcctggatgtgcctggcccgccaggagaacgcggctctcccgggattcccggagcgcccggcccaatcggcccacccggatcacctgggctccctgggaaggccggagcaagtggcttcccaggtaccaagggtgaaatggggatgatgggacctccggggcctccaggcccattgggaatcccaggtagatctggagtaccgggactgaaaggcgatgatgggcttcaggggcaacctgggctgcctggacctactggtgagaagggctccaaaggagaacctggattgccaggaccccctgggcccatggatcctaatttgctcggttcgaaaggtgagaaaggggaaccaggactgccagggatccccggggtcagcggaccgaaaggctaccaaggtcttccgggcgaccctgggcaacccggactgtcggggcaacccggactgcccgggccgccaggacctaaaggcaatcctggactgccgggccagccaggactcattggcccgcccggacttaagggaaccatcggggacatggggtttccaggcccccaaggggtggaagggccgccaggaccctctggagtgcctggacaacccgggtctccaggcctgcctggtcagaagggggacaaaggtgatcccgggattagctccattggactccctggattgccggggccaaaaggcgagcccgggctgcccggctaccccggcaatcccgggatcaaggggtctgtgggagaccccggcttgccaggtctgccagggactcctggggcaaaaggccagccgggtctgcctggattcccagggacacccgggcctccgggcccgaaagggatttctgggccaccgggaaaccctgggctccccggcgagcctgggcctgtcggaggtgggggtcacccaggacagcccgggccacccggagaaaagggaaagcctggtcaggatggcattccaggtcctgctggccaaaaaggtgaaccaggtcagcctggattcggaaatccagggcctccgggcctacccggcctgagcggacaaaagggtgatgggggattgcccggcattccgggtaatcctggccttcccggacccaaaggcgaacccggtttccacgggtttcccggcgtgcagggaccgcctggacctccagggagccctggacccgccctcgaaggaccaaaaggcaatccgggcccccaggggcccccggggcgccctgggccaaccggcttccagggactccctgggcctgagggcccaccagggttacctggcaacggtggtatcaaaggagaaaagggtaaccccggccagccaggcctccctggattaccgggattgaaaggagatcagggcccacccgggctccaagggaatcccgggcgacccggactcaatggcatgaagggggatcctggcttgccgggagttcccggcttccccggcatgaagggaccgagtggggtgcccggatccgctggacccgagggagaaccaggtctgattgggcctcctgggccacctggtctgccaggacctagcggacagtctatcatcatcaaaggggacgccggcccaccaggcattcccgggcaaccagggctgaagggcctacccggccctcagggcccccagggattacccggtcctacagggccgcccggcgatccgggtagaaacgggctgcccggctttgacggcgcgggagggcgcaagggggatccagggctgcctgggcagcccggcactagaggcctcgacggaccacctgggcccgacggattgcagggtccacccggacctccaggcacatcaagtgttgcacacggttttctgatcacccgtcatagccagacgacagatgccccacaatgcccccaggggacactgcaggtgtacgaagggttctctctcctatacgtccaggggaacaagcgagcacacggccaggatctcggaacagcgggatcctgcctgcgaaggttcagcactatgcctttcatgttctgcaacataaacaacgtgtgcaattttgccagtcgcaatgactactcgtattggttaagtactcccgagccaatgcctatgtcaatgcaacccctgaagggacagtccattcagccgttcatctctcggtgtgcagtctgcgaagcgcccgccgtcgtgattgcagttcattcacagacgatacagatcccccactgtccccagggctgggactcactgtggataggctattcgttcatgatgcacacgtccgctggggcggaaggctcaggccaggccttagcctctcccggatcctgcctggaggagttcaggagcgcgccattcatcgaatgccacggtagaggtacatgcaactactatgccaattcctactccttctggctggcaacagtggatgttagcgacatgttttccaagccacagtccgaaactttgaaggccggggatctccgtacaaggattagccgctgccaggtgtgcatgaaaaggacctag

SEQ ID NO: 2499 - DNA, 5058 bp, Artificial Sequence
  Description of Artificial Sequence: Synthetic coding sequence
atgaagctacgcggcgtgtccttggcagcaggactgttcctgctggccttgagcctctggggacagcctgccgaagctgcggcctgctacggctgcagccccggctctaaatgtgattgtagcggcatcaagggagaaaagggggagcgcggttttcccgggctggagggtcacccaggcctcccggggtttcccgggcctgagggtcctccaggcccaaggggacagaagggggacgatggtatacccgggccacctggacccaagggaattcggggtccaccgggactgcctggctttccaggcacgccagggcttcctggcatgcctggccacgacggagcccctgggcctcagggcatccctgggtgcaatggaactaagggtgaacgcggattcccaggatcccctggcttccccggcctgcagggtcctccagggccacctgggatccccggaatgaaaggcgaaccaggctctatcatcatgagtagtttaccgggcccgaaggggaatcccggctatccggggcctcccgggattcaaggcctgcctgggcctaccgggatccctggaccaatcggcccacctggcccacccgggcttatgggtcctcctggccctccaggtctgcctggccctaaagggaacatgggtctgaattttcaagggcccaaaggggaaaagggagagcagggtctgcagggaccaccagggcctcctggccaaatctcagagcagaaaaggcctattgacgttgagtttcagaaaggtgatcagggcctaccgggtgaccgcggcccccctggccctcccggcatccgcgggccacccggtcccccgggaggcgagaagggcgaaaagggggaacagggagaacctggtaaaaggggaaaaccaggcaaagatggcgaaaatggtcaaccagggattccaggactccccggagatccaggatatcctggagagccaggcagagacggtgaaaagggtcaaaagggagatacagggccgccaggcccacctggtctggtgatacctcggccaggtactggcattaccattggtgaaaagggcaatattgggctacccgggctgcctggtgaaaagggggagcgcggcttcccaggcatccagggccctcctggcctaccgggaccaccgggcgcagccgttatggggcctccaggacccccaggatttccaggcgaacgcgggcaaaagggcgacgaggggcctccagggatatcgatacccgggccccccggattggatgggcagcccggcgcccctggactgccaggacccccaggtccagcaggcccacacattcctccctctgacgagatttgtgagccaggtcctcccggacctcccggcagcccaggggacaaaggtctgcagggagagcagggggtgaagggagacaagggggacacgtgctttaactgtattggcacgggcatctctggccctcctggccagcccggcctgcccgggctacctgggcctcctggctcacttggttttccgggccaaaagggcgaaaaaggacaagctggcgcaacaggacctaaggggctcccgggaatccctggagctccaggtgcacctggttttcccgggagtaaaggggagccgggagacattctcacttttccaggcatgaaaggagataaaggggaactgggatcacctggtgctcctgggctaccaggtctgccgggaactcccggtcaggatggactaccaggtctgcctggacccaagggggaaccaggagggatcacgttcaaaggcgagaggggccctcctggaaatccagggcttccgggtctcccaggtaatattgggcctatggggccccctggattcgggcctccgggcccagtgggagagaaaggcattcaaggcgtggccggaaatccaggacagccagggattcctgggcctaaaggggatcccggccagactatcacgcaacccggaaaacctgggctgcctggcaatccagggcgcgacggcgatgtggggcttcctggggaccccgggctccccggacagccaggacttcctggtatccctggatcaaagggtgaaccaggcattccagggattggccttcccggtccacctggtcccaagggtttccccggaatacctggaccgcctggcgccccaggtaccccaggacgaataggattggagggaccgcccggaccgcctggtttcccggggcccaaaggagagccagggttcgccctacccggaccgccaggccctccgggtctccccggttttaaaggagcgttgggaccaaaaggtgacagaggatttcccgggcctccaggccctccgggccggacagggctcgacggactccctgggcctaagggggacgtcgggcccaacggccagcccgggcccatgggtccacctggtctgcctggaatcggagttcaggggccccctggtcctccaggcataccaggtcccattgggcagcctggattgcacggcatacccggagagaagggtgatccgggtccccccggattagacgtcccaggacctccaggagagcgtggctctcccgggatcccaggagctccaggccctattgggccaccgggctctccgggactgccagggaaagccggtgcatctggcttcccgggcaccaaaggcgaaatgggaatgatggggcccccgggacctcccggccccctcggtattcctggccgaagcggggtgcctggccttaaaggagatgatggcttgcagggtcagcctggactgccaggacctaccggcgaaaagggctctaagggcgaacccgggcttccggggccgcctggtccaatggatcctaacctcctgggctcgaaaggagagaaaggggagcccggcctgccaggcattcccggggtgagcgggcctaaggggtatcagggcttgcctggcgacccaggtcagccaggactgagcggtcagccaggactgcccggaccaccaggcccgaaggggaaccctggcctgcctgggcaacctggtttgatcggaccccctggactgaaaggtacaatcggtgatatgggttttcctggacctcagggagtggaggggcctcctggaccgagtggggtgcccggacagcccgggtcgcctggcttgcctggtcaaaaaggagacaagggcgatccgggaatctcctcaattgggctccccggactgccggggcctaagggcgaacccgggctgcccggttatcctgggaaccccggcatcaagggaagtgtaggcgatcctgggctgccaggacttcccggcactcccggcgctaagggccagcctggtctgccaggattccccgggactcctgggcctcccggtcctaagggaatctccggccccccaggtaaccccggattaccaggcgagccgggcccagtgggaggaggtggccatccagggcagccgggcccccccggtgaaaagggcaagcctggtcaggatgggatccccggacctgcaggccagaaaggggaacccggacaaccaggcttcgggaatcctgggccacctggtctgccaggactgtctggccagaagggggatgggggcctccccggtatcccagggaatcccggcctgccaggccctaagggtgaaccaggattccatggctttcctggagtgcaaggcccgcctggaccacccggtagcccaggacccgcactggaggggcccaaaggaaatcccggaccacaaggacccccaggtcgccccgggctgcccggccctgaggggccacctggcctccccggcaatggaggtattaaaggggagaagggcaacccagggcagcctggcctgcctggtctgcctggactcaaaggcgatcaaggcccccccgggcttcagggcaatccaggcaggcctggcctgaacgggatgaaaggggaccccggtctcccaggggttccggggtttccagggatgaagggaccgtcaggagtgcctggatccgccggccctgagggagagcccggactgatcggaccccctggtcctcctggcttaccaggtccttctggccagagtatcattataaagggcgacgctggcccccctggcatccctgggcagcccggcctgaaggggttaccgggcccacaggggcctcaggggctgcctgggccaactggacctcctggagaccctggaaggaatgggctacccggatttgacggtgctggcggaagaaaaggagatcctgggctccccggccaaccgggcacgagaggactggatgggcctcctgggcccgacggattacagggtccccctggccctcccggcacctccagcgtggctcatggcttcctcatcacacgccactctcagacaactgacgcccctcagtgtccacagggtacattacaggtctacgagggtttttcgttattgtatgtgcagggcaacaaacgagcacacggtcaggatctgggaaccgctggcagctgcctgcgccggttcagtacaatgccttttatgttctgtaatatcaataacgtgtgcaactttgcctcaaggaacgactatagttattggctgtcaacgccagaaccaatgcccatgtccatgcaaccactcaaagggcagtccattcaaccgttcattagtaggtgcgctgtatgcgaggcccccgcagtcgttatagccgtgcattcgcagaccattcagattccacattgcccacaaggctgggattctctgtggattggctactcctttatgatgcatacctccgccggggccgagggctccggacaagccctggcatccccaggtagctgcctggaggaatttcgctcggccccctttattgagtgtcacggccgcgggacctgcaattattacgctaatagctactctttctggctggccaccgtcgacgtgagcgatatgttctcaaagccacaaagtgagactctcaaggcgggagatctgaggactcgaatctccagatgccaagtttgcatgaagcgcacatag

SEQ ID NO: 2500 - DNA, 5076 bp, Artificial Sequence
  Description of Artificial Sequence: Synthetic coding sequence
atgaagttgcgtggtgttagcctggccgcaggcctgtttctgctggccttgagcctgtggggccagccggccgaggccgctgcctgttatggttgctcaccaggaagtaaatgcgactgtagcgggattaaaggggaaaagggtgaacgtggcttcccaggtttggagggacaccctggattgcctggctttcccgggcctgagggtcctccagggccacgtgggcagaaaggagatgatggaattcccggtccccctggccccaaaggcataagggggcctcctggcttgccaggattcccaggcacccccggactgcccggaatgcccggtcacgatggcgctcccggaccacagggtattcccggctgtaatggaacgaagggtgaaagagggttcccggggtcccccggatttcccggtctgcagggtcctcctggcccgcccggcattcccggcatgaagggagaaccagggagcattatcatgtcatccctccctggccctaaaggtaacccaggttatccaggcccgcccggtattcagggcctcccaggccccacagggatccctgggcccattggtcctcctgggcctcccggactgatggggcctcccggccccccagggctgccagggcccaaaggtaatatgggactgaatttccaaggccccaagggggaaaagggggagcaaggtctgcaggggcccccaggaccaccaggccaaatcagcgagcaaaagcgccccattgacgtagagttccagaaaggcgatcagggtctgcccggggatcgcgggccaccaggtccacctgggattcggggcccaccagggccccccgggggggagaagggcgaaaagggtgagcagggcgagcccggtaagaggggtaagccaggcaaagatggagaaaacggtcagcccgggatccctgggctgcccggcgaccctggctacccaggggagcctggccgcgacggtgagaaaggacaaaaaggggacaccgggcctcccggtcctcctgggctggtgatacctcggcccggcacgggtatcaccattggcgaaaaaggtaatataggtctgccaggtctgcctggcgagaaaggcgagcgtggatttcctggcatccagggacctccaggactcccaggccctccgggtgctgcagtgatggggccccccggcccaccaggcttccctggagaacgcggtcagaaaggggatgaaggtccacccggaatatcgattccgggccccccgggactggatggacagccaggcgcaccaggcctacccggcccgcccggcccagccgggccccacattccccccagcgacgagatttgcgagcctgggccaccaggccccccgggtagtccaggcgataaagggctgcagggagaacagggggtgaaaggggataagggtgatacctgcttcaactgcattggcacaggcatttccgggcctccaggtcagccggggctgcccgggcttccaggcccccccggttccctgggatttccagggcagaaaggcgagaagggacaggcaggggctactggcccaaagggcctgcctggcatccccggtgcccccggtgcacccggatttcctggttccaaaggagaaccgggtgatatacttacctttccaggaatgaagggtgacaaaggggaacttggctcacctggcgccccaggtcttcccggcctgcctggtacacccggacaagacggcctgcctggcttgccaggaccaaagggggagcccggcggcatcaccttcaagggcgaacggggtccacccggcaaccccggtctgccagggctgcctggcaacataggtccaatgggtcccccaggattcggcccccctgggccggtgggtgaaaaagggatacagggtgtcgccggaaaccccggacaaccgggcatacctgggcccaagggtgacccaggccaaacaattacccagcctgggaaacctggtttgccaggaaatcccggaagggatggcgacgtggggctcccgggggatccaggactgccaggccagccaggattaccggggatccctgggtcaaaaggggaacctggtatacctgggattgggctacctggacctccaggtcccaaaggttttcccgggataccaggacctccaggggccccaggaacgccgggcaggatcggtctggaagggcctccggggccaccagggttcccggggcctaaaggagagccaggctttgctctccccggaccccctggcccccctggacttccaggtttcaagggcgcactcggccccaaaggagaccggggcttcccagggccacccggtcctcccggacggacgggcttagatggtcttcctggacctaaaggagacgtcggtccaaacggccagcccggacccatggggccaccaggcctcccaggcattggcgtgcagggccctcctggccccccagggattccggggcccattggccagccaggcctccatggcatccccggggagaagggagaccctggccccccgggtctcgatgttccggggcctccgggcgaacgaggctcacccggcatccctggggctcctggccctattggtcctccgggctcacccggcctgccaggcaaagcaggagcatccgggttccctggcactaaaggagaaatgggtatgatgggaccacctggacccccaggacccctgggcattcctgggaggtctggagtgcctgggctcaagggggatgacggtctgcagggacaacccggcctcccaggccctacgggcgagaaaggaagcaagggggagcccggcctgcctggccccccagggcccatggatcccaatcttctgggctcaaagggcgagaagggcgaaccagggctgccaggaattcctggggtgtctggaccaaaaggataccagggcctccctggcgatcctggccagccaggtctttccggccaacccggcttgcccggccctcccgggcctaagggaaaccccggactgccaggacagcctggactaatcggaccccctggcttgaaggggactatcggggatatgggcttccctggccctcagggggtggagggccctccaggaccatctggagtgcccgggcagcccggttctcctgggcttcctgggcagaagggggacaaaggagatcccggcattagttcaattggcttgccggggctgcccggcccaaaaggggaacctggcttacctgggtatcccgggaacccaggcatcaaaggatctgtgggtgaccctgggctcccaggtctccctgggacccccggggccaagggccagcctgggcttcccgggttcccagggacaccgggtcccccgggcccaaagggcatttccggtccacccggcaacccagggctgccaggtgagccgggtccagtgggtggaggcggccatcccggccagcccggcccaccaggtgagaaaggcaagcccggacaggatggaattcctggtccggcgggccagaaaggcgagccaggccaacccgggttcggtaatccaggtcctcccgggctgcccggtttgagcggtcagaagggcgacggcggactgcccgggatacccggtaatccgggccttccaggacccaaaggcgaacccgggtttcacggcttccccggggtccagggcccccccggtccacccgggagtcccgggcccgccttagagggtcccaaaggaaaccccggccctcagggtcccccgggtcgtcctggacctactggatttcagagtctcccaggcccggagggcccacctggcctaccaggcaacggtggcattaaaggcgagaaggggaacccgggccagccaggcctgcccggcctccccggcctgaagggtgatcagggcccacccggacttcaaggcaatcccggccgccctggcctcaacggtatgaagggagaccctgggcttcccggggtaccggggttccccggcatgaagggcccctcaggggtacctgggtcagccggacccgagggcgagccgggcttaatagggccgcccggcccacctgggctgcccggcccaagtggacaatctattatcattaaaggcgatgcgggaccacccgggataccaggacagccaggcctgaaaggcctgccgggacctcagggccctcagggcctgccaggtcctacagggcctccgggggaccctggtagaaacggccttcccggcttcgatggagccggtgggcgaaagggcgaccctggactcccgggccaacctggtacacggggcttggatggccctcccggccccgatggccttcagggccctccgggacctccgggcacctcctcggttgcccacggcttcctcatcaccagacattcccagactaccgatgccccccaatgccctcaggggacactgcaggtgtacgaagggttctcactcctgtacgtgcaggggaacaagcgggcccacggtcaagatttgggaaccgctgggtcctgcttgcgaaggttctccaccatgccattcatgttttgcaacataaataacgtctgcaactttgcctctagaaacgattatagctattggctgtccacacctgaaccaatgcccatgtctatgcagcctctgaagggtcaaagcatccagccctttatcagccgttgtgcagtatgtgaagcccccgccgttgttattgccgtgcactcacagacaatccagatccctcattgtccccagggctgggacagcctatggataggatatagcttcatgatgcacacgtccgccggggccgagggatcagggcaggctctcgcgagtccggggagctgcttggaagagttcagaagtgcaccctttatcgagtgtcacggacgaggcacgtgcaactattacgctaattcttattccttctggcttgccacagtggacgtgtcagacatgttctccaaacctcaaagcgaaactttaaaagcaggggatttaagaaccaggatctctaggtgtcaggtgtgcatgaagcgcacatag

SEQ ID NO: 2501 - DNA, 5073 bp, Artificial Sequence
  Description of Artificial Sequence: Synthetic coding sequence
atgcacccgggtctgtggcttctgctcgtaactctttgcctgacagaggaattagctgccgccggtgagaagtcgtatggcaagccctgtggcggacaggattgttccggctcctgccagtgctttcctgagaagggggctcggggtcgacctgggcccatagggatccaaggcccgacagggccccagggatttacaggtagcacaggattatccggactcaaaggggagagagggtttccaggtttgctgggcccttacggcccaaaaggtgataaaggcccaatgggtgttcctggctttctggggataaacggcatcccaggacatcctggtcagccgggcccacggggcccccctggcctggacggttgcaacggcacccagggcgccgtagggtttcctgggcccgatgggtatcccggactgctgggtcctcctggcctccctggccaaaaaggctctaaaggtgaccctgtgttagccccaggcagcttcaaaggaatgaagggcgacccaggattgcccggcctggacggcataacgggcccacagggcgcccctggcttccccggagctgttggccccgctggacctcccggcctacagggcccgccagggcccccaggacctcttggcccggacggaaacatgggactgggttttcagggagagaaaggcgttaaaggggatgtgggcctgcctggaccggctggacctcctcctagtaccggcgaactggagttcatgggattccctaaggggaagaaaggatcgaaaggtgagcctggacctaaaggtttccctggaattagtggacccccaggatttccaggcctgggcactacgggggaaaagggagaaaagggcgagaaaggcatccccgggctgcccggacctcgcggtccaatggggagcgaaggcgtgcaaggtcctcctggccagcagggcaaaaagggaacactgggcttccctggcctgaatgggtttcagggcatcgagggacaaaagggggatatagggctaccaggaccagacgtgtttatcgatatcgatggagcagtaatctccggcaatccgggagatccgggagtccccggccttccaggcctgaaaggtgacgaggggatccagggactgaggggcccttcaggcgtcccaggactgccggccctaagcggagtacctggcgcccttgggccccaaggttttcccgggctgaaaggggaccaggggaatccaggccgaactacaattggtgccgctggcttaccagggagggatggcctgcccggacctcccggcccacctgggccacccagtccagagtttgaaactgagactctccataataaggagagtggattcccaggcctgcggggagagcagggcccgaagggcaatctcggtctgaaaggaataaagggcgacagtggattttgtgcttgcgatggcggtgtgccgaatacaggtcctcccggcgagcctggcccgccggggccatgggggctcattggtctgccaggtctaaagggagcccgaggggatcggggctctgggggtgcacagggtccagctggggcacctggattggtggggccattaggtccatccggtcctaagggaaaaaagggcgaacctatcctctccacaatccaggggatgccaggtgatcgaggcgattccggctcacagggttttcggggcgtgatcggcgagcccggaaaggacggcgtgccagggctgcctggcctcccaggcttgcccggagacggcggtcagggctttcccggggagaaaggtctccccggactgcccggcgaaaagggtcatcctggccctcctggccttcctggcaatggcctgcccggcctgcctggtcctagaggattgccaggagacaagggcaaggacggactacctgggcaacaggggcttcctggctctaaagggattactttaccttgcattatccctggttcctacggcccttccgggtttcctggcacccccggctttcccggccctaagggttctagaggcttaccaggtacaccaggccagcccggtagttccggcagtaaaggtgaaccaggttcgcctggactcgtacacttgccagagttgcccggatttcctggccctaggggtgagaagggactgcctggttttccggggcttccaggaaaagacgggctgcctggaatgatcggatctccaggcttgcccgggtccaaaggagctacaggagatattttcggagccgagaacggtgcccccggcgaacaggggttgcaggggctgacaggtcacaagggtttcctgggcgactccggactcccaggactcaaaggcgtccacggtaagcccggtctccttggacctaaaggggaacgaggctcaccggggaccccgggtcaggtcggccagccaggcacaccaggatcatccggtccttatggaattaaaggaaagtccggcttacctggcgccccaggctttccaggcatcagcgggcaccccggaaagaaaggcaccaggggcaagaagggtccccccggttctatagtcaaaaaggggctccctggacttaagggattgcccgggaaccctggcctggtcggtttaaaaggctctcccgggagtccaggcgtcgctgggctgccagccctgtccggccccaagggggaaaaagggagcgtaggctttgtaggcttccctggaatccctggactgccagggattcccggtacacggggtcttaaagggattcctggatcgacaggcaaaatggggcccagcggtagggctggtacccccggtgagaaaggggatcgcggcaatccggggccagtgggaatcccgtcaccaagacgacccatgagtaacctgtggctaaagggcgacaagggttctcagggatcagccggcagcaacggcttcccaggacctagaggcgacaagggagaagcaggcagaccgggcccaccaggactgcccggagccccgggacttcctggaatcattaaaggcgtgagtggaaagcccggccccccagggttcatgggcatccgtggcctccctggactgaagggctctagtgggattactggattcccagggatgccaggcgaaagcgggtctcaggggatcagggggtcgccaggtctccccggggcatctggactcccgggcctgaagggcgacaacgggcaaaccgtcgaaatatccgggtcccctgggcctaagggtcagccaggggaaagtggcttcaagggtactaagggtcgcgacgggctcataggaaacatcggttttcccgggaacaagggagaagatgggaaagttggtgtgtcgggcgatgtgggactccctggtgcccccggctttccgggcgtagcaggcatgcgtggagaaccaggtctgccaggatcatcgggccaccagggcgccatcggcccgttgggctcacccggactcatcggcccgaagggattccccggattccccggactacatggactaaatggcctgcctgggaccaaggggactcatggcactccaggcccatcaattacgggagtcccaggacctgcaggtctaccaggtccaaagggcgagaagggatatccgggaattggcatcggtgctcccggcaaaccgggtctgcgcgggcaaaagggagatcgagggttccctggtctccagggccccgccggcctgcccggtgcgcccggcataagcttacccagcctaattgcgggacagccaggcgatccagggcggcctggtttagatggcgagagaggccgccccggtccggccggaccacctggcccacccgggccttcaagtaaccaaggagatactggggatccaggattcccgggaatcccaggcccgaaaggcccaaaaggcgatcaagggatccccgggttttctggactccccggagagctgggtcttaagggcatgcgcggagaaccgggtttcatgggaacacccggtaaggtgggacctcctggcgacccggggttccctggtatgaagggcaaggcaggccccagaggatcttcgggactgcaaggggatcccgggcagactccaacagccgaggccgtgcaggttccacccggcccgttgggccttcctgggattgacggtatacccggattaacaggagatccaggcgcgcagggacccgtcggacttcaagggagcaaaggactgccaggaattccaggtaaggatggcccaagtggcctgcccggccctcctggcgcactcggtgaccctggcctgcccggcttgcagggcccgccaggcttcgagggagcaccaggacagcaggggccatttggcatgcccggcatgcccggtcagagcatgcgggtggggtacactttggtgaagcactcacagtcagaacaggtgcctccctgccccataggcatgtcccaactgtgggtgggatactccctgctgttcgtcgaaggccaggagaaggcccataatcaggacctaggctttgcgggaagttgcttaccccgattcagtaccatgccctttatctattgtaacatcaacgaagtctgtcattatgccagaaggaatgacaagtcatactggttgagtacgaccgcccctattcctatgatgcccgtgtcgcagacacagattccacagtacatcagccgttgctccgtgtgcgaggccccatctcaggcaattgccgtacattctcaggatatcaccatcccacagtgtccactgggctggaggtcgctgtggatcggatacagtttcctcatgcacacggcggccggagctgagggcggagggcagagtctggtcagtccagggagctgcctggaagacttccgcgccacaccattcatcgagtgctctggcgcccgcggaacatgtcattactttgcaaataagtattcgttttggctcactacagtggaagagcgccaacagtttggagagctgcccgtgtctgagacactgaaagcgggccagctccatacccgggtgagtagatgccaggtttgtatgaaaagtctttag

SEQ ID NO: 2502 - DNA, 5076 bp, Artificial Sequence
  Description of Artificial Sequence: Synthetic coding sequence
atgctgatcaataagctgtggctactgctggtaacactgtgtctcaccgaggagctggcagctgccggtgaaaagtcttacggcaaaccctgtggggggcaagattgctccggttcctgccagtgcttcccagaaaagggagctcgtggccggcccggaccaatcgggatccaggggcccaccggccctcaggggtttaccggctccaccgggctcagcgggttaaaaggtgaaaggggcttcccagggcttttgggcccctacggccctaagggggacaaagggccaatgggagttcctgggtttctcggcatcaatggaattcccgggcatcccggccagcctgggcctcgcgggccacctggcctggatggatgcaacggcacacaaggtgcagtcggctttcctgggccagacgggtaccctggtctcctcggaccccccggcctacccgggcagaaaggttccaaaggagaccctgtgctcgctcccggatcttttaaagggatgaagggggatccaggcctccccggactggacggaatcaccggaccgcagggagccccggggttcccaggcgccgtgggcccagccggcccccccggtcttcagggcccccccggtcctcctgggccgctgggcccggatggcaacatgggcctcggtttccagggagaaaagggggtgaaaggggatgtgggcctacctggcccagccggcccccctccttcaactggagagctggagttcatgggattccccaagggtaagaagggcagtaaaggtgaaccgggccccaaagggtttcctggaatcagcggcccccccgggtttccagggcttggtaccacgggcgagaagggcgaaaagggagaaaaaggaatcccgggactcccgggacctaggggcccgatgggcagcgagggggtccaaggtccccccgggcagcaagggaagaaaggcacgctgggttttcctggcctgaatgggttccaggggatcgaaggacaaaagggcgacattggccttccagggcccgacgttttcatcgatattgacggagctgtgatcagtggcaaccccggcgacccaggtgttcccggcctgccagggctgaagggcgatgaagggatccaggggctacgggggccttcaggggtgcccggtctgccggctctgtccggcgttcctggggcactcggcccacaaggtttccctggtctgaaaggagatcagggaaacccaggcagaaccaccattggagccgcgggcctgcccggacgcgatggattacctggccctccagggcctcccggcccacctagcccagagtttgagacagaaaccttgcataataaggagtccggtttcccgggcctacgaggcgagcagggtcctaaaggtaatttgggccttaagggcatcaaaggcgacagtggattttgcgcttgcgacggcggggttcctaacaccggcccccccggtgagcccgggccacctggtccttggggcttgatcggattacccggcttgaaaggtgcgcgcggcgacagaggttccgggggggctcaaggtccagcgggagctccaggtttagtcggcccactcggaccatcagggcctaaggggaagaaaggcgagccaatattgtccaccattcagggcatgcctggagaccgcggtgatagcggctcccaggggttccggggcgtgataggggagcccggcaaagacggagtgccaggtctaccaggcctccctggtctgcctggggacggcggccaaggatttccaggggagaaaggcctccccgggctgcctggtgaaaaagggcatcctggaccacccggcttaccgggaaatggcctgcccgggctgcccggaccccgagggctgccaggtgacaaagggaaagatgggctccctggtcaacagggcttgccggggtctaaaggaattactctaccctgcattatacctggcagttatgggccttccggctttcctggaacccctgggtttcctggacccaaaggatcacgcggcctgcccggcacccccggacagcccggctccagcgggtctaaaggcgaacccggttctcccgggctggtgcatctgccggagctgcccgggttcccggggccccgtggagaaaaaggcctacccggattccccggattgcctggcaaggatgggttgcctggaatgattggaagccctggccttccgggctccaagggcgccacgggggacatttttggggccgaaaacggcgcccctggtgaacagggtctgcaagggctcacaggccacaaaggcttcctgggggattccggattgccaggcctaaaaggggtgcatggcaagccagggctcctgggacccaaaggcgaacgcggcagcccaggcactcctgggcaggttggccagccgggaacacctggtagcagtggaccctatggtatcaaaggtaagtctgggcttccaggtgctcctggcttccctggtattagcgggcaccccggcaaaaaaggcacgcgcggcaagaagggcccccccggcagtatagtgaaaaaagggctccctggcctgaaaggcctgccagggaaccctggactcgtaggcctgaaaggaagccctggctcaccgggggtggctggtctccccgccctttctggacctaagggcgagaagggtagtgtgggctttgttggcttccctgggatacctggcctgccaggcattcccggcaccagaggtctgaagggaattccaggatctacaggaaagatgggcccatccggaagggctgggacccccggagagaagggggatcgggggaaccctggccccgtaggcattccaagcccccgcagacccatgtcgaatctctggcttaaaggagacaagggatcgcagggatccgccggaagtaacggcttccccgggcccaggggcgacaagggcgaagccggaagacctggtcccccaggcctccctggagcacctggactgccagggatcataaagggagtctccgggaagcccggccctcccggctttatggggatcaggggactcccgggactcaaaggtagcagcggaatcaccggatttcccgggatgccgggcgaatctgggagccagggaattagaggatcccccggcctgccaggggcatccggcctccctggattgaagggcgataacggccagactgtggagatatctggtagcccaggaccaaagggccaacccggagagtccggctttaagggtactaagggtagggatggcctgattggtaatatcggctttcctggtaacaagggcgaggatggaaaagtaggtgtcagcggagacgtgggcctgcccggtgcgcctggattccctggggttgctggaatgcggggggaacctggcctgccgggcagctctggccatcagggcgccatcggtccacttgggtctccgggattgatcggccctaagggttttccagggttcccaggattgcacgggctgaatggcttaccggggacaaaaggcacacacgggacaccaggcccttccataacgggagtgcctggacccgctggattaccaggacccaagggggagaagggttacccaggaatcgggatcggcgcccccggcaaaccagggctgcggggccagaagggggacagaggattccctggactccagggtcctgctggtcttcccggtgcacctggtatatcactacccagtttaatcgccggacagccaggtgaccctggaaggcctgggctggatggtgagcgtgggcgtccaggcccagcgggccctcctggacctccaggacctagtagtaatcaaggagataccggcgaccctggctttcccggaattcccggcccgaagggacccaaaggcgaccaaggaatccccggattcagcgggcttccaggcgagctgggactgaaggggatgaggggggagcccggtttcatgggaacacctggcaaagtgggccccccaggcgaccccggattccccggcatgaaaggaaaagcaggacccagaggatcatcagggctgcaaggggatcctggacagacccctacggctgaggctgtacaagtgcctcctgggcctctgggcctgcctggtattgacggcattccagggctcacaggcgatcccggcgcccagggtccagtcgggctgcagggttcaaaggggctcccaggaattcccggcaaagatggcccatccggactccccgggccccctggggctctcggtgaccctggccttccgggactccagggtcctccagggttcgagggagcccccgggcagcaaggccctttcggcatgcccggtatgccgggccagagcatgcgggttggttacacactggtgaaacattcacaatcggagcaggtccccccttgccccatcgggatgagccagctgtgggtgggttactcactacttttcgtagaggggcaggagaaggcccacaaccaggatctgggcttcgcaggctcctgcctccccaggttcagcaccatgcctttcatttattgcaatataaacgaggtctgtcattatgcccgccgaaatgataagtcctattggttgtcgacaacggcccctatccccatgatgcctgtctcccaaacccagatcccacaatatatcagtcgctgtagcgtgtgcgaagctccgagtcaggcaattgccgtgcacagtcaggatataacaataccacagtgtcccctgggctggaggtccctgtggattgggtactcctttttaatgcacacagcagccggggcagaagggggaggtcagtcactagtgagtcctggttcttgccttgaggattttagagccacaccatttatcgagtgttctggggctcgcggaacctgtcactactttgccaacaagtactcattttggctgacaacagtggaggagcgacagcagtttggggaacttcctgtgtcggaaactctgaaggctggccagctacatacccgggtgagccgttgtcaagtgtgtatgaagtccctgtag

SEQ ID NO: 2503 - DNA, 5076 bp, Artificial Sequence
  Description of Artificial Sequence: Synthetic coding sequence
atgcatccaggactatggttactgctcgtgacgctgtgcttaactgaggaactagccgcagctggcgaaaagtcatacggcaagccatgcggaggccaggattgctccggttcttgccagtgttttcccgaaaagggcgcccgcgggcggcccggcccaatcgggatccagggtccaactgggccacagggctttactggctctactgggctgagtgggctcaagggcgagcgcggattccccggactgttagggccatacggacccaagggagacaaaaaattctctatccccgtgttgttgatctatgatagccggccgggacaccccggccagccaggaccacgagggcccccggggcttgatggatgcaatgggacacaaggggctgtgggcttccccgggcccgatggttacccagggcttctgggtcccccgggccttcccggtcaaaagggctccaaaggagaccctgtgctagcgcccggatccttcaagggtatgaaggcatttatacctctcttcgagagcatcaggggcccacagggggcccccggctttcccggggccgtgggccctgctggtccccctggtctgcagcagggccaacccccctttttagaggttctctttccccattggcacgaaggcgaggaagcgaaggtacgggattccctgtttggtgacgtggggctgcccggaccggccgggcctcctcccagcactggcgagctcgaattcatgggttttcccaaaggcaagaagggtagtaaaggtgagcccggacccaaaggcttcccgggaatttcaggtccccccgggttccctggtctgggcacaactggggaaaaaggagagaaaggggaaaaaggaataccagggctccccgggcccaggaccctgctgtgctcacataccttccaccttgtggtgacgatgttcttaagtcaggggaagaagggaactttgggatttcccggcctgaacggatttcaaggcatcgaagggcagaaaggggacatcggtttgcccggtcccgacgtgtttatagatatagacggggcagtaatttcagggaatcccggggatcccggggtgcccgggctcccagggctaaaaggcgatgaaggaattcagggcctcagaggcccttccggtgttccaggactacctgcactgtctggtgtacctggagccttgggtcctcaaggtttccctggattaaagggtgatcagggcaatcctggacgtactactatcggcgctgccggcctgcccggacgcgatgggctcccaggcccacccgggccacctggcccacctagtccggagttcgagacagagaccctccacaataaagagagcggctttcctgggctgcggggagagcagggaccgaaggggaatcttggtctgaagggcattaaaggggactcaggattctgtgcctgcgacgggggagtgccaaacacgggtcccccaggggaacctggcccccctgggccctggggcttaattggcctacccgggctaaagggcgcccggggagaccggggctcggggggcgctcagggtcctgcaggggcgcctggtttagtgggcccgctcgggccatccggccctaagggaaagaaaggagaacccatcctcagcacaattcagggaatgccaggtgatagaggtgatagcgggtcccaaggtttcaggggcgtgattggcgagcccggaaaggacggagtgccaggcctgccaggcctgcccgggctgccaggcgatggaggtcagggcttccccggagagaaaggactgcccgggctccccggagaaaagggacaccctggacctcctggactcccaggaaatggtctcccaggccttcctgggccccgtggtctcccaggtgataagggaaaagacggtcttcccgggcaacaggggttacccgggagcaaaggaatcacgttgccttgtattatccccgggtcatacggcccatctgggttccccggaacacccggcttcccggggcccaagggatctcgtggtctgccgggtacccctggccagcctggctcgtcgggttcaaagggtgagcccggatcccctgggctcgtgcacctaccagaattaccgggtttcccaggccctagaggagagaagggcctcccgggttttccggggctacccggtaaggacggcctcccgggcatgatcgggtcccctggccttcccgggagcaaaggggctaccggtgacatttttggcgcagaaaatggggcgcccggagagcagggtctccaaggcctgacggggcacaagggattccttggggattccgggttacctgggctgaagggcgtacacggcaagcctgggctgctcggacccaagggagaaagggggtcacccggtacgcctggccaggttggtcagccaggcactccagggtcaagcggtccgtacggcatcaaaggcaaaagtggtctgccaggcgcaccagggtttccaggcataagcgggcatcctggcaaaaagggcactcgcggcaagaagggcccacctggaagcatcgttaaaaagggattaccaggtcttaaaggcctgcctggcaatcctggtctcgtgggtctgaaaggctcccccggttctcccggcgtggccggattacctgctttgtccgggccaaaaggtgaaaaaggttcagtagggttcgttggattccctggcatcccaggtcttcctggcatccccggcacgcgaggacttaagggaattcccggatctactggaaagatggggccgagtggcagggccggtacgccaggggagaagggtgacagaggcaatccaggtcccgttgggatcccgagtccacgcagacccatgagtaacctgtggctgaagggggacaagggatcacaaggaagtgccggttcgaacgggttccctggcccccgtggagataaaggggaggccgggaggcccggaccacccggtctccccggagcccctggcctgcctggcatcattaagggggtctccggaaagcctgggccacctggattcatgggcatccgcggactgcccgggctcaaaggcagttccggaatcacaggctttccaggcatgcctggagaaagcggcagccaggggatcaggggatccccaggcctgcctggcgctagcggcttacccggcctgaaaggggataacggacagacagtggagatttccgggagtcctggcccaaagggacagcctggcgagtctggatttaaaggcacgaagggaagagacggccttatcggcaatatcggcttcccggggaacaaaggagaggacggaaaggttggggtctctggagatgtgggcctccctggcgcaccggggttccctggggttgctgggatgaggggtgagcctggcctgccgggaagttctgggcatcaaggcgccattggcccgctcggctccccgggactgatcggccctaagggcttccctgggtttccgggccttcatgggctcaatgggttgcctggtacaaaggggacacatggtactcctggaccgtcaatcaccggcgttccggggcccgccgggctgccaggtccgaagggggaaaaaggctatccaggaatcgggatcggggcacccggcaagcccgggctgagagggcagaagggcgacaggggatttccgggtctacaaggccctgcagggttgcctggcgcacccggaattagcctgccttcccttatcgcaggccagcctggcgatcccggacggccgggcctagacggagaacggggcagacctggacctgcgggcccgccaggcccaccaggtccatctagcaaccaaggggacacgggagaccccggcttccccggcatccctggcccaaaagggccgaaaggcgaccaaggcatccctggttttagcggtctgcctggcgagctgggtctgaaaggcatgcgaggtgaaccaggtttcatgggaacccccggaaaagttgggcccccaggagatcccggtttccctggaatgaagggtaaagcagggcctaggggctcaagcggactccaaggtgatcctggacagactccaaccgcagaagcggtgcaggtgccccctggccctttaggcttacctggtatcgatggcatccctggactgaccggagatcctggcgcacaaggtccagtcggcctgcaagggtcaaaaggattacctggcatccccggaaaggacggtccatccggcctgcccggtcccccgggggcgctgggcgatccggggcttcctggattgcagggacctccaggctttgagggggcacctggacaacaggggccatttggaatgcctggaatgcccggtcagagcatgcgcgtgggttacactctggtgaagcatagtcagtctgagcaggtgcccccatgcccgatcggaatgagtcagctgtgggtgggttactccctcctcttcgttgaggggcaggagaaggcccataatcaggatcttggcttcgctggatcctgcttgccgcgctttagcactatgccattcatttattgtaatataaatgaagtgtgtcactacgccagacgcaacgacaaaagttattggctgtctacaactgcgcctatacccatgatgcctgtatcacaaacgcagatcccccagtatatcagcaggtgtagtgtctgcgaggccccctctcaggccatagccgttcacagccaagatataaccatcccccagtgccctttaggatggagaagcctgtggatagggtactcatttctgatgcacacagccgcaggggcagagggagggggacagtcattggtgtcgcccgggtcctgcctcgaggattttagagccactccctttattgaatgcagcggcgccagaggaacctgtcactattttgccaacaagtattccttctggcttaccacagtcgaagaacggcagcaattcggggagcttccagtatccgaaacattgaaagcaggtcaattgcatacgagggtcagcagatgtcaggtgtgcatgaaaagcctgtag

SEQ ID NO: 2504 - DNA, 783 bp, Artificial Sequence
  Description of Artificial Sequence: Synthetic coding sequence
atgctccaagactggaaggagcgtgccgcttctgtatggtgcaagtggttggacgttaatcccaatcatcacctggttaaagccccccaaccggacctaccatgcccatgccctctctctctcctgcccggtttcgccggctcatgcctcccacgcttctcaactatgcctttcatttattgtaacataaacgaggtgtgtcactacgctagacgaaatgacaaatcctactggctgagtactaccgcccctatccctatgatgccagtgagccagacacaaattccccagtatatatcccggtgttcagtatgcgaggcccccagtcaggcaattgctgtccattcccaggacattactattcctcagtgcccgttgggatggcgttccctatggatcggctatagcttcctcatgcataccgctgctggagcagaaggaggaggccagagtttggtttcacccggtagctgcctggaggactttcgggcgacccccttcatagagtgcagcggcgctaggggtacctgtcattattttgccaacaaatactctttttggcttacaactgttgaggagagacagcagttcggcgagctgcctgtaagtgagacactgaaggctgggcaacttcataccagagtttcacgatgccagcctggatttaccggacccggaatcaaagaatggaaatggaagtggcatcattctccatccgcacccgtgatccaccaacagaatttctgcttccttttcccacgacattatgtattgctcgcctag

SEQ ID NO: 2505 - DNA, 4902 bp, Artificial Sequence
  Description of Artificial Sequence: Synthetic coding sequence
atgcatcccggcctctggcttcttctggtgacgctgtgtctaacggaagagctggccgctgcgggcgaaaagtcttacggcaagccttgcggagggcaggactgctcagggagttgtcagtgctttcctgagaaaggagcacgaggtcgtcccggccctatcggaatccaggggcctacgggcccccaggggtttactggatctacaggtctgtcaggactgaagggcgagcgtggttttcctggactgctaggaccttatgggccaaaaggggacaagggtccaatgggcgtgccgggctttctaggtattaacggcattcccggccatcccggtcagcctggcccaaggggtccaccaggcctggacggttgcaacgggactcaaggcgctgttggattccctggaccggacggttacccgggcctgctcggccctcctggcctgccgggccagaagggctccaaaggcgaccccgtgctggcaccaggctcctttaagggaatgaagggggaccccggattgccggggctggatggcatcaccgggccccagggagctccaggatttccaggagctgtgggtcccgccgggccgcctggtctgcaaggacctccagggcctccgggcccgcttgggcccgatggaaatatggggctgggcttccagggagaaaagggcgtcaaaggggatgtcggcctccctggacccgcaggccccccaccgagtactggcgaactggaattcatgggctttcccaaaggaaagaaagggtcaaagggcgagcctggtcccaagggttttcccggcatttccggtcctcctggttttcccggactgggtacaacgggcgaaaagggtgaaaaaggcgagaaagggatcccaggtctacctgggcccagggggcccatgggctctgagggcgtccaaggtccaccaggccagcagggtaagaaaggcacactcggctttcctggtttgaatggattccaggggatcgagggacaaaagggtgacatcggcctccctgggcccgatgtgttcatcgacatcgatggggctgtgatatctggcaacccgggagatcccggggtgcccgggttgcccggtctgaagggggacgagggcattcaggggcttcgtggtccaagtggtgtacctggtctgcctgcactcagcggcgttccgggggccttggggccgcaaggattcccaggactgaaaggcgaccagggtaatcctggacggaccaccatcggcgcggctggccttccggggagagacgggctgcccggcccccctggtcctccgggccccccatcccccgaatttgagactgaaacattacataacaaggagtccgggttccccggcctacgtggcgagcaaggtcccaagggaaacctgggtcttaaaggcattaagggggattccggtttttgtgcgtgcgacggaggagtcccaaacaccggcccccccggtgagcctggcccccctgggccatggggcctaatcgggctgccaggcctgaaaggggcccgaggcgacagagggtctgggggtgcacagggcccggctggagctccaggtctggtgggtccactggggccttctggtcctaaaggcaagaaaggagagcctattctaagcaccattcagggaatgcccggcgatcgcggcgactcaggatcccaggggtttagaggggtgataggggaaccggggaaggacggcgtcccgggcttacccggtcttcctgggctgcctggggatggcggccagggttttcccggagaaaaaggcctgcctggactgccaggagagaaaggtcacccggggcctcccggcctgcctggaaatgggctgccaggtctccctgggcctaggggactgcccggagacaaaggcaaagacggtctacccgggcagcagggccttcccgggtcaaaaggcatcacattgccttgtatcatccccggctcatatggtccctccggctttcctggcacccctggcttccctggacccaaagggagtcgggggctgcccggaacccctgggcagccggggagtagcggctccaagggagagcccgggtctccaggactcgtgcaccttcccgaactgcccggatttcccgggccgcgcggcgaaaaggggctgccaggattcccggggctccctggtaaggacggcctgcccggtatgatcgggtcacccgggcttcccgggtccaaaggggctaccggagacatatttggggccgaaaacggagcacctggggagcaggggttgcagggcctgaccggacacaagggctttctcggggactccgggctaccaggtctgaagggggtacatgggaagcctgggctgcttggccccaagggagagagagggagccccggtacgcctgggcaagtcggtcagcctggtacccctgggagtagcggcccttacggaattaagggaaagagtggactccccggggctcccggcttcccagggatatcaggacacccaggaaagaaaggaacccgcggtaagaaagggcccccaggttccatagtcaagaagggattaccaggcctaaaggggctgcctggaaacccggggctcgtgggactgaaggggtcacctggcagtcccggagtcgccgggctgcctgccctcagtggccccaagggggagaagggcagcgtgggctttgtgggattccccgggatacccgggctgcctgggatacctggcacaagagggcttaaaggcatacctggatctactggaaagatggggccctctggcagggccggaactcccggcgagaaaggagatcgtgggaatccaggacccgtaggaatcccctcaccccgtcgccccatgtccaacctatggctcaagggtgataaaggatctcagggcagcgctggcagtaacggatttcccggaccaaggggcgacaagggggaggcgggccgacccgggcctcccggtctgcctggcgctccaggtctgccaggaataattaaaggcgtgtccggaaaacccggaccgccagggttcatgggaatacgaggcctgcctggtttaaagggctcctcaggtatcaccggtttccccggaatgcccggagaatccggttctcaaggtattaggggcagcccggggttgcccggggcttcaggactaccaggactgaaaggggacaacgggcaaaccgtggagatttctggctcccccggacctaaaggccaacctggcgagtctggtttcaaagggacaaagggtcgcgacggtctcataggtaacatcggatttccaggaaataagggcgaggacggaaaggttggggtgtccggtgacgtggggctccccggggctcccggctttccaggcgttgctggaatgcgcggtgagcccgggctgcctggctcaagtggccaccagggtgcaatcggtcccctgggatcgcccggccttatcggacctaaggggccgtcaatcacaggtgtgccaggccccgccggcctgccgggacccaaaggtgaaaaaggatacccaggtattggcataggtgctcccgggaagccaggactgcgaggtcagaagggagacaggggattcccaggcctgcagggcccagcgggactgcctggtgctcctgggatcagtctgccttctctaattgcaggccagcccggagaccctggtagacccgggctggacggagagagaggtcggcctggccccgcaggtccacctggcccgccggggccaagttccaaccagggcgacactggagatccgggcttccctggcattcctggacctaagggtcccaaaggcgaccaggggatacctggattttctggcctccctggagaactgggtctcaagggttcatctggtcttcagggcgatcccggtcagacccccaccgccgaagcagttcaggtgcctcctggcccactgggcctgcccggtatcgacgggattcccggccttacaggcgacccaggggcccagggaccggtgggcctccagggatccaagggacttcctggaattcccggtaaagacgggcccagcggccttcctgggcctccgggagctctgggagatcctggacttcctgggcttcagggcccgccaggctttgagggggctccaggtcagcaaggcccttttggcatgccaggaatgccaggccaatccatgcgcgttggctatacccttgtgaagcattcccaaagcgaacaggtcccgccttgtccaatcggtatgagtcagctatgggttggttactccctgttatttgtggaggggcaggagaaagcccataaccaggatttgggattcgctggctcttgccttcctcgtttctccacgatgccatttatctactgtaacatcaacgaggtctgccattacgcaagaaggaacgataaatcctactggctttctacaacggcccccattcctatgatgccagtgagtcagacacaaattcctcagtatatctcaagatgctcggtgtgtgaagccccctcacaggccatagcagtgcatagccaggacattacgatcccacagtgcccattgggatggcgttcactctggatcggctattcatttctcatgcacaccgcagctggagccgagggaggggggcaatccctggtgtctccaggaagctgtctggaagacttccgggcaaccccatttattgagtgtagcggcgcccgaggtacctgtcactatttcgcaaataaatacagcttctggctgactacggttgaagaacgccagcagtttggggagttacctgtctctgagaccctaaaggctggccagctgcatacgagggtttcacgatgccaggtgtgtatgaaatcactctag

SEQ ID NO: 2506 - DNA, 5001 bp, Artificial Sequence
  Description of Artificial Sequence: Synthetic coding sequence
atgcacccaggcttatggctgctcctggtcaccctctgtctcactgaggagctggccgccgcgggggagaagtcctacgggaagccctgtggaggacaagactgctccgggtcatgccagtgtttcccagagaagggcgcccgcggcagaccggggcctattgggatccaagggcctacagggcctcagggcttcaccgggagcactggtctctccgggttaaagggcgaacggggctttcctggtctgctggggccttatggtcccaaaggcgataagggccccatgggggtacccggcttcttaggcattaacggcattcctgggcaccccggccagccagggccgagggggccccctgggctggatggttgcaacggcacacaaggggccgtggggtttccggggcctgatggataccctggcctccttggaccacccggcctgcctggccagaagggctccaaaggggacccagttctggcccctgggtccttcaaagggatgaaaggggatccaggtctgccaggcctggacgggatcaccggcccccagggagctcctggcttcccaggtgccgtggggccagctggcccacccggactccagggcccacctggcccccccgggccgctgggcccagatggtaacatgggtcttggatttcagggcgagaagggcgtgaaaggtgacgtggggcttcctgggcccgccggcccacctccatctactggagaactggaatttatgggattccctaagggaaagaagggttccaaaggagaacccggacccaagggatttccgggtatatcaggaccacctggttttcctggcctgggaacaacaggggaaaaaggtgagaagggcgagaaagggattcccgggcttcctggacccagagggccgatgggctccgagggagtgcagggccctccgggccagcagggcaaaaaggggactcttggtttccccggtctgaatggctttcagggcattgagggacagaaaggagatataggtctcccaggacctgacgtctttatcgatatagatggagccgtgattagcgggaacccaggggatccgggcgtgcccggactgccggggctgaagggggacgaaggaatccaaggactacggggtccatctggagtaccggggctccctgcgttatcgggagtgccgggagccttggggccccaggggttccctggattaaagggtgaccaggggaaccctggtcgcaccaccataggcgcagcggggttacctggacgcgacggcctgcccggacccccaggcccacccggccctccctctccagaattcgaaaccgagacccttcataataaagagtccggatttcctggcctgcgcggagagcagggtccaaaggggaatctcggtttaaagggaataaagggtgattccgggttttgcgcctgtgatggcggcgtccccaatactggcccaccaggggaaccggggccccccggtccatggggactgatcgggctccctggactgaagggggccaggggcgatcgcggtagcgggggggcccaaggtccagcgggagctcccggtctggtaggacctctcggccccagtggacccaaaggtaaaaagggtgagcctatcttgagcacgattcaaggaatgccgggcgatcggggcgacagcggatctcaaggattccggggggtgattggagagcccgggaaggacggcgttccgggcttgccgggacttcccggtctgcctggagatggaggccaggggtttccaggggagaaggggctcccagggttgcctggggagaaaggacaccctgggccccccgggctgccagggaacggcttgcctggtctgccaggaccgagggggttacctggcgataaagggaaggacggactgcccggacaacagggcttgcctggcagcaaaggtatcacactgccctgtattatccccggctcatacggaccatccggctttcctggtaccccgggctttcctggtcctaagggatctaggggactgcctggcacccctggccagcccggctcttcggggtcgaagggggagccgggatcccctggtctcgtccatctgccagagctgccaggctttccaggacctaggggggagaagggactccctgggttccctggactccctggcaaggacggcctccctggcatgatcggatctcccggactacccggaagtaaaggagctaccggggacatttttggagcagagaacggcgcacccggggagcaaggcctgcagggccttaccggacataagggctttctgggcgactctgggcttcctggcctcaaaggggtccatggtaaacccggtctgctcgggcccaagggggagcgcgggagcccaggtaccccgggtcaggtgggacaacctggcacacccggcagttctgggccctacgggatcaaggggaaatctggactgcccggcgcacctggatttcccggcatttctggacaccccggcaagaaaggcactaggggcaaaaagggaccccctggcagcatcgtcaagaagggcctgcccggcctcaaaggcctcccggggaatccgggactggttggattaaagggtagccccggatctccgggcgtcgccgggttgcccgcccttagtgggcctaagggtgagaagggtagcgtcggctttgttggatttccaggcattccaggactgcccgggatcccaggaactagaggactgaaagggatccccggcagcaccgggaaaatggggccctctggaagagcaggcaccccaggcgaaaagggtgaccgaggcaatccagggccagtggggattccgtcacccagacgacccatgagcaatctttggttgaagggagacaaaggctcccaaggtagcgccggctccaacggctttcccggcccaaggggagataaaggagaggctggtagacccggccctccaggactgcccggtgctccaggtcttccaggcatcattaaaggggtaagtggtaagccaggcccccccggcttcatgggaattcgcggcttgcccgggctgaagggctccagcggcatcaccgggtttcctggcatgccaggtgagtctgggtctcagggaattcggggaagcccaggtctgcctggcgcttcagggctgccagggctcaagggagataacggccagactgtcgaaatcagcggatccccaggtcctaagggacagcctggggagtcagggtttaaggggacaaagggtcgcgatggactcatagggaacataggcttccccggaaataaaggtgaggatggcaaggttggagtcagcggagacgtgggcttgcctggggcgcctggattcccaggagtggccggcatgcggggggagccaggactccctggaagctccggtcaccagggcgctatcgggcccctgggcagcccgggcctgatcggccctaaaggcccttctatcaccggagtgccggggcccgcgggattgcccggtccaaagggtgagaaggggtatcctggaatagggataggtgctccaggcaagccgggcctcaggggccagaagggcgatcggggctttcccggactgcaggggccagcgggcctaccaggagccccgggcatatctctgccctctctcatcgcgggccaacccggcgaccccggacggcccggtcttgatggcgaacgtggcaggcccggcccggctggtcctcccggtcctcctggccctagtagcaatcaaggtgatacaggtgatcccggattccctggcatcccaggccccaaaggtcctaaaggggaccaagggatcccgggcttttcagggctgccaggagagttgggcctgaagggcatgagaggagaacccggcttcatggggacaccaggaaaggtgggtcctcccggtgatcccggcttccccgggatgaaggggaaggcaggcccacgtggctcatccggattacaaggggacccagggcaaactccaaccgctgaagcagtgcaggtgcctccgggaccactcggcttgcctgggatcgatgggatccccggcctcacaggcgatccaggggcccaaggtcctgtggggctgcaagggagcaaaggactgccaggtataccaggcaaggacgggccttccggcttaccagggcctcccggggctctgggcgaccccggcctgcctggcctccagggtcccccaggcttcgagggcgcacctgggcaacagggccccttcgggatgcctggtatgccaggacagtccatgagagtaggatatacactggtgaagcactcgcagtctgagcaggtgcccccctgccccataggcatgtcccaactctgggttggatattcactcttatttgtcgaagggcaagaaaaagctcacaatcaggacttgggattcgcaggaagctgtctgccaagattcagcaccatgccatttatttactgtaacattaatgaggtgtgccattatgcgcggcgtaatgacaaatcctactggctcagtacaactgcgcctatccccatgatgcccgtatcacaaacacaaatcccccaatacatttccaggtgctccgtgtgcgaggctccctctcaggctattgcggtgcactcccaggacattaccatcccacagtgccctctgggttggcggtcgctctggattgggtatagtttcctcatgcatacagccgcaggcgcagaagggggaggtcagagcctggtcagccccgggtcctgcctcgaagatttcagagccacccctttcatcgagtgcagtggcgcaaggggcacatgtcactatttcgctaacaaatatagcttctggttgaccaccgtcgaggagagacagcagtttggggagttaccagtgtctgagacccttaaagcaggtcaactgcacacccgcgtcagcaggtgccaggtatgcatgaagtcactgtag

SEQ ID NO: 2507 - DNA, 2037 bp, Artificial Sequence
  Description of Artificial Sequence: Synthetic coding sequence
atggcgtggactgctagagataggggtgccctgggattgcttctgcttggtctttgcctgtgcgcagctcagaggggacctcctggcgagcaggggccccctggcccgccaggaccacctggtgtgccagggatagacggcattgacggcgatcggggcccgaaaggcccaccgggacccccaggaccagcaggtgaacctggcaagccaggggcccccggcaagccaggtacgcccggtgcagacggactaaccggacctgatggctcaccaggctccatcggatcaaagggccaaaagggtgagcctggagtgccaggtagccgggggtttcctgggagagggattccagggccccccggcccacccggcacagccgggttgcctggcgaactgggcagagttggacctgtcggtgacccagggcggagaggtccccccggaccgcccggtccgcccggaccccggggcacaataggctttcacgatggggatccactatgcccgaacgcctgtccacccgggcgatccggatacccaggtctccctggcatgcggggccacaagggtgccaagggggaaatcggagaacctggaaggcaggggcacaagggggaagaaggcgaccagggggagttaggagaagttggtgctcagggcccaccaggggcacagggattgcggggcattaccggcatagttggcgataaaggcgagaagggcgctcgcggattggatggcgagccagggccacaaggtctccctggtgccccaggcgaccaagggcaacgcgggcctccaggtgaagccgggccaaaaggcgaccgaggcgcggagggcgcgcgtggaatccccgggctgcccgggccaaagggagatactggcctcccaggcgttgacggaagggatggcattccaggcatgcccggcactaagggggagccagggaagcctggccccccaggagacgctggcctccaagggctccccggcgtccccgggatcccaggtgccaaaggggtcgccggagagaaaggttccactggcgctcctggtaaacccggccaaatgggcaactccgggaagcccgggcagcaaggaccccccggcgaggtgggcccccgcggcccacaggggcttcccggctccaggggcgagttaggacccgtgggaagcccaggactgccgggcaaactcgggtcattgggaagccccggcctgcccgggctgccaggaccccctggactacccgggatgaagggggatcgaggagtggtaggcgaaccaggcccaaaaggcgagcagggggccagcggggaggagggtgaggcaggagaacgaggcgaactgggagacattggactgcccgggcccaaagggagcgccggaaatcccggcgaacccggtctcagaggtcccgaagggtcacggggtctaccgggggtggaaggtcccagaggccctcctggacccaggggcgtccaaggcgaacagggggcgacgggccttcctggtgtgcagggccctcctggcagggctcccaccgaccagcacattaagcaggtttgcatgcgggtgattcaggagcactttgctgaaatggcagcgtccttaaagagacccgacagcggggccaccgggcttcctggaagacctgggccccccggaccgcccgggccaccaggcgagaatggctttccgggacagatgggaatccgggggctgcccggtatcaaagggccccccggtgcgcttggattaaggggtcccaaaggtgacttaggcgaaaaaggagagagagggcccccaggcagaggacctaacggcttaccgggggcaatcggcctgcccggcgatcctggccccgcaagctatgggagaaacggccgggacggcgagcgggggcctcctggcgtggccggcatacctggcgtgcccggccccccagggcctcccgggctccctggcttttgcgagcccgccagttgcacaatgcaagccggccagagggcttttaacaaggggccagatccatag

SEQ ID NO: 2508 - DNA, 2766 bp, Artificial Sequence
  Description of Artificial Sequence: Synthetic coding sequence
atgaaaacctgttggaagatacccgttttttttttcgtctgttctttcctggaaccttgggcctcagctgccgtaaagcggcgccctcgcttcccagtgaactctaattcaaatggaggcaatgagctttgtccaaaaattagaataggtcaggacgatctcccgggctttgacctgattagccagttccaggtagataaggccgctagcaggcgcgctattcagagggtggtggggtccgccactctgcaggttgcttataagcttggcaacaacgtggattttcgtatccctactagaaacctgtatccctctggccttcctgaagaatacagcttcctgactacctttagaatgactggtagcactctcaaaaaaaactggaacatatggcagatccaggacagtagcggcaaagagcaagtagggattaaaatcaacggtcagacacaaagtgtcgtgtttagttacaaaggactggacggtagtctgcagactgcagctttctctaatcttagcagtctcttcgactcacaatggcataaaatcatgatcggcgtggagaggagcagtgctactctgtttgtcgattgcaacaggatcgagagcctcccaattaagcctagagggcccatcgatatcgatgggttcgcagtcctcggcaaactggccgacaatccccaggtgtccgtgccgtttgaattacagtggatgctcatccattgcgaccctctcagacctcgccgcgaaacttgccacgaattgcctgcacggatcaccccctcccagacgactgacgaacgcggccctcccggtgaacagggaccaccaggccctcccgggcccccgggcgtgcccggtatcgacggaatcgatggcgaccgggggcccaagggaccccccggcccccccggaccagcgggcgagccgggaaagcccggcgcccccggcaagcccggcaccccaggcgctgatgggcttacgggacccgatggctccccaggatccattgggtcaaaaggacagaaaggtgagccaggtgtcccaggatctaggggctttcctggtagaggaatcccaggacccccaggcccccctgggacagccggcttacccggcgagctcgggcgcgttgggcctgtgggggaccctggtcgcagaggacccccagggccgcccggccctccgggtcctcgcggcaccattgggttccacgatggagaccctctgtgcccaaatgcttgcccacccgggcgctcagggtacccaggcctgcccggcatgcgtggacataagggggccaaaggggagattggcgagccgggccgccagggacataagggcgaagagggcgatcagggcgaacttggagaggttggcgcccaaggccccccgggagcccaggggctgcgtggtattactggcattgtcggcgataagggcgagaagggggctaggggtctcgatggtgaacccgggccccagggcctgccgggggcacccggcgatcaggggcagcggggcccccccggtgaggcaggtccaaagggagataggggcgcagagggcgctcgggggatccccggactcccaggacccaagggggacactggactgcctggcgtcgacggacgagatggcataccaggcatgccggggacgaagggcgaacccgggaaaccgggtcctcctggcgacgccggactgcagggcctccccggggtccccggcatcccaggggccaaaggcgtcgcaggcgaaaaagggtccacaggtgccccagggaaacctggtcagatgggcaacagcggaaagcccggccaacaaggccccccaggcgaggtgggtccccggggcccacaaggattgccgggcagtcgtggggagctgggtcctgtgggatctcccggactgccaggtaagctggggtcgctcggcagtcccggactgccaggcctacccggtccccccggcctgccggggatgaagggcgatcgcggtgtagtaggagagccaggacctaaaggcgagcagggggccagtggagaggagggcgaggccggcgaacggggcgagttaggtgacataggactccctgggcctaagggctccgcaggcaacccgggcgaacccggattgaggggacctgagggatcccggggattgcctggggtcgaagggccccgggggcctcctggacctagaggtgtacaaggcgagcagggcgccactgggctcccgggagtccaagggccacctgggcgtgctcccaccgaccaacacattaagcaggtgtgcatgagggttattcaggagcactttgctgagatggcggctagcctgaagcgcccagacagtggagcgactgggcttcccggccgtccagggcccccaggaccgccaggcccacccggcgaaaacggcttcccagggcagatggggatacgcggcttgcctgggataaagggccctccgggcgctctagggctaagaggacccaagggcgatctcggagaaaaaggagaaagggggccgcccggccgcgggcccaatggcctaccaggcgctattggcctcccgggggatcccggccccgcctcttacggacgcaacggtcgggacggcgaaaggggcccgccaggtgttgccgggatacctggcgtgcccgggcctccgggcccacccgggctgcccggattctgcgaaccagcaagttgtacgatgcaagcaggccagagagcctttaacaaaggcccagacccatag

SEQ ID NO: 2509 - DNA, 987 bp, Artificial Sequence
  Description of Artificial Sequence: Synthetic coding sequence
atgaaaacatgttggaaaatccccgtcttcttcttcgtatgcagtttcctggagccttgggcctctgcggccgtgaagagacgacctagatttcctgtcaattctaattcaaacgggggcaatgagctatgcccaaagattcggatcggccaagacgatttgcctggcttcgaccttatcagccagtttcaagttgacaaggcagcatctcgtcgagctattcaacgggtcgtcggttccgcaaccctgcaagtcgcatataaacttgggaataacgtggacttccggattcccactagaaacctgtacccaagtggtctgccagaggaatattccttcttgacaactttcaggatgactggatccacacttaagaagaactggaacatatggcaaatccaggatagtagcggaaaagagcaggtagggattaagatcaatgggcagacacagtctgtagtgttcagctacaagggactagacgggtcgcttcaaaccgccgctttctccaatctgtccagtctgttcgattcgcaatggcataagatcatgatcggtgtagagcgtagtagcgcgacgttgtttgtggattgtaaccgcatcgaatcactacctatcaagccacggggacctatagacattgatggatttgcggtgctaggaaaattggcagacaatcctcaggtgtcagttccgtttgagctgcagtggatgctgatccactgtgaccctctcaggccgagacgcgaaacttgccatgagctgccagcgcgcattacaccatcacagaccaccgatgagagaggcccacctggtgaacagggcccaccagggccacctggacccccaggagtgccaggcatcgatgggattgatggggatcggggccccaaaggaccgcctggccctcccggacctgcgggcgagccaggaaagcctggcgcccccggaaagcccggcaccccgggcgcagatacatccccttag

SEQ ID NO: 2510 - DNA, 2037 bp, Artificial Sequence
  Description of Artificial Sequence: Synthetic coding sequence
atggcctggacagcaagggatcgaggtgcacttggtctgctgttgctcggcctgtgcttatgtgccgcccagaggggccctccgggcgagcaaggcccaccgggccctccgggtcctccgggcgtgcctggcatcgacggcatcgacggggacaggggcccaaagggtccccccgggccccctggccctgccggcgaacccggtaaacccggagcacctgggaagccagggaccccaggcgcggatggcctcactggacccgacggcagccctggctcgataggctccaaaggtcagaaaggcgaacccggagtgcctgggagcagaggttttccaggcaagatcctgccactgctccaagggcccccaggaaccgcagggttgccaggagagttgggtcgagtggggccagtgggagatcctggccgccgcggcccacctggcccgcctggccctccgggaccacggggaacaattggcttccacgacggggatcccctatgcccgaacgcttgccctcctggccggtctggttatccagggctcccaggaatgcgcggccacaaaggcgcaaagggcgagatcggggaacctggaagacagggacataagggtgaagaaggtgatcagggagagctaggggaagtcggggcccagggtcctcccggggctcagggactccgaggcatcacgggcatcgtaggtgacaaaggcgaaaagggcgctcgggggctcgacggagagccaggccctcagggtctgcccggcgcaccaggcgatcaggggcagagaggaccaccgggtgaagccgggcctaaaggagacaggggggccgaaggtgcacggggaatccctgggcttcctgggcccaaaggggataccggactgcctggtgtggacggtagggatggcattcctggcatgccaggcacgaagggggagcctggaaagccaggccccccaggggacgccgggctccaaggtctgccaggtgtgcccgggatccccggagctaaaggagttgccggagaaaagggcagtacgggagctcccggaaagcccgggcagatggggaactccgggaagcccggccagcagggaccaccgggggaagtgggaccgcggggcccccaaggactcccagggagccggggtgagctcggccccgtgggctcacccggtttgccggggaagctggggtcccttggcagcccggggctgcccggactacccggtccacccgggcttcccgggatgaagggcgacaggggggtggtcggagaacctggacctaagggagagcagggagcgtcaggcgaggagggagaggcaggggagaggggagagttgggagatattggactccccggccccaaggggtctgcagggaatccaggcgaacccggcctgcgcggtcccgaaggcagcaggggtctgccaggcgtggaaggaccacggggacccccaggcccgcgcggcgtacaaggagagcagggggccactgggttgcctggtgtccagggtccgcctggcagagccccaacagaccaacacataaaacaggtttgcatgagagtcatccaggagcactttgcagagatggcagccagcttaaagcggccagactctggtgcgaccgggctgccgggaagacccggccccccaggcccccctggcccacctggtgaaaatggctttccgggacagatggggatccgcggccttccgggaattaagggtccaccgggcgccttagggctgagagggcccaagggggatcttggagaaaagggggaacgaggtccacctggccgaggaccgaacggcctgccaggcgctatagggctccccggagaccccggtccagcttcctatggccgtaacgggcgcgatggcgaacggggcccaccaggtgtggcaggcatcccaggcgtccctggtcctcctgggccacctggactgcccggcttttgtgagcccgcctcttgcactatgcaggccggccaaagagcttttaacaaagggcccgacccatag

SEQ ID NO: 2511 - DNA, 252 bp, Artificial Sequence
  Description of Artificial Sequence: Synthetic coding sequence
atggcagccgctaccgcctcgccgcggagtttgctcgtactgctccaggtggttgtgctggcactggctcagattaggggacccccgggggaaagggggcccccagggccaccaggcccacctggagtgcctgggtctgatggaatcgacggacctccaggccctgtgggattgccaggcgaaattggcatccgcggacctaaaggtgatcctggcccagacggtccgtctgggcccccgggacccccgtag

SEQ ID NO: 2512 - DNA, 2070 bp, Artificial Sequence
  Description of Artificial Sequence: Synthetic coding sequence
atggccgccgccacggcatcaccaaggtccctattggtcctgctgcaagtcgtcgtactggccttggcccaaattagaggtccccccggggaaaggggcccgccaggcccccctggccccccaggagtcccgggctctgacgggatagatggcgacaacggccctcccggcaaggctggtccacccgggccaaaaggggaacccggtaaggctgggcctgatggccctgacggaaaacctggaatcgacggcctgaccggggcaaaaggggaacccggacctatgggcattcccggtgtcaaaggccagccgggactgccaggcccgcccgggttgcctggacctggttttgcggggccacctggcccgccaggtccagtgggccttcctggcgagatcgggattagaggaccaaaaggagatcctggccccgatggaccgagcgggccccctggaccccctggaaagccaggaaggcctgggaccatccagggacttgaggggagtgctgactttctctgcccgacaaattgtccccccggtatgaaagggccccctggactgcaaggcgtgaagggccatgcaggtaagagaggtatactcggggacccagggcaccagggaaaaccaggacccaagggggatgtcggcgccagtggcgagcaggggataccagggcctcccggaccgcagggcatcaggggataccccggcatggcaggcccaaagggtgagaccggacctcacggctataaagggatggtaggcgctatcggcgccactgggccacctggcgaggaggggcctagaggcccgcctggaagagccggcgagaaaggggacgagggcagtcccggcatcagaggcccacaaggtatcaccggccctaagggagctacaggccccccaggaatcaacgggaaggacggtacccctggtacaccagggatgaaaggatccgctggccaggcaggccagcccgggtcgccgggccatcaagggcttgccggcgtccctggacagcccgggacgaaaggtgggcctggagaccagggcgaacccggcccccaaggcctcccggggtttagtggaccacctgggaaagaaggagagcccggtcctcgcggcgagataggtcctcagggaattatggggcagaagggcgatcaaggagaaagaggaccggtcggccagcctggacctcagggacggcagggccccaagggggagcagggccctcccgggattccaggcccacaggggttgcccggcgtgaagggggacaaaggcagtccaggcaaaactggcccacggggtaaagtgggcgaccctggtgttgctggtctgccaggtgagaagggagagaaaggagagagtggagagccgggccctaagggccagcagggagtgaggggcgagccaggctacccagggcctagtggcgacgcaggtgcaccgggagtccaaggatacccaggccctccgggaccaagaggtctggctgggaatcggggcgttcccggccaacccgggcgacaaggcgtcgagggtcgcgacgcgaccgatcagcatattgtcgatgtcgccctgaagatgctccaggagcaactcgctgaggtggctgtctcagctaagcgagaggcactgggggctgtagggatgatgggaccaccaggaccgcccggtcctcccggctacccaggaaaacaggggccccacggacaccctggaccccggggggtgccagggatcgtcggggccgtgggtcagatcggcaataccggcccaaaagggaaaagaggagaaaaaggcgaccctggggaagtgggcagaggccatccaggcatgcctggcccaccgggcataccgggactacctggtagaccaggacaggcaattaatggaaaagacggggaccgaggctcacctggggcccctggcgaggcaggacgccccggtctccctgggccagtcgggttgccgggattctgtgagccggctgcctgcctcggggcttctgcttacgcctccgcccgccttaccgaaccgggctcaatcaaaggcccatag

SEQ ID NO: 2513 - DNA, 2055 bp, Artificial Sequence
  Description of Artificial Sequence: Synthetic coding sequence
atggccggtcctagggcatgcgcccccctgctccttctgctgctgcttggggaactccttgccgcagctggggctcagcgggtggggctgcctggtcctcctggccctcccggaccccctggcaaaccaggccaggatggcatcgacggggaagcaggaccaccgggactacccggacctcccggacccaagggagcgcctgggaagccggggaaaccgggggaggcaggtctcccggggcttcccggagtggacggattaaccgggagggacggaccccctggccctaagggtgccccaggcgagcgtggttccctcgggccccctgggcccccaggccttggtgggaaagggctacctggaccacctggtgaagctggcgtttcagggccccccggaggtattgggctaagaggcccccctggcccgtcaggtctgccgggcctgcccggacctcccggcccaccagggccgcctgggcatcccggagtgctgccggaaggggccacagatctgcagtgcccctccatatgccctccaggtcctcccggtccacctgggatgcccggcttcaagggccctacagggtataagggagagcagggcgaagtgggcaaagatggcgagaagggagacccaggaccgcccggccccgccggcctgcccggtagtgtggggctgcagggaccacgaggcctccgcggcctacctggacctttagggccacctggcgatagagggcccatcggatttcgggggcctccaggtatacccggcgcccctgggaaggcaggggatagaggcgaacgaggacccgaagggtttcggggccccaaaggggacttaggcaggccaggtcctaaaggcacacccggtgtagccggacccagtggggagccgggcatgccaggaaaggacgggcagaatggcgttccgggactcgacggtcagaaaggtgaggccgggagaaatggcgcgcccggagagaagggaccgaacggcttacctggtctgcccggcagagcggggtcgaagggcgagaagggggagcgcggcagggctggagagctgggggaggcaggcccaagcggggagccaggcgtccctggcgacgccggtatgccaggcgagcggggagaagctggccaccggggatcggcgggtgccctgggtccacagggtccccctggcgcgcctggagtccggggatttcaaggtcaaaagggctctatgggtgatcccggactgcccggaccccagggcttgaggggcgacgtaggggacaggggaccgggtggcgccgccggacccaaaggagaccagggtattgctggcagcgacggcttaccaggagacaagggagaactcggcccatccggcctcgtcggccctaagggagagagcggatccaggggagagctcgggccaaaagggactcagggccctaatgggacgagtggtgtgcagggagtgcctggcccccccgggccccttggacttcagggggtgcccggcgtgcctggcataaccgggaagcctggagttcccggtaaagaagccagtgagcaacgcatccgggaattgtgcggtggtatgatatccgagcagatcgcgcagctggccgcgcatctgagaaagcccctggccccagggagtatcgggcgccctggtccggcgggtccgcccgggccccctggcccaccaggatccatcggccacccaggcgcgcgggggccccctggttaccgaggccctacaggcgagctgggagatccgggaccacgcgggaaccagggagatcgcggcgataaaggagccgctggcgcgggcctggatggtcccgaaggcgaccagggaccccaggggccccagggtgtgccaggcacctcgaaggatggacaggatggtgcccctggcgagcctggtccccctggggaccctgggctgcctggcgccatcggcgcccagggtaccccagggatctgcgatacgtctgcttgtcagggtgccgtcctgggtggggtgggggagaagtcaggaagtagatctagctag

SEQ ID NO: 2514 - DNA, 576 bp, Artificial Sequence
  Description of Artificial Sequence: Synthetic coding sequence
atgtggtggtcgagcacacagaatgctggaaccgagggtgaggccggacctccaggactccccggtccaccaggccccaaaggcgcaccaggcaaaccgggaaaaccaggagaggccggcctgcctgggcttcctggagtggatgggctgactggccgcgatggcccccctggtcctaagggcgctcccggggagcgcgggagtcttgggccaccaggaccaccaggactcggcggaaagggtctgcccggcccgcctggagaggctggggtgtccggaccacccggagggattggactgcggggccctcccgggccgagcgggctgccagggcttcccggcccaccggggccacccgggcccccaggccatcccggggtactccccgagggagctaccgacctacagtgtccatctatttgcccgcccgggcccccaggcccaccagggatgcccggctttaagggtcctaccggatacaagggggagcagggagaagtggggaaagacggagagaagggcgaccctggaccacctgggcccgcaggactgcccggctctgtgggtctgcagtag

SEQ ID NO: 2515 - DNA, 576 bp, Artificial Sequence
  Description of Artificial Sequence: Synthetic coding sequence
atgtggtggagcagcactcagaatgccgggaccgagggcgaagctggaccaccgggccttccagggcccccaggtccgaagggtgcgccaggcaaaccaggtaaacccggggaagccggattacctgggctccctggggtcgatggtctcacggggcgtgatggtccccccggccctaagggggccccaggggagcgggggtcattagggccgcccggccctcctgggctcggcggcaagggcctgcccggaccccctggagaagctggagtttctggaccccctggaggaatcggattacgcggtcctcccgggcctagcggcctcccggggctgcctggacctccaggacctcccggaccgccaggtcaccctggtgtgttaccagaaggggctaccgacctccagtgcccctcaatctgcccccctggcccgcctggccctcccggaatgccgggattcaaaggtccgaccggttacaagggcgagcagggcgaggttgggaaggacggcgagaaaggcgacccaggccccccaggccccgctggcctgccgggctctgtgggtctgcaatag

SEQ ID NO: 2516 - DNA, 1128 bp, Artificial Sequence
  Description of Artificial Sequence: Synthetic coding sequence
atggggccgcctggcctgcccggcctgaagggcgattccggccccaaaggagagaaaggccaccctggtctcataggtttgatcggtccaccgggtgagcagggagaaaaaggtgaccggggactgccaggccctcaaggcagctctggaccaaaaggtgagcaaggcataaccggcccttccggccctatcggtcccccaggcccgccagggctcccaggccccccaggccctaaaggggccaagggtagctctgggcccacaggtccgaagggcgaagccgggcacccagggcctcctggtccaccgggcccacctggtgaggttatccagcccctgcctattcaggccagcagaacgaggcgcaacatcgacgcatcccagctgttggacgatgggaacggagagaactacgtcgactatgccgatggaatggaagagattttcgggtccttaaatagccttaagctggaaatcgagcaaatgaaacgaccactgggaacgcagcaaaaccccgctagaacgtgcaaggacttgcagttatgtcaccctgatttccccgacggagagtattgggtggatcctaatcaagggtgtagtcgcgattctttcaaagtgtattgtaactttacggctggcggcagcacttgcgtgttcccggataaaaaatcggaaggctccaagatggccaggtggcccaaggagcaaccctccacatggtacagccagtataaaagaggatccctgcttagctatgtggacgccgaagggaacccggttggggtcgtccagatgacttttctgaggcttctttcagcttctgcccaccaaaatgtgacataccactgctaccagtcagtggcctggcaagatgcagcgactgggtcctatgataaggctttgagattcctgggctccaacgacgaggagatgagttacgataacaatccatatattagggcccttgtggacggttgtgctactaagaaagggtaccaaaaaaccgtgctggagattgacacgcctaaagtggaacaagtgcccatcgttgatatcatgttcaatgactttggcgaggcgtcccagaagttcggtttcgaggtcggtccggcgtgctttatggggtag

SEQ ID NO: 2517 - DNA, 5517 bp, Artificial Sequence
  Description of Artificial Sequence: Synthetic coding sequence
atggatgtccacacacggtggaaggcccgcagtgctctccgccctggggctcctctgctgccaccactgcttttactactcctgtgggctcctccccccagtagagccgcccagcccgcggatctgctcaaggtattggacttccacaaccttccagacggcattactaagaccaccgggttttgtgccacaaggcgttcatctaaaggcccggatgtggcatatagggtcacgaaagatgcgcaactgtccgctcctaccaaacagctctatcccgcctccgcttttcccgaagatttctcaattttaaccaccgtcaaggccaaaaaaggatcccaggcatttttagtgagcatctacaacgagcaggggatacagcagatagggctggagcttggtaggtcgccggtctttctctatgaggatcacaccgggaagccaggaccggaggattaccctctgttccgaggcattaatcttagcgacggaaagtggcatcggatcgctctcagcgtgcacaagaaaaacgttacgttgatccttgactgtaaaaaaaagaccactaagtttctggacagaagcgatcatccgatgattgatatcaacggtattattgtcttcggaacgaggatccttgacgaggaggtcttcgagggcgatatccagcagctcttgtttgtgtcagaccatagggctgcctatgactattgcgagcactactcgcccgattgtgacacagccgtgccagacactccacagtcccaggacccaaaccccgatgagtattacaccgagggcgacggcgagggcgaaacttactattatgagtacccatactatgaggacccggaggacctgggaaaggaacctacccccagcaagaagcccgtagaagccgcaaaggaaactaccgaagtgccagaggagctcacaccaaccccaactgaggctgccccaatgccagagacgagcgaaggtgccggtaaggaggaggacgtcgggatcggcgattacgactacgtgcctagcgaggattattatacaccttccccctacgacgatctaacatacggagagggagaagaaaatcctgatcagcctacagaccccggggcaggagcagagattccgacctctactgcagatacctccaattcttctaaccccgctcctcctcccggcgagggggcggatgacctcgagggtgaatttaccgaggaaacaatacgcaacctggatgagaactactacgacccctattacgatccgacctcctcccccagtgagattgggcccgggatgcccgctaatcaggacacaatatacgagggtattggtggtcctcgcggtgagaagggccagaaaggtgagcccgccattatagaaccaggcatgctgatcgaaggacctcctggtccagaagggcccgccggactgcccggcccaccgggaacgatgggacccactggccaggtaggggatccaggcgaaaggggaccccccgggaggccaggacttccaggcgcagacggcctgcccggtcccccagggacgatgctgatgctaccgtttagattcggaggcggcggagacgccgggagcaagggaccaatggtgtcagcccaggagtcccaggcccaggccatattacagcaggctcgactggccctgagaggccccgctggaccaatgggactgacgggaaggcctggcccagtcggaccgccgggaagtggcgggctgaaaggagagccaggcgatgtcggcccgcaaggccctcgaggagtccagggacccccggggccagcaggaaaaccagggcggaggggcagagccggcagcgacggagccagaggcatgcccgggcagaccggacccaaaggagatcgaggcttcgatggccttgccggcctcccgggagagaaagggcatcggggcgatccgggaccatctggtcccccaggcccgccgggcgatgacggggaacggggcgacgatggggaggttggcccccgagggctgcccggagaacctggtcctagagggctcctgggacccaagggaccacctgggccccccggccccccgggcgtaacggggatggacggccagccaggccccaaaggaaatgtaggaccacagggagaaccaggccctcctggtcagcagggcaaccccggcgcccagggattaccaggccctcagggcgccatcggaccgccaggggagaaggggcctctcggaaagcccggccttccaggaatgcccggagccgatgggcctccagggcatcccggcaaagagggtccccctggcgagaaggggggccagggcccccctggtccccaagggccaatagggtacccaggtccccggggcgttaagggggcagacggaattcggggtctgaagggcactaagggggagaagggtgaggacggattcccagggtttaagggcgatatgggaataaaaggcgatagaggggagattgggccgcccggcccccgcggcgaggacggccccgaaggcccaaaaggaagaggcgggccgaacggtgaccccggcccccttggccctccaggcgagaaggggaagcttggggtacctggcctgccgggctaccctggcaggcagggaccaaagggaagcatcggttttcccggattcccaggggctaacggagagaagggcgggcgtgggactcccggaaaaccaggccctcggggccaacggggtccaactggccccagaggcgagcgcgggcccagaggcatcacaggaaaacctggacctaagggcaactccggaggagacgggccagccgggccccccggcgagcgcggccctaacggtccacagggacctactggattcccaggtcccaagggcccccctggtcctcccggcaaggatggacttcccggtcacccaggccagcgaggcgaaaccggattccaagggaaaacggggcctcctggccctccaggcgttgtggggccacagggtcctaccggcgagacggggccaatgggcgagaggggccaccccggccccccaggtcccccaggcgaacaaggactacccgggctggccggaaaggagggaacaaagggcgaccctggccctgccgggttacctggcaaggacggacccccaggacttcggggatttcctggcgatcgaggcctgcctggacccgtgggcgcactgggcctgaaggggaacgaggggcccccaggcccccccgggcccgccggcagtcctggggagcggggcccggccggagcggctggaccaattggaatccccggaaggcctggtccgcaggggcctcctgggccagctggcgagaaaggcgcacctggcgaaaagggtcctcagggccctgctgggagggacggactacagggacctgttggcttacctggacccgctggccctgtggggcccccgggagaggacggcgataaaggggaaatcggggagcctggccagaaaggatccaagggggacaagggggaacagggtccacctggccccacaggcccgcagggacccatcggacagccaggcccaagcggggccgatggcgagcctggtccgcgcggacaacaggggctgttcggccagaaaggggacgagggcccaagaggatttcccggtccgcccggccccgttgggctgcagggcctcccagggcctcccggggagaagggagaaactggggatgtgggccagatgggccctcctggtccacccggacctagagggcctagcggagcccccggagcagacgggcctcagggaccccctggtggcatcggcaatcccggcgcagtcggggaaaaaggagagcccggcgaggccggcgaaccaggattacctggagagggcgggcccccggggccaaagggggagcggggcgagaagggagagtccggcccgagcggggccgcaggtcctccaggaccaaaggggcctcctggcgacgatggcccaaaaggtagccccgggcccgtgggttttccaggtgatcctggcccacctggcgaacccgggcccgccggccaagacggcccccctggtgataaaggagatgatggagaacccggacaaacaggcagccccggccctacgggagaacccgggcctagcgggccacccggtaagcgagggccccctggacccgccggccccgagggccgccagggagagaagggagccaagggagaggcaggcctggagggcccacccggcaaaactgggccaatcggtcctcagggggcgcccgggaagccagggcccgatggacttcgcgggattcctggccctgtgggcgagcagggcttgcctgggagcccagggccagacggtccccccggaccaatggggcctcctggcttaccaggtctgaagggtgactctgggccaaagggggaaaagggacacccgggtctcatcggtctaattggtcctccaggtgagcagggagagaagggagaccgcggcctgcccggaccccagggaagtagtggccccaaaggcgagcaggggatcactggtccaagcgggcctattggccctcccggaccgcctggactgcccggcccaccaggacccaagggcgcgaaaggttcttcagggccgacgggacctaagggagaggcaggtcatccagggccccccgggccacctgggccccccggcgaggtgattcaaccactgcccatccaagcttccaggacacggaggaatatcgacgccagtcagctgctcgacgatggtaatggcgaaaactatgttgactatgccgatggaatggaggaaatctttgggtcccttaactccctaaagttggaaattgagcagatgaagaggcccctgggcactcagcagaaccccgctcggacatgtaaagacctgcagctttgtcatccagatttcccagacggcgagtactgggtggaccccaaccaggggtgtagcagagacagctttaaggtgtattgtaattttacagctggaggaagcacttgtgtcttccctgataagaagtcagagggcgcaaggatcaccagctggccaaaagagaatcctggtagttggtttagcgagtttaagcgtgggaaactactgagctacgtggatgctgagggtaacccggttggagtggtgcaaatgactttcctgagactcctgtcagcctctgcccaccagaatgtgacttatcattgctaccagtccgttgcctggcaagacgccgccactggctcctatgacaaagccctgaggttcctcgggtcaaacgatgaggagatgagttatgataataacccctacatccgcgcgctggtggacgggtgtgctactaaaaagggatatcagaaaactgtgctggaaattgatactccaaaagtcgaacaggtaccaattgtggacattatgttcaatgatttcggagaggcgagtcagaagttcggcttcgaggtcgggccagcctgtttcatgggctag

SEQ ID NO: 2518 - DNA, 633 bp, Artificial Sequence
  Description of Artificial Sequence: Synthetic coding sequence
tgaagaacccggcggaatatcgatgcttctcaactactagacgacggcaatggtgagaattacgtagactatgccgatgggatggaagagatttttggatcccttaatagtctgaaactggagatcgaacaaatgaagaggcccctgggaacacagcagaatcccgcccgaacatgtaaggaccttcagctctgccacccagattttcccgatggggagtactgggttgacccaaatcagggatgtagccgcgattcttttaaagtctattgcaactttacagcggggggctcgacctgcgtgtttcccgataagaaatcagagggatccaagatggcgaggtggcctaaagaacagccttcaacctggtactcacagtacaaaagagggagcctcctgagctatgttgacgccgaggggaatcctgtgggggtagtccagatgacattcttacgcttgttatctgccagtgcccatcagaacgtgacttaccattgctatcaaagcgtggcctggcaggatgctgcaactggctcctacgataaagccctcagatttttaggatccaatgatgaagagatgagctacgataacaacccctacattcgtgctttggtcgacggatgcgcctag

SEQ ID NO: 2519 - DNA, 5238 bp, Artificial Sequence
  Description of Artificial Sequence: Synthetic coding sequence
atgggcaatcgcagggatctgggacagccgcgggcaggcctttgcctgttgctcgccgccctccagctgctccccggcacacaagcggatccagtggacgtactcaaagcgttgggtgtccagggagggcaagccggcgtgccagaagggccagggttctgccctcagcgaacgcctgaaggggatagggcctttaggattggccaagctagcacacttgggattcctacatgggagctgtttccagaaggtcactttccagagaatttctcactgctgataactctgcgtggccagcctgctaaccagagtgtgctcctgtcaatctatgacgagcggggtgcccgccagctgggattggctctggggccagcactgggactgctgggagatcctttccgccctctgccccagcaagtgaatctgaccgatggaagatggcacagggtggccgtgtccatcgacggagagatggttactcttgtcgctgactgcgaagcccagccacctgtcctggggcatggtccgcgctttatctccatcgctggtttgactgtcctaggaacacaagatcttggggagaagacctttgagggagatattcaggagttattaatctctcctgatcctcaggccgcctttcaggcctgcgagcgatacctgccagactgtgataacttggcaccagccgctacagtggccccacagggtgagccagagacgcccagacctagaagaaaaggtaaagggaaaggaagaaaaaaaggacgtggtagaaaaggtaaaggtcggaagaaaaataaggaaatatggacctcaagtcccccgccagatagcgcagagaaccagactagcacggatattccaaagactgaaaccccggcgcctaacctgccgccaaccccgacgcctctcgtcgtgacttcaaccgtgaccactgggctgaatgctaccatcctggagcggtcccttgacccagattcaggcaccgagctcggcaccctcgagactaaagcggctcgtgaagacgaggagggggatgatagcactatggggcctgactttagggctgcggaatacccttcccgcacacagtttcagattttccctggagctggcgagaaaggcgccaaaggtgagccagcagtcatcgagaagggccagcaatttgagggaccccccggggcccccgggccacagggtgtcgtgggaccgagcgggcccccagggccacctggtttccctggtgacccaggccccccggggcctgctggattgcccgggattccagggattgacggcatacgcgggccaccgggcaccgtcatcatgatgccattccagttcgctggcggatcattcaagggtcccccagtgtcctttcagcaggcgcaggcccaggctgtcttgcagcagactcaactcagcatgaagggccctcccggtcccgtgggcctgaccggacgcccaggacctgtaggactcccaggccacccggggctcaaaggtgaggaaggggccgaagggccacagggtccccggggcctccagggccctcacggcccgcctggccgcgtgggcaaaatgggtaggcccggggctgatggcgcccgcgggctgccaggcgataccgggccaaagggtgatagagggttcgacggcctgccagggctgcccggcgaaaagggccagcgtggcgattttgggcacgtgggacagcccgggccacccggtgaagacggagagcgcggggccgaaggaccaccaggcccaactgggcaagcaggggaacctgggcctagggggctgttgggccctcgcgggtcacccgggcccacggggcgccccggcgtgacaggaattgacggcgcgcctggagctaaagggaatgttgggccacccggtgagccaggacctcccggccaacagggtaatcacgggagccagggtttacctggaccccaggggctgatagggacccccggcgagaagggccctcccggtaaccccggtatccctggtctaccaggtagcgatggacctctgggacatccgggccacgagggccctaccggagagaaaggggcacaaggtccccctggcagtgcaggacccccagggtatcccggaccgaggggggttaaaggaacctcaggcaacaggggcttacaaggggagaagggcgagaagggcgaggacgggttccccgggttcaaaggagatgttggcctcaaaggagaccagggaaagccaggcgccccaggccctaggggtgaagacggacctgaaggtcccaagggccaagcaggtcaagcgggcgaggaaggaccgccgggctccgcgggagaaaagggcaaactcggcgtccccgggctgcccggatacccaggtagacctggccccaaaggcagtatcgggtttcccggacctctgggcccaatcggggaaaaaggcaaatccggcaaaacaggacagcctgggctggaaggtgagcgcggaccccccggctcgcgaggggagcggggccaacctggtgcaactggacagcccgggccaaaaggagacgttggccaggacggcgccccgggtattcccggtgaaaaggggctgcctggcttacagggtccgcccggatttccgggtccaaaaggacctccaggacatcagggaaaagatggtcggcctggccacccgggtcaaaggggcgaacttgggtttcaaggtcaaacagggccgcccggacccgcaggggtccttggtccacagggcaaaaccggagaggtaggccctcttggagagcgagggcctcctgggccacccgggccacccggcgagcaggggttacctggccttgagggaagagagggggcgaagggcgagctgggccctcctggcccactcggtaaagagggaccggctggtcttcgggggtttcctggcccgaagggtggcccgggtgacccgggccctaccggccttaaaggcgataagggacccccgggccccgtgggagctaacggctctcctggcgagcgggggcctcttggcccagctggaggaatcggattgccaggccaaagtggatctgagggaccagttggacctgcggggaagaaaggctctcgtggggagcgaggcccaccaggccctactggcaaggatggcatccccgggccgctgggccccctgggcccgcccggggctgccggacctagcggggaggagggcgataaaggggacgtgggggcacctggacataagggtagcaaaggcgacaagggtgatgccggcccacccggtcagcctggaattcgggggccagcaggtcacccaggaccaccgggtgctgacggcgcacagggacgccgagggccccctgggctgttcgggcagaaaggggacgacggcgtgaggggatttgtaggggtgatcgggcccccaggcctgcagggtcttcccggacctcccggagaaaaaggggaggttggggacgtggggtcaatgggaccccacggagctccaggccctagaggtccccagggcccgactggctccgaaggcaccccgggacttcctgggggggtcggtcaacctggagcggtgggggagaaaggggaaaggggagatgcaggcgacccaggacctcctggtgcgccaggcatccctggtccgaagggggacattggggagaagggagattcaggaccatctggtgcagccggccccccgggaaagaaaggccccccgggggaggacggtgccaaaggttccgtgggacctactggcttgcctggggatctgggaccgcctggcgaccccggcgtgtccggtatcgatggatctcctggtgagaagggagaccctggtgacgtcggcggacctggtcccccaggcgcttcaggtgagccaggagcccccggaccacccggcaaacggggcccaagcggtcatatgggtagagagggcagagaaggcgagaaaggtgccaagggggaacctgggcccgatggtccgccaggacggactggcccgatgggcgcacgtggtccgcccggccgtgtgggtcccgaagggctgcgcggaatcccgggccctgtgggcgaaccaggcctcttgggcgcccctggacagatgggccctcctggccccctcggcccttctgggctgcccggcctaaaaggggataccgggcctaaaggcgaaaagggacacatcggtttgatcgggttaattgggcccccaggagaagctggcgaaaagggcgaccaaggactgccaggggttcaaggcccgcccgggcccaaaggggaccccggtccgcctggccccattggctctcttggacaccctggcccaccaggggtggctggcccacttggtcagaaggggtctaagggttcccctgggtccatgggacccagaggagatactgggccagccggaccccctggaccgccgggggctcccgcggaactgcatgggttaagacggaggcggagatttgtgccagtcccgctcccagtggtggaaggcggacttgaggaggtgcttgcatccctcacctctctgtcactggagctggaacagctgcgacgccccccgggcactgcagagcggccaggcctcgtctgccatgaactgcaccgcaatcatccccatcttccagatggagagtattggattgatcccaatcagggttgcgcccgagactcatttcgggttttctgtaattttaccgcggggggggagacctgcttatatcccgataagaagtttgagattgtcaagctggcatcatggagcaaggagaagccagggggctggtacagcacctttcgaaggggcaagaagttcagctatgtagacgccgacggcagccccgtaaatgttgtccagctgaatttcctgaagctgctctctgctacagccagacagaacttcacatacagctgtcagaacgctgcagcttggctggacgaggctacaggagattatagccattcagctaggtttctgggcaccaacggagaggaactcagcttcaaccagacaactgcagcaacagtgtcagtgccacaggacgggtgcaggctacgaaaagggcagaccaagacactgtttgaattttcttccagccgcgctggtttcttgcccctctgggatgtcgccgccaccgattttggccagacgaatcagaaattcggctttgagctcggaccagtttgcttcagttcgtag

SEQ ID NO: 2520 - DNA, 9534 bp, Artificial Sequence
  Description of Artificial Sequence: Synthetic coding sequence
atgagaaagcacagacacttgccgttggtggcagtgttttgtctgttcctgtccgggtttcccaccacccacgcacagcaacagcaggcagatgtgaagaacggagcagctgctgacattattttcttagtggatagctcgtggacgattggtgaggagcattttcagctggtcagggagttcctgtacgacgtggtgaaatcactcgctgtcggcgagaatgacttccacttcgctctggtccagttcaatggaaacccacacaccgaatttctgcttaacacttacagaacaaagcaagaggtgctctcccacatttcaaatatgtcatacatcgggggaaccaatcaaacaggaaaaggcctggaatacatcatgcagtcccaccttacgaaagccgccggatccagggcaggcgatggggtcccacaagtgattgtggtgctcaccgacggccactctaaagacggtctggcactaccgtccgccgaactcaagtcagccgacgttaacgtttttgcgatcggagtcgaggatgccgatgagggcgccctgaaggaaattgccagcgaaccactgaacatgcatatgtttaaccttgaaaatttcacctccctccatgacattgtggggaatcttgtgagctgcgttcactccagtgtgtctcccgaaagagcgggggacaccgagacgctcaaagatatcacggcacaggatagcgccgatatcatctttttgattgacggtagcaacaacaccgggagtgtgaactttgctgtgatcctggactttctggtgaacctcctcgaaaaattgccaatcggaacccaacagattcgcgtcggagtggttcagttttccgacgagccacgcactatgttctcccttgatacctattccaccaaggcacaggtgctgggagccgtgaaggctctcggcttcgctgggggtgagttagcaaatataggacttgccctcgattttgtagtggaaaatcacttcacacgagcggggggaagccgggtggaggaaggggtgcctcaggttctcgtactaatctctgccgggccctcaagcgatgaaataagatacggcgttgtggccctgaagcaggcaagtgtgtttagtttcggcctgggggcacaagctgcttcccgcgccgagctacagcacatagctaccgatgataacttagtgttcaccgtgccagagttccggagcttcggagacctgcaagaaaaactgctcccctatatagtaggcgtggcgcagaggcacatagtcctgaagccaccaaccatcgtgacgcaagtgatcgaagtgaataagagagatattgtctttctggtggacggaagtagcgcactcggattggctaatttcaatgctattcgcgatttcatagcaaaggtaatacagcgactcgaaattggtcaggatctcattcaggtggcagttgcacagtacgccgacacggtgaggcccgagttttattttaatacgcacccaaccaagcgtgaagtgattactgcagtccggaaaatgaagcctctggatggcagcgcgctgtacacagggagcgctcttgattttgtaagaaacaacctcttcacctccagcgcaggatatagggccgctgagggcatccccaagctgcttgtgctcatcaccgggggcaaatctctcgatgaaatatcacagcccgcccaggaactgaaaagaagcagtatcatggcttttgctattggaaataagggtgcagaccaggccgaactcgaagaaatcgcctttgattcctccttggtctttattccagctgagttccgggcggcacctctgcaggggatgctgcccggtcttctggcaccgcttcgtaccctgtccggaaccccagaagtccactctaataaacgcgatataatctttttgctggacgggtccgccaacgtgggcaaaacaaattttccttacgtgcgcgacttcgtcatgaatttggttaattcactggatattggtaatgataacataagagttgggttagtgcagttctccgatacacccgtcaccgagttctccctgaatacttaccagacaaagagcgatatcctcggtcatctcaggcaactccagctgcaaggcgggtcagggctgaacactgggtccgcactaagttacgtatacgcaaaccatttcaccgaggccggcggcagtaggattcgcgaacacgtgcctcaactccttctgctgctcacagccggtcaaagtgaagattcttacttgcaagccgccaacgccctgacgagagccggtatcttaactttctgtgtgggggcctcccaggccaataaggcggagttagagcagatagcctttaacccttcactggtctatcttatggatgatttttcctcactgcccgccctcccccagcagctcatccagccccttaccacatacgtgagcggcggcgtggaggaggtgcctttagcgcagccagagagcaaaagagatattctatttctctttgacggctccgctaatctggtcggtcagtttccagtggtgcgcgacttcctgtataaaatcatagacgaacttaacgtcaagcccgagggcacacggatagccgtagctcagtactctgatgatgtcaaggtggagagccgatttgatgagcaccagtcaaagcccgaaatcctgaatcttgtgaagaggatgaagatcaagacaggaaaggcccttaacctgggctatgcgcttgattatgcccagaggtacatattcgttaaaagcgccgggtccagaatcgaggacggagtgttgcaatttctagttttgctggtcgccggtcgctcctccgatagggtagatggccctgcgtctaatttaaagcagtcaggcgtggtgccatttatctttcaggctaagaatgccgatcccgccgaactggaacagatagtcctgtcacccgcatttatcctcgctgctgaaagccttccgaaaatcggtgatctccacccccagatcgtgaatctgctgaagagcgtccacaacggggccccagcacctgtttctggcgagaaagatgttgtgttcctgctggatggatccgagggcgtccgcagcggatttccactgctgaaggagtttgttcagcgggtagtcgagtctctggatgtgggacaggatcgtgtgcgggtcgcagtggtccagtacagcgaccgcaccaggccagaattttacctcaactcatacatgaataaacaagacgtggtcaatgccgtcagacaattaacgctgctgggtggccctacccctaacacaggagcagcactggaattcgttctgcgcaatatcctcgtgagctctgccggaagcagaatcacagagggagttccccagttgttgatcgttcttacagcggaccgatcaggagatgatgtaaggaaccccagcgttgtggtaaagcgaggaggagccgtgcccataggtattggcattggcaatgcagacatcaccgaaatgcaaacaatctcattcattccagattttgctgttgccattcccacatttagacagttaggcactgtccagcaggtgatttccgaaagagtaactcagctgaccagagaggaattgtcgcgcctgcagcccgtgcttcagccacttccctcacctggggtaggcggcaagagggacgtagtgtttttgatcgacgggagccagtcggccgggcccgaattccaatatgttagaactctcattgagcggctggtcgactacctggatgtgggctttgataccacaagagttgctgtgattcagttttctgacgaccccaaagtagaatttctgctcaatgctcattcctctaaagatgaggtccagaacgccgtgcaacggctcaggcctaagggaggtcggcagataaacgttgggaatgccctcgagtacgtctctcgcaatatctttaagcggccactagggtccaggatcgaagagggggtgccacagttcctggttcttatttcgtctggaaagtctgatgatgaggtagacgatccagcagtggaacttaaacaattcggcgtggcaccttttacaattgctcgcaatgctgatcaagaggaactcgtaaagatttccctgtcacccgagtatgtatttagtgtctcaacttttagagagctgccatcactggaacagaaattgttgactccgatcacaacactgacaagcgagcagatccagaagctgttggcctccactaggtatccgccacccgctgtggaaagtgatgccgccgacatcgtctttttgatcgattccagcgaaggcgtcagaccagacggttttgcccacatcagggattttgtgagcaggatcgttcgtaggttaaacatcggaccatccaaggtcagggtcggcgtggtgcagttttccaatgacgtattccccgagttctacctgaagacgtatagatctcaggctcctgtgctcgatgccatccggaggctccgcttaagaggaggatctccactgaacactgggaaggcgctggaatttgtggcacggaacctctttgtcaagagcgcaggtagtcgaatcgaagatggagtcccgcagcacctggtgctggtgctgggtggtaagtcccaggacgatgtatccaggttcgcccaggtgatacggagcagcgggattgtgtcccttggcgtcggtgatagaaacatcgaccggactgagctacagaccatcactaacgacccgaggctggtattcaccgtgagagagttccgagagttacctaacatagaagaacgaatcatgaattcttttggccctagcgccgctacacccgcaccacctggagtcgataccccacccccctctaggcccgagaagaaaaaggccgatattgtgttcctgctggacggctcaatcaattttcgaagagactctttccaagaggtgctccgtttcgtctccgagatcgtggacacagtgtatgaggatggtgactccattcaagtgggcttagttcaatataatagcgacccaacagatgagttctttttaaaggacttcagtaccaagcgacaaattattgatgccattaacaaggtggtatacaagggaggaaggcacgctaacactaaggtgggactggagcatctgcgcgttaaccacttcgtgccagaggccggctcgaggttagaccaacgcgtgcctcagatcgcattcgtgattaccggcggtaagtcagtggaggatgcccaagatgtgagccttgcgcttacacagcgcggggtcaaggtgtttgccgtgggcgtgaggaatatcgactccgaagaggttggaaagattgcaagtaacagcgccaccgccttccgagtcgggaacgtccaggaactgagcgaattgagcgaacaagtgctggagacattgcacgatgctatgcacgagacactctgccccggagtgactgatgcagccaaggcttgtaacctcgacgtcattctgggcttcgacgggtcccgagaccagaatgtattcgtggcacagaagggatttgagtcaaaagttgatgccattctgaatcggatctcccagatgcatcgtgtgagctgcagcggtggtcgcagtcctaccgtgcgcgtttcagtggtcgctaatacccctagcgggcccgtggaggcctttgatttcgacgagtatcagcctgaaatgctggaaaaatttaggaacatgcggtcacagcacccatacgtgctgacggaggacaccctgaaggtgtatctgaacaaatttcggcagtcttcaccagattccgtgaaagtggtcattcacttcacagacggcgcggacggcgatctggcggacctccatcgcgctagtgagaacttgaggcaggagggcgtgagggctttgattctggtgggcttagagagggtggtgaaccttgaacgcctgatgcatctggagttcgggaggggatttatgtatgacagacccctgaggctgaatctgctggacctagattacgagttggccgagcagctggacaacatcgccgagaaggcatgctgcggcgtcccctgcaagtgttcaggccaacgtggcgatcgggggccaatcggaagtataggaccaaagggcattcctggggaggacggttaccgcggctaccccggagacgagggcggaccaggggagagggggcctcctggcgtgaatggtacacaaggtttccagggatgtccaggccagagaggcgtaaaagggtcccgtgggtttcctggcgaaaagggcgaggtaggcgagatcggcctagatgggctggatggtgaagatggggacaaggggctcccaggcagctcaggagaaaagggaaatccaggccgtcgcggcgacaaaggccccaggggcgaaaagggtgaacgcggagacgtcggcatccggggcgaccccggtaaccccgggcaggatagccaggaacgcggaccaaaaggggaaaccggggacctcggcccaatgggagtgcccggaagagacggagtcccaggaggtccgggtgagacaggtaagaacggtgggtttggcagaaggggacctcccggtgccaaggggaataagggtggcccaggccagccgggctttgagggagagcagggcactagaggcgcccagggtccagcaggacccgccggaccccccggattgatcggggagcagggcatttccgggcctagaggaagcggaggcgccgccggcgccccaggcgaacgtgggcgcactggtcctctcggccggaagggtgagcccggagagcccggccccaaaggaggaattggaaaccgcggcccgcggggagagaccggagacgatggaagggacggcgtgggctccgaaggacgaaggggcaagaagggagagcgcggattcccaggctaccctggtccaaagggaaatcctggggaacctggactcaacggcactacaggccccaagggtattagagggcgcaggggcaattctggtccacctggcatagtgggccagaagggcgatccgggttatcctggtcctgccggccccaaaggtaacaggggtgacagcatcgaccagtgcgctctaatacagtccatcaaggacaagtgcccctgctgctacggcccactggagtgccctgtgttccctaccgagctggctttcgctctcgatacttcagagggtgtcaaccaggatacttttgggaggatgcgggatgtcgttctcagcatcgtcaatgatttaaccattgccgaatctaattgcccccggggcgccagagttgctgtggtcacttataacaacgaggtcacaacagaaattcgctttgccgatagcaaacgaaaaagtgtgttgctcgacaagattaagaacctgcaggttgccttgacttccaagcagcaaagcctggagactgcgatgagcttcgtggcaaggaacaccttcaagagggttagaaatggatttctaatgcgcaaagtggcggtgtttttctcgaatactccgacgcgagcttccccccagctgcgcgaagccgtcctcaagctaagcgatgcaggcatcacacctctgtttttgacaaggcaggaggatcgccagttaatcaacgcacttcaaattaacaacacagcagtgggccacgcccttgtgctccctgcgggcagggacctgaccgacttcctggagaacgtcctcacttgtcacgtttgtcttgatatctgcaacattgatcccagctgcgggtttggctcatggaggcccagttttagggacagacgcgctgctggctccgacgtggatattgacatggccttcattctcgactcggctgagaccaccactctgttccagttcaatgagatgaaaaaatacattgcttatctggtgagacagctggatatgagcccggaccccaaggcctcccagcacttcgctcgtgtggcagtcgtgcagcacgcaccatcagaatctgtggataacgcttccatgccgccagtgaaagtcgagttttctcttacagactacggcagtaaggaaaaattggtggactttctctcacgtggaatgacccagctgcagggtactcgggctctcggcagtgctattgagtatactatcgagaacgtttttgaatcagcgccaaaccccagggatctcaagatagtcgtgctgatgttgaccggggaggtccccgagcagcagctcgaggaggcgcagcgcgtgattctgcaagctaagtgtaagggctacttcttcgtcgttctgggaataggccgcaaggtgaatattaaagaggtgtataccttcgcctccgaacctaatgatgtctttttcaaacttgtcgacaagagtactgaactgaacgaggaaccgctgatgcggttcggcaggctgctgccctcgtttgtaagtagcgagaacgcgttctatttgtctcctgacattcgcaagcagtgtgattggttccaaggagaccaaccaacaaaaaacctggtgaaatttggccataagcaagtgaatgtgcctaacaacgtaacctcatctccgacgagtaacccagttactacaaccaagccggtgactacaactaagccagtcacgactaccactaaacctgtgaccacaacaaccaaacccgttactattataaatcagcccagtgtgaaacccgccgccgctaagcccgctcccgcgaaacctgtggctgctaaacccgtggctacaaaaatggcaaccgtgcgccctccagtggcggtgaagcctgctaccgctgctaaaccagtggcggccaagcctgctgccgtgcggccacccgccgcggccgctgctaaaccagttgctacaaagccagaagtccctcgcccccaggcagccaaaccagcagccactaagcccgctacgactaaacccatggtgaaaatgtcccgcgaggtgcaagtgtttgagattaccgagaactcggccaagcttcattgggagcgcgccgaaccgcccggcccatacttttacgacttgacagtgacatctgcacacgatcagtctctggtgcttaagcaaaacttgacagtgacagatagggtaattggcggcctcctggcaggacagacctatcacgtggcagttgtgtgctatctgagatcccaagttcgagccacctaccacggtagcttcagcaccaagaagagtcagccccctcctccccagcccgcacgttcggcgagctctagtaccataaatctcatggtctccacggagcccctggcactgaccgagacagatatttgcaagctccctaaggacgaaggcacctgcagagattttatcctgaagtggtactacgatccgaacacgaagtcctgcgcccgtttttggtacggtggctgtggcggcaacgagaataagtttggatcccagaaggaatgtgagaaggtctgcgcacccgtactcgcaaagcccggagtgattagcgttatgggcacctag

SEQ ID NO: 2521 - DNA, 8934 bp, Artificial Sequence
  Description of Artificial Sequence: Synthetic coding sequence
atgagaaagcatcgtcatttaccgctcgtggccgtcttttgtttatttctctcaggtttccctaccactcacgcacagcaacagcaggctgacgtgaaaaacggggctgctgccgacattatctttctggtcgactccagctggactattggagaggaacatttccaactcgtgcgggaattcctttatgacgtagtaaaatcactcgccgtgggggagaatgactttcactttgccctggtccagtttaacgggaatccacataccgagtttcttctgaacacttataggaccaagcaggaggtgctgtcgcacattagcaatatgagctatattggaggaactaaccaaaccggcaaaggtctggaatatattatgcagtcacatttgacaaaagctgccggctctagagccggcgacggggtgccccaggttattgtggtgctgactgatggccattcaaaggatgggctcgcccttcccagtgcagagcttaagagtgccgacgtgaatgtgtttgcgatcggggtggaggatgctgatgaaggggcactgaaggaaattgctagcgaacccttaaatatgcacatgtttaatctcgaaaacttcacctcccttcacgacattgttggtaatctggttagctgcgtgcactcgtctgtctctccggagagggcgggcgacactgaaacattaaaagacatcactgctcaggacagcgcggatattatttttcttatcgacggctccaataatacggggtctgtcaactttgccgtgattctggactttctagtcaacctccttgaaaagttgccaattggtactcagcaaatccgagtcggagtcgtccagtttagtgatgagcctaggaccatgttcagtctcgacacttatagcaccaaagcgcaagtgcttggagccgtcaaggcactgggtttcgctgggggtgagctcgctaatatcggattggctctggactttgtcgtggagaatcattttactcgcgcaggaggatcacgtgtggaggagggcgtccctcaggttctggtcttaatctcagctggaccgtctagcgacgaaattcgatatggtgtagtagccctgaagcaggccagcgtgttctcatttggcctgggggcccaagctgcatcacgtgctgaactgcagcacatcgccacagatgacaatcttgtgtttactgtccccgagttcagaagcttcggagacctgcaggaaaagctactcccatacattgtcggcgtcgctcagcggcacatcgtgcttaagccacctacaatagtcacgcaggttattgaggttaacaaaagggatatcgtgtttttagtggatggcagcagcgcactgggacttgctaactttaatgccatcagagatttcatcgcgaaggtgatccagagattagaaatcggacaggacctgattcaggtggcagtggctcagtacgccgatactgttcggcctgaattttacttcaacacacatccaactaaacgggaagtcataactgctgttcgcaagatgaagccactcgacgggtcagctctttatacaggctctgcactggactttgtgaggaacaatctgttcactagctccgcgggttatcgtgccgcggaggggatacctaagttgctggttttaatcaccggtggaaagagcctggatgagatatcccagccggctcaggagcttaagcgttcctcaatcatggccttcgctatcggaaataaaggcgctgatcaggccgaactcgaggaaattgcctttgattcttccctcgtttttatcccggcagaattcagagctgccccacttcagggaatgctacccggtctgctcgcccctctgcgtaccctgagcggaaccccagaggaaagcaagagagatatcctcttcttattcgacggctccgccaatcttgtgggacaattccctgtcgtacgcgactttctttacaagatcattgacgagctcaacgtcaagcctgagggaactagaatcgctgtggctcagtacagtgatgatgttaaggttgagtcgcgctttgacgaacaccagagcaagccagagatcctcaatctggtgaagagaatgaagatcaagactggaaaagctctgaatttaggatatgccctggactacgcccagaggtacattttcgttaaatctgcaggctcacgcatcgaagatggagtgctgcagttcctggttctccttgtcgccggtcggagctcggaccgggtagacggacctgcatccaatcttaagcaatccggagtggtaccgttcattttccaggccaagaacgcggaccctgctgagcttgaacaaattgtcttgagccctgcattcatacttgcagctgagtccctgccaaaaattggcgatcttcacccacagattgttaatctgcttaagagcgtgcacaacggagcgcccgcacctgtgtccggagaaaaagatgttgtttttctactggacggatccgagggagttcggtctggcttcccactgctgaaagaattcgttcagcgggtggtggagagcttagatgttggccaggaccgtgtcagagttgctgtcgtccagtattcggaccggacccgccctgagttttacctcaactcatatatgaataagcaggacgtggtgaacgcggtccgtcagctcaccctcttgggcgggcctacccctaacaccggagcagcactggaatttgtgcttcgtaatatactggtgtcaagcgccggttctcgcatcaccgagggtgttccccagctgctgatcgtgctcacggccgatcgaagcggcgacgatgtcaggaacccaagcgtcgttgtgaaaagaggaggtgctgttcctatagggattggcatcggcaacgccgatatcactgagatgcagactatctcctttataccagattttgctgttgccatacccacatttagacagctaggaactgtgcagcaagtcatcagtgagcgagtgacacaactgacacgggaggagcttagcagactccaacccgtcttacaacctctgccatcccccggggttggcggtaaaagggacgtggtcttcctcattgatggatcgcagagtgccggtcctgaatttcagtatgtgcgtacactaatcgagcgcttggtcgactatttggacgtgggctttgacaccacacgcgtggcagtcatccagttcagcgacgaccctaaggtggaatttttactgaacgcccacagctcaaaggacgaggtacagaatgccgtacaacgtttacgacctaagggaggcagacagataaacgtgggtaatgccctcgaatacgtgtccagaaacatatttaaacgaccactcggcagcaggatagaggaaggtgtcccccagttcttggtgctcatcagctcaggcaaatctgatgacgaggtcgatgatcctgcggtggagttaaaacaattcggggttgctcctttcactatcgcgagaaatgctgaccaagaagagcttgtgaaaatcagcctctccccagaatacgtgttctcagtttcaaccttcagggaattgccttctctggagcagaaacttttgacccccatcaccacgcttactagtgaacaaatccagaaattgctggcctctacccgctacccccctccagctgtggaatccgatgccgccgatatcgtattcctgatcgacagttccgaaggtgtgcgcccagacgggtttgcccacattagagactttgtttccaggatcgtcaggcggctcaatattgggccctcaaaagtacgggtaggcgtagttcagttctcaaatgatgtctttccagagttttatctcaaaacctatagatcccaggctccggtgcttgacgccataaggaggctcaggctgagaggaggatctcccctaaatactggaaaggccctcgagttcgttgctagaaatctcttcgtgaaatcagcaggctcaagaatcgaagatggggtcccacagcacctcgtgcttgttctggggggaaagtcacaggatgacgtgagtagatttgctcaggtcatccgctcttcgggcattgtgagccttggagtgggagaccgcaacattgatcggacagagctgcagacgatcactaatgacccgcgcctcgtcttcaccgtgagggagtttagagagctgcctaatatcgaggaaaggatcatgaactcttttgggccgagcgcagccacaccagctcctccaggggtagatacgcctccccccagtcgcccggagaagaagaaagccgatatcgtttttctgctagacggctcaatcaacttccggcgtgattctttccaggaagtgctgagatttgtctctgagattgtggacaccgtttacgaggatggtgactccatccaggtaggactggttcagtataatagtgatcccaccgacgaattctttctgaaagattttagcacgaaacggcagattattgacgctataaacaaagtcgtctacaaggggggccggcacgccaatacgaaagtcgggctagaacacctgagggttaatcacttcgtgccggaggccggtagcaggttggaccaacgagtccctcagatcgcctttgtcatcacggggggtaaaagcgttgaagatgcgcaggatgtatccctggctctgacccagagaggagtgaaggtgtttgctgtgggggtacgcaatattgacagcgaggaggttggcaagattgcttctaactctgcgaccgcgttcagggttggaaacgtccaggagctgtcggaactgtctgagcaagtgttagagaccctccatgatgccatgcacgaaacattgtgccccggcgtcaccgatgctgccaaagcgtgtaatctggatgtgattctgggatttgatggctctcgcgatcagaatgtcttcgtcgcccagaagggattcgagtctaaagtggatgccattctgaaccgaatctcccaaatgcacagggtgtcctgtagcggcggcagatcccccacagtgcgagtaagcgtggtggccaacacaccttcagggccagttgaggcgtttgatttcgacgaataccagcccgaaatgctggagaagtttaggaatatgcggagccagcacccttatgttctcactgaagacacccttaaggtgtacttaaataagtttaggcagtcatcacccgactcggtcaaggtcgtaattcattttacagatggggcagatggcgatctcgcagatctacatcgcgcttccgagaaccttaggcaggagggcgtgagggccttgatcctggtgggactagagcgtgtggtcaacctggagaggctcatgcaccttgagttcggcagaggcttcatgtatgaccgcccgcttcggttaaatttgttggatctggactacgaactggccgagcaattggacaacattgccgagaaggcttgctgcggagtcccatgtaaatgctcaggtcaacgaggcgaccggggcccgattggcagtatcggaccgaaggggattccaggtgaagatggatatagagggtatcctggcgacgaggggggtccaggggaacgagggcccccaggagtcaacggaactcagggatttcagggctgtcctggacagaggggcgtcaaagggtctcgcggctttcccggggagaagggagaagtcggcgaaatcgggttagatgggctggatggggaggacggagataaaggccttcccgggtctagtggcgaaaaagggaatccaggacggagaggagacaaaggaccgagaggagagaaaggcgaaaggggggacgttgggatccggggtgaccccgggaatcctggccaggacagccaggagaggggcccaaagggagagactggtgaccttggtcccatgggggtgcctggcagagatggcgtgcccggcggccccggtgagaccggtaaaaacggcggttttggtcggcgcggccctcccggcgcaaagggaaacaaggggggccccggccagcccggctttgagggcgagcaggggacaaggggcgcccagggaccagctggtccggccggccctccaggcctgatcggcgaacaagggattagtgggccccggggtagcggtggtgcagctggagcgcctggtgagagagggagaacaggacctttagggagaaaaggggaaccaggcgaacccgggccaaagggcggaattggaaacaggggaccccgcggagagacgggagatgatgggcgcgatggggtgggcagtgaaggcagacgtggaaaaaaaggcgagagaggattccccggctaccctgggccgaaaggaaaccccggggagcccggcctgaatggaacaacgggacccaaaggtattcgaggtcgaaggggcaactcgggaccacctggtatcgtgggccaaaagggtgaccccggttacccaggaccagccgggccaaaaggaaaccgcggcgactctatcgatcagtgtgccctgatacagtcaatcaaggataaatgcccctgctgctatggaccactagaatgtccagtgtttcctaccgaattggccttcgctttggacacaagtgaaggtgtgaaccaagacactttcggacggatgagggacgttgtgctgtccatcgtgaatgatcttaccatcgccgagtcaaattgcccaaggggggctagggtggccgtcgtcacttataataatgaggtcaccaccgaaattcggttcgcagacagcaaaaggaaatctgtgctgttagataaaattaagaatttgcaagttgctttgactagcaaacagcaaagtctcgagactgcgatgtcttttgttgcaaggaatactttcaagagagtccgcaacggattcctcatgcgtaaggttgccgtcttcttcagcaataccccaacccgcgcgagtcctcagctcagagaggccgtcctgaagctgtctgacgcagggattacgcccctgtttctgaccaggcaggaggatcgtcagctgatcaatgccttgcagatcaataatacggccgtgggccacgccctcgtcctgccagcaggcagagacttgacagattttctcgagaacgtcttgacttgtcatgtgtgcctcgacatctgtaacattgacccgtcttgcggatttggatcctggaggccctctttccgtgaccggcgggcagctgggtcagacgtcgacattgacatggcctttatcctcgatagtgctgaaacgactaccctctttcagttcaatgaaatgaagaagtacattgcatacctggttcgacaattggatatgagccccgaccccaaggcaagtcagcatttcgcccgcgtggccgttgtgcaacacgccccctcagagagcgtggacaacgcgtcaatgccccccgttaaggtggaattctccctcaccgattatggcagtaaggaaaaactggtggacttcctgtctaggggaatgactcagttgcagggcaccagagcacttggatcagctatcgaatacactattgaaaacgtgttcgagagtgccccgaacccccgcgacttgaagatcgtcgttctcatgctgacaggcgaggtacccgaacagcaactggaggaagcacagagagtcattctgcaggccaaatgtaagggctatttctttgtggtactgggcataggacggaaagttaacattaaagaagtgtatacttttgctagcgagcctaacgacgtcttcttcaaacttgtggacaaatctacagagctgaacgaggaaccactgatgaggtttggtcggctcctgccatccttcgttagttcagaaaatgccttctacctgtcccctgatatccgaaagcagtgtgactggttccagggcgatcagcccacaaaaaatctggtcaagtttggtcataaacaggtgaacgtccctaataacgttacaagctcacctacctcaaaccctgtaaccactaccaagccagtgacaactaccaagcccgtcacaaccaccacaaaacccgttaccacaacaacaaagccggtcacgataattaatcagccaagtgtgaagcctgctgccgcgaagcctgctcctgctaagcctgtcgccgcaaagccagtggccaccaagatggcgacagtgaggcctcctgttgccgttaagcctgcgacggctgcaaagccagtggctgcgaagccggccgccgttcggccaccagccgccgccgctgcaaaacccgtggccaccaaaccagaagtcccgagaccccaggccgcgaaacccgcagcaacaaagccggccacgactaagcccatggttaagatgtcaagagaggtgcaagtgtttgaaatcacagagaactctgcaaagctccattgggaacgggcagagccaccgggtccttatttttacgacctgactgtaacgtccgcacatgaccaaagtctagtcctgaaacagaatttgaccgtcaccgatagggtcatcgggggcttgttagccggccagacctaccacgtcgcggtggtctgttatctgagaagccaggttcgagcaacatatcacggctccttcagcactaaaaaaagtcagccgcctccgcctcaacccgctagaagtgcaagctccagcacaattaacctgatggtgtcaacagaaccattggccttgactgagacagatatatgcaaattacctaaggatgaaggcacgtgccgtgactttatcctgaagtggtattacgacccgaacactaaatcttgtgcccgattctggtatgggggatgcgggggcaatgagaataagtttgggagccagaaagaatgcgagaaagtttgcgctccggttttggccaaaccgggcgtgatctctgtgatgggtacttag

SEQ ID NO: 2522 - DNA, 8931 bp, Artificial Sequence
  Description of Artificial Sequence: Synthetic coding sequence
atgcgcaagcacagacatctgccactggtggccgtgttctgccttttcctgtctgggttccccactacacacgcacaacagcaacaggcagacgtgaaaaacggggcggccgctgatatcatttttctggtagactcttcctggactattggagaggagcattttcagttggtgcgggaattcctgtacgatgttgtgaaatcgttggccgtgggtgaaaacgatttccatttcgccctcgtacagtttaatggaaaccctcataccgagttcctcctgaatacctacagaaccaagcaagaggtgctatcccatatctcaaacatgagttatatcggcggcaccaatcaaaccggcaagggcctggagtatatcatgcagtcacacctgactaaagcagctgggtccagagccggcgatggagttccccaagtaattgtggtcctcacggatggtcactctaaggatggccttgctctcccttcagccgaactcaagagcgcagacgtgaatgtgttcgccatcggggtggaagacgctgatgagggtgcacttaaggaaattgcttccgagccgctgaacatgcacatgttcaatctggagaatttcactagcctgcacgacattgtaggtaacctcgtgtcctgcgtccactcatcagtttcccctgaaagggcaggcgacaccgaaaccttaaaggatattacggtgatcgaagtcaacaaaagggacatcgtctttctggttgatgggtccagtgcactgggtctggccaacttcaacgccatccgggatttcatagcgaaggtcattcagcgactcgagataggccaggacctaatccaagttgccgtcgcccagtacgctgataccgtcagacccgaattctacttcaatactcacccaacaaaaagggaggtaatcacagcagtcaggaagatgaaacctttagacggctcagctctatatactggaagcgcactggacttcgtgaggaacaatctgttcacatcatccgcagggtatcgagccgccgagggcattcctaaactgctcgttctaatcactgggggaaagtccctggatgagatcagtcagcctgcccaggagctgaagagaagttcaataatggccttcgctatcgggaataagggagcagaccaggcagaactggaggaaatcgcatttgactcctcactggtatttatccccgctgaatttagagccgcccccttacagggaatgctgcccgggctgctcgcacccctgcggacactgagtggcaccccagaagtgcattccaacaagagagacattatttttctgctcgatgggtcagctaatgtaggaaagaccaattttccatatgtgcgggattttgtgatgaacctggtaaactctttggatatcggcaacgataacattagagtcgggctggtccagttttccgacacacctgtgacagagttctctttaaatacgtaccaaacaaaatcggatattctgggccatttgcgccagttacagctgcaggggggctctggcttaaacacagggagcgcactgagctacgtgtacgcaaatcacttcacggaggcaggaggttctaggattcgggaacacgtgccccagctgctgctcctgctcaccgccggacagtccgaggattcttatctgcaggcagctaacgcactaacacgggctgggattctcaccttttgcgttggagcctcccaggcaaacaaggctgaactagaacagattgcatttaacccgtccctcgtgtatctgatggacgacttctcttcattaccagctctgccccagcagcttatccagccacttactacttacgtctccggaggcgtagaagaggtgccgcttgctcagcctgaatcaaagagagatatactctttctgtttgacggatcagccaacctagtaggacagtttcctgtggtgagggatttcctgtataaaataatcgacgagctcaacgtgaagccagagggtacccgcattgcagtcgctcagtactcggatgatgtaaaggtcgaatcccgtttcgatgaacatcagtcgaaaccagagatcctgaatctcgtcaagcggatgaaaatcaagacaggcaaggcccttaaccttggatatgctctggactatgcacagaggtacatatttgtaaagtctgccggctctcgcatcgaggacggagtgctgcagttcctggtgcttctagttgccggcagaagtagcgatagagttgacggtcctgcgagcaatctaaagcagtcaggagtggttccctttatcttccaggctaagaatgcagaccctgctgaactggagcagatagtactgtctcctgcattcatcttagcggcagagtcactgcctaaaattggcgaccttcatccacagattgtaaacttacttaagagcgtgcacaacggagcacccgctccggtgtcaggggagaaagacgtggtcttcctgcttgacgggagcgaaggagtgcgctccggttttccacttttgaaagagttcgtccagcgagtggtggagagtctggatgtggggcaagaccgggtgagagtcgcggttgttcagtacagcgatcgcactcgcccagagttctatttgaactcttacatgaacaagcaggacgtcgtgaacgctgtcagacagttaacattgttggggggccctacgcccaacacaggagccgctcttgaatttgtgcttcgcaatattctggtgtcttctgccggtagtagaattactgaaggggtgcctcaactgctgatcgttctgaccgcagatcggagcggcgacgatgtgcgcaacccatcagtcgtggtaaagcggggaggagcagtccctatcgggattggcatcggaaacgcagacattaccgaaatgcagaccatttcttttatacccgattttgcggtggctattccaacttttagacagctgggaactgtgcaacaggtgatcagtgagagggtcacacagctgacacgggaggagttatcgagactacaacctgtgctccagccgctgcccagtccgggagttggggggaaaagggacgtcgtgttcctgattgacggttcccagtcagcagggcccgagttccagtacgtgcggacacttatcgagagattggtagattatttggatgtgggattcgacacgacacgcgtggcggtgattcagttttctgatgacccgaaggtggagtttctgctgaatgcacattcctcaaaagacgaggtgcagaatgcagtgcagcggctaagaccaaaaggcggcaggcagatcaatgtggggaatgcgctcgagtatgtgtccagaaacattttcaagagaccccttggatcgaggatcgaggaaggagtaccgcagtttttggtcttgatttctagtggcaagagtgatgacgaggtggacgatccggccgtggagttgaaacagtttggggtagccccctttactatcgccagaaatgcagaccaagaagagcttgttaaaattagtctgtcaccagagtatgtgttttccgtttccaccttccgggagctgccaagtctggagcagaagctgctgacccctatcaccacactgacgagcgaacagatccagaagttgctagcgagcacacgctaccctcctccagctgtggagtcagatgcagcagatattgtgttcctcatcgattcatccgaaggcgtccgaccagacggctttgcgcacatacgcgatttcgtctcgcgaatcgtgaggagacttaatattggaccgtcaaaggtacgggttggggtggttcaattttccaatgatgtgttcccggaattctatctgaaaacttacaggagtcaggcccctgtgctcgatgccattaggaggctgagattacgaggcggcagtcctctgaacactggaaaagcattggagtttgtagccaggaacctgttcgtgaagagcgcgggcagtaggatcgaggacggcgtgccacagcacttagttctggtactggggggaaagagccaagatgacgtgtcaagattcgcacaggtgataagaagttctggcatcgtgtcacttggggtgggggaccgcaacatcgacagaactgagctgcaaactattactaatgaccctaggttggtctttaccgttcgtgaatttcgagagctgcctaacatcgaagagcgcattatgaacagcttcgggcccagtgctgctaccccagcaccacccggggtggacacaccccccccctctagaccagagaagaagaaagccgacatagtgttcctgctggacggaagcattaattttcggcgggacagtttccaggaagtgctccggttcgtgagtgagattgtggacacagtctatgaggatggtgattcaatacaggtcggcttggtgcaatacaatagtgatcccactgacgagtttttcctcaaggatttctccacaaagcggcagataatcgacgctatcaataaggtggtctacaaaggcgggaggcatgccaacacaaaagtgggcctcgaacatctccgcgtgaatcattttgtgcctgaggcgggctctagactggatcagcgtgtacctcagatcgcttttgttatcactgggggaaaaagcgtggaagacgcacaggatgtcagcttggcgctgacacagaggggcgtgaaggtgttcgcggtgggagttagaaatatcgacagtgaagaagtgggcaagatcgcgtctaatagcgcaaccgccttccgggtcgggaacgtacaagaactttcagagctttccgaacaggtccttgaaacgctccatgatgcaatgcatgagaccctctgtcccggcgtgacagacgcggccaaggcttgcaatctggacgtgatactgggctttgatggaagtagagaccagaacgtgtttgtagctcagaaaggctttgagagtaaggtagacgctatcttgaatagaatctctcagatgcatcgggtttcctgcagtggaggacggagccccacagtacgagttagtgtggtcgctaacacccctagcggcccagtggaggctttcgattttgacgagtaccaacctgaaatgttagagaagttcaggaatatgcgaagtcagcatccgtacgtgttaacggaggacaccttaaaagtgtacctcaacaaatttaggcagtcttcccctgattcagtaaaagtggtaatacacttcaccgatggtgccgacggcgacctggcggatctacatcgcgcctctgaaaacctaagacaagagggcgtcagagctttaatcttggtcggactcgagcgagtggtgaacctggaacggttgatgcaccttgagtttgggagaggttttatgtacgaccgaccactgcgtctcaatctgctcgaccttgactacgaacttgcagagcaattggataacatcgccgagaaagcttgttgtggcgtgccctgcaagtgtagcgggcaacggggagatcgtggccctatcggcagtatcggccccaagggcattccgggagaagatggttatcggggttatccaggcgacgaaggcggtccaggggaacgaggaccacctggggtcaatggcactcagggttttcaaggatgtccgggtcaaaggggagttaagggctcaaggggatttcctggagagaaaggagaggtgggggagatcgggctcgacggcttggatggtgaggatggcgacaagggtctgcctgggagcagcggcgaaaaggggaatcccgggcgtcggggtgacaagggccctaggggtgaaaaaggcgaaaggggggacgtgggtatccgcggcgaccccggtaacccaggacaggattcacaagaaagaggtcccaagggcgagacgggtgacctgggaccaatgggcgtgcctggtagagacggggtgcctggcggccccggtgagaccggaaagaacgggggctttgggcggcgcggcccccccggcgctaaaggtaataagggcggacccggccagcccgggtttgaaggtgagcagggaacacggggtgcgcagggacccgccggtcctgccgggcctccaggccttatcggggagcaagggatatccggccctcgaggttcagggggggccgctggggccccgggcgagcggggccgaacagggccgctcgggcgaaagggtgaacctggtgaacccggcccgaaaggcggaatcggaaaccggggccctcggggcgagacaggagacgacggtagggatggcgtaggttccgagggacggcgggggaaaaaaggtgaaaggggatttccggggtatcctggccccaaagggaatcctggagagcctggtttaaacggcacaacgggtccaaaaggcatcaggggccgccgtggcaatagtggacccccagggattgtggggcagaaaggcgaccctggctaccccggacctgctggaccaaagggcaataggggcgactcaattgatcagtgtgctctgattcagagcatcaaggataagtgcccctgttgttacggacctttggaatgccccgtcttcccaacagaactcgcctttgccctcgataccagcgagggggtcaatcaggacacgtttggcagaatgcgtgacgtagtgctgagtatcgttaacgatctgactatcgctgagagcaattgtccgagaggagcacgtgtcgccgtggtgacgtacaacaatgaggttacaaccgagatcagattcgccgacagcaaaaggaagtccgtcctcctggataagatcaagaatctgcaagttgctctaacaagcaagcagcaaagccttgagaccgccatgtcctttgtcgctagaaatacattcaagagagtaaggaatgggttcctcatgcgtaaggtggcagtgtttttctccaatacgccgacgcgggccagtccacaactgcgcgaagcggtgttgaaactctctgacgcaggcattacgccgcttttcctcacccgccaggaagataggcagttgataaacgcacttcagataaataataccgcggtgggacacgcccttgtgctccctgccgggcgtgacttaacagatttcctggaaaatgtgttgacctgtcacgtctgtctagatatttgcaatatcgatcctagctgcgggtttggctcctggaggcccagcttccgcgatcggagggcagctggctcggatgttgacattgacatggcatttatacttgattcagccgagacaacaaccttgtttcagttcaacgaaatgaaaaagtatatagcctatctcgtgagacaattagatatgagtcctgacccaaaagcatcccagcatttcgctagggtggcagttgttcaacatgcgcccagcgagagcgtggacaacgcatctatgccacctgtgaaagtcgaattctccctgactgattatggcagcaaagaaaaattggtcgatttcttgtctcgggggatgacacaactgcagggaacccgtgctttaggcagcgccattgaatacacaatcgagaacgtctttgaatctgcccccaatccccgcgatcttaagattgtggttctcatgctgaccggggaggtgcccgaacaacagctcgaagaggcacaacgggttatcctgcaggctaagtgcaaaggatacttttttgtggtcttggggatcgggcgcaaggtaaacattaaggaggtctacacgttcgccagcgagcccaatgacgtgttcttcaagctagtggacaaatcaacagagctcaacgaagaacctcttatgcggtttgggagactcctaccaagtttcgtatcttcagagaatgccttctatctgtctccggatattaggaagcaatgtgattggttccagggagaccagcccacaaaaaaccttgttaaattcgggcacaagcaagtcaacgtgcccaacaatgtcacatccagtcccaccagcaatcctgtcactaccacaaagcctgtgaccactacaaaacccgttactacaacgactaaaccagtgacaactactactaaacccgtcacaattatcaatcagccaagtgtgaagcctgcggctgccaaacccgcgcctgcaaaacccgttgctgccaagccagttgcaacaaaaatggcaaccgttcggcctcctgtggcggtcaagccggcgacagcagcaaaacctgtcgccgccaaacccgccgcagtgagaccccctgccgccgcagcggccaagccagtcgccaccaaaccagaggtacctaggccacaggcggcgaaacctgctgccaccaaaccagccacaacaaaacctatggtgaaaatgtcccgagaagtgcaggtgtttgaaatcacagagaattcggccaagctgcattgggagcgagcggaacccccgggcccatacttctacgacttaactgtcacttcagctcacgatcagtctcttgtgctcaagcagaatttaactgtcacagatcgggtgatcggggggctgctggctggccagacctatcatgtcgccgtagtctgctatctgaggtcacaggttagggctacctaccacgggtctttcagtacgaagaaatcccagccccccccacctcagcccgcccgctcagcctcttccagcactataaacctcatggtgtcaactgaacccctggctctaactgagactgacatctgcaaattgccaaaggacgagggtacctgcagagacttcattctcaaatggtattacgacccaaataccaagagttgtgccagattttggtacgggggttgcggaggaaacgaaaataaattcggttcacagaaagagtgtgagaaggtctgcgcacctgtcctcgcaaagcctggcgttatatccgtcatggggacatag

SEQ ID NO: 2523 - DNA, 8916 bp, Artificial Sequence
  Description of Artificial Sequence: Synthetic coding sequence
atgcgaaaacaccgccacctgccgctggtggcagtgttttgtctcttcttaagtggttttcctacaactcatgcccagcagcaacaggctgctcaagacagcgccgatattatttttctgatagacgggtctaataatacggggtcagtaaactttgctgttattctggattttctggtaaaccttctcgaaaagctgcctattgggacccaacaaatcagagtgggagttgttcagttctcagatgagcccaggacgatgttctccctggacacctactccaccaaagcccaggtactcggcgccgtgaaggcactcggattcgccggcggcgaacttgccaacattggtcttgctttggatttcgtggtggagaaccatttcactcgcgctggcggatctcgcgttgaagagggcgtgccacaagtgctggtcctgatatctgccggtccttcctcagacgagattcgatacggtgtggttgcactcaagcaggcgagtgtgttcagtttcgggctgggagcccaggcagcttcgcgggccgagttgcaacacatcgcaaccgacgataacttagtgtttacagtaccagagtttcggtcttttggcgatttgcaagaaaagctgctgccctacatcgttggggtggcacagagacatatcgttctcaaaccacctactatcgtaacgcaagtgatcgaagtgaacaaacgcgatatagtgtttctagtggacggcagcagcgctctcggcctggccaacttcaacgccattagagacttcattgcaaaggtcatccaaagattagaaatcggtcaggatctcatccaagtcgccgtagcccagtatgcagacacagtcaggccggagttttatttcaacacacaccctaccaagcgcgaagtgattaccgccgttcggaaaatgaagcctttagatgggagcgctctctacacagggtcagctctagactttgtccgcaataatctgttcacctcttcagccggctacagggccgctgagggcataccgaaactcctagtgttgattacgggcggaaagtcactggatgagatctcacagccagcccaagaacttaagcggtccagtataatggccttcgccataggtaataagggcgctgaccaagcagagctggaggagatcgcgtttgactcatcactcgtttttattcccgcggaattccgagctgcccctctgcaggggatgctgcccggacttctggcaccgctgcgcaccttaagcggcactccagaagtgcattccaataagcgagacataatctttctgctggacggctctgcaaacgttgggaaaacaaatttcccttacgtgagggatttcgtaatgaacctggtcaacagccttgatatcgggaatgataatatcagggtcggcctggtgcagttttcagacactccagttacagagttcagtttaaacacctaccagacaaagtctgacatcctgggtcacctccgtcagttgcaactgcagggaggaagtggattgaatactgggtccgcccttagctacgtttacgccaatcacttcaccgaggccggtggaagtcggattcgggaacatgtgccacagcttctgctcctgctgaccgcaggacagagcgaggattcatacttacaggcagccaacgccttaacacgagcagggattctaacattttgcgtcggagctagccaggctaacaaggcggagctcgagcagattgcgttcaacccctcgcttgtgtatttgatggacgacttctcatcactgccggcccttccacagcagctgatccaacctcttactacttacgtatccggaggcgtcgaggaggtgcctctagcccagccggagtctaaacgagatatactttttctgtttgacggctctgccaatctggtcggtcagttcccagtagtcagagattttctctacaaaatcattgatgagctgaacgtgaaaccagagggcactaggattgccgttgcccagtattctgatgacgtcaaagtcgagtcccggtttgatgagcatcagagtaagcccgaaatacttaacctggtcaagaggatgaaaataaagacgggtaaagccctcaacctcggctacgctctggactacgcacagaggtatatcttcgtgaagtccgctgggagtcggattgaagatggagtgctccaatttctcgttcttcttgtcgccgggcggagttcggatcgggtggatggtcccgcaagcaacttaaaacagtcaggcgtggtaccattcatctttcaggcgaagaacgccgatccggccgagctggagcaaattgtactttccccagcattcatattagctgccgaatctctgcctaaaatcggtgatcttcaccctcagatcgttaatctactgaaatcagtccataacggtgcaccagcccctgtgagtggagaaaaggatgtggttttcctcctggacgggagtgagggtgtgcgcagcggatttccgcttcttaaagaattcgtgcaacgggttgtggagagtctcgatgtggggcaggatagggtgcgcgtcgccgtcgtgcaatacagtgaccgaaccaggcctgagttttatttgaactcctacatgaacaagcaggacgttgtgaacgcagtgaggcagctgactctgttgggtggcccgactccaaatacaggagctgcgctggagtttgttctgagaaatattctcgtctcaagcgcaggaagtaggattaccgaaggtgtgccgcaactgctaatcgtgttaacagcagatcggtccggggacgacgtgagaaatcctagcgtggtggtgaaaagaggcggcgctgtgcccatcggcatcgggattggcaatgccgatatcacagaaatgcaaacaatctcatttatcccggatttcgcagtcgcaatcccgaccttccgacagctgggaacggttcaacaggtgatcagcgaacgagtaactcagctgacaagagaggaactcagccggctccagcccgtgctgcagccgctgccctctcccggcgtggggggcaaaagagacgtggtgttcctgattgatggctcccaaagcgccgggcccgagttccagtacgtgcggacactaattgaaaggttggtggactacctggacgtgggatttgatacaaccagagttgctgtgatccagttcagtgatgaccccaaggtcgaattcctcctcaacgcacactcttctaaggacgaagtccagaacgccgtccagcggttacgtcctaagggtggaagacagatcaatgtcgggaatgcgctcgaatacgtgagccggaatatctttaaaagaccactcgggagcagaattgaagagggagtccctcagttcctcgtgctgatctctagcggcaagagcgatgacgaggttgatgatccggctgtagaattgaaacaattcggcgtggctccattcaccatcgccagaaacgctgatcaagaggagctggtgaagatctccctctctcccgagtacgtgttttccgtgagtacttttagggagctgcccagcttggaacagaagttactaactcccatcaccactctcacatcggaacagatccaaaagctactcgccagcacccgatacccacctcccgcagtggaaagtgacgccgcggatattgtgttcctaatcgattcaagcgagggggtcagacctgacggttttgctcatatcagagactttgtatccagaatcgttcgaagactgaatattgggccatccaaggtgagggtgggggtcgttcaattctcaaacgatgtgttcccagagttttacttaaagacgtatcgaagtcaggctccagtgctggacgccatcagaaggctcaggctgcgaggcgggtcaccactcaatacgggcaaggctctggagttcgtggccaggaatctgttcgtcaagtccgctggctcaagaatcgaggatggggtccctcagcatcttgtccttgtactaggcggcaaatcccaggacgacgtgtctagatttgcgcaggtaattaggtcatcaggaattgtatctctcggggtgggcgatagaaatatcgaccgcaccgaactgcagaccatcaccaacgacccccgacttgtgttcacagtccgtgaattccgtgaactccccaatattgaagaaagaataatgaacagctttggcccgtctgcggcaacacctgccccccctggggtggacactccacctccaagccgaccagaaaagaagaaagctgacatagtgtttctactggatgggtcgattaattttcgccgcgatagcttccaggaagtgcttcggtttgtgtccgagattgtggacaccgtgtatgaggatggagacagcattcaggtaggactcgtccagtataattccgatcctaccgacgagttctttttgaaagacttttccactaaaaggcaaatcatagatgcgataaacaaggtggtctacaagggagggagacatgcgaatacaaaggtgggcctggaacacttgcgagtgaatcatttcgtcccggaggctgggtctcggctggaccaaagggtcccccagatcgccttcgtgatcaccggaggaaaaagcgtcgaggatgcacaggacgtaagcctggcgctgacccaacgcggtgtcaaggttttcgccgtgggggttcggaatattgatagcgaagaagtggggaaaatagcctccaactcagcaaccgcgtttagggtgggcaatgtgcaggagctgagcgaactcagcgagcaggtcttggaaacgcttcatgacgccatgcacgagacgctatgccctggcgtgaccgacgcggccaaggcatgcaacctggacgtgattctaggcttcgatgggagcagagaccaaaatgtgtttgtagctcagaaagggtttgagtcaaaggtggacgctatccttaacagaatttcccagatgcacagagtttcatgctctggggggagaagcccaaccgtcagagtgtctgtggtcgccaacaccccatccggcccagtggaagctttcgacttcgatgagtaccagcctgagatgctcgagaagtttcgcaatatgaggagccagcacccttatgtgcttactgaagacaccctgaaggtttacctcaacaaattccggcaaagcagtccagattcggttaaagtggtcatccattttactgacggggccgacggcgacctggctgacctgcaccgggcctcggaaaacttacggcaagagggggtacgtgccctgatcttggtggggttagaacgggtcgttaacctcgaacgtctgatgcacctagagtttggtcgagggttcatgtacgacaggccattgagactgaatcttctggacctggattacgagcttgctgaacaacttgacaatatcgcggaaaaggcctgctgcggagtgccatgcaaatgttccgggcagagaggggataggggtcctattggaagcattggtcccaaaggcattccaggcgaggatggatatagaggctaccccggcgacgaaggaggtccgggcgagcgcgggcctccaggcgtgaatggaacccaaggcttccagggctgcccaggtcaacggggcgttaaggggtcacgcggattccccggggaaaaaggggaagtcggtgagatcggtttagacggcttagacggtgaagatggcgataaaggattgccaggtagtagtggagaaaaggggaacccaggcagacggggtgataaaggcccgcgaggggagaagggggagagaggagatgttgggataaggggggatcctgggaatcccggtcaggactcccaggagcgcggccctaagggcgagacaggagacctcggccccatgggggtgccaggccgggacggcgtaccaggcggccctggagaaacaggcaaaaacggcggatttggccggagagggcccccaggagccaaaggcaataaaggaggcccgggacaacccggctttgagggggaacagggcacccggggagctcagggaccagccggccccgccgggccacccgggctgatcggcgagcaaggaatttctggacccagagggtcaggcggggccgccggcgcccctggcgaacggggtcggacaggccccctgggacggaagggggaacccggcgaaccaggcccgaagggcggcattggcaacagggggcctcgaggcgagacaggagacgatggtagggatggggtggggtctgaagggagaaggggtaaaaagggcgagcgaggctttccagggtacccaggacccaagggaaatccaggcgagcccggcctgaatggcactaccgggccaaagggcattagagggcggagaggtaacagcggaccccctgggatcgtaggccaaaaaggcgatccagggtacccagggcccgcagggcccaaaggcaaccgtggcgatagcattgatcagtgtgctctgatacagtccatcaaggacaagtgcccttgctgctacggtccactcgagtgtccggtattcccaactgaactggcatttgccctcgatacctctgaaggcgtcaaccaggacaccttcggacgcatgcgcgatgtcgttttgagtattgtcaatgacctgaccatcgccgagagcaactgtccgcggggagctagagttgcagtcgttacttacaataacgaggttacaacggagatcaggttcgctgattccaaaagaaagtcagtgctgttagacaaaatcaaaaatctgcaggtcgcactgacgagtaagcagcagagcctggaaactgctatgagttttgtagcccggaatacctttaagagagttagaaacggttttctcatgcgtaaggtggcagtcttcttctccaacacacctaccagggctagtccacagctgcgagaagctgtactcaaactgagtgacgctggcattacccctctgtttttgactaggcaggaggatcggcagttgattaatgccctgcaaattaacaataccgctgtggggcatgcccttgtgctgcctgcaggacgggacctgactgacttcctcgagaatgtgctcacctgccacgtctgtctggatatatgcaacattgacccatcatgcggttttgggtcttggagaccaagctttcgcgaccggcgcgccgctggctcagacgtagatatagacatggcttttattttggactcggcagaaaccaccactctttttcagttcaatgaaatgaaaaaatatatagcttatttggtgcgccagctggatatgtctccagacccaaaggccagtcagcacttcgccagagtggccgtcgtacagcacgctccctcggagtcagtagataacgcgtcaatgccccctgtgaaagttgagttcagtctcacggattacggcagcaaagagaagctcgtggactttctctcaagagggatgacccaactacaagggacacgggcgctggggtctgcgattgagtacaccatcgaaaacgtatttgagtctgcccccaatccaagggatctcaagatagtcgtcttaatgctaactggcgaagtccccgagcagcaactggaggaggcacagcgcgtaattttacaagctaagtgtaaagggtactttttcgtggttttgggaattggcagaaaagtgaacatcaaggaagtgtacaccttcgcctccgagcctaacgacgtctttttcaagttggtcgacaagtccacagagttaaacgaagaacccctcatgagatttggccggctgcttccatcctttgtgtcctctgagaatgcgttctacctttcccccgatattcggaaacagtgcgactggttccagggggaccagcctaccaagaaccttgtcaaattcggccacaaacaggttaatgttcctaacaacgtaacctctagcccaactagcaatccggtaactactacaaaaccagtcactaccaccaaaccagtgactaccactaccaagccggtgacaacaacaaccaaacccgtgacaattatcaaccaaccatccgtcaaacctgccgcagcgaagcccgcgccagcaaagcccgtagcagcaaaaccagtcgcgaccaagatggctactgtgcgccctccagtcgcagtcaaaccagccacggcagccaaacccgtggcggcgaagccagctgcagtccgcccaccagccgccgctgccgctaagcctgtcgctaccaagcccgaggtgccccgaccccaagcagccaagcccgcagctacaaagcctgcaaccaccaaacctatggtgaaaatgtcacgggaggtgcaggtcttcgagattacggagaatagcgcaaagttgcactgggagcgagccgagcccccaggcccttacttctatgacctgacggtcacgagcgcacacgaccagtcactcgttttaaagcagaaccttacagtgacagacagagttatcggcggcctgctggccgggcagacataccacgtggccgttgtttgctacctgcgtagccaggtgagggctacttaccacggatcgttcagtaccaaaaagtcccagccccctcctcctcaaccggcacgcagcgctagtagcagcaccatcaatttgatggtcagcacagagcccctggctctgacagaaaccgacatctgtaaactgcctaaagatgagggcacctgtcgcgatttcatactgaaatggtactacgacccgaataccaaaagttgtgcaaggttctggtacggcgggtgtggcggaaatgaaaacaagtttgggagtcagaaagaatgcgaaaaagtatgcgccccagttctggcgaagccgggcgtcattagcgttatggggacatag

SEQ ID NO: 2524 - DNA, 3111 bp, Artificial Sequence
  Description of Artificial Sequence: Synthetic coding sequence
atgcgaaagcaccggcacctgcccctggtggctgttttttgcctttttctctcaggattccctaccacccacgcacaacagcaacaggcagtgatagaagttaacaaacgtgacatagttttcctggttgatggatcctcagcactgggcttggcaaacttcaacgcaattcgggattttatcgctaaagtgatccagcggttagagatcggccaggatctcatccaggttgccgttgcccagtacgcagatactgttcgccctgaattctattttaacacccatccaacaaaacgggaagtcattaccgccgtgagaaaaatgaagcccctggatggatctgcactgtataccggctcagcactcgactttgttagaaacaatctgtttacctcttccgccggctaccgagcagcggaaggaatacctaagttgcttgtgctgatcacgggtggtaaaagtttagacgagatttcacagccagctcaggaactgaagaggtcctccataatggcattcgctataggtaataaaggcgccgatcaggctgagctggaagagatagcatttgatagttctttagttttcatcccagcagagttccgagcagccccactacagggaatgcttcccggcctgctggcaccacttaggaccctctcggggacaccagaagtccattctaacaaacgggatattattttcttgctggacggatcagccaacgtggggaaaacaaattttccttacgtcagggatttcgtgatgaacttagttaactccctggatatcgggaacgacaacattagagtgggccttgttcagttcagcgacactcctgtgacagaattcagtctgaatacttaccagacaaagtccgacatcctggggcacttgcggcagctccaattacaggggggttcaggcctgaatactggaagtgccttgagctacgtgtatgcaaatcatttcactgaggctggagggtcccgaattagggaacatgtgccccagctgctcctcttgctgacagccggccagtcagaggactcataccttcaagcggcgaacgccctaacacgggctggaatcttaactttctgcgtgggagcctcgcaggccaataaagccgaactggagcagattgcttttaacccctctctggtctacctgatggatgacttcagttccttacctgcccttccccaacagttgatccagccactcactacctatgttagtggcggcgtggaagaggtgccgctggcgcagcctgagtcaaagcgcgatatacttttcctttttgacggtagcgcaaatctggtggggcaatttcctgttgtgcgtgacttcttgtataagattatcgacgagctgaatgttaagcccgagggcacaagaattgccgttgcccagtattctgacgacgtgaaggtggagagcaggttcgacgaacaccaaagcaagcctgagattctgaatctggttaagcgaatgaagatcaagaccggtaaagcattaaatctggggtatgcactcgactatgcccagcgatatatatttgtcaagtccgccggcagccgaattgaggatggcgttctgcagttcctggtgctcttagtggccggcagatcctcagaccgggtggatggccccgcgagcaaccttaagcagagtggagtggtgccgttcattttccaggcaaagaatgcggatcccgctgaactggagcaaattgtgttatccccagctttcatcttagctgccgagtccctgccaaagataggggatctccatcctcagattgtaaatctgctcaagtccgtacataatggggctcctgcccctgtgagcggggagaaggatgtggtgttcctactcgatggttcggaaggtgtacggagcggttttccgctcctgaaggaatttgtacagcgcgtcgtagagagccttgatgtcggccaggaccgtgttcgagtcgccgtggtgcagtactccgatagaacccgccctgagttctacctgaattcatatatgaataaacaagacgttgtgaatgcagtgagacaattgacacttctgggaggtccgacccccaacacgggagctgcactcgaatttgtgctgcgcaatatcctcgtgtcaagcgctgggagccgaattacggagggggtaccccagctgctgatagtgttgaccgcagataggagtggtgatgacgttcggaatccttccgtcgttgtaaagcgtggtggggccgtgcctatcggaatcggcattggcaacgccgacatcaccgaaatgcagacaattagctttatacccgactttgctgtagccatccctacatttcggcagctcggcacagtgcagcaagtgataagtgaacgcgttacccagctgactcgagaagagctgagtcgcctgcagcccgtcctacagccattgcctagtcctggagtcgggggaaaacgggacgtagtattcctgatagacggcagccagagcgccggcccggagttccagtacgtgaggactctcatcgaacgtctggtggactacctagacgtcggttttgatacaaccagagtggccgtgatccaattttctgatgatccaaaggtggaatttttactcaatgcccactcctcaaaggacgaagtccagaatgcagtgcagagactcaggccaaaaggcggacgccagatcaatgtcggtaatgctttagaatacgtgagtaggaatatcttcaagcgccccctgggctctcgcattgaggagggcgtcccacagtttctggtgctgatctctagcgggaaaagtgacgatgaggttgatgatccggccgtcgagctgaaacaattcggggtcgccccctttaccatagccagaaacgccgaccaggaggagctggtgaagatatctctcagtccggagtatgtgtttagcgtctctacatttcgagagctgccttcccttgagcaaaaactcctcacgcctattactacactgacatcggagcagatccagaagttattagctagtacccgataccctccacctggagagatgggcgccagtgaagtgctcctcggagctttctcgatctag

SEQ ID NO: 2525 - DNA, 8916 bp, Artificial Sequence
  Description of Artificial Sequence: Synthetic coding sequence
atgcgaaagcatagacacctccccctggtggccgttttttgtctgtttctgagcggatttccgacgactcatgcacagcagcagcaggcggcacaggattccgccgacatcatttttctgattgatggctctaacaatacaggatcagtgaacttcgcagtaatcctggatttcctggtgaacctcctggaaaagttaccaatcgggacacagcaaattagagtcggggttgtccaattttccgatgagcccaggacaatgttcagcctcgacacgtattctactaaggcacaagtgctaggcgccgtcaaggctttaggcttcgccggcggtgaattggctaatataggactggcactggacttcgtagtggaaaaccacttcactagggcaggcggctcgcgcgtggaagagggtgtacctcaggtcctggttcttatcagcgctgggcctagttctgacgaaattcgttacggagtcgtagctcttaagcaggcttctgtcttttctttcggcctcggggcccaggccgcctctcgtgcagaattacaacacattgctaccgatgacaatcttgtgtttaccgttcctgagttccgatcttttggggatctccaggaaaagctgctgccttacattgttggagtcgcacagcggcacatcgtgctcaaacctcccacaattgtcacccaggtgatcgaagtcaataagagggacatagtgttcctggtagatggcagctccgctctggggctggccaattttaatgccattcgggactttatagcaaaggttatccagaggctggagatcggccaggaccttatccaagtggccgtcgctcaatacgcggacaccgtgcgaccggaattctacttcaatacacatccaacaaagcgcgaagtcattacagcagttcgtaagatgaagccgctggacggctccgctctttatacgggtagtgcactggactttgtgaggaataatctgttcacaagctcagcgggataccgagctgccgaaggaatcccaaaactgcttgtgctgattacaggaggtaagtctctggacgaaatatctcagccagcacaggagttgaagcggtctagtataatggcatttgccatcggcaacaagggggccgatcaggctgaactggaagagatagccttcgacagctcactggtgtttatccctgccgagttccgcgccgcacccctccaggggatgcttcctggattgctggcaccactgcggacactgtccggcaccccagaggtgcacagcaataaacgtgacatcatcttcttgcttgatggatctgccaacgtcggaaagactaatttcccttatgtgcgagactttgtgatgaatcttgtcaactctttggatattggcaacgataatatccgggtgggcctcgtgcagtttagcgacacaccagtaacagaattttccctaaatacctatcagacaaagtccgacattcttggacacttgaggcagttgcagctgcagggaggatcaggcttaaacacaggctcagctctttcttacgtttacgccaaccactttactgaggccggaggaagtcgcatccgcgaacacgtaccacagttattgctgctgcttaccgccggacagtcggaggatagctacctccaggccgcgaatgccctgacaagagcaggaatcctgaccttttgtgtgggcgcctcccaagccaacaaggctgagctggagcagatcgctttcaaccctagcctcgtctatttaatggacgatttcagttctctgcccgcactgccgcagcaacttatccagcccctcactacctacgtgagcgggggtgtggaggaggtccccctcgcccagcctgagagcaaaagggacatcctctttctcttcgacgggagcgccaacctcgtgggccagtttcctgtggtgcgcgatttcctttacaaaatcatagacgaacttaacgtgaagcccgaggggaccaggatcgcagtagcccaatactcggatgatgttaaggtagaatccagattcgatgagcatcagagcaagcccgagatattgaacctggtgaagcgtatgaaaatcaaaactgggaaggcactcaacctaggatacgctctcgactatgcccagaggtatatctttgtcaaatcagccggatccagaatcgaagatggcgtcttgcagttccttgtcctactcgtcgcggggagatcttccgaccgagttgacggccctgcctccaatctcaaacagagcggggtggtcccatttatttttcaagcaaaaaacgcagatcctgccgaactggagcagattgtgctctctcccgccttcatccttgcagcagaaagcctgccaaaaatcggagaccttcacccccaaatcgtgaatctgctgaagagtgtgcacaatggggctcccgcaccagtgtccggcgaaaaggatgtcgtatttttgctggacggttccgaaggcgtaagatccggatttcctctgctcaaggaatttgttcagcgtgtggtggagagtttagacgtaggccaagaccgtgtgagggttgcagtcgtgcagtattccgatcgcactagaccagaattctacctgaacagctacatgaataagcaagatgtcgtcaatgcagtgagacagctgaccctcttaggaggccctacccctaacactggagctgccctggaatttgtattacgcaatatccttgtctctagcgctgggagccgcatcactgaaggggtgcctcaactgttgatcgtgttaaccgccgaccgcagcggcgacgacgtgcggaatccctctgtagtggttaagcgaggaggcgcagtgccgatagggattggaattggtaacgccgatatcaccgaaatgcagacaattagctttattcctgactttgccgtggctatccccacattccgtcagcttggaactgttcagcaggtgatatcagagcgggttacgcagctgacacgggaagaactgtccagactgcagccagtcctgcagcccctgccttctcccggagtgggaggtaagagggacgtggtgtttttgatagacggtagccaatcagctgggccagagttccaatatgtccgcactttaatcgagaggcttgtggactatcttgacgtagggtttgacaccactagagtggcagtgattcagtttagcgacgatccaaaagtggagtttttgttaaatgcccatagcagtaaggacgaggtgcagaacgcagtgcagaggctcagaccaaaggggggacgccagataaacgttggcaatgcactcgaatatgtaagccgaaacatttttaaaaggccactgggctcacgaatcgaggagggagtgccccagtttctggtccttatttccagcggcaagagtgacgatgaagtagatgatcccgcagtggaattgaaacaattcggggttgccccctttacaatagcaagaaacgccgatcaggaggagcttgtgaaaatctcgttgtcacccgagtatgtgttcagcgtatcaaccttccgtgaattgccatccttggagcagaaactgttgaccccaatcactaccctgaccagtgaacagattcagaagttgctggcaagcaccaggtacccgcctcctgcagtcgaatccgacgccgccgacatcgtgtttttgatcgactcatctgagggcgttaggccagatggttttgcgcacatcagggatttcgtgtcacgcatcgtcaggaggctaaacattgggccgagcaaagtaagggtgggcgtagtccaattctcgaacgatgtgttcccggagttttatctcaagacctaccggagtcaagctccagttcttgatgccatccgcagactgcgtctaaggggtggctctccattgaacaccgggaaggcacttgaatttgtggctcggaatctgttcgtgaagtctgccgggtcccggatagaggatggcgtcccccagcaccttgttctggttttagggggaaaatcccaggatgatgtcagcagattcgcccaggtgatccgtagctctggtattgtaagtttaggtgtgggggaccgaaatatcgaccgcaccgaactgcagaccattactaacgacccccgcctcgtgttcacagtgagagaattccgcgagctgccaaacatagaagagcgtatcatgaactcttttggcccttccgccgcaacgccggccccgccaggagttgacaccccgccaccttccaggccagagaaaaaaaaggctgatatcgtctttttactagatggctccattaacttccggcgggacagcttccaagaggtgctgcgttttgtgtcagagattgtggacaccgtgtacgaggatggggattcaatacaggtcggcttagtgcagtataacagtgaccctaccgatgaattctttctgaaagattttagcactaagcgtcaaataatcgacgcaattaataaggtggtgtataagggtgggcgccacgccaataccaaggtgggactggagcacctccgggtcaatcacttcgtgcctgaagccgggagcagattggatcagagggttccccagattgcatttgtcattaccggcggaaagtctgtggaggatgcccaggacgtatcactggcgctcactcagcgcggagtaaaggtgttcgcagtaggcgttagaaatatagactctgaagaagtgggcaaaatcgcgagtaactcagctaccgccttcagggttggcaatgtgcaggaacttagcgagctgagcgagcaggttctggagacactgcatgatgccatgcatgagactctttgccccggggtcacagacgcagcaaaagcatgcaacctggacgttatcctgggctttgatgggagcagagaccagaatgtatttgtggcccagaaagggttcgagtcaaaggtggacgctatactgaatagaatctcccagatgcaccgggtgagctgttctggggggcgaagccccaccgtgagagtatctgtcgtagctaataccccctccggtccggtggaggcatttgacttcgatgagtaccagcctgaaatgttggaaaaatttcgaaatatgcgttcacagcacccatatgtgcttaccgaagataccttaaaggtctatctaaacaagttcaggcagtcaagcccagactcagtgaaggtggtcatccacttcacagacggggcagacggggacctggctgacctgcatcgcgcttcagaaaatctgcggcaggaaggggtccgcgctctgatcctggtaggactggagcgggtagtgaacctggaacgtctgatgcaccttgaatttggtcgggggtttatgtatgacagaccattgcgcctgaatctgctggatctcgattatgagcttgccgaacagttggacaacatcgcagaaaaggcctgttgtggcgttccatgcaaatgcagtggacagcggggagaccgagggcctataggtagtattggtcccaaaggaatccccggggaagacggctatcggggctaccccggggacgagggtgggcctggggagcgagggcctccaggtgtcaatggcacacagggctttcagggctgtcctggccagcgaggagtcaaaggatccaggggctttcccggtgagaagggggaagtcggcgagattggcctggatggtctagacggggaagatggcgataaaggactgcctggttcgagcggggagaaaggcaatccaggacgccgcggagacaaaggccctcgaggtgagaaaggagagagaggtgacgtggggattcgcggcgaccctgggaaccccggccaggatagccaggaacgaggaccaaagggcgagaccggcgatttagggccaatgggcgttcccgggcgggacggggtccctggtgggcctggtgaaaccggcaaaaacggcggctttggtagaaggggcccccccggggccaagggaaacaagggtgggcctggtcaaccaggtttcgagggtgaacagggcactaggggggcccaaggaccagctggtcccgccggcccacctgggctgataggagaacagggcatcagcggaccccgtggaagcggcggtgccgctggggctcctggggagcgaggacgcacggggccacttggcagaaagggagagcccggtgagccagggcccaagggtggcattggtaaccgtggtcctcgaggagaaaccggcgacgacggcagagacggagtgggcagcgagggtaggcgcgggaagaagggagaaagggggttccccggataccccggccccaagggcaatcccggggagccaggattaaacgggacaacaggcccgaaaggcatccgggggagacgcgggaactccggcccccctggaatcgtcggccagaaaggcgatcctgggtatccagggcctgccggcccgaaaggcaacagaggggactctattgatcagtgtgctctcatccaatctatcaaggataaatgcccatgctgctatgggcccctggagtgccccgtgtttccgacagaattggcttttgcactggacacatctgagggggttaaccaggatacatttgggaggatgagggatgtggtcttgtctattgtaaacgaccttaccatcgccgagagtaactgtcccagaggagcccgcgtggccgtggtgacgtacaataacgaagtcacaactgagatcaggttcgctgatagcaagcggaagagcgtgctcctggataaaataaaaaacctgcaagttgcactcacctcgaagcagcagtctctggagacagcaatgagctttgtcgcccgaaacaccttcaagagggtacgcaacggtttcctgatgcggaaagtcgctgtgtttttttctaacacccctaccagggcctccccccaacttcgggaagccgtccttaaactgagcgacgcaggaatcactcctctgtttttgacccgtcaggaggataggcagctgatcaacgccctgcagataaacaatacggcagtggggcacgctctggtgcttccagctggccgagatctgacggattttctcgagaacgttctgacttgtcacgtgtgtttagacatctgtaatatagatccctcctgcgggtttgggagttggagaccttctttcagggaccggcgcgccgctggttctgacgtagatatcgatatggcatttatcttagacagcgcagagacaacaacccttttccagttcaatgagatgaagaaatacattgcatatttagtacgtcagctcgacatgtctccagaccctaaggcctcacagcactttgctcgagtcgccgtggtgcaacacgcaccatccgagagcgttgataatgcgtcaatgcctccagtgaaggtggagtttagcctgacggattatggcagcaaagaaaagctcgtagacttcctttctcgtgggatgacgcaactgcagggtacaagagcactaggtagcgcgatcgagtatactatcgaaaacgtgtttgaatccgccccgaatcctagagacctcaaaatcgtggtgctcatgctgacgggggaggttcccgagcagcagttggaggaggcccaacgagtaatacttcaggccaagtgtaaaggatacttttttgtggtcttaggaattggtcggaaagttaatatcaaagaagtgtacactttcgctagcgaaccgaacgatgtattctttaaactggttgataaaagtacggagctcaacgaggagccactgatgcgctttggccgtttgctgccatcgttcgtatcgtctgagaatgctttctatctttcccccgacattagaaagcagtgcgactggtttcagggcgatcagcctacgaagaatcttgtgaaattcggtcacaaacaggtgaacgttccaaacaacgtgacttcctcacctacctccaatccagtcaccaccacaaaaccagtgactacaaccaagcccgtgaccaccaccaccaagcccgttaccacaacaaccaagccggtcacaattataaatcagccgagcgtcaaaccagcagccgccaagcctgcccctgcaaaaccagtcgctgccaaacccgtagccacaaagatggccactgtgagacctccagttgccgtcaagccagcgactgccgcaaagcccgtggccgctaaaccagccgctgtgcggcctccagcagctgccgccgctaaacctgtggctacaaagccagaagtcccacgaccccaagccgcaaaaccagccgctaccaagccggccaccacaaagcccatggtgaaaatgtctagggaggtgcaggtgttcgagatcactgagaattccgcgaaactccattgggagagggcggagccacccggaccttacttttatgacctcactgttacttcagcacacgatcagtccctcgttctgaaacaaaatcttactgtgactgacagagtgattgggggactgttggccggacagacctaccacgttgcggtggtctgctacttgcgatcccaagtgcgggccacctaccacggttccttcagtacaaagaaatcgcagcccccccctcctcagccagccagaagcgcttccagcagcactattaatctaatggtttctaccgaaccactggcgctcaccgagactgacatctgtaaactgccaaaggacgagggtacctgccgcgacttcattctgaaatggtactacgatccaaacactaaatcctgtgccaggttttggtatggtggttgtggggggaacgagaacaaatttggatctcaaaaagagtgcgaaaaggtgtgcgcccctgttctggccaaaccaggagtgatcagcgtgatgggtacttag

SEQ ID NO: 2526 - DNA, 7848 bp, Artificial Sequence
  Description of Artificial Sequence: Synthetic coding sequence
atgaaaatcctcctgattattttcgtactgatcatatggactgaaacgttggcagaccagagtccaggccctgggcccgtttatgccgatgtggtcttccttgtagacagcagtgaccacctggggccaaagtcattcccctttgtcaagaccttcattaacaagatgataaactccttgccaatcgaagccaacaaataccgtgtcgctctggcccagtactcggacgaattccattccgagtttcacctgtctacgttcaaaggcaggagccccatgttgaatcacctaaagaagaactttcagttcatcggaggcagcttacagatagggaaggcacttcaggaggcccacaggacttacttctcagcaccgattaacggacgcgacagaaagcaatttccccccatcctggtggtgctcgcctcagcagagtccgaagacgaagtcgaagaagcatctaaggctctccagaaggatggcgttaagatcatctcagttggcgttcagaaagccagcgaggagaatctaaaagcgatggccacatcacattttcacttcaacctgcgaaccatcagagacctgtcaaccttttcccagaacatgacacaaatcattaaagatgtaaccaagtataaagagggagcagtcgacgcagacatgcaggtgcatttccctattagctgtcagaaggacagcctagcagatttggttttcttagtcgatgagtctctgggaaccggtggcaacctccgccatctccaaacgttcctggaaaatataaccagcagcatggatgttaaagagaattgtatgcgcctgggcctgatgtcttatagcaattcggctaagacaatcagcttcctgaagtcttccaccacccaatccgagtttcagcaacagatcaaaaacctttcaatacaggtgggaaagtcaaatacaggtgcagccattgaccagatgcggagggatggtttcagtgagagctatggcagtaggagagcgcagggcgtcccacaaattgcggttcttgttacacataggccttccgatgacgaagtccatgacgcagccctgaacttacgcctggaagacgtgaatgtcttcgctctttccatacagggagccaataacacccagcttgaggagatcgttagctaccctcctgaacaaactatctcaactcttaagagttatgcagatctcgagacttactccacgaagtttctgaaaaagctgcagaacgagatctggtcccagatcagcacatacgccgaacagaggaacctggataagacaggttgcgtagacactaaggaggctgacatccatttcctcatcgacggatctagctctatacaggagaagcaattcgagcagataaagcggtttatgctcgaggtgaccgagatgttttctattggccctgataaggtgagggtcggagttgtacaatacagcgatgacaccgaagtcgaattctatataacagactattccaacgatattgatctccggaaggctatattcaacattaagcaattaaccggcggtacatacacagggaaggccctggactacattctgcagatcattaagaatgggatgaaagacaggatgagcaaagtgccctgctacctgatagtgctgacagacgggatgtccacagaccgtgtggtggaacctgctaaaaggctccgggccgaacagataaccgtgcatgcagtaggcattggtgccgcaaataagattgagctgcaggaaatcgcgggtaaagaggagcgagtgtcctttggccagaactttgacgcactgaagtccatcaaaaatgaagtcgtgcgcgagatctgtgcagagaaaggctgtgaagatatgaaagccgatatcatgttcctggtagatagcagctggagcatcggaaatgaaaatttcagaaaaatgaagatctttatgaaaaacctgctgacaaagattcaaattggcgcagacaagacccagatcggcgtggtccagttcagcgacaagacaaaggaggaatttcaacttaacaggtactttactcaacaggagataagcgatgctatcgatagaatgagcctcatcaatgagggcaccctgactggcaaggcactgaactttgtcggccagtattttacacacagtaagggtgcgaggctgggcgccaaaaagtttctgatactcatcactgatggtgtagcccaggacgatgtgcgagatcccgctcggattctgagaggaaaagacgttactatctttagcgtaggtgtgtacaatgcaaaccgtagccagttagaggagattagcggtgattcctcactggtcttccacgtcgagaatttcgaccatttgaaggctctggaaagaaagctgatcttccgggtttgcgctttacacgattgcaaaagaatcactctgctagatgtggtcttcgttttggaccattctggatctatcaagaagcagtaccaggatcatatgatcaacctcacaattcacctcgtgaaaaaggccgatgttggacgcgaccgggtgcagttcggggcattaaaatacagcgaccaacctaacatcctcttttatctgaacacatactctaaccggagcgccattattgagaacctgagaaagaggcgggacacaggcggtaatacatacactgcaaaagcccttaaacacgcgaacgccttgtttaccgaagagcacggatcacggatcaaacagaatgtcaaacagatgctgatagtgataacagatggcgagtcacacgatcacgaccaactgaatgatacagcactggagcttcggaacaagggcatcaccatttttgcagtgggggtgggaaaagctaaccagaaagagcttgagggcatggcagggaacaagaacaatacgatatacgtcgacaattttgataaactcaaggacgtgtttacactcgtacaagaacgaatgtgcaccgaagctcctgaagtttgccacctgcaagaagctgatgtgatctttctgtgcgacggttcagaccgagtgagcaactcggatttcgtgacaatgactacctttctcagcgacttgattgataattttgacattcagagccagcgtatgaagattgggatggcccagttcgggtccaattaccagagcattatcgaactcaagaattcccttacaaaaacacaatggaaaacccagatccagaatgtctcaaaaagcggcggattcccccggattgacttcgccttaaaaaaagtgtccaatatgttcaatctgcatgcaggggggcgcaggaacgccggcgtgccgcagactctggtcgtaataacgtccggcgatccgagatatgatgtggccgatgccgtcaagacacttaaggacctcggtatctgcgtgctggtcctgggcattggtgatgtgtacaaggaacacctgctccctatcaccggtaactctgagaaaattattacgtttcaggatttcgataagctgaaaaacgtggatgtcaaaaaacggataattagagagatatgtcaatcgtgtggcaaaaccaattgtttcatggatatagtcgttggcttcgatatcagcacccatgtccagggacaaccactattccaaggccaccctcagctagagtcctatttacccggtattctggaggacatctcatcaatcaaaggggttagctgcggagccgggaccgaggcgcaggtttcacttgctttcaaagtaaatagtgaccaaggcttccccgccaagtttcagatttaccagaaggccgtgtttgactcacttctgcaggtcaacgttagtgggccaactcatctcaatgcacagttcctgcgctctctgtgggacactttcaaggataagtcagcctcaagggggcaggtgctgttaattttttcagacggactgcagagtgagtcgaatattatgctcgagaaccagtccgaccgcctcagggaggctggcctcgacgcactcctcgtggtgagcttgaataccaccgcccaccacgaattctcctcgttcgagtttggcaagaggttcgactacagaacacacttgaccattggcatgagagagctgggaaagaagctaagccaatacttaggcaacatcgctgaaaggacatgctgttgcactttctgtaaatgtcccggaattccaggcccgcacggaacccggggccttcaagcaatgaaaggtagccagggattgaaaggatcccgggggcatagaggcgaggacggaaaccctggcgtccggggtgacaccggacctcaaggtgataaggggatcgcgggctgccctggcgcttggggacagaaaggacttaaaggcttctcaggccctaaaggcggtcatggtgacgacggaatcgatggcttagatggtgaggagggctgccacggattccccggaattaagggcgaaaagggcgacccaggttcccaaggaagccccggttctcgcggagcgcccggtcaatatggcgagaaaggtttccccggtgatcctggaaacccaggacaaaacaataatatcaagggccagaaaggatcaaaaggcgaacaagggcggcaggggcgcagcggacagaaaggagttcagggtagtccatcctctagaggatctcggggacgggaaggccagagggggcttcggggcgtcagcggcgagcccgggaacccaggtcctaccgggaccctgggtgccgaaggattgcagggaccccagggcagccaggggaaccccggacggaagggggaaaaaggatcacaagggcagaaaggaccccaggggagccctggtctgatgggggccaagggatctactggacggcccggactgctgggcaaaaagggggagcctggattgccaggcgatttgggcccggtgggtcaaacggggcagagagggcggcagggcgactccgggattccaggctatgggcagatgggtcgaaaaggtgtgaaaggacctagaggatttcccggggacgccgggcagaagggagatattgggaaccccggcattccaggcggccccggtcctaaaggttttaggggactggcgcttaccgtgggtctgaagggagaggagggttcgaggggcctcccaggcccgcctggacagcgtggtattaagggaatggctggccagccggtctattctcaatgtgatctgatcagattcctgcgcgagcatagcctctgttcactagagaaatgtccggcctacccaaccgaactggtgtttgctctagataattcctatgatgtgaccgaggagagcttcaacaaaacccgtgacatcattacatccattgtgaacgatttgaacattagggagaacaactgcccggtgggggcccgggtcgccatggtttcctacaattctggcacaagctatttaattcgatggagcgattacaaccggaaaaagcaactgctccaacaattatctcaaatcaaatatcaagacactactgagcccagagacgtaggcaacgccatgaggtttgtcaccagaaacgtgttcaaacgcacctacgctggtgccaatgtgaggagggtggcagtcttttttagcaacggccagacagcctctcgctcttccatcataaccgctacgatggaattctccgccctggacatatctcccaccgtattcgctttcgatgaaagggtttttttagaggctttcggatttgacaacaccggaacgtttcaagtaattcccgtgcctccaaacggagaaaatcagaccttggaaaggttacgtaggtgtgctctgtgttatgataagtgcttcccaaacgcctgtatccgagaagcttttctgccagaggacagctatatggacgtggtgtttctgatcgacaactctaggaatattgctaaggacgaattcaaagcggtgaaggcactggtaagtagcgtgatcgacaacttcaatattgcttcggacccactgattagcgactcaggagaccgcatcgctctcctttcatatagcccatgggagtcgagccgacgaaagatgggtaccgttaagactgaattcgacttcattacctacgacaatcagttactcatgaagaatcacatccagacctcattccagcagttaaacggtgaggcaaccattgggagggcgcttctctggaccaccgagaatctcttccccgagacgccatacttgaggaagcacaaagtgattttcgtggtttcagcgggtgaaaattacgaaagaaaagaatttgttaagatgatggcactccgcgcgaagtgccaggggtacgtcatctttgtgatctctctgggcagtacaagaaaggatgatatggaggagctagccagttacccgctggatcagcacttaatacagcttgggaggattcataaacccgacttgaattacatcgctaagtttcttaagccctttctctacagtgtcaggcgcgggttcaaccagtacccccctccgatgcttgaggatgcctgcagactaatcaatttggggggggaaaatatccaaaacgatggctttcagttcgtgactgagcttcaggaagactttttgggagggaatggatttatcggccaggaactcaactcagggagagagagtccatttgtcaagactgaggataatggatctgattacctggtgtatctgccatctcagatgttcgaaccccagaaacttatgatcaactatgagaaagaccaaaagtctgcagaaatagcatcattgacatcaggtcacgaaaactatggacgaaaggaagaacctgatcatacgtacgaacccggtgacgtgtccctccaggagtattacatggatgtggctttcctcattgatgcctcccaaagggtagggagtgacgaatttaaagaagtgaaagcatttatcacctccgtcctggactattttcatatcgcccccacaccactcacctctacgctgggagatagagtggctgtgctgagctattctccacctggctacatgcctaacacagaggagtgtcccgtctacttggagtttgacctggttacctacaactcaatccaccagatgaaacaccacctgcaggacagtcaacagctcaacggtgatgtgtttatcggccatgcccttcagtggaccattgataacgtcttcgtcggaacaccaaatctgcggaagaacaaggttatctttgtgattagcgccggggaaaccaattcactagacaaagatgtgctgaggaatgtcagtttgagagccaagtgtcaggggtacagcatctttgtgttttcctttggtcctaagcacaacgacaaggagctagaggagctcgcttcccaccctttggatcaccatctcgtgcagctggggcgtacccacaagcccgactggaactatatcatcaagtttgttaaaccattcgtgcacctcatcagaagggcgatcaataaatatcctaccgaagacatgaaggcgacatgtgtgaacatgaccagcccaaaccccgaaaatggtgggaccgaaaatacggtgttgctgctgcccggaatctacgaaatcaaaaccgagaacggggacctgttcgatgaattcgatagtcaggcgcagcatttgctggtcttagggaataatcattcctctgggtccgagaccgctaccgacttgatgcagaagttgtatctcctattcagcaccgagaagctggccatgaaagataaagagaaggctcatctggaagagatctctgcgctggttgtagataaacagcaggaaaaagaggacaaggagatggaggctaccgatatttag

SEQ ID NO: 2527 - DNA, 7848 bp, Artificial Sequence
  Description of Artificial Sequence: Synthetic coding sequence
atgaagattttgctgataatcttcgtgcttatcatttggactgagaccctcgctgaccagtcccctggacccgggccagtttatgctgacgtggtttttctcgtggactccagcgaccatctgggtcctaaatccttcccattcgtgaaaaccttcatcaataagatgattaactcccttcccatcgaggccaataaataccgggtggcgctcgcacagtactcagacgagttccattctgaattccatttaagcacctttaagggacgtagtccaatgttaaaccacctgaagaagaacttccagttcataggagggtcactgcaaatcggaaaagccctacaagaagcccacagaacctacttcagtgcacccatcaacggccgcgacaggaaacagttcccaccaatactggtggtgcttgccagcgccgagtcagaagacgaggttgaagaagccagtaaggctctccaaaaggacggggtcaagattattagtgtgggcgtgcagaaggcatctgaggagaacctgaaggctatggccactagtcatttccatttcaacctaagaaccatacgggacctgtcgacattcagccaaaacatgactcaaatcattaaggatgtgaccaaatataaggagggtgctgtggacgcggacatgcaggtgcacttccctatcagttgccagaaggactccttggccgacttggtcttcctcgtcgatgaatcactaggaaccggcggaaatctgcgccacctccagacatttctggagaatattacgagctcaatggacgtgaaggaaaattgcatgagactggggttaatgtcttatagcaattctgctaagaccatatcatttctgaagagttctaccacacaatcagaattccagcagcaaatcaagaatctttcaatacaggttggaaagagtaataccggggcagccattgatcagatgcggagggacgggttcagtgaatcttacggctcaaggagggctcagggcgtaccacaaatcgcagttctggtgacccaccgaccctccgacgatgaagtgcacgatgccgccctgaatctgcgtcttgaggacgtcaatgtatttgcgctgagcatccagggagccaataatacgcagcttgaagagatcgtgtcctatccccctgagcaaactatttcaacactgaaatcctatgcggaccttgaaacttactctaccaaattcttgaaaaaactgcagaatgaaatctggtcacagatcagtacatacgctgagcagcggaatctggataagacgggctgcgtggatacaaaggaagccgatatccattttctgattgacggctctagctctatccaggagaagcaattcgaacagattaaaaggttcatgttggaagtgaccgaaatgttctccatcggcccagacaaggtgcgtgtgggggtggtgcagtatagtgacgatacagaagtcgaattttacattaccgattattcgaatgatattgacctcaggaaagctattttcaacattaagcaattgacgggaggtacgtatacagggaaggctctggattacatcctgcagattataaagaacgggatgaaagaccgcatgagtaaagtcccatgctacctgatcgtgctgaccgatggaatgagcaccgaccgggtcgtagagcccgctaaacgtttgcgcgccgagcaaattaccgtacacgcagtgggtatcggcgcagccaataaaattgagctgcaggaaattgccggaaaggaggaacgggtgtcttttggccagaacttcgacgcccttaagtctatcaaaaacgaggtggtgcgggagatatgcgccgagaaggggtgcgaagacatgaaggcagacatcatgttcctggtggacagcagctggagcattggaaatgaaaattttcgtaagatgaagatattcatgaaaaatctgctgaccaaaatacagatcggtgcggacaagactcaaataggtgtcgtacaattttccgacaaaaccaaggaggaatttcaacttaacaggtacttcactcaacaggaaatatccgacgccattgaccgcatgtccttgattaatgagggtacattgacaggcaaggccctcaatttcgtggggcagtacttcacacacagcaagggcgctaggcttggagccaagaaatttctgatcctcatcactgatggtgtcgcccaggacgacgtgagagacccagcacgcatcctacgaggtaaagacgtgaccatctttagtgttggggtatacaacgccaacaggagccagctcgaagagattagcggcgactcaagtcttgtgtttcacgtggaaaatttcgaccacctaaaggcactggagagaaagctgattttccgagtgtgcgcattgcacgactgtaaaaggatcactcttctcgatgttgtgttcgttctggaccattcaggatctattaagaaacagtaccaggaccacatgattaacttgacaatacatctggtcaaaaaggccgacgttggccgggacagggtccaatttggggccttgaaatattctgatcagccgaacattctgttctacctaaacacctattctaatcggtcagcaatcatcgagaacctcaggaaaaggagagatacgggaggtaatacctacaccgccaaggcccttaagcacgctaatgcactttttaccgaggagcacggctctcggataaaacagaacgtaaagcaaatgctgatcgtgattaccgacggagaatcacacgaccatgatcagctgaatgacactgcccttgagctgcggaataagggcatcactatcttcgctgttggtgttggaaaagcaaatcagaaggaattagaggggatggctgggaataaaaacaatactatatacgtagacaattttgacaaactgaaggacgtatttacattggttcaggaacgaatgtgcactgaagcaccggaggtctgtcacctccaggaagccgacgtgatttttctgtgcgatgggtcggaccgagtcagcaattctgatttcgtcacgatgacaaccttcctgagtgatctgatcgacaattttgacatccagagccagaggatgaagatcggaatggcccagttcggctccaactatcagtctatcattgaactgaagaattcattaacaaaaacgcagtggaagactcagatacagaacgtctccaaatccgggggtttccctcggatcgattttgctctgaaaaaggtgtccaatatgttcaatctgcatgctggcggccgtaggaacgcaggcgtgccacagacactggtcgtgataacctccggggaccctcgttacgatgtggccgacgcggtgaagacgctaaaagatctgggcatctgtgtgctggtgctgggaatcggtgatgtatacaaggaacatctgttgcccatcacgggcaattctgaaaagattattacctttcaagactttgataaactcaagaatgtagacgtaaagaagcgaattattcgcgaaatttgtcagtcatgtggaaagacgaattgttttatggacatagtggtcgggtttgacatcagcacacacgtgcaaggccagcccctgttccagggacacccccagttggagtcctatttaccaggcatcctcgaagatatctcgtcaattaagggtgtgtcatgcggagctggcaccgaggcccaggtaagtctggctttcaaggtgaactccgaccaggggttcccggccaaattccagatatatcagaaggcagtgttcgacagtctgttgcaagtaaacgtgagcggccctacccacctgaacgcccagtttctgagaagcctgtgggacacatttaaagacaaaagtgcttcccgaggacaagtgttgctgatcttctccgatggtctccagagtgagtccaacatcatgctggagaatcagtctgaccgtttaagagaagcaggtctggacgcgctactcgtggtgagcttaaacacgacagctcaccacgaattttcaagcttcgaattcggaaagcggtttgactaccgcacccacttgacaatcggaatgcgggaactcggtaaaaagctgagtcagtatctcggaaacattgccgagagaacctgttgttgcacgttctgcaaatgtcccggtataccaggcccccacggcactcgtggcctccaagccatgaaaggttcccaggggctgaaaggctcgcgcggccaccgcggggaggatggcaatcccggggtacgaggtgacactggccctcagggcgacaagggcatcgcaggctgtccaggcgcctggggccagaagggactcaagggcttttcaggccccaagggaggccatggggatgatggcatcgatggattggacggagaggaagggtgtcacggctttcccggaattaaaggtgagaagggggatcctggctcccagggtagccccgggtctcgaggagctcccggtcagtacggggaaaaagggttccctggcgaccctggcaaccccggacagaataacaacattaaaggccagaaagggtcaaaaggcgagcagggccgccaggggcgcagtggtcagaaaggcgtgcagggcagcccctcgtcgcggggctcacgtggaagagagggacagcgagggttgagaggggtatccggagagcctggaaatcctggacctacaggaacactaggagccgagggtctgcagggaccacaagggtcccaaggcaaccccgggagaaaaggggaaaagggctcccaaggccagaagggcccccaaggcagccccgggcttatgggggctaaaggcagtacgggccgtcctggcctgcttgggaagaagggcgagccagggttacctggggacctaggccccgtgggacaaacgggtcagaggggccggcagggggacagtggcattccaggctatggccaaatgggacgcaagggagtgaaagggcctagggggtttccaggagacgcgggacagaaaggggatatcggcaatccgggcatccccggcggcccaggccctaagggtttcaggggactggcactgaccgtcggtctgaagggcgaagaagggagtcgcggattacctggacctcccggccagcggggcattaagggtatggctgggcagccagtttatagccaatgtgacctgataaggtttctgcgagagcactcaccatgctggaaagagaaatgcccggcatacccaaccgaacttgtcttcgccctcgataactcttacgacgtgacggaggagtcatttaacaagacaagggatatcataacctcgattgttaatgacctgaacattagagaaaacaactgcccagtcggcgcgagggtcgccatggtgagctacaactctggcacatcctatttgatccggtggtctgactataaccgcaaaaagcagctgctgcagcagctgtcccagatcaagtaccaggatacaacagaacctagggatgtgggtaacgccatgagatttgtgaccagaaatgttttcaagcgcacctatgcgggtgctaacgtcaggcgcgtcgccgtcttcttctctaatgggcagactgcgtcccgttcctccattattactgctacgatggagttttccgcactggatatatctccaaccgtttttgcctttgatgagcgcgttttcctggaggcattcgggtttgacaatactgggacattccaagtgattcccgtgcctccaaatggagaaaaccaaacactcgagaggcttaggagatgcgcgttgtgctatgacaagtgcttcccgaacgcatgcattagggaggctttcttaccagaggactcctatatggatgtcgtctttctcattgacaactctagaaacatagctaaggatgagttcaaggccgtcaaagcactcgtgtcttcagttatcgacaacttcaacattgcatctgaccctcttatatctgatagcggcgatcggatcgccctgctgtcctactctccatgggagtcatccagaagaaaaatgggaacagtgaagaccgaatttgacttcattacatatgacaatcagcttctaatgaaaaatcacatccaaactagcttccaacagttgaacggagaggcaaccattggccgggcacttttatggacgaccgaaaatctgtttcctgagactccttatttgagaaagcacaaagttatatttgtggtcagcgccggtgagaactacgaaaggaaggaatttgtaaagatgatggcgctgcgagccaagtgccagggctacgttatctttgtgatttccctgggttcaactcgcaaggacgacatggaggagctcgcctcataccccctggaccagcaccttatccaactggggcgaattcacaaaccagatttgaattacattgcaaagtttctgaaaccctttctctattctgtgaggaggggatttaatcagtacccgccccctatgttagaagacgcctgtcgcctcattaacctcgggggcgagaatatccaaaacgatggattccagttcgttaccgagctgcaagaagacttccttggcggcaacggttttataggccaggaactaaactctggccgcgaatcaccattcgtcaagacggaagataatgggtcggactacctcgtgtacttgccatcacagatgttcgaaccgcaaaaactgatgatcaactatgaaaaagaccaaaagtcagccgagatcgcaagtttgacctctgggcacgaaaactatgggcgaaaagaggagcccgaccatacatacgagccaggagatgtctctctacaggagtattacatggacgtggcttttttgatagacgctagccagagagtgggatctgatgaattcaaagaggtgaaggcttttatcacctccgtcctggactacttccatatcgcgccaacccccctcacttccaccttaggtgatcgcgtggcagtgctgagctattctccacctggatatatgcctaatactgaggagtgccctgtctatctcgagttcgacctcgtaacttacaactcaatacaccaaatgaagcaccatctgcaggatagtcagcagctgaatggcgacgtgttcattggccacgctcttcagtggacaatcgataacgtgtttgtcggaacccctaacctcagaaagaacaaagtaatcttcgttataagcgcgggcgaaaccaactcacttgacaaggacgtcctgagaaatgtatcgctacgagcaaaatgccagggctattccatatttgtcttctcttttggccctaagcacaatgacaaggaactggaagagctggcctcccatcctctggatcatcacttagtgcaactgggcagaacccataagccggattggaactacattatcaaatttgtgaaaccttttgtacatctgatacggagagcaataaacaagtatcctaccgaggatatgaaggctacctgtgtgaatatgacttctccgaatccagaaaatggtggcaccgaaaatactgttctgctgctgccaggaatttacgaaataaaaactgagaacggggatctcttcgacgagtttgactctcaggcacagcacttactggtgttaggaaacaaccactcgagtggatctgagaccgctactgatttaatgcagaagctctatctgctgttctctacagagaagctcgccatgaaagacaaagagaaggcccacttggaggagatctctgctctcgtcgtggataaacagcaagagaaagaggacaaggagatggaagcaaccgacatctag

SEQ ID NO: 2528 - DNA, 1674 bp, Artificial Sequence
  Description of Artificial Sequence: Synthetic coding sequence
atcggccgcgccctattgtggacgaccgagaatctgttcccagagacaccttatctgcgtaaacacaaagtgattttcgtggtatctgccggtgagaattatgaaagaaaggaatttgtcaaaatgatggccctgcgggccaagtgccagggctatgttatattcgtgatttccctgggatccacccgcaaggacgacatggaagagctggcaagctatcctttggaccaacatctgattcaactgggtcgcatacacaaacctgatctgaattacatcgcaaaattcttgaagccattcttatattccgtgcgccgtggtttcaatcagtatccacccccgatgctggaggacgcgtgccggctcataaatttgggaggtgagaatatccagaacgatgggttccagttcgtgacagagctgcaagaggatttccttgggggaaacggcttcatcgggcaggaactaaattccgggagggagagcccctttgttaagaccgaggataacggaagtgactatttggtttacttaccgtctcagatgtttgagccgcagaagctgatgataaattatgagaaggaccagaagagcgccgagatcgcctccttaacaagtgggcacgaaaattacggacgtaaagaagagcctgatcacacctatgagccaggagatgtctcactacaggagtactacatggatgtggcctttttaattgacgcaagccagcgggttggatcggatgaattcaaagaagtgaaagcgtttatcacttctgttctcgactactttcacattgctcccacccctttgacaagcacactaggggacagagttgcagttttatcctatagtccccctggatatatgcccaacactgaagaatgccccgtttacttggagtttgatctcgtcacgtataatagtatacaccaaatgaaacaccacttgcaagatagtcagcagctcaacggcgacgtctttatcggccacgccctgcagtggacaattgataacgtgtttgtaggaacccccaatcttcgcaagaacaaagtgatatttgttatttccgccggagaaactaatagcttagataaggacgtgctgcggaacgttagcctgcgggcgaagtgccagggttatagcattttcgtgttttcatttggaccaaagcacaacgataaggaacttgaggaattggcttctcaccctctcgatcaccaccttgttcaactcggcagaacccacaagcccgactggaattacattataaaatttgtcaagccttttgtccacctcattagaagagctataaataagtaccccacggaagacatgaaggccacttgtgtgaacatgacctcgccaaaccccgaaaatgggggaaccgagaacaccgtcctgctgcttccaggtatctacgaaattaagaccgagaacggcgacctttttgatgaattcgatagccaggcacaacatctgctggttctgggcaacaatcactcctccggcagtgagaccgcaaccgaccttatgcaaaaattatacctgcttttctccactgagaaacttgcgatgaaagataaggaaaaggcccatctggaagaaatctcagcacttgtggtggacaagcagcaggagaaggaagacggcgaggacacaaggagtagttag

SEQ ID NO: 2529 - DNA, 7581 bp, Artificial Sequence
  Description of Artificial Sequence: Synthetic coding sequence
atgaaaatcctactcatcatcttcgtcctgattatatggacggaaacactggccgatcaatctccaggtcctgggccagtgtatgcggacgtggtttttctcgtagacagtagtgaccacttgggtccaaagagcttcccttttgtcaagacatttatcaacaagatgattaacagtttgccaatcgaagctaacaagtatagagttgctctagctcaatattcagacgaattccactcagaattccatctgagcacttttaaaggcaggtcccccatgcttaaccacttgaagaagaacttccagttcataggtggcagcttacagatcggaaaggcgctacaggaagcccatcgaacttatttcagtgcacccataaatggccgggaccggaagcagttccctccaatccttgtcgtgctcgctagtgccgagagcgaggacgaggtggaagaagcctcaaaagctctgcagaaggatggcgttaagattattagtgtgggggtgcagaaagctagcgaggagaacttaaaggccatggccaccagccacttccattttaatctgaggaccataagggatttaagcacgttcagtcagaacatgactcagatcatcaaagacgtgacgaagtacaaagagggcgccgtcgatgccgatatgcaggtgcatttccccatcagttgtcagaaggattctcttgcagacctggtgttcttggtcgatgagtctttgggtacaggtgggaacctaaggcacctacaaacatttcttgagaacatcacgagttccatggatgtaaaggagaactgtatgcgcttgggccttatgtcttactccaatagcgcaaaaacaattagcttcttaaagagctcaaccactcagtctgagttccagcagcagatcaaaaatctgagcatccaggtgggcaagtccaatacaggagcagcaattgatcaaatgcgccgggatggcttctccgagtcatacggctcaaggcgggcacaaggcgtaccacaaatcgcggtcctggttacacaccggcctagcgatgatgaggttcatgatgctgctctaaacctgcggctggaagatgtgaacgtgtttgcattgagtatccagggagccaataacacacagcttgaagaaatcgtgtcttatccaccggagcagactatctctaccttgaagtcgtacgcagatttggaaacctatagcacaaaattcctaaagaagcttcaaaatgagatatggtcccagatctctacttatgctgagcagcgtaatttggacaagacagggtgtgtagacacaaaagaggcagacatccattttctaatcgatgggtcaagttcaattcaggagaagcaattcgaacagatcaagaggttcatgcttgaagtaaccgagatgttcagcatagggcccgataaggtccgagtaggcgtggttcagtactctgacgatacagaagtagagttttacattaccgactactcaaacgacatcgacttacggaaggccatttttaatattaaacagcttacaggcggaacctatacaggcaaagcattggactacattctgcagatcatcaaaaatggcatgaaagatcggatgtcaaaagttccttgttacttgatcgtcctgacggatggaatgtcaaccgaccgcgtcgttgagcctgcaaagcggctgcgggccgaacagatcacagtgcatgcagtgggaattggcgcggcaaataaaattgagctacaggagatcgccgggaaagaggaacgagtgagctttgggcaaaacttcgacgcgctgaagtccatcaagaacgaagtcgtgcgcgaaatttgtgccgagaagggatgtgaagacatgaaagcagatatcatgttcctggtcgattcttcatggtcaatcgggaacgagaatttccgcaagatgaaaatcttcatgaagaatctgttgaccaaaattcagataggcgctgataaaacccaaattggggtggtgcaattctcggacaaaaccaaggaagagtttcaactgaatagatacttcacacaacaggaaatctcagacgccattgaccgcatgtcactaattaatgagggaactctgacaggaaaagccctcaactttgtgggacagtacttcacccatagcaaaggcgcacgtcttggtgctaaaaagttcctcatcctgattacggacggagtggctcaggatgatgtgcgggatcccgcaaggattctacgcgggaaggacgtcacaatattcagcgtcggcgtgtataacgccaaccgctcacagttggaagagatatcgggggacagtagcctagtgtttcatgttgagaactttgaccatctaaaggcccttgaaagaaaactcatctttagggtttgcgctcttcatgattgcaagagaattacattgctcgatgttgtgttcgtgctggaccacagtggctccattaaaaagcagtatcaggatcacatgataaacctgacaattcatctggtcaagaaggccgatgtcggacgcgatcgcgtacagttcggggctctgaaatacagcgaccagcctaacatactgttttacctgaacacctattctaacaggtcggccattatcgagaaccttcgcaaacgcagagacacggggggcaatacatacactgcgaaggcccttaagcatgcgaacgccctgtttaccgaggaacatggctccaggatcaagcagaatgtgaaacagatgctgatcgtgattacagatggcgaaagtcacgaccatgatcaactgaacgataccgcactggagcttaggaacaaagggattacaatctttgccgtgggcgtgggtaaggccaatcaaaaagaactagaggggatggcgggaaataagaataacacaatctatgtggacaacttcgataaactaaaagacgtgttcactctggtccaggaacgcatgtgcacagaggcacccgaggtttgtcatcttcaggaggctgatgttattttcctgtgtgatggttccgatcgtgtctcaaattccgacttcgtaactatgactacattcctgagtgatctgatcgataacttcgatatacagtctcagcgaatgaaaataggaatggcacaatttggctcaaactaccaatccatcatcgagctcaagaacagcctcaccaagacacagtggaagactcagatccagaatgtgtcaaagtccggcggctttcctagaatcgacttcgctctaaagaaggtgagcaacatgttcaatctccatgcaggtggcagacggaacgccggcgttcctcagactctcgtagtgattacaagtggcgatccccgatatgatgtcgctgacgcggtgaaaaccctgaaagatctgggcatctgcgttttggttctgggtataggcgatgtttataaagagcatctgttaccaataaccggaaattccgagaagattattacatttcaagactttgacaagctgaagaacgttgacgtcaagaagcgtattatccgtgagatttgccagagttgtggtaagaccaactgttttatggacatcgttgtgggctttgatatcagcacccacgtccaagggcagcctttgttccaaggtcatccacaactggaaagctaccttccaggaatacttgaagacatctcttcaatcaagggggtatcatgtggggcagggacagaggcccaggtttccctcgccttcaaggtgaacagtgatcagggcttccccgccaagttccagatctaccagaaagctgttttcgatagccttttgcaggtgaatgtgagtggtccaactcacctgaacgctcagttcctacgatcgctctgggacacattcaaagacaaatctgcgtcacgcgggcaagtactgcttattttttcagatggcttacagagtgagagtaatatcatgctggagaatcagtcagatcggctgagggaggccggattggacgcactgctcgtggtgtctctcaacaccactgcacaccacgaattttctagcttcgagttcgggaaaaggttcgattatcgcactcaccttacaattggaatgcgagaactcggaaaaaagttgagccagtacctaggcaacatcgccgagcggacgtgttgctgcacattttgtaagtgtccggggattccaggcccacatgggacccgcggtcttcaggccatgaagggttcgcaagggctcaaagggagccgagggcatcgaggtgaagacggcaaccccggcgtacgcggagacactgggcctcagggtgacaagggcatagcaggatgtcccggagcgtggggacagaagggtcttaaagggtttagcggcccaaaaggggggcacggcgacgatggcattgatggcctggacggagaagaaggctgccatggatttcccggcatcaaaggtgagaaaggagatcccggaagccagggctctcctggatcccggggcgcacccggccagtacggagaaaaagggttccccggcgatccaggcaatcctggtcagaataacaatatcaaggggcaaaaaggcagcaaaggggaacagggaaggcaagggaggtcaggccagaagggggtgcagggtagcccctcctcaagaggttcacggggcagggaagggcagagaggacttcgaggcgtttcgggggagcctggtaatcccgggcctaccggtacactgggggccgaagggttacagggtccacagggatcccagggcaatccaggtagaaagggtgaaaaaggtagccaaggacagaagggaccacagggctctccaggcctcatgggcgcaaagggctccactggaagacctggtctgttaggcaagaaaggcgagcccggcctccccggggatctcgggccagtgggccagacaggtcaacggggacgccagggcgacagcggtatcccaggttacgggcaaatggggcggaagggcgtgaaggggcctagaggatttcccggggacgccggccaaaaaggtgacattggcaaccccggcatcccaggaggccctggaccaaagggcttcagaggtctcgctctcactgtgggcttgaaaggcgaggagggttccagggggctgcccggaccacctgggcaacggggaattaagggcatggcagggcaacctgtatactcacagtgcgaccttatccggtttctgagggaacattcattatgcagcctggagaagtgccccgcgtacccaacagaacttgtatttgcgttggacaacagctacgacgtcacagaggagtccttcaataagacacgggatatcattacatccatagttaacgatttgaatatcagggagaataactgtcccgtgggggcgagggtcgccatggtctcttacaactctggaacgtcctatttgatccgatggtcagattataaccgaaagaaacaactgctccagcagctcagccaaatcaaataccaggacaccacagagccccgtgatgtaggcaatgctatgagattcgtgactagaaacgtttttaagagaacatacgccggcgcaaacgtacgccgtgtcgccgtgtttttctcaaatgggcagacagcatcccggtcctctatcattaccgctaccatggaattttccgcactcgatatcagtcctacagtgtttgctttcgacgaaagggtgtttctggaggctttcggcttcgacaatacaggcaccttccaagtgatcccagtccctccaaacggcgagaaccagaccctagagcggctgcgccggtgtgccctgtgctatgacaaatgttttcctaacgcttgcataagggaggcttttctgccggaagacagttatatggatgtagtatttttgatcgacaactcccgtaatatcgccaaagacgagtttaaggccgtgaaggccctggtgtcatctgttatcgacaattttaacatcgcctctgaccccctgatttccgattctggggaccggatcgccctgctgagctactctccttgggagagcagccggcggaagatgggcaccgtgaagacagagttcgatttcatcacgtacgataatcagttgctcatgaaaaatcacattcagacaagctttcagcaactgaatggggaagcgacgattggaagagccttgctctggactactgaaaacctgtttcctgaaacgccttatctgcgcaaacacaaggtcatcttcgtggtaagcgccggagagaactacgaacgtaaagagttcgtgaagatgatggccctaagggccaagtgccagggctatgtaatcttcgtgataagtttaggatcgaccagaaaggatgacatggaggaactcgccagttatcccctggaccagcatctgatccagctgggccgaatacacaaaccagacctgaactacatcgccaagtttttaaagccgtttctctactcggtgcggagaggttttaaccagtaccctcccccgatgttggaggatgcctgtcggctgatcaatttgggaggtgagaacatccagaatgacggtttccagttcgtaaccgagctacaggaagactttctgggcggcaacggattcattggccaggagctcaactcaggaagagagagccccttcgtgaagacggaggataatggctccgactacctggtatacctgccctctcagatgttcgagccccagaaactgatgatcaattacgaaaaggaccaaaaatcggcagagatcgcatcgctgacaagtggacacgagaattacggccggaaagaagagcccgaccacacctacgagcctggagatgttagcctgcaggaatattacatggatgtggccttcctgatcgacgcttctcaacgagtcggctccgatgagtttaaggaagtgaaagcgtttattactagtgtgctggattatttccacatagctcctacacccctgacatctacccttggcgatagagtggctgtcttatcctactcacctccgggatacatgcccaacaccgaagaatgccccgtgtacctggaattcgatctagtaacttacaactcaattcaccagatgaaacaccatctccaagattcacagcagctgaacggggatgtctttattggacacgcactgcaatggaccatcgacaacgtgttcgtgggaacccctaatctgaggaagaacaaggtcatattcgtcatatccgccggcgaaaccaattctctagataaagatgtgctcagaaatgtctccctccgggctaaatgccagggatatagcattttcgtgtttagttttggcccgaagcacaatgataaggaacttgaagagcttgcttcacatccgttggaccatcacctggtacaactgggaagaacccacaagccagactggaattacatcattaagtttgtaaagcccttcgtccatctcattagacgcgccatcaataaatatcccactgaggatatgaaggctacctgcgttaatatgaccagcccaaaccccgaaaacggcggcactgagaacactgttttatggtag

SEQ ID NO: 2530 - DNA, 1332 bp, Artificial Sequence
  Description of Artificial Sequence: Synthetic coding sequence
aaccagtatccacccccaatgctggaggacgcatgtcgtttgattaacttaggcggggagaacattcagaatgacggatttcagtttgtgactgagctgcaggaggacttcctcggcggcaacggctttattggacaagagctgaattccggacgtgagagccctttcgtgaagacagaagacaacggcagcgactatctcgtttatctgccatctcagatgttcgaacctcagaaactgatgatcaactatgagaaggatcagaaatcagctgaaatcgcctcactgacaagcggacatgagaactacggacgaaaggaggaacctgaccatacttacgagcccggcgatgtatcgctgcaggagtactatatggatgttgcctttctaattgacgcttcgcagagagtcgggagcgatgaattcaaggaggtaaaggctttcataacctctgtgctagattattttcacattgctccaacacccctcacttcaaccctgggagacagagtcgcggtgctttcatactcccctccaggatatatgccgaacaccgaagagtgtcccgtgtacctcgagtttgacctggtgacctataactcaattcaccagatgaagcatcacctgcaggattcacagcagctaaatggggatgtgtttattggacacgcgctgcaatggacaattgataatgtgtttgttgggacccccaatctgcgcaagaacaaagtgatctttgtgattagcgccggcgaaacaaacagcctggataaggatgttttaaggaacgtgtctctgcgcgcaaaatgccaggggtactctatcttcgttttttcattcggtcctaagcacaatgacaaagagctcgaagagcttgccagtcacccactggaccatcacctggtgcagttgggtcgtacgcacaaaccagactggaattacataatcaagttcgtcaagccattcgtacacctgattcgcagagctatcaataagtaccccacggaagatatgaaagccacatgtgttaatatgacctcaccgaaccctgagaacggaggtaccgagaacactgtcctcctccttcctggtatttatgagatcaagacagagaacggagatctctttgacgagtttgactcgcaggcccagcatctgcttgttctgggcaacaaccacagtagcggtagcgaaactgccactgatctgatgcagaagctgtacttgttgttcagcaccgaaaaattagcaatgaaggataaagaaaaagcccacctcgaagagatatctgctttggtagtggataagcagcaggagaaagaggatctctag

SEQ ID NO: 2531 - DNA, 6792 bp, Artificial Sequence
  Description of Artificial Sequence: Synthetic coding sequence
atgatgctgctcattctttttctcgttatcatttgttcacacatctcagttaatcaggatagtggcccagagtatgctgatgtggtgttccttgtggactcaagcgaccgattggggagcaagtcctttccgttcgtgaagatgttcatcacaaagatgatatcctccttaccaatcgaggcggacaagtaccgcgtggcattagctcagtactcagacaagctgcatagtgagttccatctttctacgtttaaaggtagatctccaatgctgaatcatctaaggaaaaattttgggtttatcggcggcagccttcagattggtaaagcactgcaggaagcccaccggacttatttcagcgcaccagccaatggccgcgataagaaacagttccctccgattctggtagtgctggcatcttctgaatccgaagacaacgtggaagaggccagtaaagccctgcgcaaggacggcgtgaaaattattagcgtgggcgtacagaaggccagcgaggaaaatttgaaggcaatggccacctctcagttccattttaacctgaggactgtgcgagatttatccatgttctctcagaacatgacacacatcattaaggacgttattaagtataaggagggagcggtggatgatatcttcgtggaggcctgccaaggccccagcatggctgacgtggtcttcttgctggacatgagcataaacggaagcgaggaaaattttgactacctgaagggctttttggaggagtcagtttcagcactggatataaaggaaaactgtatgcgggtcggcttggttgcttactcaaacgagaccaaagtgatcaactcactgtcaatgggcatcaacaaaagcgaggtactccagcacatccagaatctatcaccgaggactggaaaagcgtacaccggagccgccatcaagaaactgcggaaagaagttttttctgcccgaaacgggtccagaaagaatcagggcgtcccacagatcgcggtgcttgtgacacaccgcgacagcgaggataatgttacgaaggccgccgtgaatcttagaagggagggcgtcactatcttcaccctcgggattgagggggcctcggacacccagctcgagaagatcgctagccaccctgctgagcagtatgtctctaaactcaaaacctttgccgacctggcagcacacaatcaaacattccttaaaaagctcagaaaccagatcacgcatactgtgtccgtattctcggaacgaaccgaaaccctgaaaagtggatgcgttgatacagaggaggccgacatctacctgctgatagacgggagcggatcgactcaggctaccgacttccacgaaatgaagacattcctgagtgaggttgtgggaatgttcaatatcgccccacacaaagtgcgcgtgggagcggtccaatacgccgacagctgggacctcgaattcgaaataaataagtactctaacaaacaggacctgggaaaggcgatcgaaaatatcagacagatgggagggaacacgaataccggggccgccttaaattttacactgagcctgcttcagaaggctaagaagcagcgtggaaataaggtgccatgtcacctggtggtactgacaaacggcatgagcaaagattccattttggaacctgctaatcgccttagggaggaacacatacgtgtttatgcaattgggataaaggaggcaaaccaaactcagctgagggagatcgctggcgaggaaaagagggtgtattatgtccacgactttgatgctctcaaagacatacgaaaccaggttgttcaagaaatctgcacggaagaagcctgcaaagaaatgaaggccgatataatgttcctggtggatagctctggcagcatcggacccgagaattttagtaagatgaagaccttcatgaagaacctggtgtctaagagtcaaatcggtccggatagagtgcagatcggcgtggtgcagttcagcgatattaataaagaggagttccagctgaacagattcatgtcacagagtgacatctctaatgctattgaccagatggctcacattggtcagaccacgctcaccgggtccgcattgtccttcgtgtctcagtacttttcccccacaaagggagctaggcccaatattaggaaatttctgatccttattactgacggagaggcccaggatattgtgaaagaaccggccgtcgtcctgcgtcaagagggagtgatcatttactcagttggtgtcttcggctcgaatgtgacacagctcgaggagatcagtggacggcccgaaatggtcttctatgtggaaaacttcgatatcctgcagcggatagaagatgatctggtctttggtatctgctctccgcgagaggagtgtaaacgcattgaagtactggatgtggtgttcgttatcgattcctccggaagtattgattacgacgaatataatattatgaaagactttatgattggtcttgtcaagaaagctgacgtcggcaaaaaccaagtccgtttcggggctttaaaatatgctgatgacccagaagtgcttttttaccttgatgacttcgggaccaaattggaggtaatttctgttctacagaacgaccaagcaatgggcggaagcacctatactgctgaggcactcggcttcagcgaccacatgttcaccgaagcccgtggttcaagactgaacaagggagtgcctcaagtgctcatcgtgatcaccgatggcgaaagccacgatgctgacaaacttaacgctaccgccaaagcactgagagataagggaattctggtcctggcagtcggtatagacggagctaacccggtggaactgctggccatggctgggagctctgacaaatacttctttgtggagactttcggcggcctgaagggcatcttttcagacgtgacggcatccgtgtgtaacagttccaaggtcgattgtgagattgataaggttgatctcgtctttttgatggatggaagcacaagcattcaaccgaacgattttaagaaaatgaaggagttcctggcctcggtcgtgcaggattttgacgtgtccctcaaccgcgtgcggattggcgccgctcagttttccgacacctaccatcccgaatttcctctgggaacgttcatcggtgagaaagagatatctttccagattgagaatattaaacaaatcttcggaaatacccacataggcgctgccctaagggaggtcgagcactacttcagacccgacatgggctctaggataaataccggtacccctcaggtacttctcgtgttgactgatggacagtctcaggacgaggtggcccaggcggctgaagcgctcaggcatcgaggaatagatatctattctgttggaattggggacgtcgacgaccagcagttaattcagattacaggtacggcggagaaaaaactcaccgtgcacaattttgatgaattgaaaaaagtgaacaaaagaatcgtcagaaacatctgcactacggctggggagagtaactgttttgtcgacgtggtagttggcttcgatgtctccacgcaggagaaaggacagacattgctcgaagggcagccatggatggagacataccttcaggacatcttaagggccattagcagcctcaatggagtgtcttgcgaagttggcaccgagacgcaggtctctgtggcttttcaggtgaccaacgctatggagaaatatagccctaaatttgagatctactccgagaatatcctgaactctctgaaagatatcaccgtgaagggacctagcctgcttaatgctaaccttttggactcactgtgggacactttccagaataaatcagccgctagaggcaaggttgtcctgctgttttctgacggcttagacgatgatgtcgaaaagttggaacagaaaagtgatgaattaagaaaagagggcctgaatgctctcatcactgtcgcgctcgatggcccagcggattcttccgacttagcagacttaccgtatattgaattcggcaaaggatttgaataccgaacacagctgagcattggaatgagggaactgggctctaggctttcgaaacagcttgttaatgtagccgagagaacgtgttgttgcttattttgcaagtgcattggaggggacgggacaatgggcgatcccggacctcctgggaagaggggccctcccggcttcaaaggctccgagggatatctgggggaggaaggaattgcaggcgagagaggcgcccctggtcccgtgggggaacagggaacaaagggatgttacggtaccaaaggaccgaaaggcaacagggggctgaacggtcaggaaggcgaggtgggcgagaatggaattgacggcttgaatggcgaacagggtgataacggcctgcctggacggaagggggagaaaggcgacgaagggtcccagggtagccccgggaaaagggggaccccaggagaccggggcgccaagggtctacgaggtgatccaggcgcaccaggcgttgatagttccatcgaggggcccaccggacttaagggggagcgggggaggcagggtcgaaggggatggcctggtcctccagggaccccgggatcccgacgaaagacggccgcccatggacgcaggggacacaccggcccccaagggaccgcgggaattccaggcccagacggcttagaagggagcttgggtctgaaaggccctcaaggtccccgcggtgaagcaggggtgaagggagagaagggtggcgtcggctccaaaggacctcagggcccaccggggccaggaggcgaagcgggcaaccaggggcggctgggctctcaaggtaataagggcgaacctggagacctgggtgaaaaaggggcagtcggcttccctggtccccgcggccttcagggcaacgatggttcgcccggctatggctctgtggggcgaaaaggggctaagggacaggagggcttcccgggtgagagtggacctaaaggggagatcggcgacccagggggcccaggcgagaccggccttaaaggggcccgcggcaaaatgatcagtgccggtctcccaggagagatggggtcacctggggaaccaggaccccccggccggaaaggagttaagggggccaagggtctcgcctctttctcgacgtgtgagctcatccagtatgtgagggaccggagccccggccgccacgggaaacctgagtgtcccgttcaccccaccgagctggttttcgctctcgaccattcacgtgacgtgacggaacaggagtttgaaaggatgaaagaaatgatggcatttctggttcgcgatataaaggtacgtgaaaatagctgtcctgtgggtgcccatatcgcgatcttatcatataattctcacgctcgccaccttgtgaggtttagtgacgcatacaaaaagtcccaactccttagagagatagaaaccatcccatacgagagatccagtgcatccagagagatcgggagagcgatgcgatttatatccaggaatgtgtttaagcgaacgctgcctggtgcacataccagaaagatcgccacctttttcagtagcggacagagcgccgatgctcatagcataactactgccgccatggagttcggagctcttgagattatccccgtagtcataaccttcagtaatgtgccgagcgtgcggcgagcatttgccatagacgatacggggactttccaggtgatcgttgtaccttccggagccgactacatcccggccctggaacgtttgcagaggtgtactttttgttatgatgtctgcaaacctgatgcttcttgcgaccaagcgcgcccaccccctgtccagtcttatatggacgcggctttcctactcgacgcatcccgcaacatgggttctgctgagttcgaggacatcagggcattcctgggggcgttactcgatcacttcgagattacccccgaacccgagacgtccgtgacaggagacagagtagcactcctgtcccacgcaccaccggattttctcccaaacactcagaaatctcccgttagagccgaattcaatcttacgacttatcgaagtaagcgtctgatgaaacgacacgtccatgagtctgtgaagcagcttaatggggacgccttcatcgggcacgcattacaatggactctggacaacgtgttcctttccacccctaaccttagacgaaacaaagtgatcttcgtcatctccgcgggagagacttcccatctggacggcgaaatcttgaagaaagaatcactgcgggccaaatgccagggatacgccttgttcgtatttagtcttgggccaatttgggatgataaagaacttgaagatctggcttcacacccactggatcaccatttagtgcagcttgggcggatccacaagccagaccatagttacggcgtcaaatttgtgaagtcatttatcaatagtatccggagggcaatcaacaagtacccccctatcaatctcaaaattaaatgcaatagacttaacagtatcgacccgaagcagccccccagaccattcaggagctttgtgccgggtcccctcaaagcaaccttgaaggaagatgtacttcagaaggcaaaatttttccaggataaaaagtacctgagccgggttgctaggagtggtcgtgatgacgctattcaaaactttatgcgatccaccagccataccttcaaaaacggaagaatgattgagagcgcccccaaacagcatgactag

SEQ ID NO: 2532 - DNA, 6792 bp, Artificial Sequence
  Description of Artificial Sequence: Synthetic coding sequence
atgatgctgctcattttatttctggtaatcatatgttcacacatatcagtgaaccaagattcggggcccgaatatgcagatgttgtgtttctcgtagattccagcgatcgtttgggaagcaagagcttccccttcgtgaagatgttcattactaaaatgatatccagcctccctatcgaagcagataagtaccgagtagccctggctcaatacagtgacaaactgcactcagaatttcacctctccacattcaaaggacgcagccccatgctcaaccacctgaggaagaacttcgggtttatcggaggatctctccagatcggcaaagccctgcaagaggctcatcgtacgtatttttccgccccagctaacggtagagataagaaacagtttccacccatacttgtcgtcttagcctcaagcgaaagtgaagacaacgtagaggaggcatccaaagcccttagaaaagatggggtgaagatcataagcgtgggggtgcagaaagcctcagaggaaaatcttaaggccatggctaccagccaattccacttcaaccttcgtaccgtgagagacctcagtatgttctcacaaaacatgacccacatcataaaagacgtgataaagtacaaagagggagccgtggacgacatttttgttgaggcgtgccagggaccctcaatggctgatgttgtatttctcctggatatgtctattaacggctccgaagagaacttcgattatctgaaaggctttctggaggaaagcgtctcagccctggacattaaagagaactgcatgcgcgtaggactggtagcttattctaatgaaaccaaagttataaatagcctatcgatggggatcaataaatctgaagtcctgcaacacatccagaatctgagcccaaggaccggcaaggcctacacaggggccgctattaaaaagcttagaaaggaggttttctccgcccggaatgggtccagaaagaatcaaggggtcccacagattgctgtgttagtcacgcatagggatagcgaagataatgtcactaaagccgcggtgaatcttagacgggaaggggtgactatctttacgttagggattgaaggtgcgagcgacacacagctggagaagatcgctagccacccagcggagcagtacgtgagtaagttgaaaacttttgctgatctagcggctcataatcagacgttccttaaaaagctgaggaatcagataactcacaccgtcagtgtgttctctgaacggacagagaccctgaaaagtggatgtgttgacacagaggaggcggacatctatctactcatagatggttcaggatccactcaggctacagatttccacgaaatgaagaccttcttatcagaagtggtcggcatgtttaacatcgcaccccacaaggtccgcgtcggagctgtgcaatatgccgattcgtgggatctcgaatttgagatcaataaatacagtaacaaacaggatctgggtaaggccattgaaaacatccgccagatgggaggaaatacaaatacgggtgcagccttgaattttacactgagcctgctgcagaaagccaagaagcagcggggcaataaagtgccgtgccatttggtggtgctcacaaatggcatgagcaaagactctatcctcgaaccagctaataggctgcgcgaggagcacatcagagtctacgccattggaattaaagaggctaaccaaactcagttaagagaaatagcgggagaggaaaagcgcgtctactacgtgcatgactttgacgcattaaaggacattcgaaaccaggtcgtgcaggagatctgcaccgaagaggcctgcaaagagatgaaggccgatatcatgtttcttgttgattccagtggctcaataggcccagaaaatttcagcaaaatgaagacctttatgaagaacttggttagcaagtcacaaatcggccctgatagggtacaaataggagtggtacaattttccgatatcaacaaagaagaatttcaactcaacagattcatgtctcagtcagacatatctaacgccattgaccagatggcccacatcgggcagaccactttgacaggaagtgccctgtcatttgtgtcccaatacttctcacccaccaaaggagcacgtccaaacataagaaagttcctcatcctgataaccgacggcgaggctcaagacattgttaaggaacctgcggtggtccttcgccaggagggtgtcattatctatagtgtcggggtttttggttctaacgttactcaactggaagagatcagtggacgccccgaaatggttttctacgtagagaattttgacattcttcaacgcattgaggatgacctcgtgttcgggatctgtagtccaagagaagagtgtaagcgaatcgaagtccttgacgtagtctttgtgatcgattctagcggtagtatagactatgacgaatacaacatcatgaaagattttatgatcggcttagttaaaaaggcagatgtgggcaaaaaccaggtcagattcggagccctgaagtatgctgatgacccagaggtgctcttttatctagacgatttcgggaccaaactggaagtaatttcagtgttgcagaatgatcaggcaatgggaggatccacctacactgccgaggctttaggattcagcgatcacatgttcaccgaggcccggggatctcggctcaataaaggggtgcctcaggtgctgatcgtgatcacagatggggagtcacacgatgccgataaattaaacgctacagccaaagccctgcgggacaaggggattcttgtgctggccgttgggattgacggagcgaacccggtggaactgttggccatggctggctctagtgacaagtacttttttgttgagaccttcgggggcctgaaaggaatattcagcgacgtcacggcctcagtttgcaatagctcaaaagtcgactgcgagatagacaaggtggaccttgtcttcctaatggacgggagcaccagcatccagcctaacgactttaagaaaatgaaggagttcctagcgtcggttgtgcaggatttcgacgtctctctgaaccgggttcgcatcggcgcggcccagttcagtgacacatatcacccagagttcccgctgggaactttcatcggcgaaaaagaaataagctttcagatcgagaacatcaaacagatctttgggaacacacacatcggggcagcattgagggaggttgaacattactttcggcctgatatggggagtagaattaacaccggaacaccccaagtacttctggtgctcaccgacggtcagtcacaagacgaagtggcccaagcagccgaggccctccggcacagaggcatcgatatatactcggtggggataggcgatgtggatgatcagcagctgattcagattaccgggacagcggaaaagaaactgactgtccacaactttgatgaattgaaaaaagttaacaagcggattgtccggaacatctgtaccaccgctggggaatcgaactgcttcgtcgatgttgtggtcgggttcgatgtgtcaacccaggagaagggacagacactgctggaaggacaaccctggatggagacgtatctgcaagatatcctccgggccatcagctccctgaatggggtatcttgtgaagtggggaccgagacccaggtgtcagtggccttccaggtaacaaatgccatggaaaagtactctcccaagttcgaaatctactcggagaacattctcaactctctaaaggacatcacagtaaagggaccgtcactgctaaatgccaatctcctggatagtctctgggacacctttcagaacaagagtgcagcccgtgggaaagttgtgctgctattttcggatgggctggatgatgatgtagaaaagctcgagcagaagtcggatgagctgaggaaagagggcctgaatgcacttatcaccgtggccctggacgggccggctgacagttccgacctggctgacctcccctacattgaatttgggaaaggcttcgagtatcggacacaactgagcatcgggatgcgcgaactcgggtcgcggctttcaaagcagctcgtcaatgttgcagaacgcacatgttgttgcctgttttgtaaatgcataggtggagatgggacaatgggcgatccaggccctccaggtaagagaggcccccctggcttcaagggctccgaagggtaccttggtgaggaaggcattgctggtgaaaggggagctcctggacccgtgggcgaacaaggaaccaagggttgctacggcaccaagggaccaaaggggaaccgtggcctgaacggtcaagaaggcgaagtgggagaaaacggaattgatgggctgaatggcgaacagggcgacaacggcttgcctggtcgcaagggcgagaagggcgatgaaggttcacaaggtagtcccggaaaacgagggactcctggggatcgtggcgcgaaaggacttagaggcgatccgggagcccccggcgtagactcctccatcgagggacctactgggctaaaaggcgaaaggggaagacaaggacgacgcggatggcctggcccccctggaacaccaggctctaggcgtaagacagctgctcacgggcggcgcggacacacaggtcctcagggaacagctggaatcccgggccccgacggcctcgaaggttcgctgggcctgaagggacctcaaggaccaaggggagaagcaggtgtgaaaggtgaaaagggcggagtagggagtaaaggtcctcagggtccccccgggccaggaggtgaggccgggaaccagggcagactcggcagccaaggtaataaaggcgagcctggagacttaggagagaagggcgccgtgggttttccggggccgcgaggcctgcaagggaatgacggatcccctgggtatgggagtgtgggccggaaaggggctaagggccaagaggggttccccggagagtctggcccaaagggagaaatcggcgaccccggcggcccgggcgagactggcctgaaaggggccagggggaagatgatatctgcaggactgccgggggaaatgggatctccaggcgaacctggtcctcctgggagaaagggggtcaaaggagcgaaaggtcttgcttctttctcaacttgcgagcttatccagtatgttcgcgaccgatcccccggccagcatcgtaagcccgagtgtccagttcacccgactgaactcgtctttgcattggaccattcacgagacgttactgagcaagaatttgagagaatgaaggagatgatggcctttttagttcgagacatcaaggttcgggagaacagttgtccagtaggcgcccacatcgcaatattatcatacaattctcacgccaggcatttggtgcgcttttcagatgcctacaagaaaagccagctactaagagagattgagactatcccctatgagagatccagcgccagtcgcgaaattggccgggctatgcgcttcatctcgcgaaacgtgttcaagaggaccctgccaggagctcatactagaaaaattgccacattcttttcaagtggccaaagcgccgacgcccacagcatcacgacagcagctatggagttcggcgcattagaaatcatcccagtcgtgattacattcagtaatgtcccctccgtccgacgggcttttgcaatagacgacaccggtaccttccaggtaatagtggttccaagcggtgctgactatatacccgccctagagagacttcagaggtgcactttctgctacgacgtgtgtaagccggacgcctcttgtgatcaggctagacctccccctgttcaatcatatatggacgctgccttcctactggacgcatctcggaatatgggcagcgccgagttcgaagacattcgggcctttcttggtgctctcctggatcactttgagatcacgccagaaccagaaacgtcagtgacaggtgatagggtggcccttctgagtcacgccccccctgatttcctacccaacacacaaaagagccctgtgcgggccgaattcaatctgactacctaccgttcaaagcgacttatgaaaagacacgttcatgagtctgtaaagcaattgaacggcgacgcctttattgggcacgccctgcagtggactttggataacgtgtttttgagtaccccaaacctgcggcgcaataaggtgatctttgttatttcagctggcgagacctctcacctggatggagaaatcctgaagaaagagagtctacgggccaaatgtcagggatatgcactgttcgtgtttagtctcggacccatctgggacgataaagagcttgaggacttagcatctcacccactagatcatcacctggtacagctggggcggatacacaaacccgaccactcttatggcgtcaagttcgtcaaaagcttcattaactcaattcggcgggcgatcaataagtaccccccaatcaatttgaagatcaaatgcaacagactcaatagtatcgaccctaagcagccgccacgtccattccgtagctttgtgcctggtcccctaaaagccacactcaaggaggacgttctgcagaaggccaagttcttccaggacaagaagtatctgagcagggtggctcgaagtgggagggatgacgcgatccagaatttcatgcgcagcactagccacaccttcaagaacggccggatgatcgaaagtgctcctaagcagcacgactag

SEQ ID NO: 2533 - DNA, 2112 bp, Artificial Sequence
  Description of Artificial Sequence: Synthetic coding sequence
atgctagggacgctcacccctctctcgtctctgctcttgttactcctggtgctggtgctgggatgtggccctcgggcatcaagcgggggcggagccggaggggctgcaggatacgcccccgtgaaatatattcagccgatgcagaaggggcccgttggtcccccgttccgagaaggtaaaggccagtacctcgagatgccgctgcccttactcccgatggatctgaagggtgagccggggcctccaggtaaacctggcccccgagggcctcccgggcctccaggattccctggaaaacccggaatgggcaaacccgggctacacggacagcccgggccagctggtccccccggcttctcacggatgggaaaggccggccccccgggtctcccgggaaaggttggccccccaggacagcctggcctccgcggggagcctgggatcaggggggaccaggggctgagaggacccccaggtcccccagggctcccaggaccctctgggatcaccattccagggaagcccggcgcccagggcgtacctggccctcctggctttcaaggcgagccggggccccagggggaacccggacccccaggcgaccgggggctcaaaggggataacggggtgggtcagcctggcctgcccggagcacccggacaggggggagcccccggccctcctggattgcctggccccgctgggctgggcaaaccaggcctggatggactgcccggagcacccggggataagggggagtcagggcctccgggggtgcccggccccagaggtgagccgggggctgttggtcccaagggtcctcctggcgtcgatggggtgggggtcccaggggctgcgggcttgccagggccccagggcccaagtggtgccaagggcgaaccgggaacaaggggtccccccggtttgattgggcccaccggatacggaatgccaggactccctggcccgaagggagatcgaggccccgcaggtgtaccaggattgctcggtgataggggggagcctggtgaggatggggagcctggagagcagggccctcagggcctgggtggcccaccgggactgccggggagcgctgggttaccagggcggcgaggaccacctggcccaaaaggtgaagcagggccaggggggcctcctggagtgccgggtattcggggagaccagggacccagcgggttagccggaaagcccggggtgccaggcgagcgggggctgccgggggcccacgggccccctggacccacagggcctaagggagagcccggctttaccggtagacctgggggccctggggtcgccggcgcccttggccaaaagggtgaccttggactgcctggccagccaggcctgcgaggtccctctggaataccaggactgcagggccctgcaggaccaatcgggccccagggcctgcctgggctgaaaggggagcccgggctgccgggccctccaggagaaggccgtgcaggcgagcccggtactgccggacccacaggaccccctggggtcccaggctctcctggaatcactggcccgcccggccccccaggacctcccgggccccctggcgcgcctggagcctttgacgaaacaggaattgcagggctccaccttcctaacgggggggtcgaaggagcagtgttggggaaaggcggcaagcctcagttcggcctcggcgagctaagcgcgcacgcgacacccgcttttacggctgtcctgacgtccccctttcccgcatcaggcatgccagtgaagttcgaccggactttgtacaacggccacagcggatacaatcctgctaccggcatatttacctgtcccgtgggtggtgtgtattatttcgcttatcatgtccacgtcaaggggacaaacgtgtgggttgcactatataaaaataatgtacccgccacttatacctatgacgagtataagaaaggctatttggaccaagcctcgggaggggcagtcctgcagcttagacccaacgaccaggtctgggttcagatgccttctgatcaggccaatggtttgtattctactgaatatatccacagcagcttcagtggttttctgctctgccctacctag

SEQ ID NO: 2534 - DNA, 1284 bp, Artificial Sequence
  Description of Artificial Sequence: Synthetic coding sequence
atgcttgggacactaacccccttatcatctctgcttttgctgcttttagtcttagtgttaggttgcgggccccgcgcaagttcaggcgggggagctggaggtgccgcaggctatgcgcctgtcaaatacatccagcccatgcaaaagggcccagtaggacccccatttcgggagggtaagggccagtacctggaaatgccactccctctcctccctatggatctgaagggcgaaccgggaccccctgggaagccgggacctcgggggcccccgggcccccctggattccccgggaaaccaggtatgggcaaacctggactgcatggccagccgggacctgccggtcctcccgggttctcccgcatgggtaaggccggtccccccggcctacctggaaaagtgggtccccctggccaacctggtctgcggggggagcctgggattcgtggcgatcagggattaaggggcccaccggggccaccaggactgccaggaccttctggtattacgatcccaggcaagccgggcgcacagggtgtccccggtccgccaggcttccaaggcgaaccagggccacaaggcgagcccgggcctcctggggatcgaggactgaaaggcgacaatggcgtcggtcagcccggtctccctggtgctccaggtcagggtggcgcccccgggccacctggattgcccggcccagccggccttgggaagcccggattagacggtctgcctggcgcccctggcgataaaggagaatccgggcctcctggcgcctttgacgaaactggcatcgcaggcttgcacctccccaacggtggggtcgaaggggctgttttggggaagggcggcaaaccccagttcggtctgggcgaactctccgcacacgctacgcccgcatttacagcagtgcttacttccccattccctgcttctggaatgcccgtcaagtttgatcgtacattatataacggacatagcggctacaacccagccaccggtattttcacctgtcccgtgggaggagtttactactttgcataccacgtccatgtcaagggcaccaacgtttgggtagctctgtataagaacaacgtgcccgccacttatacttacgacgagtacaagaaaggctacctggaccaggcaagcgggggagccgtgctgcagctccgtccaaacgaccaggtctgggtacaaatgccttccgaccaggcaaacggactgtactctacggagtacattcactcttccttctccgggtttctgctgtgtcctacctag

SEQ ID NO: 2535 - DNA, 2112 bp, Artificial Sequence
  Description of Artificial Sequence: Synthetic coding sequence
atgttgggaactcttacgcctctctcgagtctactcctgctactgctcgtgctcgttttgggctgcggtcctagagcaagtagtgggggtggggctggtggcgctgctggttacgctcctgtcaagtatatccagcccatgcagaagggaccagtgggaccacccttccgtgagggtaaggggcaatacctggagatgccactgcctctcctgcctatggacctgaagggcgaaccgggccccccgggcaaacctgggccaagggggcctccaggcccccctgggttcccggggaaacctggaatgggcaaaccaggccttcacggccagcctggaccagccggacctccaggattctcacgtatgggaaaagccggtccccctggcctgcccggaaaggtggggccccctgggcaaccggggcttaggggggaaccggggatcagaggagatcaggggctcaggggccctcccggcccccccgggttacccgggccttcaggcatcactattccaggaaaaccaggcgcgcagggggttccaggcccccccgggtttcagggggagccggggcctcagggagagcccggaccgcctggagaccgcggtctgaaaggtgacaatggagtgggccagcctgggctgcccggtgcacctggacaggggggcgcacctggtccccctggcctgcccggcccagccggtctgggaaagcccggcctggacggcttgcctggtgcccctggtgacaagggggaatcaggcccgccaggagttccaggccctcgtggagagccaggagctgttggccccaaaggccctcctggggtggatggcgttggggtgcctggtgccgcgggcctccccggacctcaaggaccctctggggctaagggggaaccaggtacccgcggtccgcccggccttatcgggccaacggggtatgggatgccaggactgccagggcccaaaggagaccgcggcccagctggagtccccggcttactgggggatcgcggagaaccaggcgaggacggggaacctggcgaacagggtccccagggtttaggaggaccaccaggccttcctgggtcagccggacttcctggccggcgcggccctccaggaccaaagggggaagctggacctggcggacctcccggcgtcccaggtattagaggcgaccagggcccttccggactagctggcaaaccaggtgtgcccggagagaggggtctccctggggctcatggaccccccggaccaacaggaccaaagggcgaaccgggcttcactgggagacccggaggtccaggcgtggctggtgctttagggcagaagggagatctcggcttgcctggccagccggggctgagaggccccagcggcatcccaggactgcagggtccggccggtccgatcggcccacagggcctccctggattaaagggggaaccaggtttgccaggccctcctggagagggccgcgctggtgaacctggcaccgccggcccgacgggcccgcctggagtacctggttcaccaggtatcaccggtcccccaggaccgccagggcccccaggccctccgggcgcgcctggcgccttcgacgagactggtattgcggggctccatctccccaacggcggcgtggagggcgcagtcctggggaaaggcggtaagccccagtttggtttaggcgagctctccgcacacgcaactcctgcgtttaccgccgttctgacgagcccctttcctgcatccggcatgcccgtgaaattcgacaggaccctgtacaacggccatagtggatacaaccctgcgaccggcatcttcacgtgccccgtcgggggggtctactacttcgcatatcatgttcacgtgaaaggaaccaatgtgtgggtggctctttacaaaaacaatgtgcccgcgacttacacttacgacgagtataagaagggttatctcgaccaggccagtgggggagccgtcctgcagctgcggccaaacgaccaggtctgggtgcagatgccgagcgatcaggccaatgggttgtattccacagagtacattcattctagctttagcggctttttactgtgccccacctag

SEQ ID NO: 2536 - DNA, 1917 bp, Artificial Sequence
  Description of Artificial Sequence: Synthetic coding sequence
atgcctcttccccttctgcctatggacctgaagggagagccgggccctccgggaaaaccgggcccccgtgggcccccggggccgccgggtttcccaggcaagcctggcatgggcaagccagggttacacgggcagcctgggcccgccgggccccctggcttttccaggatgggcaaggcaggtcctccaggattgcctggcaaagtgggaccccctggccaacctggacttaggggggaacctgggattcgaggcgaccaggggttacgcggcccccctgggccccctggtctgccagggccgagcgggatcaccattcctggtaagcctggagctcagggcgtccccggaccgccgggcttccagggagagccaggcccccagggggagcctgggccccctggggatcgcggcttaaagggggacaacggggttggacaaccagggttaccaggagcccccggccaaggaggagctcccggaccacccggcctacctggacctgccggtctcggcaaacccgggttagacggacttccaggggctcccggggacaaaggggagtctggacccccgggggtccctgggcccagaggcgaacccggggctgttggacccaaaggaccgcctggggtggacggagtcggagtgcccggagctgcagggctccccggtcctcagggccctagtggagccaaaggggagcctgggacacgcggcccaccaggactcattggacctaccggctatggcatgccaggactgcctggacccaagggcgatagaggcccagcaggcgtcccaggcttgctgggtgatcgaggggagccaggtgaggacggcgaaccgggggagcagggccctcagggcctaggcggtcctccagggttgccggggtcagctgggctgccgggtcggcggggcccgcctggccccaaaggtgaagctggtcccgggggacctcctggagtgcctggcatcaggggggaccaggggccctctggcttagctggaaaacccggggtgcccggagaacgtggcctccctggcgctcatgggccaccaggccctactggacctaagggcgagcccgggtttaccggccgaccaggcgggcctggagtagccggagctcttgggcagaaaggcgatctcgggctacctggtcagcctggcctccgtggtccttccggcataccgggtctccaaggccccgcgggcccaatcggaccacagggactgcccggcctgaagggcgagccgggcctcccgggaccaccaggggaaggtagggcaggagagcccggcacagctggccctacagggccgcctggagtaccaggctctccaggaatcacaggcccacccgggcctccagggccccccggcccacccggagctccgggcgcgtttgacgaaacaggaatcgcgggactccacttgcccaatggaggcgtggaaggcgccgtgctgggcaaggggggcaagccacaattcggcttgggagagttgagcgcgcacgccacccctgcctttaccgcagttctcacttccccctttcccgcgtcgggaatgccagtcaaattcgatcgtaccctctataacggacactcagggtataatcccgcgacaggcatttttacttgtcctgtcggaggtgtttattattttgcctaccacgtgcacgtcaaggggacgaacgtatgggtagcgctttataagaataatgtgcccgccacatatacatatgatgaatataaaaagggatacctggatcaggctagtggcggcgctgtgctgcagctgcgtccaaatgaccaggtgtgggtgcagatgccatctgaccaagcaaacgggctgtactccaccgaatacattcattcctccttttcaggatttctgctgtgccccacttag

SEQ ID NO: 2537 - DNA, 2043 bp, Artificial Sequence
  Description of Artificial Sequence: Synthetic coding sequence
atgctaccacagatcccttttcttctcctggtgtccttaaacctggtccatggggtgttctatgcagaaaggtatcaaatgcctacggggataaaaggccccttacccaatacgaagacacaattctttattccatataccattaaatctaagggaatcgccgttcgaggggaacaaggcacacctggacccccgggaccagccggcccccggggacaccctggcccctctggacctcccggtaaacccggatacgggtctcctggcctacagggggaacctggattgccaggtcctcccggcccgagtgcagttggcaaaccaggggtgccggggctgccaggaaagccaggagaacgcggcccttatggacccaagggggacgttggccctgcagggttacctggcccgcgcggccctcccggtccacccggcatcccaggtcccgcgggaatttccgtgcccggaaaacctggccagcagggcccgacaggggccccagggccacgagggtttccaggggagaagggtgctcccggcgtccctggcatgaatgggcagaagggtgagatgggctacggcgcccctggacgtcccggtgaaagggggctgcctgggccacaagggcccacaggcccctcgggcccacccggagtcggaaaaagaggagagaacggcgttccgggccagcccggcattaagggagacaggggattccctggtgagatgggaccaatcgggccacctgggccccaggggccgccaggggagcggggcccagagggtatcgggaaacccggagccgcgggagcccccggacaacccggaatccctgggacaaaggggttgcccggcgcccccggaatcgcgggccctcccggaccccccggctttggaaaacccggactgcccggtttgaagggcgaaaggggccctgccgggctgcctggcggtcctggagctaaaggagagcaaggtcccgccggactccccggaaagccgggccttacaggaccgcccggcaatatggggcctcaggggccaaaggggattcccggatctcatgggttgcccggaccaaagggggaaactgggcccgccggccccgctgggtacccaggcgccaagggagaacgcggcagtcctggctcggatgggaagcccgggtacccagggaagcctggcctcgatgggcctaagggcaaccccggactgcccgggccaaagggcgatcccggggtgggcggcccacctggattaccaggtcctgtaggcccggcaggggccaaggggatgccaggacacaacggcgaggctggcccaaggggggcacctggcattccagggaccaggggcccgattggcccaccaggtattccagggttcccgggctctaagggggaccctggtagtccgggacctccaggcccagcaggcatcgccactaaaggtctgaatggaccaactgggcctcctggcccacccggcccccgcgggcactctggcgagcccggtctgcctgggccccctggaccaccaggcccacctgggcaggctgtcatgcccgagggcttcatcaaagccggccagaggccttctctgagcgggaccccactggtctctgccaaccaaggcgtgacgggcatgccagtgagtgcatttaccgttatcctctctaaggcataccccgccatcggtacacccatcccgtttgacaagatactctacaaccgacaacagcactatgacccgaggacaggaattttcacatgtcagataccaggtatttattactttagttaccatgtacacgtaaaaggtactcacgtctgggttggactgtacaagaatggtaccccagtgatgtacacgtatgacgagtataccaagggataccttgatcaggcatcaggttccgctattattgaccttaccgagaacgaccaggtctggctgcaactgcctaatgccgagagcaacggtttgtactcatctgaatatgttcactcatctttttctggatttttggttgctcccatgtag

SEQ ID NO: 2538 - DNA, 2043 bp, Artificial Sequence
  Description of Artificial Sequence: Synthetic coding sequence
atgctgccacagattcctttcctgcttcttgtgagtttgaatttggtgcacggagtattctatgctgaacgctatcagatgccaacagggataaagggtccgcttccgaacactaagacgcagttcttcattccctacacaatcaaatccaagggcattgctgtccggggagaacagggcactcctggccctccgggacccgctggccctcgagggcatccgggtccgtccgggcccccgggaaaacccgggtacgggtcacccggtctgcaaggcgagcccgggttacccggaccaccggggccatccgctgttggcaagcccggggtccctggtttaccaggcaaacctggcgaacggggaccttacggccctaagggtgatgtcggtcctgccgggcttccaggacctaggggcccaccaggtccgcctggcattcccgggcccgccgggatatcagtgccagggaagcctggacagcagggacctacaggggccccagggccgaggggcttccccggcgaaaagggcgcccccggcgtgcccgggatgaatggacagaagggcgagatggggtacggagcgcctggtagacctggcgagagaggccttcccggccctcagggaccaacgggcccctccgggcctccaggggtcggcaagcggggcgaaaatggggtgcccgggcagcctgggatcaagggggaccggggattcccgggggaaatgggaccaatcggacccccaggtcctcaggggcctcccggtgagagaggacccgagggcataggaaaacctggggctgccggcgcccccggccaacctggtattcctggcactaaggggctcccaggcgcgccgggaatagccggtccccctggccctcctggcttcggcaaacctggtttgcccgggctgaagggcgaacgagggccagccggcctgcctggcggacccggtgctaaaggagagcaaggaccagctggcctaccaggtaagccaggccttactgggccccccggcaacatgggcccgcaggggccaaagggaatcccaggtagccacggtcttcctggaccaaagggagagactggtcctgccggaccggccgggtaccctggagccaaaggtgaaagaggatcccctggaagcgatggtaaaccggggtatccaggaaaacccggcctggatggacccaaggggaacccgggcctgcctggacccaaaggcgatcccggagtcgggggacctcccggcctccctgggcctgtggggcctgccggcgctaaaggtatgcccgggcataatggcgaggccggcccgcgtggcgcccctggaattccgggaactcggggacctatcggaccacctggaatccccggtttcccaggtagcaaaggcgaccctggctctccaggacctccgggacccgccggcattgcaaccaagggattgaacggtcccacaggaccaccaggccctcctggaccaagagggcatagcggtgagccaggactcccggggccccctggaccccctggccccccaggccaggccgttatgccggaggggttcatcaaggctgggcagaggccatctcttagtggcacccccttagtgagcgccaaccagggggtgaccggtatgcctgtttccgctttcaccgtgatcttgtccaaagcttatccagctataggcacacctattccattcgataagatcctgtacaacagacagcagcactacgacccgagaactgggattttcacatgtcagattccaggcatctattacttcagttatcatgtacatgtgaaaggaacgcacgtatgggtgggcctctataaaaacggcactcctgtgatgtacacctatgatgagtatacaaaagggtaccttgatcaggcctccggctctgcgatcattgacctgaccgagaatgaccaggtgtggctgcagctgcccaatgcggagtccaatggactatatagcagcgaatatgttcacagttcttttagcggatttctggtggcccctatgtag

SEQ ID NO: 2539 - DNA, 156 bp, Artificial Sequence
  Description of Artificial Sequence: Synthetic coding sequence
atgttgccccagattccctttctgcttttggtgagtttaaatctcgtgcacggcgtgttctacgctgagaggtatcaaatgccgaccggaattaagggccctctccccaacaccaagacacaattctttatcccatacacaattaagtccaaatag

SEQ ID NO: 2540 - DNA, 651 bp, Artificial Sequence
  Description of Artificial Sequence: Synthetic coding sequence
atgctgccgcagattcctttcctcttgctggtaagcctgaacctcgtgcatggcgtattctatgccgagagatatcagatgccaactggtatcaaggggcccctgcctaataccaaaacacagttcttcatcccttacactatcaagagtaaagggatagcggttagaggggagcagggcacccctggacctccgggcccagctgggccacgcggccacccaggtccctcaggaccccccgggaaacctggatacggctctccagggctacagggtgagccgggcctcccggggcctccaggaccttctgctgtgggcaaaccgggtgttccggggttgccaggcaaacctggagaacggggaccttacggacccaagggagacgtaggccccgccggactcccaggaccacgtggtcctcctggcccccccggcatacctggaccagccggaatcagcgttccaggaaagcccggccaacaggggcccactggagctccaggcccgcggggctttcctggggaaaaaggagcacctggagtccctggaatgaacggccaaaagggagagatggggtacggggcccccggacgtcctggcgaacggggactgcccgggccgcaagggcccactggtccctcgggaccttag

SEQ ID NO: 2541 - DNA, 5211 bp, Artificial Sequence
  Description of Artificial Sequence: Synthetic coding sequence
atggaaaggtgtagccgctgtcacaggttactgctattgctgcctctcgtcctcgggctgagcgcagcccctggctgggcaggggccccccccgtggacgtcttgagagcccttcgattcccatctctgcctgacggagtgagacgggctaaaggcatctgtcctgctgacgtggcgtaccgagtcgccagacccgcgcaattatccgcccccacacgacagctttttcccggtgggttcccgaaggacttctctctgctaacggtggtgaggacaagaccagggctgcaagccccgctcctcacactatatagtgcacagggcgtgcgtcagctgggtctggaactgggcaggccagttagatttctctacgaagaccagaccggaaggccacagccgccatctcagccagttttccgtgggctttctctcgccgatgggaaatggcatagggtggccgtggctgtgaaaggacagtcagtaacgctcattgtcgattgcaaaaaacgtgtcacacgccccctgccccggtccgcccgtcccgttctagacactcatggagtgatcattttcggcgcgaggatactcgatgaagaagtctttgaaggggatgttcaggagctcgccattgtccccggcgtgcaagcggcctatgaaagctgtgagcagaaggagttggagtgcgagggggggcagagagagagaccgcagaaccagcagccgcacagggcccagcggtccccacagcagcagccttccaggttacaccgcccacagaatcaggagccccaaagccagcctacagaatctctgtattacgactacgagccaccatattatgacgttatgaccaccggcaccacccctgattatcaggaccccacccccggagaagaggaggagatcctggagtcatctttgctcccgcctctggaagaagagcagaccgatctgcaggtgccgcctaccgcagatagattccaagcggaagagtatggcgaggggggcaccgacccaccagaggggccgtacgattatacatacgggtatggcgacgattatagagaggagaccgagctgggaccagccctgagtgccgaaaccgcacacagtggcgccgccgcccacgggccccgaggcctgaagggggagaaaggagagccggctgtgttagaacccggaatgctggttgaaggccctcccggccccgaaggccctgctggtctgatcgggcctcctggaattcaaggcaatccgggcccagttggtgaccccggtgagagggggcccccaggcagggccggactccccggcagcgacggcgctcctggaccaccgggcactagcctgatgctgccctttagattcggttccgggggaggcgataaaggccctgtggtggcggctcaagaggcacaagctcaggcaatcctacagcaagccagactcgctttgcggggccctcctgggccaatggggtacaccggcagacctggccccctagggcaaccaggctcgcccggactgaaaggcgaaagcggcgacctcggaccgcagggcccgaggggtccccagggcctgacggggcctcccggtaaggccggccgccggggccgggccggagccgacggcgcacggggcatgccaggggatccgggcgtgaaaggggaccggggattcgatggcctgcctgggcttcctggcgaaaagggacatcgaggcgatacgggcgctcagggcctgccagggcctcccggggaagacggcgagcggggcgatgacggcgagattgggcccagaggacttcctggggaatccggcccccggggccttcttggaccaaaaggtcctcccgggatccccggccccccaggtgtgcggggcatggacggccctcagggacctaaaggaagcttggggccccagggcgagccaggacctcctggacagcagggaacccccggcacccaagggctgcccggccctcaaggcgcaataggtcctcacggggagaaaggaccacaagggaagcctgggctgccggggatgcctggttccgacgggcccccgggtcatcccgggaaggaaggaccccccgggaccaaaggcaatcagggaccatctgggcctcagggacctctggggtatccaggacccagaggtgtaaagggtgtggatggcattaggggcctcaaaggtcacaaaggagagaaaggagaggacggattccctggatttaagggagacatcggtgtaaaaggagataggggagaggtcggggtgcccggatctcggggcgaggatggccctgagggacctaagggccgtaccggcccaacaggcgatcctggcccccctggccttatgggggagaaaggaaaattaggcgttcctggactgcctggatacccggggcggcaagggccgaaggggtccctcggatttcccggctttccaggggcttccggcgagaaaggcgcccgcggcctctccgggaagtccggtccgcgaggcgagagagggccgacgggtccaaggggccagcgagggccaagaggtgcaacagggaagtccggcgctaaaggcacgagcggaggggacggtccccatgggccccctggagaacgcggattacccggacctcaagggcccaacggattccccggtccaaagggaccaccaggcccgcctggaaaagacgggttacccgggcacccaggacagagaggggaagtcgggtttcaggggaagaccggaccaccaggccccccaggagttgtcggaccccagggcgcagcgggtgagactggtcctatgggagagaggggacacccaggcccacccggaccaccaggagaacaggggctgccgggaacagcgggcaaggagggtacaaaaggagaccctggccctcctggcgctcccggcaaggacggacccgccgggctgagggggttccctggagaacggggtctacccggcacagcaggtggacccggattgaagggaaatgaaggtccttccggtcccccgggacccgccggctcgcctggagagcgcggagcagctggctcgggcggaccaatcgggcccccaggcaggccgggccctcagggacctccaggcgcagcgggagaaaagggcgtgccaggagaaaaggggccaattggccccacgggccgcgacggagtacagggccctgtgggtttgcctggccccgccgggcctcctggcgtggctggcgaagatggtgacaagggagaagtcggcgacccagggcaaaaaggcacaaaggggaacaagggtgagcatggacctccggggcctcctggccccatcggaccagttggacagcccggggccgcaggggctgacggagagcccggagcccgtgggccacagggacattttggagcaaaaggcgacgagggaacaaggggcttcaatggaccccctggccccattggcttgcaaggccttccagggccatcaggcgagaagggcgagactggtgatgtgggacctatgggaccgcccggccccccagggccccgagggcctgctggccccaatggggcagacggcccacaagggcccccaggcggcgtgggaaatctgggccctcccggggaaaaaggcgaacccggtgagagtggttcgccaggaatccagggcgagcccggggtgaagggccccagaggagagcgtggagagaaaggggaaagtgggcagcctggcgagccagggcctcccggccctaaagggcctacgggcgatgatgggcccaagggaaatcccgggcctgtgggctttcccggggatcctggaccccccggggagggcgggccacggggacaggacggggcaaaaggggaccgcggtgaagacggagagcctggccagccgggctctcctgggccaaccggcgagaatggcccacccgggcccctgggtaagcgcggtcctgccggcagtccagggtccgagggccgccaaggcggcaaaggagcgaaaggcgacccaggtgccatcggcgcacccggaaaaaccggccctgtcggccccgccggcccagccggcaaaccaggcccagacgggctgcggggactgcctggaagcgtcggccagcaaggtagaccaggtgctactgggcaagccggacctcccggaccagtgggaccacccggactgcctggcctccgcggtgacgcgggagctaagggggagaaagggcatcctggcttgatcggcctcattggaccgcctggggagcaaggcgagaagggagataggggtctgcctggtccgcagggatcaccagggcaaaaaggagaaatggggatcccgggagcaagcggtcctataggaccgggggggcctccaggtctgccaggcccggccggcccaaaaggcgcaaagggcgcaactggtcctggaggacctaagggcgagaaaggagtgcagggtccgcctgggcatcccggacccccaggagaggttatccagcccctaccaattcagatgcctaaaaagactagaaggagcgttgacggatctaggctaatgcaagaagacgaggctatccctacaggcggggccccgggaagtcccggaggcctggaggaaatatttggatcccttgatagcctgcgcgaagagattgaacagatgcgtcggcctaccggcactcaggatagcccggcccgcacttgccaagatctcaagctgtgccatccagagctgccagatggggaatactgggtggacccgaaccagggttgtgcaagggacgcatttagggtcttctgcaactttacggccgggggcgaaacatgtgttaccccacgggatgatgtcacgcaatttagttacgtggactcagagggatctccagtgggagtggtccagttaaccttcctgcggctgttatccgtgtccgcccaccaggacgtctcttacccctgctcgggcgctgcgcgggatggccctctccggttgagaggagcaaacgaagatgaactcagtccagaaaccagtccctatgtgaaagagtttcgggacggttgtcagactcaacaggggcgaactgtactggaggtccgcacgcccgtgttggaacagctgccagttctagatgcctccttctccgacctgggcgctcccccccggagaggtggggtgctgctcggccctgtctgtttcatggggtag

SEQ ID NO: 2542 - DNA, 5148 bp, Artificial Sequence
  Description of Artificial Sequence: Synthetic coding sequence
atggaacgctgcagtaggtgccatcggctgctcttactgttgcctctcgtgttaggccttagtgctgcgcccgggtgggcaggggcccctccagtagacgtcctgcgagcccttcgattccctagcctgcccgacggagtgagacgggcgaaaggaatatgccctgccgatgtcgcttatcgggtagcccgcccagctcaactgagcgccccaacaagacagctgttccctggtggctttccaaaggacttttcgttgcttaccgtagtaaggacgaggccaggcctgcaagccccccttttgactctatactcagcccagggtgtgagacagttgggtctggaattgggacgacccgtcagattcctgtacgaagaccagacaggcagaccacagcctccttcacaaccagtctttcgcggcctgtcacttgctgatggaaagtggcaccgtgtggcagtagccgtgaaaggtcaaagtgtgacccttatagtggactgcaagaaacgcgtcacaaggccattacccagatctgcccgccctgtgctagacactcacggcgttatcatctttggggcccgtatcttggacgaggaggtgttcgagggcgacgtccaggagctagccatagttccaggtgttcaggccgcctacgaatcgtgcgaacagaaagagttagagtgcgaggggggacagagggaacgcccacagaaccaacagccgcaccgggcccagaggtccccccagcagcagccttcaaggttgcaccggcctcagaaccaggagccccaaagccaaccgaccgaaagtctgtattacgattatgaaccaccctattatgacgtgatgacaactggaactacccccgactaccaggaacaaacggatctgcaggtgcctcccacagctgacagattccaggcagaagaatacggagagggggggactgacccccccgaaggaccatacgattacacctacgggtatggggatgattaccgggaggaaacggaactcgggccggccctttccgccgagactgcacatagcggcgcagccgcccatggccccagaggcctgaagggcgagaaaggggagcctgccgtcctggaacccggcatgttagtcgagggtccacctggacccgagggtcctgcagggttgattggtccgcccgggatacaaggaaatcctggacctgtaggagaccctggagaaaggggccctccaggtcgagcagggctcccgggttctgatggggcccccggtcccccaggcaccagcctcatgctgcctttccgattcggctcaggtgggggcgacaagggtcctgtagttgctgctcaagaagctcaggcacaggcaatcttgcaacaggccagacttgccctgaggggaccgccaggccctatgggttacacaggccggcctggtccactcggtcagcccggtagcccagggctgaagggggaaagcggagacctgggaccccagggccccagggggccacaggggctgactggtcccccagggaaggccggccgtagagggcgggccggggccgacggggcacgtgggatgcctggggaccctggcgtaaagggcgacaggggttttgacgggttgcccggtctgccaggagagaaaggacaccggggcgatactggagcgcaggggttgcctgggcctcctggagaggacggcgaaaggggcgatgatggtgaaatcggtcctcggggactgcccggagagtcggggcccaggggactgctgggacctaagggtccccctggaatccctggaccaccaggcgtacggggaatggacggacctcaggggcccaaaggctccctgggcccgcagggcgagccaggccccccaggccagcaggggacacctggtactcagggattgccaggtcctcagggcgcgatcggaccccacggtgagaaggggccccagggcaaacctggactgcctgggatgcccgggtctgacggcccacctggacatcccggaaaggaagggccgcctggcacgaagggcaatcaggggccatctggccctcagggtccacttggatacccaggacctcgcggtgttaaaggagtggacgggattcggggccttaaaggccacaagggggaaaaaggcgaggacggtttccctgggtttaaaggagacattggtgtgaagggagacagaggagaagtaggtgtgcccgggagtagaggggaggacgggccggaaggccctaagggccgcaccggaccgacgggcgatccagggcctcctggccttatgggagagaaaggcaaactgggcgttccaggattgccgggatacccagggcgccaaggaccaaagggatccctgggcttccccggttttccgggggccagcggtgagaagggcgctagaggcctgtccggtaagtcgggacccaggggggagcgtggccccacaggtccgagaggccagcgaggccctcggggagcaacaggaaagtctggtgctaaaggtacgagcggtggggatggtcctcacgggccaccaggggaaagaggcctcccaggcccccaggggcccaacggttttccggggcctaaagggcctcccggcccacccggaaaggatgggcttcctggtcacccggggcagcgcggtgaggtcggctttcagggcaagaccggcccaccaggccctccaggggtcgtgggcccacagggggccgcaggcgagacaggaccgatgggggagcggggccatccagggccgccaggccctccgggtgaacaggggttgcccggcacggccggtaaagagggaactaagggggacccaggtcctcccggtgctccgggcaaggacggtcccgccggactccgcgggtttccaggggaacgtggcctcccagggaccgccggcggccccggactcaaggggaatgaaggaccatccggcccgcctggccccgcagggagccccggagagcgaggtgcagcaggcagcgggggccccattggtcctccagggcgacctggcccccagggcccgcccggggctgcaggagagaagggtgtccccggtgaaaagggaccaattgggcccactggacgggatggggtccaaggccctgtgggcttgcccggccccgccggacctcccggtgtcgcgggtgaggacggtgacaagggcgaggttggggaccccggccagaaaggaacaaaagggaacaaaggagaacatgggcctcctggacctcctggccccataggccccgtgggacagcccggagctgccggagctgacggcgaacccggggctagaggaccccaaggccactttggtgctaagggtgacgagggaaccagaggatttaatggtccacccggtccaatcggcctgcagggactgccaggaccatcaggcgaaaagggagagaccggagacgtcggccccatggggcctccggggccccccggcccgagaggaccggctggccctaatggggctgacgggccccagggcccccccggcggagtggggaatcttggcccccctggcgaaaagggagagccaggcgagtcaggatcacctgggattcagggcgagcccggcgtgaaaggaccacgcggtgaacgaggggagaaaggagaatcaggccagcctggagaaccaggccctccagggcccaagggaccaactggggatgacgggcccaaaggcaaccccggccctgtgggctttcctggggaccctggcccacctggggagggtggcccaagggggcaggacggcgctaaaggagacagaggcgaggatggcgagccagggcagcctggctccccaggaccgaccggagagaatggcccacccgggcccttaggtaaacgcggccctgccgggagccctggaagtgaaggtcgtcagggaggaaagggagctaaaggagaccccggagctataggggcccctggcaaaactgggcccgtgggacctgcagggccagccggaaagccaggacccgatggccttaggggcctgcctggctccgttgggcagcagggaaggcctggagctaccggccaggccggcccgccgggtcccgtgggcccaccgggactcccaggcctgaggggggatgctggggcaaaaggagaaaaaggccaccccggtctgatcgggctaattggaccccccggtgagcagggagaaaaaggagacagaggtctgcctggtccacagggcagcccaggccagaagggggagatgggaatccctggtgcctcaggacccattggtcctggcggccccccagggcttcccgggcccgctggtcccaaaggagcaaaaggggccacaggcccaggcgggcccaagggcgagaagggtgttcagggaccaccaggtcaccccggccccccaggcgaggtaattcagcctttgcctatccagatgcctaaaaaaaccagacggagcgtcgacggctccaggttgatgcaggaggatgaggcaatcccgaccggcggagcaccgggcagtccgggggggctggaagaaatcttcggttccctcgactccctgcgggaagagatcgagcagatgcggcggccgacaggcacacaggactcaccagcccgaacctgccaagacctgaagttgtgtcatcccgaattgcctgatggcgagtactgggtggatcccaaccagggctgtgcccgcgatgcttttcgagtgttctgtaacttcacagcaggtggagagacttgtgtgacaccgcgagatgatgtcactcagttctcctacgtggactcagaggggtctccagtgggcgtggttcagctcacattcctgaggctgctgagtgtgtctgcacatcaggacgtgtcctacccatgctccggagccgcccgggatggacctctgagactcagaggggcaaacgaggatgaactgtccccagaaacttcgccctacgtaaaagaattccgcgacggatgtcagacgcagcagggacgaaccgtgctcgaggtaagaacacccgtgcttgagcaactacctgttctggacgcatccttctctgatcttggcgctccacctcgccgaggtggcgtgcttctcgggcctgtctgtttcatgggctag

SEQ ID NO: 2543 - DNA, 4890 bp, Artificial Sequence
  Description of Artificial Sequence: Synthetic coding sequence
atggagcggtgtagccgttgtcacaggctcctgctcctgcttcccctggtgctggggttgagcgctgcgcccggatgggcaggagccccacctgtggacgtgttgcgtgctctcaggttcccgagtctcccagatggtgtgaggcgcgcaaaagggatctgcccggctgatgtcgcataccgtgttgcccggcctgcccagctctcagcgcccacacgacagctgttccctgggggcttcccgaaagactttagccttttaacagtcgttcgcacaagaccaggtctgcaggccccacttctgactctctatagtgcgcagggggtgcggcagctcggactggagctggggagaccggtccgcttcctatatgaggatcagactgggagaccgcaaccaccttcccagcctgttttccgcggactgagtctggccgacgggaaatggcatcgggtggcggtggccgttaaaggccagagcgtaacccttattgtggattgcaagaagagagtaacacgcccactccccaggtcagcgcgccccgtgctcgacacacatggggtcattatctttggggctaggattttggatgaggaggtatttgagggggatgtgcaggagttagccatcgtgcccggcgtccaggctgcttatgaatcttgcgaacagaaggaactggaatgtgagggcggacaacgagaacgacctcagaatcaacagccccaccgtgcgcagaggagtcctcagcagcagccatctcgcctgcatcggccccaaaaccaggagccacaaagtcaagccgcccacggcccaaggggacttaagggagagaaaggcgagcccgcagtactggagcctgggatgctcgttgagggcccccccggacctgagggcccagctggactgatcggtccccctggcatccagggtaatccaggtcccgttggggaccctggtgaacggggccctcccggacgtgcgggactccctggaagcgacggagcgcctgggccaccaggaaccagtctgatgctgccattcaggttcggatctggcggtggcgataagggccccgtggtcgctgcacaggaggcccaggcacaggccatcctgcagcaggcccgcctcgccctgcgcggtccccccggtcctatgggttataccgggcgccccgggccactgggtcaaccaggaagtcccggtctcaaaggcgagagcggggatctcggcccccagggccctcgcggtccccagggactcacaggcccacccggaaaggctgggcggcgaggaagggcaggagcggacggagctagaggaatgccaggcgatcccggcgtaaaaggagacagagggttcgatgggttgcccggccttccaggcgagaaaggacacagaggcgacaccggtgctcagggtcttccaggccctccgggcgaggatggggaacgcggcgatgacggcgagattgggccgagaggcttgcctggtgagagcggcccccgaggactcctaggaccgaaggggccccctggcatcccgggcccaccaggcgttagaggtatggatgggccacaagggcccaaaggcagcctgggcccccagggagaacctggcccacctggacagcaggggacacccggaacacagggcctccctgggccgcagggagctattgggccccacggagagaagggaccacaaggcaagcccgggctgccgggcatgccggggtcagatggacccccaggacatccaggcaaagaagggccaccgggaacaaagggtaaccaaggcccctcagggccccagggtcctctcggctatccgggcccaagaggagttaaaggcgtggatggcattaggggactgaaagggcataagggagagaaaggcgaggacggatttccgggctttaaaggggacattggtgtgaagggtgaccgcggcgaagtaggagttcctggctccagaggcgaagacgggccagaggggcccaaggggcgcacagggccaacgggagatcctggtcctcccggcctgatgggagaaaaggggaagctcggagtgccaggcctgcccggataccctggcaggcagggcccgaaggggagtcttggcttccccgggtttccaggcgccagcggtgaaaaaggcgctcggggactgtccgggaagagtggcccccggggggagcggggacccactggacctcgcggacaacgaggacccaggggggccacgggaaaatctggcgcaaaagggacgagcggcggcgacgggcctcacgggcctccgggggaacggggccttccgggcccacagggccctaatggcttccccggtcccaaaggcccaccaggacccccaggaaaagacgggcttccaggacaccccggacagcgcggtgaggttggcttccagggcaagaccggacccccgggccccccaggggtggttgggccacagggcgcggccggagagacaggacccatgggggagcgtggccacccaggccccccagggccacctggggaacagggacttccggggaccgccggaaaggagggcacaaagggtgaccctggcccccccggcgctccaggaaaagatggacccgctggactgaggggattccccggagaaagagggctccctgggacggctggcggtcccggcctgaagggtaatgaaggaccttcggggcctcctgggcccgccgggtcccctggggaaagaggcgccgctggaagcgggggaccgatcgggcctcctgggagaccaggtcctcaagggccacccggagcagcaggcgaaaaaggtgtgcccggcgaaaagggacctatcggcccgacaggacgcgatggggtgcagggcccagttgggctcccaggtccagcaggcccacctggagttgccggcgaagacggcgacaagggggaggtgggtgaccccggacaaaagggtacaaagggcaataagggagagcatggtccgcccggcccacccggaccgatcggccccgtgggccagccgggtgctgccggtgccgacggagagccaggagcccgaggaccccagggacacttcggagctaagggagacgaaggcactcgcggcttcaacggcccacctggacccattggcttgcaggggctgcctggccctagtggcgaaaaaggtgaaaccggcgacgtgggtccgatgggtcctcccggtccccccggcccccgcgggcctgccgggcctaatggtgccgacgggcctcaagggccaccggggggcgtcggcaaccttggtcccccaggcgagaagggcgagcctggggaatccggctctcctggcattcaaggggagccaggtgtgaaaggcccaagaggtgagcgtggagagaagggcgagtcaggtcaaccaggggagcctggtccacccggccctaaggggccaacaggagacgatggccccaaaggaaatccggggccagttggtttccctggcgatccaggccccccaggtgagggcggacctcgtggccaagacggtgcaaagggcgacagaggagaggatggggaaccggggcagccgggcagtcccggtcctactggtgagaacggacccccaggacctctgggcaaacgcggacccgctgggtccccggggtcagaaggtcggcagggaggtaaaggagcaaagggggaccctggagctatcggggcgcccggaaagaccggacccgtaggccccgccggccccgctggcaaacccggcccagacggattgcgcggcctgccgggctccgtagggcagcagggacggcctggggctactggccaagcaggccctccagggcctgtcggcccaccgggcctgcctggcctgaggggcgatgcaggagcgaagggcgagaaggggcatccaggattgattggtctgatcggccccccgggagaacagggggagaagggcgaccggggcctgccaggacctcagggctcccctggacagaagggggaaatggggatccccggggcctccggccccatagggcccggcggaccgcctggtctgcctggcccggcgggcccaaaaggcgctaagggtgccaccggacccgggggacctaagggagaaaagggggtgcagggcccacccggacaccctggacctcctggggaagtgatccagccattgcccatccagatgccaaaaaaaacacggcgatccgtggacgggagtaggctgatgcaggaggatgaggctattcccacaggaggggccccaggatctcccggcggacttgaggagatttttgggtctcttgattctctgcgcgaagaaatcgaacaaatgcggagacccacgggaacccaagacagccctgccaggacctgtcaggacttgaagctgtgccatcctgagttaccagacggggaatattgggtggacccgaatcagggatgtgcccgagatgcattccgagttttctgcaacttcacggcaggtggtgaaacctgtgtcaccccgcgcgatgacgtgacacagttttcttatgtcgactccgaaggcagtccagtgggcgtggtgcaactgacctttctgagattactttccgttagtgcacaccaggacgtcagctatccatgctccggagctgcccgtgatggccctttgcgcctccgcggtgccaacgaggatgaattgtctccagagacttccccatacgtgaaagaatttagagacggctgccaaacgcaacaaggaaggaccgtgctggaggtgagaactccggttctggaacaacttccagtgctggatgcctctttttcggacctgggggccccgccccgcagagggggggtactgcttggccccgtctgctttatgggctag

SEQ ID NO: 2544 - DNA, 4953 bp, Artificial Sequence
  Description of Artificial Sequence: Synthetic coding sequence
atggaacgttgttccaggtgccatcggcttctcctgctcctccccttggtcctgggtttaagcgctgctccaggttgggcaggcgccccgcctgtagacgtgctgagagcccttaggtttccatccctgcctgacggcgttcggcgggcgaaggggatttgtcctgcagatgtagcctatcgggtggctaggccagcgcaactctccgctcccacgaggcaactcttccctggtggcttccccaaagatttctctttgctgaccgtggttcgaacgcgcccaggcctccaggcgcctttacttaccttatacagtgcacagggcgtcagacagctcggactcgaactcgggaggccagttcggtttctgtacgaggaccagaccggccggccacaacccccaagccagccagtcttcagggggctaagtctggccgacggtaaatggcatcgggtggctgtggctgtgaaaggccagtcagtcaccttgatcgttgattgcaagaaacgagtaaccaggcctctaccacgttctgcgaggccagtactggacacccacggcgtcatcatttttggagctcggattctcgatgaggaggtgttcgagggagacgttcaggaactggcgatagtgcccggcgtgcaggccgcttatgagagttgtgaacagaaagagctggagtgtgagggtgggcagcgggaaagaccccagaatcagcagcctcaccgcgcacaaaggagtccacagcagcagccaagtaggcttcatcgtccccagaatcaggagcctcagtctcaggatcctactcccggtgaggaggaagagattctggaatcatcgttgctgccaccactggaggaagcggcccatgggccaagaggcttgaagggagagaagggagagcctgcagtcctcgaaccggggatgctggtggaaggtccacccggtcccgaaggccccgcaggcctcatcggtccacctggcatccagggaaacccaggtccggttggcgatcccggagagcgcgggccgcccggaagggccgggctccccggatctgatggggctcctggaccccccgggacctcactcatgctgccctttaggttcggttccggcggcggagacaaaggccccgtggtcgcagcgcaggaggcccaggcccaggccattctccagcaagcccggctagctctccgaggcccccccgggccaatgggctacaccgggcggcccgggcccctgggtcagccaggctcaccaggattaaagggagaatccggggatcttggcccccaggggcccagaggtccacagggactgactggcccacctggcaaagcaggcaggagaggaagggctggtgcagacggggctcggggtatgcctggcgacccaggggtcaagggggaccgcggtttcgacgggctgcctgggctccctggcgagaagggccataggggagatacaggggcccagggcctgccaggtcctccaggagaagatggcgagcggggagatgacggagaaattggcccaagaggattacccggcgaaagcggaccaagggggctattagggccaaagggcccaccaggaatccccgggcctccaggcgtgcgagggatggatggcccccaaggtccaaaaggctcccttgggccccagggcgaacccggacccccgggtcagcaggggacccctggaacgcaagggctgcccggcccccagggcgccatcgggccacacggcgagaagggcccccaaggcaagcctggtctgccaggaatgcctggatctgatggccccccgggccaccccggcaaagagggacccccagggacaaagggcaaccagggaccctctggccctcaaggccccttaggttatcctggtccacggggcgtgaagggcgtggatggtattcgcggactcaaaggtcacaagggggagaagggtgaggatggtttccccgggttcaaaggcgacataggcgtgaaaggcgacaggggggaggtgggggtgcctgggagtagaggggaagacggacctgaagggccaaagggcagaaccgggcccaccggcgatcctggtcctcccggactaatgggagagaagggtaagttaggggtcccggggcttcctggctaccctgggaggcagggccccaaaggctccttggggttcccaggcttccccggggcctcaggcgaaaagggcgcaagaggcctgtcgggaaaaagcggtccacggggagagagaggtccaacggggccaagaggacagcggggaccccgaggagcaactgggaaaagtggcgccaaggggacctcgggtggtgacggccctcacggcccacccggggagcggggcctgcccggacctcagggccccaacgggtttcccgggcccaaaggcccccctggaccccccggaaaggatgggctccctgggcaccctggacagcgtggtgaagtggggtttcaaggcaagacaggccccccagggcctccaggagtggttggaccccagggcgccgctggagagactggccccatgggcgaaagaggccaccctggccccccaggccctcccggggagcaaggcctccctggtacagctggtaaagaggggaccaaaggtgacccaggccctccgggcgctcctggaaaagacggtccagccgggttgcgcggatttcccggtgagagaggcttgccagggactgcaggggggccgggcctgaaaggtaatgagggaccttctgggccaccagggcctgccgggtcaccgggagaacgcggtgccgctggaagcggggggcccattggcccaccaggaagacctggaccacagggccccccgggagcagcaggagagaagggggttccaggagagaagggacctatcggtcctactggtcgggatggggttcaagggcccgtgggcctccccgggcctgctggcccccctggcgtggctggcgaagatggggacaagggcgaggtaggagaccccggccagaaagggaccaaagggaataagggcgagcatggacctcccggccctcccggacccatagggcccgtcggacaacccggcgccgctggcgccgatggagaacctggggctagaggcccacagggacatttcggggctaagggagacgaaggaacgcggggatttaatggtccccccgggcccatcggactccaaggactgcctggccctagcggtgagaaaggcgagaccggagacgttggaccaatgggcccacccggccctcccggaccgcggggaccagccggtcccaatggggcggacggaccacaggggccacccggcggggtgggtaaccttggccctcccggggaaaaaggagagccaggggagagcggctctccaggcattcaaggtgaacccggtgtgaaagggccccggggagagcggggcgagaaaggggaaagtgggcagcctggagagcccggcccaccaggccctaaggggccgacaggcgacgatggaccgaagggcaaccccggcccagtgggcttccccggcgaccccgggccgcctggagagggaggtcccagaggtcaggacggagctaagggtgaccggggagaggatggagagcccggccagccaggaagtccaggccccacaggggagaacggaccacctggcccactgggcaagcgcggcccagcaggttccccggggtccgagggtaggcaggggggcaaaggggccaagggagatcctggagccataggtgcaccggggaaaacaggacccgtgggccccgcaggacctgcaggcaagcctggtcccgacgggttaagaggtctgccagggagcgtcggacagcaggggagacccggggcaacaggacaggctggtcctcccggaccggtagggccccccggcttaccagggctaagaggcgacgccggagcaaagggagagaaaggccatccaggcctcatcggcctcatcggcccacccggcgagcagggtgagaaaggtgaccggggattgcccggcccgcaaggctccccaggccaaaaaggggagatggggatcccaggcgcaagtgggccaattggccccggtggccctcctggcctcccaggtcccgcaggacccaagggagcaaaaggcgccactgggccaggcggccctaagggcgaaaaaggagttcagggccctcccggtcacccagggccccctggagaagttatacagcccttgccgatacagatgcctaagaagacacgtcgctctgtcgatggctcacgactgatgcaggaggacgaagccatcccaacaggtggcgcaccggggtcacccggggggctcgaggagatcttcggatcactggattcccttagagaagagatcgagcaaatgcgtaggcctaccgggacacaagatagccccgctcggacttgccaggatctgaagctgtgccaccctgagcttcctgacggggagtactgggttgacccaaatcagggatgcgctcgagatgcattcagggtgttctgcaattttaccgccgggggggaaacctgcgtgactcctcgtgacgacgtgacccagtttagctatgtggattcagaaggaagccctgtcggtgttgtccaacttacatttcttcgcttattgagcgtctccgcccaccaggatgtctcatatccatgttctggggcagctagagacggccccctgagacttcgaggcgccaacgaagacgaattatcaccggagacctccccttacgtgaaagagtttcgcgacgggtgtcaaacccagcagggccgcacagtgcttgaagttcggacccccgtcctagagcaactgcctgtgcttgacgcgagtttttctgacctgggcgctcctcctcgtcgcgggggtgtcctgttggggccagtctgctttatgggctag

SEQ ID NO: 2545 - DNA, 4968 bp, Artificial Sequence
  Description of Artificial Sequence: Synthetic coding sequence
atggagcgctgttcacgctgtcatcggttgttactactgttgcctctggttctgggcctgtcagcggcaccagggtgggcaggggcacccccagtcgatgtgcttagagctttaaggtttccctcactccctgacggcgtgcggagggctaaaggaatatgccctgcggacgtggcttatcgagttgcacgcccggcgcagctcagcgcccctacacggcagttattcccaggagggttccctaaagacttctccctgctgaccgtggtgcgcaccaggccgggactccaggcccccctgttgaccctgtacagcgcccagggcgtgcgtcagttgggcctcgaactgggccggccagtacgatttctgtatgaggatcaaaccggccgcccgcaaccccccagtcaacccgtgtttagaggactatctctggccgacggaaagtggcaccgcgtggcagtggctgtgaagggccagagtgttaccttaattgtggattgcaagaaaagagtgaccaggccgttgccacgcagcgcccggcctgtgctcgatacccatggtgtcataattttcggtgcaagaatcttggatgaggaagtattcgagggagacgttcaggagctcgccatagtaccaggggtgcaagccgcttatgagagctgcgagcagaaggagttagaatgtgaggggggacaacgagagcgcccacaaaaccagcagccccatcgtgcccagcgttctcctcaacaacagccgtcccgcttgcatcggccacagaatcaggaaccacaatcccagccaaccgaatccctgtattatgattatgaaccgccatactacgatgtcatgaccaccgggacgaccccagattatcaggctgcacatggccctcgaggcttaaagggagagaaaggggaaccagcggtgctggaacccgggatgctggtagaagggcccccaggacctgagggccctgctggacttatcggtccccctggcatccagggtaatcctggacccgtgggtgatccaggcgaaaggggtccaccggggcgtgctggactcccgggttctgatggcgcacccggccctcccggcaccagtctgatgttgcccttcaggttcggaagtggtggtggcgataagggacccgtggtagcagcccaggaagcccaagctcaggccatactgcagcaagctcgactggccctgagaggcccacctggtcccatgggctacacggggcgcccggggcctctgggacagcccggctcacccggcttgaaaggagaatctggggaccttggtccccagggtcctcgaggaccccagggcttaacaggccctcccggaaaagccggacggcggggacgggcaggggccgacggggcccgcggaatgcccggcgaccctggcgtgaaaggtgaccggggtttcgacgggctcccaggcctgcccggggaaaaaggccatagaggggacactggagcccaaggtctccccgggcctcccggtgaagacggagagcgcggagatgacggagagattggacccagaggcttacctggggaatctggtccgcgcggtctactgggccccaaggggccacctggtattccgggtcctcccggcgtgcggggaatggatggcccacaaggccctaaaggttcgcttggaccccagggcgaaccagggccgccaggccagcagggaacacccggtacgcagggcctgccgggcccacagggtgcgatcggcccacacggggaaaaggggcctcaaggtaagccggggttaccaggcatgccaggtagcgatggaccacccggccaccccggcaaagagggtccaccgggaacaaaggggaaccagggcccctctggcccacagggccccctgggctacccaggtccacgtggagtgaagggcgttgacggaattcgtggcttgaagggtcataagggcgagaagggggaggatggatttccagggtttaagggcgatattggggtgaaaggagatcggggggaggtaggggtacccggatctcggggagaggacggaccggagggccctaaagggcggaccggccctaccggtgatccaggccccccgggtctcatgggagagaagggtaaactcggcgtccctgggctgccaggctaccccggccgacagggccctaaaggcagcctggggttccctggattcccaggggcttccggggaaaagggagccaggggactttctggtaaatctggccctagaggcgagcggggccccacgggcccccggggccaaagaggccctcggggggcaactgggaaaagcggcgccaaaggtacctctggcggagatggcccccatggccctccaggggagaggggtctccccggtcctcagggtccaaatggatttcctggtcccaaaggcccccctggtcccccagggaaggacggtctgcctggtcacccgggtcagagaggcgaggtaggattccagggtaaaacagggccccccggaccacccggggtggttggcccccagggggctgcgggggaaacaggacctatgggggaaaggggtcacccagggccacctggtccacctggtgagcaggggctccctgggaccgcaggaaaagaaggcacaaagggggacccgggccctccaggcgcccccggcaaagatggcccggccgggctgagaggtttcccaggagagagaggccttccaggcaccgccggcgggcccggactcaagggaaatgagggccccagtggcccccctgggcccgcagggagccctggcgagcgtggtgccgccggaagcggagggccaattggccctcccggcagaccggggcctcagggccctccaggcgccgcaggggaaaagggagtgcctggcgagaaaggccccatcggaccaacagggagggatggagtccagggccctgttgggctgccaggccccgctggcccgccaggcgtggctggagaggacggcgataaaggtgaagttggagatcctgggcagaaaggcactaaaggaaataagggtgaacacggacctcctgggcctccaggccccatcggcccagtgggccagccaggtgctgccggcgctgacggggagcctggcgccaggggccctcagggtcacttcggtgccaagggggatgaggggacgaggggattcaatgggcctcccgggcctatcgggttgcaaggattgcctgggccaagcggggaaaagggtgagaccggggatgtgggaccaatgggcccacctggcccgccaggtccacggggccctgcgggccccaatggagcggatgggccccaggggcccccgggaggggtgggcaatttaggccccccaggggagaaaggagagccaggagaaagtgggtcccccggcattcagggagaacctggagttaagggtccccggggcgaaaggggtgaaaaaggagaaagcggtcagccaggagaacccgggcctcctgggcctaagggccctaccggtgatgatggacctaaaggcaaccctggacccgtcggctttccgggagacccagggcctcctggggaggggggacctcgggggcaggacggagcgaaaggggatcgcggagaggatggcgagccaggccagcccggctcccctgggccaaccggcgagaatggtcctcctggcccgctgggtaagcggggccccgccgggtcgccaggctcagagggaagacaaggtggcaagggggcgaaaggagatccaggcgcgatcggcgcccctggcaagaccggtccagttggccctgccggcccagcgggaaagcccggacctgacgggctaaggggactgcctggttcagtgggccagcagggtcgaccaggagccacagggcaggccggccctcctggacccgtgggccctcctggcctcccagggcttcggggagacgcaggtgccaaaggcgagaaaggacacccgggcctgatcgggctgatcgggcccccgggcgagcagggagagaagggcgatagaggcctcccaggtcctcagggctctcccggacagaagggcgaaatgggcatcccaggggcaagcggtcccatcggcccgggtgggccacctggccttccaggtcctgcaggcccaaaaggcgccaaaggagctaccgggccagggggcccgaaaggggaaaagggtgtgcaggggcctccaggacaccccggtccccctggagaggttatccaaccactgccaatacagatgccaaaaaagacacgtcggtctgtggacggcagccggttgatgcaagaggacgaggccattccaacaggaggagcccctggatcgcccggaggattggaagaaatcttcgggtctctagattctctgagagaagaaattgagcagatgcgaaggccaaccggcactcaggacagtcccgcccggacttgccaggaccttaagctttgtcatcctgaattgccagacggagaatactgggttgatccaaatcaggggtgtgccagagatgctttccgagtgttctgtaattttaccgctggtggtgagacctgtgtgactccgcgggatgacgtcacacagttctcatacgtggattccgaagggagtccagtgggcgtcgttcagctcacctttctgagactgctctccgtttcagcccatcaggatgtgagctacccatgttccggagccgctcgcgacggacctctgcggctccgcggagcgaacgaggacgagctgagccctgaaactagcccttacgtgaaggagttccgcgacggctgtcagacacaacagggacgcactgtcctcgaggttcggacacctgtgttagaacagctacccgtattggacgcttctttttctgatctcggcgcccctccccggagaggcggcgtcctgctcgggcccgtgtgttttatgggatag

SEQ ID NO: 2546 - DNA, 5070 bp, Artificial Sequence
  Description of Artificial Sequence: Synthetic coding sequence
atggagcggtgcagccgctgccatcggctactcctcctgctccctctcgtgctgggactatccgccgcaccaggatgggcaggcgccccgcccgtggacgtgctcagggcgctcaggtttcctagtctgccagacggagtgcggagagctaagggcatttgtccggccgatgtggcataccgggtcgcacgacccgcacaactcagcgctcccacgaggcaacttttcccagggggctttcctaaggacttctccctgctcacagttgtgagaactaggcctggcctgcaggcgcccctgctaacactttactcagcccagggcgtcaggcaacttggactagagctgggcaggcctgtccggttcctgtacgaggaccagaccggaaggcctcagccaccgagtcagcccgtatttagaggtctgagcctcgcagacggtaagtggcacagggttgctgttgcagttaaaggtcagagcgttacattgatcgtggactgcaaaaagagggtgacacgccctctgcctcgaagcgcccggccagtgctggacacacacggagtgataatcttcggagcacgtattctcgatgaggaagtgtttgaaggggacgtgcaagagcttgccatcgtgccgggggtccaagccgcctatgagagttgcgagcagaaagagctggaatgtgaagggggccagcgggaaagaccccagaatcagcagcctcaccgggcacagcgaagtccacagcagcaacccagtcgtctgcataggccacagaaccaggagcctcagtctcaggaacagactgacctgcaggtcccccccactgcggaccggttccaagccgaagaatacggggaaggcggtacagatccgccggagggaccatatgattacacatatggctatggggatgattacagagaggagactgaattagggcctgcactaagcgctgagactgctcattctggcgctgctgctcatggcccccggggccttaaaggagagaaaggggaaccagccgttcttgaacccggcatgctcgtggaggggccccccggccctgaaggccctgccggcttgatcggcccgcccgggatccaagggaatccagggccagtgggggatccgggcgaacgcggcccacccggcagggctggcctcccgggaagtgacggcgcaccggggcctcccggcacctccctgatgctgccattcagattcggctctggaggaggcgacaagggcccggttgtggccgcacaagaagcgcaagcgcaggccatacttcagcaggctcgactagcactccgtgggccccctgggcccatgggatacactggacgcccaggacctctaggtcagcccgggtcccctggactgaagggggagagtggagacctgggaccgcaggggcctcgtggccctcaaggcctaacagggccccctgggaaagctggccgcagggggcgcgctggtgccgatggggcccgtggcatgccaggggacccgggcgtaaaaggcgaccgtggcttcgatggcctgcccgggcttcctggggagaagggacacagaggagataccggcgcccagggtctccccggtccgccaggagaggacggagagcgcggagatgacggagagattggccctcggggcctcccaggtgagagtgggcctcgcggactgctaggccctaaaggtcctccaggcattcctgggccaccgggcgtgcgtggtatggatggcccgcaaggtcctaaaggaagtctggggcctcagggggagccagggcccccgggtcaacaggggacaccaggtacccagggacttccaggtccccagggcgccattggaccgcatggtgaaaaagggcctcaggggaagccaggacttcctggtatgcccggttccgatgggccaccaggtcatccaggcaaggagggacctccaggaacaaaaggcaatcaaggaccaagcgggcctcagggtccccttggctacccggggccaagaggggttaaaggggtggatggtatccggggactcaaggggcacaagggtgagaaaggggaagacggattcccaggcttcaaaggcgatataggggtgaagggagaccgtggcgaggtgggagtgccaggcagtcggggcgaggatggaccggaaggtcctaaagggcggacaggtcctaccggagacccgggccctcccggtctgatgggtgaaaagggaaaactgggcgtccccggcttaccaggctatccggggcgacagggcccgaagggatctctgggattcccaggcttccccggtgcctcaggggagaaaggggccaggggccttagcgggaagtctgggccaagaggggaacggggcccgaccggacctagggggcagcggggccccaggggagccaccggtaagtccggcgcaaaaggtaccagtgggggtgatgggcctcacggaccccccggtgaaagaggcctcccaggcccccagggccccaatgggtttcctggccctaaaggccctcccgggcccccggggaaagacggtctgcctgggcaccctggacagagaggggaagtcggttttcaaggcaagactggccctcctggaccacccggggtagtcggcccacagggggctgcgggggagaccggacctatgggggagcggggacaccccgggcctcctgggcctccaggcgaacagggtctgcccggcacggccgggaaagaagggactaaaggcgatcctggaccccctggggctccaggcaaggatggccctgccggcctcagagggttccctggtgagcggggcttgcccgggacggctggagggcccggattaaagggcaatgagggaccatcagggccaccagggcctgcaggtagtcccggtgaaaggggggcagctggctccgggggccccattgggcctccaggcaggcctggcccacaggggcctcccggggcagctggggagaaaggcgtgccaggcgagaagggccctatcggccctacagggcgcgatggagtacaaggcccagtcggcctgcccggtcctgcaggcccacccggagtggccggtgaagatggggacaagggagaggtcggggatcctggccagaaggggacgaaggggaataaaggtgaacatgggcctccaggaccgccagggcctattggcccggttggccagcccggagctgccggtgccgacggagagcccggggctaggggcccccaggggcatttcggagccaagggcgacgaaggaaccaggggattcaacggcccaccgggccctattgggctccaggggctgcccggtccatctggcgagaaaggggaaaccggggacgtggggcctatgggccctcctggtccccccggacctaggggcccagctggacctaatggggctgacggaccacaggggccgcctggtggggtcgggaatttaggccccccaggagagaagggtgagcccggggagagtgggagccccggaatacagggggagccaggtgtgaagggtccaaggggcgagcggggcgaaaaaggagagtccggtcagccgggggagccggggccacccgggccaaaaggtcccacaggggatgatgggccaaagggcaatcccgggcctgtaggatttcctggagacccaggaccccccggagagggcggcccaaggggacaggacggtgccaagggtgacagaggggaggacggcgagccaggccagcccggctccccaggacctacaggcgagaacggacctccaggtcccctcggaaagcgtgggcccgccgggagcccagggagtgaaggcaggcagggagggaagggggccaagggggatccgggcgccattggagcaccagggaagaccggtccagttggtcctgcagggccagccggtaaaccgggtcctgacggtctgaggggactgccaggctccgtcggacagcaaggacgccccggagccacaggacaggccggccctccaggacctgtgggacccccaggattacctgggcttcgcggtgatgcaggcgcaaagggagagaaggggcacccagggctgattgggttaatcggacctccaggtgagcagggggaaaaaggggataggggcctgccgggaccgcaaggcagccccgggcaaaagggtgagatgggcatccccggcgcaagtggccctattggaccaggggggccacccgggctgcctggacctgccggccctaaaggcgccaaaggcgctactggccccggaggccccaaaggggagaagggtgttcagggacccccgggtcacccaggacccccaggcgaggtcatacaaccgctgccaatccagatgccgaagaagacacgcagatcagttgacggtagccgcctgatgcaggaggacgaagctatccccacaggtggagcccctggttctcccggtggtctggaggaaatcttcggatcactggatagcctccgtgaagagattgagcagatgcggcgccctaccggaacccaagattctcccgcccggacatgtcaggacctcaaactgtgtcatccggaattgcccgatggagaatattgggtggacccaaaccagggatgcgccagagatgcatttagggttttttgtaactttactgccggcggagagacatgtgtcacaccgagggacgatgtgacgcaattttcctacgtcgactcagaaggcagcccggtgggagtcgtccagctgacctttctccggctccttagcgtaagtgctcaccaagacgtctcttatccatgcagcggagcagcccgggacgggcccctgcggctgaggggcgctaatgaagacgagctctctcccgagacatcaccttacgtcaaggagttccgagatggatgccaaacccagcaaggacgcactgtgctggaggtgcggacacctgtgctggagcagctgcccgtgctcgacgcttccttttcagatttgggggccccaccaagaagaggcggcgttctgctaggacctgtttgttttatggggtag

SEQ ID NO: 2547 - DNA, 5133 bp, Artificial Sequence
  Description of Artificial Sequence: Synthetic coding sequence
atggaaaggtgttctcgatgccatcggctgctgcttctgctgccactggtgctcggtctaagcgccgctcctggctgggcaggggccccccccgtggatgtgctcagggctctcaggttcccaagtttgcccgatggggtccgaagagcgaaaggtatctgtcctgccgacgtggcctatagggtcgcacggcccgcccagctcagcgcgcctactagacaactttttcccgggggatttcctaaggattttagccttctgaccgtagttagaacaagaccaggtctgcaggcaccgctcctgactctgtacagcgctcagggagtcaggcagctaggactggagctgggaagaccagtccgctttctgtacgaagatcagaccggcagaccccaaccgccttctcagcccgttttccgcggtctatccctcgcagatggtaagtggcatagggttgctgtcgccgtgaagggccagtcagtgaccctgatagtcgattgtaaaaagcgggttacgaggcctttacctagaagtgcccggccagtcctggacacccatggcgttattatcttcggcgcacggatcttagacgaggaagttttcgagggcgatgtccaggagctggccatcgtacccggcgtacaagctgcttatgaatcctgtgaacagaaggagcttgagtgcgaaggggggcagcgcgagcggccccagaatcagcagccgcacagagctcagcgttcccctcaacaacagccgtcccgcctgcatcgtccacagaatcaggaaccccagtctcaagatccgacccctggagaagaagaggaaatcctggaaagctctttgcttccgccgctagaggaagaacagacagaccttcaggtcccacctactgcagaccgcttccaagccgaagagtatggcgaaggagggacagaccctccggaggggccctacgattatacatacggctacggcgacgactatagggaggagaccgagctgggtccagctttgtccgctgaaacagctcactccggggccgccgctcacggcccccgcggactgaagggcgaaaagggggagccagcggtcctggagcccggaatgctcgtcgagggtccaccaggacctgaaggtccagctgggctgattgggcccccaggcatccagggcaacccgggcccagtcggcgacccaggagagcggggtcctcccgggagggcgggcttacccggtagcgacggagcgccgggcccccccgggacttccctgatgctgccgtttaggttcggttctggtgggggggataaaggcccagtcgtggccgcccaggaggcgcaggcgcaggccatccttcagcaagcacgcctagcactgcgtgggccccccggacccatgggatatacgggcaggccgggtccgttaggccagccagggagcccagggctgaaaggggaatccggcgacctgggcccacagggcccaaggggccctcaagggttgaccgggcctccagggaaggcagggaggagaggccgtgccggggcagatggagcccgtggaatgccaggagatcccggcgttaaaggtgaccgcggtttcgacggtttgccaggcctgcctggagagaaagggcaccggggagataccggggcccaaggtttgcctgggccaccaggagaggacggcgagcgcggagacgacggcgaaatcggaccaagaggattgcccggagagtctggacctagaggcttattaggcccgaaaggtccaccaggcatccctggaccccccggagtccgcggtatggacggcccccagggacctaagggaagtctgggacctcagggcgagcccgggccacccgggcagcaggggactccaggcacacagggcttacctgggcctcagggggctatcggtccacacggcgaaaagggtcctcaggggaagcccggactacctggcatgccaggatccgatggacccccaggccacccggggaaagaggggccccctgggacaaaaggcaaccagggcccctccggtccacaaggtcccttaggatatccggggcctcgcggcgtcaagggtgtggatggcatccgcggcctgaagggacacaagggggaaaagggggaggatggctttcccggcttcaagggtgatataggagtgaagggggaccggggcgaagtcggagtgcctgggagccgtggcgaagatggtcctgagggccccaaaggacgaacgggcccaactggggatcccggccctcccgggttgatgggtgagaagggcaagctgggcgtacctggcctccctggttatcctgggcgccagggtccaaagggctccctgggctttcctggctttccaggcgcttcaggcgaaaagggcgccagaggactcagcggaaagtcaggtccacgcggcgagcggggacctactgggcctagagggcaacggggaccaaggggggccacgggcaagtctggagccaaggggacctccggtggcgatggccctcatggacccccgggggaaaggggcctcccaggcccacaagggcccaatggctttcccggtcccaagggacctccgggcccccctggcaaggacggcctgccgggacacccaggtcaacgcggggaagtgggcttccaagggaagacagggcctccggggccacccggcgtggtcggtcctcagggggccgctggggagactgggccaatgggcgagaggggccacccaggtcctccggggccacccggggagcagggtttgccaggtaccgcgggcaaagaagggactaaaggggacccaggaccacccggtgcaccgggcaaagacgggccggcagggctccggggctttcctggagagagaggtctgccgggcacagccgggggcccaggtctgaagggcaacgagggcccttccggccctcccggaccagctggcagccctggcgaacgcggtgcagcaggtagtgggggacccatcggacctcccggtaggcccggccctcagggccctccaggcgctgccggcgagaagggcgtgccaggggaaaaagggcctatcggcccaaccggccgtgacggggtgcaggggcctgttgggctacccgggcctgccgggcctcccggggtggcaggcgaggacggagataaaggggaggttggcgaccctggccaaaaaggtacaaagggtaataagggcgaacacggtccacccggacccccggggcccattggacccgtgggacagcccggcgccgccggggctgacggagaacccggcgctaggggcccccaaggccatttcggcgccaagggggacgagggtacccggggattcaacggcccacccggcccaattgggctccaagggctgccaggaccctccggcgaaaaaggcgagaccggagatgtgggcccaatgggcccacctggccctccggggccccgggggccagccggcccaaatggcgccgacgggccgcagggtccgcctggcggggtagggaacctgggtccccctggggaaaaaggggaacctggggagtccgggtcacctggaatccaaggcgaacccggcgttaagggaccccgtggcgagcgtggcgagaaaggagagtccggccaacccggcgaacctggccccccaggcccgaaaggccccaccggcgacgatggccctaagggaaatccaggcccggtaggatttccgggggaccccggccctcctggggagggagggccgagaggccaggacggggccaagggagatcgtggtgaggatggcgagccaggccagccaggctcacctggaccaacaggtgaaaacggaccacccggaccattggggaaacggggaccagctggctcgccagggtcagaaggtcgtcagggagggaagggcgccaaaggtgatccaggagcaatcggagcaccagggaagaccggaccagtgggtcccgctggtcccgccggaaaacctggtcccgacggcttgaggggcctgcccggtagtgtagggcagcagggccggccaggcgctactggtcaggccggaccacccgggcccgtgggaccaccaggcctgcccggtctaagaggggacgctggtgcaaagggggagaagggacatcccgggcttatcggtctgataggcccccccggcgaacagggcgagaagggcgatcgagggctccctggcccccaaggcagccctggtcaaaagggagaaatgggtattcccggtgctagcggccccatcggccctggcgggcccccaggcctccccgggcctgctggccccaagggtgctaaaggggcgacaggacccgggggccctaagggagagaagggagtgcaaggacctcccggccatcccggtccgcctggggaagtaattcagccacttcctattcagatgcctaagaaaacaaggaggtcagtcgatggcagtcgactgatgcaggaggatgaagccatcccaacagggggagctcctggctctcccggcggactcgaagaaatattcggcagcctcgattccctgcgtgaagagattgagcagatgcggagacctactggaacacaggattcccctgcccgcacgtgccaggaccttaaactgtgtcaccccgaactgcccgacggggaatactgggtggatcccaaccaggggtgcgctcgcgatgcctttagagtgttctgtaacttcaccgccgggggagagacatgtgtgactccacgcgacgacgtgacccagtttagttacgtcgactctgagggctcccccgtgggggttgtccaactgacttttttgcgtcttttatccgtcagtgcccaccaggacgtgagttacccttgttcaggcgccgccagagacggccccttgcgactgagaggcgcgaacgaggatgaactgtcacccgagacatctccgtacgtgaaagagttcagagacggatgccaaacacaacaggggaggactgtgctcgaggtgcgaactcctgttttggagcagctgcccgtgctggatgcttcctttagcgacttgggcgcgcccccgcggcgcggcggcgtgttgctgggaccagtttgctttatgggatag

SEQ ID NO: 2548 - DNA, 4953 bp, Artificial Sequence
  Description of Artificial Sequence: Synthetic coding sequence
atggagcgatgtagccgatgtcatagacttctactcttattgcccttggtgctgggacttagcgccgcgccgggctgggctggagcacccccagtcgacgtactgagagccctgcgcttccccagcctgcctgacggagtgagacgcgccaaggggatctgccccgcagacgtggcctatagagtcgctcgtccggcgcagcttagcgccccgacacgccagctgtttccaggcggttttccaaaggacttctctctactgaccgtggttagaactaggcccggcttacaggctcctttgttgacactatacagtgcccagggtgttcgccagctaggcttggagcttggccggccggttcgatttctgtacgaggaccaaactggaagacctcagcctccaagccagcctgtgtttaggggcctgagcttagcggacgggaaatggcatcgggtggccgtcgccgtgaaaggacagtctgtgactctgattgtggattgcaagaagcgcgtgacccggccattaccaagatcagccagaccagttttggatacacacggtgtaattatcttcggagcccgtatattagatgaagaggtctttgaaggagatgtgcaggaactcgcaatagttccgggagtgcaagcagcctatgagagctgtgagcagaaggaactcgagtgcgaaggagggcagcgggaacgtcctcagaaccagcagcctcaccgagcccagagatcaccccaacagcagcctagccgacttcaccgcccacagaatcaggagccacaatctcaagatcctaccccaggcgaagaagaagagatcctggaatcttccctcctgcctccactggaggaggccgcccatgggccgcgtggtctcaagggagagaagggagaaccagcagtcctcgaacccggaatgctggtggagggccccccagggccggagggacccgcgggccttatcggccccccgggaatacagggtaacccgggccctgtaggtgacccaggcgaaaggggccccccagggcgcgcaggactgcccggctcagacggcgcgccgggtccacccggcaccagtctgatgctcccttttcgctttgggagtggtgggggggacaaagggcctgtggtggccgctcaggaagcccaggcccaggctatcctgcagcaggccagactggctcttagggggccccccgggcccatggggtataccgggcgaccaggcccactgggacagcccggctcgcctggattgaagggcgaaagcggcgatctcgggcctcaggggccgagaggaccccagggactcacggggccgcccggcaaagcagggcgtaggggccgggcaggggcggacggcgctaggggtatgcccggcgacccaggagtaaaaggagatcgcggattcgatggtttgcctgggctgcccggggagaagggtcacaggggggataccggtgcccaagggctgcccggaccgccaggggaggacggggaacgcggtgacgacggcgagattggaccgaggggcttgccaggcgaatccggaccaagaggcctgttgggaccgaagggcccacccgggatcccaggaccccccggagtgcgcggaatggacggcccacagggaccgaagggcagcttaggcccgcagggggagcccggtcctcccggacagcaggggacccccggcacgcagggactccctggtcctcagggtgcaatcggaccacacggggagaaaggtccccagggaaagcccgggctgcccggcatgcccggctccgatggcccaccgggccatcctggcaaagaaggtccaccaggcactaaaggaaatcagggaccatccgggccccagggccctctgggctaccctggtccccgaggcgtgaaaggagttgacggcatccggggcttaaaagggcacaagggagagaagggggaggatggcttcccaggtttcaaaggggacatcggcgtcaagggtgaccggggcgaagtgggagtcccagggagtagaggcgaggatggccccgaaggacctaaaggcaggactggacccaccggagatcctggccctcccggactcatgggcgaaaagggcaagctaggcgtccccggcttacccggctatcccggcaggcagggccctaagggctccctcggctttcccggctttcccggcgctagcggagagaagggggccaggggtctgtctggaaaatccggtccacgcggggaacgaggccccacaggtcctcgaggacaaaggggtccccgtggcgctaccggcaaatctggagcgaaaggcacctccggcggagacggacctcatggacctcccggtgagcgcgggctccccggacctcagggcccaaacgggttccccggaccgaagggtcccctaggaccaccaggcaaggatgggctgccaggacacccggggcagaggggggaagtgggatttcagggcaaaaccggccctccaggcccccctggagtggtcggaccacagggggccgctggtgagaccggaccaatgggggaacggggacaccccggaccccccggcccccctggggagcagggtttgcctggcactgctggtaaagaagggactaagggggaccctggccccccgggagcccctggaaaggatgggcctgccggcctccgggggtttcccggcgagagaggtttgccaggcactgcaggcggccctggactgaaggggaatgagggcccctccgggccccctggcccagctgggagccccggggaacgcggcgccgccggaagcggcggcccaatcggccctcccggccggcccggcccccaggggccaccaggcgcggcaggcgagaagggcgtccctggcgagaagggcccgataggcccaaccggtcgggacggagtccaaggccccgtaggactgcccggtcctgcaggtccacctggtgtcgccggggaggatggcgataagggcgaagtgggagatcccgggcaaaaagggaccaaaggaaacaaaggtgagcatgggccacccggcccccctgggcccatcggcccagtaggccaacccggtgccgccggcgccgatggggaacctggcgcacgggggcctcagggtcatttcggcgccaaaggcgacgagggaacacgcggttttaatggtccacctggccccatcggtctgcagggactcccgggcccatccggggaaaagggtgagacaggtgacgtgggaccaatgggaccaccagggccccccggcccacgaggcccagccggccctaacggggccgacggaccccagggcccccctggcggtgtggggaacctaggacctccgggagaaaaaggagaaccaggcgagtccggaagtcctggcattcaaggagaaccaggcgtgaagggcccgcgcggcgagcgtggagagaaaggggaaagcgggcagcccggagaaccaggacctccgggaccaaagggccctaccggagacgacggccctaaaggcaaccctggacctgtagggttcccgggtgatccggggccccccggagaaggaggaccccgggggcaggacggagcaaagggagaccgcggcgaggatggtgaacccgggcaacctgggagcccaggacctaccggtgagaacggtcctcccggccccttgggaaagcgcgggccggcaggatcacccggcagcgagggccggcagggcggtaaaggcgccaagggagacccaggagctatcggagccccagggaagacaggcccagtaggccccgccggaccggcagggaagccagggccagatggcctgcgaggcctgcctggctctgtgggccagcagggccgccctggtgccacgggacaagccggcccccctggtcctgtgggccccccagggctgcctggtttgcggggcgacgctggagcgaagggggagaagggccatcctgggctcattggcctgattggcccacccggcgagcagggggagaaaggcgatcgaggacttccgggaccacaaggctcaccagggcaaaagggggagatgggcatccctggtgcctccgggccaattggtcccggaggtcctccagggttgcctggccctgccggacccaagggcgccaaaggcgccactggtcccggaggtcccaaaggcgagaaaggcgtacaggggccccccgggcaccctggcccacctggagaggtcattcagccccttcccatccagatgccaaagaagactcgtcgatcagttgatggaagcagactcatgcaagaagatgaggcaattccaacaggcggtgcccccggctccccgggcggactcgaagaaatctttgggagcctcgattccttacgcgaagaaatcgagcagatgcgacgtccaacaggaacccaagactcgccagcccgcacttgccaggatcttaagctgtgccacccagagctaccagatggagagtattgggtagatcctaaccaagggtgcgcacgggacgcctttagggtgttttgcaacttcaccgctgggggagagacatgcgtaacacctcgcgacgacgtgacccagttttcttatgttgactctgaggggtccccggtgggcgtcgtgcagttaacctttctgcgcctgctgtccgtcagcgctcaccaggatgtaagctatccatgctctggggcagcgcgggatgggcccttaagactcagaggagctaatgaggacgagctgagccctgagaccagcccttatgtgaaggaatttagggatggttgtcagacccagcagggcaggacagtactggaggtgcgcacacctgtgctggagcagctgccagtgctggacgcaagtttcagcgatctcggcgcacccccacgtcggggaggagtcctgcttggccctgtgtgtttcatgggctag

SEQ ID NO: 2549 - DNA, 873 bp, Artificial Sequence
  Description of Artificial Sequence: Synthetic coding sequence
atggaaagatgctcccgctgtcacaggctgctgctgctcctccctctggtgttaggcctcagcgccgcaccaggatgggccggcgcccctcctgtggacgtgcttagagcattgaggtttccatctctgccagacggcgtaagacgcgcaaagggaatttgtcccgccgacgttgcttaccgcgtggctcgacccgcacagctctctgctccaactaggcagctttttccaggaggcttccctaaagactttagtttgttgactgtggtcagaactagacccggtttgcaggctcctttactgactctttatagcgctcaaggggtgcgccagctgggactggaactaggtcgtcctgtgcgtttcctgtatgaggatcagacagggcggccacaaccacctagtcagcccgtattcagagggctttccctcgccgatggcaagtggcaccgtgttgcggtggccgtgaaaggccaaagcgtaactcttattgtcgattgcaaaaagagggtcacccgtcctctgcccaggagtgcgcggccagtccttgacacgcacggggtaatcatctttggagccagaattttggatgaggaagttttcgaaggagatgttcaggagctggccattgtacctggcgtgcaggccgcatatgaatcatgtgagcagaaagagctggaatgtgaggggggccagagggaaagaccacagaatcagcagccccatcgtgcacagcgcagcccgcagcagcagccttcacggttgcaccgaccgcagaaccaggagccacagtcccaggtgcgggagctgggcgagccaccttccgccgcgcatcccagagaagggcgtcaccctggcatctcacccccctag

SEQ ID NO: 2550 - DNA, 4953 bp, Artificial Sequence
  Description of Artificial Sequence: Synthetic coding sequence
atggaacgctgttccagatgtcatagactccttttgctgttgccattggtcctggggctttccgctgccccggggtgggcaggagctcctcccgtggatgtccttcgggctctccgatttccatccttaccagatggggtcaggagggccaagggcatttgtcctgccgacgtggcgtacagagttgctcgccctgcccagctgagtgctccaaccagacagctatttccgggggggttccctaaagacttcagcctactgaccgtcgtacgtactcgtcccgggcttcaggcaccactgctaaccctctattccgcgcagggtgtgcgtcagcttgggttagagctggggaggccggtacgtttcctatacgaggaccagaccggaaggcctcaacccccgagtcagcctgtctttagggggttatccctggctgacgggaaatggcatagagtagcggtagccgtcaaaggtcagagtgtgactctcatcgtggattgcaagaaacgggtgacacgtccgcttccaaggagcgcgcggccagtgctcgacacacacggcgtgatcatattcggagctcgcatcttggacgaagaggtgttcgaaggtgatgtccaggaactggccatagtccccggcgtacaggcagcttacgagtcttgcgaacagaaagagttggagtgcgaaggcgggcaacgcgaacgtccccagaaccagcagccacaccgggcccagcggagcccgcagcagcaaccttcacgactgcatcgaccgcaaaatcaagagccgcagtcccaggatcctactccaggagaggaggaagaaatactggaaagcagtcttctgccaccactggaggaggccgcacacgggccgcgggggctgaaaggcgagaaaggggagcctgctgtgctggagcccggaatgcttgtggaagggccacccggccccgagggccctgcgggcctgatcggtccccctggcatccagggaaacccaggtccggttggcgaccctggagaacgcggaccgcccggcagagccggcttaccaggttctgacggcgcaccggggcccccagggacatcgctgatgctacctttcagatttgggtcagggggaggggataaaggtccagtggttgccgcgcaggaggcacaggcccaggctatactgcagcaggccagattagccctcaggggccctcctggaccaatgggctacaccggtcggccagggcctctgggacaaccaggctcccctggccttaagggggaaagtggcgacctcggaccccagggacccaggggcccccagggtctcacgggtcccccaggcaaggccgggcggagaggtcgggctggagctgacggtgcccggggaatgcccggcgatccaggagtgaaaggtgaccggggcttcgatggactcccagggctgccaggggaaaagggccatcggggagatacaggagctcaaggcttgcctgggccccccggtgaggacggtgagagaggagacgacggggagatcggccctcgaggattgcctggcgaatccgggcccagaggtcttctcggacccaaggggcccccaggtatccctggcccgcctggagttaggggcatggacggcccgcaaggccctaagggctcacttgggccccagggtgagcctgggcctcctgggcaacagggcacaccagggacacagggcctgccggggcctcaaggagcaattggtccacacggtgaaaagggcccccagggtaaacccggtctgccgggcatgccgggtagcgacggcccccccggccaccccggtaaagaggggccccccggcacaaagggaaatcagggacccagcggcccccaagggcccctgggctaccccgggcctcgcggggttaaaggagtggacggaatccgggggctcaaaggccataagggcgagaaaggcgaggatggattccccggtttcaagggagatatcggagtcaaaggggatcgtggtgaggtgggggtgcccggatcacgcggcgaagacgggccggaaggacctaagggcaggaccggacctactggcgatcccggacctcccggactgatgggtgaaaaaggcaagttaggggttccagggcttccaggttaccccggcaggcagggccccaaaggctccctcggttttcccggcttcccaggagccagcggcgagaagggggccaggggcctgagcggcaaaagcggtcccagaggggaacgaggacccactggtcctcgcggccaacgcggcccaagaggagctacagggaaatccggcgccaaggggaccagcggcggggatggtccccacggaccacccggcgaaagagggttgcccgggccgcaggggcccaacggcttccctggccccaagggaccccctggcccacctgggaaggacgggctgcctggtcatcctggccagaggggtgaggttggcttccagggcaagaccgggcccccagggccaccaggagtggtgggtccacagggcgctgccggggagaccggacccatgggggaacgcggtcacccaggaccgcccgggcctccaggggagcagggactcccaggcaccgcaggaaaggaggggaccaaaggcgaccctggtccgcccggtgctcccggcaaggacggaccagcaggactgaggggcttccccggagagaggggcctgcctggaaccgcaggtggcccaggactgaaaggaaacgagggaccctctgggccccccggccctgccgggagccccggcgagcgaggagctgccggctccggcggacctattgggcctccgggccgccccgggccacagggccccccgggcgccgccggggagaaaggagtgcccggggagaagggcccaatcgggccaaccggcagggacggggtgcagggaccggtgggactgccaggaccagccggaccgccaggggtagcgggggaggatggagacaaaggcgaggtgggggaccccggccaaaagggcactaaggggaacaaaggtgaacacggacctccagggcctcctggcccgattggccccgtgggccaacccggtgctgctggggccgatggagagcccggtgcgcgagggccccaggggcactttggcgctaagggtgacgagggtactagaggattcaatgggcccccagggcccataggcctgcaaggattgcccggcccctcgggcgaaaagggcgagacgggagatgtcgggccaatgggcccacccggccctcccggacctcgggggcccgccggtccgaacggcgcagacggtccgcagggacccccaggaggcgtggggaacctcgggcctccaggagaaaagggggagcctggtgagagcggcagtcccggcatacagggagagcctggggtaaaaggccccagaggcgagcgcggcgagaaaggcgaatctggacaaccaggggagcccggcccacccggtccaaaaggcccaaccggagacgatgggcccaagggaaaccctggcccagtgggcttccccggggaccctggtccacctggcgagggcgggccacgggggcaagacggggccaagggggaccggggcgaggacggcgaaccggggcagcccgggtctcctggtcctacgggcgagaatggtcctcctgggccattaggaaaacgaggccctgctggctcacctgggagcgaagggaggcagggagggaagggggcaaaaggggaccccggagcaatcggtgccccaggtaaaacgggcccagtcgggccagcgggccctgccggcaagcccggccctgacgggctgcgtggcctgcccggaagtgtgggtcagcaaggccgtccaggagctacaggccaagcaggacccccgggtccagtgggtccaccaggattgccgggactgaggggagacgcgggtgcgaagggagagaaggggcacccagggttaatcggactgattggtcctcccggtgagcaaggagagaagggagacaggggactgcccggccctcagggttccccaggtcagaaaggagaaatgggcattccaggggcatcaggacctatcggcccgggaggcccgcctggtctcccgggtcctgccggtcccaagggcgccaaaggcgccaccggtcctggcggaccaaagggagaaaaaggggtgcaggggccacccgggcaccctggtcctcctggcgaggtcattcagccccttccgattcagatgcccaagaagactaggagatcagtagacggcagccggctgatgcaggaggacgaggctattcccactggcggagcaccaggcagccccggtggactggaggaaatttttggatcacttgactctctgcgagaggagatcgaacaaatgagaaggccaacaggcacccaggactccccggctcgcacctgtcaggacctcaagctgtgtcaccctgaacttcccgatggtgagtactgggtggatcccaatcaagggtgcgcaagggacgctttccgggtgttttgtaacttcacggcgggaggcgagacatgtgtgactcccagagacgatgtgacacagttctcctacgtagactctgaaggatctcctgtgggcgtggtccagttgacttttctacggctgctgagcgtaagcgcccaccaggatgtctcttatccctgttccggcgctgccagagatggacccctaaggcttcgcggcgctaacgaggatgaacttagccccgaaacgagtccctatgtaaaggagtttcgggatggctgtcagacccagcagggtagaaccgtgctggaagtgaggactcctgtactcgagcagttgccggttctggacgccagcttttccgatttaggcgcccctccacgtcgaggcggtgttttgctgggcccggtctgcttcatgggatag

SEQ ID NO: 2551 - DNA, 873 bp, Artificial Sequence
  Description of Artificial Sequence: Synthetic coding sequence
atggagaggtgctccagatgtcaccggctattgctgttactcccattggtcctaggcctgagcgctgccccaggctgggcgggcgcaccacctgtggacgtgctgcgtgccctcagattccctagtctccccgacggggtgcgtcgcgctaagggcatttgccccgctgatgtggcttaccgcgtcgctaggccagcccagctcagcgccccgacaaggcagctcttccctgggggctttcccaaagacttctccctacttacggtcgtgcggacacgccctgggttgcaggccccactgctcaccttgtactctgctcagggtgttcggcagctgggactcgagctgggacggccagtgcgctttttatacgaggaccagacgggcaggcctcagcctcctagtcagcccgtttttaggggcctgtccctggcagacggtaagtggcaccgcgtggctgtggccgtgaagggccagtccgttaccttaatcgtggactgtaagaaacgagtgacacgtcccttaccacgttcagccaggccggtcctggacacacacggtgttattatcttcggtgcacgcatcttggatgaagaggtgtttgaaggggatgtccaagagctggccatcgttcctggagtgcaggccgcatatgagagttgcgaacagaaagaactggaatgtgagggggggcaacgagaaaggccccaaaaccagcagccgcatcgggcacagcggagcccccagcaacagccgtctaggctccatagaccacaaaatcaggaacctcagtcccaagtccgagaactgggcgaaccgccatctgcagcccaccctcgcgagggacgccatccaggcattagtccaccctag

SEQ ID NO: 2552 - DNA, 921 bp, Artificial Sequence
  Description of Artificial Sequence: Synthetic coding sequence
atggattggcgagcgtctgaggcatggatggtgccacgggcccctaagggcgcttgggatccaagagaatctcaggatcttctggacaacagagcaccacttggaccacgagtctttcccgggccacgcgtcccgtccgctcttatggagcgtcgagtcctgaaagggtctcagggatctccggcctgtccaggtccacctggggaagtgatccagcctctgccaattcagatgccaaaaaaaacaagacgatcggtagacggttccaggctcatgcaggaggacgaagcgatccctaccggaggtgcgcccggctctcctggcggactcgaagagatattcggaagcctagatagtctgagagaggagatcgaacagatgagaagacctactggtactcaggactctcctgcgaggacctgccaggatttaaaattatgtcatcctgagctgccagatggggaatactgggtggatcctaaccagggatgcgcgcgcgatgcattccgggttttttgtaacttcaccgctggtggggagacctgcgtcactccgcgggatgatgtgactcaattctcatacgtggactccgagggaagccctgtgggggtggtgcagcttactttccttcggctgctgtccgtgtcagctcaccaggacgtgagctacccgtgctcaggcgctgcacgagatgggcctctacgactgaggggtgccaacgaggacgagttgtctcctgaaacttccccctatgtgaaggagttccgcgatgggtgccagacccagcaaggaagaacagtgcttgaagtccggacccctgttcttgaacagcttcctgtgctcgatgccagcttctcagatctgggggccccaccacgacgcggcggggtgctgttggggcccgtctgctttatgggttag
